United States Patent 8,999,380 (MODIFIED POLYNUCLEOTIDES FOR THE PRODUCTION OF BIOLOGICS AND PROTEINS ASSOCIATED WITH HUMAN DISEASE) - sequence listing, part 4

SEQ ID NO: 4818 - RNA, 3777 nt, Artificial Sequence
  Description of Artificial Sequence: Synthetic coding sequence
augccugagcaggaacgacagauuaccgcuagagagggcgcuuccagaaagauccuaaguaagcuaucucugcccaccagggccugggagccugccaugaagaagucguuugccuucgauaaugucgguuacgaaggagggcucgauggccugggcccuagcucgcagguggccacuagcacuguccgcauucucgggaugaccugccagaguugcgucaaaucaauugaagacaggauuucaaauuugaaaggcaucauaaguaugaaaguaagccucgaacagggcagcgcuacagugaaguaugugccaucugucgugugucuacagcaggugugucaucagauuggagauaugggguucgaagccagcauugcagaggguaaagcugcaucauggcccagcaggagccugccagcgcaagaggccguuguaaaguuacgcguggaagggaugacgugucagucuugugugaguucuaucgaaggcaaagugcggaaacugcagggaguugugagagugaaagucuccuuauccaaccaggaggcaguuauuacauaccagcccuaucugauucaaccugaagaccugagggaccacgugaacgacaugggcuucgaggcagccauuaaaagcaaggucgccccacugagucuugggccaauagacaucgaaagacuccaaagcacaaauccaaaacggccgcucucuuccgcaaaucagaacuucaauaacucggaaacccugggccaccagggaagccaugugguuacuuugcagcuccggauugacgguaugcacuguaagagcugcgugcugaacauugaggaaaauaucggacagcuguuaggggugcaaucaauucaggugaguuuggaaaauaagacagcccaggucaaguaugacccuaguuguacaucuccuguggcucugcagagggcuaucgaagcguugccaccagggaacuuuaagguuucauuacccgauggagcagaagguucugguaccgaucauagaucauccagcucacauucucccggaagcccaccucggaaccagguccagggcacuuguagcaccacccuuauagccauugccgguaugacuugcgcuaguuguguucauaguauugaggggaugaucucccagcucgaggggguucagcagauuucugugucucuugcagaagguacagcaacaguacuguauaacccuucugugaucuccccugaggagcugcgggccgccaucgaagacauggguuucgaggcuagcgucguaucugaaagcugcuccaccaauccccugggcaaucacucggcaggaaacaguauggugcaaacaaccgaugggacacccacaagcguacaggaaguggcuccucacaccggccgacugccugccaaccacgcaccagauauuuuggccaagucaccacaguccacucgagcugucgccccacagaagugcuucuuacagauuaaggguaugaccugcgccucaugcguuucgaacauugagagaaaccuucagaaagaagcaggagugcugagcguccuagucgcacuuauggccgguaaggcugaaauuaaguaugaucccgaggugauccaaccucuggaaauugcccaguucauccaggauuuaggauucgaagcggcugugauggaggacuaugccgguagugacgggaacauugaacugacuauuaccgggaugacaugugcaagcugugugcacaacaucgagaguaagcugacccgaaccaauggaauaacuuacgcuagcguggcacuugcuaccuccaaggcucuggucaaguucgaccccgagauuauugggccgcgagacauuauuaaaauuauugagucaaagacaucggaagcccuggcaaagcuuaugucucuccaggcuacagaggcuacugugguuacucugggagaagauaaucucaucaucagagaagagcaaguacccauggagcuggugcaacgaggugacauagucaagguagugcccggggggaaauuucccgucgacggaaaaguguuggaagguaauacuauggcagaugagucucugauaacaggggaagcuaugccgguaacuaagaaaccugguagcacuguuauagcuggaagcaucaacgcccacggcaguguacuuaucaaggcuacccauguggguaacgacacaacucucgcucagauugugaagcugguggaagaggcucaaaugucuaaaaaucccaauaaacauauuucacaaacagaagugaucauccgguucgcuuuccaaaccuccaucacuguguugugcauugccugcccgugcagucuaggcuuagcaacccccaccgccgucaugguuggaaccggaguggcagcccagaauggcauccuaauuaagggcggaaagccucucgaaauggcacauaaaauaaagacugugauguuugacaaaacaggaacaauuacucacggggugcccagagugaugagaguacuccuccucggggacgucgcuacucucccacugcgaaaggucuuggccguuguggggacagccgaggccucgucagagcacccucugggcguugccguuaccaaauauugcaaggaggaacucgguacagaaacucucggguauugcacugacuuucaagccgugccugggugcgggauugggugcaaagugucaaauguugaagggauacucgcccauucggagagaccguuaucugcccccgcuagccaucugaaugaggcaggaucccucccugccgagaaggaugccgugccccagacauucaguguucucauagguaaucgggagugguugagaagaaacggacugacaaucuccagcgacguuagugaugcaaugacagaucacgaaaugaaaggucaaaccgcaauuuuggucgcgaucgauggcguccugugcggaaugauugccaucgcggaugcggugaagcaggaggcagccuuggccguacauacgcuccaaucgaugggaguugacgucguguugaucacuggugauaacagaaagaccgcgagagcuaucgcuacccagguggguaucaauaaggucuucgcggagguccugcccucacauaagguugcuaaaguucaggagcuccaaaacaagggcaaaaagguggcuaugguuggggacggcgucaaugacaguccggcgcuggcgcaggccgacauggggguggcuaucgggacagguaccgacguugcaauugaagcagcugacguggugcucaucagaaacgauuugcucgacgucguggcgucgauucaucugucaaagcgaaccgucagaaggauacggauaaaucucguccuggcccuuauauauaaccuggugggcauucccaucgccgcagggguauuuaugcccauaggcauuguucuacaaccauggauggggucugcugcaauggcugcguccaguguguccgugguuuugaguagccugcaacuuaaauguuacaaaaagccagaucucgagcgguacgaggcgcaggcacacggucauaugaaaccgcugaccgcuagccaggugagcguccauauugguauggaugauagauggagagacuccccccgcgcuacuccgugggaucaggugucuuacgugucucaagugucacugucuagccugacaucugauaagccuagcagacauucagcagccgcggaugacgacggcgacaaauggucccuucuucucaacggacgugaugaggagcaguacauuuag

SEQ ID NO: 4819 - RNA, 4065 nt, Artificial Sequence
  Description of Artificial Sequence: Synthetic coding sequence
augccagaacaggaaagacaaauuacagcaagggaaggcgcgucacgcaaaauccucagcaagcuuagucuuccaacucgcgcaugggaaccugcuaugaaaaagucuuuugcauucgacaauguggguuacgaggguggguuagacggacugggcccuuccucccagguggcaacaaguacaguacgaauccucggcaugaccugucagucuugugugaagucuauugaagaccgcauuuccaaccugaaggggauuauuagcaugaaagugagccuagagcaagggucggccaccgucaaguaugugccaagcgugguaugccuucagcaggugugucaucagauuggagacaugggauuugaagccucuaucgccgaaggcaaggccgccaguuggccuagucgaagccuaccugcgcaggaggcuguggugaagcugaggguugaaggaaugacaugucagucaugugucagcucuaucgaagggaaggugagaaaacuucagggagugguccgggugaaggugucgcugaguaaccaggaggccguaauuacauaccagccauaccugauccagcccgaagaccugcgagaucacguuaacgacaugggguucgaggcugccauuaagucaaaaguggccccacuaucccuuggacccauugauaucgagcgccuccaguccaccaauccaaaacggccccugaguuccgccaaccagaauuuuaauaacuccgaaacccuuggacaccaaggaagucauguugugacccugcagcugcgaaucgauggcaugcauugcaugauaucacaguuggaagggguucagcagaucucugugucucucgccgaagggacugcaacggucuuauacaauccgucagucauuucuccagaggaauugagagcugcaaucgaagauaugggguuugaagcaagcguggucucagaaucuuguucaacuaacccccugggaaaucauagcgcaggcaacagcaugguccaaacaacugacgggacccccaccucaguccaggaaguugcuccacacaccggcagguugccagccaaucacgccccagauauuuuggcaaaaaguccgcagagcacccgagcugucgccccacaaaaguguuucuugcagauaaaggggaugacuugcgccucuugcgugagcaacauagaaaggaacuugcaaaaggaagccgguguccuaucagugcucguggcgcugauggccggcaaagccgaaaucaaguacgaccccgaggucauacagccgcuggagauugcccaauucauccaagaccucggcuuugaagcggcugugauggaggacuaugcagguagcgacgggaacaucgagcuuacgauuaccggcaugacaugcgccucaugugugcacaacauugaguccaaauugacaaggacaaacggaauuacauacgcaucuguagccuuggcaacuucuaaagcacugguuaaguuugaccccgagauaauuggaccuagggacauuaucaagaucaucgaagagaucggauuccacgccucauuggcacaacgcaaucccaacgcacaccauuuggaccacaaaauggagaucaagcaguggaaaaagaguuuucuguguagccuugucuucggaauuccagugauggcccuuaugauauauaugcugauuccgaguaacgaaccgcaccagagcauggucuuggaucacaacaucaucccuggacugucaauccugaacuugauauuuuucauccugugcacuuucguccaguugcuuggcgggugguauuucuauguucaagcuuauaagucccuacgccaccggucggcuaauauggacgucuugaucguccucgcuacuaguaucgcauauguguacucucuggugauacuggugguagcagucgcagaaaaggcugagagaagcccagugacauuuuuugauacucccccaaugcuauuuguguuuaucgcauuaggacggugguuagagcaucuagcuaaguccaaaaccucagaggccuuagccaaacucaugucccugcaagcuacagaagcuaccguagugacgcugggagaagauaaucucauaaucagggaggaacaggugcccauggagcuaguucagaggggagacauugucaaaguggugccgggagggaaguuccccguggauggcaaaguucucgaggguaauacuauggcugacgaaucucuaauuacuggcgaagccaugcccgugaccaagaagccugguucuaccgugauugccggaucgauuaacgcccacgggucaguccugaucaaggcgacccauguuggaaacgauacaacgcucgcccagaucgucaagcugguugaagaggcccaaaugucuaaagcaccuauucagcagcuggcagauagauucaguggauauuuugugccuuucaucaucauaaugucaacauuaacccugguuguuuggauagucauuggcuuuaucgauuuuggggugguacagcgcuacuuucccaaccccaauaaacauauuucucagacggaagugauaaucagauuugcauuccagacuagcauuacaguucuguguaucgcuugcccguguucccuagggcucgcaacucccaccgcuguuauggugggcacgggaguagccgcccagaauggcauucugaucaaaggagggaaaccacuugagauggcacacaagaucaaaacaguaauguuugacaaaacaggaacuauaacucauggcguuccacgggugaugcgggugcuguugcuuggggaugucgccacguugccucucaggaaagugcuagcugucgucgggacagccgaagcgucaagugagcacccacugggaguggcgguuacuaaauacugcaaagaagagcuugggacagagacccugggcuacuguacugacuuucaagcugugccuggaugugggauuggcuguaaagugaguaacguggaagggauacuggcccacagcgagcguccccugagugcaccagcuucccacuugaaugaggcagggucacuccccgcagaaaaagaugccguuccccagaccuucucagugcugaucgggaacagagaauggcugaggagaaauggucucacuaucagcagcgacgugucugacgccaugacggaucaugaaaugaaggggcaaacagccauccuuguagcgauugacggaguguuauguggcaugauugcgaucgcugacgcuguaaaacaagaggcagcacuagccguacacacccugcaaagcauggggguggaugucguucucaucacaggagauaaccggaagacugcccgugcuaucgccacucaagucgggauuaacaagguuuuugcagaaguguugcccucacauaagguugcgaaagugcaggaacuucagaauaagggcaagaagguggccaugguaggagacgggguuaaugacuccccagcacuggcacaggccgauauggggguugcuaucgggacuggcacggauguagccaucgaagcagcagauguuguguugauucgcaacgaccugcuggacgugguggccaguauucaccugucuaagaggaccgugagacggauccgaauuaauuugguguuagcccugaucuauaaucugguaggaauucccaucgcugcaggcguguucaugccaauuggaaucgugcuacaaccuuggaugggguccgcagcaauggcagcuaguuccguuucagugguuuugaguucucuucagcugaaauguuauaagaaacccgaccuggagcgcuacgaagcccaggcucaugggcauaugaagccccugacugcuucucaggugucaguacacauaggcauggaugaccgauggcgagauagcccaagagcuacccccugggaucaggucuccuacgugucccaaguaucucucaguucacuuacuucagacaaaccaagcaggcacagugcagcggccgacgaugacggcgacaaguggucccuguuacucaacggccgcgaugaggagcaauacauuuag

SEQ ID NO: 4820 - RNA, 3108 nt, Artificial Sequence
  Description of Artificial Sequence: Synthetic coding sequence
augccugaacaggaaagacaaauuacugccagagaaggggccucccggaaaauccugagcaaacuuagccugccaaccagagcaugggaaccugcuaugaagaaaaguuucgccuuugacaacguuggauacgagggaggauuggauggcuuaggcccauccucucaaguagcaaccuccacuguccggauccuuggaaugacaugucagucaugcgugaaaucuauugaggaccguauauccaaucugaaaggcaucaucaguaugaaggugucacuggagcaggggucggcgacuguuaaauacguuccuuccguggucugucuccagcaggucugucaccagauuggugacaugggauucgaagcuagcauugccgagggaaaagccgccucauggccaagccggagccuaccugcccaggaagccguugugaagcuuagaguagaaggcaugacaugucagucgugcgugucauccauugaagggaaagucagaaaacugcaaggggucgugcgggugaaagugucccuuuccaaucaagaggcagugauuaccuaucagccguaucugauccagccagaggaucucagagaccacgugaacgauaugggauuugaggcugccauaaaauccaagguagccccuuugagucuuggacccaucgauauugagcgccugcagucaacuaauccuaagcgcccuuugagcagcgccaaccaaaacuucaauaauucugaaacuuuaggacaucaagguagccaugucguaacucuucagcuccgcaucgauggcaugcacugcaaaaguugcguguugaacauugaagagaauauagggcaguugcugggggugcagaguauucaggugucacuggagaacaaaaccgcacaagugaaauacgacccaucaugcacaucacccguggcucugcagcgcgcaauagaagcccugccaccuggcaacuucaaggugucccucccagacggugccgaaggauccggaacagaucaccgaucaaguuccagccacucuccugggagcccgccaagaaaccaggugcaaggaacuugcucaaccacacuuaucgccauagcaggcaugacgugcgcaagcugcgugcauaguauugagggcaugauaagucaguuggagggcguucagcagaucucagugagccuugccgaaggaaccgccacgguccuuuacaacccaagcguuaucagccccgaagagcugcgggccgccaucgaggacaugggguucgaggcaucuguugugaguggagaggcaaugccuguaaccaaaaagccugggucuaccgucaucgcggggucaaucaaugcucacgggucagugcucaucaaggcuacccacguugggaacgauaccacccuugcacagauugugaaguuaguagaagaggcacagaugagcaaagcgccuauucagcagcucgccgacagauucucaggauacuucgucccauucaucauaauuauguccacuuugacacuggucguuuggaucguuaucggguuuaucgauuucggcguagugcagagguacuuuccuaacccuaacaagcauauuucacagaccgaagucauuauucgguucgccuuucaaacuucaauaacuguauuaugcaucgccugcccgugcagucucggccuggccacccccacugcugugaugguagggaccgguguugcugcccagaaugguauacucaucaaagggggcaaaccacucgagauggcgcacaaaaucaagacugugauguucgauaaaacagggacaaucacucauggcgugccaagaguaaugcgagugcuucuguugggugacguggcuacccuuccccucaggaaaguccucgcugugguaggaacugccgaggcaucaagugaacauccucucggcgucgcagugacgaaguacuguaaagaagaacuggguaccgagacccucggcuacugcacagacuuucaggccgugcccggcugcgggaucggguguaaggugucaaaugucgagggcaucuuggcccacagcgagcguccacucucugcuccugcuucacaucuuaaugaagccgggucccugccugccgagaaagacgcagugccccagaccuucagcguccugaucggcaaccgcgaauggcuucgucggaauggacugacuaucuccucugacguuucugaugccaugacggaccacgaaaugaagggccaaacggccauccuggucgcuaucgacggagugcugugugggaugauagccauagccgaugcugugaagcaggaagcagcccucgccgugcacacacuccaaucuaugggcguggacguugugcuaaucacaggugacaaccgaaaaacggcaagggccauugcuacacaggucggaauuaacaagguauucgcugagguccucccaagccacaaaguagccaagguucaggagcugcagaauaaagggaagaaaguugccauggucggugacgguguuaaugacucuccagcuuuggcucaggccgacaugggugucgcaauuggaacagguacugauguggccaucgaggccgccgauguuguacuuauaaggaacgaucuccucgacguuguggcauccauccaucucuccaagaggacagugagacguauucgaauaaaccuuguccucgcgcugauuuauaaucugguggguauccccauugcugcugggguguuuaugccuauaggcauaguguugcagcccuggaugggcucugccgcaauggcugccagcagcguaagcguugucuuguccagucuccagcuuaaaugcuauaagaaaccugacuuggaaagguaugaggcccaagcacauggccacaugaaaccacucacugccagccaagucucugugcauauaggaauggaugaccgguggagggacucgccucgagcuacacccugggaucaaguuucauaugucucacaggucagccuuuccuccuugaccucggauaagccuuccaggcacuccgcugcugcugaugaugauggggacaagugguccuugcuucuuaacggcagagaugaggagcaauauauuuag

SEQ ID NO: 4821 - RNA, 2031 nt, Artificial Sequence
  Description of Artificial Sequence: Synthetic coding sequence
auggacgugcuaauaguccuugcuacgucaauugccuauguguacuccuuggugauacuagucguagccguggcggagaaggcagaacguucccccgugacuuucuuugacacgccuccuaugcucuucgucuuuauugcacugggaagauggcucgaacaucuugccaaaucuaaaacgucagaggcccucgcaaagcuuaugagucuacaagcaaccgaggccacagucgugacccuuggcgaagauaaccugauuauuagggaagaacagguaccaauggagcuggugcaacgaggugacauuguuaagguuguacccggggguaaguuuccaguggacggaaaggugcuggaaggaaacacuauggcugaugaaucucucaucacaggcgaagcaaugccagucacaaaaaaacccgggucaacuguuauagcaggaagcaucaaugcucacggcagcgugcucauaaaggccacacacgugggaaacgacacuacccuagcgcagaucguuaagcuggucgaagaggcgcagauguccaaggccccuauucaacagcuggcagauagauuuucaggauacuucgugccuuucauuaucauuaugucgacauugacacucguugucuggauaguaaucggguucaucgacuucggaguaguccaaagauauuucccaaaccccaauaagcauauuagccagaccgaagucaucauccguuucgcauuucagacuaguaucaccgugcucugcauugcuugcccuugcagucuuggcuuggccacacccacugccgugauggucggaaccggaguggcagcccagaaugggauccugaucaagggaggaaaaccuuuggaaauggcacacaaggaacuagguacagaaacccuuggcuacugcacagauuuucaggcugucccuggaugcggcaucggcuguaaagugucaaacgucgagggaauacuggcacacagcgagcggccucuuucggcgccagcuucucaucugaaugaagcugggucacucccugccgaaaaggacgccgucccucagacuuuuucuguccugaucgggaaccgagaguggcugcgacgcaauggguugacuaucagcucagaugugagcgacgcgaugaccgaucacgagaugaaaggucaaacagccauccuggucgcgauagauggagugcuuugcgggaugauugccauugccgaugcgguaaagcaagaagcagcucucgcuguucauacacugcagucuauggguguggauguggugcucaucaccggcgauaaucgaaagacggccagggcaauugcuacacaggugggcaucaauaaagucuucgcagaaguguuaccaagucacaagguugcaaaagugcaggaguuacagaauaaggguaaaaagguugccaugguuggagacggagugaaugauagccccgcccuggcacaggccgauaugggcguugccaucggcacagggacugacguagccauugaagcugcagacgugguacucauccgaaacgacuuacuggacguuguggccuccauacaucucuccaaaaggacgguucgucgaauucgcauaaaccugguacuugcccugaucuacaaccuuguagggaucccaauugccgcaggaguuuucaugccgauuggaaucgugcuacaaccguggaugggauccgccgccauggcugccuccagcguuagcguggucuuaucauccuuacaguugaaaugcuauaaaaagcccgauuuggaaagauaugaagcucaggcucacggacacaugaagccucugacggccucacaggucuccguucacaucggaauggaugaccgguggcgggacucuccccgggcaaccccuugggaccaagugucuuacgucagccaggugagucucaguucgcugacguccgacaaaccuucccgacacucugcugcggcugacgaugacggugauaaguggucucuguuacuuaacgggcgagacgaggaacaguacauuuag

SEQ ID NO: 4822 - RNA, 4203 nt, Artificial Sequence
  Description of Artificial Sequence: Synthetic coding sequence
augccagagcaggagcgucagaucacagcacgcgagggcgcaagccgcaaaauucugagcaagcuaucacuaccgaccagggccugggaacccgcgaugaagaaaaguuucgcauuugacaacguuggcuaugaggggggccuggacggucuuggacccucuucccagguggcgaccucgacggucagaauucuugggaugacgugucagucaugcgugaaaucaaucgaggaccggaucaguaaucucaagggaauaauuuccaugaaagugagucuggagcagggcuccgcgacagugaaguacgucccaagcgucgugugccuucagcaggugugccaucagauuggugauaugggauucgaagccucaaucgccgaaggcaaagcggcgaguuggcccagcagaucgcuuccagcacaggaggcuguggucaagcuccggguugaagggaugaccugucagagcuguguaagcucaauagaaggaaaagugcgaaaacuacagggggucgugagaguaaaggucucguuaaguaaccaagaagcagucauuaccuaccagcccuauuuaauucaaccagaagaccugagagaucacgugaacgacaugggcuuugaagccgcaauuaaaucuaaggucgcaccuuugagucugggcccuaucgauaucgaaagacugcagucuaccaauccgaaaaggccccuuuccagugccaaucagaacuucaauaauagcgaaacccuggggcaucaaggcagucauguggugacguugcagcuacguauugauggaaugcacugcaaaagcugcguccucaacauagaagaaaauaucggccagcugcugggagugcagaguauccaggugagucuggaaaauaagacugcucaggucaaauacgacccaagcuguaccucaccaguugcacugcagcgcgccauagaagcgcucccuccugggaacuucaagguuucauugccagauggcgccgagggcagcggaacugaucaccgaagcuccaguucccauuccccagggaguccacccaggaaucaggugcaaggcacuugcucuaccacacucaucgcuaucgcuggaaugacaugcgcaagcuguguucacucgauugaaggcaugauaucucagcucgagggcguccagcaaauuagugugucccuagcugaagggaccgcuacagugcuuuacaaucccagcguaaucuccccugaggaacugcgcgcagcgauugaggauauggguuuugaagccucuguggugucugaauccugcucaacaaaucccuuaggcaaucacucagcggggaacagcaugguacagacaacagacggaacaccuaccagcgugcaagagguugccccccacacagguagguugcccgccaaccacgcuccagacaucuuagcaaagucuccacaguccacccgugccguugcuccacaaaaauguuucuuacagauuaaaggcaugacaugugcuucuugcgucuccaauauagaacgcaaccugcaaaaggaagccggcguacugucagugcugguggcccuuauggcuggcaaggccgagaucaaauaugacccagagguaauacagccccuugaaauugcucaguuuauucaggaucuuggcuuugaagcugccguuauggaggacuacgcagggagugacggcaauauugaauugaccauuacaggaaugacuugugccuccugugugcacaacaucgaguccaaguuaaccagaaccaauggcauuacauaugcauccgucgcacuggcuacaaguaaggcccucguuaaguucgauccagaaaucaucggaccucgcgacaucaucaagaucaucgaggagaucggguuucaugcuagccucgcccaaagaaaccccaacgcgcaucauuuggaucacaaaauggagaucaaacaauggaaaaaaaguuuuuuauguagccuugucuuugggauccccgugauggcccuaaugauuuacaugcugaucccaucgaacgagccccaucagucuaugguucuggaccacaauauuauccccggccugucgauucucaaccugaucuucuucauucuuugcacauuuguccagcuguuagggggcugguacuucuacgugcaggccuauaaaagccugaggcaccgaucugcaaacauggacguccugauuguccuggcuaccagcauugccuacguguacucucuggugauucucguggucgcuguggcagaaaaagcagagcgcaguccggucaccuuuuuugacaccccccccauguuauucgucuuuaucgcauugggacgaugguuagagcaucuggccaagucuaagacaagcgaggcauuggccaagcucaugucucugcaagcuacggaagcaaccguggucacucuaggcgaagacaaccugaucauacgggaggaacaggugccuauggagcugguucagagaggugauauugucaagguugucccaggaggaaaauuuccaguugacgggaaagugcuggagggaaacacaauggccgacgagucccugaucacaggggaagcaaugcccgugacuaagaaaccgggcucuacagucaucgccggcucaauaaacgcccacggcucuguucugauaaaagcaacccacguuggaaaugauacuacacucgcacagaucguuaagcuggucgaagaggcgcagaugucuaaggcaccaauucaacaacucgcugaccgauuuagcgguuacuucguuccuuuuaucaucaucauguccacacuuacuuuggucguguggaucgucauugguuucaucgauuucggcgugguccaacgcuacuuccccaucaaaacggugauguuugacaagaccggaaccaucacccauggaguuccccgugugaugagaguccuccuacuuggagauguggccacucuuccuuuacgaaaaguguuagccguaguggggacugcagaggcaagcagcgagcacccucugggcguagccgugaccaaguacugcaaggaagagcuagggaccgaaacacugggguauuguaccgacuuucaagccgugccaggaugugggauuggcuguaaggucaguaacgucgaaggcaucuuagcucacagugagcguccccucucagcccccgccagucacuuaaacgaagcuggcucccuucccgcugaaaaagaugcgguuccacagacauuuagcgugcucaucgggaacagagaauggcuccguagaaacggucucacgaucaguagcgaugucagugacgcgaugaccgaucacgaaaugaaaggccagacggcuauucucguggccaucgacgguguccuuugcggaaugaucgcuaucgcagacgccgugaagcaggaagcugcccuggcuguucacacccuccaguccaugggaguagacguugucuugaucaccggagauaaucggaaaacugcaagggccaucgccacccagguggguaucaacaaaguguuugcugaagugcuuccuucucacaagguggccaaaguucaggagcugcagaacaaggggaagaagguugcaauggugggggacgguguuaaugacucaccagcucucgcccaggcugacaugggcguggccaucgguacuggaaccgauguggcgauugaggcagcugacgugguucucauuaggaaugaucuccuagacgugguggccuccauucaccuuucgaaacggaccgugaggagaauuagaauaaaccuggucuuagccuuaaucuauaaccuuguagggauaccaaucgcugcugguguguucaugcccauugggaucguucugcaaccuuggaugggaagcgcugcaauggcggcgagcuccguauccgugguacuuuccucucugcaacugaaguguuacaagaagccugaucuggaacgguacgaagcucaagcacaugggcacaugaagcccuuaacagccucucaggucagcguucacaucggcauggacgauagguggagggacagcccccgugcuacccccugggaccagguauccuacguaagccagguguccuugucaagccugaccagcgauaagccuucuagacacucugccgccgccgacgacgacggugacaaauggucgcugcuucugaacggccgcgacgaagagcaauacauuuag

SEQ ID NO: 4823 - RNA, 4164 nt, Artificial Sequence
  Description of Artificial Sequence: Synthetic coding sequence
augccggaacaggaaagacaaaucacugcuagggaaggagccagucggaagauccucuccaaacuuucacuacccaccagagcuugggagcccgcgaugaagaaguccuucgcuuucgauaaugucggguacgaggguggacuggaugggcuuggaccaagcucccagguagccacgagcacagugaggauucuugguaugacuugccagagcugcgucaaauccaucgaggaccggauuagcaaccugaagggcaucauuucaaugaaagucucccuggagcaagguagcgccacagugaaguaugugcccuccgucguaugccuucagcagguuugucaucagaucggagacaugggauucgaagcuucaauugcugaagguaaggcagccuccuggccuucacggagcuuaccugcucaagaggccguaguuaagcuucgcguugagggcaugaccugccagucgugcguaaguagcaucgaggggaaaguccggaaguugcaagggguugugcgagugaaaguuagucucuccaaccaagaggccgugauuaccuaccagccuuaucugauucagccagaggauuugcgcgaccacgugaacgauaugggcuucgaagcagcaaucaaaucaaagguggcgccacuaucucugggacccaucgacauagaaaggcuucaaucaacaaacccaaagagaccuuuaucgagugcaaaucagaauuuuaacaacuccgagacacuaggccaccaggggagccauguggugacucuacaauugcggaucgacggcaugcacugcaaaaguuguguguugaauaucgaagagaacaucggccagcugcuuggaguucagucuauucaagugagccucgaaaauaaaacagcccaggucaaauacgauccuucauguacuucacccguagcucuccaaagagcuauugaagcccuuccacccggaaacuuuaaagucucgcugcccgacggggccgaaggcucaggcacggaucacaggaguucuagcagucauucaccggguucuccgccgaggaaucaaguccagggaaccuguucuacgaccuugauugcaauagcuggaaugacgugcgcaucuugcgugcauuccauugaagguaugauuucacagcuggaaggagugcaacaaauaucggugucucucgccgaaggaaccgcuacuguguuguacaauccuagugucaucagccccgaggagcuucgggcugcuauagaagauaugggcuucgaagcuucaguugucuccgagucuugcucgacuaacccccuuggaaaucauuccgccgguaacuccauggugcaaacaaccgacggcaccccaacauccguacaggagguugcaccgcauacugguaggcuuccagcgaaucaugcuccugauauucuugccaagagcccacaguccaccagggccguagcgccccagaagugcuuccuccagaucaaagguaugaccugugcaagcugcguaaguaacauugaacgcaaccuccagaaggaggcgggcguucuguccguguugguugcccugauggcuggcaaagcggaaaucaaguaugaccccgaggucauucagccccuggagaucgcccaguuuauucaagaccugggauucgaggcugccgugauggaggacuacgcagggucagacggaaauauagagcugacgaucaccggcaugaccugugcuuccugcgugcauaauauugagaguaagcucacuagaaccaaugggaucacguaugccagugucgcucuagcaacuaguaaggcccucgucaaguucgacccugagaucaucggacccagagauauuaucaagauaaucgaagaaaucggguuucacgccucuuuggcacagcguaaucccaaugcacaucaccuggaccauaagauggaaauaaagcaguggaagaagaguuuucuaugcucacucguauuuggcaucccugucauggcccugaugauauauaugcugauaccaucuaacgagccccaucaaaguaugguucuugaccacaauaucauaccagggcuaucuauacucaaccuuauuuucuucauacugugcacauuugugcagagcaagacgucggaagcacuugcgaaguugaugagccuacaagcgacagaagcaaccguggugacuuugggagaagauaacuugaucaucagagaggagcaggucccaauggaacuagugcagcggggagacaucguuaagguaguuccgggggguaaauuuccugucgauggcaaagugcucgagggaaacacgauggccgacgagucauuaauaacaggcgaggccaugcccguaacgaagaaaccggggagcacugugaucgcuggcucaauuaaugcgcacgggucaguacuaauuaaagcuacccauguuggaaaugauaccacccucgcgcaaauagugaaacuaguugaggaagcacaaauguccaaggcuccuauccagcagcuggccgacagauucucuggauauuuuguuccauuuaucauaauuaugucaacucuuacucucgugguguggaucgugauuggauucaucgacuuuggaguaguucaacgauacuuuccaaacccgaauaaacauauaucacagaccgaggugauuauacgcuucgcguuucagacauccauuacuguguuguguauagccugcccgugcagucugggacuggccacuccuaccgcagucauggucgguaccggcguugcagcacaaaacgguauacuuauuaagggugguaagccucuugagauggcacacaagauuaaaacgguuauguucgacaaaacaggaacaauuacgcacggcgugccucgaguuaugcggguguuacuguugggagacguggccacacuuccacuucgaaaaguccuugcuguggugggcacagcagaggcgucauccgaacacccuuugggcgucgcugugacaaaauauuguaaggaggaacucggaaccgaaacccuugguuacugcacugauuuucaggccguacccggcugcggaaucgguuguaaaguuucaaacguugagggaauacuagcccauuccgaacgaccgcuuagcgcuccugcgagucacuugaaugaggcugguucucucccagccgagaaggacgcugucccccagacauuuaguguauugauaggcaaccgagaauggcugcgccgaaauggccugacuauaucuucggacguuucggacgcgaugacggaucacgaaaugaaaggccagacugcaauucuuguggccauugauggcguccuguguggcaugaucgccauugccgaugccgucaagcaagaggccgcccuagcugugcacacucugcaaagcaugggcguggacguaguguuaauaaccggcgacaaccggaagaccgcuagagcgauugccacacaggucggcaucaacaagguuuuugcugagguguugcccucccauaaaguugccaaaguccaagagcugcagaacaaggggaaaaagguugcuauggucggggacggggugaaugacuccccggcccuggcacaggccgacauggguguggcgaucggaaccggaacagauguugccaucgaagcagcugacguuguccucauacgcaaugaccuucuugaugugguugccuccauacaucuguccaagaggacagucaggagaauucgcauuaaucuggugcuggcgcugaucuauaacuugguggguauuccaauagcggccggugucuuuaugccaaucggaauugugcuucaaccauggaugggguccgccgcaauggccgcaucuucaguaucugugguccucuccucacugcaguugaaguguuacaaaaagcccgaccucgaaagauaugaggcucaggcccauggccauaugaaaccucucacugccagccagguuagcguucauauugggauggacgacagauggcgggacagcccccgugcuaccccuugggaucaggugagcuacgucucccaggucagccugucaucacugacgucugauaagcccucucgacacuccgccgcugccgaugacgauggugacaaauggucucuacuucugaaugggagagaugaggagcaguacauuuag

SEQ ID NO: 4824 - RNA, 1587 nt, Artificial Sequence
  Description of Artificial Sequence: Synthetic coding sequence
augaagaaaaguuucgcuuuugacaacgucgguuaugaagguggguuggauggcuugggaccguccagccaaguggcgacaucaacagucaggauccuggguaugacaugccagaguugugugaaaaguaucgaggacagaauuucuaacuugaaagggaucauaucuaugaaagucucacuugaacaagguucugcgacggugaaguacgucccaagcguggugugccuccagcaggucugucaucaaauuggagauaugggcuuugaggccucaaucgccgaagggaaggcagccuccuggccaucaagaagcuuaccggcccaggaagccgugguuaaacuaaggguggaggggaugacaugucaaaguuguguguccuccauugaaggaaaagugcgcaaacuucagggaguggugagagugaagguuucguuauccaaucaggaagcugugaucacauaccagccauaccucauccaaccagaggaucugcgggaucaugucaaugacaugggguucgaggcugcuauuaaauccaagguggccccccucagucuggguccuauugauaucgaacggcuccagucuaccaacccuaagaggccacuuuccuccgcaaaucagaauuucaauaauagcgaaacauugggucaccagggaagucacguagugacccuccagcugcggauagauggcaugcauuguaagucuugcguuuugaauauagaagaaaauauuggacaguugcugggaguccagaguauccagguuuccuuggagaacaagaccgcccaagugaaauacgauccaagcugcaccuccccuguggcuuugcagagagcuaucgaagcucuacccccugggaacuucaaagucuccuuaccggauggggcagaagggucagguacagaucaccggucgucguccagucacucaccaggcuccccaccccggaaccaaguacagggaacuugcagcacaacauugaucgcuauugccggaaugaccugugccucguguguucacaguaucgaaggaaugaucucucaguuggagggggugcagcagaucagcguuucucuggcugaggguacugccacuguguuguacaauccguccgugauuucccccgaagaacugcgagccgcaauagaggauaugggcuucgaagccuccgucguuucagaaagcuguuccaccaacccucugggcaaccauuccgccggcaauucaauggugcaaaccacagacgguacgcccacauccgugcaggaaguugcuccucauacugguaggcuuccugccaaccaugcccccgauauccuggccaaaucaccucaguccaccagggccgucgcuccccaaaagugcuucuugcagauuaaaggcaugacgugcgcaucuugcgucaguaauauugaacgaaacuuacaaaaagaagcagcaccccgcuggguugugcuguugcgcucaggucuucagauaucggagacccaggucucacagcaugggagagcccaccgccccggccauaaacacugccuuugucuuuucucgggccauccaggcggcugcugugguuag

SEQ ID NO: 4825 - RNA, 1296 nt, Artificial Sequence
  Description of Artificial Sequence: Synthetic coding sequence
augcaugugcgcucucugcgagccgcugcaccccacagcuuuguggcccucugggcaccucuauuccugcuaagaucagcauuggcggacuuuucccuggacaacgagguccacucgucauuuauucauagacgccugaggucacaggagaggagagagaugcaacgagaaauccucagcauccuaggccuuccucacagaccacggccccaccuucaagguaagcauaacucagcccccauguucaugcucgauuuguacaacgcuauggccguggaagagggaggcgggccgggcggacaaggguucuccuaucccuacaaagccguauucucgacacaaggcccaccccuugccagccuccaggauucccauuuuuuaacagacgcugacauggugaugaguuucgugaauuuagucgagcacgacaaggaguuuuuucacccucgguaucaccaccgcgaguuccguuuugaucugagcaaaauaccugaaggugaagccgugacugcugcugaauuucggauauacaaggacuacauacgagaaagguuugauaaugagacuuuuagaaucagcguauaucaggucuuacaggaacaucugggucgggaaagcgaccuguucuuacuagacucuagaacucucugggcgucagaagaaggguggcugguuuucgacauuaccgccacaagcaaccacuggguagugaacccgcgucauaaucugggccugcagcugucuguggagacuuuagauggacaaucuaucaaccccaagcucgccggccugauaggaaggcacggcccacagaacaagcagcccuucaugguggccuucuucaaagccacugaaguacacuuccguucaauucggucaacaggcucuaagcaaaggucacaaaacagaagcaagacucccaagaaccaggaagcccugcgcauggcuaaugucgccgaaaauaguaguucagaccagcgccaagccuguaaaaaacaugagcuguaugugucauuuagggaccuuggcuggcaagauuggauaauugcaccugagggauaugcugcguacuauugugagggcgaaugcgcauuuccucuuaacagcuauaugaacgcaaccaaccacgcuaucguccagacacugguccacuucauuaauccagagacuguacccaagcccuguugcgcuccgacccaacugaacgcaaucaguguuuuauacuucgaugacaguuccaauguuauucucaagaaguauaggaacauggucguacgagcuuguggaugccauuag

SEQ ID NO: 4826 - RNA, 1098 nt, Artificial Sequence
  Description of Artificial Sequence: Synthetic coding sequence
augcacgugcgaucgcugagagccgcugccccucauuccuuuguggcucugugggcaccacucuuccugcugcgaagugcuuuggcugacuucagucuggauaacgaggugcauagcucuuucauucauagaagacugcggucacaagagcgcagagagaugcagcgagaaauucucucaauauugggccuaccucaucgcccccggccacaucugcagggcaaacauaacagcgcccccauguucauguuggaucuguacaacgcuauggcuguggaggaagguggaggucccggcggucagggguucucuuacccauacaaagcaguguuuaguacacagggccccccucucgcuucacugcaagacucccauuucuugacagaugcagacauggucaugaguuucgucaaucucguagaacacgacaaggaauucuuccauccaagauaccaccaccgcgaguucagauucgauuuaagcaaaauucccgagggcgaggcgguuacagcagcugaguuuaggaucuauaaggacuauauccgagaaagauucgacaacgagacauuuagaauuucaguuuaucaggugcugcaggagcaucuaggcagggagagcgaccuguuuuuguuggauucacgcacacuuugggcguccgaggagggcuggcugguauuugacauuacggcaaccucaaaucacuggguaguuaacccccgacauaaucucggucugcagcugaguguugaaacucucgaugagaauucaucgucugaccagagacaggccuguaaaaagcaugaacuuuacguguccuucagagaucucggauggcaagacuggaucaucgccccagagggguaugccgcuuauuacugugagggagaaugcgcauuuccuuugaacucauauaugaacgcaacaaaccacgcuauuguccagacauugguccacuucaucaauccugagaccguaccuaaaccuuguugugcucccacccaacugaacgcuauauccgugcuguacuucgaugauucaaguaacguuauauugaaaaaguaucgcaauaugguugugagagccugcgggugucacuag

SEQ ID NO: 4827 - RNA, 513 nt, Artificial Sequence
  Description of Artificial Sequence: Synthetic coding sequence
augaagacucagagagaugggcauagccucggacgcuggucccuggugcuccuccuguuaggauuagucaugccacucgcuauuauagcacagguacucuccuacaaagaggcuguguugagagcuauugauggaauuaaccagagaaguucugacgcuaacuuguauaggcugcuggaucuggacccucgcccaacaauggauggcgauccagacacccccaaaccuguuaguuucaccgucaaggaaacuguguguccccgaacuacacagcaaucucccgaggauugugacuucaagaaagacgggcucgucaaaagaugcaugggcaccguaacccugaaucaggccagaggaagcuucgacaucucgugugauaaagacaacaagcguuucgcucuacugggagacuuuuuuaggaagucuaaagagaagauaggaaaagaauuuaaaagaaucgugcagcgcaucaaagacuuccucagaaaccuggugccgcgaaccgaaaguuag

SEQ ID NO: 4828 - RNA, 1692 nt, Artificial Sequence
  Description of Artificial Sequence: Synthetic coding sequence
gcauguuguugcggaggcggcugcacguguugcggauguacaugcacaaccggaugcuguacuaccuguaccugcugugcuugugcuuguacaaccggcaccaccacuggggcgggugcuuguuguacuggagggugugcagcuggggguaccggaugugggggagcaggcuguuguugcacauguugcgccggagccgccgguacugguuguggagggacaugugcugccggguguggaggcugugccgggugcgggggugccggugcuugcgguggcuguggcgcggggugcugcgcaggcggcgcggcuuguugcaccugcuguugcugcugcugcggaugcggcaccuguugcugcugugccggauguaccacaugcugcugcgcugggugugguacaggaggauguggaggauguggcggagcagccuguugcugcuguugcggcggcgcuggagccgccgccggggccgcgaccgccgcugcuggcgccuguacgggcggagcgacagcaugugccggcggaaccugcugugccacaaccgcaugcggaacaugugcuaccacuuguaccgggugcgccggggggugcugugcagcuaccacuacagcuacaggcgcgggcggggcagccacuuguugugcugcaggugcuacaggagccgccacuacaacagggggagcgggaugugcagggggugccggcgccggcggcuguugugguaccacuacuggaacgugcacuggaugugcaggcacaggaugcuguuguugugccggaggcugcacaggaugcacauguugcugcgccggguguggguguacuaccugcuguugcgccgcaugcgccggggcggggggggcuuguugugccacgugcacuggcgccaccggagcaacuaccugugcuaccgcagguggaugugcaugcgccgcagcgugcgcgacaggugccgcugccacgggcgccugcacaacaaccggagcugccggaacgacuacaugcuguacuaccugugcugcuacagcggcagccgcggcuugcgccggugccugugcugcuacugccaccgggacaaccgcaaccugcgccggcgccacaugcgcagccgcuuguacaugcuguggcgccugcuguuguugcgcagccugcggcgcuggcgcuacuacgugcuguaccggggccgccggagcugccuguacugguugcggagccggaggagccggcggaacuggcgggggaugcuguacgugcacuaccugcgccggcugcggcgcaggauguacagguggggcaugcaccggcuguaccugcuguuguacgggcggcgcuggcugcgcaugcggagcaggcacuacuugcgccgggggggccgccggcggcugcacaugcgcugggggagcagcuggagccggaggcgcuggcgcuggcugcgcagggugugccgcaggcuguggcggagccgcuacugcgacuuguacaugcggggcuacagguugugcuacagcugcuaccgggugugcagguaccaccggaggcacaggaggcggcggaugcugugcaacaggagccugugggggggggggguguuguugugggggagcagcuuguaccugcgccuguugugcaggaugcacaacagcugggugugcagguugcggauguacuuguggaggguguacaggguag

SEQ ID NO: 4829 - RNA, 3198 nt, Artificial Sequence
  Description of Artificial Sequence: Synthetic coding sequence
augaagauccucauucugggaauuuucuuauuccucugcucgacccccgccugggccaaagaaaaacacuauuauauuggaauaaucgagacaaccugggauuaugccucagaccacggagagaaaaagcugauaagcguugauacagaacauucaaacauuuaccugcagaaugggcccgauaggauuggccggcuguacaaaaaagcacuguaucugcaguauacagacgaaaccuuccggacuaccaucgagaagccuguauggcucggcuuucugggucccauaaucaaagccgaaacuggagauaaaguguacguacaucugaaaaacuuggcuucacguccuuacaccuuucacucucacggaauaaccuauuauaaagagcacgagggcgcaauauauccagacaacacgaccgacuuccaacgugcugacgauaagguauauccaggugaacaauacaccuacaugcugcuggccacagaggaacaaucaccaggcgagggugacggaaauuguguuacuaggaucuaccacucccauaucgaugcuccaaaggauaucgccucuggucugaucggccccuuaaucaucugcaagaaggacucgcuggauaaggagaaagagaaacacaucgacagggaguucguugucauguuuucaguggucgaugaaaacuuuagcugguaccucgaagauaauaucaaaaccuacuguagcgaaccagagaagguggauaaagacaacgaagacuuucaggaguccaaucggauguauagcgugaauggguauaccuuuggaagccuccccggacugaguaugugcgcugaagaucgggugaagugguaucucuuuggaaugggcaacgaagucgacguacacgccgccuucuuccaugggcaagcucuaacuaacaagaauuacagaaucgauacuaucaaccuuuucccagcaacccuauucgaugccuacaugguggcacagaauccaggcgaguggaugcuaucaugucagaaccuuaaucaucucaaagcugggcugcaggccuuuuuccaggugcaggagugcaacaaaucaagcucuaaagauaacaucagagggaagcacguucggcauuauuauaucgcagcugaggaaaucauauggaauuaugccccaagcggcauagacauuuuuacaaaggagaacuugaccgcucccggcucagauuccgccguguucuucgaacaggggacaacuaggaucgggggauccuauaagaaacugguguaucgagaauauaccgaugcaucguucacaaauagaaaggagagagggccagaagaggaacaucugggaauacuugggcccgugauuugggccgagguaggcgauaccauuagggugaccuuccacaacaagggagcguacccucuuuccauagaaccuaucggagugagauuuaauaaaaauaacgagggcaccuacuauuccccaaacuauaacccacaaagucggagugugccaccuuccgccucccauguggccccuacagaaaccuucacauaugaguggacggugccaaaagaagucggaccaacuaacgcagaucccguuugucuggccaaaauguauuacucugccguagagcccaccaaggauauauuuacuggacugaucgggccgaugaagaucuguaagaaagguucacuacaugccaauggucggcagaaagacguggacaaggaauucuaccuguucccaacaguuuuugaugagaacgagagccuucuguuagaggacaauaucaggauguuuaccacggcucccgaucagguagacaaggaggacgaagacuuucaggaguccaauaaaaugcauucgaugaacggauucauguacggcaaccagccagggcucacuauguguaaaggagacuccguagucugguaucuguuuucagcuggaaacgaagccgacgugcaugggauauacuuuaguggcaacacuuauuuauggcgcggagagcggagggacacugcgaaccuauuuccccagacaucccugacccuccauauguggccugacacagaagggacuuucaacguggagugccugacaacagaucacuauacuggcggaaugaaacagaaguacaccguaaaccagugucgacgacaguccgaagauucuacauucuacuugggggagaggacuuacuacaucgcugcagucgaaguagaaugggauuacucgccccagcgagaaugggagaaggagcuacaccaccuacaagaacagaacguuuccaaugccuuccuagacaaaggggaauucuacauuggaucaaaguauaagaaggugguguaccggcaguacaccgacuccacauuccgggugccuguggagcgaaaagcagaggaggaacaccugggcauuuugggaccucagcuucacgcagacgugggagacaaagugaaaauuauuuuuaaaaauauggcgacaagacccuacuccauucaugcacacggaguccagaccgagucuagcacaguuacgccuacacuuccaggcgagacccugacguacguguggaagauccccgagagaagcggggccggaaccgaagauucugcuugcauccccugggcuuauuacuccacugucgaccaggugaaagaucuauacuccggacucaucggcccauuaauagucugccggagacccuaucuuaaaguguucaauccccgucgcaagcuugaauucgcacugcuguucuugguguuugaugagaaugagagcugguaccuggacgauaauauuaaaaccuacucugaccacccagagaaagugaacaaagacgaugaggaauucauagaauccaauaaaaugcacgccauaaauggcaggauguucggcaaucuucagggacugacuaugcaugugggcgacgaaguuaacugguaucugaugggcaugggcaaugagauugauuugcacacgguccacuuucauggccauucguuccaguacaaacaccggggcguauauagcagcgauguguuugacauauuucccgggaccuaucagacucucgaaauguucccucgcacgccuggcauauggcuacuucacugccaugucacugaccacauucacgcuggaauggaaaccacauacacaguucuccagaacgaggauacgaaauccggcuag

SEQ ID NO: 4830 - RNA, 1869 nt, Artificial Sequence
  Description of Artificial Sequence: Synthetic coding sequence
auggcucaugugaggggguugcagcucccugguugccuagcccucgcagccuuguguuccuuaguccauucccagcauguauucuuggccccucagcaggcgcgcuccuuguuacagcgcgugaggcgggcaaauacuuuccucgaggaggugcgcaaggguaacuuggagagagaauguguagaagagaccuguuccuacgaagaagcauuugaggcacuggaaagcucgacagcaacagacguauuuugggccaaauacaccgccugcgagacagcacgcaccccaagggauaagcuggccgcuugcuuagaagguaauugugcugaggggcucggaacuaauuaucgugggcacgugaauauuacucgcuccggaaucgaaugucaacuguggcguucucguuacccgcauaaaccugagauuaacucaacuacacaucccggcgccgaccugcaagaaaauuucugcagaaacccugauuccuccacaaccgggcccugguguuauacuacugauccaacugugagacggcaggaaugcagcauccccgugugcggacaagaucagguaacgguugccaugaccccaaggagugaaggauccucugugaaccucagcccuccccuggagcagugcguaccugaucgcggccaacaguaccaaggcagacuagcagugacuacccauggacuccccugucuggcaugggcaagcgcccaggccaaagcccucagcaagcaucaagauuuuaauagugcaguacagcugguggagaacuucuguaggaaccccgauggagacgaagagggcgucugguguuacguugccgggaagccuggggauuuuggguacugcgaucugaauuacugcgaggaggccguggaagaagaaaccggcgaugguuuggacgaggacucagauagggcuaucgagggaaggaccgccacauccgaauaccagacauuuuucaacccccguacuuucggaagcggcgaagcugacugcggccugaggccccucuuugaaaaaaagagcuuagaggauaagaccgaaagagaauuacucgaaucuuauauagacgggcgcaucgucgaagggagcgacgccgaaaucgggaugucccccuggcagguaaugcuauuccgcaagaguccgcaggaacugcugugcggggccagucuuaucagcgaucgguggguucugaccgccgcacacugucugcuguacccaccuugggauaagaacuucacugagaaugaccuccucguaaggauuggcaaacauucccggacaagauaugaacggaauauagagaaaauauccaugcuggaaaagaucuacauacacccaagguauaacuggagagaaaaucuggaucgcgacauugcucuuaugaaacugaaaaaaccuguagcuuucuccgacuauauucacccaguaugccuuccugaccgcgagacugccgccuccuuguugcaggcgggcuauaaagguaggguuacuggauggggcaaucugaaggaaacauggaccgcgaacgugggaaagggucagcccucgguccugcagguuguuaaccugccaauuguggagcggccaguguguaaagauuccacgaggauuagaauaacugacaacauguuuugcgccgguuauaaaccugacgaaggcaaaaggggugaugcgugcgaaggcgauagcggggguccauucgugaugaaguccccguucaauaauaggugguaccagaugggcauaguuaguuggggagagggcugcgacagagacggaaaauauggauuuuacacacauguguucagacucaagaaguggauacagaaggugaucgaucaguucggugaguag

SEQ ID NO: 4831 - RNA, 195 nt, Artificial Sequence
  Description of Artificial Sequence: Synthetic coding sequence
cuacagggcgaauuucuuccucagccucggcaacagcaccacggcacacugguccuacauuacaggccucaucgggaagaggcaggcaugcagcaccccugcuuguggccaggaaguagccacugcagcgaugauucuacucuccgaaggcuucagugcgaauccgugacaucuaucggcgcagucuguccauag

SEQ ID NO: 4832 - RNA, 1752 nt, Artificial Sequence
  Description of Artificial Sequence: Synthetic coding sequence
auggcccauguuaggggccugcaauugcccggcugccuggcccucgccgcccuguguucacucguccauagccagcauguguuccuggccccccaacaagcacggucuuuguugcaacgaguucgacgugcuaacaccuuccuggaagaagugcggaagggcaaccuggaacgagaaugugucgaagaaacaugcaguuaugaagaggcuuuugaggcccucgagagcuccaccgcuaccgacgucuuuugggcgaaauacacagccugcgagacagcccggaccccgcgcgauaaacucgcggcgugccuagaagggaauugcgcugagggacugggcacgaacuaccgaggacacgugaacaucaccagaagcggcaucgagugccaacuguggagaagccguuauccccauaaaccggaaauaaacagcacgacccauccaggugcagaccugcaggagaacuucugucgcaacccugacaguuccacaaccggacccugguguuacacuaccgaccccacugugagacggcaagaauguagcauacccguuuguggccaggaccagguuacaguggccaugacaccacgcucggaaggcagcuccguaaaccugagcccccccuuggaacaguguguccccgauagaggccagcaguaucagggcaggcucgccgugaccacccacggucucccuugcuuggcaugggccucugcucaagcaaaggcacucucaaagcaccaagacuuuaauagcgcagugcagcugguugaaaauuuuugcaggaaccccgacggcgacgaggaaggggugugguguuacguugccggcaaacccggagauuucggcuacugcgaucuaaacuauugugaagaggcuguggaagaagagacuggcgauggccuggacgaagauuccgaucgugccauagaaggaaggaccgcuacuucugaguaccaaacuuucuuuaauccccggacguucggcucuggcgaggccgacugcggccuacgcccccuguuugagaagaagucucucgaagacaaaaccgaaagggaacuguuggaguccuacaucgacgggagaauuguugaagggucugacgcugaaauaggcaugucgccauggcaggugaugcuuuuccggaagaguccucaagagcuguuauguggcgcaucccucaucagugacagaugggugcugaccgcggcacacugucuauuguaucccccgugggacaagaacuucacagagaacgacuuacuggugcggauuggaaagcauucuagaacucgauacgaacggaacauagaaaagaucaguaugcuagaaaaaauuuauauccacccuucacugcugcaggcuggauacaaaggaagggugacuggauggggcaacuugaaggaaaccuggacggccaacgucggaaaaggacagcccaguguucuucaagucguuaaucucccuaucguggagagacccgugugcaaagauagcacucguauuaggaucaccgacaacauguucugcgccggguauaagccugaugaagggaagcgcggcgaugcaugcgaaggugacagugggggcccauucgucaugaagucucccuuuaacaaccggugguaccagaugggaauaguaucauggggugagggaugugaucgggacggcaaguauggauuuuacacacacguguuucgacuaaagaaguggauccaaaaaguaauugaucaguucggcgaguag

SEQ ID NO: 4833 - RNA, 1272 nt, Artificial Sequence
  Description of Artificial Sequence: Synthetic coding sequence
augcaaagggucaacaugauaauggcggagucuccgggauuaauaaccauuugccugcucggcuaucuguuaagcgcggaaugcaccgucuuucuggaccaugagaacgcaaacaagauccugaacagaccaaaaagguauaauagugguaaacuggaggaauucgugcaaggcaaccuugaacgcgaguguauggaagagaaguguucuuucgaagaagcccgcgaaguguuugagaauaccgagcgcaccacagaguuuuggaaacaguacguggaugucacuugcaauaucaagaacggccggugcgaacaauucuguaaaaacucggccgacaacaaagucguguguaguugcacugaagguuauagauuagcagagaaccagaaaagcugugaaccugcuguccccuuuccaugcggcagaguaucugucagucagacgucaaagcugacuagagccgagaccguuuuucccgauguggauuaugugaauucaacagaggccgaaaccauucuggacaacauaacgcagucuacccaaagcuucaaugacuucacuaggguuguuggcggagaagacgcaaaacccggucaguuucccuggcaagugguguuaaauggcaaggucgaugccuuuugcggcggguccauuguuaaugaaaaguggauugugacagcagcacacuguguggagaccggugucaaaauaacggugguugcgggggagcauaauaucgaagagaccgagcauacggaacagaagcgcaauguaauuagaaucauaccucaccacaacuauaacgccgcuaucaauaaauauaaucacgacauagccuuacuggaguuggaugaaccccuuguccugaauaguuacgucaccccaauaugcauugcagacaaagaguauacaaacaucuuccugaaguucggcucaggcuaugugagcggguggggucggguuuuccauaaagguaggucggcgcucgugcugcaauaucuacgagucccucuuguugaucgcgcaacaugucuaaggucuacaaaguucacuauuuauaauaauauguuuugugcuggauuccacgagggcgggcgagacagcugucagggagauuccggcggcccacauguuacugagguggaagggacuuccuuucucaccgggauaauuagcuggggggaggagugugccaugaagggcaaguaugggaucuacacaaaaguuucccgauacgucaauuggaucaaagagaagacuaaacugacuuag

SEQ ID NO: 4834 - RNA, 1335 nt, Artificial Sequence
  Description of Artificial Sequence: Synthetic coding sequence
auggucucucaggcccuuagacuucugugucugcugcucggacuucagggcugccuugcagccguauucguuacccaggaagaagcacacggcguacuccauagaagacggagggccaacgcauuucucgaagagcugcgaccaggaucucuggagcgugaauguaaggaggagcagugcuccuuugaggaggcucgggagauuuucaaggacgcugagcggacuaaguuauucuggauauccuauuccgacggggaucagugugcaaguucacccugucagaacggaggguccugcaaagaccagcuucaaaguuacauuugcuucugucugccugcuuucgagggucgcaacugugaaacccacaaggacgaucagcugauuugcguaaacgaaaacggugggugugaacaguauuguuccgaccauacugggacuaaaagaagcugucggugccacgaaggguacucacugcuggccgauggugucucuugcacaccuaccguggaauacccaugugggaagauuccaaucuuggagaagagaaaugccucuaaaccccaggggcgaaucgugggcgguaaaguaugcccgaagggugaguguccauggcaaguacuguugcucguaaacggggcucaacuuuguggcggcacccucauuaauacuauauggguaguuucugccgcucacuguuuugauaagauuaagaacuggaggaaccugauugccguccugggugaacaugaccucucagaacaugacggggaugagcagagucgccguguggcccaagugauuauuccgagcacguacgucccuggcacaaccaaccacgauauagcccuccucaggcugcaccagcccguugugcuuaccgaucacgucgucccccuuugucuuccagaaaggaccuuuucagaacggacgcuggcuuucgugagguucagucuugucaguggcugggggcaacuccuggaucgaggugccacugcccuggaacugaugguccuaaacgugccuagacuaaugacucaggauugucuacagcaaucccgcaagguuggcgauucuccaaauauaacagaauauauguucugugcaggcuauagugacggaucuaaagacagcugcaaaggcgacucaggaggaccacacgcaacccacuaccgagguacuugguauuugacugggaucguuagcuggggccaggggugugcuacagugggccauuucggugucuacacgcgggugucccaguauaucgaauggcugcagaaacuuaugcgcucggagccucgcccaggugugcuguugcgcgcucccuuccccuag

SEQ ID NO: 4835 - RNA, 1401 nt, Artificial Sequence
  Description of Artificial Sequence: Synthetic coding sequence
auggugucgcaggcuuugagacuacuaugccucuuacugggccugcagggcugccuugccgccggcggaguagccaaggcaagcgggggagagacgagagacaugcccuggaagccaggcccacauagaguguucgugacucaggaagaggcccauggcgugcuacaccgcaggagacgugcuaaugccuuucuggaagagcucagaccggggagccuggagcgagagugcaaggaggaacagugcaguuuugaagaagcaagggagaucuuuaaagacgcagaacggaccaagcuuuuuuggauaucguacagcgauggagaccagugcgcuagcucucccugccaaaacggaggaucuugcaaggaccagcuucaguccuauauauguuuuuguuugccugcuuucgagggacgcaacugcgagacccauaaggaugaucaguugaucuguguuaaugagaaugguggaugcgaacaguacuguagcgaucacacggggaccaaacggucgugccggugccaugaaggcuauucucuguuagcagacggaguuucaugcacucccaccguggaguacccuugcggaaagauccccauuuuggagaagcggaaugccuccaaaccacagggaaggaucguggguggaaaaguguguccaaaaggugaaugcccuuggcagguucucuuacugguaaauggcgcacagcuguguggaggcaccuugaucaacacgauuuggguugucuccgccgcccacuguuucgacaaaaucaagaacuggagaaaccuuauugcagugcuaggagaacaugaccugucugagcacgauggagacgaacagucacgcagggucgcccaagugaucaucccaaguacuuauguccccgggacuaccaaucacgacaucgcccugcuaaggcuacaccagcccguggugcugacugaucacgucgugccucucugucuucccgagcggacauuuagugagaggacccuggcguucgugcgcuuuuccuuggugaguggguggggccaguuguuggauaggggggcgacugcacuugaacuaaugguauuaaaugugccucgacucaugacgcaggacugccuccaacagucuagaaagguuggcgacucaccgaacaucaccgaauacauguucugcgcuggcuacucugauggauccaaagauucuugcaagggagauagcggcgggccucacgcaacacauuacagaggaacaugguaccuaacuggaaucgucucuuggggacagggcugugcuaccguugggcacuucggcguguacaccagggugucucaauacauugagugguuacaaaagcugaugagaucagagccuagaccuggcguguuguuaagggccccuuucccuuag

SEQ ID NO: 4836 - RNA, 1194 nt, Artificial Sequence
  Description of Artificial Sequence: Synthetic coding sequence
augggaaacgugaacaggcagggucagcauugucgcgauuucaucauggugucacaggcacugcgccugcugugucuguuauugggacuacagggcugcuuagcugcugacggagaucaaugcgcuuccucuccaugucagaacggcggcucuuguaaagaucagcuccagaguuacauaugcuuuugccugcccgcuuucgaaggccguaacugcgaaacgcacaaggacgaucagcucauuugcgucaaugagaauggggggugcgagcaauauuguagcgaccacacaggaacgaaaagaucgugcagaugccacgaaggcuauucacugcuugcugauggcguguccugcacccccacagucgaguacccaugcgggaagauccccauauuagaaaagagaaacgcuucuaagccacaggggaggauagugggcgguaaagugugucccaaaggagagugcccauggcagguacugcuguuggugaacggggcccagcucugcggggguacucugaucaacacaauuuggguggugagugcagcgcacugcuuugauaagauaaagaauuggagaaaccucaucgccgugcugggcgagcaugaucucagugaacacgauggugacgagcaguccagaagagucgcccaaguuaucauacccaguaccuacgucccaggcacgaccaaucacgauauagcccuucucagacugcaucagccaguuguacucacugaccacguagucccacuaugccucccugagaggacuuuuucagagcgaacgcuggcuuuuguuagguucucucucgucucaggguggggccagcuucuggacagaggcgcgacggcucuugagcucauggugcugaauguuccccgucuuaugacacaggauugccugcaacagagucggaagguaggugauaguccgaauauuaccgaguacauguucugugcuggcuacucggaugggucaaaggacagcugcaaaggggacuccggcggcccccacgcgacccacuaccgcgggacgugguaccucaccgggauagugucaugggggcagggaugcgcuacugucggucacuucggcguuuauacacgugugagucaguauauugaguggcuucaaaaacucaugcgaucagaaccacgacccgggguccugcugagagcaccuuuuccauag

SEQ ID NO: 4837 - RNA, 651 nt, Artificial Sequence
  Description of Artificial Sequence: Synthetic coding sequence
augcggauccaggaucccgguaaaguuuuuuuugguaauguagauucaagcggcaucaaacacaauaucuuuaacccuccaaucaucgccagauauauucgccuucaccccacucacuauucaauuagaucgacccuccgcauggaacucaugggaugugaccuuaacuccuguucgaugccucucggaauggaguccaaagcgaucucggaugcccagauuacugccagcuccuacuuuaccaacauguuugcuacauggucgccgaguaaggccagacuccaccugcagggccgcaguaacgccuggcgaccucaagucaacaaccccaaagaauggcuccagguagacuuccagaaaaccaugaaagugacuggugugacgacacagggaguaaaguccuuacuuacaaguauguaugugaaggaguuccugaucagcaguagucaggauggacaccaguggacacuuuucuuucaaaacggaaaggugaaaguauuucaagggaaccaagacagcuuuacuccuguugugaacucucuggacccaccacuuuuaacgcgauaccuuagaauucauccucaguccuggguccaccaaaucgcccuuagaauggaaguguuagguugugaagcacaagaucuuuacuag

SEQ ID NO: 4838 - RNA, 7056 nt, Artificial Sequence
  Description of Artificial Sequence: Synthetic coding sequence
augcagaucgaacuaucuacaugcuucuuccucugccugcugcgcuuuuguuucucggcuacaagacgguacuaucugggugcgguugaguugagcugggauuauaugcagucugaccuuggagagcuccccguggaugcacgguucccgccccgcguaccuaaauccuuuccauucaauacauccgucguuuacaaaaaaacgcucuucguugaguucacugaccaucuguucaauaucgcaaagccaaggccuccguggaugggccucuuaggaccaaccauucaagccgaaguguaugacacagucgugaucaccuugaaaaauauggccagucauccugucagccugcaugccgugggcgucucuuauuggaaggcgucagaaggagcugaauacgaugaucagacgucccaaagggagaaagaagaugauaaagucuuuccuggagguucucauaccuacguguggcagguccucaaagaaaauggcccgauggccucugaccccuuaugccugaccuacucuuaucucucgcacguggaccuggucaaagaucuaaacucuggccuuaucggugcucugcucguuugucgugaaggcucgcuggccaaggaaaagacccagacccuucauaaauuuaucuugcuguuugccguguucgacgagggcaagucuuggcacucagagacuaaaaauucgcucaugcaggacagggacgcugcuagcgccagggcuuggcccaaaaugcacacagugaacggauacgugaaucgcucauugccaggacuaauugguugccaccguaaaagcguauauuggcacguuauugguaugggcacaacacccgagguccacagcauuuuucucgagggacauaccuuucucguccgaaaccacagacaggcaucccuggagauaagcccaauuacuuuucucaccgcccagacacugcucauggacuugggacaguuuuugcucuucugccacaucaguucccaccagcaugaugggauggaggccuacgucaaaguagacucuuguccggaggaaccacagcugcggaugaagaacaaugaggaagcggaagauuaugaugacgaccugaccgacagcgaaauggacgucguccgcuucgacgaugauaacuccccaagcuuuauucagauuagaucaguugcgaagaaacauccaaaaaccuggguccauuacaucgccgcugaggaagaggauugggacuaugcucccuuagugcuggcaccugacgaccggagcuacaaaucacaguauuugaauaauggaccacagaggaucggccgaaaguacaaaaaggugagauuuauggcauauaccgaugagacguucaagacaagggaagcuauccagcaugaaucggggaucuuggggccccuguuauacggggaggugggcgacacucuacugaucaucuuuaaaaaccaggccucaaggccauacaauaucuacccacauggcaucacugacguccgaccccuuuauucccggcgguuaccaaagggaguaaagcacuugaaagacuuuccaauccugccgggugagauuuucaaguacaaauggaccgucaccguagaggauggccccacgaagagugacccacgauguuugaccagguauuacucaucuuuugucaauauggagcgggaccuugcaucugggcuuauaggaccccuguuaaucuguuacaaggaauccguggaccagcgagguaaccagaucaugucagacaagcgcaaugucauauuauucagugucuuugaugaaaauaggagcugguaucucacugagaacauucagagguuucuaccuaauccggcgggggugcagcuggaggacccagaguuccaggcuaguaacaucaugcacaguaucaacggauauguguuugauagucugcaacugucaguuugucuccaugaaguagccuacugguacauccugucaauuggugcgcagaccgauuuccuuucagucuuuuuuagcggguacacguuuaagcauaaaaugguguaugaggacacccuaacccuguuccccuuuucgggcgaaacggucuucaugucaauggaaaauccuggacuguggauccuugguugucauaacucggauuuuaggaauagggggaugacggcacugcugaagguuagcuccugcgauaagaauacgggagauuacuacgaggauucguacgaggacaucagugcuuaucuguugaguaagaacaaugccaucgaaccaagaucuuucagccaaaacagccggcacccaagcacacgccagaagcaauucaacgccaccaccauucccgagaacgacaucgaaaaaaccgaucccugguuugcccacagaacucccaugccuaaaauucagaauguuagcagcucagacuuacugaugcuccugagacagucucccacgccgcacggucuuucccugucagaccugcaggaagcuaaauacgagaccuuuucugaugaucccucccccggugcaaucgacucuaauaauagccugagugagaugacccauuuucgcccgcaacugcaucacucaggcgacaugguuuucacacccgaaagcggacugcagcucagacucaacgagaaacucggcaccaccgcagcaacggaacugaaaaaacuggacuuuaaagucaguagcacguccaauaaucugaucaguacgauacccuccgauaaucuugcggcaggcaccgauaauacauccagucuaggccccccguccaugcccguccacuacgacagccagcuggacacuaccuuguucggcaagaagaguagcccacuuaccgaaucgggggggccucuuaguuuauccgaggaaaauaaugacucuaaacuccuagagucuggcuuaaugaacagccaagaaaguaguugggggaaaaauguaaguagcacagagucuggccgccuguuuaaaggaaaacgggcucacggcccugcccuucuuacaaaagacaaugcucuuuuuaaggugucgaucagcuugcugaagaccaauaagacuagcaacaacagcgcaaccaaccggaaaacucacaucgacggccccagucuguuaauugagaacagucccucuguuuggcagaauauacuggaauccgauaccgaauuuaaaaaaguaacaccucucauucacgaccgaauguugauggacaagaaugccacugcucugcggcuuaaccacaugaguaacaagacaaccagcaguaagaacauggaaauggugcagcagaaaaaggaaggcccuauuccaccagaugcccagaauccugauaugucuuuuuuuaaaaugcuguuucugcccgaaucggcacgguggauccagcggacucacggaaagaacagucuuaacucuggacaaggaccaagcccaaaacaguuagucucccugggcccugagaagucagucgaaggccaaaacuucuuaucugaaaagaacaaagucgugguggguaaaggagaauucaccaaggacguuggauugaaagaaaugguuuuccccuccucucgcaaccucuuccucaccaaccucgacaaccugcacgagaacaauacgcacaaccaagagaaaaaaauucaagaggagaucgagaaaaaagagacccugauucaggagaacgucgugcucccccagauacauaccguaacugggacaaaaaauuucaugaagaacuuauuucuacugagcacacggcagaaugucgaagguagcuacgauggcgccuaugcucccguuuuacaggauuuccggucgcugaaugacucgaccaauagaaccaagaaacacaccgcccauuuuucuaaaaaaggggaggaggaaaaucuggagggacuuggcaaccagacuaaacagaucguggaaaaauacgccuguaccacccggauaucuccaaauaccucccagcagaauuuugugacccagagguccaaaagagcccucaagcaauucagacucccgcucgaagaaacggaacuggagaagcggaucauugucgacgauacuucuacucaguggagcaaaaacaugaagcaccugacuccuagcacucugacccagauagauuauaaugagaaggagaaaggcgcgaucacccaaucuccucuuagcgacugccucacccgcucucacucaaucccucaggccaacaggaguccccugcccauugccaagguaaguagcuuuccaagcauucggcccaucuaucugacucgcgugcuauuucaggauaauuccucucaccugcccgcagccuccuacaggaaaaaagacucaggagugcaagaguccagccacuuccugcagggcgccaagaaaaauaaccugucacuggccauccucacccucgaaaugacuggugaccaaagagaggucgguucccucgguacauccgccaccaacucuguuacauacaagaagguugaaaauacugugcuccccaaaccggaucugccuaaaacuucaggcaaaguggaacuguugccaaaggugcacauuuaccagaaagaccuguuuccuacugagacaagcaauggcagcccgggccaccucgaccucguagaagggaguuugcuucaggggacugagggugccaucaaguggaacgaggcaaacaggccugggaaagucccuuuccugcgggucgccaccgaauccucagcaaaaacuccguccaaacuccucgauccacuagcaugggacaaccacuacgggacacagauaccaaaggaagaguggaagagucaggaaaagagcccugaaaaaacugcguucaagaagaaggauacgauucugagucugaacgccugcgagucuaaccaugcuauugcagccaucaacgaggggcaaaacaagccagaaauugaggugacgugggcaaaacagggccguacagagaggcuguguucccagaauccucccguuuuaaagagacaucagcgcgaaauuacccggacaaccuugcaguccgaccaggaagaaaucgauuacgacgauacaauuagcguagagaugaagaaggaggacuucgauauuuacgaugaggacgaaaaccaaaguccuaggagcuuccagaaaaagaccaggcauuauuuuauugccgcuguagaaagacuuugggacuauggcaugagcagcaguccacacguucugcggaaucgggcacagucagguuccgugccucaauuuaaaaaagucguguuccaggaguucaccgacggaucuuuuacccagccccucuaccggggggaacuuaaugagcaucucgguuuauuaggcccauauauccgggcggagguugaggacaacauuauggucacauucaggaaccaggcgucaagaccauauucuuuuuauagcagucugauaaguuaugaagaagaccaacgucagggggcggaaccacggaaaaauuucguuaaaccaaaugagaccaagacauacuuuuggaaggugcagcaccacauggccccuaccaaagaugaguucgauugcaaggccugggcuuauuuuuccgauguugaucuggagaaagacguucauucuggguuaaucgguccacugcuagugugccacacaaacacccuaaacccugcucauggccggcaagucaccgugcaggaguucgcccuauucuuuaccauuuuugaugagacuaaguccugguauuuuaccgaaaauauggagcguaacuguagagccccaugcaacauccaaauggaggauccaacuuucaaagagaauuauagguuccaugcuaucaacggcuauaucauggacacgcugccaggccucgugauggcccaggaccaaaggaucagaugguacuugcugucaaugggcucgaacgaaaacauccacagcauacacuuuucuggccacgucuuuacugugaggaaaaaggaggaguauaaaauggccuuguauaaucuguaccccggcguguuugaaacaguggagaugcuccccagcaaggcagggaucuggcgggucgagugucucauaggcgagcaucugcacgcuggcauguccacgcuguuucugguguacucaaacaagugucagacgccacucgggauggccucagggcacauuagggauuuccagaucacugcaucaggccaguacggccagugggcccccaaguuggcucgguuacacuauagcgguucaaucaacgcuuggagcacaaaagagccauucucuuggauaaagguggaccuguuggcccccaugaucauccacgggauuaagacccaaggggcacgccagaaguucucuucccucuauaucagucaguuuaucaucauguacagccucgacggcaagaaguggcagacauaucgaggcaauucaacggguacacucaugguguuuuucgguaacgucgacucaagcggaaucaagcauaauauuuuuaacccacccaucaucgcccgcuacauccgcuugcacccgacccacuacuccauccgauccacacuccgcauggaacuuaugggcugugaccugaauucuuguaguaugccccuuggcauggaguccaaagcaauuagcgacgcucagauaaccgccagcucuuauuuuacaaacauguucgccacauggagcccguccaaggcuaggcuccaccuucaggguagauccaacgcauggagaccgcaggucaacaacccaaaagaguggcuccagguggacuuccaaaagacgaugaaagugacugguguuacuacgcagggggucaaaucgcuacugacaucuauguaugucaaagaauuucugaucucuucaucucaagauggacaccaguggaccuuauuuuuucagaauggcaaaguaaaaguguuccagggcaaucaggacagcuuuacgccggucguuaacucauuggauccaccgcuccuuaccagguaucucaggauucacccacagucuuggguucaccagaucgcguugagaauggaaguguuggguugcgaggcucaggaucuuuauuag

SEQ ID NO: 4839 - RNA, 999 nt, Artificial Sequence
  Description of Artificial Sequence: Synthetic coding sequence
auggggagaccucugcauuuggugcugcucucagcuucuuuagccggacuccuucugcuuggugaaagccuuuuuaucaggcgcgagcaggcaaauaauauccuagccagaguuaccagagccaacucuuucuuggaggaaaugaaaaaagggcacuuagaacgcgagugcauggaggagaccuguaguuaugaagaggccagggaaguuuucgaagacagcgauaagacuaacgaguuuuggaacaaguacaaagauggagaccagugcgaaacgagucccugucagaaccaaggaaaguguaaggacggacucggcgaguacaccuguacaugucuugagggguuugaaggaaaaaauugugaacuuuucacgcggaagcuuuguagccuggacaacggugauugcgaucaguucugucaugaggagcagaauucaguugucugcagcugcgcaagagguuauaccuuagccgacaauggaaaagcgugcaucccaaccggacccuauccuugcggcaagcaaacauuggagcgcaggaaaagaucgguugcccaggcuacuucuuccucuggagaggcaccagauucuauaacuuggaagccuuacgaugcugcagaccucgaucccaccgaaaauccauuugaucugcuggacuuuaaucaaacccaacccgagcggggggauaacaacuugacucggauugugggugggcaggaguguaaagacggcgaaugcccauggcaggcacugcucaucaacgaagaaaacgaaggguuuuguggcgguacuauucucucugaguucuauauccucacagcagcucacugucuauaccaggccaaaagguucaaagguacggggacucguagccgccggagggccguucgacgguguacacgauggcgauggaguagcucuacgacaggcagccaaagacgcccaaugaccagcacuucuccuugcucugguucucggcccccuagcccuucggccuag

SEQ ID NO: 4840 - RNA, 1467 nt, Artificial Sequence
  Description of Artificial Sequence: Synthetic coding sequence
augggaagaccccugcaucucgucuuacuuagugcaagucuugccggucuucuccugcugggcgaaagucuguucauucgaagggaacaggccaacaauauucuggcacgcgugacucgugccaauucuuuucuggaggaaaugaaaaagggccaccuagaacgugaaugcauggaagaaacaugcucuuaugaggaggcgcgggaaguguuugaggauagugacaagaccaacgaguucuggaauaaauacaaggauggcgaucagugugaaacgucccccugucagaaccagggcaaauguaaggauggacuuggggaguauacuuguacaugucucgagggcuuugaaggcaagaacugcgagcuguucacucggaagcuuuguagcuuggacaauggcgacugugaccaguucugucacgaggagcagaacucggugguguguucuugugcgagaggauacacccuggcugacaaugguaaggcuuguauaccuaccggcccauaccccugcgggaaacagaccuuagagaggcgcaagagaucuguggcacaggccaccaguagcucuggcgaggcgccugauucuaucacuuggaaacccuacgacgcugcugaucuugacccaacugagaaucccuucgacuuacucgauuuuaaucagacacagccggaacgaggagauaauaaucuaacccgcaucgugggaggucaggaaugcaaagacggcgaaugccccuggcaagccuuguugaucaaugaggaaaaugaagguuucugugggggaacgaucuugagugaguucuacauucuuacugccgcucauugucuguaccaggccaaacguuuuaaagugcgugucggggaccgcaacaccgaacaagaagagggcggagaagccguccacgagguagaaguggugauuaagcauaauagguuuaccaaggaaaccuacgauuucgauauugcuguccugaggcucaagacaccuauaaccuuucgcaugaacguugcuccugcaugucugccugagagagauugggcagaaucgacacuuaugacacagaaaacaggaauuguuaguggguucggacgcacgcacgaaaaagggagacagucuacaagacugaagaugcuagaagugccguauguugacaggaauaguuguaagcugagcucgucuuuuaucauaacacagaacauguucugcgcuggcuacgauacgaaacaagaggaugcuugucagggugacucagggggcccgcacgugacuagauuuaaagauacauacuuugugacugggauagugucuuggggagaggggugugcccguaaaggcaaguaugggaucuauacaaaagucacugcguuuuugaaauggauagaccggucuaugaagacuaggggacuucccaaggccaagucucacgcuccugaagugaucacuuccucuccucuuaaguag

SEQ ID NO: 4841 - RNA, 1005 nt, Artificial Sequence
  Description of Artificial Sequence: Synthetic coding sequence
augggccgcccuuuacaucuaguguugcucagcgccagccuggccgggcuccuguugcugggagagagucucuucauccgaagagagcaggcgaacaauauccucgcuaggguuaccagagcuaacagcuuccuugaggagaugaaaaaaggccaccuagagagagagugcauggaagaaacuuguagcuacgaagaagcuagagagguauuugaggacucugauaagacuaaugaauucuggaauaaauacaaagauggggaucagugcgagaccucuccaugucaaaaccaagggaaauguaaagaugggcugggcgaguacacuugcaccugucuggagggcuucgaagggaagaauugugaacucuuuacccggaagcuguguagccucgacaacggagauugcgaccaguuuugucaugaggaacagaauagcgugguuuguaguugcgccagaggauauacucucgcugacaaugggaaagcgugcauuccaaccgggccauaucccuguggaaagcaaacguuagaacggcgaaagagaucuguugcgcaggccaccucaucgucgggcgaagcaccagacuccauaaccuggaaaccauacgacgcagccgaucuagaccccacugagaacccauucgaucugcuagauuuuaaucagacacaacccgagagaggcgauaacaaucucacccguaucgugggagggcaggagugcaaagauggcgagugucccuggcaagcucugcugauaaaugaagagaacgagggguucugcggcgggaccauucuguccgaguucuacauucugaccgcagcucauugucuguaucaggcgaagagguucaagguucgcggcacugguacuagaagccgacgacgggccgucaggagauguacccgguggaggugguccagcuccaccaccggaagccaaaggcggccuaugacuucgacaucccccuguagcggcucucguccaccaagucccucagcuuag

SEQ ID NO: 4842 - RNA, 1722 nt, Artificial Sequence
  Description of Artificial Sequence: Synthetic coding sequence
augauauuucucuaucaaguggugcacuucauucucuucacauccgugucaggcgagugcgugacgcaauugcugaaagacacaugcuucgaaggcggcgauauaacaaccguguucacccccuccgccaaauauugucaaguggucuguaccuaucauccucggugccugcuauucaccuucacagccgagagucccucagaggauccaacgagaugguucacuugcgucuugaaagacuccguuacugagacacugccaaggguaaaccguacagcagcaauaagcgguuacucuuucaaacaguguagucaccagauaucagucaauaauauuugcuugcucaagcauacccagacaggcacaccaacccggauaaccaaguuagacaaaguugugagcgguuucagcuugaagucuugugcacuuuccaauuuggcuuguauacgugauauuuuuccgaacaccguuuuugccgacagcaacauugacucuguaauggcccccgaugcauuugugugcggucgaauuuguacgcaccauccuggcugucuauucuuuacuuucuucagucaggaguggccaaaggagucucagaggaaucugugcuugcuuaaaacuucggaguccggacuaccauccacuaggauaaagaagucgaaggcccucaguggguucucccugcaauccugucggcacuccaucccagucuuuugccauagcuccuucuaccacgauacugacuuucugggcgaagaacuugacauuguggccgccaagucacacgaagccugccaaaaacuuuguaccaacgcugugcguugucaguucuuuacguacacgccugcacaggcaucauguaacgagggaaaaggaaaauguuauuuaaaacuuagcucaaauggcagcccaacgaaaaucuuacacggaaggggcggcaucucaggguacacucugagacuuugcaaaauggauaaugaaugcacaacgaagaucaaaccaaggauagucggaggaacagccaguguccgaggagaauggccguggcaagugacucuacauacgacuagcccuacgcagcgccaucugugcgggggcuccauuauuggcaaucaauggaucuugacagcugcccacugcuucuacggcguggagucgcccaaaauucuucggguguauagcggaauccuuaaucagucagagauaaaggaggauacuagcuucuuuggcgugcaggagaucauaauucaugaccaguauaagauggcagaaucaggauaugauauagcccugcuaaaauuggagaccacugugaauuacacugauagccagcggcccauuugccugccgucuaaaggagaucguaacgugaucuauacugauuguugggucacgggauggggcuacagaaaacuucgggacaagauccagaacacucugcagaaggccaaaauuccccucgugaccaacgaagagugucaaaagcgcuaccgggggcacaaaaucacccauaagaugaucugugccggauacagggaggggggaaaggacgcauguaagggagauucuggcgggccacugucuuguaaacacaaugaaguauggcaucugguggggaucacuagcuggggggaaggcugcgcccagcgcgaacgcccuggaguuuacacuaacgugguagaauacguugauuggauuuuagaaaagacucaggcuguauag

SEQ ID NO: 4843 - RNA, 1878 nt, Artificial Sequence
  Description of Artificial Sequence: Synthetic coding sequence
augauauuuuuauaccaaguugugcauuuuaucuuguucacaucagugucaggagagugugucacccagcugcugaaagacacuugcuuugaaggaggugacaucaccaccgucuucaccccuucagcaaaguauugccaggugguguguaccuaccacccucggugucugcuguuuaccuuuacugccgaauccccuucagaagauccuacgagaugguucacauguguacuuaaagacuccgucacugagaccuugccaagaguuaaccgcacagcagcgauauccggcuacuccuucaaacagugcagccaucagauauccgccuguaacaaagauauuuacgucgaucuggacaugaaaggaauuaacuacaauaguagcguugccaaauccgcccaggagugccaagagcgcugcacugaugauguccacugccacuucuucacuuacgccacacgccaauuucccucacuggaacacagaaacaucugucugcugaagcacacucagacuggcacccccacacguauaaccaaacucgauaagguuguuuccggcuucucacuuaaaucuugugcccucucgaaccuggccuguauaagggacaucuucccaaauaccguguucgccgacucuaacaucgauagcgugauggcacccgacgccuucguuuguggacgaauuugcacccaccacccuggaugucuguucuuuaccuuuuucagccaggaguggcccaaggagucgcagcggaaccugugccugcugaagacaucagagucuggccugccaagcacccgcaucaagaaaagcaaagcccucagcggguuuucauuacagucaugccgacacucaauucccgucuuuugucauagcucuuuuuaccaugauacugacuuccugggagaggaacuggacaucguggcagcuaaaagucacgaagcuugucaaaaauuauguaccaaugccgugcgcugccaguuuuucacauacacaccggcucaggcguccugcaacgaggggaaaggaaaguguuaccuuaagcuuagcaguaacggcuccccaaccaaaauacugcacggacgcgguggcauuucuggcuacacgcuucgccuguguaaaauggacaaugagugcaccacaaagaucaaaccacggaucgugggcggcaccgccucgguccgcggcgaguggccguggcaggugacacuccacacaaccucgcccacucaaagacauuugugcgggggcagcaucauaggcaaccaguggauucucacagcugcacacuguuucuacggcgucgagucaccaaaaauacuccgugucuauagugggauucugaaucaguccgagauaaaggaagauacaaguuuuuuugggguccaggagaucauuauucaugaucaguacaaaauggccgaauccggauaugacauugcauuacugaaacuugaaaccacggucaauuacacagauucccagaggccuauuuguuugccaaguaagggcgauagaaaugugauuuacacagacugcugggugaccggauggggauacagaaaacugagggauaagauccagaauacucugcagaaggcgaagauaccccuagugacuaacgaagagugccagaagcgguaccgcggacauaaaaucacacauaaaaugauuugcgcaggauacagggaggguggcaaagaugccugcaagggugacaguggcggcccccucucuuguaagcacaacgaaguguggcaccugguuggcaucacaucguggggagaaggaugcgcccaaagggagaggccuggggucuacacaaauguaguggaguacguugacuggauccuugagaagacacaagcuguguag

SEQ ID NO: 4844 - RNA, 633 nt, Artificial Sequence
  Description of Artificial Sequence: Synthetic coding sequence
uaaucuggauucucucugaaaucuugugcucugucaaaucuugcuugcauacgcgauaucuuccccaauacugucuucgccgacucuaacaucgauucuguaauggcccccgaugcuuucgucuguggacggauauguacccaucaccccgggugucuuuucuuuacauucuuuagucaggaguggcccaaagaaucccagcguaaucugugcuugcugaagacaucugaaucaggcuuacccucgacgcggauaaagaaauccaaagcacuuaguggauucucgcugcagucuugucggcauucuaucccugucuucugucauagcagcuuuuaucacgauacggauuuucugggcgaggaacuggacaucguggccgcaaagucccacgaagcgugucagaaguuaugcacaaacgcagugcggugccaguucuuuacguauacccccgcccaagcaucgugcaacgagggaaaggggaaguguuauuugaagcuguccucuaauggcucaccaaccaagauccugcacgguagagguggcauaucaggcuauacacuccgccucuguaaaauggacaaugaacugaggggagcaccaaugaaaauaucuggcuggcuuaaaacaucguag

SEQ ID NO: 4845 - RNA, 8835 nt, Artificial Sequence
  Description of Artificial Sequence: Synthetic coding sequence
augacauugcgucuccugguugcugcucugugugccggaauccuggcagaagccccacgugugcgcgcccagcacagggaacggguuacuugcacccggcuauacgcagcagauauagucuucuugcuggacggcaguuccagcaucggccgcaguaauuuccgggaggucagaagcuuccuggaaggccucgugcucccguuuagcggggcggcuagcgcgcaaggcgugagauucgccacaguccaauauucagacgaccccaggacugaguucggccucgacgcccugggaucgggcggggacgugauuagagcaauacgagaacugucuuacaagggugggaauacacggaccggagcagcuauccuucaugucgccgaucauguuuuucucccccagcuugcccggcccgggguaccaaaaguuugcauacugaucacagacggaaaaagccaggaccucgucgauacagcugcgcagaggcugaagggccaaggagugaaacuguucgccguugguauuaaaaaugcagacccagaggagcugaagcggguggcaucucagcccacuucagacuucuucuuuuuugugaaugauuucucaaucuuaagaacuuuauugccccuggugagucggcgggucugcacaaccgcgggcggggugcccgugacuagaccgccugacgacucaacauccgcaccaagagauuuaguucuuagugagcccagcagucaaagucugcggguccaauggacggcagccuccggaccaguuacuggguauaaggugcaguauaccccccugacuggacucggucagccccucccuucugaacggcaagagguuaauguaccggccggcgagacaucaguucgccuuagaggacuucggccccucacagaguaccagguaacagugaucgcucuguacgcaaacagcaucggagaggccgugucugguacagcaagaacaacugcccucgagggcccagagcucacuauccagaauacuacggcacacagucugcucguagcguggcggagcgugccuggugcuacuggauaccgagugacguggagagugcuuagcgguggccccacccagcaacaagaacuuggaccuggucaggguagcguacuguuaagggaccuggaaccaggaaccgauuacgaggucaccgugucaacgcucuucggccggucugugggacccgcuacuucuuugauggcacgaacagaugcguccguggaacagacucugagaccuguuauucuagggccaacauccauucuccugucuuggaaucugguuccagaggcgagggguuaucguuuggaguggaggagggagaccggucuggagccaccacagaagguggucuuacccuccgacgugacgcgcuaucagcuggacggauuacagcccgguacugaauauagacugacucuauacacgcugcucgagggucacgaagucgccaccccagcuacaguaguuccgaccggacccgagcugcccgucuccccgguaaccgauuugcaggcaacugaacuucccggacaacgcgucagagugucauggucccccguaccaggagccacacaguacaggaucauagugaggucgacucaggggguggaacgcacccuggugcugccugggucucaaacagccuuugaccuggacgacguccaggcgggccugucuuauacugugagggugagugcuagaguuggaccgagggaagggagcgccuccgugcugacugucaggagggagccggagacaccacuugccgugccaggcuuaaggguugugguuagcgacgcaacacgggucagagucgcauggggacccgugccaggcgccaguggcuuucggaucaguugguccacgggcagcggcccugagagcucccagacuuuaccccccgacuccacagcuacagacaucacagggcuccagcccggaacaaccuaccaggucgcagugaguguacucagagggcgugaagagggacccgccgccgugauagucgcccguaccgauccacuggggccaguuaggacaguucaugugacgcaggcuucuaguucuucuguuacuaucaccuggacuagaguucccggggccacuggcuaucgcgugucuuggcacagcgcgcacggccccgaaaaaagccagcuggugaguggggaggcaacuguugcugaacucgacggacucgagccugauaccgaauacaccguacacgugcgagcacacguggcugggguggacggaccccccgccaguguggucgugagaacagcaccugagccaguuggacgagugucccgguuacagauacugaaugccagcuccgauguccugaggaucacuugggugggcguaaccggcgcuacugccuaccgacuggccuggggucgcucagaaggcgggccaaugaggcaccaaauucugccugggaauacugacagcgccgagaucagggggcucgaaggcggaguaucauacagcgugcgcgugaccgccuugguaggggaccgggaggguacuccggucucuaucguggucaccacucccccggaagcgcccccagcauuaggaacacugcacgugguccagaggggggagcacucucuccgauugcggugggagcccguucccagagcccagggauuccugcuccacuggcaaccugaaggcggccaggaacaaucccgcguguuagggccugaauuauccucuuaccaucucgacggcuuagaaccggccacgcaguaucgaguacggcuuaguguccugggucccgcuggagagggcccuuccgcugaaguuaccgcgcggacugagucuccccgcgugcccuccaucgaauugagggucguggacacgucuaucgauaguguuacguuagcauggacccccgugucuagagccucuuccuacauccugagcuggagaccauugcguggaccuggccaggaagugccgggaaguccacagacacuaccuggaauuucaagcucucaaagaguuacuggacuggagccuggcguuuccuacaucuuuucacugacacccgugcuagauggagugcgcggaccagaggccuccguuacccaaacuccaguguguccccggggccuggcggacguuguauuucucccacacgccacgcaggacaaugcucauagagcagaggcaacuaggcggguacuggagcgccuggugcucgcucuuggcccacugggaccccaggccguacaggugggacuccugagcuacucucaucggccuucaccccucuuuccacucaaugggucucaugaucuaggcauuauacugcagaggauccgggauaugcccuauauggacccuagcgggaauaaucuugggaccgcaguugugaccgcucaucgauacauguuggcgcccgaugcuccuggcagaaggcagcauguccccggugugaugguccuguuggucgaugagccauuaagaggggauauuuucuccccgauccgagaagcccaggcuucaggccugaacgucgucaugcuggggauggccggcgcggacccugaacagcuucgccgacuggcgcccggaauggauuccguucagaccuuuuucgcuguggacgauggucccucucuggaucaagcgguuaguggguuggcuaccgcacugugucaagcauccuucacuacacagccucgcccugagcccugccccguguacuguccaaagggucagaagggcgagccaggggagaugggauugagaggccagguagggccaccaggagacccagguuuacccgggaggacaggggcucccggcccccaagggccuccggggagcgcaaccgccaagggcgagagaggguuccccggcgccgacgguagacccggauccccagggagggcuggcaaucccggaacccccggugcuccuggucugaaaggcucaccaggccucccugggccucgaggugaucccggugagcgagguccucgcggcccaaagggagagccuggcgcucccgggcaggugaucggaggcgagggccccggccuccccgggcgcaaaggagacccgggaccuucuggcccuccugggccccggggaccuuuaggggauccagggccaaggggaccuccaggacuuccaggcacagcaaugaagggagauaagggcgauagaggagaaaggggcccccccgggccuggcgaggggggcauugccccuggggagccaggccugccgggcuuacccggaucaccggggccucaagguccaguaggucccccuggcaagaaaggagagaaaggugauuccgaagacggugcccccggauugccaggacagcccggaagccccggcgagcagggcccucggggcccucccggcgccauaggcccgaaaggcgauaggggguucccagguccacugggcgaggcuggcgaaaagggcgagcgcgguccaccuggcccagcuggaagccgaggcuugcccggaguugcugguagacccggagcuaaaggccccgaggggccccccggaccgacuggcaggcaaggggaaaaaggagagcccggaagaccgggggacccugcagugguagggccagcugucgccggaccuaaaggcgaaaagggagaugugggcccugcaggaccucgcggcgccacuggugugcagggagagagagguccaccuggccuagucuugccuggcgaccccgggccaaaaggugauccgggagacagggggcccaucggacucacaggccgcgccgggcccccuggagauagcggucccccaggggagaaaggcgacccggggcgaccugggccucccgggccugugggaccgaggggccgagauggcgaagucggagagaaaggugaugaaggccccccaggcgacccuggccugccuggcaaagccggugaaagaggccuuagaggagcucccgggguuagaggcccggugggggaaaagggagaccagggagauccaggcgaagaugguagaaaugguucuccagggaguagcggaccuaagggggauaggggcgagcccggccccccggggcccccuggccggcucguugacaccgguccuggcgccagggagaagggcgaaccaggugaccguggacaggagggacccagagggccaaaaggugaccccggucuuccaggcgcgccaggcgaacggggcauugagggcuuuagaggaccgccagguccccagggagacccuggaguccgcgggcccgcaggggagaaaggcgaccgagggcccccuggcuuagacggaaggagcggcuuagauggaaaaccuggagcggccgguccgucugggccuaacggagccgcagguaaagcuggggauccaggccgugauggccugccaggucucaggggggagcaagggcugccuggcccaucuggcccaccaggccuuccgggcaagccuggggaggacgguaaacccggguugaauggcaagaacggcgaaccaggagauccgggcgaggacggcagaaaaggggagaaaggagacaguggagcgagcgggcgggagggacgggacggccccaaaggagaacgaggcgcucccggaauuuuggggccucagggucccccgggguugccaggcccaguggguccuccuggccagggguuccccggcgugcccgguggaacgggaccgaagggcgacagaggagagaccggguccaagggugagcagggucuuccaggggaaagggggcugaggggggagccgggaucugugcccaacgucgacagauugcuggagaccgccgggauuaaagcgucggcucuaagggaaaucguggaaaccugggacgagucuuccggcagcuuccucccugugcccgaacgccgcaggggaccuaaaggcgauuccggugagcaggggcccccuggcaaagaaggcccaaucggauucccaggcgaaagaggacucaaaggggaccggggcgacccagggccgcagggaccacccggacuggcccuuggcgaacgcggucccccuggucccuccggccucgcaggggaaccuggcaaaccgggaauccccggacugccagguagagccggggggguuggagaggccggucgucccggagagagaggggagcgaggcgaaaagggcgagcggggggaacaagggcgcgaugguccuccugggcugccuggcacuccuggcccuccugguccacccgggccaaagguuucagucgaugagccaggaccaggacugagcggagaacaggggccaccuggguugaagggggcuaagggagagccuggaagcaacggggaccaaggcccaaagggagacaggggaguacccggaaucaagggcgaucguggggaaccuggaccucgcgggcaggaugggaauccaggguuacccggggagaggggaauggcugggccagaaggaaagccuggccuucagggcccucgggggccacccggcccaguggguggucacggugaucccggaccaccaggggcaccgggucucgcuggaccugcuggaccccaaggcccaucaggccuuaaaggagagcccggagagaccggucccccaggcagaggccuuaccgggccuacuggggccguuggacuuccugguccucccggacccagcggacuggucggcccacaggggaguccaggauugccaggccagguuggagagacaggcaagccaggagcaccugggagggacggggcuaguggaaaggacggagauaggggcucacccggcgugcccggcucucccggccugccaggaccuguggggccgaaaggagagccugggccgacuggcgcucccgggcaagcugucgugggguuaccaggugcaaagggcgaaaagggcgcaccugguggacuagccggugaccuggugggcgagccaggggccaagggcgauaggggcuugccugguccccguggggaaaagggggaggcgggaagagcuggcgagccuggggacccuggcgaggacgggcaaaaaggcgcuccaggccccaagggcuuuaaaggggaccccggggugggcgugccagggucaccaggcccccccggaccucccggaguuaagggcgaucucggauugccagguuuaccgggagcucccggaguugugggauuucccggacagacagguccuaggggcgagaugggacagccuggccccagcggugagagaggacuugcaggcccccccgggcgggaagguauaccuggcccacugggacccccuggucccccuggaagcguggguccaccuggagccucaggucuaaagggcgacaaaggcgacccuggaguugggcucccggggccuaggggugagcgaggugagccuggcauacggggugaagacgggcggccuggccaggagggcccuagaggacugacggggccgcccgguucccgcggagaacgcggggaaaagggagacguggguuccgccggccucaagggcgauaaaggagacagcgcugucauucugggaccuccuggcccuaggggugccaaaggugacaugggggagcgggguccacgcggccucgacggcgauaaagggccacgaggugacaacggcgacccuggggauaagggcuccaagggugagcccggggauaaaggcucggcuggguuacccggacuccgcggacugcugggaccccagggucagccuggagcugcuggcauccccggcgacccaggcuccccuggcaaagacggugugcccgggauucggggggaaaagggcgacgugggcuuuaugggaccaagagggcugaagggugagagaggagucaagggugccuguggcuuagacggggagaaaggagacaaaggugaggccgggccucccgggagacccggauuggccggacauaagggggagaugggagaaccaggaguucccggccaaagcggcgcuccaggcaaggaaggccugauugggccaaagggagaccgcggcuuugacggccagccugguccgaaaggagaccagggugagaaaggugaaagagguacacccggcauuggaggcuuuccaggaccaucagguaaugacggcuccgccggcccuccggggccccccggcuccgugggcccccgcgggccagaagggcuucagggccaaaagggggaacgaggcccaccuggugaaagaguagucggggccccggggguccccggcgcuccuggggagaggggcgagcaagggcgcccagggcccgcaggaccacggggcgagaagggggaagccgcucugacagaggacgauaucagaggguuuguacgacaggaaaugucucagcauugugcuugccagggucaguuuauugccucaggaucgcguccucucccauccuacgccgcugauacggcagggucacaacugcaugcggugccagucuuacgagucucccaugcugaggaagaggaaaggguuccucccgaggacgaugaauacagugaguauagcgaauacucuguggaggaauaccaggaccccgaggcgccaugggacucugacgacccaugcagccucccccuggacgaggggagcugcacagccuauacccuacggugguaucaccgagcaguaaccgggaguacugaggcgugucauccuuucguguacgggggaugcggaggcaaugccaacagauucgguaccagggaggccugugagcggaggugcccuccccgcguaguccaaucucagggcacugguacugcccaggacuag

SEQ ID NO: 4846 - RNA, 8739 nt, Artificial Sequence
  Description of Artificial Sequence: Synthetic coding sequence
augacacugcgccuacugguggcugcccugugugcugguauuuuagccgaggcuccuagggugagggcccagcaccgugaaagaguuacauguacccggcuguacgccgcagauaucguauuccucuuggacgguucuuccucuaucggcaggucaaauuuucgugagguuaggagcuuucucgagggucuugugcugccuuuuucuggggcugcguccgcccaggggguuagauucgcaaccgugcaauauuccgacgacccacggaccgaauuugggcuugacgcccucgggucaggcggcgacgugauccgcgccaucagagagcugucuuauaaaggcggcaauacacggacaggcgcggccaucuuacaugucgccgaccacgucuuucuuccccaacuggccagaccuggugucccuaagguaugcauucucauuacagauggaaaaucucaagaucuggucgauaccgccgcccagagacugaaggggcaaggcgugaaacuguuugcgguggguaucaaaaacgcugaucccgaagaacucaaacguguugccucccaaccuacgucggacuucuucuucuucgugaaugacuuuagcauccugagaacucugcucccucugguguccaggcguguuugcacuaccgcagguggcgugccagugacucgccccccugaugacuccacaucagccccucgugaccuuguucucagcgaacccucaucucaaucacuucgcguucaguggacagcagcaucugggccgguuacgggauacaagguccaguacacaccacugacaggccugggccagccccuuccuuccgaaagacaggagguuaacgugccugcuggugagacguccgugcguuuaagaggucuucggccgcugacugaauaucagguuacggugauugcucuguaugccaauagcaucggggaggcggugucuggcacugcucggaccaccgcauuggaaggccccgaacugacaauucaaaauacuaccgcccacucucuauuaguugccuggagaucggugccuggggccacugguuaccgcgugacguggcgcgugcuuucggguggcccuacgcagcaacaggaacucgggccugggcagggcagcguccugcugagagaccuggaacccgguaccgauuacgaagugacaguuucuacucucuuugggaggucagucggccccgcuacuagccuaauggcgcgaaccgaugcuagcguggaacagacucugcggccugucauucugggacccaccaguauccugcuaagcuggaaccuagucccugaagcacgcggcuauaggcucgaguggaggcgugaaacuggguuggagcccccacagaaaguggugcugccaucugauguuacccgcuaccagcuggacggacugcagccagggacugaauaccgauugacauuguacaccuugcucgagggucacgagguggcuacaccugcaacggugguuccuaccggccccgaacugccuguaucccccgugacugauuugcaagcgacggagcuuccuggacagcgcgucaggguaucauggucuccugucccuggggccacccaguacagaaucauagugagaucgacucaaggcgucgagagaacccuggugcuucccgggagccagaccgccuuugaccuggaugaugugcaggcaggcuugaguuauaccgucagggugagcgccagaguuggaccaagggagggcagcgcuuccguucucacugugcggagagagccagagacuccccuggcagucccuggucugcggguggugguguccgacgccacccgugugcgcguggcauggggcccagugccuggagcaagugguuuccgcaucucguggucuacaggauccggcccugaguccucacagacucuaccuccagauucaacggccaccgauaucacuggucuccaaccuggaaccacguaucaaguagcgguaucaguucugcguggaagggaggagggaccugcggccgugauaguagccagaaccgauccauuggggcccguaaggaccgugcacguaacucaggcauccuccagcucuguuacaauaacauggaccagagugcccggcgcaacuggguaccgcguguccuggcauucugcccacggcccagaaaagucgcagcucguuagcggggaggccaccgucgccgagcuugauggccuggagccagauacagaauauacagugcaugucagggcucacguugccggcguagaugggccccccgcaucuguuguggugcggaccgccccagagcccguuggccgggucagcaggcuacagauucugaacgcuucguccgacgugcugcgcaucacaugggugggagugacaggagcgacugcuuaucggcuggcauggggacgcagcgaaggcggccccaugaggcaucaaauucugcccgggaacacugacucagccgaaauccggggacuugaaggcggagucuccuauagcgugcgcguuaccgcucuggucggcgaucgggaggguacuccagugaguauugucgugaccacaccuccugaggcuccaccagcccugggaacauugcaugucguacaaagaggcgagcauucccugcgccuccgcugggaacccgugccccgagcucaggguuuccugcugcauuggcagccugagggcgggcaggagcagagccgagugcuggggcccgaacuuucuaguuaccaccucgacggguuagagccugcaacccaguauagggugcggcuaucaguccugggaccggcaggggaaggucccagcgcagaggucacagcacgcaccgagucuccacgcguaccaucuaucgagcugagggugguugacacaucuaucgauucaguuacucuggccuggacacccgugucacgagccuccagcuacauucugaguuggaggccauuacgcggaccagggcaggagguaccaggaucaccacaaacgcugcccgggaucaguuccucacagcgcgugaccggacuugaaccaggcgugucuuauauauuuucccugacaccggugcuggacggcguccgcggcccagaggcaagugugacccaaacucccgugugcccacgaggccuugccgauguaguguuccugccgcaugccacccaagauaaugcacaucgggccgaggcuacaagacggguccucgagagacucgugcuugcacuggguccgcuugggccucaggccgugcagguuggcuugcugagcuauagccaccggccuaguccucuguucccacucaacgggucacacgauuugggaaucaucuuacagaggauccgggauaugccauacauggacccaucugguaacaaucugggaacagcaguugucaccgcgcaccguuacaugcuggcccccgacgcacccggccggcggcaacaugugccuggagugaugguguuacucguagaugagccacuucggggcgacauuuuuucuccaauccgcgaagcucaagccucuggccuaaaugucgucaugcugggcauggccggugccgacccggagcaacuccguaggcuggcaccugggauggacagcgugcagacuuucuucgcaguugaugaugggccuucucucgaccaagcagugagcggccuggccaccgcacugugccaggccucauucacaacgcagccaagaccggagccuuguccaguguacugcccaaagggccagaagggugaacccggcgagaugggacugcgcggucaggugggaccuccaggggauccuggauugcccgggaggacuggggcaccagguccccaggggccaccuggaucugcaaccgccaagggcgaacguggguucccuggggcugauggcaggcccgguucuccuggaagagcggggaauccgggcacuccuggagccccaggacugaaggguagucccggucugccaggaccccgcggcgauccgggcgaacguggaccaagaggcccgaagggugagccaggcgcacccggacaggugauagguggagaaggucccggcuuaccugguaggaagggggauccuggaccuaguggcccuccugguccccgggggccuuugggcgacccgggacccagaggaccccccgggcugccuggcaccgccaugaagggugauaaaggagauagaggcgagaggggcccacccggccccggagaagguggaaucgcacccggcgagccaggucugcccggccuccccgguagcccagggccccagggacccguagggcccccaggcaaaaagggagaaaaaggcgacucugaggauggagccccuggauugccugggcagccugggagcccuggcgaacaggggccacguggaccgccgggggccaucggcccuaaaggcgaccgcgguuucccggggccccugggcgaagccggggaaaagggggagcggggcccgccuggcccugcgggaucucgcggccugcccgggguggccggacggcccggcgccaaggggccugaagguccuccuggcccaacaggcaggcagggugagaagggcgaaccgggaaggccaggugacccagcuguagucggcccugccguggccggccccaaaggcgaaaagggcgauguggguccagccggcccuagaggggcgacagggguucaaggcgagagggggcccccugggcucguacugcccggagauccugggccgaaaggagaucccggcgacaggggcccgauuggacugaccggcagagcgggcccccccggugacagcgggccacccggcgagaaaggggauccaggccgaccaggaccuccagguccuguggggccuaggggucgugauggagaggucggagaaaagggggacgaggggccaccuggggauccagggcuuccuggaaaggcaggugagcgcggucucaggggagcacccggaguccgcggcccuguaggggagaaaggugaccagggggauccaggugaggauggacgaaauggcaguccugggagcucuggacccaagggagaccgaggcgaaccagguccuccaggccccccuggccgccucguggauaccggccccggagcaagagaaaaaggcgagccaggagauagaggacaggagggcccucgcggcccaaagggggaucccggccuucccggagcccccggagaacgcggcaucgaaggauucaggggcccaccugguccgcaaggggacccaggggugcguggcccugcuggugaaaagggagaucgcggacccccugggcuggaugggcgcuccggccuggauggcaagccgggagccgccggaccauccggccccaacggggcugcugguaaagcaggggacccgggccgagacggacucccagggcugagaggcgagcaggguuugccagggcccuccggaccaccuggacuuccagggaaacccggggaggauggaaaaccgggccucaauggcaaaaacggcgaaccuggcgaccccggugaggauggaagaaagggcgagaaaggagacagcggcgcuucagggagagagggguucccaggagugccugggggcaccgggccuaagggugaucgcggggagacuggaucuaaaggcgagcaaggucuaccgggugaaagggggcugcgcggcgaaccuggaucugugcccaauguggaucgcuugcuggaaacugccggaauaaaagcuuccgcgcuucgggagauuguggaaacuugggaugaaucaagcggcucauuuuuacccgucccugaaaggagaagagguccaaagggugauaguggagaacagggcccuccaggcaaagaaggcccaaucggguucccaggagagcguggacuaaagggugauagaggagauccggguccucaggggccgccaggacuggcccuuggagagcgggggccucccggacccagugggcuggccggagagccgggcaagcccggcauuccgggccucccuggccgggcagguggcguuggugaggccggcagacccggggaaaggggugagcgcggggaaaagggggagcggggugaacaggguagggaugggcccccuggguuaccuggaacgccuggcccgccagguccuccugguccuaagguuucagucgacgaaccaggucccggacuguccggagagcagggccccccuggccugaaaggugcuaaaggggagcccgguagcaacggggaucagggaccuaaaggggacagaggggugccagguauaaaaggggauaggggggagccugggccacggggccaggacgguaaucccggucugccuggcgaaagaggcauggccggaccugaggggaaaccgggacugcaggguccucgcggaccaccagguccggugggggggcacggggauccuggcccgccuggcgcaccgggguuagcaggaccugcaggcccgcaagggccuagcggucucaaaggcgaaccuggagaaaccggcccgccaggccgcggccucacuggucccacuggugcggugggccugccugguccuccaggccccagcggguugguugggccucagggcagucccgguuuaccagggcaaguaggcgagacaggaaaacccggagccccugggagagauggugcuucuggcaaagauggcgaucgcggaaguccaggagugccuggaagcccugguuuacccggaccugugggcccuaaaggggaaccuggaccuaccggagcccccggccaagcaguagucggucuacccggagccaaaggcgaaaagggagcccccgguggucucgccggggaccuggugggagaaccaggagcuaagggugauaggggccuccccggaccacguggagagaagggagaggcuggcagagccggcgagcccggcgacccaggcgaagauggacaaaagggcgcacccggacccaaaggguuuaagggggauccaggagugggcgugccuggaucuccagggcccccagggcccccugggguuaaaggugaccuugggcugccagggcuuccuggggcucccgggguggugggcuucccuggccaaacuggcccaaggggggagauggggcaaccuggacccucaggagagcgcggccuggccggaccccccggucgugaggggaucccaggcccccugggccccccaggcccccccggcucaguuggcccacccggagcuucuggguugaaaggagacaagggcgaucccggugucggucuuccagguccgcggggagaaagaggugaacccggaauucgaggcgaggacggccgccccggccaagagggcccccggggucucacaggcccccccggguccagaggggaacggggcgagaagggggauguagguucagccgggcugaaaggggauaagggugacagugcagucauucugggcccaccaggaccgcgcggcgccaagggugauaugggugagcgagguccacgcggacuugacggugauaagggaccucguggcgacaauggcgaucccggcgacaagggcaguaaaggagagcccggagauaaaggcucagcaggauugccuggguugagaggauuacugggaccacagggacagccuggcgccgccgguauccccggugauccaggaaguccaggcaaagacggcgugccggggauccggggcgaaaaaggggacguuggguuuauggguccgcgcggauuaaagggggaaaggggcgugaaaggggccugcgggcuggacggagaaaaaggcgacaagggugaggcaggaccuccuggcaggcccggccucgcgggacauaagggggagaugggggagcccggcguccccggccagucuggcgcgccaggcaaagaaggacuuauugguccuaagggugaccggggauucgacggccaacccgguccuaaaggcgaucaaggagagaaaggcgagagggguaccccaggcauuggcggcuuuccagggcccucgggaaacgauggaucagccggacccccuggcccaccaggcagcguggguccaagaggacccgaggggcuucaaggccagaaaggagaaaggggaccaccuggugaaagagugguuggggcccccggcgugccuggagcucccggggaacggggagagcagggccgcccaggaccugccgggcccaggggugagaagggagaggcugcguugaccgaggaugacaucagaggcuucguccgccaagagaugucccagcacugcgccugccaggggcaguucaucgccucagguagucguccucugccgaguuaugcagcggacacugccgggucccaacugcacgcugugccugugcugagagucucccacgcagaggaggaagagcgggugcccccagaggacgaugaguacucugaauacagugaguauucuguggaagaauaucaggauccggaagccccaugggacagcgaugaucccugcucgcugccucucgaugagggcagcuguacugcuuauacucuccggugguaccaccgugccgugacuggcaguacugaagcuugucaucccuuuguuuacggcggauguggcgguaacgccaaucgcuucggcacacgcgaggcaugugaaagaagaugcccacccagaguuguccagucccaaggaaccggaaccgcccaagacuag

SEQ ID NO: 4847 - RNA, 435 nt, Artificial Sequence
  Description of Artificial Sequence: Synthetic coding sequence
auguggcugcagucacuucuacuccuuggcaccgucgccugcucuauauccgccccugcacgguccccaagcccaucaacucagccaugggagcacgugaacgcaauccaagaggccagaagacuguugaaccuuagcagagauaccgccgccgaaaugaaugagaccguggaggugaucagcgagauguucgacuuacaagaaccaaccugucugcagacacgauuggagcuuuacaagcaaggauuacgaggcucacugacaaaacuaaaaggaccccucaccaugauggccagucauuauaagcagcauuguccucccaccccagagaccaguugugccacgcagauuaucacuuuugagaguuuuaaggaaaaucucaaagauuuccuucugguuauuccauuugacuguugggagcccguucaagaguag

SEQ ID NO: 4848 - RNA, 603 nt, Artificial Sequence
  Description of Artificial Sequence: Synthetic coding sequence
auguccccugaaccagcccucagcccugcacuacaacugcuuuuguggcacagcgcucucuggacaguucaggaggcaacaccccugggacccgcauccucuuuaccacaaucuuuucugcugaagugccuggaacaagugcgcaaaauccaaggcgauggcgcugccuugcaggagaaacugugugcaacuuacaaguugugccaccccgaagagcucguuuuauugggacacucucuggguauuccaugggcgccccucucaagcuguccuucccaggcccugcaacuagcuggaugccuuucccaguuacacucaggguuguuuuuguaucagggguugcuccaggcacuggaggggauaucaccugagcucggcccgacccucgacacgcuucagcuggacgucgccgacuucgccacuacaaucuggcagcagauggaagagcuuggcauggcgccugcacuccagccuacucagggggcuaugccugcuuucgcuucagccuuucaaaggagagcaggaggaguuuuaguggcuucccaccuucagagcuuccucgaggucagcuaccggguucugcggcaucuggcucaaccauag

SEQ ID NO: 4849 - RNA, 516 nt, Artificial Sequence
  Description of Artificial Sequence: Synthetic coding sequence
auggcggguccugcuacacaguccccaaugaaacugauggcucuccaguuacugcuguggcacucggcccuuuggacuguucaggaggcuaccccccugggccccgcuaguucccuuccccaaagcuuuuuacugaaaugccuggaacaggugcggaagauccaaggcgacggcgccgcucuccaggagaaauugguauccgaagcugguugucucagccaguugcacucuggucuguuuuuauaccaaggguugcugcaggcccuugaaggaauuucucccgagcugggaccuacgcucgacacucuccagcuggauguggcagacuuugcaacuacuaucuggcagcaaauggaagaacuggggauggccccagcacuccagcccacacagggggccaugccggcuuucgcuucugccuuccaaagacgagcaggagguguguuggucgcuucccacuuacaauccuucuuagaggucucauacaggguccuacgacaucuggcacaaccuuag

SEQ ID NO: 4850 - RNA, 615 nt, Artificial Sequence
  Description of Artificial Sequence: Synthetic coding sequence
auggcaggaccugcuacucaaagcccaaugaaacuuauggcccuucagcuauuauuguggcacuccgcgcucuggaccguucaggaggccaccccucucggcccugcaagcucccucccucagaguuuccuacuuaagugcuuagagcaaguccgcaaaauucagggcgauggagcugccuuacaggaaaaacugugcgccaccuacaaauuaugucauccggaggagcugguacuucucgggcauucccugggaauuccaugggcuccacucagcucuuguccaagucaagcauugcaauuagcugggugccuuucucagcugcauucaggccuguuucucuaucaaggguuguuacaggcucuagagggcauuagcccagagcugggaccuacccucgacacacugcaacuugauguugccgauuucgcaacaacgaucuggcagcaaauggaggaacugggcauggccccagcucugcagccaacccaaggagcaaugccugccuucgcaagcgccuuccaacgcagagcuggcggcguguugguggcuucccaccuccaguccuuucuagaaguaucuuaccgggucuugagacaucuggcccagcccuag

SEQ ID NO: 4851 - RNA, 3696 nt, Artificial Sequence
  Description of Artificial Sequence: Synthetic coding sequence
augagauuguuagccaaaaucauuugcuugaugcucugggccauuugcguagcugaagauuguaaugaacugccaccaaggcgcaacacagagaucuugacuggcaguuggucagaccagaccuauccugaaggcacccaggcuaucuauaagugcaggcccggguaucgcuccuugggcaacgugauuaugguaugucgcaaaggggaguggguugccuugaauccccugagaaagugucagaagcgacccuguggucauccgggugacacccccuuugggacauuuacacugaccggagggaacguguuugaguacggcgucaaagcaguguacaccuguaacgagggcuaucaauuacuuggagagauuaauuacagggagugcgacacugauggcuggaccaacgacauaccuauuugugagguggugaagugccuuccagucacagcgccagaaaaugguaaaauuguuuccagcgcgauggagccugaucgggaauaccacuucggccaggcugugagguucgucugcaacagcgguuacaaaauugagggggacgaggagaugcacuguuccgacgaugguuuuuggucuaaagaaaagcccaagugcguugaaauaagcugcaagagcccggaugugauaaauggaagcccaauuagccaaaaaauuaucuauaaggagaaugagcgcuuucaguacaaaugcaacaugggcuacgaguacagcgagaggggagacgccgugugcacugagagcggauggaggccucuaccaaguugcgaggaaaagaguugugauaacccauauaucccuaauggcgauuauagcccccugagaaucaagcaccguacaggcgacgaaaucacuuaucaguguagaaacggauuuuauccagcaaccagaggcaauacugccaaguguacuucaaccggguggauuccugcuccccgcuguacauugaagccaugcgacuauccagauaucaagcacgggggacucuaccacgagaauaugcggcgucccuauuuucccguggcagucggaaaauauuauuccuacuacugugaugagcauuuugaaacaccuagugguagcuacugggaucacauccacuguacacaagacggguggucaccugccguaccuugccuccggaaaugcuacuucccuuaccuggagaauggguauaaccagaaccacgggcgaaaauucguucaagguaaauccauugauguugcuugucaccccggcuaugccuugcccaaggcacagaccacagugacuugcauggagaauggaugguccccuacgccacgauguauacgcgugaagacgugcagcaaaucaucuauugauaucgaaaauggauuuauuucugagucccaguauacauaugcccugaaagagaaagccaaauaucagugcaaacucggcuaugucaccgccgauggcgaaacuuccgguucgauuacuugcggaaaagauggauggagcgcccaacccaccugcauuaagaguugcgauauucccguguuuaugaaugcgcggacaaaaaaugauuucacaugguucaagcuuaacgacaccuuagacuacgagugccacgauggcuaugaaagcaacacaggcucaacaacaggaagcauugugugcgguuacaacggauggucagacuuacccauuugcuacgagcgagagugcgaacugcccaagauugacguacaccuugugccggaccggaagaaagaccaauacaaagugggcgagguucugaaauucuccuguaagccaggguucacaauuguagggccaaauucuguucagugcuaccacuucgggcucucucccgaccugccuaucugcaaggaacaggugcagagcuguggcccaccgccugaacuguugaacgggaacgucaaagagaagacgaaggaagaguacgggcacucugaaguuguggaguacuacugcaacccaagauuucuuaugaaaggaccuaacaaaauccagugcguggacggcgaauggaccacccucccaguaugcaucguugaagaauccacguguggggauauccccgagcuggagcacggcugggcccaacugucuucaccucccuauuauuauggcgacagcguugaauucaauugcuccgaaucguucacaaugaucggacauagauccaucacuugcauccacgguguauggacccagcugccccagugcguugccaucgacaaacuuaaaaaaugcaaaaguucaaauuugauuauccucgaggagcaccuuaagaauaaaaaagaauucgaccacaacagcaauauccgguauagaugucgaggcaaggaaggcuggauucauacggugugcauuaacgggaggugggacccagaagugaauuguagcauggcccaaauccagcucugcccuccaccgccacaaaucccaaauagccauaauaugaccacaacgcucaauuaccgugacggugaaaagguaagcgugcuaugccaagaaaacuaccuuauucaggaaggugaggagauuacaugcaaggacgggcgcuggcagagcauaccccuuuguguggaaaagaucccaugcucgcagccaccucagauagaacauggcacgauuaacucuucccggagcucucaggagucauacgcccauggcaccaaacucucuuauacaugugaaggaggauuucgcaucagcgaggagaaugagacuacguguuauaugggcaaauggaguucucccccccagugugagggcuuaccauguaagagcccgcccgaaauuagccacggggugguggcacauaugucugauuccuaucaguacggggaggagguaacauacaaauguuucgagggauucggcauugacggccccgccauugcuaagugucucggcgaaaaguggucacauccaccaagcugcaucaagacagacugucugaguuugccuucuuucgaaaacgccauuccaaugggggaaaaaaaggauguuuauaaggccggcgagcaagugaccuauacuugcgcaacuuauuauaaaauggacggcgcuucaaacgucaccuguauaaacagccgauggaccggcaggcccacuugucgcgauaccucauguguaaaucccccaacagugcagaacgcguauaucguuucuagacagaugagcaaguacccuuccggcgagagggugcgcuaucagugcagaagccccuaugaaauguucggcgacgaggaggugaugugucuaaaugguaacuggaccgagccgccucaauguaaagacucuacugguaaguguggcccacccccaccgauugauaauggagauaucacaucguuuccacugaguguguacgcaccugcaaguuccguggaauaucagugccagaaucuguaucaacuagagggcaacaaacguauuacaugcaggaacggucaauggagcgagccucccaagugccuccacccaugcgugauuucuagggaaauaauggagaauuacaacaucgcccucagguggacagccaaacagaaacuguacuccagaacaggcgagaguguggaguuugucuguaagaggggguaucgacuaucaucacgcagucauacauugcgaacaaccuguugggacgggaagcuagaauacccuacuugcgccaagagauag

SEQ ID NO: 4852 - RNA, 1350 nt, Artificial Sequence
  Description of Artificial Sequence: Synthetic coding sequence
augcgccuccucgcaaagaucaucugccugaugcucugggccaucuguguggcggaagacugcaaugaacuucccccaagaaggaacaccgagaucuugacgggcucauggagugaucagacauacccugaaggaacccaggcuauuuacaaguguagaccuggcuaucggagucuuggcaacgugaucauggugugcagaaaaggggaauggguggcucugaacccucuaagaaagugccagaaaaggcccugcggucauccuggggauacaccauucggaacguuuacacuuacaggagguaacguguuugaauacggggucaaagccgucuacaccugcaacgaagguuaccagcuucugggagagaucaauuaccgcgaaugcgacaccgacggauggacuaaugacaucccgaucugcgagguagucaagugucuuccuguaacugcaccggagaauggaaagauugugucuucagcaauggaacccgaccgggaauaccauuucggccaggcagugcgguucgucugcaacuccggauacaaaauugagggugacgaggagaugcauugcucagacgacgguuuuuggagcaaagaaaagccaaagugcguggaaauuuccuguaaaaguccugaugugauuaaugggaguccuauuucccaaaaaaucaucuauaaagaaaaugagcgguuccaguacaaaugcaauaugggguacgaguauagugaaagaggcgaugccguguguacagagucaggcuggagaccccugcccucaugugaagagaaaagcugcgauaacccuuauauaccuaacggugacuacuccccccuucgcaucaagcaucgcacaggugacgaaaucacuuaucaaugccgcaauggguucuauccagcuacgcgggggaauaccgcaaaguguacaucuacuggcuggauacccgcaccacgaugcacccugaagcccugcgacuauccugacauaaagcaugguggccuauaucacgagaacaugagaaggcccuauuuccccguugcggucgggaaauauuauaguuauuacugugaugaacacuuugagacaccaagcggcuccuauugggaucacauccauugcacccaagaugguuggaguccagccgugcccugccugaggaaauguuacuucccauaucuggaaaauggguacaaucagaaccacgggcguaaauuuguucagggaaaaucuaucgacguggcuugucacccgggauacgcccucccgaaagcacagacaacagugaccugcauggaaaacggauggucuccuacuccacgcugcaucaggguaaucuuccagcuguag

SEQ ID NO: 4853 - RNA, 1350 nt, Artificial Sequence
  Description of Artificial Sequence: Synthetic coding sequence
augcggcuacuggccaagaucaucugccuaauguugugggccaucugcguggccgaggauugcaaugaacugccgccucggaggaauaccgagauucugaccggaucuuggagugaccagacauaccccgaaggcacccaagcuaucuacaaaugcaggcccggauaucguucucuugguaauguuaucaugguaugcagaaaaggcgaguggguggcacuuaauccucuuagaaagugccaaaaacggccuugcgggcacccaggcgacaccccuuuugggacuuuuacccucaccgguggaaauguguucgaauauggcgugaaggcuguguacacauguaacgaggguuaccaguuacucggugaaauaaacuaucgggaaugugacacugauggguggacgaaugauauuccaauuugcgaaguggugaaaugucuaccagucacagccccugaaaauggcaaaauagucucauccgccauggaaccugaccgcgaauaucacuucgggcaggccguccgguucguaugcaacuccggcuacaagauugagggugacgaagagaugcauuguagugacgauggguuuuggucaaaggagaagccuaagugcguagagaucuccuguaagucuccagacgucauuaauggcagcccuauuucacagaagauuauuuacaaagaaaacgaaagauuucaauacaaaugcaacauggguuacgaguauuccgagagaggcgaugcggugugcacagaaagcggcuggagaccacuucccucaugcgaagagaagaguugcgauaauccauacauuccaaacggagacuauucuccgcuccggaucaagcaccguacaggagacgagauuaccuaucaaugccggaauggauucuaccccgcuacucgagguaacacagcuaagugcacgucuaccggcuggauuccugccccacguugcaccuuaaaaccuugcgauuauccugauauuaaacacgguggcuuguaccacgaaaacaugagacgcccauacuucccagucgcuguugggaaauacuacucuuacuacugcgaugaacacuuugaaacccccuccgggucuuauugggaccauauacauuguacgcaggauggauggucacccgccgucccaugcuuacgaaaauguuacuuccccuaucucgaaaaugguuauaaccagaaucacgguagaaaauuuguacagggaaaaucaauugacguagcaugccaucccggcuacgcucugccuaaggcccagacgaccgugaccugcauggagaauggauggucgcccacgccucguuguaucaggguuaguuucacacuauag

SEQ ID NO: 4854 - RNA, 591 nt, Artificial Sequence
  Description of Artificial Sequence: Synthetic coding sequence
augcggcugccacugcugguuucugccggagugcugcuggucgcucuuuuaccuuguccaccuugccgggcccuguugagcagaggcccggugccaggcgcucgacaagccccacaacacccacagccccuggacuuuuuucagccuccaccucaauccgagcagccccagcaaccccaagcccgcccgguacuguuacgaaugggcgaggaauacuuccugcgacucgggaaucuaaauaaaucccccgccgccccucuuucuccagccucgucacugcuagccgggggcaguggcagcagaccuaguccggagcaggccacugccaauuuuuuuaggguccuuuugcagcagcuccucuuaccucggcgaucauuggauuccccagcggcucuggcugaacguggcgcaagaaaugcacucggcggacaucaagaggcccccgaaagagaaaggagaagcgaagaaccacccaucucccuagaucucacauuucauuuguuacgugaagucuuagaaauggcaagagccgagcaacuggcucagcaagcucacucuaaccgaaaauuaauggagaucauugggaaauag

SEQ ID NO: 4855 - RNA, 4443 nt, Artificial Sequence
  Description of Artificial Sequence: Synthetic coding sequence
augcagcgcuccccgcuggaaaaagccucggucguaucaaaacuguucuucucauggacacggccuauccugcggaagggauaccgccaaaggcucgagcugagugauaucuaccagauacccagcguagacagugccgacaaucucuccgaaaaacuagaaagggaaugggaucgugaacucgcuaguaagaaaaacccuaaauugaucaaugccuugcgaagaugcuuuuuuuggcgauuuauguucuaugggaucuuucuguaccucggcgaaguuacuaaggccgugcagccucugcuuuugggacggaucaucgccucauacgacccugauaacaaagaagagaggucaauugcuauuuacuugggaauuggccugugucuucuuuuuauaguucgaacguugcuuuuacacccagccaucuucgggcugcaccacauuggcaugcagaugaggaucgcuauguucucacugaucuacaaaaagacccuuaaauugaguaguagaguacuggacaagaucucuaucggucagcugguuagccucuugucuaacaaucucaauaaauucgacgagggccuggcucuggcacacuucguguggauugccccccugcagguggccuugcucaugggucuaauuugggaacuucugcaggcuucagcuuucugcgggcugggauuccugaucgugcucgccuuauuucaagcgggccuagguaggaugaugaugaaguaccgggaucagagagccggaaaaauuagugagcgccuggugauuacuucggaaaugauugaaaauauacagagugucaaggcauacuguugggaggaggcuauggaaaagaugauagagaaccugcggcagacugaauugaaacugacacggaaagcagccuauguccgguacuuuaacagcucugccuuuuucuucagugguuuuuucgugguguucuuguccguucugccuuacgcccugauuaaggguauaauauuaagaaagauuuucacuacuauaagcuuuuguaucgugcuccgaauggcggucacgcgucaguucccuugggcaguacagacaugguacgauucgcugggcgcuaucaauaagauccaggauuuccuccagaaacaggaauauaaaacacucgaguauaaucugaccacuacggaaguggugauggagaacgugacggcauuuugggaagaaggcuuuggggagcuuuucgagaaggccaagcagaauaacaauaaucguaagacauccaacggugacgacucccuguucuucuccaacuucagcuuacugggcacgccugugcucaaagauauuaauuucaagauugaaaggggccagcugcuagcagucgccgguuccacaggggcagguaaaacaucacugcuuauggugauuaugggcgaauuggaaccgucugaaggcaagaucaagcacuccggacggaucagcuucugcagccaauucucguggaucaugccugggacaaucaaggaaaacauuaucuuuggcguuagcuaugacgaguaucgauacagauccgugauuaaggccugccaacuggaggaagacauaucaaaauuugcugaaaaagacaauaucgugcuaggggaaggagggaucacacucagugguggucagcgcgcccgaaucucacuugcgcgggcagucuacaaagaugccgaucuguacuugcuugauagucccuucggguaccuggacguccuuacagaaaaagagaucuuugagucuugcguguguaaauugauggccaacaaaacuaggauuuuggucacuucgaagauggaacaucugaagaaggccgacaaaauuuuaauccuccacgaggguucuuccuacuuuuauggaacauuuagcgagcuccagaaccuucaacccgauuuuucaagcaagcugaugggaugcgauucauucgaucaguucagcgccgagcggagaaacucaauccucacagaaacucuccaccgguucucucuugaaggggaugccccuguuaguuggacugagaccaagaagcagagcuucaagcagacuggcgaguuuggagaaaagagaaaaaacaguauccugaauccaaucaauagcauccggaaguucagcauagugcagaagacgccccugcagaugaaugguaucgaagaggauagcgaugagccucuggaacgccggcuuucuuuggucccagacucugagcaaggcgaagcaaucuugcccagaauaagugucauuagcacaggcccgacguuacaagcacgccgucgacaaucggugcucaaucuaaugacccauucagucaaccaaggccagaacauccacaggaaaacuacugcauccacgcggaaggugucgcuggcaccacaggccaaccuuacagaauuggauaucuauagccggagacugucgcaggagacuggccuggaaaucuccgaggaaauuaaugaggaagaccugaaggagugcuuuuuugacgacauggagaguauucccgcugugaccaccuggaacacuuaccugagguacaucaccgugcacaaaucacuuaucuucgugcucaucuggugccucgugauauucuuggcagagguggcggccucccucguggugcuuuggcuguuagggaacaccccacugcaagauaaaggaaauaguacucauagucgcaauaacucuuacgcugugauuauuaccucuacauccucauauuaugucuuuuauauauauguuggcguggcagauacgcuuuuggccaugggauucuuucggggccucccucuugugcacacucugauuaccguuuccaaaauucugcaucauaaaaugcugcauucaguccugcaggcgcccaugucuacacucaacacucuaaaagcuggaggaauucuuaacagauuuaguaaggauaucgccauacucgacgacuuguuacccuuaacuauuuucgacuucauccaguugcuucuaaucguuauaggcgcuaucgcuguuguagcuguccugcagcccuauaucuuuguugcaacugucccaguaauuguagccuucaucauguugcgugcguauuuucugcagaccagccaacagcucaagcaacuugagucagaaggaaggagucccauuuuuacccaccucgugaccucccugaagggucuuuggacucuccgcgcuuucggccgucagcccuauuucgagacacuguuccacaaggcccucaaccugcauacugcgaacugguuucuguaccucagcacgcugagaugguuucagaugcguauagagaugaucuuugugauauuuuucaucgccgucaccuucauuagcauuuuaacuaccggagagggggaggggagaguuggaaucauccugacucuagccaugaauauuaugucaacccuccagugggcggucaauaguuccaucgauguagacucacuaaugaggucggucagcaggguguuuaaguuuaucgacaugccuacugaggggaaaccgacaaagaguacaaagccuuauaaaaauggccagcugaguaaagugaugauuaucgaaaauucccaugugaaaaaggacgacaucuggcccuccggaggccaaaugacggucaaggaccucaccgcuaaauacacagaaggcgggaaugccauccuggagaauauauccuucucaaucucgccuggccagaggguggguuugcuggggaggaccggcagcgggaagaguacacugcugagcgcuuuccucaggcuacucaacaccgaaggugaaauccagaucgauggagugagcugggacucuaucaccuuacaacaguggaggaaggccuucggcgugauaccgcaaaaagucuucauuuucuccggaacauuuaggaagaaccuagacccuuacgaacagugguccgaccaggaaaucuggaaaguggccgaugaggugggacugagaagcgucaucgaacaguucccugggaaguuggauuucguccugguggacggcgguuguguucugucucacggccacaagcagcucaugugccucgccagaucaguacuauccaaggcuaaaauacuauuguuggacgagccuucagcucaccuggacccuguaacuuaccagauuauaaggaggacuuuaaaacaggcauucgcagacuguacugucauccucugcgagcaccguaucgaggcgauguuagagugucagcaauuccuggugauagaagaaaacaaagucagacaauacgauagcauccagaaacucuugaacgaacgcagccuauucagacaggccauuaguccuuccgaucgugugaaacuguuuccccauagaaacucauccaaguguaagucaaagccacagauugcugcacugaaggaggaaaccgaggaggaaguacaggauacaaggcuauag

SEQ ID NO: 4856 - RNA, 4317 nt, Artificial Sequence
  Description of Artificial Sequence: Synthetic coding sequence
augcagagaucaccacuugaaaaggcaagcguagugagcaagcuguuuuucucuuggacuagaccuauucugaggaaaggcuaucgacagcgguuagaacugucugauaucuaccaaauucccucuguugauucugccgauaaucucucugagaaguuggaaagggagugggacagagagcuggcaucuaaaaaaaaccccaagcugaucaacgcacuuaggcgcuguuucuucuggagauucauguuuuacgguauauuuuuguaccuuggugagguaacuaaggccgugcagccccuucuuuuggggcguauuaucgcgagcuaugaucccgacaacaaggaagaacggagcaucgcgaucuauuuggggauugguuugugucugcuuuucauuguccguacacuccuccugcaccccgccaucuucggacuccaucauaucggaaugcaaaugagaauugccauguucaguuugauauauaaaaaaggacuggcacuugcccacuucguguggaucgccccccuccagguggccuugcugaugggccugauuugggaguuguugcaggccagugcuuucugugggcuggguuuucugaucgugcucgcccucuuccaggcaggccugggcagaaugaugaugaaguaucgggaccagagggcugggaagauuucggaacguuuaguaaucaccuccgagaugauagagaauauucaaucugugaaagccuacuguugggaggaagccauggagaagaugauugagaauuugcggcaaacggaacucaaacugacucgaaaagcugcauaugucagguauuuuaauuccagugcuuucuucuucucuggguuuuucguaguguuucucuccguacuccccuaugcacucauaaaagggaucauauugagaaaaauauuuacuacuauuagcuuuugcauugugcugcggauggcagugacccgacaguuuccuugggcuguccagacuugguaugacagucucggcgcuaucaacaaaauccaggacuuuuugcagaaacaggaauauaagacgcucgaguacaaccugacuaccacagagguggugauggaaaaugugacagcauucugggaggagggauucggagaacucuuugaaaaagcuaaacagaacaacaacaaccguaagacuaguaacggcgacgauucucuuuuuuucuccaauuucucgcugcuuggcacgcccguccuaaaagauauaaauuucaaaaucgaacgcggucagcugcuggcagucgcaggcaguaccggugccgggaaaaccucgcugcucauggugauaaugggagaacuggaacccuccgaggggaagaucaaacauucaggcaggaucucguucugcucucaguuuagcuggauaaugccuggcaccaucaaggagaauauuaucuucggugucucauaugaugaguacagauaucgcagcgugauaaaggccugccagcucgaggaagauauaucuaaguuugccgagaaagacaacauugugcugggagaagggggcauaacacugagugggggucagagagccaggaucagucuggccagagcggucuauaaagaugccgaccuguaccugcuggacuccccuuuuggcuaucuggaugugcucacugagaaggaaaucuucgaaucuugcguguguaaacugauggcaaauaaaacccgaauucuggugacaucuaagauggagcacuuaaagaaagcagauaagauacugauacugcaugaagggagcucuuauuuuuaugggacauuuagugaacuccagaaccuccaaccugauuucagcuccaaguugaugggcugugauuccuucgaucaauucucugcagagagaagaaacucgauacugaccgaaacucugcacagauuuucgcuggagggggacgccccggugaguuggacggagacgaagaagcagagcuuuaagcaaacaggagaauucggcgagaagcgaaagaacagcauacugaacccuauaaauucaauacgcaaguuuuccaucgugcagaaaaccccacuccagaugaauggcauugaagaggacagugaugaaccucuagaacggcggcucagucugguuccugauagcgagcaaggcgaggcuaucuugccccgaaucuccgugauuagcacugguccaacacugcaggccagaagacgccagucgguguugaaucugaugacacacucugucaaucagggacagaauauccacaggaaaacaacugccagcacaaggaaggucagucuugcaccacaagccaaucugacugaacuggauauauacucgagaaggcugagccaggaaaccggacucgagauaagcgaggagaucaacgaggaagauuugaaagagugcuucuucgaugauauggagucuaucccggcagugacuaccuggaauaccuaucucagauauaucaccguacacaaaagcuugauuuuuguucuaaucuggugccuggucauuuucuuagcugagguugcagcuucacuugugguccuuuggcugcuuggcaacaccccauuacaggacaagggaaauucuacacauuccaggaauaacucauacgcagugaucaucaccagcaccaguucuuacuacgucuuuuacaucuaugucggggucgcugacacucuguuggcaaugggauuuuuccgaggcuugccucugguucacacacucaucacuguauccaaaauucuucaccacaagaugcugcacucuguucugcaggcuccuaugucuacccugaauacguugaaagcuggaggcaucuugaaucgcuuuucaaaggacaucgcaauccuggacgaucugcucccucuuaccaucuucgauuuuauucagcuucuucucauagucaucggagcuaucgcaguggucgccguucuucaaccguauaucuucguagcaaccguccccgugaucguggcauuuaucaugcugcgcgccuacuuucuccaaacuagccagcagcucaaacagcuggagucagaagggaggucaccuauuuuuacucaccuggucacaucccugaaggguuuguggacucuaagagccuucggucgacaacccuauuucgagacgcuguuccacaaagcccugaaccuccacaccgcaaauugguucuuguaccugucuacacucaggugguuucagaugcggaucgagaugaucuucguuaucuucuucaucgcugugacauuuaucucuauccugacgaccggcgagggcgaaggccgggugggcaucauccuaacccuggcuaugaacauuauguccacacugcagugggccgugaauaguuccauugacgucgauucuuugaugcgcagcguuuccagagucuucaaauuuauugauaugccuaccgaggggaaacccacuaaaagcaccaagcccuauaagaacggucaacuguccaaggugaugaucauagagaauucucauguuaagaaagacgauauauggcccuccgggggacagaugacaguuaaggaucugacugcaaaguacacagaggggggcaaugccauucucgaaaauauaucauuuuccaucucgccuggacagcgugugggccugcucggccgaaccgggaguggcaaauccacccuccucuccgcuuuuuuaagacuccugaauacugaaggggaaauccagauagauggggugagcugggauucuaucacccuccagcaguggcgcaaagcguuuggggugaucccgcagaagguguuuaucuucucagggacguucaggaagaaucuggacccuuacgagcaguggagcgaucaggagaucuggaaaguggccgaugaggucgggcuccgcagcguaauugagcaguuuccaggaaaauuggacuuuguacugguugacggcgguugcguacugagucauggccacaaacaguuaauguguuuggcuagaucuguccuaucuaaggcuaaaauccugcuccuggaugagcccagugcccauuuagaccccgugaccuaucagauaauacgccgaaccuugaagcaagcauuugccgacuguacggugauucugugugaacaccgaauugaggccaugcuggagugccaacaauuucuagugauugaggaaaacaaagugcgacaguacgauucuauccaaaaacuccuuaacgaacggagucuuuuucgucaggccaucucacccuccgaccgugugaaauuauucccucaccggaacaguuccaaauguaagucgaaaccccagaucgccgcucucaaauag

SEQ ID NO: 4857 - RNA, 4260 nt, Artificial Sequence
  Description of Artificial Sequence: Synthetic coding sequence
augcaaagaucgccuuuggagaaagcauccgucgugagcaaguuguucuucucauggaccagaccaauccugcgcaaaggcuaucgccagagacuggaguuauccgauauauaucagaucccuuccgucgacuccgcggauaaccuuagcgagaaacucgagcgugaaugggacagagagcucgcauccaaaaaaaaucccaaacugaucaacgcacugaggcgaugcuucuucuggagguucauguuuuaugggauuuucuuguaucucggugaaguaacaaaggcagugcaaccgcugcuucucggccguauuaucgcaagcuacgauccagacaauaaggaagagcgcuccaucgcaauuuaucuggguauaggucuaugucuccuguucaucguuaggacccugcugcuccaccccgccauuuucggccugcaccacauuggcaugcagaugcgcauagccauguucucucucaucuacaagaaaacucucaagcugucuucccgggugcuagauaagauaagcauuggccagcuuguaucacuucuguccaacaauuuaaauaaauucgaugagggacucgcucuugcacacuuuguuuggaucgcgccccugcaaguggcucugcugaugggacuaaucugggaacugcugcaggccagcgcuuucugcggucuagguuucuuaaucgugcuagcacuguuucaggccgggcuagggaggaugaugaugaaguaccgcgaccagagggcagggaagaucuccgaaagauuggugauuacauccgaaaugaucgaaaauauacagucagugaaagcuuacuguugggaagaagcaauggaaaagaugauagaaaaucuccgacagacagagcuaaagcucaccagaaaggcagcuuauguucgcuacuuuaacagcucugccuuuuucuuuagcggauuuuucgucgucuuucucucagugcuacccuacgccuugauaaaggggaucauccugcgcaaaaucuuuacaacaauauccuuuugcaucgugcugagaauggccguuacgcgucaauuuccuugggccguucagacgugguacgauagucugggugcuauuaacaagauacaagacuuuuugcagaaacaggaguauaagacauuggaguauaauuugaccacaacagagguggugauggagaaugugacugccuuuugggaagaaacaucucucuugauggugauuaugggggagcuggagcccucugaaggcaagauaaagcacucagguagaauaucauuuugcucgcaauuuagcuggaucaugccuggcaccaucaaagagaacaucaucuucggcgugucuuacgacgaguaccgauaucgcuccgucaucaaagcaugucaacuugaagaagacaucucaaaauucgcugagaaagauaauaucguccucggagagggcgguaucacucucucugguggccagcgagcccggaucucucuggcucgugcgguguacaaggacgcugaccuguaccuucucgauucuccuuuuggcuaucuugaugugcugaccgagaaagagauuuucgagagcugcguuuguaaguugauggcgaauaaaacucgaauccucgucaccucuaaaauggagcaccugaagaaagccgacaagauacuaauucugcaugagggaucaucuuacuucuacgggaccuucucggagcugcagaaucugcaaccagacuuuucaagcaaacugaugggaugcgauuccuuugaccaguuuucagccgaacgccggaauaguauuuugacugagaccuugcauagauuuucucucgaaggcgaugcaccgguuagcuggacggaaacuaaaaagcaauccuucaagcagacgggggaauuuggagaaaaacggaaaaacucgaucuugaaccccaucaacagcauucgaaaguuuucuaucguucagaaaacgccgcugcagaugaaugguaucgaagaggacucugacgaaccuuuggagagacgacugucacugguccccgacucugagcagggagaggcgauccugccacguaucagugucauaagcaccggcccgaccuuacaggcccgccgccgacaaucaguucuuaaucuuaugacucacaguguaaaucaaggccaaaacauccauagaaagaccaccgccuccacacgaaaggucagccucgccccacaagcaaaucucacugaauuggauaucuacucucgcagacugucacaggagaccggauuagagaucuccgaggagauaaaugaagaagaucugaaggagugcuucuuugacgauauggagucuauucccgccgucacaaccuggaacaccuaucuucgcuacauaacaguacacaagucuuugauauucgugcugauuuggugccugguaauuuuucuggccgagguggcagccucgcugguggugcuguggcugcuaggaaauaccccucugcaggacaagggcaauagcacgcacagucgaaauaauaguuaugccguuauuaucacaucuaccucuucuuacuauguuuucuauauauaugucggcgucgcagauacacuucuggcuaugggcuuuuuucgcggacucccccucguccauacccugaucacugugaguaaaauccuacaucacaaaaugcugcacucaguucuccaagcucccaugagcacacugaacacacugaaagccgguggcauauuaaaccgguucuccaaagacaucgccauucucgacgaccugcuuccucugaccauauucgacuuuauucagcuucuccuuauaguuaucggugcuauugcugugguggccguacugcaacccuacaucuuuguugccacugugcccgugaucguggccuucaucaugcugcgcgcuuacuuuuuacaaacgucacagcagcugaaacagcuggagagcgaaggacggucuccaauauucacucaccuugugaccucguuaaagggacucuggacauugagagcauucggccggcaacccuacuucgagacauuauuucauaaggcucugaaccuucacaccgccaauugguuccuguaucuuucaacacuccggugguuccagaugagaauugagaugauuuucgugauuuuuuuuaucgccgugacuuucaucagcaucuuaaccacaggggaaggagagggccguguggggaucauucucacucucgccaugaacaucaugucgacccugcagugggcugugaauagcucuaucgacgucgauucacuuaugcguuccgucucccgcguguuuaaguuuauagauaugccaaccgagggaaagcccacaaaaaguacgaagcccuacaagaacggccagcucucuaaggugaugauuauugaaaauagccaugugaaaaaggacgauauauggccauccggcgggcaaaugacagugaaggaucugacagccaaguacaccgagggugggaaugcaaucuuggagaauauuucguucucuaucucaccaggucagcgcguggguuugcuaggcaggacuggcucaggcaagucaacccuacugucugcuuuccugagacugcucaauacggagggagaaauucagauugacggcgugucgugggacagcaucacgcuucagcaguggcggaaggccuuuggggugaucccucagaagguguucaucuucaguggcacuuucagaaagaaucuggacccauaugagcaguggagugaccaagagaucuggaagguggcggaugagguggggcuucgcagugugaucgagcaguuuccugguaaguuggacuuuguccugguagauggcggcuguguccugucccauggccauaagcaguugaugugccuggcucgcucuguacuuaguaaagcgaaaauccugcuguuggacgaaccaagugcucaccuggauccgguuacguaucagauaaucaggagaacucugaagcaggccuucgcagauuguacaguuauccugugugagcauagaaucgaggcuaugcuagaaugccagcaguuucugguuaucgaagagaacaaaguucgacaauaugauucuauucagaaacugcuaaaugaacgcagccuguuucgccaggcaaucuccccuuccgaucgcgucaaauuguucccacaucgcaauucuuccaagugcaaaagcaaaccacaaaucgccgcucugaaagaagagacagaagaagaaguucaagauacccgccucuag

SEQ ID NO: 4858 - RNA, 573 nt, Artificial Sequence
  Description of Artificial Sequence: Synthetic coding sequence
ugaaaaggucuuuggacauugcgggccuucggcagacagcccuacuuugagacucucuuucacaaagcacucaaucuucacacugcaaauugguuccuguaccucagcacccugcggugguuucagaugcgaaucgagaugauuuuuguuauuuuuuuuauagcagugaccuucaucucaauuuuaacaaccggagaaggcgaaggcagagugggcauaauccugacgcuagcuaugaauauaauguccaccuuacaaugggcuguaaauaguucgauagauguugauagccuaaugcggucagucagucgcguauucaaguuuaucgauaugcccaccgaaggcaaacccacuaaaagcaccaaaccauauaagaacggucagcugaguaaggucaugauuaucgaaaacagccacgucaagaaggacgauauuuggccuagcggcggacagaugacagugaaggaccucacagcaaaauacacugaaggaggcaacgcuauucuggaaaacauuuccuucaguaucucuccaggacaacgcguacgcuucgaacacugccuucucuguuag

SEQ ID NO: 4859 - RNA, 1104 nt, Artificial Sequence
  Description of Artificial Sequence: Synthetic coding sequence
augauaagaaauuggcucacaaucuucauuuuguuuccucucaagcuaguugaaaaaugcgagagcucugugucucuuacggugccuccuguuguaaaguuggagaacggaucaucgaccaauguuagccuuacacucagaccuccacugaacgcuacgcuggugauuacauuugaaauuaccuuuagaucuaagaauauuacaauccucgagcuccccgacgagguugucgugccaccaggcgugacuaauucauccuuucagguuacgucccaaaaugucggucaguugacuguguacuugcaugguaaucauucuaaucaaacugggccuagaauaagauuucucgucauuagauccagcgccauaucuaucauuaaccagguaauaggcuggauuuauuuuguugcuuggagcauaaguuucuacccgcaaguaauuaugaacuggcgccgaaagucuguuauuggccucuccuuugauuucguagcacugaaccugacuggauucguggcauauaguguguuuaacauaggacuguugugggugccuuauaucaaggagcaguuucuccuaaaauaccccaauggcguuaaccccgugaacaguaaugacguuuuuuuuucacugcaugccguugugcuuacgcugauaaucauuguccaguguugucucuacgagagagggggacagcgggucucguggcccgcuauaggcuuccuagugcuugccuggcuguucgcuuucgugaccaugaucguggcugccguuggggugacaacauggcugcaguuccuuuuuuguuucucuuauaucaagcuggcagucacuuugguaaaguauuucccacaggccuauaugaacuuuuauuacaaaucaaccgaagguuggagcauuggaaacgugcugcucgauuucacagggggaaguuucagucugcuucaaauguucuugcagaguuacaacaaugaccaauggacauuaauuuuuggggauccgacuaaguucggccugggaguuuucaguauugucuuugauguggucuucuuuauucaacacuucugucuuuaucggaaacgaccaggauacgaucagcucaacuag

SEQ ID NO: 4860 - RNA, 204 nt, Artificial Sequence
  Description of Artificial Sequence: Synthetic coding sequence
augcggauucauuacuugcucuuugcucuccuguuuuuauuuuugguuccagugccuggucacggagggauuauuaauacuuuacagaaguauuauugccgaguacgcggagguagaugcgccguucugucaugucugccaaaggaggaacaaaucgguaaaugcuccacucgcggaagaaaaugcugcagacguaagaaguag

SEQ ID NO: 4861 - RNA, 204 nt, Artificial Sequence
  Description of Artificial Sequence: Synthetic coding sequence
augagaauccauuaccuucuuuuugcccuucuauuucuguuucucgugccagugccaggccacgguggaaucauaaauacacuccagaaauacuacugcagggugaggggcggccgcugcgcaguucucucgugucuacccaaggaggaacaaaucggaaagugcucaacgcgcggaagaaaguguugccgaaggaagaaauag

SEQ ID NO: 4862 - RNA, 195 nt, Artificial Sequence
  Description of Artificial Sequence: Synthetic coding sequence
augcgaguucuuuaucuucuuuuuaguuucuuguucauuuuccucaugccacucccaggcguauuuggcggcaucggcgauccugugaccugccucaaauccggcgccaucugucaccccguguuuugcccaaggcgauacaaacagauugguaccuguggcuugcccgguacaaaaugcugcaaaaagcccuag

SEQ ID NO: 4863 - RNA, 195 nt, Artificial Sequence
  Description of Artificial Sequence: Synthetic coding sequence
augagaguauuauaucuccuguucucuuuucucuucaucuuccuaaugccacugccaggcguguucggcggaaucggugacccagugaccugccugaagucuggcgcaauuugucaucccguauuuuguccucgcagauacaaacagaucggaaccugugggcugccuggaacgaaguguugcaaaaaaccauag

SEQ ID NO: 4864 - RNA, 849 nt, Artificial Sequence
  Description of Artificial Sequence: Synthetic coding sequence
augaggggcaugaaguugcuaggggcccuccucgcacuugcugcgcugcuccaaggagcuguaucccugaagauugcggccuuuaacauccagacuuuuggggagaccaagaugagcaacgcuacauuggugucauacauuguccagaucuugucgcgcuacgauauagcuuugguucaagaaguucgcgauagccaccuuacagcagucgggaagcugcuugacaaccucaaucaggaugcccccgacacuuaucauuacguaguguccgaaccucuuggcagaaacuccuauaaggaacgguaucuguucgucuaccggcccgaucagguauccgccgucgacaguuauuauuaugacgauggaugugagcccugugguaacgacaccuucaauagagaacccgcaaucgugagauucuucagucgguuuacagaaguucgggaauuugcuauuguaccucugcacgcugcccccggagaugcagucgcugaaaucgacgcacuguacgacguuuauuuagauguccaggagaaguggggccucgaagaugugauguugaugggcgacuucaacgcagguugcuccuaugugagaccuagccaguggaguucuauucgacuguggacauccccaacauuucaguggcucaucccagauucugccgauacaacagcuaccccaacucacugcgcauacgacagaaucgugguugcagggaugcuucuuaggggggcugucgugccagacucggcccucccuuucaacuuccaggcagcuuacggacuaagugaucagcucgcucaggccauaagugaccauuacccaguggaagugaugcuaaaauag

SEQ ID NO: 4865 - RNA, 849 nt, Artificial Sequence
  Description of Artificial Sequence: Synthetic coding sequence
augcggggcaugaaacugcugggggcccuuuuagcucuugccgcccugcugcagggagccgugucccugaagaucgcagccuuuaacauacagacguuuggagagacuaagaugucuaaugccacacucgugucuuacauuguacaaauucucagucguuaugauaucgcuuugguucaggaagugagagacagucaucuuacagcugugggaaaacugcuggacaauuugaaccaagacgcucccgacaccuaccacuauguggucucugaaccucugggcagaaauucauacaaagaaagauauuuauuuguguaccgccccgaccaggugagcgccguagauuccuauuauuaugaugauggcugcgagccuugugguaaugacacguucaacagagagcccgccaucguccgcuuuuucucaagauucaccgaagugcgggaauucgcuaucgugccuuuacaugcugcaccaggcgacgcggucgcugagauugacgcccuauaugauguguaucucgacguucaggagaaguggggucuugaagacgugaugcugaugggugacuuuaaugccggaugcucuuacguccguccgucccaguggucuucgauucgacuguggaccagucccacuuuucaauggcugauuccugacucugccgauacuacagcuacgccaacacacugugcuuaugaccggauaguggucgccgguauguuacugcgcggagcaguugugccagauagcgcuuugcccuuuaacuuucaagcagcauauggcuugucagaccaacuggcacaagccaucuccgaucauuacccuguggaagugaugcuuaaguag

SEQ ID NO: 4866 - RNA, 564 nt, Artificial Sequence
  Description of Artificial Sequence: Synthetic coding sequence
augcaucaaacuccuaucaccacauggucuguaagccacugggacggcacugcaauucggagcgccaccugcuccugcacaggucuuacucgcuguuugcgguggaccgcuacaaccaccaugauggcugcaucuccugccggaacuaccccaaguacggaaucucagccacucucuggcucaagcccuggaucacaagacgucaugcugaugggugauuuuaaugccgguugcucuuacguaaggccuucgcaguggagcucaauucgucucuggacaagcccuaccuuccaguggcugauuccagauucugcggauacaacagcuacaccaacucacugcgcauacgaucguauugugguugccggaaugcuccuccgcggcgcaguugugccagacuccgcucugccauuuaacuuccaggcugccuacggucugucggaucagcuguucuccguacacacauguuccggcgcuggucuuggagaaagacacggccugcccgcuuccgcagcccucccaucuaauaccugucgcgcuggcacgcauagaguguccaccuag

SEQ ID NO: 4867 - RNA, 6243 nt, Artificial Sequence
  Description of Artificial Sequence: Synthetic coding sequence
augcugcggguguucauccucuaugcagaaaaugugcacacacccgauacagacauuucugaugcauauuguagugcgguguucgccggggugaagaaaagaaccaaaguuaucaaaaauuccguaaacccagucuggaacgaaggauuugagugggacuuaaagggcauuccgcuugaccaaggcagcgagcugcacgucgucgucaaggaucaugagacaaugggucgaaaucgauuccugggagaggcgaaagucccacugagggagguguuggcuaccccaagucuguccgcuagcuuuaacgcaccacuccuugauaccaaaaagcagcccacuggagcuucauuggugcuccaggugaguuauaccccucuccccggcgcagugccccuauuuccaccaccaaccccucuggagcccucucccacauugccagaucuggacgugguagcugacacuggcggggaggaggauacugaggaucagggccugacaggcgacgaggccgagccuuuucucgaccaaucagguggucccggcgcgcccaccacaccucguaagcugccuucacguccuccuccacacuacccagggaucaagagaaagcgcucggcacccacgucuagaaagcuccuguccgacaaaccccaggacuuucagauacguguacaagugauugaaggcaggcaacugccuggcgucaauauuaaaccagucgugaaggugacagcggcuggccagaccaaaagaacuagaauucacaagggcaacuccccccuauuuaaugagaccuuguucuuuaaucucuucgacucuccaggugagcuguucgaugagcccauuuucaucaccgucguugauucucggucuuuacguacagacgcguugcugggcgaguuucgcauggauguuggcacuauuuauagggagcccaggcacgcauaccucaggaaauggcuucuucucuccgacccggacgacuuuucagcaggagcucgcggguaucuaaagacuucccugugcguguuggggccaggagacgaggcaccccuagaaaggaaggauccauccgaagacaaggaggacaucgagucuaaccuccugcggccaacuggugucgcccuuaggggugcccauuucugccucaaggucuuuagggcugaagaucugccacagauggacgaugcggugauggauaacgugaaacaaauuuucggcuucgaauccaauaaaaaaaaucuuguggaccccuuuguggaggugucuuucgccgguaagaugcuaugcucaaagauccuggaaaaaaccgccaauccacaguggaaucagaauaucacguuaccagcaauguucccaucuaugugcgagaaaaugcgaauucgcaucaucgauugggauagacugacccauaaugauauuguggccaccaccuaucuuucaaugagcaaaauuucugccccaggaggcgaaaucgaggaggaaccggcaggggcagugaaaccaucgaaagccagugauuuagacgauuacuuaggcuuccuuccuacuuucggcccuuguuauaucaauuuauauggguccccgagggaguuuacugguuucccugaucccuacacggaacuuaacacuggaaagggugaaggcguggcauaccguggcagacugcuccugucucuggaaacgaaguugguggaacauuccgagcaaaagguggaggacuugcccgcggaugauauucuuaggguggaaaaauacuugagacgcagaaaguacaguuuguucgcggcuuucuacagcgcaacaauguuacaagacguggacgacgccauucaguucgagguaagcauagguaauuacgggaacaaauucgauaugaccugccucccgcuggccagcacgacccaauacagcagagccguguuugacggcugccacuacuauuaucuuccuuggggcaaugucaagccagugguuguacugagcuccuacugggaggauaucagucaccgaaucgagacacagaaucagcugcugggaauagcagaucgccuagaagcugggcuugagcaggugcaucucgcccuuaaggcacagugcagcacugaagaugucgauagccugguggcacagcugaccgacgaacuaaucgccgguugcagucaaccuuugggcgacauucaugaaacaccuagugcgacgcaccuggaccaguaccuguaccagcugcgaacgcaucaccugucccagaucacagaagcagcucuggcacucaagcuuggucauucagagcucccugcggcgcuggaacaggcagaggauuggcugcugcgccugcgagcauuggcugaggaaccccaaaauagccugccugacauaguuaucuggauguugcagggugacaagcgcguggccuaucaacgcgugcccgcacaucaagugcuguuuuccaggcgcggggcgaacuauugcggcaagaauugcggcaaacuacagaccaucuuuuuaaaauauccaauggaaaaggugccgggggcgcggaugcccguucagauucgcgugaagcucugguuuggccugucuguggacgagaaggaauuuaaucaauuugccgagggaaagcugucuguauuugccgagaccuaugaaaacgagaccaaacuggcccucguggguaauuggggcacaaccgggcugacguauccaaaauucagcgauguuaccggaaaaauaaagcuaccuaaagauucguucagacccuccgccgguuggacuugggccggagacugguuugugugccccgaaaaaacucugcugcaugauauggaugccgggcaucuuuccuucguagaagagguguucgaaaaucaaacgcggcuccccggggggcaguggauauauaugucagacaauuauacagacgugaacggugagaaagugcugccaaaggaugacaucgaauguccacucggauggaagugggaagacgaagagugguccaccgaccugaaccgggcuguagaugaacagggcugggaguacucaauuaccaucccaccagagcggaagccaaagcauugggucccagccgaaaagauguauuauacccaucggcgcaggagaugggugaggcugagacggagggaccugagccagauggaggcuuugaaaagacaccggcaggcugaggcugagggcgagggaugggaauacgcgucccuauuuggcuggaaauuccaucuugaauaccggaagaccgaugcguuccgcagacggagguggagaaggcggauggaaccguuagagaaaacaggcccugcggccgucuuugcccuugagggcgcacugggcggcgucauggacgacaaaucagaagauagcaugagugucaguacccugaguuuuggugugaacaggccaaccaucucauguaucuucgacuacggaaaccgguaucaucucagguguuacauguaccaggcacgagaucuggcagccauggacaaagauucauuuagugaccccuacgcaaucgucucguuccuacaccaaucccagaaaacgguuguagucaagaauacacuaaaccccacaugggaucagaccuugauuuucuacgagauagaaaucuuuggugagccugcaaccguggcugaacagccaccaagcauugugguugaacucuaugaucaugacaccuauggagcugacgaauucauggggcggugcauaugucagcccucccuggagagaaugccaagauuggccugguucccacucacccgcggcagccagcccagcggggaacuccuggcgaguuuugagcuaauccagcgcgagaaaccugccauucaucacauaccuggauuugaagugcaagagacuagccgaauccuugacgaauccgaggauacugaucuucccuauccaccaccucaaagggaggcgaacauuuauaugguuccacagaacaucaagccugcacuccagagaacugcuaucgaaauccucgccuggggacugcgcaacaugaaguccuaccaacuggcuaacauuucuucuccuucacuggucgucgaaugcggcggucagacaguccagagcugugucaucagaaaucugagaaaaaauccuaacuuugacaucuguacacucuucauggaagugaugcugccucgcgaagaguuguauuguccccccauuaccgugaaggugaucgacaaucgccaguucggacgcaggcccguaguuggucagugcacaauucggucucucgagaguuuccucugcgacccauacucugccgaauccccguccccucaaggcggccccgaugacguuagccuguugagcccuggcgaagauguccuaauugauauugacgauaaggaaccucugauaccuauucaagaggaggaguucauugacugguggaguaaguucuucgccucaauuggagagcgggaaaaaugcggcagcuaucuugaaaaggacuucgauacccugaagguauaugacacacagcucgaaaacgucgaggcauucgagggccugucugacuucuguaauacauucaaguuauauagggguaagacucaggaggagacggaagaccccucggucaucggugaauuuaaaggccucuuuaaaaucuauccccucccugaggacccagccaucccuaugccaccucgccaguuucaccagcuggccgcacagggcccccaggaaugucucgugcggaucuacaucguacgcgccuuuggccuacaaccgaaggacccaaacgggaaaugugacccauacauaaagauuaguauuggcaaaaagucugucagcgaccaagauaacuacauacccuguacccuggagccuguauucgggaagauguuugaguuaacaugcacacugcccuuagaaaaagaucucaaaauuacucucuacgauuaugaccugcucucuaaggacgagaaaauaggagaaacagucguggaucuggagaacagacuguugagcaaguucggcgcuagauguggguugccccagaccuauugcgucuccgggcccaaccaauggcgcgaucaauugaggcccagccaguuauuacaucuguucugucagcagcaccgggugaaggcccccguauaccgaacugacagagugauguuucaggauaaagaguacucaauugaagaaaucgaggcugguaggauccccaacccucaucucggacccguagaagagaggcuggcuuuacacguucugcagcagcagggauuggucccggagcacguugagaguagaccucuauacagcccacuccagccagacaucgagcagggaaaacuccagauguggguggaccuuuucccuaaagcccucggccgcccaggccccccguucaacaucaccccacgaagggcucggcgauuuuuucucaggugcaucaucuggaacacucgggacgucauucuugaugaucugagccugaccggcgaaaagauguccgauaucuaugucaaaggcuggaugauuggcuuugaggaacacaagcagaaaacugauguucacuaucggucucugggcggcgaaggaaauuucaauuggcgguucaucuucccguuugauuaccucccugccgagcaggucuguaccauagcaaagaaagaugccuucuggcgucuagacaagacagagaguaagauccccgcaagaguuguguuucagauaugggacaacgacaaauuuuccuuugacgacuucuuagggucccuccagcuggaucuaaaucguaugccaaagcccgcgaagacugccaaaaaguguagucuggaccagcucgacgaugccuuccaccccgaaugguuugugagccucuuugagcagaagacagugaaggguugguggcccuguguugcagaagaaggcgagaagaaaauacuggcaggcaaacuggaaaugacacuggaaaucguggccgaaucagaacacgaagagcgaccugcuggacaagggcgagaugaacccaauaugaaccccaagcuggaagauccacgcagaccugauaccucauuucugugguuuacuucuccuuauaagacuaugaaauucauccuguggcgaagauuuagaugggcaaucauccucuucaucauccuguuuaucuuacugcuguuccuugcuaucuuuauuuacgcuuucccuaauuacgcugccaugaaauuagucaaacccuucagcuag

SEQ ID NO: 4868 - RNA, 6246 nt, Artificial Sequence
  Description of Artificial Sequence: Synthetic coding sequence
augcucuguugucucuuggugcgagccagcaacuuaccgucugccaaaaaagacagaagaucugauccuguagccucacucacauuuaggggggugaagaagcggacaaaaguaaucaaaaauaguguuaacccuguuuggaaugaaggauuugaaugggaccugaaggggauucccuuggaucagggaagcgagcuacacgucguugugaaggaccaugagaccauggggaggaacagguucuugggggaggcuaaggucccccuccgcgagguucuagcaacccccucccuuuccgccagcuucaacgcgccccugcuggauaccaaaaagcagccuaccggggccucucugguccuccaggugagcuauaccccauugccuggugcuguaccucuguuccccccaccuacgccucuggagccaucaccaacguugcccgaccuggauguuguagcugacacugggggugaggaagauaccgaggaccagggucuaaccggagaugaagccgaaccuuuucucgaccaguccggaggacccggggcaccgacuacaccacgaaagcucccuucccggccucccccucacuauccaggaaucaaacgaaaacggagcgccccaaccucacgcaagcuucugagcgauaaaccacaggacuuccagauacgcguucaagugauugagggccgccagcugccgggugugaauauaaagccugucgugaaggugaccgcugcuggucagacuaaacguacuaggauccauaaggguaauucaccacuguuuaacgagacacuguucuucaaccucuucgauuccccuggugagcuuuucgacgagccuaucuuuaucaccguggucgauucaaggagucugaggaccgaugcucuucuuggcgaguuccgcauggauguagggacuauuuaccgggagcccagacaugccuaccugcgcaagugguuacuguugucugauccugacgacuucagugcuggagcgaggggauacuugaaaaccagccuuuguguccuggggcccggggaugaggccccccuagagagaaaagacccaucggaggacaaggaagauauagagucuaaucugcuacggccaacugggguugcauuaaggggggcacacuuuugucugaaaguuuuuagggcugaggaccucccucaaauggaugacgccguaauggauaauguaaaacagauauucgguuuugagucuaauaaaaaaaaucucgucgauccuuucgucgagguuuccuucgccggaaaaauguugugcagcaagaucuuagaaaaaacagcuaacccccaguggaaccagaacaucacacucccugccauguuuccuucaaugugugaaaaaaugagaauucgaauuaucgacugggaccgauugacccauaacgacauuguggcuaccacauaucucaguaugucuaagauuagugcuccaggaggugagauagaggaggagcccgccggcgcggucaagccuagcaaagccuccgacuuggaugauuaucucggguucuugcccacguuuggcccauguuacaucaaucuuuacgguagcccucgcgaguucacuggcuuuccggaucccuacacggaacuaaauacugggaagggcgagggaguggcguaucggggacggcugcugcuuagucuggagaccaaacugguggagcauagcgaacagaagguugaagaucuucccgccgacgacauauugcgaguagaaaaguaccucagacgcaggaaguacucccuauuugcagcuuucuauucggccacaaugcugcaagacguggaugaugcaauccaguucgaaguuuccauaggaaauuaugggaauaaguuugacaugaccugucucccucuagcuuccacaacacaguacuccagagcuguguucgaugggugucauuauuauuacuugcccuggggcaauguuaagccugugguggucuugaguaguuauugggaggacauuagucaucgcauagaaacacagaaccagcuucuagggauugcugaucgguuagaagcaggacuggagcagguacacuuggcgcucaaagcucaguguucuaccgaggaugucgacagucuagucgcccagcuaaccgacgaguugaucgcaggcuguagccagccccugggggacauccacgagaccccuagcgccacacaccuggaucaguaucuuuaccagcuccggacacaccaucugagccagauuacagaagccgcucuugcccucaaacuaggccacucugaguugccugcugcccuagagcaagcggaagauuggcuccugcgccugagagcccuggccgaagagccucagaacagccuucccgauauuguuaucuggaugcuacagggugacaaacgcguugccuaccaacgcgugccggcucaccagguacuguucucccgucggggagcgaauuacugcggaaaaaacuguggaaaacugcaaacgaucuucuugaaguacccuauggaaaaagugcccggagccaggaugcccguucaaauucgagugaaauuaugguucggccuuaguguagaugaaaaagaguucaaucaguucgcugaggguaaacucaguguuuuugcugagacuuaugaaaaugaaacuaaacuggcacuugucgguaauugggggaccaccggacuaacauauccgaaguucagcgaugugacagggaagaucaagcugccuaaggauucauuccgucccagcgcaggauggacuugggcaggugauugguucgugugccccgagaagacucugcugcaugauauggaugccggucaucucuccuuuguagaggagguguuugagaaccagaccagacuucccggggggcaguggaucuauaugucagauaacuauaccgaugugaauggggaaaaaguacucccuaaggaugacaucgaaugcccacugggcuggaaaugggaagacgaggaguggucaaccgacuuaaaccgcgcgguggaugagcagggcugggaguauucgaucaccaucccuccagagaggaagccgaaacacuggguaccugccgaaaagauguauuacacucacaggcggaggagaugggugcgacugagacgccgggauuugagccagauggaagcccugaagaggcaccgucaggcagaggcugaaggggagggcugggaguaugcgagccuguucgguuggaaguuucauuuagaguaccgcaagacggacgcguucaggagacgacgcuggcggaggagaauggagccucuugagaagacagguccagccgcaguauuugcccucgagggagcucucgggggagugauggaugauaagagugaggauuccaugucaguuucgaccuugucguucggcguaaauagacccacaaucuccuguaucuucgacuacgggaacagauaccacuugcguuguuacauguaccaagcccgugaccucgccgcgauggauaaagacucuuucucugaccccuacgccaucgucagcuuccuucaucagucccagaaaacagucguugugaaaaauacccugaacccgacuugggaucagacacugaucuucuaugagauugagaucuucggggagccugccacagucgccgagcagccccccuccauuguuguugagcuuuaugaucacgauacauacggcgccgacgaauuuaugggacgcuguauuugucagccgagccuggagagaaugccaagacuugccugguuuccucugaccagaggaagccaaccuuccggagagcuucucgccucauucgagcugauacaacgggagaagcccgcuauucaucauauuccuggauucgaagugcaagaaaccagcaggauucucgacgaauccgaagauacugaccugccuuacccaccaccacaaagggaagcaaauauuuacauggugccacagaacaucaagccugcuuugcagaggaccgccauugaaauccuugcauggggacuucggaauaugaaaucuuaccagcuggcuaacauauccucccccucucuuguggucgaguguggagggcagaccgugcaaaguugcgugauuagaaaucugcguaagaaccccaauuucgacauuugcacucuuuuuauggaggugaugcugccucgcgaggaauuguauuguccacccauuacgguaaagguuaucgauaauaggcaauucggacgcaggccugugguuggacaguguacaaucaggucacuggaauccuuucugugugaccccuacagcgcugaaaguccuagcccacagggggggccugaugacgugucacuguuaucccccggcgaagacgugcucauugacaucgacgacaaagagcccuugauuccaauacaggaggaagaauuuaucgauugguggucuaaguucuucgcaucuaucggcgaacgggagaaaugugggagcuaucucgaaaaggauuucgacacccugaagguguaugacacgcaacuggaaaacguggaggcuuuugagggccugagcgauuuuuguaauaccuuuaaauuauauagaggaaagacucaggaagagaccgaggaccccuccguaauuggagaauuuaaggggcucuuuaagauuuacccuuugccugaggaucccgccauccccaugcccccaagacaguuccaccagcuggccgcucaaggaccccaggaaugccuuguuagaauuuacauugugagagccuuuggccugcagccgaaagaucccaacgguaaaugugauccguacauuaaaaucagcauagguaaaaagagugugagcgaccaggauaacuacauucccuguacauuggagcccguguucggaaagauguucgaacucacaugcacucucccacuggaaaaggaccugaaaauaaccuuguaugacuacgaccugcuuucaaaggacgaaaaaaucggggaaacuguaguggaccuggagaaccgucugcuguccaaguuuggagcuagauguggacucccccagaccuauugcgucucugggcccaaccaguggagagaucaguuaagaccuucccaguuauuacauuuguuuugccagcagcacaggguaaaagcaccuguuuacaggacugaccgggugauguuucaagacaaagaauauucuaucgaggagauugaagccggccgcaucccuaauccccaucugggcccuguggaggaacgccuggcuuuacauguucuacagcagcagggucugguaccugagcaugucgagucgaggccacuguacucaccucugcagccggacauagaacagggcaagcugcaaauguggguugaucuguuucccaaggcucugggaagaccugguccaccuuucaacauuaccccucggagggcacgcagauucuuucuccggugcaucauuuggaacacaagagauguuauccucgaugaucucucuuuaacgggcgagaagaugagcgacaucuacgugaagggauggaugauuggauucgaggagcacaagcagaaaaccgaugugcacuacagaaguuuagggggagaaggaaacuucaauuggcgguuuaucuucccauucgauuaccucccggcugaacaggucuguacgauagccaagaaggaugcauucuggcggcuggacaaaacagagagcaagauucccgccagaguggucuuucagauuugggauaaugacaaauucucuuuugacgacuuccucggauccuuacaacuagaucugaauaggaugccaaaaccggccaaaacagcaaagaaaugcagucuggaucagcuggacgaugcuuuccaccccgagugguucgugucauuguuugagcagaaaacggucaaaggcugguggcccugcguggccgaggagggcgaaaagaagauucucgcuggaaaguuagaaaugacccuggaaauuguugcggagagugaacacgaggagagacccgcugggcaagggagagacgaaccaaacaugaauccaaaguuagaggauccaagacggccugauacgucuuuucucugguuuacgagccccuauaagacaaugaaguuuauucucuggcgcagauuucggugggcaaucauucuuuucauaauccuguuuauacuucuucuuuuccuggcuauuuuuaucuacgccuucccaaacuacgcugcgaugaaacuagugaagccauucuccuag

SEQ ID NO: 4869 - RNA, 6309 nt, Artificial Sequence
  Description of Artificial Sequence: Synthetic coding sequence
auguuguguugucuuuuggucagagcaucaaaucugcccucagccaagaaggacaggcgcucugacccaguugccucucugaccuuucgcggugugaagaaacguacuaagguuaucaagaauucugugaacccuguguggaacgagggguuugaaugggauuuaaaaggcaucccacuggaccaagggagugaauugcacgugguagugaaagaccacgaaaccaugggaagaaaucgguuucugggggaggccaaggucccucugcgugaagugcucgcuacaccuagccuguccgcaucuuucaacgcaccuuuauuagacacaaagaagcaaccuacaggugcuucccugguucugcagguguccuauacuccacugccuggcgcggugccucuguucccuccaccaacgccacuagaacccuccccaacucugccugaccucgacgucguggcagacaccggaggcgaagaagacaccgaagaucagggccugacuggcgaugaggccgagccuuuucuggaucaaagcggcggucccggagcccccaccaccccgagaaagcucccuucuagacccccaccucauuauccuggaauaaagcggaagcgaucugcgccaacaucuaggaagcuacugagugacaaaccccaggauuuccaaauucgugugcaggugauugagggacgacagcugccuggagucaauaucaaaccuguggucaaaguuacugccgcuggccagaccaaaaggacgaggauacacaaagguaacagucccuuauuuaaugagacccuguuuuuuaauuuguucgacagcccuggggagcucuucgacgaaccuauauuuauuacagugguggauagucggucucuacguacagaugcuuugcugggagaauuuagaauggacguuggcacaauuuaccgggagccuaggcaugccuaccucaggaaaugguuauuacugagcgacccugaugacuucucugccggcgcuaggggauaucucaaaaccagucucugcguucucgguccaggugaugaagccccacuugaaagaaaagauccauccgaggauaaagaggacauugagucuaaccuccuccgaccaacaggcguggcccuccgcggggcucauuucugccucaagguuuuucgggcggaggacuuaccccagauggacgacgcaguuauggacaacgucaaacagaucuucggcuucgaaucaaacaaaaagaaucucguggacccauucgucgaagugagcuuugcugggaagaugcugugcagcaagaucuuagagaagaccgcaaacccacaguggaaucaaaacaucacccuuccagcaauguuuccuucaaugugugaaaaaaugagaaucaggaucauugacugggauagacucacccacaacgauaucgucgccacuacauaccugagcaugucaaaaauuuccgcaccaggcggugaaaucgaagaggagccugccggcgccgugaaaccgagcaaggcaucggaccuggacgacuaucugggcuuucucccuacuuucggccccuguuacauuaaccucuacgguucuccgcgggaauuuacaggauucccugaccccuauacggagcucaacacggggaagggcgaagggguggccuaucggggacgucugcuacuuucacuggagacaaagcucgucgaacacagcgaacaaaaaguggaagaucuuccggcugacgauauccugcgaguggaaaaauaccugcgccgccgaaaguauuccuuauuugcagccuucuacucagccacaaugcuucaggacgucgaugacgcaauacaauucgagguaagcaucggcaauuauggaaauaaguucgacaugacuugccugccccucgcaucaaccacgcaauacucaagagcuguauuugacgggugucacuauuauuaucuuccguggggaaacgucaagccuguugucgugcucucuucuuauugggaggacaucucgcaccggaucgaaacacagaaccagcugcuuggcauagcagauaggcuggaggcuggccuagagcagguccaccucgccuugaaggcccaaugcuccacagaggaugucgacucacucguggcccagcugacggacgagcugauagccggauguucacagccguuaggagacauccaugagacuccuucugccacucaucuagaucaguaccuuuaccagcucaggacucaucaccugucucaaauuaccgaagcggcacuagcccugaagcuaggacacucugaguugcccgcagcucuggaacaggcagaggacuggcugcugcgacuccgcgcuuuagcggaggagccgcagaauucucuucccgacauugucaucuggaugcugcagggggacaagagaguggccuaccagcgggugccagcgcaccaggugcuguucucacgucggggugcaaacuauuguggaaagaauuguggcaaacuccagacuauauuuuugaaauacccgauggaaaagguuccuggggcccgcaugccugugcagauucgugugaaacuuugguuugguuuguccguggacgagaaagaguuuaaucaguucgcagaaggaaagcucaguguguucgcagagacguacgagaaugagacaaaacuugcucugguggguaacuggggaacaacaggacucacauacccaaaguucagugaugugacgggaaaaaucaagcuccccaaagauagcuuccgccccuccgcuggcuggacaugggcuggagacugguuuguuugcccagagaagacccuccugcacgauauggacgcuggucacuuaagcuucguugaggagguguucgaaaaucaaacgcgauugccaggggggcaguggauuuacaugagcgauaacuacaccgacgugaacggcgagaagguuuuaccgaaggaugacaucgagugcccccuuggauggaagugggaagaugaagaguggaguacugaucugaacagggcugucgaugagcaagguugggaguacuccauuacuaucccuccagagaggaagccaaaacacugggugccugcugaaaaaauguauuacacccauagaaggagaaggugggugagacugaggagacgggaccucucacaaauggaagccuugaaacgccaucgacaagccgaggccgaaggggaaggaugggaauacgccucccuauucggauggaaguuccaccuggaguacagaaagacggaugcuuucaggcggagaagguggcgcagacgaauggagccuuuagaaaagacugggccugcagcuguauucgcucuggagggagcacucgggggugugauggaugacaagucugaagacagcaugagcguuuccacgcuuuccuuugguguuaaccguccaacaaucucuugcauuuucgauuaugguaaccgguaccaucucagguguuauauguaucaggccagggaccuugccgcaauggauaaagacagcuucucggauccauaugcuaucguuagcuuccuccaccagagucagaagaccguggucgugaagaacaccuuaaauccaacuugggaccaaacuuuaauuuuuuacgaaaucgagaucuuuggggagcccgccacaguggccgagcagccuccuaguauuguggucgaacuguacgaucacgacaccuacggugcagaugaauuuauggguagauguaucugccagcccucacuagagcgcaugcccagacuggcuugguucccacugacucgaggaucucagccgaguggagaauuacuggccagcuucgaguugauucaaagggaaaaaccagccauacaucacauccccggcuuugaggugcaggagacaucacggauccucgaugaaagugaggacacagaccucccuuacccucccccacagcgcgaagccaauaucuauauggugccacagaacaucaagcccgcuuugcagcgcacagccaucgaaauccuggccuggggacugcggaauaugaagagcuaucaacuggcaaacaucucaagcccuagccugguaguugaauguggcgggcagaccgugcaaagcugcgugauucgaaaccugaggaagaaccccaauuucgauauuugcacacuuuucauggagguuaugcugccaagggaagagcucuacugcccacccaucacaguaaagguuauugacaaccgccaguuuggaagacgcccagugguuggacaguguacaauuaggagccuggaguccuuucugugugauccuuauagugcagaauccccaaguccacaagguggccccgaugaugucucacugcugaguccaggugaagacgugcugaucgacaucgaugacaaggagccucucauccccauccagcuugcagacgggcugaguucucuggcccccacuaauaccgcaagcccgcccucauccccacacgaggaagaauuuaucgacugguggaguaaauucuuugcuagcaucggagaaagggaaaagugugggaguuaccuggaaaaggauuucgauacguugaagguuuaugacacucaauuggagaaugucgaggcauucgagggccuuagcgauuucugcaacacuuucaagcucuaccgagguaaaacacaggaagagacagaagaucccucugucaucggcgaauucaaaggacuguucaagauuuacccccuuccagaagaccccgcuaucccaaugccucccagacaguuccaucagcuggccgcccaggggccacaggagugccucgugcguauuuauauuguccgagcauucggauugcagccaaaagauccuaauggcaaaugcgaccccuauauuaaaauaucaaucgguaagaagucuguguccgaccaagacaacuauauccccugcacucuggaaccgguuuuuggaaaaauguuugagcugacauguacccuaccccuggaaaaggacuuaaagaucacauuguaugacuacgaucugcugucuaaggacgagaagauaggggaaacggugguagaccuggagaacaggcuguugucuaaauuuggcgcccgcugcggucugccacagacguauuguguuuccgggccuaaucaauggagagaccaguugagaccuucgcagcuacuccacuuauucugucaacagcaccgggucaaggcuccaguuuaccgcaccgaucggguaauguuccaggacaaggaguauucaaucgaagagaucgaagcaggaagaaucccaaacccccaucuggguccgguugaagagcgacuugcccugcacgugcuucaacagcagggcuuggucccugaacauguugaaaguaggccacucuacucaccgcugcagcccgacauugaacagggaaaguugcaaauguggguggacuuauuucccaaagcacucgguagaccuggcccccccuucaacauuacuccacgacgagcuagaagguuuuucuuaagaugcauuauuuggaacacaagggacguaauucuggaugaucucucacucacuggagaaaaaaugagcgacaucuaugugaagggguggaugauaggcuuugaagagcauaagcagaaaacggacguccacuauaggagucugggaggcgaagguaauuuuaacuggcgguuuaucuuucccuuugacuaucuuccugcagagcaggugugcaccauugcgaaaaaggaugcauuuuggcgguuagauaagaccgagucuaagauccccgcucguguuguguuccagaucugggauaaugauaaguucagcuucgacgacuuccuugguagucugcagcuugaccucaacaggaugccaaaacccgccaagacagccaaaaaaugcucccucgaucagcuggacgacgcauuucaccccgaaugguuuguuaguuuguuugagcaaaagaccgugaaaggaugguggcccugcguggccgaagagggagaaaagaagauccuugccgggaaacuggagaugacucuggaaaucguggccgagagugagcaugaagagcggccagcaggacagggaagggaugagccaaacaugaacccuaagcuagaggaucccagaagaccagacacaaguuuucugugguuuaccucgcccuacaaaacaaugaaauuuauauuguggcggcgguuucgcugggccaucaucuuguucaucauccucuucauccuucugcuuuuccuggccaucuucauuuaugcauuuccaaacuacgccgcaaugaaacucgucaaaccuuuuucuuag

SEQ ID NO: 4870 - RNA, 6357 nt, Artificial Sequence
  Description of Artificial Sequence: Synthetic coding sequence
augcuaagaguguuuauucuauacgcagaaaaugugcacacaccugauacugauaucagcgacgccuacuguucugccguguuugcuggugucaaaaaaaggaccaaggugauuaaaaauaguguaaauccgguguggaaugagggauucgaaugggacuuaaaaggaauaccgcucgaccaggguuccgagcugcaugugguggugaaggaucaugagaccaugggucggaaccgcuuccuaggggaagccaagguaccacucagggagguucucgccacaccaucucugucagccuccuucaacgccccccuucuggacaccaaaaagcagccuacaggagccucucugguauugcagguaucuuauaccccccuuccuggggccguaccucuuuuucccccaccaacuccauuggagccgagcccaacucugccugaucuagacgucguggcaggaggcggacaauccagggccgagacauggagucuguuguccgacagcacuauggacacccgcuacucugguaagaaauggcccgccccaaccgacacaggaggggaggaggauaccgaggaucagggccugacgggagaugaagcugagcccuucuuggaccagagcggcggaccaggagccccgacuacaccaagaaagcugccauccagaccgcccccucacuaucccggcauuaagaggaagcgcagcgcuccaaccaguagaaaacuucuguccgacaagccacaagacuuucaaauuagagugcaagugauugagggaaggcaacuaccuggggucaauaucaagccaguagugaagguuaccgcugccggacaaaccaagcggacacggauucacaaagguaacaguccucucuucaacgaaacacuauucuuuaaccuguuugauagcccaggcgaguuguuugaugaacccaucuuuauuacagucguggacucuaggucacugagaacagaugcacugcucggcgaguuccgcauggacgugggaacuaucuacagagaaccgcggcaugcguaucugagaaaauggcuccucuuaagcgaucccgaugacuucucugcuggagcaaggggguaccuuaaaaccucucuguguguguuaggacccggcgacgaagccccacuggagagaaaggauccaagcgaggauaaagaggauauagaauccaaucuguuaaggccaaccgggguagcuuugagaggggcccauuuuugucugaaaguguuccgggccgaagaccuaccacagauggaugacgcuguuauggacaacguuaaacagaucuucggguucgagucuaacaaaaagaaccucguggauccguuuguagaaguuuccuucgccgggaaaaugcuguguagcaaaauccuggagaagaccgcaaacccccaguggaaccagaauauaacccucccggcaauguuucccucaaugugcgaaaagaugagaaucagaaucaucgauugggaccggcugacccacaacgacaucgucgcuaccaccuaccugagcaugucaaaaaucagcgccccaggaggugaaauugaaguugacgacuaccuaggauuucuccccacauuugggccuugcuacaucaaccuguauggaucaccaagagaguucacgggguuucccgaccccuauacugaauugaacaccgggaagggagagggggucgcauaucgcggaaggcucuugcugucucucgaaacuaaguuggucgaacauucugagcagaaggucgaagaccuccccgcugaugauauacugagagucgagaaguaucuccggcgccggaaauacucacuguuugccgccuucuacucugcuacuaugcuccaagacguggacgacgcuauccaguuugaagucucgaucggaaacuauggcaacaaauuugacaugacuugccuaccucucgcuagcacuacgcaauacucaagggcaguuuucgacggcugucacuauuacuacuuacccuggggaaauguuaagcccgucguggucuuauccucuuauugggaggauaucucucacaggaucgagacucagaaucagcugcuuggcaucgcugaccgacuggaggccggccuggaacaggugcaccuggcucuuaaagcccaauguaguaccgaggacguggauagucugguagcccagcuaacugacgagcucauugccggcuguucucagccccugggugacauucacgaaacgccuagugccacgcaucuggaucaauauuuauaucaguuaaggacgcaucauuugucccagaucacagaggccgcccucgcucugaaacugggccauuccgaauugccggcagcucuggagcaagcagaggacugguuguugagacuuagagcauuagcagaagaaccucaaaacucucugccagauaucguuaucuggauguugcaaggugauaagaggguugcauaucaacgggugccagcucaccaggugcuuuucagcagaaggggggcuaacuacugugggaagaauuguggaaagcuccagacgaucuuccuuaaauaccccauggagaaaguuccuggagcacguaugccagugcagauccgggugaagcugugguuuggacuaagcguggacgaaaaagaauuuaaccaauuugccgaggguaaguuauccguguucgcagaaacauaugagaacgagacaaagcuggcacuggugggaaauugggggacuacuggucugacuuauccuaaauuuagugacgugacgggaaagaucaagcuucccaaagauucauuuaggccaagugccggguggaccugggccggagauugguucguuuguccagaaaagacuuuacugcaugacauggacgccggacaucucuccuucgucgaggaaguuuucgaaaaucagacccgguuaccgggugggcaauggaucuauaugagugacaacuacacggacguuaacggggagaaggugcugccuaaagacgauauagaguguccccucgguuggaagugggaggacgaggaauggaguacagaucucaaucgagcaguggacgagcaggguugggaauacagcauuacaauuccaccugagagaaaacccaaacauugggugccagccgagaaaauguacuacacccauaggcguagacgauggguuagacuccgccgccgcgaccugagccagauggaggcacuaaaacgccacagacaggcagaggcagagggcgaaggcugggaguacgcaagucuauuuggauggaaauuccaccuggaauacagaaagacggacgcuuuucgcaggaggcgguggcgacggcgcauggaaccccucgaaaaaacagggccagccgcaguguucgcacuggaaggugcccuuggcgggguuauggacgauaaaucagaagacaguaugucaguuagcacucucagcuucggcgugaaccgcccaaccaucaguuguauuuuugauuaugggaauagguaccacuugcguugcuauauguaccaggcacgcgaccuggccgccauggacaaggauucauuuucagaccccuaugcaauaguguccuuucugcaucaaagucaaaaaaccgugguaguuaagaauaccuuaaacccaacuugggaucagacccucauauuuuaugaaauugagauuuucggggagccagcaaccguagcagagcagcccccuagcauugugguggaauuauacgaucaugacaccuacggcgcugaugaguuuaugggucgauguauuugucagccuagcuuagaaagaaugccucgccuggcuugguucccguugacccgagguucucagcccaguggggagcugcuggcuucuuuugagcugauucaacgcgagaagccugccauccaucacauccccgguuuugaaguucaggagaccucccggauucucgacgaaucugaggauacagaccugccuuacccaccuccccagcgcgaagccaacauuuacauggucccccaaaacaucaaaccugcucugcagaggacagcaaucgaaauuuuggccuggggccuccggaauaugaagaguuaccaguuggccaacauaaguucuccuaguuugguggucgaaugcggcggucagaccgugcagagcugcgucauucgcaauuuaagaaagaauccaaauuucgacauuugcaccuuguuuauggaggugaugcugccacgagaagaacucuacugcccacccaucacagugaaagugaucgauaaccggcaguuuggcaggcgcccagucgucgggcaguguacuauaaggagucucgaauccuuccucugugacccauacucugccgaaagucccagcccucagggggggcccgacgaugugagccuucuuucuccaggagaggauguccuuaucgauaucgacgauaaagagccccugaucccuauacaguuagcugauggucucagcagcuuggcaccaaccaauacagcuucacccccaaguucaccccacgaggaggaguuuaucgacuggugguccaaauucuuugcuaguauuggcgaacgggagaagugugggagcuacuuggaaaaagauuuugauacccugaaaguguacgauacccaacuagaaaacgucgaagcauuugagggucucagugacuuuugcaauacauuuaaacuguacaggggcaagacgcaggaagagacagaagauccuagugugauaggagaauuuaagggccucuucaagauuuauccccuaccggaagauccagccaucccuaugccaccccggcaguuccaucagcuugccgcucaagggccucaggaaugucuggugcgaaucuauaucgugagggcuuucggucugcaaccaaaggaucccaauggcaagugugaccccuauaucaaaaucucgaucgggaagaaaagugucucggaucaggauaauuacauucccuguacacucgagccaguguucgggaagauguucgagcugacuugcacccugccuuuagaaaaggaccugaaaaucacccuuuacgauuaugaucucuuaaguaaggacgagaaaaucggcgagacgguaguugaucucgagaauagacuccuuaguaaauucggcgcgaggugugguuugccucagaccuauugugugucgggaccgaaccaguggagggaucaacugaggccuucacaacugcugcacuuguucugccagcagcaucgugugaaagcucccgucuaucggaccgaccgugugauguuccaggacaaggaguacaguaucgaggaaaucgaggcuggacguaucccuaauccccaucugggaccgguggaagagcgacuugccuugcacgugcugcaacagcaggggcuuguuccagaacauguggagucucggccauuauauuccccauugcaacccgauaucgagcaggggaagcuccagauguggguggaccuguuuccaaaggcccuugggagaccaggccccccauucaacauuaccccacggagagcgcgccguuuuuuccugagaugcaucaucuggaauacccgugacgugauucuggaugaucugucgcucacaggugagaaaauguccgacauuuacgucaaaggcuggaugaucggcuuugaagagcauaaacagaagaccgacgugcauuacagaucucugggcggggaggguaauuucaauuggagguucauuuuucccuuugacuauuugccugccgagcagguguguacaauagcuaagaaagaugcuuucuggcggcucgacaaaacagagucaaaaauacccgcaagaguaguguuccaaauuugggauaaugauaaguuuuccuucgaugacuuucucggaucccuucagcuggaccugaaccggaugcccaagccagcgaagacugccaagaagugcucucuggaucaacuggacgacgcuuuccauccugagugguuugugucacuguucgagcaaaagaccgugaaaggaugguggccuugcguugcugaggagggugagaagaagauccucgcugggaaacucgaaaugacucucgaaauaguugccgaaucugaacacgaggagagaccugcugggcaggguagagacgagccuaacaugaauccaaaacucgaagacccgcggaggccugacaccuccuuucucugguuuacaagcccuuacaagacuaugaaguuuauccuuuggcggcgcuuccgcugggcgauuauacuguucauuauuuuguucauacugcuucuguuccuggcaaucuucauuuaugcauucccgaacuacgccgcaaugaagcugguaaaacccuuuucuuag

SEQ ID NO: 4871 - RNA, 6339 nt, Artificial Sequence
  Description of Artificial Sequence: Synthetic coding sequence
augcugugcugucuucucguccgcgcuagcaaucuccccagugccaagaaggaccgccgaucagaccccguugcuagcuugacuuuccgcggaguuaaaaaacggacuaagguaauuaagaauucugucaaccccguguggaaugaaggcuucgagugggaccugaaagggauaccacuggaucaggggucugagcugcaugugguugugaaagaccaugaaacaauggggcggaauagauuucuaggugaagccaagguuccguugcgagaggugcucgcuacuccaucucugagugcaagcuuuaacgcgccccuguuagacaccaagaagcaacccaccggcgccucucugguacugcaaguuuccuauacaccgcucccaggugcugucccucuguuuccuccaccaaccccucuugagccgagcccgacacuucccgacuuggacguugucgccgguggcggucagaguagagcugagacguggagccuauugagcgauagcacuauggauacucgguauagcgggaaaaaguggccggcccccacugauacuggaggcgaggaggacaccgaggaccaggggcugacuggugacgaggcugaacccuuucuugaccaaagugggggccccggcgcuccaacuacuccacgcaaacucccaucucggcccccgccacauuaccccgggaucaaaagaaagcgguccgccccaacuagccgcaagcucuugagcgacaagccccaggacuuucagauccgagugcagguuaucgaaggcagacaacuuccuggagucaacaucaagccuguggugaaagucacggcggccggccagaccaagagaaccagaauccacaaagguaacagcccccuguucaacgagacucuguuuuuuaacuuguuugacucaccuggugagcuguuugaugagccaaucuuuaucacaguagucgauagccgcagucuccgcacugacgcucugcugggagaauuuaggauggauguugggaccaucuaucgagagccucgccaugccuaucuuaggaaguggcuguuauuaucggaucccgaugauuuuuccgccggugccaggggguacuuaaagacaagccuguguguucucggcccuggcgaugaagccccccuggaacgcaaagacccuucggaggauaaagaggacaucgaguccaauuuacugagaccaaccggagucgcccuccgcggugcacacuucugucugaaaguuuuccgggccgaggacuuaccucaaauggaugacgcagugauggacaacgugaaacaaaucuuuggcuucgagucaaacaaaaaaaaucugguugacccuuucguugaagucagcuucgcuggcaagauguugugcaguaaaauccuggagaaaacagcuaacccucaguggaaucagaacauaacucugccugccauguuucccucuaugugcgaaaagaugaggauaagaauuaucgauugggacagauugacacacaacgauauuguggcaacaacuuaccuguccaugucaaaaauuagcgcuccugggggcgaaaucgaggaagagccugccggcgccgucaaacccaguaaggcauccgaucucgacgauuaucucggauuuuuacccaccuucggccccugcuauaucaaucuguacggaagcccucgggaguucaccggguucccugacccauacacagagcugaacacaggaaaaggggaggggguggccuaccggggccgccuucuccuuagcuuggaaaccaaacuuguggaacauucagaacagaaaguggaagaccugccugcagaugacaucuuaagaguugagaaauacuugcgucggcgaaaguacucauuguucgccgccuuuuauagcgcgacuaugcugcaggacguggaugaugcuauucaauuugaggugucuaucgguaauuacggcaacaaguucgauaugacaugucuuccucucgccucuacaacacaguauucaagagcuguguucgacgggugucauuacuacuaucuccccuggggcaaugugaaacccguggucguucuaucuagcuacugggaagauaucagucaccgcauagaaacucaaaaccaacucuuagggaucgccgaccgguuggaagcaggacucgagcaagugcaccuggcccucaaagcucaguguagcaccgaagauguggauagucugguagcacagcuaaccgacgaacugauugcuggguguucacaaccacugggagauauacacgagacccccagcgcaacacaucuggaccaguaccucuaucaacucagaacccaccaccucagucagaucacagaagcugcccucgcucugaagcugggccacuccgagcugccagccgcucuugagcaagcugaggacuggcugcugagacugcgggcgcuagcugaggaaccccagaacucucugcccgacauugugauuuggaugcugcagggugauaagcgcgucgccuaccaacgcgugcccgcccaccaagugcuguucucacgacggggggcuaauuacuguggcaaaaacugcggcaagcugcagacuauuuuucugaaauauccaauggaaaaaguccccggcgcaaggaugcccgugcaaauucggguuaagcucugguucggacucaguguggacgagaaagaguuuaaccaguuugccgagggcaaguuguccgucuucgcugagacuuacgagaaugaaacuaaguuagcucucguggguaauugggggaccaccggcuugaccuacccuaaguuuagcgauguaacaggaaaaaucaagcugccaaaagauaguuucagaccgagcgccggguggacuugggcuggagauugguucgugugccccgagaagaccuuacuccacgacauggacgcggggcaccuguccuucguugaagaaguguucgagaaccagacgaggcuaccaggcggacaguggaucuauaugagugacaacuacaccgacgugaauggagaaaaagucuugccuaaggacgacauugaguguccauuagguuggaaaugggaggaugaggaguggucaacugaucucaauagggcugucgacgaacagggaugggaauacagcaucaccauuccuccagagcgaaagccuaagcacugggugccugcugaaaagauguacuacacacaccgccgucgaagguggguucgccuccgcagaagagaccugucacaaauggaagccuugaaaaggcauaggcaagcggaagcggagggggaaggcugggaauaugcauccuuguucggcuggaaguuucacuuggaguaucgaaagacagaugccuuccgaaggcgaagauggagaagacggauggagccguuggagaaaacuggaccugccgccguauucgcacuggagggugcccucggcggcgucauggaugauaagucagaggacuccaugucugucucaacauuaucuuucggaguaaaucgucccacuauuucauguaucuucgacuauggcaaccgcuaucauuugcguugcuacauguaucaagcgcgugaucuggcugcaauggacaaggauaguuuuagcgauccguacgccaucgugucuuucuugcaccagagucagaagaccgucguuguuaagaacacguuaaacccuacaugggaccaaacucuaaucuucuacgaaaucgagauuuuuggggagcccgcaaccgucgcugaacaaccccccucuaucgugguggaacuuuacgaccacgacacauacggugccgacgaguuuauggguagguguaucugccagccuucacuugagaggaugccucggcuggccugguucccucucacccgcggaagccagcccucuggcgaauugcuugccucuuucgagcugauacagcgggagaagccggcgauucaucacauacccgguuuugagguccaagagacaucgcgaaucuuggacgaaagugaggauaccgacuugccuuacccaccaccacagagagaggcaaauauauacaugguaccgcagaauaucaagcccgcacuucagagaacagcaauagaaauucuagccuggggccuaaggaacaugaaauccuaccaacuugccaauaucagcuccccgucacucgugguggaguguggcgggcagacugugcagaguugcguuauuagaaaccugagaaaaaauccuaacuucgacauauguacucuauucauggaggugaugcuaccgagggaggagcuuuacugucccccaaucacgguaaaggugaucgauaaucggcaguucggacggcggcccgugguggggcaguguaccauaaggagucuggagucauuccugugugauccguacucggccgaaucuccaaguccccagggaggcccggaugaugucucgcugcugagcccuggagaggacguccuuaucgacaucgaugacaaggaaccucucauucccauccaggaggaagaguucauugacugguggucuaaauucuuugcaucuauaggagagcgagagaaguguggcucuuaccuggaaaaagacuuugacacauugaaggucuacgacacgcagcuggagaauguagaggcuuuugagggucugucagacuucugcaauacauucaagcucuaucgcggcaagacacaagaggagacugaagauccauccgugaucggugaguucaagggccucuucaagaucuauccucucccugaggauccugccauuccuaugcccccuaggcaguuccaccaacuggcggcgcaagggccccaagaaugucugguuaggauuuauauugucagagcguucgguuugcagccuaaagacccuaacgguaaaugcgauccguacaucaagauuucuauuggaaagaagaguguaagugaccaggacaauuauauucccuguacccuggagccgguguuuggcaaaauguucgaacugacauguacacugccucuugagaaagaccuuaaaauuacccuuuaugauuaugauuugcucaguaaggacgagaagauuggcgaaaccgucguggauuuagaaaaccgacugcuuucuaaauucggggcccgaugcggccucccucagacguacugcgucuccggcccaaaucaguggcgcgaccagcucagacccucacaauuacugcacuuguuuugccagcagcauagagucaaagcccccguauauaggacggaucgaguuauguuccaggacaaggaguacagcauugaggagauugaggcuggcaggauucccaacccucaccugggccccgucgaagaaagacuugcacugcauguucugcaacagcagggucuggugcccgaacacguggagucacggccccuguauagcccucuccagcccgauauugagcaaggaaaauuacagauguggguggaccuauuucccaaagcacuaggucggccugguccuccuuucaacaucacaccccgacgagcaagacgcuucuuuuugcgauguauaauuuggaacacucgugacguuauccucgacgaccugagucugaccggagagaaaaugagcgauaucuacgugaagggcuggaugauuggauuugaggagcauaagcagaaaaccgauguccauuaccgauccuugggaggugagggcaauuucaacuggcgauuuauuuuccccuuugacuaccugccagcugaacagguauguacgaucgccaaaaaggacgcauucuggcggcucgauaagacugagagcaaaauaccagcacgcgugguguuucagaucugggauaaugacaaguuuagcuucgacgauuuucugggcucccugcagcuggaucugaaucguaugccaaaaccggcaaagaccgccaagaaaugcucgcuugaccaguuggacgaugccuuccacccagaaugguucguaagccuguucgagcagaaaacugugaaaggcugguggccuugcguggcagaagagggagaaaaaaagauacucgccgguaaacuggagaugacccuggagauuguggcagagagcgaacacgaagagcgacccgccggacaaggccgcgaugaacccaacaugaauccaaagcucgaagauccacgacguccagacacuuccuuccucugguucacgucucccuauaagacuaugaaguucauacucuggaggagauuuaggugggcuaucauucuguuuauuaucuuauucauuuugcugcuguuuuuggccauuuucaucuacgccuucccaaacuacgccgcuaugaagcuuguuaaaccuuucagcuag

SEQ ID NO: 4872 - RNA, 6267 nt, Artificial Sequence
  Description of Artificial Sequence: Synthetic coding sequence
augcugugcugccuacuugugagagcguccaaccugccuucagcgaagaaggaccggcgcucagauccugucgcaagccugacauuccguggagugaagaaaaggaccaaagugaucaaaaauuccgugaaccccguguggaacgagggguucgaaugggaucugaaggggauuccccucgaccaggggagcgaacuucauguaguggugaaagaucacgaaacgaugggucgcaaucgguuccucggggaagcaaagguuccccuacgcgagguucuggcuacgcccucccuuuccgcaagcuucaaugcgccucugcuggauaccaagaaacagccuacuggagcaagccucgugcugcaggucagcuacacaccauugccaggcgcuguaccucuguucccuccccccacgccacuugaaccuuccccuacccuaccagaccuugacguuguggcagauacuggaggcgaagaagauaccgaagaucagggucugacuggagacgaagccgaaccguuuuuagaucaaucuggaggccccggcgcuccuaccacaccccguaaacuccccuccagaccuccuccacacuacccagggauuaagagaaaacggagcgccccuacaucuaggaaauuguuguccgacaaaccccaggacuuccagaucaggguccaggucauagagggccgucaguugcccggaguuaauauaaagccgguugugaagguaacugcugccggacagacaaagcggacaaggauccacaaggguaauucaccucucuuuaaugaaacucuuuuuuuuaaucucuuugacucccccggcgaacucuuugacgagcccauauucaucaccgugguggacagccgcagucugcguaccgaugcgcugcucggagaguuccgaauggacgugggaacaauuuaucgagaaccccgccacgcuuaccucagaaaguggcugcuccucagcgacccagaugauuucucagcuggcgcucgggguuacuuaaaaacaucguugugcguucugggacccggcgacgaagcgccacuugagagaaaggacccaagugaggacaaagaagacaucgagagcaaccucuuacgaccgacuggaguggcauugcguggagcccacuuuugccucaagguuuuuagggccgaggaccugccacagauggaugacgccgugauggacaacgucaaacagauuuucggauuugaaagcaacaagaagaaccucguggacccuuucgucgaaguuaguuucgcagggaaaaugcugugcagcaagauucuagagaagacugccaacccccaguggaaccagaacauuacccuucccgcaauguuccccuccaugugcgagaaaaugagaaucaggaucaucgacugggaccgccucacacacaacgauauugucgcgacaacauaucugucuaugagcaagauaucugcacccggaggagaaauugagguggaugacuaccuggguuuuuugcccacauuuggccccuguuauauuaaucuuuauggcaguccacgcgaauuuaccggauucccagauccauauaccgagcuuaacacgggcaaaggcgagggcguggcauacagagguagacuccuccugucacucgagacuaaauugguggagcauagugagcagaaagucgaggaucugccugccgaugacaucuuacggguggaaaaguaccuccgcagaaggaaauauaguuuguuugccgcuuucuauucggcaacaaugcuucaagauguagaugacgccauccaguuugaagugagcauaggaaacuacggaaacaaguucgacaugacuugucuccccuuggccaguacuacccaguacucaagagcuguuuuugacggcugucacuacuauuaucugccauggggaaaugugaaacccguaguggugcugucuucguacugggaagauauuucucaccggauagagacucagaaucagcuucuggggaucgccgauagauuggaagcgggucuugagcagguucaucuggcguuaaaggcucagugcagcacagaggacguggacaguuuggucgcccagcugaccgacgaguuaaucgcuggcugcagucaaccucugggugacauccaugaaacgcccucagcaacgcaccucgaccaauaucuguaccaguugcggacccaccaucugagccaaauuacagaagccgccuuggcccugaaauugggccacucugagcugccggccgcccuugaacaggcugaagacuggcuguugagacuucgggcucuugccgaggagccacagaacucccugccagauauugugaucuggaugcuccagggcgauaaaagggucgcuuaccagagggugccagcacaucaagugcuauucucaagaagaggggcaaauuacugcggaaaaaauugcggaaaguuacagaccauauuucugaaguauccaauggagaaggugcccggagcgcggaugcccguccagauacgcgugaaacuuugguuuggccugagcguggacgagaaggaguucaaccaguucgcugaaggcaaacugucugucuucgcugagaccuacgaaaacgagacaaagcucgcuuuagugggaaauugggggacaacaggcuuaacguacccgaaguucucagacguaaccggcaaaauaaagcugccaaaagacucguuucggccgucugcaggguggacgugggccggagauugguuuguauguccugagaaaacccugcugcacgacauggaugccggucaccugagcuucguggaggagguguuugaaaaucagacuagacucccugguggccaauggauuuacaugucggauaacuauacagacgucaacggcgaaaagguacucccuaaagaugacaucgaaugcccauugggauggaagugggaggaugaggaguggucuacugaccugaaccgggcagucgaugaacagggcugggaguauucuauuacuaucccucccgagaggaaaccuaaacacuggguaccggcggaaaagauguacuacacacaccgacggcggcguugggugcgacuccgccgaagagauuugucacagauggaggcccugaagcgccaucgacaggcggaagcugaaggugaaggaugggaguaugcuucauuauucgguuggaaauuucaccuggaauacagaaagaccgaugcauuccggaggagacgcuggcgacggcggauggaaccccuggaaaagacugguccagccgcagucuuugcauuagaaggagcguuagggggagugauggacgauaagagcgaggauucuauguccgucuccacucuuaguuuuggggugaacagacccacuauuucuugcauuuucgauuacggaaaccguuaccaccugagaugcuacauguaucaggcucgcgaccuagccgccauggauaaagauucauuuucagaucccuacgccauugugagcuuucugcaucagagucagaaaaccgucguggugaagaauaccuugaaucccaccugggaccagacgcugauuuucuaugagaucgagaucuucggggagccugccacaguugcugaacagccuccgaguaucguuguggagcuguacgaccaugauacauauggcgcggaugaguuuaugggcaggugcauuugucaaccgucuuuagagcgcaugccacgguuggcaugguuuccacugacaagaggcucucaaccaagcggggaauugcuggccucuuuugagcuaauucagcgagaaaaaccagcaauucaucauauaccugguuuugaggugcaagagaccagcaggauacuggacgaguccgaggacacugaucugccguauccuccaccacagagggaagccaacauauacaugguuccccagaacaucaagccugcgcuccagcggacagcuauugagauucuugcauggggacuuagaaacaugaagagcuaucagcuugccaacauuucuucgccaucucugguuguggagugcggaggccagaccguccagucuugugugauucgcaaucuacggaagaauccuaauuuugacaucugcaccuuguuuauggaagugaugcugccgcgggaggaacuuuacuguccgccaauuacaguuaaagugaucgauaaucggcaguuuggaagacggcccgugguaggacaguguacuauacggagccuugaaucauuucugugcgaccccuacagugcagagagccccucuccucagggcggucccgacgaugugucacucuuaagcccaggcgaggacguguuaauugauauugaugacaaggagcccuuaauucccauccaguuggccgacggguugaguagccuugcuccaaccaacacagcaucacccccuagcagcccucacgaggaggaguuuauagacugguggaguaaguuuuucgcgucuauuggagaacgagaaaagugcggaucauaucuggaaaaggacuucgauacccuuaaggucuacgauacgcaacuggagaaugucgaggcuuucgaaggccugucugacuucugcaacaccuuuaagcucuaccgggggaagacacaagaagaaacagaggacccuagcguaauuggagaguucaaaggauuguuuaaaaucuacccacuuccagaggaccccgcaauuccaaugccuccgaggcaguuucaccagcucgcagcccagggaccacaggagugucucguccgcauuuacauuguucgggccuuugggcugcaaccaaaggaucccaauggcaagugcgacccauauauuaaaauuucaauaggcaagaagaguguuucagaccaagacaacuauauucccugcacgcuggaacccguguucggaaagauguucgagcucacauguacuuugccguuggaaaaggaccuaaaaauuaccuuguacgauuaugaccugcucagcaaggacgaaaagauuggggaaacagucgucgaccucgagaaccgucugcuaucuaaguucggugcacgaugugguuugccucaaacauauugcgugagcggcccuaaccaauggagggaucagcucagacccagucagcuucuacaccuauuuugccagcaacauaggguuaaggcuccagucuaucggaccgaccgggugauguuccaggacaaggaguauagcauugaggaaauugaggcagguagaauuccuaacccccaccugggccccgucgaggaaaggcucgcccuccacguucugcagcagcagggacuggugccagaacauguugaaucucggccccuguauuccccccugcagccagacauugagcaaggaaaguugcagauguggguggaucuguuucccaaagcgcuaggacggcccggcccaccauucaauaucacuccgagacgagcucgacgcuucuuuuuacgauguauuaucuggaacacccgggaugugauucucgacgaccucagccuuacaggugaaaagauguccgacaucuacgugaaaggguggaugauuggcuuugaagaacauaaacaaaaaacggauguucauuaccggaguuuggggggcgaaggcaacuuuaacuggagauucaucuuuccuuuugauuaucuuccggccgagcaggucugcaccaucgcaaagaaggacgcauuuuggagacucgacaagacugagagcaaaauuccggccagagugguguuccagaucugggacaaugacaaguucagcuuugaugacuuccugggcucacuucaguuggaccuuaaccguaugcccaaaccagccaaaacagccaagaaguguagccuggaucagcuggaugacgccuuccacccagaaugguucgugucacuuuuugaacagaagaccgucaaaggaugguggccauguguggccgaagagggcgaaaaaaaaauccuggcugguaagcucgaaaugacccuagaaauuguugccgaguccgagcacgaggagcggcccgccgggcagggacgcgaugaaccaaacaugaauccgaagcuggaggauccuaggcgccccgacaccucuuuuuuaugguuuacaucucccuacaaaacuaugaaguucauccuguggcgacgguuuagaugggccauuauuuuauuuauuauucuauucauccuacuguuguuucuggccauuuuuaucuacgcguucccaaauuacgccgcaaugaagcuggugaaaccuuuuaguuag

SEQ ID NO: 4873 - RNA, 6294 nt, Artificial Sequence
  Description of Artificial Sequence: Synthetic coding sequence
augcuaaggguguucauacuauaugccgagaacguacauacuccggacaccgacaucuccgaugccuauugcucagcgguuuuugcuggugugaaaaagaggaccaaagugauaaaaaacucagucaauccuguguggaaugaggguuucgagugggaucucaaggguauaccccuggaccagggcuccgaacugcaugugguggugaaggaccacgaaacaaugggacgaaaccgauuccucggugaagcuaaagugccccuuagagaagucuuggccacccccucuuugagcgccucauucaacgccccccugcuggacaccaaaaaacagccaacaggagccucccuagugcugcagguuuccuauacaccauuacccggcgccguuccccuauuucccccuccuacaccccuggagccaagcccgacccucccagaccucgacgugguggccggcggaggacagaguagggccgaaaccuggagcuugcugagcgacucaaccauggauacucgguacuccggcaagaaauggccugcuccgacagacacaggcggugaagaagauaccgaggaccagggcuugacuggcgaugaagccgagcccuuucuggaucagagcggaggacccggggccccuacuacucccagaaagcugccuucccgcccccccccucacuaccccgggaucaaaaggaaaaggagcgcucccaccagccguaaacugcugagcgacaagccucaggauuuccagauccgagugcaggucaucgaaggaaggcagcugccaggagucaacauuaaacccguugugaaagugacagcugcaggacaaaccaagcgcacuaggauccauaaagggaauucaccacucuucaacgagacacuuuuuuuuaaucuguuugacucaccuggcgagcuauuugaugagccuauuuuuauaacagucguggauagccgaagcuugcggaccgaugcucuacuuggggaauuccgcauggacgucgggacaauuuaccgcgaaccacgucaugccuaucuuagaaaaugguugcugcucucugauccagaugauuucucugccggagcuaggggguacuugaagacaagccucugugugcuugggccaggcgacgaggcgcccuuagagcgaaaggacccgucggaagauaaagaagauaucgaaucuaaucugcugcgcccaacuggggucgccuuacgaggggcccacuuuugccugaagguauuuagggcugaggaccuaccucagauggacgaugcugugauggauaaugucaaacagaucuuuggauuugaaagcaacaaaaagaaccugguggauccuuucguagagguuuccuuugccggcaagaugcucugcucaaagauauuggaaaagacggccaauccucaauggaaccagaauaucacccucccagccauguuuccuucaaugugcgagaaaaugcgaaucaggaucauugauugggauagacuaacucacaacgauauugucgccacuacuuaucugagcaugucuaagaucuccgcgcccgggggagaaauugaaguggacgauuauuugggcuuucugcccacguucgggccuugcuauaucaaucuuuacggcagccccagggaguucacaggcuuccccgacccuuacaccgagcucaauacuggcaagggggaggggguggcguaucgggggcgcuugcuucugucuuuggagacuaagcugguggagcauagugagcagaaagucgaggaccucccagcggacgauauccuaagaguggaaaaguaccugcggcgacggaaauauagccuguucgccgcauuuuacagcgcaacgauguugcaagacguggacgaugcuauacaguuugagguuuccauaggcaauuauggaaacaaguucgauaugaccugcuugccauuagcauccaccacucaguacucgagggcaguguucgacgggugccacuauuauuaucugccauggggaaauguaaagccaguugugguccugagcaguuacugggaggacaucucccaucggauugaaacccaaaaccagcucuuaggcauugccgacagguuagaagccggucuggaacaggugcaccuggcucugaaagcccaguguaguacagaggauguggauucccugguagcccagcugacugacgagcuuauugccgguugcagccaaccccucggugacauucaugagacuccauccgcgacucaucuggaccaauauuuguaccagcucaggacucaccaucucucgcaaaucaccgaagcagccuuggccuugaaguugggccacucagaauuaccagcagcacuugaacaggccgaggauuggcuucuccgucucagggcucucgccgaggagccucaaaacagccuuccugacauugugaucuggaugcugcagggcgauaagagggucgccuaucaaagaguuccagcgcaccaaguucuguuuucucgccgaggugcuaacuauugcggcaagaauugcggaaaguuacaaacuauauuccucaaguauccuauggaaaagguucccggcgcaagaaugccaguccagauucgggugaagcuuugguucgggcuguccguagaugaaaaggaauucaaccaauucgcugaagguaagcuguccguuuuugcugagacauacgaaaacgagacaaaacuggcacucguggggaacuggggcacaacuggacugaccuaucccaaauuuucggacgucacagguaaaauuaagcuuccaaaggacuccuuucguccuucagcaggguggaccugggcaggagacugguucgugugcccagagaaaacccuacuacaugacauggaugcgggccacuuaaguuucgucgaagagguguuugaaaaccagacgagacuuccugguggccaauggaucuacaugucugacaauuacacugauguuaauggcgagaaggugcugccaaaagacgacauugagugcccuuugggcuggaaaugggaggacgaagaauggagcacagaccugaaucgggcuguagaugaacagggaugggaauauuccauuacuauaccccccgaaaggaagccuaagcacuggguuccugcugagaaaauguacuacacucaucgcaggagacgcuggguacgguugcgucgaagagauuuaucccaaauggaggcgcucaaacgucauaggcaagcagaggccgagggcgagggcugggaauaugccucccuauucgguuggaaguuccaccuagaguauagaaagaccgacgcauuuagacggaggagauggaggcggcgaauggagccccuggaaaaaacugggccggccgccgucuucgcucuggaaggcgcucuagguggggugauggacgacaaaagugaggacuccaugucaguaucaacccuguccuuuggagucaauaggccuaccaucucguguaucuuugauuacggaaaccgcuaucaucuccgcuguuacauguaccaggcgagggaccuggcagcgauggauaaagauagcuucuccgacccuuacgcaauaguguccuuccugcaccagucucagaaaaccguuguggugaaaaauaccuugaaccccaccugggaccagacacucaucuuuuacgaaauagaaaucuucggcgaaccugcaacaguggccgaacagccccccucuaucgucguggagcuguacgaccacgauaccuauggugcagaugaauucaugggucgguguaucugucagcccucccucgagagaaugccucguuuggcuugguucccgcuaacgagagggucacagccaagcggcgaacugcuggccaguuucgaauugauucaaagagagaagcccgccauccaccacaucccaggauuugagguccaggaaacuagcagaauccucgaugaaucagaagacacggaucuaccuuauccucccccccagagggaagccaauauauauaugguaccacaaaacaucaaacccgcuuugcagcgcacagccauugaaauucucgcuuggggccuccguaacaugaaguccuaccaacucgccaauauuuccucuccuuccuuagucguggagugcggcggccagacaguucagaguugugugauucggaaccugcgaaaaaaucccaacuuugauaucugcacuuuguuuauggaaguuaugcugcccagagaagaauuauauugcccacccaucacagucaaagugauugacaaccggcaauuugggcgaaggcccguggucggacagugcacaauucgaucucucgagaguuucuugugcgaucccuacagcgcagaaucacccucaccucagggcgggccagaugauguauccuuauuaucuccuggcgaggauguccuaauugauauagacgauaaagaaccucugauuccuauccaagaggaggaauucaucgacugguggucaaaguucuucgcuuccaucggggaacgggagaagugcgggagcuaucuggaaaaagauuuugacacucugaaaguuuacgauacccaauuggaaaacguugaagcauucgaaggacugagugacuuuugcaacaccuuuaagcucuaccgagguaagacucaagaagagaccgaagaucccagcgugauaggcgaguucaaaggguuguuuaaaauuuacccccugccugaggaucccgccauccccaugccaccccgccaguuucaccagcucgcugcccaaggaccgcaggaaugccuggugagaaucuauaucgugcgcgcuuuuggacuucagcccaaggauccuaauggcaaaugugauccuuauaucaaaauauccauugguaaaaaguccgucuccgaccaggacaacuauaucccauguacucuggaaccuguguuugguaaaauguucgaacuuacaugcacccugccucucgaaaaagaccugaagaucacccuguacgacuaugaccuucuauccaaggacgagaaaaucggcgagacuguuguugaucuugaaaaucggcuacugucgaaauuuggagcucgcuguggcuuaccacagacuuauugcguuagugggcccaaccaguggcgggaucaacuacgaccgucacagcuucuccauuuguucugccagcagcaucgaguuaaggccccuguauacagaacagaccgcguaauguuucaggacaaagaauauucuaucgaagagauugaggcagguagaauuccgaacccacaccucggacccguggaagagagacuggcgcugcacguucugcaacaacagggcuuagucccagagcacguugagucucgaccacuguauagcccacugcagcccgauauagaacaggggaaacuucaaaugugggucgaccuuuuuccaaaggcuuugggcagaccgggcccccccuuuaacauaacuccgcgccgggccaggcgcuuuuuucugagaugcauaaucuggaauacacgagacgugauucuagaugaucugucucugacaggugagaagaugagugauauuuacguaaaaggguggaugauuggguucgaggagcacaagcagaagaccgaugugcacuaucgcuccuuagguggggagggaaauuucaauuggagguuuauuuuccccuuugauuaucuuccugcagagcagguguguacgauagccaaaaaggaugccuuuuggagacuggacaaaacagagucuaaaauuccggcaagaguuguguuucagauaugggacaacgauaaguuuuccuucgacgacuuccuugguuccuugcagcuggacuugaaccguaugccuaagccugccaagacagcgaaaaagugcucucucgaucaacuggacgaugccuuccacccugaaugguuugugagucuguucgagcagaagacugugaagggaugguggccauguguagcagaagagggggagaaaaaaauucucgcugggaaacuggaaaugacacuugaaaucguagccgaaucagaacaugaggaacgucccgcgggacaaggcagggaugaaccgaacaugaaucccaaguuagaagacccgcgcaggccagauaccucauuccugugguucacgucuccguauaagacgaugaaauucauucucuggaggagguuuagaugggcgauuauacuguuuauuauacuguucaucuugcuucuguuucuggcaaucuucauuuacgcuuuccccaauuaugcagcgaugaagcugguuaagccauucucuuag

SEQ ID NO: 4874 - RNA, 6360 nt, Artificial Sequence
  Description of Artificial Sequence: Synthetic coding sequence
augcugugcugccugcugguccgagcgucuaaccuuccuucggcuaaaaaagaccgucgaagcgaucccgucgcuuccuugacauuccgaggggugaagaaacgaacaaaggucaucaagaauucuguuaaucccgucuggaacgaaggcuucgaaugggaccugaagggcaucccgcuggaccagggauccgagcugcacguugucgugaaagaccacgagacuauggggcgcaacagauuccucggcgaggcaaaagucccacugagagaaguguuagcaaccccuagccugagcgcuuccuucaaugccccccucuuggacacgaaaaagcagccaacgggugccagccuggugcugcaagucagcuauacucccuugccuggggcugucccucuguuucccccaccuacaccucuugaacccucuccaacccucccugaucuggacgugguggccggcgggggucaaucgcgggccgagacguggucucuguuaagcgacagcacaauggauacacgcuauagugguaagaaauggccggcucccacagacaccggaggugaggaggacacugaagaucagggccuaacuggagacgaggccgagccauuccucgaccagucuggcggucccggugcacccaccacaccgcgcaaacugccaucaagaccgccuccccacuacccaggcauuaaacggaaaagaagcgcucccaccucucggaaguuacugagugacaagccgcaagauuuccagaucagggugcaagugauugagggacgccagcugccaggggugaacaucaaacccgugguaaaggucaccgccgcuggacagacuaagcgaacgcggauccauaaaggcaauuccccucuguuuaacgagacucuguucuucaacuuauuugauucgccaggcgaauuguuugacgagcccaucuucauuacuguggucgacagccggucacuuaggaccgaugcucugcuuggcgaauuuaggauggauguggguaccaucuaucgagagccccgacaugccuacuugagaaaguggcuccuacuuucggacccggaugacuucucagcaggcgcucgcggauaccugaaaacuucucuguguguacucggaccuggugacgaggccccacuggagcgcaaggauccgucggaagacaaagaagacaucgagaguaaucuguugcgcccaaccggaguggcccugaggggcgcccauuucugccugaagguguucagggccgaagaucugccucagauggacgacgcugugauggacaaugugaaacaaaucuucggcuucgaauccaauaagaagaaccuugucgacccguuuguggaaguuagcuuugcaggcaaaauguuguguagcaagauacuugagaagacugccaauccacaguggaaucagaacaucacacugccagcgauguuccccuccaugugugagaagaugagaauucguauaaucgauugggaucgccucacucacaaugauaucguugcgacuacuuauuugagcaugagcaagauuagcgcucccgggggugaaaucgaggucgacgacuaucugggcuuucugccaaccuuugguccaugcuauaucaaucuauacggcucuccccgcgaauuuaccggguuuccugacccuuacacugaacuuaacacaggcaaaggagagggcgucgcuuaccgugggcgccugcuacugucccuugagacaaaacucguggagcacucagagcaaaaagucgaggaucucccugccgaugacauccuucgcguggaaaaauaccuuaggagacgcaaauacucauuauucgccgcuuucuacucagcaacuauguugcaggauguggacgaugcaauucaguuugaagucagcauugggaacuacgggaauaaguucgauaugaccugccuuccacuggcauccacaacucaguauucaagggccguguucgacggaugucauuacuacuaucugccuuggggaaacgugaaaccugucgucgugcuuucuucauauugggaggauauuagucaucgcauagagacucagaaucagcuucugggaaucgccgaccgccuggaagcgggacuugaacagguccaccuggcccucaaagcucaguguaguaccgaagauguugacagccuuguggcucaguugacagaugaauugauagcgggguguagucaaccucuuggcgacauucacgaaacucccagcgccacccaccuugaucaguaucuguaccaguugcguacccaccaccucucacagaucaccgaagccgcucuugcucuuaagcugggccauagcgagcugcccgcugcccuggagcaggcggaagauuggcugcugcgccucagagcucuagcugaagaaccacaaaacucccugcccgauaucguuaucuggaugcuucaaggugauaagcgaguggccuaccagaggguaccugcgcaccagguacuuuuuagucgacgcggggcaaauuauugcggaaagaauugcgggaaacuucagaccauuuuccugaaguaccccauggaaaaagucccgggugcccgaaugccaguucagauaagagugaaguugugguucggccuuagcgucgacgaaaaagaauucaaucaguucgcagaagggaagcugagcguuuuugcagaaacauacgaaaacgagaccaagcuugcccugguggggaauugggggacaacuggacugacauauccaaaguuuucugacguuacgggcaagauaaaguugccaaaggacucauuucgcccuucugcuggguggaccugggccggcgacugguuugucugcccagaaaagacacucuugcacgauauggaugcuggacaccuaucuuuuguggaagagguguucgagaaccaaacgagacugcccgggggccaguggauuuacauguccgacaauuauacugaugugaacggagagaaaguauugcccaaagacgacaucgaaugcccacuuggguggaagugggaagacgaagaauggagcaccgaccucaacagagcaguggacgagcagggaugggaguacaguaucaccaucccacccgaacggaagccuaagcauuggguucccgcugagaaaauguacuauacgcaccgaagacgucgcuggguacggcugaggcgucgugaccugucucagauggaggcgcucaagagacaccgacaggccgaagcugagggcgaagguugggaauacgcaucacuguucggauggaaauuccaucuagaguaccgcaagaccgacgcuuuuagacgacgccgauggcgccggaggauggaaccccuagagaagacaggaccagccgccguguucgcuuuagaaggugcacucggaggcgugauggacgacaaaucggaggauaguauguccguguccacucugucauuuggagucaaccgcccuacaaucuccugcauuuucgacuaugggaacagauaccacuugcggugcuauauguaucaggcucgggacuuagcagcaauggacaaggacagcuucucugaccccuacgcuauaguaucuuuccuucaccagucucagaaaaccgugguaguaaagaacacccugaacccuacaugggaucagacuuugaucuuuuaugaaaucgaaaucuuuggugaacccgcgaccgucgcugagcagcccccaucuaucgugguggagcuguacgaccacgacacguacggggcugaugaguuuauggggcgcuguauuugccagccaucacuggagaggaugcccagauuagccugguuuccacugacaaggggcucccagccaucuggugaauuauuggcuagcuuugaacugauacagcgggaaaaaccggccauucaucacauucccggcuuugagguccaggaaacuucucggauacuggacgaauccgaagacacagaccugccauaccccccaccacaacgugaggcaaauaucuacauggugccccaaaauaucaagccugcccugcaacgaacagcgaucgagauacucgccugggggcucagaaauaugaaguccuaccagcucgcaaacauaucgucucccagcuugguggucgaaugcggaggucaaacaguucagagcugcguuauacggaaccuucgaaagaacccaaauuuugauauaugcacgcuauucauggagguaaugcugccccgggaggagcucuacugucccccaaucaccguuaaagugauugauaauagacaguucggacggcgaccuguuguuggacaauguacuauacgaagucuagagagcuuucugugugacccguauucggcagaaagccccuccccccagggaggccccgacgaugugucccuacucagccccggcgaggacgugcucauugacauugacgauaaagagccauuaaucccuauucagcucgcagacgggcuuucuagucuggcuccaacuaauacugccagcccuccauccagcccacaugaagaggaguucauugacugguggagcaaguucuuugccagcauuggagaaagagaaaaaugcgggucuuaucucgagaaggauuuugauacccugaaaguguaugacacucagcuggagaauguggaggccuuugaaggcuugucugauuuuuguaacacauuuaagcuguaccggggcaagacacaggaagaaaccgaagauccaucaguaaucggagaguucaaaggccuguucaagaucuacccacugccagaggauccggcuauaccuaugccuccaaggcaguuccaccagcuggcugcucaaggaccacaggaaugcuuagugcguauuuacaucgugcgugccuucggacugcaaccuaaggacccaaaugguaagugugauccauacauaaaaaucucuaucgguaaaaagagugugucugaucaggauaacuauaucccuuguacucucgagccaguguuuggcaaaauguuugagcuuacgugcacucugccccuggaaaaggaccuaaagauaacccuguacgacuaugaucugcugucgaaggaugagaagauuggggagacaguggucgauuuggaaaaucgcuuacugagcaaguuuggagcucggugcggccuuccacagaccuauugcgugucaggcccuaaccaguggcgagaccaguugcgcccgucgcaauugcugcacuuguuuugucaacagcaucgcgugaaagccccggucuaucguacagaucgcguuauguuccaggauaaagaguacuccauagaggagaucgaagcaggucggauacccaauccacaucucggcccaguggaggagcggcuggcccugcacgugcugcagcagcagggacuugucccagagcauguugagucucguccacuuuacuccccuuugcagcccgacauugaacagggaaaauugcagaugugggucgaucuauucccgaaagcucuaggccgacccggucccccguucaacaucacaccacgacgagcucgcagguucuuucuccgguguauaauauggaacacuagagaugugauccuggaugaucuuucucugaccggggaaaaaaugagugacaucuauguaaagggcuggaugaucggcuucgaagaacacaagcagaaaaccgacguucacuacagaucuuuagguggugaagggaauuuuaauuggagguuuauuuucccauucgacuaccugcccgccgaacaagucuguacaauugcuaagaaggacgcauucuggagacucgacaagacugaaagcaaaauuccagcaagagugguguuucaaauuugggauaaugauaaguucaguuucgacgauuuucucggcuccuugcaacuggaccuaaacagaaugcccaaacccgcuaagaccgcaaaaaagugcucccuggaucagcucgacgacgcauuucacccagaaugguucgugucacuuuucgagcagaaaaccgucaagggcugguggcccuguguggccgaagaaggcgagaagaagauucucgcugggaaauuagagaugacgcuagagaucgucgcugaguccgagcaugaagagcgaccugccggacagggcagagacgagcccaauaugaacccaaaauuagaagacccccggcggccugacacaucauuccucugguuuaccucaccuuacaaaacaaugaaauuuauuuuauggaggcgcuuuaggugggccauuauccucuucaucauacuuuucauucugcugcuguuucuggcaauauucauuuacgccuuuccuaacuacgccgcuaugaagcucgugaaacccuucucuuag

SEQ ID NO: 4875 - RNA, 6297 nt, Artificial Sequence
  Description of Artificial Sequence: Synthetic coding sequence
augcuuugcuguuuacuagugagagcaucaaaccugcccuccgccaagaaggauagaagaagugacccaguggcaucacugacguuucggggcgugaaaaagagaacuaaaguaaucaaaaacucuguuaaccccguuuggaaugaaggcuuugaaugggaccugaaaggaauaccuuuagaccagggaagugaacugcacguuguagucaaagaucaugagacuaugggucguaauagauuccucggggaagcaaaagugccucugcgcgaaguucuggcaacccccucucugagcgccagcuuuaacgcgccauugcuggauacgaagaagcagccuacuggggcgaguuugguguugcaggucucauacacaccucuuccuggcgcugucccacuguuuccuccaccaacaccccuugagcccuccccaacccuuccagaccuggauguaguggcaggcggcggacagucucgcgcugaaacguggucucucuuguccgacaguaccauggacacaagauauucagggaagaaguggccggccccuacagauacagggggggaggaggauaccgaagaucaggggcugacgggugacgaggcugaacccuuucuggaccagaguggaggaccuggcgcucccaccaccccucgcaagcuuccaucucgaccaccuccucacuaccccggaauuaagcgaaaacgcagcgcuccuacuagcaggaaguuguugucggacaaaccucaagauuuucagauucggguucaagugauugaaggcagacagcuacccggagugaacauaaagcccguugucaaggucacagcagcaggacagaccaagagaacccggauucauaagggcaacaguccucucuuuaaugagacccuuuuuuuuaaucuuuuugacaguccaggcgagcuuuucgacgaaccgauuuucaucacuguuguugacagcaggagccugcggacagaugcacuucucggggaauucagaauggacguuggcaccaucuauagggaaccucgacaugccuauuugcgcaagugguugcuauugagugaucccgacgacuucuccgcuggagcacgggguuaccuaaagacaucguuaugcgucuuggggcccggggaugaggccccucucgagcgcaaggauccuagcgaggauaaggaggacaucgaauccaaccugcugaggccaacaggaguggcacugaggggggcucacuuuugcuuaaaaguuuuuagggcugaggacuuaccucaaauggacgacgcggucauggacaacgucaaacaaauuuucggcuuugagucuaauaaaaagaaccucguagacccuuuuguggaggucaguuucgcugggaagaugcuguguaguaagaucuuagaaaagacugccaauccacaguggaaccaaaauauaacccuuccugccauguucccaucaaugugugagaaaaugcggauacggaucauugacugggaucggcugacccacaacgacaucgucgcaaccacuuaucuguccaugaguaagauaucugccccagggggagagauagaaguugacgacuaccucgguuuccugccuaccuuugggccguguuauauuaaucuauacgggucuccccgugaauuuaccggcuucccggacccauauaccgaacucaacacugggaaaggagagggcguugccuacagagguagacuguuauugaguuuagagacaaaacuugucgagcauucggagcagaaaguggaagaucugccugccgacgacauacugcgggucgagaaguaccugcggcgcagaaaguacagccucuuugcugccuuuuacucggccacuauguugcaggaugucgaugacgcuauacaguucgaagucuccaucgguaacuacgggaacaaguuugauaugacaugccuucccuuagccagcacuacccaguacucccgggccgucuucgacggcugccauuacuauuaucuuccuugggggaacgucaagcccgugguaguuuugucuucuuauugggaagauauuagccaucguauugagacccaaaaucaacuccuggggauugcagaucgucuugaggccggacuggaacagguacaccucgcucucaaggcacaaugcucaaccgaggauguggacucucugguggcacaacugaccgaugaacugaucgccggcugcucucagccauugggcgacauccacgagacuccgagugcaacacaucucgaucaguaccucuaccaacugagaacgcaccaucuuagccaaauuacagaagcggcguuagcucugaagcuaggucacucugaacucccugccgccuuagagcaggcugaggacuggcugcugcgccugagggcccuggcugaggagccucaaaacagccugccggacaucgugaucuggaugcuacagggagauaaacgcguagccuaccagcgcguuccggcccaucaggugcuguucucucgcagaggugccaacuacuguggaaagaacugcggcaaguugcaaacaauauucuugaaguauccgauggagaagguacccggggcaaggaugccuguucaaauccgcgugaagcugugguuuggucugagcguggacgagaaggaguucaaccaauuugccgaaggcaaacucuccguauucgccgaaaccuaugagaaugaaacuaaacuggcacugguugggaacuggggcacgacgggacugacauaccccaaguuuucagacgugaccgguaagauuaagcugccuaaagacucauuuaggcccagugcuggcuggacaugggccggggauugguucguguguccagagaagacacugcuccaugauauggacgccggccaccugagcuuuguggaagaggucuuugagaaccagacaagacugccgggcggccaauggaucuauaugagugauaauuauacagacguuaacggagagaaaguguugccaaaggaugacaucgaguguccucugggauggaaaugggaggaugaggaauggaguacagaucuuaauagagccguggacgagcagggcugggaguacagcaucaccaucccucccgagaggaagccuaagcacugggugcccgcugaaaaaauguacuauacccacagacggcgccgcuggguucgauugaggaggcgggaccugucucagauggaggccuugaaacgucauaggcaggccgaggccgagggagaaggaugggaauacgccucccuuuuuggauggaaguuucaucuggaguauagaaagaccgacgcauuuaggcggcgccgguggagaagaaggauggaaccuuuagagaagacgggaccugccgccguguucgcccucgaaggcgcgcugggcggagugauggaugacaaaucugaggacagcaugucugugagcacccucucauucggcgucaauagaccuacgauuuccuguauuuuugauuacggaaaccgguaucaucugcgguguuacauguaucaggccagagaccuggcagccauggacaaagauucauuuuccgaccccuacgccaucgucucauuccugcaccaaucgcagaaaacagugguggugaaaaacacacuaaacccgacuugggaucagacacuaauauuuuacgaaaucgaaaucuucggcgagcccgcaacagucgccgagcagccucccaguauuguaguggagcuauaugaccaugauacauacggagccgaugaauuuauggguaggugcauuugccagccuucccuggaaaggaugccucgacucgcgugguucccauugacucggggcucucagcccaguggcgaauuacuggccagcuucgaacuuauccagcgugaaaaacccgcgauucaccauauaccuggauucgaagugcaggagacaaguagaauucuagaugagagcgaagacaccgaccucccauauccccccccacagagggaagcuaacaucuacaugguuccacagaacaucaaacccgcacugcagcgaacugccaucgagauucuugcuuggggccugagaaauaugaagucauaccagcuggccaacauuaguagccccucccuggucguggaaugcgguggucagaccguccagucuugcguuaucaggaaucugcgaaaaaauccuaacuuugacaucuguacacuguucauggaggucaugcuaccucgugaagagcuguacugccccccaaucacagucaaagugaucgauaaucggcaguuuggccgccggcccguggugggacaauguacaaucaggucccuagaguccuuucugugcgacccuuacucugccgaaucuccuucaccccaagggggcccugacgaugugagucugcugucuccuggggaggauguucugaucgauaucgacgacaaagaaccccugauaccuauucaggaggaggaauucauugauuggugguccaaguucuucgcuagcaucggagagagagagaaaugcggguccuacuuagaaaaggacuucgacacccucaagguuuaugacacacagcucgaaaauguugaggcauuugagggccuaagugauuucugcaacaccuucaaacuuuacagaggcaagacccaagaagagacugaagauccgucugugauuggugaauucaagggccuguuuaaaauauauccccugccugaagaucccgcuaucccaaugcccccucgacaauuccaucagcucgcggcacagggaccacaggaaugccuugugaggauuuacaucgugagggcuuuuggccugcaaccuaaagauccaaacgguaagugcgaucccuauaucaagaucucgauaggaaagaagagcguuucugaccaggacaacuacaucccuugcacgcuggagcccgucuucgggaagauguucgagcugaccugcacacucccccuugagaaggaccuaaagauuacacuguacgauuacgaccuucuaaguaaggacgaaaagaucggcgaaacaguagucgaucuggagaaccgccugcucucgaaauucggggcacggugugggcugccacagacuuauugcgugucaggaccuaaucaguggcgagaccagcuccgcccaucucagcugcuucaucucuucugucagcagcaccgugucaaagcaccgguuuaucggaccgacagagucauguuccaggauaaggaguauucuaucgaagagaucgaggcggguagaauuccuaacccucaucuaggccccguagaggaacgccuggcauuacacgugcuccagcagcaggggcuggugccugaacacguugagucuaggccccucuacucaccucuucaaccugacaucgagcagggcaaacuccaaauguggguggaccuuuucccgaaggcccugggcagaccaggcccuccuuucaauauuacgcccagacgagcacgacgguuuuuuuuaagaugcauuauuuggaacacccgugaugugauccuugacgaccucucccugaccggcgaaaaaaugagcgacaucuacgugaagggauggaugauaggguucgaagaacacaagcagaagaccgacgugcacuauagaagccugggcggggaggggaacuucaacuggcgauuuaucuucccguucgauuaucugccugccgagcaggugugcacuaucgccaagaaggacgcauucuggaggcuagacaaaacagaaucuaaaauaccagcuagaguuguuuuccagaucugggacaacgauaaguuuucuuuugacgauuuccuaggcuccuugcaacuugaccugaaucggaugccgaaaccugccaagacugcgaaaaaauguucacuggaccagcuagaugacgccuuccacccagagugguuugugagcuuguuugaacagaaaaccgucaaagggugguggccauguguggcagaggagggagaaaagaagauucucgcgggcaagcuggaaaugacucuggagaucguggcugaaucugaacacgaggaaagacccgccggacagggccgcgaugaaccaaauaugaacccuaaacuggaagauccaaggcgcccugacacuagcuuccucugguuuaccucaccauauaagacuaugaaguuuauccuguggcggcgguucaggugggcaauaaucuuauucaucauccuguuuaucuuacuacucuuucucgcaauauuuauuuacgcuuuuccgaacuacgccgccaugaagcuggugaagccuuuuaguuag

SEQ ID NO: 4876 - RNA, 6336 nt, Artificial Sequence
  Description of Artificial Sequence: Synthetic coding sequence
augcuaagggucuucauucuuuaugccgagaauguccacacacccgacaccgacaucuccgaugcguauugcucggccgucuucgccggaguaaaaaagcgcacuaaagucauaaaaaauuccguuaacccuguguggaacgagggcuucgaaugggaucugaaggguauuccucuugaucaggguagugagcuccaugucguggucaaagaccacgagaccauggggaggaacagguuucuuggugaggcgaagguuccauuaagggaggugcuugccacaccuagccuauccgcauccuuuaacgccccccuauuggacaccaaaaagcagcccaccggagcgucacuggugcugcagguaucuuauaccccacugccgggcgcagugccucuguuuccaccuccuacacccuuagagccuagcccuacacuacccgaccuugacgucguugcuggugggggacaguccagagcugaaacuuggucacuucugagcgauaguacgauggacacucguuauucaggaaagaaauggccagcccccacugacacugguggagaagaggauaccgaagaucaggggcugacgggggacgaggcggagccauuucuagaccaguccggaggacccggcgcccccacuacaccacggaagcugccaucucgcccaccuccccacuaccccggcauuaaaaggaaaagauccgccccaaccucccguaagcuucucucagacaaaccccaggauuuccagaucagggugcaagugauugaggguaggcaacucccaggaguuaauauaaagccagugguuaaaguuaccgccgcaggacagacuaagcgaacaagaauccacaagggcaacucacccuuauuuaacgagacacucuucuucaaccuauuugauucuccaggcgaacuguucgaugagccuauuuucauuaccgugguugacagcaggucucuccgcacggacgccuuacugggggaguuucgaauggaugugggaaccaucuaucgugaaccuagacacgccuaccucagaaagugguuacuccucucagaucccgacgauuuuucagccggcgccagaggguacuuaaagacaucacugugcguauuaggucccggcgaugaagcgccucuggaacguaaggauccgucagaagauaaggaggacauagagagcaaccugcugcgucccaccgguguggccuuacgaggcgcacacuucugucugaagguguucagagcagaggaucugccacagauggacgacgcugugauggauaauguaaaacagauuuucgguuuugaaucuaacaaaaaaaaucugguggauccauucgucgagguuagcuucgcaggcaagaugcuguguucaaagauucuggaaaaaacagccaacccacaguggaaucagaauaucacauuaccggccauguuccccuccaugugugaaaaaaugagaauacgcaucauugauugggauagacucacccauaaugacaucguggccacuacauaccugucuaugagcaagauaucugcccccgguggggaaauugaggaggaaccagcaggggccgucaagcccucuaaggcaagugaucucgaugauuaccuuggguuccugccuacauucggucccugcuauauaaaccuguauggcucgccacgggaauuuaccggguuccccgaccccuauaccgagcugaauaccgggaaaggagaaggaguggccuauagaggucggcugcugcugucccucgagacuaaacugguagaacauagcgaacagaagguggaagaucuuccggcggacgacauccuccgcguggagaaguauuugcgucgaaggaaauacagcuuguucgcugcuuuuuacagcgcuaccaugcugcaagauguggaugacgccauucaguucgaaguuuccauaggcaauuauggcaacaaauucgacaugacuugcuugccacuugcuaguacuacacaguauucuagagcuguguuugaugggugccauuacuacuaucugcccugggguaacgucaagcccguggucguucugagcucauauugggaggacaucucacaccggauagaaacccagaaucagcuccugggcaucgccgaccgucuugaggcuggucuugagcaggugcaucucgcccuuaaagcgcaguguucaacugaggacguugacagucucgucgcacagcucacugacgagcugauagcugggugcagccagccucugggggauauucaugagacuccgagcgcgacccaccuugaccaauaucuguaucagcugagaacacaccaccugagucaaauuacugaggcugcccuggcguuaaaauugggccacuccgagcugccugccgcacucgagcaggcugaggacugguugcugagacugcgggcucuggccgaagagccccaaaauagucugccagauaucgugauuuggaugcuacagggggacaaaagggucgccuaucagcgugugccugcccaucaaguccuguuuucacgcaggggcgcuaauuauugcgggaaaaauugugggaagcugcagaccauuuuucucaaguacccaauggaaaaggugcccggggcccgcaugccaguacagauccgcgugaaacugugguuuggccugucuguggaugaaaaagaguuuaaucaguuugcugaaggcaagcugagcguguuugcugaaacauacgagaaugaaacaaaguuagcccugguugggaacugggggaccacaggccuuacuuacccuaaauucucugaugugaccggcaaaaucaagcugccgaaagacucauuuagacccucggcaggcuggacaugggcaggagacugguuuguaugcccagaaaagacacuccuccacgacauggacgccggacaucuaaguuucguugaggagguuuuugagaaucaaacgaggcugccuggaggccaguggauuuacauguccgacaacuauacggacgucaauggagaaaaagugcugccaaaggacgacauugagugucccuuaggguggaaaugggaagacgaagaguggucuacagacuuaaaccgggcuguggacgaacagggaugggaauacucgaucacaaucccaccugaaagaaagcccaagcauugggugcccgcugagaaaauguauuacacacauaggcggaggagauggguaagguugagaagaagagaccuaucccagauggaggcccuuaaaaggcacaggcaggcugaggcugagggugaggggugggaauacgcuucuuuauuuggauggaaguuccaccuagaauaccguaaaacugacgccuucagacgcagacguuggcgcaggagaauggaaccuuuggaaaagacugggccagcugcaguguuugcucuggagggggcuuuaggagggguaauggaugauaagagcgaagauucuaugucgguguccacacuaaguuuuggggugaauaggccuacuaucucuuguauuuucgauuaugggaaccgcuaucaccugagauguuauauguaucaagccagggaccucgcagcgauggauaaagacaguuuuuccgaccccuaugcaauugugucuuucuuacaccaaucccagaaaacugucgucgugaaaaacacacucaauccaaccugggaucagacccugauauucuacgaaaucgagauuuucggggagccggccacagucgccgagcagccacccucuaucguugucgaguuguaugaccaugacacguacggcgcagaugaauuuauggggagauguauuugucaaccuagucucgagaggaugccucgccucgccugguucccgcuuacucggggaucccagccuuccggggagcuguuagccuccuucgagcucauccaacgcgagaaaccggcaauccaccauauaccaggguuugaggugcaagaaacuucuaggauucuggacgagucugaagacacggaucucccauaucccccuccgcagcgugaagcaaacauuuauauggucccccagaacauuaagccggcucuacaaagaacugcuauugagauccuugcuugggggcugcgcaacaugaagucauaccaauuagccaacauuucuucaccuucacuggucguugagugugguggacaaaccgugcaguccugugugauaagaaaccuccguaagaacccuaacuuugacaucugcacucuuuucauggaggugaugcucccccgggaggaauuguauuguccucccauaacagugaaaguaaucgacaaucggcaauuuggccggcggccaguagucggacaguguaccauaaggucccuugaaucguuuuugugugacccuuacucugccgaauccccaucaccacagggggggcccgaugacguuaguuuacucagcccaggggaggacguacugauugauauagacgacaaggagccccugaucccaauacaggaggaagaauucaucgacugguggagcaaguuuuucgcaaguauuggagagagggaaaagugugggagcuaucuugagaaggauuuugacacucugaagguguaugauacccaguuagaaaacgucgaagccuuugagggauugucagacuucuguaauacauucaaauuauaccggggcaaaacacaagaagaaaccgaggacccuaguguaauaggagaguuuaaaggacucuuuaagaucuacccgcugccugaggacccugccaucccaaugccuccucggcaguuucaucagcuggcagcccaaggaccacaggagugucuagugcggauuuacauugugcgagcuuuuggacuucagccaaaggauccuaacggaaagugugauccuuauauuaagauaucaaucgggaaaaaguccgucagcgaucaggauaacuacaucccgugcacucuggaaccuguuuuuggaaagauguucgaguugacaugcacucugccgcucgagaaggaucucaaaauuaccuuguaugacuacgaucuacuuuccaaagacgaaaaaauuggugaaaccguggucgaucuggaaaaccggcuuuuaucgaaguuuggagccagaugugggcucccacagacuuauugcgucagcggaccgaaccaguggcgugaucagcugaggcccucccaacuguuacaccuguuuugucagcagcaucgcguuaaagcuccuguguauaggaccgaccgggucauguuucaggauaaggaguacucaaucgaagagauugaagcagggaggauucccaauccccaccuggggccaguagaagaaaggcuugcacuccauguacuccagcagcagggccuggugccagaacacguagagagucgaccuuuguacaguccacugcagccugauaucgaacagggaaaacugcagauguggguagaucuuuuuccuaaagcucugggacgccccggccccccuuuuaauaucacuccccgccgagcaagaagauuuuuccugagauguaucaucuggaacacucgagacgugauacucgaugaccucagccuaacaggggaaaaaaugucugacaucuauguaaaaggcuggaugauaggauucgaggagcauaaacaaaagacugacgugcacuaccgaucccuuggcggcgagggaaauuuuaacuggcgguuuauauucccguuugauuacuugcccgcugagcaaguguguacuauugcuaaaaaggaugccuuuuggcgucuugacaagacugagucuaagauuccagcgagagugguauuucagaucugggacaaugacaaauucaguuucgaugauuuucuggguagucugcaauuagauuugaacagaaugcccaagccugccaagacagccaagaaaugcucacucgaucaacuggacgacgcuuuccauccagaaugguuugucucucuguucgaacagaaaacaguaaaggggugguggccaugugucgcugaggagggcgagaagaaaauacuggccggcaagcuagagaugacacuggaaaucgucgccgaaagcgagcacgaagagagaccggcggggcaggggcgggaugagccuaauaugaacccaaaauuggaagacccccgcagaccugacaccucuuuccugugguuuaccagcccuuauaaaaccaugaaauucauucuguggagaagauuccgcugggcuauuauucuauucauuauucucuuuauacugcuccucuuccuugcaauuuucauuuacgccuucccaaacuaugccgcaaugaaacucgucaaacccuuuucuuag

SEQ ID NO: 4877 - RNA, 6306 nt, Artificial Sequence
  Description of Artificial Sequence: Synthetic coding sequence
augcugcgcguguuuauccuguaugcugaaaacguccacaccccggauaccgauauuagcgaugccuauuguucagcuguuuucgccggugugaaaaagcguacgaaagucaucaaaaauucaguuaacccugucuggaaugaaggcuuugaaugggaccugaaaggcauuccccucgaccagggcucggaacuucacgugguggugaaggaccacgaaacuaugggcaggaacagauuuuugggagaagccaaagucccgcugcgugaaguucucgcuaccccgagucuguccgccuccuucaacgcccccuugcucgacacuaagaaacaacccacaggagcuucacuggugcuccagguuagcuacaccccacucccgggggccgugccgcuguucccuccucccacuccccuggaaccgucccccacucugccagaucuggaugucguggccgauacuggcggcgaggaagauaccgaggaccaaggauuaacuggggacgaggcagagccauuucucgaucagagcggaggcccaggcgcgcccaccacaccaagaaaacugccuagccgccccccuccccacuauccuggcauaaaaaggaagagaagcgccccaaccucccggaaacuucugucagauaaaccccaagauuuccagauacgaguucaagucaucgaggggcgacaguugcccgggguaaacaucaagccaguggucaaagugaccgcugcaggacagacgaagcgaacuagaauucacaaagggaauucaccacuuuucaaugagacucucuucuuuaaucuguucgacucuccgggagagcuauucgacgagccuaucuucaucacugucguggacagccgcuccuugcggacagaugcucuguugggcgaauuccggauggacgucggaaccaucuaucgugagccucgucaugcauaucugagaaaguggcuguuacugagcgauccugacgacuucagcgcuggcgcuaggggauaucucaaaaccagucuauguguguugggcccuggcgacgaggcaccacuagagcguaaggacccguccgaagauaaagaggacaucgagucuaaccugcuccgaccgacggggguggcucucagaggggcucauuuuugccucaagguguuccgcgccgaggaucugccccaaauggaugacgccguuauggacaaugugaaacagauuuuuggcuuugaaucaaauaagaaaaacuugguggaccccuucgucgaaguguccuuugcaggaaaaauguugugcuccaagauccuggaaaaaaccgcuaacccccaguggaaccagaacaucacacucccagcuauguuucccucuaugugcgagaaaaugagaauucguaucauugauugggaccgucugacccauaacgauauaguugccaccacuuaccugagcaugucuaagaucucugcaccuggcggcgaaauagaagaagaaccagccggagccgugaaacccucuaaagccagugaucuggaugauuauuuaggauuuuugcccacauuuggccccuguuacaucaauuuauacggcagcccucgcgaauuuacuggcuucccagauccauacaccgaguugaauacuggaaagggugagggcguggcauaccguggaaggcuacugcuaucauuggagaccaagcugguggaacauucugaacagaaggucgaagaucuccccgccgaugacauacuucgaguagagaaauaccugaggagacgcaaauacucccuauuugccgccuuuuacucagcaacaaugcugcaggaugucgaugaugccauccaguucgaggucagcauuggaaacuauggaaacaaauucgacaugaccugccugccucuagccuccacuacucaguacucacgggccguguucgacggaugucacuacuacuaucuuccuugggggaauguaaaacccguuguaguccuguccucguacugggaagacauaagccauagaauagagacccagaaccagcugcuuggcauagcagaucgguuggaggcuggccuggagcagguacaccuggcccuuaaggcacagugcucuacagaagacguggacucacugguggcgcagcugacggaugagcuaaucgccggcugcucacagccgcuaggagacauacacgaaacaccuagcgcaacgcauuuggaccaguaccuauaucaguugagaacgcaucaccugucucaaauuaccgaggcugccuuggcucugaaacucggccacucugaacugcccgccgcccuggagcaggccgaagauuggcugcuccggcucagggcacuggcggaggagccucagaacucccuucccgauaucgugaucuggauguuacaaggugacaagcggguagccuaucagcgcgugccagcacaucaggugcuuuuuucccgccguggagccaacuacugcggaaaaaacuguggaaagcugcagaccaucuuccucaaguacccgauggagaagguaccuggggcaaggaugccuguucagaucagaguaaagcugugguuugggcugaguguugaugaaaaggaauuuaaucaguucgcagaagguaaacucucaguguuugccgagacauacgagaaugagaccaagcuggcacugguaggcaauugggggacuacaggucuuaccuaucccaaguucucagauguaacaggcaaaaucaaacuccccaaagauagcuuuagacccuccgcaggauggacuugggccggcgacugguuugugugcccugaaaagacccuucuucacgauauggaugcaggucaucuguccuucguggaagaaguauuugagaaccaaacgagacugccuggaggccaguggaucuacaugucugauaauuacacagauguuaauggugaaaaaguuuuaccaaaggacgauauugaaugcccacucggcuggaagugggaagaugaggaguggucaacagaccugaaccgggcagucgacgagcagggaugggaguauuccauuaccauuccaccagaacgcaagccaaagcauuggguucccgcugagaagauguacuacacccaccgccgacggaggugggucagauugaggaggcgugaucuaagucagauggaggcccuuaagagacauagacaagccgaagcugaaggggagggaugggaguacgcuuccuuguuuggguggaaauuccaucuggaguaucgaaagaccgacgccuuucgccggagacguuggcggaggagaauggagccacucgagaaaaccggacccgcagccguuuucgcccuggagggcgcucuuggaggagucauggacgauaaaucugaggacucuaugaguguuucaacauugaguuuuggcgugaaccguccgaccaucucuuguauauucgacuacgguaacagauaucaucuccgcugcuauauguaucaggcacgggacuuggccgcaauggauaaagacaguuuuucagaccccuacgccaucguuuccuuucuucaccaaucucaaaagacuguaguugucaaaaauacucugaauccuacuugggaccagacacuaaucuucuacgaaauugaaaucuuuggagaaccagcuacaguagcggaacagccccccucaauugugguagaauuauaugaccacgauacauauggggccgacgaguucaugggaaggugcauaugucagccaucccuugagcggaugccgcgccuagcaugguucccacucacaagagggagccagccuagcggggaacuacuugcuagcuuugagcugauucagagagaaaaaccggccauucaucacaucccugguuucgaggugcaggaaaccucacgaauacuggaugaaucagaggacacagaccugccuuauccucccccccagcgcgaggccaacaucuacaugguuccccagaacaucaaaccagcacugcagcggaccgccaucgaaauccuagccuggggccuacgcaacaugaaguccuaccaauuggccaacaucucuucuccuagccugguggucgaaugcgggggccagaccgugcaaucuugugugauaaggaaucugaggaagaaccccaacuucgauaucuguacccucuuuauggaagugaugcucccccgagaagagcuuuauugccccccaauaaccguuaaggucaucgauaacaggcaguuuggaaggcgcccaguugugggccaguguaccaucaggucauuggaguccuuucuaugcgauccuuauucugccgagucaccaucaccacagggggguccagaugacgucucacuucucaguccuggggaggacguguugauugauaucgaugacaaagaaccucucauuccaauccaacuggccgauggacugagcucacuggccccaaccaacacagccagcccuccaaguucaccucaugaggaagaauuuaucgauugguggucaaaguuuuuugcuagcaucggagagcgcgaaaagugcggcagcuaucucgagaaggauuuugauacccugaagguguacgauacacagcuggagaaugucgaagcuuuugaggggcugagugacuucugcaacacauucaaacuguaucgggggaaaacacaggaagagaccgaagaucccuccgugaucggggaauucaaaggccucuucaagaucuauccacugccugaggauccugccauucccaugccgcccaggcaguuucaccaguuagcugcgcagggcccacaggagugucuagugagaauauauaucgugagagcuuuuggcuugcaacccaaggacccuaaugggaaaugcgauccguauauaaaaauuuccaucgggaaaaaguccguaagcgaccaggacaacuauaucccuuguacucuggaacccguauucgguaagauguuugaacugacauguacucugcccuuggaaaaagaccugaaaauaacccuguacgacuacgacuugcuguccaaagacgagaagaucggagaaacuguuguugaccuugaaaaccggcugcugucaaaguucggagcccgaugcggccucccacaaacguacuguguguccggcccaaaccaguggcgcgaccaauugaggccaagucagcucuuacaccuuuuuugccagcagcauagggugaaagcuccaguauauaggaccgauagggugauguuucaggauaaagaguauagcauugaagaaauagaagcgggaaggauuccuaauccucaccuugggccaguggaagagcgauuggcacugcacgucuugcagcaacaggguuuggugccugaacacgucgagucaagaccuuuauacuccccucuacagccugauauugaacaagggaaguugcagauguggguugaucuguucccaaaggcccugggucggccugggcccccuuucaacaucaccccuagacgcgcccgucgcuucuuccucaggugcauuauauggaacacaagggacgucaucuuggacgaucugucacugaccggggaaaagaugagcgacaucuacgugaaaggcuggaugauaggguucgaagagcauaagcagaaaaccgauguucauuaucgaucccuggggggugaagggaauuuuaacuggcgguuuauuuucccuuucgacuaccuuccagcagagcaggucugcacaauagccaaaaaagaugcguuuuggcgucuugauaagacugagaguaaaauucccgcccgagucguguuccaaauaugggauaacgauaaguucucauuugaugauuuucugggcucccuccaacuggaucucaacagaaugcccaaacccgcuaagacagcuaagaaguguagucuggaucagcuggaugacgcuuuccauccggagugguucgucucucuguuugaacagaaaacagugaagggcugguggcccugcguggccgaggaaggggagaaaaagauauuggccgguaaacucgagaugacucuugagauuguggccgagagcgaacaugaagagaggccagcgggccagggacgcgaugaaccuaauaugaacccuaaauuggaggacccuagacgaccggacacaaguuuucucugguucacuucucccuauaaaaccaugaaguucauccuguggagacguuucaggugggccaucauucucuucauuauucuguucauccuauuacuguuccuggccauuuucauuuaugccuuuccaaacuaugcugcuaugaaacucguuaagccauuuucuuag

SEQ ID NO: 4878 - RNA, 447 nt, Artificial Sequence
  Description of Artificial Sequence: Synthetic coding sequence
augggauauccagagguggaaagacgagagcuucuccccgccgcugcuccaagggaaagagggagccaaggaugcgguuguggaggagcaccugcuagggcgggagagggaaacucuugccugcuauucuuaggcuuuuuuggacugagccuggcucuccaucuccuuacguugugcugcuaccucgaguugagaucugaacuccguagagaacgcggcgcagaaagccgcuugggcggaucggguacgcccgguacaucaggcacucuuuccucccuggguggucucgaucccgacuccccaauuacaucacaucuuggccagcccaguccaaagcagcagccacuggaaccuggagaggcugcccugcacagugacucucaggacggacaucaagacuucgauuacaucaucuccuucagcuacggacugcaaggguuuugcuag

SEQ ID NO: 4879 - RNA, 1176 nt, Artificial Sequence
  Description of Artificial Sequence: Synthetic coding sequence
augggguaucccgaaguggaaagaagggaacuguugccagccgcggcaccaagagaacggggaagccaggggugugguugcgguggggcaccugccagagcuggcgagggaaacucaugcuugcuguuucugggcuuuuuuggucugagccuugccuugcaucuucugacacuuuguugcuaccuggaguuaagaucagaacuucggagggaacgcggagcugaaagccgccuggguggauccgggacuccugggacuagcgguacucucucuucacucgggggacucgauccugacucuccaaucacgucacaccugggccaaccaagucccaagcagcagccacucgaacccggagaagccgcccugcauucugauagccaggauggccaccagauggccuuacugaacuuuuuuuuucccgacgaaaagcccuacagcgaagaggaaucuagaaggguuaggagaaauaagcgaagcaaauccaacgagggugcugauggcccugugaagaauaagaagaagggcaagaaggccggcccuccaggcccgaacggacccccuggaccuccuggaccccccggcccacaggggcccccgggcauuccuggcauaccugguauccccgggacgacagucaugggacccccagggccuccugggccacccgggccacaggguccucccggccuucaaggaccguccggggccgcugauaaggcaggcacgcgcgaaaaccagccugcugucguacacuugcaagggcagggcagugcgauccagguuaagaaugaucuuucaggaggcguuuugaaugauuggucuagaaucacaaugaauccaaagguuuuuaagcuacacccccggucaggugagcuggaaguccugguggacggaacguauuuuaucuauucacagguagaaguguauuacauuaauuucacugacuucgcaaguuacgaggucgugguugaugagaaaccauuuuuacagugcacacggagcauugagacuggcaaaacuaauuacaacacgugcuauacugcuggagugugucuucugaaggcaaggcaaaaaaucgcaguaaaaaugguccaugccgauaucucaauuaauaugucaaagcauacuaccuucuucggagcuauaaggcugggggaggcacccgcuaguuag

SEQ ID NO: 4880 - RNA, 1170 nt, Artificial Sequence
  Description of Artificial Sequence: Synthetic coding sequence
augggcuauccagagguggagaggagggaacugcugccugcagcggccccuagggaaagagguucucaggguugcggcugcgguggggcccccgcgcgagccggcgagggcaacagcugucuccuauuccucgguuuuuuuggacugucucuggcccuccaccuucuaacacuuugcuguuaucucgaacugagaucagaacugcgccgcgaacggggggcagagucaagacuaggggguucaggaacuccuggaacaucagggacccugucuucauuagggggccuagaccccgacucgccuauaacaucacaucucggccagccgaguccuaagcagcagccucuugagcccggugaagcugcccuucauagcgacucacaggacgggcaucagauggccuugcuaaauuuuuucuuuccagacgaaaaacccuacucugaggaggagucucggcgcgugcguagaaacaaaagaucaaaaucuaaugagggagccgacggucccgucaaaaauaagaaaaaagguaaaaaggcugguccuccaggucccaaugguccuccuggcccuccaggcccuccuggaccccaaggcccuccaggaauuccagggauccccggcauaccagggacaacugugaugggcccuccagggccuccggggccucccgguccccaaggcccgccagggcugcaggggccuuccggggcugcugacaaggccggaaccagggagaaucagcccgccguaguccauuugcagggccaaggcucagcgauacaggugaagaacgaccugagugggggaguucuaaacgacuggucacgcaucacaaugaacccuaagguguuuaaguugcauccacgauccggcgagcuagaaguucugguggauggcaccuauuuuauauacucccagguuuacuauaucaauuuuacagauuucgcaucuuacgaaguugugguugacgagaagcccuuccuucaguguacaaggucuauugaaacagggaagacaaauuacaacaccuguuacacagccggcguuugccugcugaaagccagacagaaaauugcaguaaagauggugcacgcagauaucucaaucaauauguccaaacauaccaccuucuuuggcgccauucggcugggagaggcacccgcuucauag

SEQ ID NO: 4881 - RNA, 408 nt, Artificial Sequence
  Description of Artificial Sequence: Synthetic coding sequence
auggguuacccugagguggaaagaagagagcuauuaccagcugcugcccccagagaaagaggaucacagggaugugguuguggcggcgccccggcaagggccggagaaggcaacuccugucuccuguucuuaggcuucuucgggcucucccuugcuuuacauuugcugaccuugugcugcuauuuggaguugagaagcgaacucagacgagaaagaggggcagaaucgcgacugggcggguccggcacucccggcaccagcgguacucugucuagccuuggcggcuuagaccccgacuccccgaucaccagccauuuaggacagccaucucccaagcaacagccgcuggagcccggugaagccgcuuuacauagugacagucaagaugggcaucagggccaucaguag

SEQ ID NO: 4882 - RNA, 1161 nt, Artificial Sequence
  Description of Artificial Sequence: Synthetic coding sequence
auggguuacccugaagucgaacguagagagcugcugccagcugccgcgccccgcgagagaggaucccagggcugcgggugcggaggagcgcccgcuagggccggagaagggaacuccugcuugcuguuucucggguucuuuggacugucgcuugcucuccacuuacuuacuuuauguuguuacuuggagcugaggagcgaacugagacgggagcggggcgcugagagcaggcugggcggcuccgguacaccuggcacaagcggcacccuguccucacuaggaggucuggaucccgauucuccuauuacuucccaccucgggcagccaucucccaagcagcagccucuggagcccggagaagcugcccuccauuccgacagccaggaugggcaccagauggcacuccuuaacuucuuuuuuccagaugagaagcccuacucugaggaagaaucccgacggguccgaagaaacaagagaagcaaaucuaaugagggagcugauggccccguuaagaauaagaaaaagggcaagaaagcaggcccuccuggaccuaauggccccccuggcccuccuggccccccugguccucagggcccucccggaauaccaggcauccccggcauccccggcaccacagugauggggccaccgggaccccccggaccaccagggccacagggaccaccuggcuuacagggucccagcggggcggccgauaaggcugggacgcgugagaaccagccggcagucgugcacuuacagggccagggcagcgcaauccaagugaagaauggcggcguccuaaacgacugguccagaauaacgaugaacccuaaggucuucaagcuucacccucgcucuggggaacuggaaguucucguugacgguacuuacuuuauuuacagccagguuuauuauaucaacuuuacggacuucgcaaguuacgaggucgucgucgaugaaaagcccuuccuccaaugcacccgauccauugagacggguaaaacaaauuacaacaccugcuauaccgcugggguuugcuuacugaaagcaagacaaaaaaucgcuguuaagauggugcaugccgauauuuccaucaacaugucuaagcacacuacauuuuuuggcgccaucagacugggagaggcacccgccagcuag

SEQ ID NO: 4883 - RNA, 447 nt, Artificial Sequence
  Description of Artificial Sequence: Synthetic coding sequence
augggauauccugaaguugagagacgggaacuucuuccagcagcagcaccgagagagagaggaucccaaggcugcggcugugggggagcaccggcacgggccggagaggggaauagcugccuacuguuuuuaggguucuucggguugagucuggcccuucaccuguuaacacugugcugcuaccuggaacugagaucggaauuaagacgggaaaggggagccgagagcagacucgguggaucagggaccccuggaaccagcggcaccuuaucgucguuaggcggccuggauccagauucuccuauuacaagccaccugggacagcccaguccgaaacagcagccacuggaacccggagaggccgcauuacauuccgauucccaggauggucaucaggacuucgauuacaucauuucuuucagcuacggauuacagggguuuugcuag

SEQ ID NO: 4884 - RNA, 3429 nt, Artificial Sequence
  Description of Artificial Sequence: Synthetic coding sequence
augcugguccucaggugccggcuaggaaccuccuucccuaagcuugacaaccuuguucccaaagguaagaugaaaauccuucugguuuuucuaggucuacucggcaacagcguggcaaugcccaugcacaugccccggaugccggguuuuagcagcaaauccgaggagaugaugcguuacaaccaguucaauuuuaugaauggcccacacauggcccaccugggcccauucuuuggcaauggccuuccucagcaguuuccgcaguaucagaugccuauguggccucagcccccccccaacacguggcaucccagaaaaucguccgcaccuaagaggcauaacaaaaccgaccaaacccaagaaacucagaaaccgaaucagacacaguccaaaaaaccaccucagaaacgaccucugaagcaacccucccauaaccagccacaacccgaagaagaagcccagccuccacaggcguucccuccuuuuggaaacggacuguucccauaucagcaaccgccuuggcaaauuccccagcggcugccuccuccugguuacggaaggccaccaauauccaacgaggaaggaggcaacccguacuuuggguacuuuggcuaccauggcuuuggcggucgaccuccguauuacuccgaggagauguuugaacaggacuucgagaagcccaaggaggaagacccgccuaaagcugagaguccagguaccgagccaacagcaaauucuacagugacagaaaccaacuccacccagcccaauccgaaaggcagccaaggcgggaacgacacaagcccaacuggcaauuccacuccgggauuaaacacuggcaacaaccccccugcucagaacgggaucgggccacuuccagccgucaacgccucgggucagggggggccggggucacaaaucccauggaggccaucccagcccaacauucgagaaaaccaccccuacccaaauauacgcaauuuucccucaggacgccagugguacuuuaccggaacagugaugggucauagacagaaucguccguucuaucguaaucagcaaguccagagaggcccacgcuggaacuucuuugccugggaaaggaagcagguggccagaccgggcaauccaguuuaccacaaagcauaccccccgacaagucggggaaacuauccuaacuacgcagguaauccugcaaaccuucgccggaaaccgcaggggccuaacaagcacccgguuggcacaaccguugcaccccugggaccaaagccuggcccugucgugcggaacgagaaaauucagaaucccaaggaaaagccucucggaccuaaggaacagauaauuguccccaccaaaaacccaaccucccccuggcgaaacucucagcaguaugaggugaauaagagcaacuauaagcuaccccacuccgagggcuauaugccugugcccaauuuuaacucaguagaccagcaugaaaauucuuauuauccccggggcgauagcagaaaagucccaaauagcgacggccaaacccaaagccagaaccucccuaaaggaaucguacuggguucacgccgcaugccauacgaaagugagacuaaccagagcgaguugaagcauucuucauaucaaccagccguuuaccccgaggagauaccgucuccagcaaaggagcauuucccagccggaagaaauacuugggaccaucaagaaauuuccccuccguucaaagaggacccggggagacaggaggaacaccucccacauccgucucacgguucuaggggguccguguucuaccccgaguacaauccuuacgauccucgagaaaauucaccauaucugagagggaacacaugggacgagcgggaugauucuccuaacacaauggggcagaaggaaucaccucuuuauccuauaaacaccccagaucagaaggagauugugccauacaaugaagaagauccaguggacccaacaggugaugaagucuucccuggacagaacagguggggagaagagcucucauuuaaaggcgguccaacgguucgucacuacgagggcgaacaauauaccagcaaucagccaaaggaauaccugccguacucgcuugacaacccgucuaaaccucgcgaggacuucuacuauuccgaguuuuauccauggucucccgaugagaacuuucccuccuacaauacagcuucuacuaugccucccccaauagagucucggggguacuacguaaacaacgcagcugggcccgaagaaucgacccuauuuccuucaagaaauagcugggaucacaggauucaggcacaggggcagagggagaggcggccuuauuuuaacagaaacaucugggaccaagcuacccaucuucaaaaagcgcccgccagaccuccggaucagaaggggaaccagccauauuauucaaauacaccagccggguugcagaaaaacccuauauggcacgaaggugaaaaccucaacuaugguaugcagauaacgcgaaugaacuccccagagagagaacacucaaguuuuccuaauuuuaucccgccaagcuaccccagcggccagaaggaggcacaccucuuucauuugucccaacgcggaucaugcugcgcuggauccaguaccggcccaaaagacaauccccucgcucugcaagauuacacuccuagcuacggccuagcaccuggcgagaaccaggacaccucuccucucuauacagacggcagucacacaaaacaaacucgggacauuauuucacccacgucuauccugccaggccagcguaauagcuccgaaaagcgugagagccagaacccguuucgugaugacgucagcacacucaggcgaaacaccccaugcucuauuaaaaaccagcuugggcaaaaagaaaucaugccguuucccgaggccuccucacugcaguccaagaauaccccaugucugaaaaaugaucugggaggcgacgguaauaacauccuagagcaaguguucgaggacaaccaguuaaacgagcggaccgucgaccugaccccagaacagcucguuauugggacccccgacgaaggaucuaaccccgagggcauucaaagccagguucaagagaacgaaucggaaagacagcagcagaggcccucaaacaucuuacaccugccaugcuuuggaaguaaacuugcuaagcaccauucauccacuaccgggaccccuaguagcgauggacgacagagccccuuugacggagacaguaucacgccuacugagaaccccaacacacuuguugaacuggcuacagaagagcaguucaaaucaaucaauguggaccccuuggaugcugacgagcauagcccauucgaauucuuacagcgggggacaaacguccaggaucaggugcaggauugccuccuccuacaagcguag

SEQ ID NO: 4885 - RNA, 582 nt, Artificial Sequence
  Description of Artificial Sequence: Synthetic coding sequence
augggugugcacgaaugucccgcguggcuguggcugcuacugagccuucucucucugccacuuggacugccuguacucggugccccccccagguugauuugcgacaguagaguauuggagcguuacuugcucgaggccaaggaggcggaaaacauuacuacuggaugcgcugagcauugcagccugaacgaaaauauuacugugccagacaccaaagugaacuuuuacgccuggaaaaggauggaagucgggcagcaggccguggagguguggcaaggccuggcacuucuuagcgaagcuguucuuagaggacaagcuuuacuggugaacagcagccaaccaugggagccacuucaguuacacgucgauaaagccguuagcggucugcguagucugaccacucuccuacgcgcccugggagcucagaaagaggcaaucucccccccugacgcagcguccgcugccccucugcggaccauuacagccgacacuuuccggaagcuguuccgcguguacucaaauuuucuuagaggcaaauugaaauuguauacaggcgaggcaugucguaccggcgauagauag

SEQ ID NO: 4886 - RNA, 192 nt, Artificial Sequence
  Description of Artificial Sequence: Synthetic coding sequence
augcccaguagcguguccuggggcauauuacugcuugccggguugugcugucucgugcccguaucuuuggcucacggagaaggaaccuucacgucggaccuuucuaagcaaauggaagaggaggcugugcgguuauuuauugaauggcuuaaaaacggaggcccaucauccggcgcgccaccaccuaguuag

SEQ ID NO: 4887 - RNA, 390 nt, Artificial Sequence
  Description of Artificial Sequence: Synthetic coding sequence
augaagacuuugcaguucuucuuucuauuuuguuguuggaaagcaauuugcuguaauagcugugaacuuacgaauaucacgaucgcaauugaaaaggaagaauguagauucuguaucaguaucaauacaaccuggugcgcuggcuauuguuauacucgcgaucugguuuauaaggauccagcccggcccaaaauccagaaaaccuguaccuucaaagagcuuguauaugaaaccguccgagugccuggcugugcucaccaugcagauagucucuauaccuacccaguggcgacacagugccauugcggaaaaugugacagcgacagcacugauuguaccguccgggggcuaggaccgaguuauugcaguuucggcgagaugaaagaguag

SEQ ID NO: 4888 - RNA, 390 nt, Artificial Sequence
  Description of Artificial Sequence: Synthetic coding sequence
augaagacacugcaguuuuuuuucuuauuuuguuguuggaaagccauauguugcaacagcugcgaauuaacuaacauuacaauugcaauugaaaaagaggaaugucguuuuuguauuucgaucaauaccacuuggugcgccggauauuguuauacacgcgaccuggucuacaaggacccugcccggccaaagauccaaaagaccuguacauuuaaggaacugguguaugaaacggucagggugccgggaugugcacaucaugccgauagccuguacacuuauccaguagcaacucagugucauugcggcaaaugcgauucagacuccacagacugcaccgugcgaggccugggccccucuuacugcucauucggagagaugaaggaguag

SEQ ID NO: 4889 - RNA, 390 nt, Artificial Sequence
  Description of Artificial Sequence: Synthetic coding sequence
augaagacacuacaguucuuuuuucuguuuugcugcuggaaagccaucugcugcaauucuugcgagcucacaaacauaaccauugcaauugaaaaagaagagugcagguuuugcauuucgauuaauacuaccuggugcgccggauauugcuauacuagagaucucgucuacaaggauccugcccguccgaaaauccagaagacuugcacauuuaaagaguugguauaugaaaccgugcgcguaccuggaugugcccaccacgccgacagucucuauaccuacccgguagcaacucaaugucauugcgggaaaugugacuccgacagcaccgauuguaccgugagaggguuaggccccuccuauugcucguucggcgagaugaaggaguag

SEQ ID NO: 4890 - RNA, 1569 nt, Artificial Sequence
  Description of Artificial Sequence: Synthetic coding sequence
auggcagccguggucgcggcgacaagaugguggcaguuauugcugguccugagcgcagcgggcaugggcgcaagcggagcaccccaacccccaaauauacugcuucuccugauggacgacaugggauggggcgaccugggcguguacggugaacccucccgggaaacuccaaauuuggauaggauggcugccgaagggcucuuguucccuaacuucuauuccgcuaacccccucugcucccccucacgcgccgcuuugcugacuggacggcuucccauccguaacgguuuuuauacaacuaacgcgcacgcacgaaacgccuacacaccccaagagauugugggugggauccccgacuccgagcagcugcucccagaauuacuuaaaaaagcuggcuacgucucgaaaauugugggcaaguggcaccugggucaccggccccaauuccacccuuuaaaacacgguuucgacgaaugguucggcuccccuaauugucauuucgggccauaugauaauaaggccaggccgaacaucccugucuaccgagauugggaaauggugggaagauauuaugaggaauuccccauuaacuuaaaaaccggugaggccaacuugacucagaucuaccugcaagaggcccuugacuuuauaaagcgacaggcccggcaucaccccuucuuucuuuacugggcuguugacgccacccacgcuccagucuacgcuuccaaaccuuuccucggcacuucacagagaggucgauacggcgacgcggugcgcgagaucgaugacagcauaggcaaaauccuugagcucuugcaggaucuacacguggcagacaauacuuucguuuuuuucaccagugauaauggagccgcccugauuuccgcuccagagcagggcgguucuaacggucccuuucugugugggaaacagaccaccuucgaaggagguaugcgagagccugcccuggccugguggccuggccacgugacagcaggccaggucucccaccaguuagggucgauuauggaccucuucaccaccucucucgcauuagcuggccuuacuccgcccucagaccgcgcaauagacggucuuaauuuacucccaacacuucugcagggacgccuuauggaucgccccauuuucuacuacagaggggauacccugauggcggcgacacucggccagcacaaagcucacuucuggacuuggacgaauagcugggaaaauuuccgacagggaaucgacuuuugcccaggacagaacgugagcgggguuacuacucacaaccuugaagaccacacaaagcuuccucugaucuuucaucugggacgagauccuggggaacgguucccacugaguuuugcaagcgcagaauaccaggaggcucuuucucgaauuaccagcguuguccaacagcaccaagaggcgcuggugccugcccaaccacaauuaaacgucugcaauugggccguuaugaacugggcaccgcccggaugugagaagcuuggcaagugccugacuccaccagaguccaucccaaaaaagugccuauggucccacuag

SEQ ID NO: 4891 - RNA, 261 nt, Artificial Sequence
  Description of Artificial Sequence: Synthetic coding sequence
auggccgcugucguggcugcgacaaggugguggcaacugcugcuaguccuaagugcugcaggaaugggcgccuccggagcuccucaacccccuaauauccuuuuacuucuaauggacgacagaggacggcauugcucccaggauggauaucccagcgccauggccaguaccccaccuacccccaugccagagaccccaacucaccggcguaggcugugggcugcuagccaaaccaggaguucaucauguagaaguuucuag

SEQ ID NO: 4892 - RNA, 1344 nt, Artificial Sequence
  Description of Artificial Sequence: Synthetic coding sequence
auggcugcaguugucgcagccacccgcugguggcaauuguuacuugugcuaagcgcugcuggcaugggcgccucuggagcccccgggcagagggcauacaccccacaggagauaguaggaggcauucccgacucugagcagcugcuacccgagcuacuuaaaaaggccggguacgucuccaaaaucgucggcaaauggcaccucggccacagaccucaguuucacccguugaaacacggguucgaugagugguucggaucucccaauugccacuuugggccguacgacaauaaagcacgacccaacauuccaguguacagggacugggagaugguaggacgcuacuacgaggaguuccccauuaaucucaagacuggugaagcuaaccugacacaaauuuaccugcaggaggcguuggacuuuaucaagcgacaggcacgccaucacccuuuuuuccucuacugggccguagaugccacacacgcccccguguaugccucuaagccauuucuuggaacuucccaacgaggucgguacggcgacgcugugagggagaucgacgacuccaucggcaaaauccuggagcugcugcaggauuuacacguggcagauaacacuuuuguguuuuucacgagcgauaauggcgccgcccucaucuccgccccagaacaaggugguucgaauggaccauuccuuugcgggaaacaaacaaccuuugaaggcgggaugcgugagccagcgcuugcuugguggccagggcacguaaccgccggccaggucucccaccagcugggcuccauuauggaucuguucacgacuucucuagcccuugccggccugacaccuccauccgacagagcuaucgacggacugaaucugcuuccuacauugcuucaaggaaggcugauggauagaccuaucuuuuacuacaggggcgauacccugauggcugcaacccucgggcagcauaaggcacacuucuggaccuggacuaacagcugggagaacuuucgccaaggcaucgacuuuugucccggucagaaugucagcggcgugacuacccauaacuuggaagaucacacuaaauugccccuuaucuuucaucuuggccgcgaucccggugaacgcuuuccccucuccuucgccuccgccgaauaccaagaagcgcucucacggauuacuagugucgugcagcagcaccaggaggcacucguuccugcucaaccccagcucaauguuuguaacugggcagugaugaacugggcuccaccuggaugugagaagcuuggaaaaugccuaacaccucccgagucuauuccaaagaaaugccucuggucccacuag

SEQ ID NO: 4893 - RNA, 636 nt, Artificial Sequence
  Description of Artificial Sequence: Synthetic coding sequence
augaaauuaugggacguaguggccguguguuuaguccugcuccacacagcuucugcuuuccccuugcccgcaggcaaacggccucccgaagcucccgccgaagaccggagccucggcagacggagggcgcccuuugcccuaaguagcgacuccaacaugccagaagauuacccagaccaguuugaugacguuauggacuuuauccaagcuacaauaaagcgacugaagagaucaccugacaagcagauggccgugcugccccgccgggaacguaauagacaggcugcagcagcaaacccugagaacucccgcgguaaggguaggagagggcagagagguaagaaccgaggcuguguccucacagcaauucaccuaaacguaacagaucuagggcugggcuacgaaaccaaagaggaguugauauucagguacugcucaggaagcugugaugcugccgaaacaacauacgacaaaauuuugaaaaauuugucacguaaccgacgccucguuuccgacaaagugggccaggccugcugcagaccaauugcguuugacgacgaucucagcuuucucgaugauaaccuuguuuaccacauucucaggaagcacucugccaagagaugcggcugcauuuag

SEQ ID NO: 4894 - RNA, 558 nt, Artificial Sequence
  Description of Artificial Sequence: Synthetic coding sequence
augaagcuuugggacgucguggcagugugcuuagugcugcugcauacugccucagccuucccauuaccagccgccaacaugcccgaggauuaccccgaucaauucgacgacgucauggacuuuauacaggcaacuauaaagcgguuaaagaggucaccagacaaacaaauggcugucuuaccaagaagagagcgcaaccgccaggccgccgccgcuaacccugaaaacucgcgcgguaaaggccggagaggacagcguggcaaaaauagagggugugugcucaccgcaauccaccugaacguuacagaccugggacugggguaugaaacaaaggaggaguugauauuuagguacuguucagguucaugcgaugccgccgaaacgacauaugacaaaauucugaaaaacuugagucgcaaucgacgccucgugagugauaaagucggacaagcuuguugucgaccgaucgccuuugacgaugaccucuccuuccuagaugauaaucugguguaccacauauugagaaagcacagcgcgaagagauguggcugcauauag

SEQ ID NO: 4895 - RNA, 687 nt, Artificial Sequence
  Description of Artificial Sequence: Synthetic coding sequence
augcagucacugccaaacagcaacggagcagcugcuggaagagacuucaagaugaagcugugggauguggucgcuguaugucugguauuguuacacacagcuagcgccuuccccuugccggccggaaagcggccaccugaagcaccugcugaggacagaagccucggacgcaggagagcucccuuugcucuuucuagcgacagcaauaugccagaggacuacccagaucaauucgacgacguuauggacuucauccaggcuaccauuaaacgguugaaacgcuccccagacaagcagauggccguccuuccgagaagagagcgcaaucgccaagccgcagccgcuaauccagagaauuccagaggaaagggccgacguggccagcgcggcaaaaauagaggaugugugcugacagccauccaccucaacguaacagaccucggccugggguaugagacaaaggaagaguuaaucuuucgcuauugcagcgggucgugcgaugcugccgaaaccacuuacgacaaaauacuaaaaaaccucagccgcaaccgaaggcuggugucugacaaggugggacaggccugcugcagaccgauagcguucgaugacgauuuaucauuccuggacgauaaccucguguaccauauucuccguaagcacucugccaagcguugcggaugcaucuag

SEQ ID NO: 4896 - RNA, 186 nt, Artificial Sequence
  Description of Artificial Sequence: Synthetic coding sequence
augaaacuuugggacguaguagcuguuugccucgugcugcuucacacugcuagugcuuucccccucccugcggccaacaugcccgaagacuauccugaccaauuugacgacguuauggauuuuauccaagcuaccaucaaacgccugaaaagaucacccgacaaacaaauggcaguguugccuuag

SEQ ID NO: 4897 - RNA, 186 nt, Artificial Sequence
  Description of Artificial Sequence: Synthetic coding sequence
augaagcuaugggacgugguugccguuugccuaguucuacuucacacugccucugccuuccccuugccagcugccaacaugccagaggauuauccugaucaauuugaugacguaauggauuuuauccaggccacaauuaaacgucucaagcguucuccagauaaacagauggccguacugccuuag

SEQ ID NO: 4898 - RNA, 558 nt, Artificial Sequence
  Description of Artificial Sequence: Synthetic coding sequence
augaaguuaugggacguuguugccguuugucuuguacuguugcauacagcauccgcauucccguugcccgcugcuaauaugccagaggauuaucccgaccaauucgacgacgucauggauuuuauucaagccaccauuaagcgccugaaaaggucuccggacaagcagauggcaguacugccccggagagaacguaaccggcaggcagccgccgcaaaccccgagaauucccguggaaaaggacgucguggucagcgaggcaaaaaccguggauguguccuuacggcgauucaucugaacgugacagauuuaggacuuggguacgaaaccaaggaggagcucauauuucgcuauuguuccggguccugcgaugcugcagaaacgacguacgacaaaauucugaagaaccugucgagaaaccgacgucugguuucugacaagguuggccaggccuguugucggccuaucgcuuucgaugaugaucuuagcuuccucgacgauaaucuuguuuaccauauucuccgcaaacauucagcuaaaagguguggauguaucuag

SEQ ID NO: 4899 - RNA, 609 nt, Artificial Sequence
  Description of Artificial Sequence: Synthetic coding sequence
augcagagccuuccuaauuccaacggagcagccgcaggcagggauuucaagaugaaacugugggaugucguagccgugugucugguccuguuacacaccgccucagcuuucccacuuccagccgcgaauaugccagaagauuaccccgaucaauuugacgaugugauggauuucauacaggcgaccaucaagagguugaagaggucuccagacaaacagauggcuguguuaccuagacgcgaacgcaaccgucaagccgcugcagcaaaucccgaaaauucccgggguaagggcagacgcgggcagcguggaaaaaauagaggcugcgugcugacagccauccaccugaauguaacggaucugggccugggcuaugaaaccaaagaagaguugauauuucgcuacuguucugggaguugugacgcugccgaaacgacauacgacaaaauccugaagaaucugagucguaaccgucgacuugugucagauaaagugggucaggcauguugccgcccaaucgccuuugaugaugaucucucuuucuuagacgacaauuugguuuaucauauacuucguaaacauucugcaaagcgcugcggcuguaucuag

SEQ ID NO: 4900 - RNA, 543 nt, Artificial Sequence
  Description of Artificial Sequence: Synthetic coding sequence
augaaaagcaucuacuucguugccggucuguuugugaugcuggugcagggaucauggcagcguucacuacaggacaccgaggaaaagagccggagcuuuucggccucccaagcagacccucuguccgaccccgaccaaaugaaugaagauaagagacauagucagggcaccuuuacaucugauuauagcaaguacuuagauucuaggagagcucaagacuuugugcaauggcugaugaacacaaagaggaauaggaauaauauugccaaaagacaugaugaguucgaacgccaugcggagggcaccuuuaccucugaugugaguaguuaucuugaagggcaagcagcgaaagaauucauagcuuggcuaguuaagggacgcggaagaagagacuuccccgaagagguugcaaucguugaagaauuaggcagacgccacgcggaugggucuuuuagugaugagaugaauacaauccuggacaauuuggcagcgagagauuuuaucaacuggcuuauacagacaaagaucacugacaggaaguag

SEQ ID NO: 4901 - RNA, 543 nt, Artificial Sequence
  Description of Artificial Sequence: Synthetic coding sequence
augaaauccauauauuuuguugccggucucuuuguaaugcucguacaagguucauggcaacgcucacuucaggacacagaagagaaaucuaggucauuuagcgcuucccaggccgacccuuuaucggacccggaucaaaugaacgaagauaaaagacacucgcaagggaccuucacaucagacuacuccaaguaucucgauuccaggcgggcucaagauuucgugcaaugguugaugaacacgaagcgcaaccgcaauaacaucgcaaagaggcaugaugaguuugaaagacaugcugaagggaccuucacaagcgacgucagcuccuaccuagaggggcaagccgcgaaagaauucauugccuggcuggugaaaggaagggggcggagagauuuucccgaagaggucgccaucguugaagaauuaggucggagacacgcggacggauccuucucggacgagaugaacacaauccuugauaauuuggccgcccgcgauuuuauuaauuggcugauacaaacgaaaaucaccgaucgcaaguag

SEQ ID NO: 4902 - RNA, 2859 nt, Artificial Sequence
  Description of Artificial Sequence: Synthetic coding sequence
augggaguacgacauccuccgugcucucaccggcugcuugcaguuugugcccuagugucucuggccaccgcugcauuguugggacacauacuguuacaugacuucuugcuugugcccagggagcugaguggaaguuccccugugcucgaggaaacgcacccagcgcaccagcaaggcgcgagucgccccgggccgcgugacgcucaggcucauccgggucgacccagggcgguccccacccaaugcgacgugccuccuaauucucguuucgacugugcaccugacaaggcuauaacacaggagcaaugcgaggcuagagggugcugcuacauaccagccaaacagggguugcaaggcgcucagaugggucaaccuugguguuuuuucccacccagcuacccaagcuauaaacuggagaacuugagcucaagcgagaugggauacacagccacacuuacacgaaccacaccaacauuuuucccgaaagacauccuuacacuacgacuugaugugaugauggagacagaaaauaggcugcacuuuacgauuaaagacccggccaauaggcgguaugaaguuccuuuggagaccccacaugugcacucacgggcccccucaccgcuguacuccguugaauuuuccgaggagccguuuggugugauuguuagacgccaacuugacggaagaguccugcugaacacaacuguugccccucuguucuucgcagaucaguucuugcagcucaguacuucccugccgucacaguacaucacuggacuggccgaacaccugagccccuuaaugcugucuacgaguuggacacgcauaacucuguggaaucgggaccuggcccccacaccuggcgcuaaccuguauggcucucacccuuuuuaccuggcccuugaggauggcgguagugcccacgguguauuccuacuuaacagcaacgccauggacguuguccuccagccuucaccugcgcucucguggcgguccacugguggaauucuggauguuuauaucuucuuggguccggagccuaaguccgugguucagcaauaccuagacguagugggcuacccuuucaugccaccguauuggggccugggguuccaucuaugccgguggggcuacucaagcacagccauaacaagacagguuguugaaaacaugacucgcgcacacuucccacuggacgugcaguggaacgacuuagacuauauggauucgcggcgugauuuuacauuuaacaaagacggcuucagggacuuccccgccaugguucaagaacugcaccagggaggcagaagauauaugaugaucguagacccugcuauuucuucaagugguccugccgguuccuacaggccuuacgacgaaggccugagacguggaguguucaucacaaaugaaacaggacaaccacucaucgggaagguuuggccaggauccaccgcauuuccugacuuuacaaauccaacggcauuagcauggugggaggauaugguggccgaguuccacgaccaggugccuuucgacggaauguggaucgauaugaacgagccuuccaacuuuauaagagguuccgaggacgggugcccuaauaacgagcucgaaaaccccccuuaugugccuggcgugguuggaggcacgcugcaggccgcuacaauuugugccaguagccaucaguuccuuuccacucauuauaauuuacauaacuuguauggccucacagaggcuauugcaucucaucgggcccugguuaaagcacgaggcacacgaccauuugugauuucacgcagcacuuuugccggacacggaagguaugcuggccauuggaccggggauguuugguccucaugggagcagcucgccuccuccgugccagaaauauuacaauucaaccugcucggcguuccucucgucggagccgacgugugcggcuuccuuggcaacacguccgaagagcucuguguacgcuggacacagcuuggagccuucuauccuuucaugcguaaccacaauagucuucuaucuuugccccaggaacccuacucguucucggagccugcucagcaagcgaugagaaaagcuuuaacccuucgcuacgcacuucuuccacaucuuuacacuuuguuucaucaggcucacguggccggggagaccguugcgcgcccucuguuuuuggaguuccccaaggauagcagcacuuggaccguggaccaccagcuucuguggggagaggcucuccuuauuacaccggugcugcaggcgggaaaagcugaggugacagguuacuucccacuugggaccugguacgacuugcaaacuguuccuguagaggcccucggcagccuuccuccucccccggccgcaccuagagagccugccauacacagugaagggcagugggugacuuugccugcuccacucgacacgauuaaugugcacuugagggcaggcuauauuauuccguuacaaggcccagggcucaccaccacugagucucgucagcaacccauggcacucgccguugccuuaacuaaaggcggugaagcucggggagaacuguuuugggacgauggagaaucauuagaaguuuuagaacgcggagcuuacacucaaguuauuuuucuggcccggaacaacacgaucguuaaugaacuggugcgggugacgagcgaaggcgcuggauuacagcugcaaaagguaacuguguugggagucgcuaccgcuccucagcaggugcuguccaacggugugccuguuuccaauuucacguauucucccgauacuaaaguacuugauauuugugugucucuccucaugggcgaacaauuucugguuagcuggugcuag

SEQ ID NO: 4903 - RNA, 2859 nt, Artificial Sequence
  Description of Artificial Sequence: Synthetic coding sequence
augggcgugagacacccacccugcagccacagacuacucgccgugugcgcccuggugagccuggcaacugccgcccugcuuggccacauucugcuacacgacuuucuccuggugccaagggagcugucuggaagcagcccagugcucgaagaaacucaccccgcacaucagcaaggggccagucgccccgggccacgagaugcccaggcccacccgggaagaccuagagccgugccuacccagugcgauguccccccuaauucgagauucgacugcgcucccgauaaagccaucacccaggagcaaugcgaggcucggggcugcuguuauaucccagcuaaacaaggccugcagggggcccagaugggucaaccuugguguuucuuucccccuucuuacccauccuacaagcuugagaaccuaucaaguuccgagaugggguacacggccacuuuaacucgaaccacccccacuuucuuuccaaaggacauacugacacugcgccuggacguaaugauggagaccgagaacagguugcauuuuaccauaaaagacccagcuaaccggcgguacgaagugcccuuggagacaccacacgugcauagccgcgccccgucuccuuuauacucuguggaguucucugaggaaccauucggugugauuguccgacgacagcuggauggcagagugcuucuaaacacaaccgucgcuccacuguucuucgcugaucaauuccugcagcucucaacaucacugcccagucaguauauuacaggacuggccgagcaccuaagcccacugaugcucucuacgaguuggacaaggaucacccuuuggaaccgagaccuggcuccuaccccgggcgccaaucucuacggcucucacccuuucuaucuagcucuggaagauggcggaagcgcucacggaguguuccuccuaaauagcaaugcaauggaugucgugcuccagcccucucccgcacugucauggcgauccacaggggggauuuuagacguuuacauuuuucucgguccugagccuaagucugugguccaacaauacuuggacguugugggguacccuuucaugcccccuuauugggggcugggguuucaucugugucguuggggcuacucaaguacagccaucacaaggcaggugguggaaaacaugacucgagcccauuuuccucuggacguucaauggaacgaucuagacuauauggacucuaggcgagacuucacauuuaacaaggauggcuuucgcgauuuucccgcuaugguccaagaacuucaccaaggcgggcggcgcuauaugaugaucgucgaucccgccaucuccucguccggacccgcagguagcuaucgaccauacgacgaaggucugcggaggggcguguucauuacaaacgagacaggccagcccuuaauuggcaaagucuggccagguucuacagccuucccugacuucacuaacccaaccgcccucgcauggugggaagacaugguggcugaguuucacgaucaggucccguuugacgguauguggauugauaugaaugaacccucaaacuuuauucgagguucagaggauggguguccuaacaaugagcucgaaaaucccccauaugugccugggguugugggaggcacuuuacaggcugcuacaaucugugcuucaagccaucaauuucugaguacgcauuauaaccugcauaaccuguauggucucaccgaggcuauugccagucaccgggcccuggugaaggcacgcggaacacggcccuuuguaaucagccguagcacguucgcgggccauggccguuacgccgggcacuggaccggugacgucuggagcaguugggaacagcuggcauccuccgugccugagauccuccaguuuaaucuucuuggggucccacuugucggggcagaugugugcggauuucuggguaacacaucugaggaacugugugugagauggacucagcugggugccuuuuaucccuucaugaggaaccauaacagucugcugagucuaccccaggaacccuauucauucagcgaaccugcucagcaggcuaugaggaaagcacugacacugcgauacgcccuucuaccacacuuguacacacuauuucaccaggcucaugucgcuggagaaacugucgcccguccgcuuuuccuugaauucccaaaggauaguucaaccuggacagucgaucaccaguugcuguggggagaggcccuacuaaucaccccugucuugcaggccggcaaagccgaggucacuggcuauuuuccucucgggacgugguacgaucugcagacaguuccuguggaagcccugggcucguuaccaccaccaccagccgcucccagagagcccgcaauucauuccgaaggacagugggugacacucccagcuccccuagauacaaucaauguacacuuaagggccgguuacauuauuccacugcaaggaccaggucugaccacaaccgaauccaggcagcagccgauggcucucgccgucgcucucacaaaggguggcgaagcucgaggcgaguuguucugggacgauggggaaucacuugagguucuugagaggggagccuacacucaggugauauucuuggcacggaacaauacaauugugaacgagcuggucagaguuaccagcgaaggagcggggcuccagcuccaaaaggugacggugcuuggcgucgcuacagcaccgcagcagguuuuaaguaacggggucccuguuaguaacuucacguacaguccagauacaaaagugcuggacaucugcgugucacuccucaugggcgaacaguuccugguuaguuggugcuag

SEQ ID NO: 4904 - RNA, 1611 nt, Artificial Sequence
  Description of Artificial Sequence: Synthetic coding sequence
auggaauuuuccagcccgagcagagaggaaugcccaaagccacugucacgaguaaguaucauggcugguaguuugacaggacugcuccugcuucaagccguuuccugggcuuccggagcaagacccugcauacccaaaagcuucggcuacucuagcgucgugugcgucuguaaugcgacguacugugauucguucgacccuccaacauuccccgcucugggcacauuuucucgguaugaaucgacucgcagcgggcgccggauggaacugagcaugggcccaauucaagcaaaccauacagggacuggacuccucuugacccuccagccagaacagaaguuucagaaggugaaagguuuugguggggccaugacggaugcugccgcauuaaauauacuagcgcugagccccccggcucagaaucugcugcucaaguccuacuuuucggaggaagguauaggauauaacauuauaagggucccuauggcuucuugugacuucucuauuagaacuuacacuuacgccgauaccccagaugacuuucagcuccacaacuuuuccuugccagaggaggauacaaagcuaaaaaucccacugauucaccgcgcucugcaguuggcacaaagaccugugucacuucuggccucuccuuggaccuccccgacauggcuuaagaccaauggcgcugugaacgguaagggaucucugaagggucagccaggagacaucuaucaccaaaccugggccagauauuuugugaaguuccuggaugccuaugccgaacauaaacugcaguuuugggccguaaccgccgaaaaugaaccaagugcaggacuccugagcggauauccuuuucaaugucuaggcuucacuccagaacaccagagagacuuuauagcccgagaccugggucccacacucgccaacucuacacaucacaauguuagauugcucauguuagacgaccagagacugcuccuuccucauugggcgaaagucguguuaacagauccagaggcggccaaauauguccacgguauugcuguccacugguaccuggacuucuuggcccccgccaaagccacacugggggagacucaucggcucuuuccaaacaccaugcucuuugccucugaggcaugugugggcucaaaguucugggaacaguccguacggcugggcaguugggaccgugggaugcaguacucucauucgauuauuacgaaccugcucuaucacguugugggguggaccgauuggaauuuggcacucaaccccgaaggaggcccgaacuggguacgcaacuucguugacuccccgauuauuguggauauuacaaaggacaccuuuuacaagcaacccauguuuuaucaccucggacauuucucaaaauucauucccgagggcucccagagaguaggacugguggcgagucaaaaaaaugaucuugacgccgucgcuuugaugcaucccgacggaucagccgugguagugguccuuaacaggucuucaaaggacgugccucucacaauuaaagacccagcggugggcuuccuggagacaaucagcccagguuauaguauacacacauacuuauggagaagacaguag

SEQ ID NO: 4905 - RNA, 1611 nt, Artificial Sequence
  Description of Artificial Sequence: Synthetic coding sequence
auggaauucuccucccccagccgcgaggaaugccccaagccacucagucgugucucaauuauggccggaagccuuaccggguuguuacuucuacaggccguuucaugggcaagcggcgccaggcccugcaucccgaaauccuuuggauauaguucagugguguguguuugcaaugcuaccuauugugacaguuuugaucccccuaccuucccugcacuuggaacguuuagucgcuacgagucaacccgauccgggagacggauggaacuuuccaugggcccaauucaggccaaccauaccgguacugggcuucuccucaccuuacagccagagcagaaauuccagaaggucaaaggcuucggaggugccaugacugaugccgcagcauuaaacauucuggcgcuuaguccccccgcucaaaaucuucugcucaaaucauacuucucagaggagggaaucggcuacaacaucauacgggucccaauggcuagcugcgacuucaguaucagaaccuacaccuaugccgauacgccggaugauuuccaacugcauaauuucucccugcccgaagaagauaccaaauugaagauuccgcugauccaucgcgcucugcagcuugcucagcggcccgucagucuccuggcaucacccuggacaucacccaccuggcugaaaacgaacggcgcagugaaugggaagggaagcuugaagggccagcccggugacauuuaucaucagacuugggcucgauacuucgugaaauuucuggaugcuuacgcugagcauaaguuacaguuuugggcuguuacagccgaaaacgaaccuuccgccggucugcugucagguuauccguuucagugccuaggcuucacgcccgagcaucaaagggacuucauugcaagggaccuagguccuacacuggcaaauaguacccaccacaacguccgacuguuaaugcuugaugaccagaggcuccuccuaccccacugggcuaaaguaguccugacugauccagaagcagcaaaguauguucacggcaucgccguacacugguauuuagacuuccuggcgccagcaaaagcuacucugggagaaacccauaggcuguuuccuaauacuaugcucuuugcuucugaggcaugugucggaagcaaguucugggaacagaguguacgccugggcucuugggaccggggcaugcaguauucucacucaaucauuacaaaucugcucuaucauguggugggauggacggacuggaaccuugcccugaauccggagggcggccccaauuggguccguaauuuuguugauucacccaucaucgucgauauuacaaaggacaccuucuacaaacagccuauguuuuaccaccuugggcauuuuaguaaauucaucccagaagggagccaacgagugggauugguugcuucucagaagaacgaccucgaugccguggcccugaugcacccugaugggagcgccgugguaguagugcugaaccgcuccucuaaggaugugccccugacgauuaaagacccagccguuggcuuccuggagacuauuagcccgggcuauagcauacauaccuaccuguggcgccgucaguag

SEQ ID NO: 4906 - RNA, 1566 nt, Artificial Sequence
  Description of Artificial Sequence: Synthetic coding sequence
auggaauucucauccccuucacgggaagagugccccaagccucucucaagagucuccaucauggcugguucccugaccggauugcugcuacuucaggcagugagcugggccucuggggcucgaccaugcauucccaaaucuuuuggcuacagcaguguugucugcgugugcaacgccaccuacugugauaguuuugauccucccaccuucccagcacucgggacguuuucccgcuacgaaagcaccagaucaggucguagaauggaacugagcaugggaccgauccaagccaaccacacuggaacgggccuacucuugacccuccaaccagaugcugcagcacugaacauccuugcacuaagcccaccagcucagaaccugcuacuuaaaaguuacuucucagaagaagggaucggauauaacaucauccgcguuccaauggcaagcugugauuuuuccauucgaacauauaccuaugcugauacccccgaugacuuucagcugcacaacuuuucauugcccgaggaggauaccaagcugaaaaucccucugauccaccgggcgcugcaacuggcacagcgacccguuucuuuguuagcuucaccauggacaagucccaccugguugaaaaccaauggggcagucaacggaaaaggaucucugaaaggucagccuggggacauauaccaccagaccugggcuagauauuuugucaaauuccuggacgcuuaugcagaacacaaacugcaguucugggcugucacggcugaaaaugagccuagcgcgggccugcucucugguuauccauuccagugcuugggcuuuaccccagagcaccagagagacuuuauagcucgugaccugggcccuacccucgccaacucaacacaucacaaugucagacucuuaaugcuagaugaccaaaggcuucuacuuccccacugggccaaggugguucuuaccgacccggaagcugcgaaauacgugcauggcaucgccguccacugguaucuggauuuccuggcaccagcuaaagcaacacugggcgagacacaccguuuguuucccaacaccauguuguucgcguccgaggcuugcguuggcucuaaauucugggaacagucugugaggcuuggcaguugggacagaggaaugcaguauagccauagcaucaucacaaaccuccuguaucacguugugggguggacagauuggaaccucgcauugaaucccgaggggggaccuaauuggguaaggaacuucguggauaguccaauuauaguugauauaacgaaagauacauucuauaagcagccuauguucuaccaccuuggccacuucucuaaauucauccccgagggcucccagcgcguuggccucguggccucgcaaaaaaacgacuuggacgcugucgcccugaugcacccugacgguucugccguugugguggucuugaaccgauccucaaaggacguuccccuuacuaucaaagacccagccguuggcuuucuugagacaauaucaccuggcuauucuauucauacauaucucuggcgcagacaguag

SEQ ID NO: 4907 - RNA, 1464 nt, Artificial Sequence
  Description of Artificial Sequence: Synthetic coding sequence
auggaauuuuccaguccuagucgggaagaaugcccuaagccuuugucucggguuagcauaauggccgggucacuuaccggacuucuccuccuucaggccgugagcugggcaucgggggcacgacccugcaucccaaagucauuuggauauucuuccguagugugcgucuguaacgcaacauauugugauaguuucgacccuccuaccuuuccggcccuaggcacguucagcagauaugaaaguacaaggucgggucgccggauggaacucagcaugggcccuauucaggcuaaucauacugggaccgggauugguuacaauauuauccgagugccuauggcaagcugugauuucuccauacggacuuauacuuacgccgauacaccugacgauuuucaacuucacaauuucagucuuccagaggaggauacaaagcuaaaaauaccuuugauccaccgagcgcugcagcuugcacaaagaccugucucccuacuggcuucuccuuggaccucucccaccuggcugaagacaaauggugccguuaacgggaaggguucccucaaaggccaaccuggcgacauauaucaccagaccugggcgagguacuuugucaaauuccuggacgccuacgccgaacauaaguuacaauucugggcugugaccgccgagaacgagccaucggcaggucugcuaucuggcuacccauuccaaugccuuggauucaccccggagcaucagcgagacuuuaucgcccgcgaccugggcccgacucuggcaaauuccacacaccacaauguucggcuguugaugcucgaugaucaaagacuucuucuuccacacugggcuaagguggugcuaacugaccccgaggccgcaaaauacguacacggaauagccgugcauugguaccuggauuuucuugcccccgcaaaggcaacccuaggugaaacacacagacuguuucccaacacaaugcuguuugccagugaagcuugcguuggcucuaaauucugggagcagucaguucggcucggcucgugggacagaggaaugcaguauagucauaguaucaucaccaaucuacuguaccacgucgucgguuggaccgacuggaacuuggccuugaaucccgaggggggacccaauuggguaagaaacuucguagacuccccaauuaucguggauauuacaaaagauacguucuauaagcagccaauguuuuaucauuugggucauuuuuccaaauuuauaccggagggcucccagcgggugggucugguugccucacagaagaaugaucuugacgcuguggcccugaugcacccggauggcagugcgguggugguuguauugaaucgcucguccaaggaugucccccugaccaucaaggaucccgcugugggcuuccucgagaccaucucuccgggcuacagcauccacacguaucucuggcgcagacaguag

SEQ ID NO: 4908 - RNA, 1350 nt, Artificial Sequence
  Description of Artificial Sequence: Synthetic coding sequence
auggaacuaagcauggggccuauccaggccaaccauaccgggacaggacuacuccucacccugcagccugagcagaaauuccagaaggugaaaggguucggcggcgcuaugacagaugcagccgcacugaauauucuggcuuuaagcccaccagcucagaaucugcuucucaaauccuacuucuccgaggaggggaucggguacaauauaauucgcgugcccauggcgucuugugacuuuuccauucggaccuacacauacgcugauacacccgaugacuuccaacuucacaauuucucucugccagaggaggauacuaagcuuaaaauuccucugauccacagagcucuucaacuggcccaacguccuguuucuuugcuagcauccccuuggacaagccccacuuggcugaaaacaaauggagcggugaauggaaaagggucacugaaaggacagccgggggauaucuaccaccagacaugggcccgguauuuuguuaaguuccucgacgcuuacgccgagcacaagcuccaauucugggcaguuaccgcggagaacgaaccgucagccggccuacuaagcggguauccuuuccaaugucugggcuucacuccugaacaccagcgcgacuuuaucgcccgcgacuugggaccuacucucgcuaacucaacacaucauaaugugagguuacuuauguuggaugaucagcgccugcuccugccucacugggcuaagguugugcucaccgauccugaagccgccaaguauguccauggaauugccguccauugguaucuugacuuccuagcaccggccaaagccacccugggagaaacacaccgcuuguucccuaauaccaugcucuucgccuccgaagcuuguguuggaaguaaguucugggaacaguccgugagguuaggcucaugggaccgugggaugcaauacucucauagcaucauuacuaauuugcuguaucaugugguaggauggacagauuggaaucuggcacucaauccagagggcgggcccaauugggugagaaauuucguggauucgccuauaauuguggacauaacaaaagauaccuucuacaaacagccuauguuuuaccaccuagggcacuuuucaaaguucauuccagagggcucacaacgugugggauugguggccucucaaaaaaaugaccuugacgcuguugcacuuaugcacccggaugggagcgcuguggucguaguacugaaccggaguaguaaagacgugccccugacaaucaaagauccugccgucggcuucuuggagacaaucaguccgggguauaguauucacacauaccucuggcgaagacaguag

SEQ ID NO: 4909 - RNA, 1482 nt, Artificial Sequence
  Description of Artificial Sequence: Synthetic coding sequence
augacccuaagggguuggaguuuccaggugcugccggagucuaaugcuacauacugugacucauucgacccacccaccuuuccagcucucggaacauucucccgauacgagucgaccagaucggguaggcggauggaguuguccauggggccgauucaggccaaccauaccgggacugggcuccuucugacacugcaacccgagcaaaaguuccagaaggugaagggguucggaggcgcuaugacagacgcggcugcccugaauauccucgcucuguccccccccgcucaaaaucuccuccucaaaucauacuuuagcgaagaggggauuggcuauaacauuaucagaguuccuauggcuucuugcgauuucuccauucgcacguacacuuacgccgacacccccgaugauuuccaacuacacaacuuuagccuuccugaagaagacacgaagcugaaaaucccccuaauucacagagcgcugcagcucgcccagcgucccguuucucuacuggcuucucccuggacuuccccuacauggcucaagacuaacggugccguuaacggaaaggggucucuuaagggccaaccaggagauaucuaccaccagacuugggccagauauuucgugaaguuccucgacgcauaugccgagcauaaauuacaguuuugggcggucacagcugagaacgagcccagcgcuggacugcuuuccggauaccccuuucaaugcuugggcuucacacccgaacaucagcgagauuuuauagcaagggaucuagggccuacacucgcuaauucuacacaucauaacguucgacuccucaugcuugacgaccagcggcugcuccucccucauugggcuaaaguuguuuugacugauccggaggcugccaaauacgugcacgguaucgccguucauugguaucucgacuuuuuggccccagcaaaagccacacuaggagaaacacacaggcuguucccaaauacuaugcucuucgcuuccgaggccugcgugggcuccaaauucugggagcagagcgugaggcucggcagcugggauagaggcaugcaguacucacacaguauuauuaccaaucuacuguaccacgucgucggcuggacugauuggaauuuagcucucaacccugaggggggucccaacugggugcgcaauuuugucgauucccccauuauuguugauauuacgaaagauacguucuacaaacagccuauguucuaccaucucggacacuuuucaaaguucauuccagaaggaagccagagggucgggcuuguugccucucaaaagaacgaucucgaugccguagccuugaugcauccagauggauccgcaguggugguuguguuaaauagaucaucaaaggaugugccauugacuauuaaggauccagcaguaggcuuucuugaaaccaucagccccggcuacagcauacauaccuaccucuggcgccgccaguag

SEQ ID NO: 4910 - RNA, 1272 nt, Artificial Sequence
  Description of Artificial Sequence: Synthetic coding sequence
auggaauucucaaguccaagcagggaagagugccccaagccacugucccgcguaucuauuauggcaggcagcuugacaggacuccuguuauuacaggcaguuagcugggccaguggcauuggauacaacaucauuagagugccuauggcuagcugugauuucucaauacggaccuauaccuaugcugauacucccgacgauuuucaauugcacaauuuuucacuuccugaggaagauacgaagcuaaaaauuccuuuaauacacagggcauugcagcuggcucaaaggcccguaucucuucuagcaucaccguggacuagcccaacauggcugaaaaccaacggcgccgugaaugguaaaggcuccuuaaagggccagccgggggacauauaccaccagaccugggcccgcuacuuugugaaguuucucgaugcuuaugccgaacacaaacuacaguuuugggcagugaccgcagagaacgaaccauccgccggcuuauuaucuggcuauccauuccaaugccucggguucacaccugaacaucagcgggacuuuauagcccgcgacuuagggccgacucucgcaaacucaacacaccacaaugucagacuacuuaugcuggaugaucaaaggcuucuucucccgcacugggccaaagugguacugacagacccugaagccgccaaauacguccacggaauagccguccacugguaucucgacuuucuggccccagcuaaggccacacucggggagacccaucggcuguucccgaauaccaugcucuucgcuuccgaggccugcgugggcuccaaguuuugggaacaaagcguuaggcugggcucaugggauagaggcaugcaguauucucauuccaucaucaccaaccugcucuaccauguagucggcuggacugauuggaaucuagcauugaauccugaggguggaccuaauugggugagaaauuuugucgauagcccuaucaucgucgacaucacaaaagauacauuuuauaaacaaccaauguuuuaucacuugggucauuuuagcaaguuuaucccagagggcucgcagagggugggauuaguugcaucucaaaaaaacgaucuggaugccguggcucuuaugcacccggacgguucagccgugguuguggucuuaaaccguucuaguaaagacguaccucugaccauuaaagauccagccguaggauuucucgagacaaucagucccggguacucuauacacaccuauuuauggaggcgccaauag

SEQ ID NO: 4911 - RNA, 351 nt, Artificial Sequence
  Description of Artificial Sequence: Synthetic coding sequence
auggauuacuacaggaaguacgcugcuaucuuucucgucacguugagcgucuuucuucacguccuccacagcgccccugauguacaggauugcccagaauguaccuugcaagagaauccauucuucagccagccaggcgcacccaucuuacaguguauggguugcugcuucucccgggccuaucccacuccucuccggucuaagaaaacaaugcugguacagaagaauguuaccagugagucuaccuguugugucgcaaaauccuacaaccggguuacugucaugggcggcuucaaagucgaaaaccacacugccugccauuguucuacaugcuauuaccacaagagcuag

SEQ ID NO: 4912 - RNA, 654 nt, Artificial Sequence
  Description of Artificial Sequence: Synthetic coding sequence
auggcuacaggaucuaggacaucucuucugcuggcuuucggguugcuaugcuuacccuggcuccaagaggguagcgcauuuccuacgaucccacugucccggcuuuuugacaacgccaugcuucgggcccaccgccugcaucaauuggccuucgauaccuaccaggaguucgaagaagccuacaucccuaaagagcagaaguauuccuuucuccaaaacccccagacaucucuuugcuucagugaauccauacccacuccgucaaaccgggaggagacccaacagaaaucuaaucucgagcuccugagaaucucacuccuacuuauccagaguuggcuggagcccguccaguuccuucguaguguguuugccaauagucuaguauacggcgcuagcgauagcaacgucuaugaucuccugaaagaccuagaggaaggcauacagacccucaugggucgccuggaggaugguucuccucggacugggcaaaucuucaagcaaacguacucuaaauucgauaccaacagccacaacgacgaugcucucuugaagaauuaugggcuuuuguauuguuucagaaaggauauggauaaagucgaaacauuccugaggauaguucagugcagaucuguagagggguccugcggauuuuag

SEQ ID NO: 4913 - RNA, 369 nt, Artificial Sequence
  Description of Artificial Sequence: Synthetic coding sequence
auggcuacggggagucgaacaagccuguuacuugcuuuuggguuacugugcuugccuuggcugcaggagggcagcgcguuuccaaccaucccucucaguagacuguuugauaacgccaugcugcgcgcccaccgccuccaccaacucgcguucgauacguaccaggaguuccggcuggaggauggcuccccccggacuggacagauauuuaaacaaacauauuccaaguuugacacaaacucacacaaugacgaugcacugcugaagaacuacggacuccucuauuguuuuaggaaggauauggauaaaguugaaaccuuucuccgaauuguacaaugcagguccguugagggcaguuguggauucuag

SEQ ID NO: 4914 - RNA, 534 nt, Artificial Sequence
  Description of Artificial Sequence: Synthetic coding sequence
auggccacugggucccggaccagccuccugcuugcuuucggucuguugugccucccuugguugcaggaggggucggcuuuuccuacuauaccgcucucucguuuauuugacaaugcuaugcuuagagcucauagauuacaucagcuugcauuugacacuuaucaggaauucaaccuugagcuccuccgaaucucccuccuccuuauccagucauggcucgaaccgguacaauuuuugcgcagcgucuucgccaauucucucguuuauggggcgucugauucaaauguuuaugaucuccugaaggaucucgaggaggguauccagacacucaugggcagauuagaggacgguucucccagaacuggccagaucuucaaacagaccuacuccaaauucgacaccaauucccacaaugaugaugcacugcugaagaauuauggacugcuguacugcuuuagaaaggauauggacaaaguggagaccuuccugcgcauugugcaaugccggagcgucgaggggucaugcggauuuuag

SEQ ID NO: 4915 - RNA, 609 nt, Artificial Sequence
  Description of Artificial Sequence: Synthetic coding sequence
auggcuaccggguccagaaccuccuuauugcucgccuucggacuacugugccugccuuggcugcaggaagguucugcuuucccaacuauaccacuguccagauuguucgauaaugccaugcucagagcccaucgccugcaccagcuugcuuuugauacguaccaagaauucaacccacaaacaagucugugcuuuuccgaaucuauaccaacacccagcaacagagaggagacgcagcaaaaguccaaccucgagcuucucaggaucucccugcugcucauucagucuuggcuggagccaguccaauuccuucgcagcguauuugcgaacagccuugucuauggggccagcgauuccaauguguacgaucuccugaaagaucuagaggaaggcauccaaacauugaugggacgucucgaagauggcaguccaaggacaggacagaucuucaaacagaccuauuccaaauuugacaccaacucccacaacgacgacgcucuccugaaaaacuauggacuccucuacugcuuccggaaggacauggauaagguugagaccuuccucaggaucgugcaaugcagguccguugaaggaucuuguggauuuuag

SEQ ID NO: 4916 - RNA, 771 nt, Artificial Sequence
  Description of Artificial Sequence: Synthetic coding sequence
auggcagcaggcagccguaccucacuuuugcuagccuuuggcuuauuaugucugagcuggcuucaggaaggcucagcguuucccaccauaccucuuagccggcuguuugacaacgcaauguugcgagcuaggagacuuuaccaacuugccuaugacacuuaucaggaguuugaggaagccuauauauugaaagagcaaaaauauucguuccuacagaacccccagaccucucuguguuucuccgagagcaucccuacgccuagcaaucgcguaaaaacacagcaaaagaguaauuuggaacuacugaggauaucauuacuucugauccaaucguggcuggagccagugcagcuguuacggagugucuucgcuaacucucugguuuauggagcguccgacagcaacguguaccgccaucucaaagauuuggaggagggaauucagacacugauguggguuaggguugccccaggcauucccaauccuggcgccccccuugcaucuagggacuggggcgagaaacacuguuguccuuuauuuucgagccaggcccucacccaggagaauuccccuuacuccagcuuuccccucguuaauccaccgggucugaguuugcaaccaggcggagaggggggcaaauggaugaaugaacggggacgggaacaaugcccuucugcguggccccucuuguuauuucugcacuuugccgaagcugggcgguggcaacccccugacugggccgauuugcagucugugcugcagcagguguag

SEQ ID NO: 4917 - RNA, 654 nt, Artificial Sequence
  Description of Artificial Sequence: Synthetic coding sequence
auggcagcaggaucacggaccagccugcuacuugcauucggccugcugugcuuaucuuggcuccaggaagguagcgccuuuccaacuaucccacuuaguagacuguuugacaaugcaaugcugcgcgcuagacgacucuaccaacuagcuuacgacacguaccaggaauuugaggaagcuuauauccugaaagaacagaaguauuccuuucugcagaauccgcagacuucccuguguuuuucagagucuauaccgacacccuccaaucgggucaaaacccaacagaaauccaaccuugagcugcuuagaauuucucugcugcuuauccaaucuugguuagagccgguucaacuucucagaucaguauuugcaaauucacuaguauacggggccucugauuccaaugucuaucggcauuugaaagaccuggaggaagggauucaaacccuuauguggcggcuggaggaugggagcccaaggaccgggcagauuuucaaucaaucuuacagcaaauucgacacuaagagucacaaugacgaugcucuucuaaagaacuacggccugcuguauugcuucagaaaggauauggacaagguugaaacauuccucaggauaguccagugcaggucaguggaggggucaugcggcuuuuag

SEQ ID NO: 4918 - RNA, 609 nt, Artificial Sequence
  Description of Artificial Sequence: Synthetic coding sequence
auggcagccgguucccguacuuccuuacuguuggccuucggacuucuguguuugucuugguugcaggaagggucagcauuccccaccauaccucuuucccgccucuucgacaaugcuaugcugcgcgcccgcagauuauaucagcuggcguacgacacguaccaagaauucaauccccaaacaagccuauguuucucugaaagcauuccgacaccgagcaaucggguaaagacccagcagaagucaaaccuggagcucuugagaaucucccuccugcugauucaguccuggcuugaacccgugcaauugcucagaagcguguucgccaauucacucgucuauggugccucagacagcaauguguaucgucaucugaaagacuuggaggaaggcauccagacacuaauguggcgcuuggaagauggaucaccccgcaccggucagaucuucaaucagaguuacucaaaguuugacacaaaaagucauaaugacgacgcgcugcugaagaacuacggauuguuguacuguuucagaaaagauauggauaagguggaaacuuuccugcgcaucgugcaaugucguucaguggagggcucuugcggcuucuag

SEQ ID NO: 4919 - RNA, 738 nt, Artificial Sequence
  Description of Artificial Sequence: Synthetic coding sequence
auggcggcuggcucccggacuagcuuauuacuugcuuucggacuguugugccucagcuggcugcaggagggcuccgccuucccuacaaucccacuuucucgguuguuugacaacgccaugcugagggcgagacgacuuuaucagcuggcuuaugauacauaccaggaguuugaagaggccuauauccuuaaagaacagaaauacuccuuucuucaaaacccacagacaucucuguguuuuuccgagucuauccccaccccuucaaaucgcgugaaaacacaacaaaagagcaaccucgaacuauuaagaaucagucuccuccucauucagucauggcucgaaccagugcaacugcugagguccguguuugcuaauaguuuagucuauggggcuuccgacucaaauguguaucgacaccuaaaggacuuggaggaaggcauccagacauuaaucggcuggaaaauggccgcaccugggcucggcagaucuucaaucuccccuaccgccucucugacccagaaccgaaccacuaugacccauuguucucgaaccacugguugcaguacugccuccgggcgcacuuggacaaggucccgccacaguugugcgaguuguucugccgcguuauggcgggcggcaguagccagcagcugcccaggcgggaucccugucacucccccacaaugccuaucauggucuuggaaagugcugcuucaguguccuccagcacucucuuag

SEQ ID NO: 4920 - RNA, 753 nt, Artificial Sequence
  Description of Artificial Sequence: Synthetic coding sequence
auggaaaagggaccuguuagggcgcccgcugagaagccaaggggcgcaagauguucaaauggcuuuccagagagagaucccccccgcccagggccaucccggccagcagagaaaccaccccgcccagaagcuaaaagugcccaacccgcggaugguuggaagggagagaggccccggagugaagaggacaacgaacuaaaucugccuaauuuggcugcugcauacuccucgauuuugucaagccugggcgaaaauccacagcggcaaggcuuacugaaaacacccuggagggcugcaucugcuaugcaauucuuuacaaagggcuaucaggaaaccauauccgacguacucaacgaugcuauuuucgaugaagaccacgaugagauggugauagugaaagauaucgauauguucuccaugugugagcaucaucucguaccauucguagggaaagugcacaucggcuaucuccccaacaagcaggugcuaggacugaguaagcuggccagaaucguagagauuuauucacgaaggcuccagguucaagaacgccuuacaaagcagauugcuguggcgauaacggaagcuuugcgccccgcgggggugggcgucguggucgaagcuacccacauguguaugguaaugaggggagugcagaagaugaauuccaagaccgugacaagcaccaugcucggaguguuccgugaggacccuaagacccgagaggaguuucuuacucugauaaggaguuag

SEQ ID NO: 4921 - RNA, 693 nt, Artificial Sequence
  Description of Artificial Sequence: Synthetic coding sequence
auggaaaagggaccugugcgcgcccccgcagaaaaaccaaggggcgccagaugcagcaauggcuucccugaacgcgaccccccccgccccggcccuaguaggccggcggagaagcccccaagaccugaagcgaaguccgcgcagccugccgacggauggaaaggggaacggccacggagcgaagaggacaacgaacugaaccugccuaaucucgcagcagcauauucaucuauucugagcagucugggagaaaacccccagcgccaggggcuucugaagacgccauggagggcagccuccgcgaugcaguuuuuuacaaagggguaucaggagacuaucuccgacguucucaaugacgcuauuuuugaugaagaccacgacgagauggugaucgugaaagacauugacauguuuuccaugugcgagcaucaucuggugccauucguugggaaggugcacauugguuaucuaccaaacaagcaaguucugggccugucgaaguuagccaggauuguggaaauuuauucacguaggcuccaaguccaagagcgacugacuaaacagauugccgucgcgaucaccgaggcucugaggccagccggcguaggagugguaguggaggcaaccaagucaaauaaauacaauaaagggcugucauacuuccugcuggcaaccuuuuuguggcaguauuag

SEQ ID NO: 4922 - RNA, 753 nt, Artificial Sequence
  Description of Artificial Sequence: Synthetic coding sequence
auggaaaaaggaccaguaagagccccagcugaaaaaccaaggggggcuaggugcaguaacggguucccagagagagauccaccuaggccuggaccuucccgaccugccgagaaaccccccaggccagaagcaaaauccgcacagccagccgacggcuggaagggggaaagaccgagaagcgaggaggauaacgaauuaaaccuuccuaaccuggccgcagcuuauuccagcauccuaucaucccucggagaaaacccacagcgccaggggcugcucaaaacacccuggagagcagcuucugcuaugcaguucuuuacuaaaggcuaccaggaaaccauuucagacguguugaaugaugccauuuucgacgaagaccacgacgagauggugauaguaaaagacauagacauguuuucaaugugcgaacaccacuuagugcccuuugugggaaagguacacauuggcuaccugccaaauaaacagguucucggccugucuaagcuggcaagaauagucgagaucuauagcaggagacuccagguucaggaaagacucacuaagcaaaucgccguagccauuacagaagcccuuaggccagcuggcgugggaguagugguugaggcuacacauauguguauggugaugcgggggguacagaaaaugaauagcaagacugugacaagcaccaugcuuggcguguuccgggaggaucccaaaacccgugaagaguuucugacccucauuagaaguuag

SEQ ID NO: 4923 - RNA, 642 nt, Artificial Sequence
  Description of Artificial Sequence: Synthetic coding sequence
auggaaaagggucccgugcgggccccggccgaaaaaccaagaggagcccgauguucuaacggcuucccagaacgcgacccaccaagaccgggaccaagccgacccgcagaaaagccuccccggcccgaggcuaagagugcccagcccgcugacggcuggaaaggcgaacggccucggucagaagaagauaaugagcuaaaucugccaaaccuggccgccgccuacuccuccauccuguccagucuaggggaaaacccacagaggcagggacugcuaaagacgcccuggagagcugcaucagcuaugcaauuuuucacgaagggauaucaggagacaaucagugauguguugaacgacgcaaucuucgacgaagaucacgacgagauggugaucgugaaagauaucgauauguuuucaaugugcgaacaucaccuggugccauuugucggcaaagugcacaucggauaucuaccuaacaaacagguucucggacugagcaaacuggcgcguauugucgaaaucuauagcaggcgacugcagguucaggaaagguugaccaaacaaaucgccguggccauaaccgaggcgcucaggccagcuggaguaggcgugguuguggaagcuacuuccgcggagccauag

SEQ ID NO: 4924 - RNA, 702 nt, Artificial Sequence
  Description of Artificial Sequence: Synthetic coding sequence
auggagaaggggccgguccgggccccugcugaaaagccacgcggagcuagguguuccaauggcuuucccgagagggacccgccaagacccggacccucucgaccugcugagaagccuccaaggccagaagccaaaagcgcucagccagcugauggguggaaaggcgagaggccccguagcgaagaagauaaugagcugaacuuaccuaacuuggccgccgcauauaguucuauccugucuagccuuggagagaauccccagagacagggguuauugaaaaccccuuggcgggcagccagcgcaaugcaguucuuuacgaagggauaucaggagaccauuagugacguccuuaaugacgcaauuuuugacgaagaucacgacgaaauggugauagugaaggacauugauauguucagcaugugugagcaccacuuggugccuuucguaggcaaggugcacaucgguuaucucccgaauaaacaagucuugggcuuaucuaaacuggcgaggaucguagagauauauuccagaagacugcagguucaagagcgccuuacgaaacaaaucgcuguggcuauaacagaagcauuaagaccugccggcguaggagugguagucgaagccacaaaaucaaauaaguacaauaaaggacugucaccacuucugucuucaugucaucuguuuguagcuauccucaaauag

SEQ ID NO: 4925 - RNA, 1281 nt, Artificial Sequence
  Description of Artificial Sequence: Synthetic coding sequence
augggagaaccgggccagagucccuccccgagaucuucacauggcucuccacccacacugagcacuuuaacacuccuucugcuccuguguggacacgcucacucccaguguaagauuuuaagauguaaugcugaguacgucaguuccacacugucccuccguggcggaggaaguagcggcgcgcuucgcggugguggcggcggcggccggggaggcggugugggaucuggaggucugugcagagcgcugcgcucauaugcucucuguacccggaggacggcgagaaccugucguggcgaccuggcuuuccacagcgccguccauggcaucgaggaucugaugauucaacacaacugcucuaggcagggaccuaccgcucccccucccccacgcggcccugcccugccaggggccggcagcggacuuccggcuccugacccuugcgacuacgaaggcagauuuucccgucuucauggucguccaccuggguucuuacauugugccucuuuuggugacccucacgugcgaucuuuccaccaccacuuccacacaugccgcgugcagggugcauggccucugcuggauaacgacuuccuguucgugcaggcaacuucuuccccaauggcccucggagccaaugcuacagcgacaaggaaguuaaccaucauuuuuaaaaauaugcaggaaugcaucgaucaaaaggucuaccaagcugaaguugacaaucuacccgucgcauuugaggacgguucaauaaauggcggagaucgcccuggcgguaguagccucaguauucagaccgcaaaucccggaaaucacgucgagauccaagcugcuuacaucggcacaacuaucaucauaagacaaacugccggucagcugucuuuuucuaucaaaguggcggaggacguggccauggcuuuuagcgccgagcaggaucuccaauuaugcguggguggaugcccaccaagccagcgucugucacgcuccgaacgcaacagacgaggagcaaucacaauugacacagcccggcgacuaugcaaggagggacuccccguagaagaugccuacuuucauuccugcguguucgacgugcuaauuucuggcgaucccaacuuuaccguggcagcucaggcugcucuggaagacgcaagggccuuuuugccagaucuagaaaagcugcaccuuuuucccagcgaugccggggugcccuuaucgagugcaacacuacuggcccccuugcugagcggucuguuuguacuguggcucugcauccaauag

SEQ ID NO: 4926 - RNA, 942 nt, Artificial Sequence
  Description of Artificial Sequence: Synthetic coding sequence
augauccagcacaauuguucucggcagggccccacagcaccaccaccuccccgagguccugcccucccaggugcuggaucuggccugcccgcaccugaccccugugacuacgagggccgauuuucucgccugcaugggagaccccccggauuucugcacugugcguccuuuggcgauccacacgugagaucauuucaccaccauuuucauacauguaggguucagggagcauggccacugcuggacaaugacuuucuguuugugcaagccaccuccuccccgauggcccucggcgccaacgcuacagcaacucgaaagcugaccauuaucuucaagaacaugcaggaguguaucgaccagaaaguguaucaggcugaagucgacaacuugcccguggcuuuugaggacggauccauaaaugggggggaucgcccaggaggauccuccuugucaauccaaacagcaaaucccgguaaucacguugagauucaggccgcguacauaggcaccaccaucauuauacgccagaccgccggacagcugaguuuuucuauuaaggucgcagaagacguagccauggccuuuucugcugaacaggacuugcagcugugcgugggaggauguccccccagccagcggcugucacggagcgaacgcaaccgcagaggagccauaacuaucgauacugcccgaaggcuuuguaaagaaggacuaccuguugaggacgcguauuuucauagcuguguguuugacgugcuuaucaguggcgaccccaacuucacaguugccgcccaagccgcacuggaagaugcuagagcuuuccugccugaucucgagaagcuccacuuguucccaucugacgcaggggucccccuguccucagcuacccugcucgccccuuugcuaucaggcuuauuugugcuuugguuaugcauccaguag

SEQ ID NO: 4927 - RNA, 282 nt, Artificial Sequence
  Description of Artificial Sequence: Synthetic coding sequence
augggcgagcccggucagucuccuucaccccgaaguucccauggaucaccaccaacccugaguacauuaacccuccuacuacuccuuuguggccacgcccacucacagugcaaaaucuugcgauguaacgccgaguacgugucauccacucucaguuugcgcggcgggggaagcucuggcgcuuuacgggguggaggcggaggaggcaggggcggcggggucggaagcggaggccucuguagagcccuucgaagcuaugcgcucugcaccaggcgcacuuag

SEQ ID NO: 4928 - RNA, 603 nt, Artificial Sequence
  Description of Artificial Sequence: Synthetic coding sequence
augcaggaauguaucgaucaaaaaguuuaccaagccgaagucgauaaucugccuguugccuucgaagauggcucuaucaaugggggcgaucgacccggaggcucaaguuuaucuauccagacugcaaauccaggcaaucacgucgaaauucaggccgccuacauuggcacaacaaucauuauccgccagacugccggccagcuuagcuuuagcauuaaaguggcagaagauguggcaauggcauucagugcagaacaggaccuccaguuaugcguuggggguuguccucccucucagcggcugucccgcagcgaaaggaauaggaggggcgcuauaaccauugacacugcacguaggcucuguaaggaaggccucccaguagaagaugccuacuuccacuccuguguuuuugacguccucaucucuggggauccuaauuuuacggucgccgcccaagccgcccuggaagacgcucgcgcauuucuuccugacuuggagaagcugcaccuguucccgucggacgccggagugccccugagcucugcuacccugcucgcccccuuacucagugggcuguucguguuauggcucuguauccaguag

SEQ ID NO: 4929 - RNA, 603 nt, Artificial Sequence
  Description of Artificial Sequence: Synthetic coding sequence
augcaagaauguaucgaucagaagguguaucaggccgagguagacaaucugcccguagcguuugaagacggaucaauuaacggcggcgauaggccaggagggagcagucuuaguauccagaccgccaauccagguaaucaugucgaaauccaggccgcuuacaucgggacuaccauuaucauuaggcagacagcaggacagcucucguucagcauuaaggucgcggaagauguugccauggcguucuccgccgaacaagaccugcaguuaugcguggguggcugccccccaucucaacgacugucuaggagcgagcggaauagacguggagcuauuaccaucgacacugcuaggagguugugcaaagaaggacugcccguggaggacgcuuacuuccacuccuguguguuugacguacucaucucgggggauccuaacuucaccguggccgcacaagcugcucuagaggacgccagggcguucuuaccugaucuggaaaaacugcaccuauucccuagugacgccggcgucccccucaguuccgccacccuccuugcuccucucuugucuggauuguuugugcucuggcugugcauacaauag

SEQ ID NO: 4930 - RNA, 1422 nt, Artificial Sequence
  Description of Artificial Sequence: Synthetic coding sequence
auggcagugauggcuccaagaacccuagugcuccugcugagcggcgcacucgcucugacacaaacuugggcagaagugcagcuuguugaaagcggaggcggacucgugcagccuggagggagccugcggcugaguugugccgccucaggcuucaacaucaaggacaccuauauccacugggucaggcaggccccaggcaaaggucuggaaugggucgcucgaauauacccaaccaacggauacacucgcuacgcagacagugucaaaggcagguucacuauauccgcagauaccagcaagaauaccgcauaccuucagaugaacucucugcgugcagaagacaccgccguguauuauugcuccagguggggcggagauggauucuacgcgauggacuauuggggccaggggacccucgugacaguuaguucagcuaguaccaagggccccuccguguuuccccuggcaccuagcuccaaauccacuuccggaggcaccgccgcguugggcugucugguaaaagauuacuuccccgagccugucacuguaucguggaauuccggggcacuaaccagcggaguacauacguuucccgcuguccugcagagcaguggcuuauacagucuuaguucuguggugacuguacccucuucuagccuaggcacccagacuuacaucugcaaugucaaucacaaaccaucaaacacuaaaguggacaaaaaaguugaaccuaagucaugugacaagacccacacauguccucccuguccggcuccagaauugcuggguggaccuagcguuuuccuauucccuccaaagcccaaggacacccugaugauuucgcgcacucccgaaguaacuugugugguuguggacgucucucacgaagacccggaaguuaaguuuaacugguacguggauggcguagaagugcauaacgcgaagacaaaaccuagggaagagcaguauaacucuacuuauagaguggucucagugcugacagugcuccaccaggauuggcuaaacggcaaggaauauaaguguaaagucuccaacaaagcccucccagcacccaucgaaaaaacaauuagcaaagcuaaagggcagccaagagaaccacaggucuauacucucccgccaagcagagacgaacuuaccaaaaaucaggucucucuuacuugucuagugaaaggcuuuuacccuagugacauugccguagagugggagaguaacggacagcccgagaacaacuauaagacuacgccucccguauuagauucagacggcuccuuuuuccuguacuccaaacuuaccguagauaagagccgcuggcagcagggcaauguuuucuccuguucagugaugcaugaggcccugcauaaccacuauacucaaaaaagucugucccugucaccugguuag

SEQ ID NO: 4931 - RNA, 717 nt, Artificial Sequence
  Description of Artificial Sequence: Synthetic coding sequence
auggcugugauggcuccuagaaccuuaguacucuuauuaucuggugcccuggcucuuacgcagaccugggcagauauucaaaugacccagagccccucaagccuguccgcaucaguuggggauagagugaccauuaccugccgagcuagccaggaugugaauacggccguggcuugguaucagcagaaaccggggaaggcaccuaaacuccucauauauucugccagcuuucuguauucaggugugcccucacgauucuccgguucccgaucagggaccgauuuuacauuaacaaucucuucgcuucaacccgaagacuucgcaaccuauuauugccagcagcauuauacuacaccuccuacuuuuggacagggaacaaaaguggagaucaaaaggacuguggcggcaccaagcguguuuaucuuccccccaagugacgaacagcugaaguccggaacagccucagucgucugccugcuuaacaauuucuauccucgcgaggccaaagugcaguggaagguggauaaugcucuucaaaguggcaacucccaggaaucagucacugagcaggacagcaaagacaguacauacucuuugucuaguacacuaacacucuccaaagcagauuacgaaaagcacaagguguacgcaugcgaggucacccaccagggccuaagcagccccgugacuaaaucauucaauaggggcgaauguuag

SEQ ID NO: 4932 - RNA, 657 nt, Artificial Sequence
  Description of Artificial Sequence: Synthetic coding sequence
auggcaaccagguccccaggcguagucaucagcgacgacgagccuggauacgauuuagacuuauuuugcauuccuaaucauuaugcugaagauuuggagcggguguucaucccccaugggcuuauaauggaucggacugagcgucuggcacgcgauguaaugaaggagaugggcggacaccacauuguggcacuguguguuuugaaggguggauacaaguuuuucgccgacuuacuugauuauauaaaggccuuaaaucggaacagcgaucggucuauacccaugacaguggauuucauucgccucaagaguuacuguaacgaccagaguacaggugauauaaagguuauuggaggugaugaucuguccacccugacaggcaagaacguguugaucgucgaagacauaaucgauaccggcaaaaccaugcagacacuguuaucacucguacggcaauacaaccccaaaauggugaaagucgcuucccuauuagugaaaaggacaccuagaagcguaggguacaagccggacuucguaggauuugaaauuccagacaaauucgugguuggguaugccuuggauuacaaugaauacuuucgcgaccugaaccaugucugugugauaagugaaacugguaaggcaaaguacaaagccuag

SEQ ID NO: 4933 - RNA, 657 nt, Artificial Sequence
  Description of Artificial Sequence: Synthetic coding sequence
auggcuacccguagccccggaguagucaucagugaugaugaaccuggcuacgacuuagaucucuuuugcauccccaaccauuacgccgaagaucuggaacggguguucaucccacauggacuuaucauggaccgcacagagagacuugcacgagaugugaugaaggagaugggcgggcaucacauaguagcccuauguguacuuaaaggcggcuacaaauuuuucgccgacuuauuagauuacaucaaggcucugaacagaaacucugaccguaguaucccgaugacaguagacuucauacggcucaagucguacugcaaugaucaaucaacuggggacauaaaagugauaggcggagacgaccugucuaccuuaacuggaaaaucaagacugcuggcagaggacauuauagacacagggaagacaaugcagacguuacugagccucguacggcaguacaaccccaaaaugguuaagguggccucccugcuggugaaacggaccccccggagugucggauacaaaccugacuucguaggcuuugagauucccgauaaguuugugguuggauacgcacuggauuacaaugaauacuuuagagacuuaaaccacgucugcgucauauccgagacuggcaaggccaaguacaaagccuag

SEQ ID NO: 4934 - RNA, 1653 nt, Artificial Sequence
  Description of Artificial Sequence: Synthetic coding sequence
augccgccuccuagaaccgguagaggacuguugugguugggacucgucuuauccucaguuugcgucgcccugggguccgaaacacaggccaauagcacgacugacgcacucaacguccugcugauuauuguagaugaucuucguccaagccuggggugcuacggugauaagcuggugaggagcccuaauaucgaucagcuggccagucauucacuucuguuccagaaugcauuugcccagcaagcaguuugcgcuccaagucgcgugagcuuccugacugguaggcggcccgacacuacucgacuauaugauuuuaauucauacuggcgcguacaugcagguaacuucagcaccaucccacaauauuucaaggagaacggauacguuaccauguccgucgguaagguguuccauccuggaauauccuccaaucacaccgaugauuccccguauucguggagcuucccacccuaucaccccagcucugaaaaauacgagaacaccaagacuugcagaggcccagacggagagcugcaugcuaaccuguugugucccguggacgugcuugaugugccugaaggaacacuaccugacaagcaauccacggagcaagcuauccagcuguuggagaaaaugaaaaccagcgccagcccuuucuuccuggcuguagguuaucauaaaccgcauauuccuuuucgcuauccaaaggaauuucagaaacucuauccucucgagaacaucacauuagcaccggacccugaaguacccgacggcuuaccuccuguugcuuacaaucccuggauggacauucgacagcgcgaagacgugcaagcgcugaauauuagugugcccuauggacccauuccuguggauuuccagcgaaagauccggcagaguuauuuugcaucuguuucauauuuagauacccaaguuggccgacugcucagugcuuuagacgaucuccaacuugccaacagcaccaucaucgcuuuuaccagcgaccauggcugggcacugggcgagcacggggaaugggcuaaguacucuaacuuugauguugcuacccacguuccccuuauuuuuuacguccccggccggacagcuucucuuccugaagcuggugagaagcuguuuccauaccucgacccauucgauucugccagucagcucauggaacccggcaggcagucuauggaucuaguggagcuggugucauuauuuccuacacucgccggacuggcugguuuacagguuccuccccgcugcccaguuccuagcuuccacguggagcuuugucgcgaggguaagaacuuacuuaagcacuuccgcuuuagagaccuugaagaggaccccuaucucccaggaaacccuagggagcugaucgcauacucacaguacccgcgcccaucagauauuccccaauggaauucagauaagcccucgcugaaagauauaaagaucauggguuauaguauucgcacgaucgauuauagguauacugugugggugggcuuuaauccagaugaguuucuggcuaacuuuagcgauauucaugcgggggagcuauauuucguagacucagauccccuccaggaucacaauauguacaacgacucccagggaggagaccucuuccagcuacuuaugccauag

SEQ ID NO: 4935 - RNA, 1032 nt, Artificial Sequence
  Description of Artificial Sequence: Synthetic coding sequence
augccuccuccacgcacuggccgggguuuguuguggcucggcuugguuuuaaguucugugugcguggcuuugggcucggagacucaagcgaauucaacuacugaugcccuaaacguuuuacucauaauuguagacgaucucaggccaagucugggaugcuauggcgauaagcuugugcgcaguccaaauauugaccaguuggcaucgcauucccugcuuuuucagaacgccuucgcacaacaagccguaugcgcuccgagccgcgugucuuuucuuaccggacggcguccagauacaacaagacucuacgacuuuaacuccuauuggagagugcacgccgguaauuucucgacaaucccccaauauuucaaagaaaacggcuauguaacuaugucagugggcaaggucuuccaccccggcauuucaagcaaucauacagaugauucucccuacuccugguccuuccccccuuaucaccccucuagcgagaaguacgaaaacacaaagaccugcagggggccugacggagagcuacaugccaaucucuuaugccccguagacguccuggacgucccugaggguacauuacccgauaagcaaucuacugagcaagccauccaauugcuugagaagaugaagacuuccgcguccccuuucuuucucgcggugggguaucauaagccacacauuccuuuccguuacccaaaggaauuucagaaacuguauccccuagagaacaucaccuuggcuccugauccggaaguucccgacggccugccucccguugcuuacaauccauggauggauauucggcaaagggaggaugugcaagcccugaauauuucugugccuuacgguccaauuccaguggauuuccagaggaagauucgacaguccuacuucgccucaguuaguuaucuggauacccagguuggacggcuccucagcgcccuggacgaucuucaacuggcuaacagcacgaucauagcguuuacaagcgaccauggauucuuaaugagaacaaauacguag

SEQ ID NO: 4936 - RNA, 939 nt, Artificial Sequence
  Description of Artificial Sequence: Synthetic coding sequence
augccuccuccccggaccggccggggucugcuguggcugggguuggugcucuccucugucugcguagcauuaggaagcgagacacaggcuaauuccaccaccgaugccuuaaauguucugcugauuaucguggacgaucucagaccaucacucggaugcuacggcgacaaacugguucguucucccaacauugaucaauuggccagccauucacuccuguuccagaaugcauucgcucagcaagcuguuugcgccccaagccgaguuucauuccugacgggaagacguccggauacaaccagguuguaugacuucaacucuuacuggcgaguacacgcuggcaacuucucuacaauuccucaguauuuuaaagagaacgguuacgucacaaugucagugggcaagguguuccacccagguaucuccucuaaucacacagaugauagcccauauaguuggucuuuuccuccauaccauccuucaagugaaaaguaugagaacacuaagacuugucgcggccccgacggggaacugcaugcaaaccugcuaugccccguggacgugcuggacguucccgaagggacccuccccgauaagcagagcacagaacaggcuauccagcuucuugaaaagaugaaaaccagcgcuagcccuuuuuuccucgccgucggcuaucauaaaccacauaucccauucagauaccccaaagaauuucagaaacuguauccacucgagaauaucacccucgccccggaccccgaggugccugacggucucccucccguugcuuauaacccuuggauggauauuagacaaagagaagaugugcaagcauugaacaucagugucccuuauggcccgauucccguggauuuccaagaagaccaguccucaacuggauuccgccucaaaacuaguuccacaaggaaauauaaauag

SEQ ID NO: 4937 - RNA, 540 nt, Artificial Sequence
  Description of Artificial Sequence: Synthetic coding sequence
augccucccccgagaaccggacgcggacuccuguggcuugggcucguucucuccuccguuugcgucgcacuuggcucugaaacucaggcuaauucuaccacugacgcccugaauguccuguuaaucauuguggaugaucuacgacccucacucggcugcuauggcgauaagcugguacgcucaccuaacaucgaccaguuggccagccacagucuccucuuucagaaugcauuugcccagcaggcuguuugugccccgucucgggugucuuuccucacuggccgccggcccgacacaacacggcuuuacgauuucaacagcuacuggcggguucaugcuggaaauuuuuccacaauaccccaguacuuuaaagagaauggauacgucaccaugagcguggguaagguguuucauccaggcacagcccccugcccugaaagcgguuucuccugguucgugguuucugagucuucgauuccaauccugggaaugggucucucccugcaauccccccuccuagcugguagagugccccgcuag

SEQ ID NO: 4938 - RNA, 261 nt, Artificial Sequence
  Description of Artificial Sequence: Synthetic coding sequence
augccaccaccgagaacaggacgcgguuugcuguggcuuggguugguccuuucuaguguaugcgucgcccuggguuccgagacucaagccaacuccacuaccgacgcgcugaacguacugcucauuauaguugacgaccuccggccuucccuuggcuguuacggugacaaacucguuaggucacccaacaucgaccaacucgcuucgcauucucugcuuuuucagaacgcauucgcccaacaggcuguuugcgcuccuuag

SEQ ID NO: 4939 - RNA, 462 nt, Artificial Sequence
  Description of Artificial Sequence: Synthetic coding sequence
auggaccuggucgagcuuguuagcuuauuuccgacgcuggcuggacucgccgggcugcaagugccucccagaugucccgugcccuccuuccaugucgagcugugcagagaggggaagaaucugcugaaacauuuccguuuucgagacuuggaagaagauccauaucuccccggcaacccccgagaacucauugcuuacucucaauaccccaggccauccgauaucccgcaguggaacuccgauaagccaagccucaaagauauaaaaauuaugggauacucaaucaggacaauugacuaucgguacacggugugggugggcuuuaauccugaugaguuucuugcuaacuucucugacauucacgcaggcgaacuguauuuuguggauuccgacccgcugcaagaucauaauauguauaaugauucccagggcggugaucuuuuucaacuacugaugcccuag

SEQ ID NO: 4940 - RNA, 1020 nt, Artificial Sequence
  Description of Artificial Sequence: Synthetic coding sequence
augaaaacuucugcaagcccuuucuuucuggcgguuggguaccacaagccucacaucccauuuagauacccaaaggaguuccagaagcuguacccuuuagagaacaucacacuggccccagaccccgagguaccggaugggcuaccccccguugcuuacaacccguggauggauauucggcagagagaagaugugcaggcacucaauauuagcguccccuacgguccgauuccuguagacuuccagagaaagauccgccagucauacuucgcgagcguuucauaccuggauacccaggugggcagauugcuuagcgcguuggacgaccuacaauuagcaaacagcacaauuauagcguucaccagugaccacggaugggcccugggugaacacggugagugggccaaguauucaaacuuugauguggccacccaugucccgcucauuuuuuaugugccuggacgcacagcauccuuaccagaagcaggugaaaaacuguucccauaucuggauccauucgacuccgcuucacagcugauggaacccgggcggcaauccauggauuugguggaacuuguuucucuauucccaacccucgcuggccuugccggccuccaaguccccccccggugcccugugccaucauuucacguugagcuuugccgagagggcaaaaaucugcugaaacauuuucgcuucagggacuuggaggaagacccuuaccuaccuggcaacccaagggaacugauagcuuauucacaguauccacguccauccgauaucccccaauggaauagcgauaaacccagccugaaggauauuaagauaaugggauacucaauccgcacaaucgauuaccgcuacacuguuugggugggcuuuaaucccgaugaguucuuggcuaauuuuagcgacauucaugccggugaacuuuacuucguggauucugauccucuccaggaccacaacauguauaaugauucucaaggaggcgaucucuuccaauuacuaaugccuuag

SEQ ID NO: 4941 - RNA, 1962 nt, Artificial Sequence
  Description of Artificial Sequence: Synthetic coding sequence
augaggccauuaagaccucgcgcugcccucuuggcauuauuagcaucauuacuggcggcuccuccagucgcgccggcggaggcaccacacuuggugcauguggaugccgcgcgugcccuuuggccccuuagaagguucuggcgcucaacuggcuucugccccccucugccucauucccaggccgaccaguaugugcugagcugggaccaacaacugaaccucgcuuaugucggggcgguaccccacagggggauuaagcaggugcgcacgcauuggcugcuggaacucgugacuacuagaggcucaaccgggcgcgggcuguccuauaacuuuacacaccuggauggcuacuuggacuugcugcgggagaaccagcuacuucccggguucgaacucaugggcuccgcguccggccacuuuacugauuuugaggacaagcagcaaguuuucgaauggaaagacuuggugagcucgcucgcucgccguuauaucggcagauauggacucgcgcacguguccaaguggaauuucgaaaccuggaaugagccggaucaccacgacuuugacaacguguccaugacaaugcagggcuuucugaauuacuaugaugcauguagugagggccuuagagccgccucucccgccuugaggcucggagguccuggagauagcuuccacacuccaccucguucacccuuaaguuggggacuacugcggcacugccaugauggcacaaauuuuuucaccggagaggccggcguucgacuugauuauauuucacuccauaggaagggugcucggucgucgauaucaauccucgagcaggaaaaagucguggcccagcagaucagacaguuauuuccaaaauucgcagauacccccauauacaaugacgaggccgauccacugguaggcuggucccuuccccagccauggcgugccgauguuaccuacgcggcgauggucgugaaggugauugcccagcaccaaaauuuacuccuugcuaacacaaccuccgcauuuccauacgcccuucuuucaaaugacaaugcuuuccugagcuaccauccccauccuuucgcccagcgcacucuuaccgcccgcuuccaggucaauaauacucggccaccacaugugcaguuacugcgcaaacccguacuuaccgcuaugggcuugcuugcacucuuggaugaagaacaguugugggcagaagucucucaggcagggacagugcucgauagcaaucacaccguaggaguguuagccagcgcccauaggccacagggacccgcagaugcauggcgagcugccguccugauuuaugccucugaugauacuagagcacauccgaauaggucugucgcagugacucugcggcugcgcggggugccccccggcccaggucucguguacguuacaagauaccuugauaauggauuguguagcccagauggugaguggaggcgccucggccgucccguguucccgaccgccgagcaauuccgccggaugagggcugcugaggaccccguggccgcagccccccgaccccuccccgccggugguagacugacccuacggccagcauugcgucugccaagcuugcugcucgugcaugugugugcuagaccggagaagccgccaggucaggucacaaggcugcgagcccugcccuuaacucagggacaguugguccugguguggagcgaugagcauguuggcagcaaaugucuguggaccuaugaaauucaguuuucccaggaugguaaggcguacacaccaguguccagaaagccauccacguuuaaccuuuucguguuuagccccgacacaggagcugugagcggaucuuaccgggugagagcgcucgauuauugggcaagaccagggccuuuuuccgauccugucccuuacuuggaagugccaguuccucgggggccuccuucuccuggcaauccuuag

SEQ ID NO: 4942 - RNA, 2028 nt, Artificial Sequence
  Description of Artificial Sequence: Synthetic coding sequence
augagaccccuucgcccuagagccgcauugcuggcccuauuagccagucugcuugccgcaccuccuguggccccugccgaagcaccacaccucgugcauguagacgcagcccgagcccuguggccccuccgucgguuuuggagaucgacaggcuuuugggguaguacuggaagaggacuguccuauaacuucacccauuuggaugguuaccucgacuugcucagggagaaucagcugcuacccgguuuugagcugaugggcucagcuaguggccauuucacagacuucgaggacaagcagcagguguucgaauggaaggaccuaguuucaucccuggcaagaagguacauuggcagauauggauuagcucacguaagcaaauggaauuucgagacauggaaugagccugaucaccacgauuuugauaacguguccaugaccaugcagggcuuccucaacuauuacgacgccuguagugagggccugagggcagcuuccccugcucugcgccugggcgggccaggugacagcuuccauacuccaccacgguccccacuuucauggggacuucugaggcacugucacgauggcacuaacuuuuuuacaggcgaggccgggguaagacucgauuacaucagucuucaccgaaaagugcgcccugccccaccuagcgcacccgucuuuugcgcucucucuagaugcgccccagguagggcugauccuggcggagccgaagcagccccuccggcaggcugcgcccaguugcaccugcauccgggcgccggagaaggacgcagggcugccgaccccgcugcgcugccacaggucaggggccacccacaccugcaacggcgcggagggccagccggaggcuuggugcccgcaacugccguggaggggggacgugauuugcgcggucauggcggagaagguggccccgcacagcgcccggcucggccucccgccacauuucugccccgaagagaucgccgagcuguagccgccccaccaggccccuccugucccggccacccucaagugaucgcucagcaucagaaucuguuacuggccaauacuacaucagccuuuccguaugcguugcucucuaaugacaacgccuucuuguccuaccacccucaccccuuugcccaaagaacccugacagcgcgcuuccaagugaacaauacucggcccccacacgugcagcugcugcguaagcccguccucacggccauggggcuguuggcacuccuggaugaggaacagcucugggcugagguaucgcaagcgggaacaguucuggauucuaaucacacagugggaguccuggcauccgcccacagaccacaaggcccagcagacgcguggagggccgcugugcugaucuacgcuucggacgauacucgagcccaccccaacagaaguguggccgucacucuuagacuccgggguguuccgcccggaccaggccucgucuacgugacccguuaucuggacaacggccucugcucucccgauggggaguggcggagguuggggcggccaguguuuccgaccgcugaacaguuccggaggaugcgagcagcugaagacccaguggcugccgccccucgaccucugccugccggaggcagacucacgcucaggcccgcacugaggcuccccucacugcuccucguccacgugugugcccgcccugaaaagccuccgggacaggugacuaggcuacgggcucuaccccugacccaaggccaacuaguacucgucuggucagaugaacacguaggauccaaaugcuuauggacguacgagauacaguuuagucaagacggcaaagccuacacacccgucagucggaagccaaguacuuuuaaucucuucgucuucucaccugacaccggcgccguuucgggcucauaccguguuagagcacuggauuauugggcacggcccggcccuuuuucagacccugugccguacuuagaagugccugucccacgcggaccuccaucccccggcaauccauag

SEQ ID NO: 4943 - RNA, 603 nt, Artificial Sequence
  Description of Artificial Sequence: Synthetic coding sequence
auggcucuguggaugaggcuucuaccacugcuugcgcuccucgcucuaugggggcccgacccagcugcugccuucgugaaccagcaucuuugcggcagucaccucgucgaggcucuuuaccuggucuguggcgagcgcggauuuuuuuauacaccuaaaacucggagagaggcagaggacuuacaggcgucagcucuuucgcucuccagcucuacgaguacuuggccagaggggcuggacgcaacugcccgcgcaccaccagcccucgucgugacugcuaacauaggucaggcuggcggcucgucguccagacaauuucggcaacgcgcacucgggacuucugauaguccgguguuauucauccauuguccgggugcggccggaacugcccaaggucucgaauaccgcgguagacgugucacaacugaguugguaugggaagaaguugauuccuccccacagccucaagguuccgaaucccucccugcacagcccccugcccagccagcuccacagccggagccacaacaggcccgagagcccuccccugaagugucuuguugcggccuguggcccagaaggccccagagaucccagaauuag

SEQ ID NO: 4944 - RNA, 333 nt, Artificial Sequence
  Description of Artificial Sequence: Synthetic coding sequence
auggcucuguggaugagacuguugccgcugcuggcucuccucgcuuuguggggcccggaucccgcugcagcuuucguuaaccagcauuuauguggaucacaccugguggaggcccuuuaccuugucugcggggaacguggauucuuuuauacaccaaaaacuagacgagaggcugaggaucugcaggugggacagguagaacugggcggagguccaggcgcaggcuccuugcaaccgcuggcucuggaagguucacuacagaagaggggcaucguagagcagugcuguacuucgauauguucacucuaucagcuggaaaacuauugcaauuag

SEQ ID NO: 4945 - RNA, 333 nt, Artificial Sequence
  Description of Artificial Sequence: Synthetic coding sequence
auggcccuuuggaugcgccuguugccgcugcuggcacuuuuagcucuguggggaccugauccagccgcagcguuuguuaaucagcaccugugcggcagccauuugguggaagcccuuuaccucguaugcggcgagcguggauuuuuuuacacaccuaaaaccaggagggaggccgaggacuuacagguaggccaggucgaacucggaggcggcccaggggcagguagucugcagccacucgcccucgaaggaaguuuacagaaaagagggaucgucgaacaguguuguaccuccaucuguagccuguaccaacuggaaaauuacuguaacuag

SEQ ID NO: 4946 - RNA, 333 nt, Artificial Sequence
  Description of Artificial Sequence: Synthetic coding sequence
auggcccuuuggaugagacugcugccguuguuggcuuuacucgcuuugugggggcccgauccugccgcggcuuuugucaaccaacaccuuuguggaagucaccuggucgaggccuuauacuugguguguggcgagagaggauuuuucuauacccccaagacaaggcgggaggcugaagaucugcaagugggacaaguggaauuggggggcggaccuggggcaggcagccuucagccacuggcccuggaagggagcuuacaaaagagagguaucgucgagcagugcugcacaucaaucuguucuuuauaucagcucgaaaauuacuguaauuag

SEQ ID NO: 4947 - RNA, 297 nt, Artificial Sequence
  Description of Artificial Sequence: Synthetic coding sequence
auggcauuguggaugcgcuugcuaccccuccucgcccuccucgcucugugggggcccgauccugccgcagcguuugucaaccaacaucugugcggcagucaucucgucgaggcacucuaucuggucugcggugaacgaggguuuuucuacacucccaagacacgacgugaggccgaggauuuacaggggucacugcagccacuggcucuggaaggaagccugcaaaaaagagggaucguggaacaauguuguacaaguauuugcucacuuuaccagcuggagaauuauuguaacuag

SEQ ID NO: 4948 - RNA, 333 nt, Artificial Sequence
  Description of Artificial Sequence: Synthetic coding sequence
auggcacuuuggaugcggcuacuuccguuacuggccuuacuagcucuuuggggaccagauccagccgcggccuucguuaaccaacaucuguguggcucacaccuagucgaagcccuuuaucuggugugcggggaaagaggauucuuuuauacugauaaaacccggagagaagccgaggaccugcagguaggacaaguggagcugggcggaggccccggagcagggucccuacagccucuggccuuagaggggucguugcaaaagagaggcauaguggaacaguguugcacuagcauauguucucuuuaucagcuggaaaauuacugcaacuag

SEQ ID NO: 4949 - RNA, 333 nt, Artificial Sequence
  Description of Artificial Sequence: Synthetic coding sequence
auggcccuauggaugcgguuacugccacuucuugcccuuuuagcccuuuggggaccagaucccgccgcagcguuuguaaaucagcaccugugcggcagccaccuuguggaagcacuuuaucucgugugcggcgaacgcggauuuuucuacacuccuaaaacucgcagagaggccgaagaccuccaggugggacagguagagcugggcggugggccuggagcuggcagucuccagcccuuagcacuggaagguagucugcaaaaacguggcauuguggagcaguguugcacaucuauuugcaguuuguaucagcucgagaauuacuguggauag

SEQ ID NO: 4950 - RNA, 333 nt, Artificial Sequence
  Description of Artificial Sequence: Synthetic coding sequence
auggcacuguggaugagauuacuccccuugcuggcacuucuggccuugugggguccggacccugcugccgcuuuugucaaacagcacuuauguggcucucaucuuguugaagcucuguacuugguaugcggcgaacgcggauucuucuacaccccugaaacuagacgugaagcggaagacuugcaggugggccaaguggagcugggugguggcccgggggccggcagccuacagccguuggcgcuggagggcucacugcagaaacgcggaaucguggaacagugcugcacaagcauaugcucauuauaccaacucgagaacuacuguaacuag

SEQ ID NO: 4951 - RNA, 333 nt, Artificial Sequence
  Description of Artificial Sequence: Synthetic coding sequence
auggcccucuggaugcgccugcuucccuugcuugcuuuguuagcacuguggggaccagaucccgccgccgcauucguuaaccagcaccuaugugguucacaucugguggaagcccucuaucuugucugcggggagaggggcuuuuucuauacgaagccaaccagaagagaagcagaggacuuacaggugggucaggucgaauuggguggcggcccaggcgccgguucuuugcaaccgcuugcacucgaaggcucucuccaaaagcgaggaaucguggaacagugcuguacaucuauauguucacucuaucagcuggaaaacuacugcaacuag

SEQ ID NO: 4952 - RNA, 570 nt, Artificial Sequence
  Description of Artificial Sequence: Synthetic coding sequence
auggcacugagcuucagccugcugauggccguucucguuuuaucguauaagucuauuuguagccucggcugcgauuugccccagacccauagccuggguaacagacgggcucuaauauugcugggucagaugggucggaucuccccuuuuagcugcuugaaagaccggcacgauuuccgcauuccacaggaagaauucgacgggaaccaguuucagaaggcacaagcuauuaguguucuacaugagaugauucagcaaacauucaaucuguucucgacugaagauagcucugcugccugggaacagagucugcuagagaaauucucaacagaacuguaucaacagcugaacgauuuggaagcuugcgugauacaggaggugggcguagaagagacaccucuuaugaacgaagacaguauacucgccgucagaaaguauuuccagaggaucacccuauaucugaucgagaggaaauauucaccgugugcuugggaaguggucagagcggagauaaugcgguccuugucuuuuucuaccaaucuacagaagcgucuccgacggaaggauuag

SEQ ID NO: 4953 - RNA, 573 nt, Artificial Sequence
  Description of Artificial Sequence: Synthetic coding sequence
augauggcuagcccuuucgcccugcugauggcccuaguaguuuuaagcugcaaaucaucauguucacuugguugugaucuucccgaaacccauaguuuagacaaucgccggacacuuaugcuguuggcucagaugucucggauuagcccgagcucaugucucauggaccgacacgauuuuggauuuccucaagaggaauuugacgggaaccaguuccagaaagccccagcuauuuccguucugcacgagcugauucaacagauuuuuaaucuguuuacuacgaaggacucuuccgccgccugggaugaagaccuucucgacaaauucuguacagaacucuaccagcaguuaaaugaucuugaggcaugcgugaugcaagaagaacgugugggagaaacuccauuaaugaacgcagacucaaucuuggcuguuaaaaaguauuuuagacguaucacccuuuaucucaccgagaaaaaauacucaccuugugcuugggaaguggugagggcggaaaucaugaggucacugagccuaaguacgaaccuccaggagcgacuuaggcguaaggaguag

SEQ ID NO: 4954 - RNA, 570 nt, Artificial Sequence
  Description of Artificial Sequence: Synthetic coding sequence
auggcucuucccuuugcgcucaugauggcccucguggugcugaguuguaaaagcagcuguucacugggcugcaauuuaagccagacccauucacucaauaaucggcgcacccucaugcucauggcucagaugcgccggaucucgcccuuuuccugcuuaaaagaucgucacgacuucgaguucccccaggaagaguuugacggaaaucaauuccagaaagcacaagcuauuuccguacuccacgagaugaugcagcagacauucaaccuguucaguaccaagaacucaucagcugccugggacgaaacacuccuugaaaaauuuuacauugaacuguuccaacaaaugaacgaccuggaggcuugcguaauucaagagguaggcguagaagaaaccccccuuaugaaugaggacaguauccuagcaguuaaaaaauacuuucaaaggaucacccucuaccuuauggaaaaaaaauacucacccugugccugggagguugugcgggcugagaucaugagaucccuuaguuucucuaccaaccugcagaagcgacuaaggcgaaaggacuag

SEQ ID NO: 4955 - RNA, 570 nt, Artificial Sequence
  Description of Artificial Sequence: Synthetic coding sequence
auggcccugucauucagccuauuaauggcagugcucguacuuucuuacaagucuaucugcucucucggcugcgaucugccucagacucauucccugggcaacagaagagcgcugauucucuuggcgcaaaugggacggaucucucacuuuucuugcuugaaagaccgcuacgauuuugguuucccacaggaaguauuugauggcaaccaguuccagaaggcucaagcuauuucugcguuucacgaaaugauucagcagacauuuaaucuguucagcacaaaagauagcucagcugcuugggaugaaacccugcucgauaaguucuacauugaacuuuuucagcaacugaacgaucuggaggccugcgucacucaggagguuggcguggaggagauagcguuaaugaacgaggacucgauucucgcuguucgaaaauacuuucagaggauuacccuuuacuugaugggcaaaaaguauucuccuugcgcuugggaaguugugcgcgcagagauuaugcgaucauucagcuucagcaccaaccugcagaaaggguuaaggcguaaagauuag

SEQ ID NO: 4956 - RNA, 570 nt, Artificial Sequence
  Description of Artificial Sequence: Synthetic coding sequence
auggcccuaaguuuuucccugcucauggcuguccucgugcucucauacaaaucgauaugcucguugggaugcgaccugccacagacacauucacuuggaaacagacgggcccuuaucuuacucgcucagaugggcagaaucaguccauucuccugccuaaaggaucgccacgacuucgggcuuccccaggaagaguucgacggcaaccaguuucagaaaacccaggcuaucucaguccuccaugaaaugauucagcaaaccuuuaauuuauuuuccaccgaagauucuucagcagcaugggagcagucucuccuagagaaguuuucuacagagcuauaucagcaacucaauaaccucgaggcguguguuauacaggaggucggcauggaagagacaccucucaugaacgaagauaguauccuagccgugagaaaauauuuccagcgaauaacccuguaucucaccgaaaagaaguacagcccuugugcuugggagguggugcgggcugaaaucaugagaagccugaguuucucaacaaacuuacagaagaucuugaggcgcaaggacuag

SEQ ID NO: 4957 - RNA, 567 nt, Artificial Sequence
  Description of Artificial Sequence: Synthetic coding sequence
auggcuuugacauucgccuugcuuguugcucuguuaguucuaagcuguaaguccucuuguucugugggaugcgaccucccacagacccauagccucgggucaaggcggacgcugaugcuccucgcccagaugagaagaaucucacuuuucagcugcuuaaaagacagacacgacuucggcuucccacaggaagaguucggcaaccaguuccagaaggcugaaaccauuccuguccugcacgaaaugauacagcaaauuuuuaauuuauuuucaacuaaggauaguagugcugcaugggaugaaacguuacuggauaaguuuuacaccgagcuauaucaacaacugaacgaucucgaggcgugcguuauccagggggugggcguuaccgaaacuccacugaugaaagaggauuccauccuagcaguuagaaaguauuuccaacgaaucacgcucuaccuuaaagagaagaaauauucacccugcgcaugggaaguugugcgggcugagauuaugaggagcuucucucugaguaccaaccuucaagaaucucuucgguccaaggaauag

SEQ ID NO: 4958 - RNA, 570 nt, Artificial Sequence
  Description of Artificial Sequence: Synthetic coding sequence
auggcauuaucuuuuucccuucugauggccguucucgugcucuccuauaaaucuaucugcucuuuagguugcgaccuuccccaaacgcauagccuuggaaauagacgcgcacugauccucuuagcacagaugggcaggauuaguccauucagcugccugaaggaccggcacgauuucggguuuccucaggaggaguucgacggcaaucaguuucagaaagcccaagcaauaaguguucuccaugaaaugauucagcagaccuuuaaccucuuuagcacgaaggacaguagugcuacgugggaacagucacugcuggaaaaguucuccacagaacucaaccaacaacugaaugauuuggaagcuugcgugauccaagaaguaggaguggaggagaccccccuuaugaauguggacucaauacuggcggucaaaaaauacuuucaacgcaucacucuguaucucacagaaaagaaauacaguccuugugccugggaggucguccgcgccgagaucaugaggucauuuagucucuccaaaauauuucaggaacgacugcgucgcaaagaauag

SEQ ID NO: 4959 - RNA, 570 nt, Artificial Sequence
  Description of Artificial Sequence: Synthetic coding sequence
auggcacucucuuucucacuguugauggcaguccugguuuuguccuauaagucaaucugcagccugggcugcgaucugccccagacucauucucucggcaacagaagagcccugauccuccuggcacagauggggcgcaucucacacuuuucaugcuugaaagauaggcaugacuucggauucccagaggaggaguucgauggacaccaguuucaaaaggcacaggcuauuagcguacuccaugaaaugauccagcagaccuuuaaucucuucaguaccgaagauucguccgccgcaugggaacaaagccugcuggaaaaguucucaacagaacuguaucaacagcugaaugaucucgaggcuugcgucauacaggagguuggcgucgaggagacuccacuaaugaaugaggauagcauccuggccguucgcaaauacuuccagcggauuacccuuuaccugacugaaaaaaaguacagcccuugugcuugggagguuguucgggcugaaaucaugcgcucgcuuaguuucuccacaaacuuacagaaaagauuaagaaggaaggauuag

SEQ ID NO: 4960 - RNA, 570 nt, Artificial Sequence
  Description of Artificial Sequence: Synthetic coding sequence
auggccuuaccuuucgugcuucugauggcgcuaguggugcucaauuguaagucgauaugcucacuuggcugcgacuugccgcagacccauucucucuccaaccgacggacuuuaaugaucauggcacagauggggaggauuagcccuuucagcugccugaaagacagacacgacuucggcuucccacaggaggaguucgacggcaaucaguuccaaaaagcacaggccauuuccguccuccaugaaaugauccaacaaacuuucaaccuguucagcacuaaagacagcagcgcuacaugggaugaaacucuucuggauaaauucuacaccgaacuauaucaacagcucaaugaccuggaggccugcaugaugcaggaggucggugucgaagauacuccgcuuaugaacguugacuccaucuuaacugugagaaaguacuuucagcgaaucacccuguauuuaaccgagaagaaauacucaccaugcgccugggagguaguccgugccgaaauuaugaggagcuuuagucugagcgccaauuuacaggaaagauugagacggaaagaauag

SEQ ID NO: 4961 - RNA, 570 nt, Artificial Sequence
  Description of Artificial Sequence: Synthetic coding sequence
auggcccucccauucgcacugcugauggcccugguuguccuauccuguaagagcagcugcagccuugacugugaccucccacagacucacucccuaggccaccgaaggacuaugaugcuccuugcgcagaugaggcgaauaagucuauuuagcugccucaaagaucgccacgauuucagguuuccucaggaagaguuugauggaaaucaguuccagaaagcugaggcuauauccgugcuccacgaaguuauucagcagacguuuaauuuguuuaguaccaaggacuccuccguugccugggacgaacgccuccuggauaaacuuuauacggaauuguaccaacaacuaaacgaccucgaagcgugcgugaugcaagaaguaugggugggugguacuccgcucaugaacgaagauucaauuuuagcaguucgcaaauauuuucagaggaucacccuguaccuaacugagaagaaauacuccccuugcgcuugggaggugguaagagccgaaauaaugcgcucguuuuccaguucgaggaaccuccaggaaagacugaggcgaaaggaguag

SEQ ID NO: 4962 - RNA, 570 nt, Artificial Sequence
  Description of Artificial Sequence: Synthetic coding sequence
auggcgcgcaguuucucucugcugaugguggugcucguucucagcuacaaaaguaucuguucucuugggugcgaucuuccgcagacucacucuuugagaaauaggagagcccugauccugcuggcccaaaugggaagaauuagccccuucagcuguuugaaagauagacaugaguuccgauucccugaggaagaguucgacggucaccaguuccagaaaacucaggcaauuagcguccuccaugaaaugauacaacagacuuucaaucucuuuucgacugaggacuccagcgcagcuugggagcaaucacuccuagaaaaauuuucaaccgaauuguaucagcaacugaacgaccuugaggccugcguuauccaagagguggguguugaagagacuccuuuaaugaacgaagauuuuauccuugcaguucgcaaguacuuucagcggaucacuuuguauuugauggagaaaaaguacaguccgugcgcuugggaagucgucagggcagagaucaugagauccuucuccuuuuccacgaaucugaagaagggccuucgacggaaggacuag

SEQ ID NO: 4963 - RNA, 570 nt, Artificial Sequence
  Description of Artificial Sequence: Synthetic coding sequence
auggcuuugaccuucuaccuucucgucgcccugguaguccugucuuacaaaagcuuuaguaguuuggguugugaccugccacaaacacacucccuugggaacaggcgcgccuugauuuugcuagcccagaugcggcguauauccccauucucuugcuuaaaggaucggcacgacuuugaguucccacaagaggaauucgaugacaagcaguuccaaaaggcccaggcuauuuccgucuugcacgaaaugauucagcagacuuucaaucucuucuccaccaaggauucuagcgcagccuuagacgagacccugcuugacgaguuuuauaucgagcuugaccaacagcuuaaugaucucgaauccuguguuaugcaggaaguuggagugaucgagucaccccuaauguacgaagauucaaucuuagccgucagaaaauauuuucaacgcauaacacucuaccugaccgaaaaaaaauacagcucaugcgcaugggaagucguccgugcagaaaucaugcgaaguuuuagccugaguaucaaccugcaaaagaggcugaaguccaaggaauag

SEQ ID NO: 4964 - RNA, 564 nt, Artificial Sequence
  Description of Artificial Sequence: Synthetic coding sequence
augaccaauaaaugcuuacuccaaauagcgcuuuugcuuuguuucuccacaaccgccuuaucaauguccuacaaccugcugggguuucuccaaaggagcagcaauuuucagugucagaagcucuuauggcagcucaacggaaggcucgaguacugcuuaaaggacagaaugaacuuugacauccccgaagagauuaagcaacugcagcaguuucaaaaggaggacgcggcucugacaaucuaugagauguuacagaauauauucgcaauuuuucgacaggacagcucuaguaccggauggaaugaaacaaucguugagaaucuguuggccaauguguaccaucagaucaaccaccuaaagaccguguuagaggagaagcuggagaaagaggacuuuacaagaggcaagcugaugaguagucugcacuugaaaagguauuacggacguauuuugcacuauuugaaggcaaaggaauauagucauugugcuuggacgaucgugagagucgaaauucugagaaauuucuacuucaucaaccgccugacuggauaccuccgcaauuag

SEQ ID NO: 4965 - RNA, 534 nt, Artificial Sequence
  Description of Artificial Sequence: Synthetic coding sequence
auguuucacgugucauuuagguacauuuucggucugccuccucuuauacugguacugcucccuguggcuucuuccgauugcgauauugaaggaaaggauggcaaacaauacgagucaguucugauggucuccauugaccagcugcuagauaguaugaaagagaucgguucaaauugccugaauaaugaguuuaauuucuucaagaggcacaucugugacgcuaauaaggaagguauguuccuguuccgugcugcucggaagcugcgacaauuccuaaaaaugaauucaacgggagauuuugacuuacaucugcugaaaguaagcgaaggcacgacaauucugcuaaacuguacuggacaaguaaagggucggaaacccgcagcccuuggugaagcucagccuaccaagagucuggaggagaacaagagccugaaagaacagaagaagcucaacgaucuguguuuccuuaagcgccuccugcaagagauuaaaacauguuggaacaagaucuuaaugggaacuaaagagcacuag

SEQ ID NO: 4966 - RNA, 216 nt, Artificial Sequence
  Description of Artificial Sequence: Synthetic coding sequence
auguuucacgucaguuuccguuauauuuucgggcugccccccuuaauccucgugcuccuaccuguggcuucaucugacugcgacauugaaggaaaagacgguaaacaguacgaaagcguacuuaugguaaguaucgaccagcucuugaaccagcccuacaagaagaaagaaaaaaggaccgaacggaaacaacagucggcaauguccaacaacuag

SEQ ID NO: 4967 - RNA, 393 nt, Artificial Sequence
  Description of Artificial Sequence: Synthetic coding sequence
gugagcuucagguauauuuucggauuacccccccugauccuuguccuacugcccguggcuuccuccgacugcgacauugaaggcaaagacggcaaacaguaugaauccguucuaaugguaaguaucgaccagcugcucgacaguaugaaggagauagguucaaauugucugaauaaugaguucaauuuuuucaagaggcauauuugugacgccaacaaggucaaggggcggaaaccugcugcacuaggugaagcccagccgaccaaaagcuuagaggaaaauaaaucacucaaggagcaaaagaaacucaacgaccuguguuuccucaagcgacugcuucaagagauuaaaacuugcuggaacaagauccuaaugggcaccaaggaacacuag

SEQ ID NO: 4968 - RNA, 216 nt, Artificial Sequence
  Description of Artificial Sequence: Synthetic coding sequence
auguuucauguaaguuuccgcuacauauucgggcuucccccuuugauuuugguguuguugccugucgccuccagcgacugcgacauugagggaaaggauggcaaacaauacgaaagcgugcucaugguguccauagaccagcugcugaaucagcccuauaaaaagaaagaaaagagaacagagagaaaacaacagucagcuaugucaaauaauuag

SEQ ID NO: 4969 - RNA, 114 nt, Artificial Sequence
  Description of Artificial Sequence: Synthetic coding sequence
auguuucauguuucuuucagguacaucuucgggcucccgccguuaauucuuguccuucuccccguagcaagcagugauugugauaucgaaggccaacacgagcguaacugguag

SEQ ID NO: 4970 - RNA, 402 nt, Artificial Sequence
  Description of Artificial Sequence: Synthetic coding sequence
auguuccacgucucguuucgcuacauuuuugggcugccuccucucauccugguccugcugcccguggcaucuuccgauugugacaucgaaggcaaggacggcaaacaauacgaaagcguacugaugguaagcauagaccagcugcucgauagcaugaaagaaauuggcuccaacugucuuaauaaugaauucaacuucuuuaaacgucacauuugcgacgcuaacaaggugaaggggagaaaaccagccgccuugggggaggcucaaccuacuaagucucuugaggagaacaaaucccuaaaagaacagaaaaaacuuaaugaucucugcuucuugaagcggcuacuucaggagaucaaaaccugcuggaauaaaauucugaugggcaccaaagagcacuag

SEQ ID NO: 4971 - RNA, 114 nt, Artificial Sequence
  Description of Artificial Sequence: Synthetic coding sequence
auguuccacgucuccuuuagauacauuuucggccugcccccucugauuuuggugcuguuacccguggcaagcucagauugcgacauugagggccaacaugagcgaaauugguag

SEQ ID NO: 4972 - RNA, 195 nt, Artificial Sequence
  Description of Artificial Sequence: Synthetic coding sequence
augaaggagaucgggucuaauugucuaaauaaugaauucaauuuuuucaagaggcauauuugugacgcaaacaaagaagaaaauaaaucucuuaaggagcagaaaaaacugaacgaucuuuguuuucugaaaagacuuuugcaggaaaucaaaacauguuggaauaagauccucaugggcaccaaagagcauuag

SEQ ID NO: 4973 - RNA, 660 nt, Artificial Sequence
  Description of Artificial Sequence: Synthetic coding sequence
augaagaugagguuccucggccugguugucugucuugugcucuggacacugcauagcgaaggaagcggaggcaagcugaccgcuguggauccugagacuaauaugaauguauccgaaauuaucaguuauuggggguuuccuagcgaagaauacuugguugaaacagaagacgguuacauacucugucugaaucgcauaccacacggccguaagaaccauucagauaagggccccaaaccaguuguguuucugcagcacgguuugcuggcggauucgucuaacugggugaccaaucucgcgaacucaagccucggauucauucucgccgacgccggcuuugacgucuggaugggaaacagucgugguaacacuuggucucgcaaacacaagacacugucagugagccaggacgaguucugggcuuucucuuacgacgaaauggcaaaguacgaccuuccugcaucaauaaauuucauuuuaaacaagacagggcaagaacagguguacuacguaggucacucacaggguaccaccaucggcuuuaucgcguuuucccagauacccgagcuggccaaaagaaucaaaauguuuuucgcgcugggcccaguggccaguguggccuucugcacauccccuauggcaaagcucggucgguuguag

SEQ ID NO: 4974 - RNA, 1200 nt, Artificial Sequence
  Description of Artificial Sequence: Synthetic coding sequence
augaagaugcgguuccugggacucguagugugccuuguccuguggacccugcacucugaaggcuccggcgguaagcugacagccgucgacccugagacaaacaugaacgugucagaaauuaucucauacugggguuuccccuccgaagaguaccuugucgaaacagaagacggauauauacugugccugaauagaauaccccacggccggaaaaaucacagcgauaaaggcccgaaaccaguaguauuucugcagcacggcuugcuggcagauucuaguaacugggugaccaaucuggcuaacucuucccugggcuucauucucgcugaugccggguucgacguguggauggggaauaguagggguaacacauggucgcgcaagcacaaaaccuugagcguaagccaagaugaguucugggccuuuagcuacgacgaaauggccaaauaugaucugcccgcuuccaucaauuuuauacucaauaagacuggacaggagcaggucuacuacguuggucacucucagggcacaaccauaggauuuauugccuuuagucagauucccgaacucgcuaagaggaucaaaauguuuuucgcccugggcccggucgccagugucgcauuuuguacaucuccaauggcaaaguugggcagauugccagaccaccucaucaaagaccuguuuggagauaaggaguuucucccgcaguccgcguuucucaaauggcuggggacgcacguguguacucaugucauccuaaaggaauuaugugggaauuuguguuuucuacuguguggauucaaugaacggaacuugaauaugucccguguugacguguauaccacucauucaccggcugggacauccguucaaaauauguugcauuggucgcaggcugugaaguuucagaaauuucaagcauuugacuggggcucgagcgcaaagaacuauuuccauuauaaucagaguuacccacccacuuauaaugucaaagacaugcuaguucccacagccguguggaguggggggcacgacuggcuggcggauguguaugacguuaacauccuacucacccaaauuacaaaucucguauuucaugaaagcauaccugaaugggaacaccuagacuuuaucuggggccuugacgccccuuggaggcuuuacaacaagaucauuaaucuaaugaggaaauaccaguag

SEQ ID NO: 4975 - RNA, 1074 nt, Artificial Sequence
  Description of Artificial Sequence: Synthetic coding sequence
augaaauugcgcacccuugccguuucugccacugucgucaaagacggagugagcgguguguguucuuuucggugcucugacguaucugguguucugccaagcgguccaaagcccguggucuucuuacagcauggauugcuggcagacagcaguaauugggucaccaauuuggcaaauucuucucucggcuucauacuagccgacgcaggcuucgacguauggaugggcaacucgcguggaaauacguggucccgcaaacauaaaacgcucucggucucgcaggacgaguuuugggccuuuucauaugacgaaauggccaaguacgacuugcccgccaguauuaauuucauuuuaaauaagacaggccaggaacaaguauacuauguuggccacucccaggguacaacgauuggauucaucgcguucucucagauuccugaguuggccaagcgcaucaaaauguuuuucgcacucgggcccguagccagcguugcguucugcacaucucccauggcaaagcugggucgacuccccgaucaccugauuaaagaccucuucggagauaaagaguuccucccucaaucagcguuccuaaaauggcugggcacucaugugugcacccauguaaucuugaaggaacucuguggcaaucucugcuuucuguugugcggcuucaacgagaggaaucuuaauaugucuagaguugacguuuacacaacccauagccccgccggcaccucugugcaaaacaugcuccauuggucccaggccgugaaauuccagaaguuccaagcguuugacugggguagcagcgcuaagaacuauuuucauuauaaccaaucuuacccaccaacguacaauguuaaggauaugcuggugccuacagccguuuggucuggcggccaugacugguuagcugacguuuaugacgugaacauucuucugacucagaucaccaaccuuguuuuucacgaguccaucccugaaugggaacauuuagacuucaucuggggucuagacgccccuuggaggcucuacaauaagaucauuaaucucaugagaaaauaccaguag

SEQ ID NO: 4976 - RNA, 1200 nt, Artificial Sequence
  Description of Artificial Sequence: Synthetic coding sequence
augaaaaugcgauuccugggccuggucguuugccugguacuguggacacuucauucugaaggaagcggcggcaaguuaacugcaguggacccagaaaccaacaugaacgucucagaaauuaucaguuauuggggguucccgagcgaagaguaccugguggagacugaagacgguuauauucucugccugaaccggaucccgcacggccguaaaaaccauucagauaaaggcccuaagccaguggucuuccugcagcacggcuuacuggcggacagcagcaacugggugacaaaucuggccaauucaucucuagguuuuauccuggccgaugccggauucgacguguggauggguaauucccgcggaaacacuuggucacguaaacacaaaacucugucugucagccaggacgaauuuugggccuuuagcuaugaugagauggcaaaguacgauuugcccgcuucuaucaacuucauucuuaauaaaacaggacaggaacagguguacuacgucggacauucacaaggcaccacgaucggcuucauugcauuuagccaaaucccugagcuagcaaaaaggaucaaaauguuuuuugcacuggggccaguagcuucgguugcauuuuguacuuccccuauggcgaaguuagguaggcugcccgaccaccugauuaaagaccucuuuggcgauaaggaauuccuuccucagucagcuuuuuuaaaauggcugggcacccacguaugcacucaugugauccucaaggaacugugcgguaaccuuuguuuccugcuauguggguuuaaugaacgcaaccuuaacaugucgcgaguggaugucuacacuacucacagcccugccggcacaaguguucagaacauguugcauuggagccaggccgugaaguuucagaaguuucaggcuuuugacugggggagcuccgcaaagaacuacuuccacuauaaucagucauacccccccacuuacaacgucaaggauaugcuggugccgaccgccgucuggucuggaggccacgauuggcuggcugacgucuacgauguaaauauucuccucacacagauuacaaaucuuguuuuccacgagucuauucccgagugggaacaucuggacuuuaucuggggcuuagaugcuccauggcgacuguauaacaaaaucauuaauuuaaugcgcaaauaucaguag

SEQ ID NO: 4977 - RNA, 1032 nt, Artificial Sequence
  Description of Artificial Sequence: Synthetic coding sequence
auggcuuguuuggaguuugugcccuuugacguccagaugugccucgaguuucugcccagugggccaaagccuguuguguuccuccagcauggccuucucgcagauuccuccaacuggguuacaaaucucgccaauucaucucuuggguucauacucgcagacgcuggauucgauguguggaugggcaacaguagaggcaacacauggucaaggaagcacaagacacuuucagucucccaggacgaauucugggcauuuucuuacgaugagauggccaaguaugaccuccccgccuccaucaauuucauucucaauaaaacaggucaggagcagguuuauuaugugggacacagccagggaacgacuauaggauucaucgcuuuuagccaaauuccugagcuggccaaaagaauuaaaauguuuuucgcccugggaccaguggcaagcgucgccuuuuguacuuccccaauggcgaaacucggaaggcuuccugaccauuugauuaaggaccuguucggagacaaggaguuccugccccagagcgcauuuuugaaaugguugggcacccacgucuguacgcacgugauuuuaaaagaguugugugggaaucugugcuuuuugcucuguggcuuuaacgagcggaaccucaacaugucccggguggaugucuacacuacacauucccccgccggaaccucaguacaaaauauguugcacuggagucaagccgucaaauuucagaaguuccaagccuuugauuggggguccagcgccaagaauuacuuccauuauaaccaauccuaucccccuacauacaauguuaaggauauguuaguuccaaccgcugucuggucaggcggccacgauuggcuggcagacguguaugacgugaacauucuccucacccagauuacgaaccugguuuuucaugaauccaucccagagugggaacaccuugacuucaucuggggacuagaugcaccauggagacuguacaauaaaauuauuaaccugaugcggaaauaucaguag

SEQ ID NO: 4978 - RNA, 1206 nt, Artificial Sequence
  Description of Artificial Sequence: Synthetic coding sequence
auggcgugcuuggaguucguuccuuucgauguucagauguguuuggaauuccugccaucaggagaauuuguggucuuauugacaagcggcgugcaacuucaaacuuuuaccgucucaguaacugauuuaaaagggggcgcuucgggcgugguccggucaagccgcugggugcgcgguuucaccgauuucagaucaaaagcuguggacuuauguggacccaaaccggucguuuuucugcagcaugggcuccuggcagacagcaguaauuggguaaccaaucuagccaacucaucacugggcuucauuuuggccgacgccggguuugauguuuggauggguaacuccagaggaaacacauggucaaggaaacauaaaacccuuucagugagucaggacgaauucugggccuucagaguacccuuucucgacuauuccuaugaugagauggcaaaauacgauuuaccagcaaguauaaauuuuauucugaauaagaccggccaggagcagguguauuauguggggcacagccagggaacaaccaucggauuuauagccuuuucucagauuccggaacuagccaagagaaucaaaauguucuucgcccugggcccugucgccucagucgccuucuguacuuccccaauggccaaguuaggcagacugccagaucacuuaauaaaagaucucuucggcgauaaagaguuccuaccccaaucugcauuucugaaguggcuugggacacacguaugcacccaugugauucuaaaggagcuaugugggaaucugugcuuccuccugugcggcuuuaacgaacguaaucucaauaugucuagggucgacguguacacuacacacagcccagcuggcacuagcguccagaauaugcuccacuggucccaggcaguuaaguuccagaaguuccaagccuuugauuggggguccagcgccaaaaauuacuuccacuauaaucaaucuuacccaccuacauacaaugucaaagacaugcuggugccaacggcggucugguccggcgggcaugacuggcucgcugaugucuaugacguaaauauccuucuuacacagaucaccaacuuaguauuccacgagaguaucccugaaugggaacaccuggauuuuaucuggggccuggacgcucccuggcggcuuuacaauaagauuauuaaucucaugcggaaauaccaguag

SEQ ID NO: 4979 - RNA, 873 nt, Artificial Sequence
  Description of Artificial Sequence: Synthetic coding sequence
augaagaugcguuuccucggccucguggucuguuuagucuuauggacauugcacucagaaggcagcggcgggaaacugacggcaguggauccugagacuaacaugaaugugucggagaucauuucguacuggggguuccccucugaagaguacuugguggagacugaggacggcuacauucugugucucaauaggauuccccauggacgaaagaaccauagugauaaaggaccaaagccaguuguauuccuucagcauggccuucucgcagacuccaguaauugggugaccaaccuggcgaacuccucccuuggguuuauuuuagcagacgccggguuugauguauggaugggcaauucgcgcggaaacaccuggaguaggaagcauaaaacucugucugucagucaggaugaguuuugggcauuuucauaugaugaaauggcuaaauacgaccugccagccagcauaaauuuuauccucaauaaaacagggcaggaacagguguauuaugucgggcacucccaggggaccacuaucggauuuaucgcauucucacaaauuccugaacuggcuaaacgcauaaaaauguuuuuugccuugggacccguagccaguguggcuuucugcaccaguccaauggccaaauuagggcgguugccugaccaucuuauaaaggaucuguucggggauaaagaguucuuaccacaaucagcuuuucugaagugguuggguacacacguuugcacucacguaauuuugaaagaacucuguggaaauuuguguuuucugcucugcggcuucaacgaacgcaaucuuaacaugucuagagucgacguguauacuacacauucuccggcaggcacgucaguuuag

SEQ ID NO: 4980 - RNA, 1200 nt, Artificial Sequence
  Description of Artificial Sequence: Synthetic coding sequence
augaaaaugcguuuucuuggcuugguggucugccugguacuguggacgcuccacucagaagguucagguggaaaacugacugccguagaccccgagacgaauaugaacguguccgaaauuaucucuuauugggguuuuccaagugaagaauaucuuguagaaaccgaagacggguacauucuguguuugaaccgcauaccccacggacggaagaaucacucugacaagggcccaaaaccgguaguguucuugcagcauggucuguuggcugauagcaguaacuggguuacuaaucucgcgaauaguucucucggauucauacucgcagacgccggcuuugacgucuggaugggcaauucacgaggcaacaccuggucccguaaacauaagacuuuaagcgugucacaggacgaguucugggcuuucucauaugacgaaauggcuaaguaugacuugccagcuuccaucaauuucauccucaauaagacuggccaggagcagguguacuauguaggccauucccaagguacuacuaucggguucauugccuuuucccagaucccggagcucgcgaaaagaaucaagauguucuucgcucugggccccguggcgucaguggcauuuuguacuaguccgauggccaagcucgggcggcucccugaucaucugauuaaagaucucuuuggggacaaggaguuucuuccccaguccgcauuuuuaaaauggcucggaacucacgugugcacucaugucaucuugaaggaacucuguggcaaccuguguuuucuguuguguggcuuuaacgaacgaaaucugaauaugucccgagucgauguauacacaacucauucaccagccgguacauccgugcagaauaugcugcacuggucucaagcagugaaguuccagaaauuucaagcuuuugacuggggcucuucagcaaagaauuauuuucacuauaaucaaagcuauccuccaacauacaauguaaaagacaugcuugugccaacagccguguggaguggcggucacgauuggcuggccgacguauacgacguaaacauccugcuuacacaaauuacaaaccuuguuuuccaugagucuauccccgagugggagcaccuggauuuuaucuggggacucgaugccccauggcggcuuuauaacaaaauaauaaauuuaaugcgcaaauaccaguag

SEQ ID NO: 4981 - RNA, 87 nt, Artificial Sequence
  Description of Artificial Sequence: Synthetic coding sequence
cuguguuuuuuacucuguggauucaacgagcgaaacuuaaacauggcugugaaauuccaaaaauuccaggccuuugauuggggguag

SEQ ID NO: 4982 - RNA, 1200 nt, Artificial Sequence
  Description of Artificial Sequence: Synthetic coding sequence
augaaaaugcgcuucuugggccucgugguuugucuggugcucuggacacuacacuccgaagguucuggugggaaacugaccgccgucgauccagaaaccaacaugaaugugagcgaaauuaucagcuacuggggauucccauccgaagaauaucuuguggaaacugaggauggguacauccugugccucaaccguaucccgcacggccggaaaaaucacuccgauaaggggccuaagcccguuguauuccugcagcacgggcugcuagccgauagcuccaauugggucacaaaccucgccaacuccucacugggcuucauucucgccgacgcuggauuugauguguggaugggcaauagccgaggcaacaccuggucacgcaagcacaaaacacucucagugucucaagacgaguuuugggccuucagcuacgacgagauggccaaguaugaccugccugcauccauuaauuuuaucuugaauaagacugggcaggaacagguguauuacgucgggcacucacagggaacaacgaucggauuuaucgcauuuucucagauucccgagcuggcuaaacgcauuaaaauguucuuugcucuuggcccggucgccucuguugccuuuuguaccucuccaauggcuaagcugggucgucugcccgaucaccugaucaaagaccuauucggggauaaggaguuucucccucaaucugcguuccuuaaauggcucggcacucacguuugcacccacgucauucugaaggaacugugcggcaacuuauguuuucuauugugcggauuuaacgagcgcaacuugaauaugagcagagucgacguauacacaacacacucaccugcaggaaccagcgugcagaauaugcuccacuggucccaagcugugaaguuccaaaaauuccaagcuuucgauuggggaagcucugcuaaaaacuacuuccacuauaaucaaucauacccgccaacauacaauguaaaggacaugcucgugccaacggccguguggagcggcgggcacgauuggcuggcagacguauacgauguaaacauacugcucacacagauuacaaaccuggucuuucaugagucuauuccugagugggaacaucucgacuuuaucugggggcuggaugcaccuuggcgccucuacaacaagauaauuaaccucaugagaaaauaucaauag

SEQ ID NO: 4983 - RNA, 411 nt, Artificial Sequence
  Description of Artificial Sequence: Synthetic coding sequence
augaagaugcgcuuccugggacugguuguuuguuuggugcuguggaccuugcacagugagggcaguggagguaagcuuaccgccguggauccagaaaccaacaugaauguuucugaaauuauuuccuauuggggauuuccguccgaggaguauuuagucgagacugaagacgguuacauccugugccugaacagaauaccucauggccgaaagaaccacucggacaagggcccuaagccugucgucuuccuucaacauggacucuuagcugacucaucaaauuggguuacuaaccucgccaacucaucucugggauucauucuugcggacgccggguuugacguguggaugggcaacucucgggggaauacuuggucacgcaagcaugugacucuggagccaggcugcuag

SEQ ID NO: 4984 - RNA, 1428 nt, Artificial Sequence
  Description of Artificial Sequence: Synthetic coding sequence
auggaguccaaggcacugcuagugcugacacuagccgucugguugcagagccuaaccgcaagcagaggaggggucgcagcugcagaccaacgacgggauuuuauugauaucgaauccaaauucgcccuuaggacaccagaagauacagccgaggacacaugucacuugaucccugggguugccgaguccguugccacuugccacuucaaucacaguagcaaaaccuuuauggucauacacggcuggacaguuacuggaauguacgaaaguuggguuccaaagcugguugcggccuuauauaaaagagaaccagauucaaacgucaucgucguugacuggcugucaagagcucaggagcauuaucccguuuccgcaggguacacuaaguuagugggucaggauguggcucgcuucaucaacuggauggaagaagaguuuaauuacccauuagauaacgugcaccuuuugggcuauucccugggugcccacgcugcuggcauugcuggcucccucacaaacaagaaagugaauagaaucaccggccuggacccagcagggccgaacuuugaauaugccgaagcgcccaguagacucucuccggacgaugcggauuucgucgacguccugcauaccuuuacacgaggauccccuggucgaucgauaggcauacagaagccgguuggucacguggacaucuaucccaauggggggacguuccagcccggguguaacauuggagaagccaucagaguuaucgccgagcggggccuuggggacguggaucagcucgugaaaugcagucacgaacguuccauacaccuguuuaucgauagucuacugaacgaagaaaaucccagcaaggccuaccggugcagcaguaaagaagcuuuugaaaaaggcuuaugucugagcugccgaaaaaaucggugcaauaauuugggguacgaaauaaacaaaguucgcgcuaagagaagcuccaagauguaccugaagacuagaucccagaugccuuacaagguauuccauuaccaagugaagauccauuuuuccggaacagaaagcgaaacccacaccaaccaggccuuugagauuagccuguauggcaccguagcugaauccgagaacauccccuuuacgcugcccgaaguaaguacuaauaaaaccuacagcuuucugauuuauacagaaguggauauuggcgaacugcugaugcugaagcugaaguggaagucagacagcuacuuuucguggagcgacugguggucuucccccggauuugcaauacagaaaaucagggugaaagccggagagacacagaaaaaggugaucuucuguagcagagaaaagguaagucaucugcagaaggguaaggcuccagcgguguuugucaagugccaugacaaaucccugaauaaaaaguccggcuag

SEQ ID NO: 4985 - RNA, 348 nt, Artificial Sequence
  Description of Artificial Sequence: Synthetic coding sequence
augguuauccauggcuggacugugacuggcauguacgaaaguuggguuccaaaacugguggccgcccuuuacaaacgcgagccggauucuaaugugauugucgucgauuggcuuucucgcgcacaggagcauuaccccgugucggcaggauauacuaaauugguuggucaggauguggcaagauuuauuaacuggauggaggaggaauucaacuacccccuugauaacgugcaccuguuaggguauagucugggugcccacgccgccgguaucgcuggcucacucacaaauaagaaggucaaucgaaucaccggccuugacccugccgggcccaauuuugaguauuag

SEQ ID NO: 4986 - RNA, 321 nt, Artificial Sequence
  Description of Artificial Sequence: Synthetic coding sequence
auggaaucgaaagcuuuacugguccugacgcuggccgucuggcuucaaaguuuaaccgccuccaggggaggcguugccgccgcagaucagaggcgugauuuuauugacaucgagucuaaauuugcauuacgcacaccagaggauacugccgaagauaccugucacuuaauccccggcguagccgagagcguggccacuugccauuucaaccauaguucaaaaaccuuuauggucauucacggcuggaccgucaccgguauguacgaaucuugggugccuaaacuggucgcugcacuguacaagcgggaaccagauucuuag

SEQ ID NO: 4987 - RNA, 393 nt, Artificial Sequence
  Description of Artificial Sequence: Synthetic coding sequence
auggaaaguaaagcacuacugguccucaccuuagcuguauggcugcagucuuugacagcgagccgcggggggguggcagcugcagaccaacgccgggauuucauugacauagaaagcaaauuugccuuacgcaccccagaagacacagcugaagauacuugccaucucauccccggcguagcugaaagcguggcuaccugucacuuuaaccacaguuccaagaccuucauggugauccacggcuggacugucacaggaauguacgagucaugggugccgaagcugguggcggccuuguauaaacgcgagccugacaguaaugucauagugguggacuggcugagccgagcccaagagcacuaccccgugagugcuggauauacaaaacuguag

SEQ ID NO: 4988 - RNA, 1386 nt, Artificial Sequence
  Description of Artificial Sequence: Synthetic coding sequence
auggaaaguaaggcacuacucguuuugacacuagccgccgcugaucagcgcagagacuuuaucgauaucgaaucuaaauucgcuuugcgcacccccgaagacacugcugaagauacaugccaccuuaucccugggguggcugaauccgucgccacuugccauuucaaccauucaagcaagacuuucauggugauccacggauggacggucacaggcauguacgaauccugggugcccaagcucgucgcugcccuguacaagagagaaccagacuccaaugucauuguugucgacuggcugagcagggcucaggaacauuaucccgugucugcuggauacacaaagcuggucgggcaagacguagccagauuuaucaacuggauggaggaggaauuuaacuacccgcuggacaacguacaucugcuugguuauuccuuaggggcccacgccgccgggauugcagggucucugacgaacaaaaaggucaaucggauuaccgggcucgauccagccgguccaaauuucgaauacgcugaagcgccuucaagacuguccccagaugaugcagauuucguggauguccuacacacguuuacuagaggaucaccaggacgcaguaucggaauccaaaaacccgucggacacguggauaucuaucccaauggaggaacuuuccaaccgggauguaauauuggugaggccaucagggugauugccgaacgugguuugggagacguugaucaacuggugaaguguagccacgaaaggaguauucaucuguuuauugacucacuucugaaugaggagaaccccucaaaagcuuacagguguucaucaaaggaggcauuugagaaaggccuuugucugucgugcaggaagaaucgauguaauaaucucggauacgaaauuaacaagguuagggcgaagcggaguaguaagauguauuuaaagacccguagucagaugcccuacaaggucuuccacuaucaagugaaaauccacuuuucgggcaccgaauccgaaacacacaccaaccaggccuucgagauuucuuuauaugggaccguggccgaaagugagaauauaccuuucacauuacccgaggugucuacaaacaagacguauuccuucuuaauuuacacagaaguugacauaggcgagcugcuaaugcugaagcuaaaguggaagagcgauucguauuucaguuggucagacuggugguccagcccaggauuugcaauccagaaaauucgcgucaaagccggugagacacaaaaaaaaguuauauucuguucuagggaaaaagugagccaucuucagaaagguaaggccccagccgucuuuguuaagugccacgacaagucccuaaauaaaaagucaggcuag

SEQ ID NO: 4989 - RNA, 828 nt, Artificial Sequence
  Description of Artificial Sequence: Synthetic coding sequence
auggugauccacggguggacugucacuggaauguacgaguccugggugccaaaguuaguugcagcgcuuuauaagagagaaccugauagcaacguuauuguggucgacuggcugucccgcgcccaagagcacuacccagugucugcggguuauacuaagcugguagggcaggauguggcacgguuuauaaauuggauggaggaagaguuuaauuauccccucgacaaugugcaucugcucggcuauagcuugggagcgcacgcagcagggaucgcgggaagucuaaccaauaagaaggugaaucgcauuacagggcuugauccugccggcccaaacuuugaauaugcugaagcccccucacggcugagcccugacgacgcagauuuugucgauguccugcacacuuucacacgcggcucuccuggcagaucuaucggcauucaaaaacccgugggccauguagauauuuaucccaauggaggcacauuucaaccuggaugcaacauaggagaggcaauaaggguaauugccgaaaggggccugggcgacguugaucagcuugugaaaugcucacacgagcguagcauccacuuguucaucgacagccuguugaaugaggagaaccccagcaaagccuacaggugcucaaguaaggaggcuuuugaaaaaggucuuugucuuagcugccgaaaaaaccgaugcaacaaucugggcuaugaaaucaauaaaguaagggccaagcgguccucaaaaauguacgaagacucuuuuucggaugcacugcagagccugccguugccaucaaaagacaguuuuuucugggacuag

SEQ ID NO: 4990 - RNA, 540 nt, Artificial Sequence
  Description of Artificial Sequence: Synthetic coding sequence
augggcagaccuggacuuggcgccgcugugagugaccugggcgaggcugugucacugucucaaggccugcuguugcugcugcugcuaagcauggggggggccugggcuucucgcgagccgcuucgaccguggugccaccccauaaacgccauuuuagccguggaaaaagaaggaugucccguaugcaucacggugaacacaaccauuugugcaggcuacuguccuaccaugaugcgcguucugcaggcugugcugccccccuugccucagguagugugcaccuacagggauguaagguucgaguccaucaggcugccuggcugucccagaggaguggacccaguugucucuuuccccguagcccugaguugucguugcggucccugcagaaggucuacgagcgacugugguggcccgaaagaucacccuuugacaugcgaucacccacagcaggcaucaucuagcucaaaagauccucccagaaguuugccauccccguccaggcuccuugagcccgacacgccaauucuuccacaauag

SEQ ID NO: 4991 - RNA, 2253 nt, Artificial Sequence
  Description of Artificial Sequence: Synthetic coding sequence
augcucagagccaagaaccagcuauuccugcugucuccucacuaccugcgucagguuaaagaaucaucugguucacgucuuauccagcaaaggcugcugcaucaacaacaaccccuccauccggaaugggcagcgcuggccaaaaagcaauuaaaagggaaaaacccggaggaucucauuuggcacacccccgagggaauuucuaucaaaccccuguauuccaagcgcgacacaauggaucuuccugaagaacuucccggcgucaaaccguucacacgagggccauaucccacgauguauacauucagaccauggacaauccggcaguacgccggcuuuagcacaguagaggaaagcaacaaguuuuacaaagacaauauuaaagcagggcagcaaggccuuuccgucgccuuugaccuggcuacucaccggggauaugauuccgacaauccucgcguacgcggggacguggggauggccggcguugcaauugauaccgucgaagacacuaagauucuauucgauggaaucccacuugagaagaugagcgucucuaugacuaugaauggcgcugugauccccguguuagccaacuuuauugugacaggagaagagcagggcgugccaaaggagaaacuaaccggaaccauucagaacgacauucuaaaggaguucauggugcgaaacacauacaucuuccccccggagcccucaaugaagauaauugcugacaucuucgaguauaccgccaagcauaugcccaaguucaauucaauuagcaucuccggcuaucauaugcaggaagccggggccgaugcuauucucgagcuugccuacacuuuggccgacggucuggaguacucccggacaggacuacaggcuggguuaacaauugaugaguucgcuccgagauuguccuuuuucugggguaucggcaugaacuuuuauauggaaauugcaaagaugagagcgggacggaggcugugggcccaccuuauugaaaagauguuccagccuaagaacucuaaaucccugcuguugagagcgcauugccagacauccggauggagucuaaccgagcaggaucccuauaacaauaucguucgaacugcgauugaggcuauggcagcaguguucggggggacucaguccuuacauacaaauuccuucgacgaagcccucgguuugccgaccgucaaaagcgcucggauugcccggaacacucagaucaucauccaggaagaguccggaauucccaaaguggcugaccccuggggugguuccuacaugauggagugccugacgaacgauguguaugaugcagcacugaagcugaucaaugagauagaggaaaugggggguauggccaaggcaguugcagaaggcauuccuaaacucagaauugaagagugugcagcacgccggcaagcccgcauugacucagggucagaaguaaucgucggcgugaauaaguaccaacuggaaaaggaagaugcuguagaaguacuggcaaucgauaauacuagcgugcgcaaccggcaaaucgaaaaguuaaaaaagauuaaguccucgagggaccaggccuuggcugaaagauguuuggcugcccucacggagugcgccgcuucaggcgauggcaauauacuggcuuuagcgguugaugcaagcagagcaagguguaccgugggggagauuacugaugcgcugaagaaaguauuuggagaacauaaagcuaaugauagaaugguaaguggugccuauagacaggaauucggcgaaucgaaggaaaucacaucagcgauaaagaggguccacaaauucauggagagagaaggacguaggccgcgccugcugguggcaaaaaugggacaagacggccacgacaggggcgcuaaagucaucgcaaccggguuugcagaccugggauuugacguagacauugguccccuguuucagacacccagagaggucgcucagcaagccguggacgcagauguucacgcgguuggcaucuccacacuggcugccggucacaagacacuagucccugagcucauaaaagaacugaacuccuugggacgaccagauauccuggugauguguggcggugugaucccuccucaggauuacgaauuucuguuugagguuggcgugucaaauguguuugggcccgggaccaggauuccuaaggccgcagugcaggugcuugacgacaucgaaaaaugcuuggagaagaaacagcagucgguguag

SEQ ID NO: 4992 - RNA, 594 nt, Artificial Sequence
  Description of Artificial Sequence: Synthetic coding sequence
accagauaccuggcccgcuguacagugggagagaucacugacgcccucaaaaagguguucggugaacacaaagcuaaugacagaauggugagcggcgccuauagacaggaguuuggcgaaucuaaagaaauaacgucagcuaucaaaaggguucacaaauuuauggagagagaggguaggagaccccgguugcuaguugccaagaugggacaggacggccacgacagaggugccaagguuaucgccacaggauucgcggauuugggauuugacguggacauuggaccccucuuucaaacgccuagagaaguggcccagcaagcaguugacgcggauguccaugcagucgguauuucuacauuggcagccggacauaaaacccugguuccagagcuuauaaaagaacugaacucauuagggcguccggacauauugguuauguguggcggcgucaucccgccgcaggacuacgaguuccuguucgaggucggggucaguaauguguuugguccuggcacccgcauacccaaggcagcagugcagguucuagaugauauagagaaguguuuagaaaagaaacagcaaagcgucuag

SEQ ID NO: 4993 - RNA, 405 nt, Artificial Sequence
  Description of Artificial Sequence: Synthetic coding sequence
auggacccacagacagcuccaucacgagcccuacugcucuuauuguuccuucaucuggccuuucuuggaggacgcucgcauccccuugguaguccaggauccgcaucugaccuugaaacauccggccugcaggagcagaggaaucauuuacaagguaagcugagugagcugcaagucgagcagacgaguuuagagccuuuacaggaaucuccucguccgaccgggguguggaaauccagagagguagcuacagaagggauucggggacaccggaaaaugguacuguacacccugagagccccacgcucaccuaaaaugguccaagguagcgguuguuuuggucgaaagauggaucggaucucaaguucuucaggccuggggugcaaaguguugcgucgccacuag

SEQ ID NO: 4994 - RNA, 726 nt, Artificial Sequence
  Description of Artificial Sequence: Synthetic coding sequence
auguccaugcucuucuacacacuuaucacugcauuccugauugggauucaggccgagccucacuccgaaagcaacguaccugccgggcauacaauaccucaagcacauuggaccaagcuucagcauucccucgauacagcacuucggagagcccggucagccccagcagcugccauagccgcucgcguggcgggccagacgcgcaacauuacgguggacccuagacuguucaagaaaaggcgacuacggaguccaaggguccuuuucucuacucagccacccagggaggcagccgacacucaggaucuggauuucgagguuggcggggcagcaccuuuuaauagaacgcauaggucuaagagaucaucaagccauccuauuuuccauagaggcgaauuuucagugugugauagugucagcguguggguaggugauaagacgacagccacagauauuaagggaaaggagguuaugguucucggugaggucaacauuaacaauucugucuucaaacaauacuuuuucgaaacaaagugcagggaccccaacccaguggacagcgggugccgaggaaucgacucuaaacauuggaacuccuacugcacuacuacacauacauucgucaaagcgcucaccauggacgggaaacaggccgcuuggcgcuucauucgcaucgacacagccuguguuuguguccugagucggaaagccgugcggagagcguag

SEQ ID NO: 4995 - RNA, 1065 nt, Artificial Sequence
  Description of Artificial Sequence: Synthetic coding sequence
auguuguuuaaccuacgcauacuccucaacaacgcagcuuuuagaaacggccacaacuuuauggugcgcaacuuucgguguggccaaccuuugcagaauaaggugcagcugaaagggcgggaucugcugacuuuaaaaaauuucacuggggaggaaaucaaguacaugcucuggcucucugcagauuuaaaguucaggauuaagcagaaaggagaguaccugccacuccuucaggggaagucauuaggcaugaucuuugagaagcggagcacgcgcacucgacugucaacggaaaccggauucgcucugcugggaggccacccuuguuuccucacaacccaagacauucaucucggcgucaaugagucgcucacugauaccgcccggguccuaucaucuauggcugaugcugugcuggcccgcguguacaagcaaagugaucucgacacccucgccaaggaggccucaauuccuaucauaaacggacuuucugaccuauaucauccaauccagauccuggcggacuaccugacucugcaggaacacuacuccucucugaagggauugacauuaagcuggaucggagauggcaacaacaucuuacauagcauuaugaugucugcugcaaaguucggcaugcaucugcaggcugcuacccccaaaggcuaugagcccgacgcaucuguaacaaaacucgcagagcaguaugcaaaggaaaacgguacgaaauugcugcuaaccaaugaccccuuggaagccgcccacggggggaaugugcucaucacagauacauggauuagcaugggacaggaggaggagaagaaaaaaagguuacaggcauuccagggauaccaagugacaaugaagaccgccaaaguagcagcaagcgauuggaccuuccugcacugccucccccguaagcccgaggaaguggacgaugaaguauuuuauaguccacguagucugguguucccugaggcugagaacaggaaauggacuaucauggcugucauggugaguuuacuuaccgauuacucuccucaguugcaaaaacccaaguuuuag

SEQ ID NO: 4996 - RNA, 348 nt, Artificial Sequence
  Description of Artificial Sequence: Synthetic coding sequence
augauccccgccaaagacauggccaaggucaugaucgugaugcuugcaauauguuuucuaaccaaguccgacgggaaguccgugaaaaaaaggucuguuagcgaaauccagcuuaugcacaaucucgggaagcacuugaauagcauggagagaguugaaugguugaggaagaagcuccaggacgugcauaauuuuguagcucucggcgccccucucgccccacgggacgcuggcagccaacgccccagaaaaaaagaggauaacguucuuguggagagucaugaaaagagccucggggaagcagacaaagcugacgucaacgucuuaacaaaagccaagagccaguag

SEQ ID NO: 4997 - RNA, 348 nt, Artificial Sequence
  Description of Artificial Sequence: Synthetic coding sequence
augauucccgcgaaggauauggccaagguaaugaucgugaugcuggcaauuuguuuccucaccaagucugaugggaagaguguaaagaaacggucuguuucugagauucagcugaugcauaaucugggcaaacaccugaauucuauggaacgcguugaauggcuucggaagaaacuccaagauguccacaauuucguugcguuaggcgcacccuuagcuccucgagaugcuggaagccagaggccacggaagaaagaagauaacgugcugguggagucucaugagaaaucacugggcgaagcggauaaggcagauguaaauguguugaccaaagccaagagucaauag

SEQ ID NO: 4998 - RNA, 354 nt, Artificial Sequence
  Description of Artificial Sequence: Synthetic coding sequence
augucaacagccguguuagagaaucccggccuuggacggaaguuauccgacuuuggacaggaaaccaguuauauugaagauaauuguaaucagaacggagcaaucucacucauuuucagucucaaggaggaaguuggcgcacuagcaaagguguugcgcuuauucgaggagaacgaugugaaccucacacauauugaguccaggccuucgcgccucaaaaaagacgaauaugaguuuuuuacgcaccuggauaaacgcagccucccagcccuaacuaauauuaucaaaauccucagacaugacauuggagccacaguccacgaauugucucgagauaagaaaaaagauacuuag

SEQ ID NO: 4999 - RNA, 411 nt, Artificial Sequence
  Description of Artificial Sequence: Synthetic coding sequence
auguccacagccgugcucgaaaacccuggguuagguaggaaauugucugauuucggccaagagacgagcuacaucgaagacaacugcaaucagaacggggcaauuagucugaucuucucucuaaaagaggaggugggggccuuagcgaaaguacugagacuguuugaagaaaacgacguuaauuugacacauauugaaucuagacccuccaggcuuaagaaagacgaguaugaguucuucacacacuuggauaagcgaucucucccagccuugacuaauaucaucaaaauucugagacaugacauaggcgcuaccguccacgagcucucacgggauaaaaagaaggauacugucccuugguuuccucgcacuauacaggagcuagaucguuuugccaaccaaauccucuag

SEQ ID NO: 5000 - RNA, 1359 nt, Artificial Sequence
  Description of Artificial Sequence: Synthetic coding sequence
auguccacugcaguccucgaaaauccaggacuugggcggaagcugucugauuucggacaagagacuuccuauauugaggauaauuguaaccagaacggggccaucagcuugauauucucauuaaaggaagaggucggugccuuggcuaaaguauuacgauuguucgaggagaaugacgugaaccuuacucauauugaauccagacccagccgacugaagaaggaugaguacgaauucuucacacaccucgacaaaaggagccuccccgcccugaccaacaucaucaaaauucuccgccaugacaucggcgcuaccguccaugagcugagucgcgacaagaaaaaggacaccgugcccugguucccgcgcacuauucaagaguuagauagguuugccaaccaaaucuuauccuacggagccgaacuggaugcagaucauccagguuuuaaagauccgguuuauagagccaggagaaagcaauuugcugauaucgcauacaauuauagacacggucagccuauuccacggguggaguacauggaagaagagaaaaagaccugggggacuguguuuaagacucuaaaaagcuuauauaagacucacgcauguuaugaauauaaccauaucuucccacuguuggagaaguacugugguuuucacgaagauaauauuccacagcucgaggaugugucucaauuucuccagaccugcacaggcuuucgccuccgcccaguugccgggcugcucucuuccagggacuuccugggaggacucgcauuuagaguguuucauugcacacaauauauacgccauggaucaaaaccaauguacacuccagagccugacauuugccaugagcugcuugggcacgugccacuguucucugaucggucauucgcacaguuuagccaggagauuggguuggccagucugggagccccugacgaauauaucgagaaacuugcuacaaucuauugguuuacagucgaauucggccucuguaaacagggagacagcauaaaagccuauggagccgggcugcucaguucguucggggagcuacaguauugcuuaucugaaaagccaaagcucuugccccuugagcuugagaaaaccgccauccaaaauuauaccgugacugaguuucaacccuuauauuacguugcugagagcuuuaacgaugccaaggaaaaggugagaaauuuugcagccacaauuccccggccauuuuccgucagguaugacccuuacacucaacggauugaagugcuggacaacacacagcaauugaagauccuggcagauuccaucaauuccgagauaggaauucuaugcucugccuugcagaagaucaaauag

SEQ ID NO: 5001 - RNA, 882 nt, Artificial Sequence
  Description of Artificial Sequence: Synthetic coding sequence
auggacgcuaugaaacguggucucuguugugucuugcugcugugcggggccgucuucgucagcccuucucaggaaauacaugccagguuccgccgcggagcgcggucuuaucagguaaucugccgcgacgagaagacucagaugauuuaccagcagcaucaaucguggcucagacccguccuucggagcaaccgcguagaauauuguuggugcaauagcggccgggcacaaugucauucuguucccgugaaaucauguagcgagccgagaugcuucaacggcggcacaugucagcaggcccucuauuucucggacuuuguuugccaaugucccgagggcuucgccggcaaguguugugagaucgacacgagagcgacaugcuaugaggaccagggaaucucauauagagggacguggucaacugcagaaucaggcgcugaaugcacaaacuggaacuccucagcacucgcccaaaaacccuauucagggaggaggccagacgcuaucagacucggacuggggaaccauaacuauugccguaauccagaucgcgacucaaagcccugguguuacguguucaaggcagggaaguacagcagcgaguuuugcaguacccccgcuugcagugagggaaauagugauuguuacuuugggaaugguucugcauacagggguacccauagccuuacugaauccggagccucaugucuaccuuggaauuccaugauccugauaggaaaaguuuauaccgcucaaaaccccuccgcacaggcacugggcuuaggcaaacacaacuacugucgguguagaacaggucgaagcgucuccucgccggcaaccgcuucaaugcgccccugccugcucuccauuagaucuggcuag

SEQ ID NO: 5002 - RNA, 1551 nt, Artificial Sequence
  Description of Artificial Sequence: Synthetic coding sequence
auggaugccaugaaacgcggucuauguuguguccuucugcucugcggcgcaguuuuuguguccccuucacaggagauucacgcgagguuccgcagaggcgccaggagcuaccagggaugcuccgagccuagguguuucaacggggggaccugccaacaagcccuguacuucuccgauuucguaugucagugccccgaaggcuucgcuggcaaauguugugaaaucgacacucgagcgacuuguuaugaggaccaaggaaucaguuaucgaggaacuuggaguaccgccgaaucaggagcugaaugcacuaacuggaacuccucugcucuggcccagaaaccauauaguggacggcgcccagacgccauucgucuuggacuugggaaccauaauuacugccgcaacccugauagagacaguaaaccaugguguuacguguuuaaagccggaaaguauagcagugaauucugcucuacucccgcuugcagcgaagggaauucagacugcuacuuugggaaugggucagccuacagggggacccacagccugacagaguccggcgccaguuguuugccguggaacagcaugauucuaauuggcaaagucuauaccgcgcagaaccccucugcacaggcucugggccugggaaaacacaauuauugcagaaauccggacggugacgcgaagccuuggugccauguacuuaagaacagacgccugaccugggaauacugcgacguuccuaguuguuccacauguggccugagacaguacucucaaccccaguuucgaaucaaaggagguuuguuugcagacauagccucucaucccuggcaggccgcuaucuuugccaagcaucgaaggagccccggagagcguuucuuguguggagguauucucaucaguuccugcuggauucugucugcugcacacuguuuccaggagagguuucccccgcaccaucugacggugauucuggggagaacauaccgaguaguucccggggaagaagaacaaaaauucgaaguugagaaauacaucguccacaaagaguucgaugacgacaccuacgacaaugacauagcccugcuccagcugaaaagcgauuccucccgaugcgcccaggaguccucugugguccggaccgucugucucccaccggcggaucuccaacuaccagauuggacagagugcgagcucagcggcuaugggaagcacgaagccuuaucuccauucuacucagagagguugaaagaagcccacguuagacucuaccccagcagucgguguacaucccagcaccuccucaaccggaccgugaccgauaacaugcuaugcgcaggagacacuagguccgggggcccccaggccaauuugcacgaugccugccagggggauuccggugguccccuggugugucugaacgacggacguaugacacuaguuggcaucauuagcugggggcuugguugcgggcagaaagauguuccagguguauacaccaaggugaccaacuaccuggacuggauucgagacaacaugcggccauag

SEQ ID NO: 5003 - RNA, 1689 nt, Artificial Sequence
  Description of Artificial Sequence: Synthetic coding sequence
auggaugcuaugaaaagaggacugugcugcguucugcugcuauguggggcagucuucguuucaccuucacaggagauacaugcacgcuucaggaggggagcucgcaguuaccaagucauauguagagacgagaagacucagaugauauaccagcagcaccaauccuggcuaagaccaguccuucggagcaacagaguggaauauuguuggugcaauucuggccgggcccagugucacuccguccccgucaaaucuugcagcgagcccagaugcuuuaauggcgguacaugucaacaggcccuguauuuuuccgauuuuguuugccaaugcccagaaggcuucgcaggcaagugcugugagaucgacacacgugcaacauguuacgaggaccaaggcaucaguuaucguggaacauggagcacagcugaaucuggugccgaauguaccaauuggaacucuagugcucuggcucagaaacccuacagcgggcgcaggccugaugcuauucggcuuggcuuaggaaaucacaauuacugccggaacccugaucgagacucaaagccuuggugcuacguuuucaaggcagguaaguauuccagcgaguuuugcucaacucccgcuugcuccgagggcaacucugauugcuauuucggaaacggguccgcauauaggggcacccacucuuugaccgaguccggcgccagcugccuccccuggaauagcaugauacucauugggaagguauacaccgcccagaacccuagcgcgcaggcccuuggucuggggaaacacaauuauugucgaaauccugacggagacgcaaaacccuggugccacgugcugaagaaccguaggcuuacaugggaauauugugacguuccaaguugcucuacaugcgguuugagacaauauucacagccucaguucagaaucaaaggggggcuauucgcagauaucgcuagccacccauggcaggcugcaaucuuugccaaacaucgcagaucuccuggcgaacgcuuucuuugcgguggcauccugaucucuaguugcuggaucuugagcgcagcccauuguuuccaggaacgguuccccccccaccaucugacugugauccugggacgcaccuauagagucguucccggcgaggaggagcagaaauucgaaguagagaaauacaucgugcauaaggaguucgaugacgacacauaugacaaugauaucgcacugcugcagcuaaagagugauuccagcaggugugcccaagaaaguucaguaguuagaacgguaugucuuccuccagccgaccugcaauuaccagacuggaccgaaugcgaacuuucaggauacgguaaacacgaagcucugucgcccuucuacucagaaaggcugaaagaagcccacguccgccuuuacccuucuaguagaugcacaagccaacaucugcugaaccgcacggugaccgauaauaugcugugcgcaggcgauacaagauccggugggccccaggccaaucugcaugaugcuugccagggagacucaggaggaccucuggugugucugaacgacggacgcaugacacuggugggaaucauuucaugggggcugggguguggacagaaggaugugcccggaguguauacgaagguuacaaacuaucucgauuggaucagagacaauaugcggccuuag

SEQ ID NO: 5004 - RNA, 1311 nt, Artificial Sequence
  Description of Artificial Sequence: Synthetic coding sequence
auggacgcaaugaagcgagguuugugcuguguuuuauuacuaugcggcgccguuuuuguuagcccuagucaagaaauccaugccagauuucgcagaggagcgaggagcuaccaagugauuugucgggacgagaagacccagaugauuuaucagcagcaucaguccuggcucaggcccguccugcgaagcaauagaguggaguacugcuggugcaauucaggacgcgcucagugucacucugugccugugaaacgcaacucugauugcuacuuuggaaacgguagcgcauauagagguacccauagcuuaacugaaagcggcgccagcugcuuacccuggaauagcaugauccugauagguaaaguguacacggcgcagaacccaucagcccaggcccugggcuugggcaaacacaauuacugcaggaacccugacggcgacgcgaaaccauggugccauguucugaagaaucggaggcucaccugggaguauugugauguuccaucaugcuccacaugcggauuacgccaauacucacagccccaguuuagaauuaaaggaggccuguucgcagacaucgcaagccaccccuggcaggcggccauuuuugcaaagcaccgacguagcccuggcgagagauuccucugcggcgguauccucaucucuucaugcuggauccucucagcugcacacuguuuccaagagagguucccgccacaccaccugacaguuauucugggacgaaccuaucgcgucgucccuggggaagaggaacagaaauuugagguugagaaauacaucguucacaaagaauuugacgaugauacauacgacaacgauauugcccugcugcagcugaaguccgauagcucacgaugcgcccaagaauccaguguagucagaaccgucugccucccucccgccgaucugcaauugcccgacuggaccgagugcgaacucaguggcuacggcaaacacgaggccuugagccccuucuauucugaaagacuaaaagaggcucacgugcgcuuguaucccaguuccagauguacuagccagcacuugcugaaccguaccgucacagauaauaugcugugugcuggagauacacgcucaggcgguccucaagccaauuugcaugaugcuugccaaggagauaguggcgggccccuaguaugucuuaacgauggaaggaugacucuaguuggcauuaucagcuggggucucggcuguggccagaaagacgucccagguguguacacaaaggucacgaacuaucuggauuggauucgugauaauaugcggccuuag

SEQ ID NO: 5005 - RNA, 1500 nt, Artificial Sequence
  Description of Artificial Sequence: Synthetic coding sequence
auggacgcaaugaagcguggccucugcugcguucugcuccugugcggcgcuguuuucguuagcccaucgcaggagauccaugcucgcuuucgcagaggcgccagguccuaccaagugauuugucgagaugagaaaacgcagaugaucuaccagcaacaucagaguugguugaggcccguccuacgcagcaauagagucgaauacugcugguguaauucagggagagcccaaugccacucugugccaguaaagucguguucugagccaagguguuuuaacggugguacaugccagcaggcucuguauuuuuccgacuuuguaugccaauguccggaaggguuugccggaaaaugcugcgagaucgacucaaagccaugguguuacguauucaaagcugggaaauauucaagcgaguucugcucuacucccgcuuguucggaggguaacuccgauuguuauuuuggcaauggaagcgcauauagagggacacauucucugaccgagagcggcgcgucuuguuugccguggaauucaaugauccugauuggcaagguguacacagcacaaaacccgagcgcccaggcccucggauuaggcaagcacaacuacuguaggaacccagacggggacgcaaaaccuuggugucacgugcucaaaaaccgcagauugacaugggaguacugcgaugugccaaguuguucaacaugcggacugaggcaguacucacagccgcaguuuagaaucaaaggcggacuauuugcagauauugccucccauccuuggcaggcggcaaucuucgcuaagcaucgacgcagcccuggugagcgguuucugugugguggcauucuaaucagcucuuguuggauacucucugcagcccauuguuuccaggaacguuuucccccccaucaucugacggucauucugggaagaacguaucgggucguccccggcgaagaagagcaaaaguucgagguggaaaaauacauuguucacaaggaguucgaugacgacacuuaugacaacgauaucgcucuucuucaguuaaaaagugacucuaguagaugcgcucaggagagcagcguugucagaaccguuugccugcccccagccgaccuacaacuacccgauuggaccgagugcgaacuuucaggguauggcaagcaugaggcucugaguccauuuuacucugagagguugaaagaagcccauguuagacucuaucccaguucacgguguacuucacagcaucugcuuaauaggacagugacagacaauaugcucugugccggagacacccggucagguggaccccaagccaacuugcacgaugccugucagggagauucuggcggaccccucgugugccugaaugaugguaggaugacccuggucgguauuaucuccuggggccucggaugcggccaaaaagacgugccaggugucuauacaaaaguaacaaauuaucuggauuggauccgggauaauaugcgcccuuag

SEQ ID NO: 5006 - RNA, 537 nt, Artificial Sequence
  Description of Artificial Sequence: Synthetic coding sequence
auggacgcgaugaagagaggacuuuguuguguccuccucuuguguggcgcuguuuuuguuaguccaagccaggaaauacaugccagguuucgccgcggugcccgaucauaucaaguaauuugccgggacgaaaaaacucagaugauauaucagcaacaucaguccuggcugcgcccagucuuacgauccaaucgcguagaguacugcugguguaauaguggccgugcccagugucacuccgugccugugaaauccuguuccgaaccaagauguuucaacggcgguaccugccaacaggcucuuuauuuuagcgacuuugucugccaguguccagaaggauuugcuggcaagugcugcgaaaucgacacucgcgcuaccuguuaugaggaccaaggaauuaguuaucgaggaaccuggucaacagcugagagcggcgccgaauguacaaauuggaauagcagcgcucuugcccagaaaccuuacaguggccgccggccagaugccauccgguuaggauuagggaaccacaacuacuag

SEQ ID NO: 5007 - RNA, 474 nt, Artificial Sequence
  Description of Artificial Sequence: Synthetic coding sequence
auggaugcaaugaagcgaggguuguguugcguuuuacuccucuguggagcagucuuugucagcccaagccaggagauccacgcuagguuccgaagaggcgcaaggucuuaucaggugauuugcagagacgagaagacacagaugaucuaccaacaacaucaaucuugguuacgaccugugcuccgcagcaaucggguggaguauugcugguguaauucugggagggcacagugccauucugugccuguaaagucaugcagcgagccuagauguuuuaacggagggacuugccaacaggcccuguacuuuucagacuuugugugccaguguccagaaggcuuugcagguaaauguugcgagauugauacucgagcuaccuguuacgaggaucaaggcaucucauaccgugguacgugguccaccgcagaaucaggggcagaguguacaaauuggaacucaucagcacuugcuuag

SEQ ID NO: 5008 - RNA, 1422 nt, Artificial Sequence
  Description of Artificial Sequence: Synthetic coding sequence
auggaugccaugaaacguggacuguguuguguucuguugcucuguggggcaguuuucgugagccccucccaagagauacaugccagauuuaggagaggagcaaggagcuaucaggugaucugccgcgaugagaagacucagaugauuuaccagcagcaucaguccuggcuuagacccgugcugcgcucaaaccgaguggaauacuguugguguaacucuggacgggcucagugucacucugugccagugaagucuuguagcgagccacgcugcuucaaugguggaacuugccagcaggcacuuuacuuuucggauuuugugugucagugcccagagggguucgcugguaaaugcugugagauuggaaauucagacuguuacuucgguaacggaucagcauacaggggcacucacagucugacagagagcggggcuaguugucugcccuggaauucgaugauccugauagggaaaguauauacagcacagaaccccagcgcgcaggcccucggguuagguaaacauaauuacuguaggaacccagauggagaugccaaaccauggugucacgugcuaaagaacagacgacucaccugggaauauugcgauguccccagcugcuccacgugcggguuacgucaguauucucagccucaguucagaaucaagggaggccuuuuugcggauaucgccucacacccauggcaagcagcuaucuucgcaaaacacagacgcaguccaggagaacgcuuucuuugcggagguauucuaaucucuucuuguuggauucuuucagccgcgcauuguuuucaagaaagauuuccgccacaccaccuuacugugauuuuagggcggacauaccgcgucgugcccggcgaagaggaacagaaguucgagguugagaaauauauuguccauaaggaauucgaugacgauacauaugacaaugauauugcacuccugcagcuuaaaucagacucaucgagaugcgcucaagaauccuccguggucaggacggugugccucccacccgcagaccugcaauuacccgauuggacagagugcgaauuaagcggcuaugguaaacacgaggcauuguccccauuuuacucagaacggcuaaaggaggcccauguaaggcuguaucccaguucgcgaugcacuucucagcacuuguuaaaucguacagugaccgacaacaugcucugugcuggugacacaagguccggaggaccucaagcuaaccugcaugaugccugucaaggggauucuggcgguccauuggugugcuugaaugacgggaggaugacauuggucgguauuauuucuugggggcuuggaugcgggcagaaggaugugcccggcguauauacaaaggugacaaauuaucucgauuggaucagagauaacaugcguccuuag

SEQ ID NO: 5009 - RNA, 1488 nt, Artificial Sequence
  Description of Artificial Sequence: Synthetic coding sequence
auguggcagcugacuucgcugcugcuguuugucgcuacauggggaaucucaggaacacccgcaccauuagacucugucuuuuccuccucagaacgcgcccaucaggucuugcguauuagaaagcgggccaauagcuuuuuggaggagcuccggcauaguucucuugaaagagaguguaucgaggagaucugcgauuuugaggaagcuaaggagauauuccagaaugucgaugauacacuggccuucuggagcaagcacguugacggagaccagugucuaguccugcccuuggaacaccccugcgcaucucuguguuguggccaugguacguguauugacggcauagguucguucaguugugauugccggucagguugggaaggaagauucugccagcguggagagggggagagauggaugcucgcugggggaggcgcaggacucgguccgggauggggaagaggaacaucuacuucaugcccaagacccccgcugccagcagaaguaagcuuucucaacugcuccuuggacaacggcgggugcacgcauuauugccuggaggaaguuggguggcgccgcuguucuugugcucccggguacaagcugggggacgaucuccuucagugucacccagcuguuaaauuuccguguggcagaccguggaaaaggauggagaagaaaagaagucauuuaaagagggacacggaggaucaggaagaccagguagaccccagacucauugaugguaaaaugaccagaagaggagacucuccguggcaggugguccuacucgacuccaagaaaaagcuggcuugcggggccgugcugauccacccauccuggguucugacggcugcucauuguauggaugaaaguaagaagcuguuggugcgcuuaggggaguacgaucugcgucgcugggaaaagugggagcucgaccuggacauaaaggagguguuuguucaucccaauuauaguaagagcaccacagauaaugauauagcccugcugcaucuagcacagcccgccacccucagucagacuauagugccuauuugucuaccagauucagggcucgccgagcgagagcugaaucaggccggccaggaaacccucgucacagguuggggauaucauuccucgcgcgaaaaggaagcuaaaagaaaucgcaccuucguccucaacuuuauaaagauaccugugguuccccacaacgaaugcucugaagucaugucaaauauggucagugagaacaugcugugugcaggcauauugggcgauaggcaagacgcaugcgagggagacaguggaggcccaaugguggccagcuuucacggaacaugguuccugguggggcugguaagcuggggggaagguuguggucuguuacauaauuacggcguguauacaaaggugucuagauaucuggauuggauucacggccauauccgcgacaaggaggcaccucaaaagaguugggcaccuuag

SEQ ID NO: 5010 - RNA, 1386 nt, Artificial Sequence
  Description of Artificial Sequence: Synthetic coding sequence
auguggcaacuuaccucgcugcugcuuuucgucgccacauggggcauaucagggaccccagcuccgcuggauucugucuucucuuccagcgagcgggcccaccagguguuaagaauucgcaaacgugcgaacaguuucuuagaagagcugcgucauucuucucuagagcgagagugcaucgaggagauuugugauuuugaagaagccaaggaaauuuuccagaauguugaugacacacuggcauuuuggucaaagcauguagauggggaucagugcuuaguguuaccccuugaacauccuugugcaucccuuuguugcggccacggcaccugcauugauggcaucggaucuuuuaguugcgacugccgcucagggugggaggggagguuuugucagcgagagguuucauuccugaauugcucccuggacaacggcggauguacucauuacugccuggaagaagugggcuggagacguugcagcugcgccccgggcuacaagcucggggaugaucugcuucagugucacccugccguuaaauucccuugcgguaggccauggaagcgcauggaaaaaaaacgcucgcaucugaaacgggauacagaagaucaggaggaccaagucgacccuaggcugauagaugggaaaaugacaagaagaggagauagcccguggcagguuguacuucuagacagcaaaaagaagcucgccuguggggcagugcucauacacccuuccuggguccugacggccgcccacuguauggaugaauccaaaaagcuucugguaagauugggugaguaugaccuacgccgaugggaaaagugggaauuagaccucgacaucaaggaaguuuuugugcacccuaauuauucaaagucuacuacggacaacgacauugcccuccugcaccuagcucaacccgcaacuuugucacagacuauagucccaauuugccuucccgacucaggccucgcagaaagggaacuaaaccaggccgggcaggagacccuggucacuggguggggauaccacaguucacgcgagaaggaggcuaaacggaaccgcacuuuugugcugaauuuuauuaaaauacccgucguuccucacaacgaaugcagugaagugauguccaacaugguuucugaaaauaugcugugcgcuggaauauugggcgacagacaggacgcaugcgaaggagauagcggcggcccaaugguagccucuuuucacgguacgugguucuuggucggucucgugucauggggggaaggcugugggcuccugcacaauuauggaguauacacgaagguaucacgcuaucucgauuggauccauggccauauucgggacaaagaagcaccgcagaagagcugggccccauag

SEQ ID NO: 5011 - RNA, 351 nt, Artificial Sequence
  Description of Artificial Sequence: Synthetic coding sequence
auguggcagcucacaaguuugcuccuguuugucgccacuuggggaauuuccgguaccccugcaccccucgauucaguuuuuucuaguagcgagagagcucaccagguucugcgcauucgcaaacgugccaauagcuuucuagaggaacuccgccacucuucauuagaacgggaaugcaucgaggagauuugcgacuuugaggaggcaaaagaaaucuuucagaaugucgacgacacccuggccuuuuggagcaagcacguggauggggaccaaugucuugugcuuccccucgaacacccuugcgccucuuugugcuguggacaugggacuuguauugacggaauuggauag

SEQ ID NO: 5012 - RNA, 381 nt, Artificial Sequence
  Description of Artificial Sequence: Synthetic coding sequence
auguggcaauuaaccucuuuacuguuauucguggcaacuugggguauuucagggaccccugcucccuuggacagcgucuuuaguagcagcgagcgagcucaccaaguccuaaggauacgcaaacgagcuaauucuuuucucgaggagcuucgacacucuucucuggagcgcgaaugcauagaggagauaugugacuuugaagaagccaaggagaucuuccagaacguggaugacacuuuggccuuuuggucuaagcacguagauggugaucaaugccuaguucugccucuugaacauccuugugccagccuuuguuguggccacggaaccugcaucgauggaauugggaguuuuaguugugauugucguucagggugguag

SEQ ID NO: 5013 - RNA, 1551 nt, Artificial Sequence
  Description of Artificial Sequence: Synthetic coding sequence
auggcggccggucgacgcacuuguucaauuagcaccacaagacccugugcgagcgcuucacguauguggcagcugaccagccuguuacuguuuguggccaccuggggcaucucugguacgccagccccucucgacucagucuucucuagcucagagagggcacaccaaguguuacggauucggaaaagggcgaauucauucuuagaggagcugcgacauucuucgcuugaaagagaguguaucgaagaaaucugcgacuuugaggaggcuaaagagaucuuccagaacgucgacgacacccuggcuuuuuggucgaagcacguggacggggaucaaugccuaguccucccccuggagcacccuugugcaucucugugcugcgggcacggcacuugcaucgacggaaucgguucuuucuccugugacugcaggagcggcugggaaggcagauucugccagagaggcgagggggagcgauggaugcuggcuggaggcggagcuggacucggccccggguggggcaggggaaccagcacguccuguccucggccuccucugccugcugagguaucuuuuuugaacuguagcuuggacaacgggggguguacacacuacugucucgaggaaguggguuggcggcguuguagcugcgccccgggauacaagcucggagaugaccuguugcagugccaccccgcugucaaguuucccugugguaggccauggaaaaggauggagaaaaaaagaucccacuugaaaagagacacugaggaucaggaggaccaaguugacccaaggcugauugacggaaaaaugacaagacgaggugauuccccauggcagguaguacuccuggauucgaaaaagaaacuggccugcggagcaguguugauccacccuucaugggucuugacugccgcccauuguauggaugagucaaaaaaauuacucgugcggcuuggcgaauacgaccugcgucgcugggagaaaugggagcucgaucuggauauaaaggaggucuuugugcauccaaauuacucaaaaaguacuacugacaaugauauugcccuucuccacuuggcgcaaccugcuacucucagucagacgauagugccaauauguuugcccgacuccgggcuugcugaaagagaguuaaaccaagccggacaagaaacccuaguaaccggauggggauaucauucuucucgcgaaaaagaagcaaaacgcaaccguacauuuguguugaacuuuauuaaaaucccuguuguaccccauaaugaaugcucagaagucaugagcaacaugguuucugaaaacaugcucugugccggcauucugggcgacagacaggacgcaugcgaaggugauuccggcggccccaugguggccuccuuccacgguaccugguuucucgugggucucguguccuggggggagggaugcggacugcugcacaauuauggaguuuacacaaaggugagcagguaccuugauuggauccacgggcacauucgggacaaagaagcaccacagaaaucaugggcgccuuag

SEQ ID NO: 5014 - RNA, 1263 nt, Artificial Sequence
  Description of Artificial Sequence: Synthetic coding sequence
auguggaugacucauuggccaaguggaccgucaacauccacaguuacuuccgccugguccuguccguggagcacccgagcacccgcuugcgcugcugggaccgcgcgggcuuccacugcauccgcugcaucugccgccacagcggccgccgccgggagggccgcaucugcuucugccgugagaggacggggcggcugcuggagggggggggcuggcuuaggcccagguugggggcgcgguaccucaacuucaugcccucggccuccccugcccgcugaaguuucauucuuaaauugcucccuugacaauggugguugcacccauuacugucuugaggaaguuggcuggcguagaugcagcugugcccccggauacaaacugggcgacgaccucuuacagugucaccccgcgguaaaguuuccauguggccggcccuggaaaagaauggagaaaaaacgaucccaucugaagcgcgauacugaggaucaggaggaucagguggauccacgcuugaucgacgggaaaaugacccgcaggggagauaguccauggcaggugguguuacuggacucuaaaaagaagcuggcuugcggggcaguauugauacaccccucauggguguuaaccgcagcgcacuguauggaugaauccaagaaauuauuagucaggcugggcgaauaugaccuccgacgcugggaaaaaugggaacuagaccucgauauaaaggaaguguucgugcacccaaacuauucgaaaucuacaacggauaaugauauugcacugcugcacuuagcucagccugcuacucucagccagacaauuguaccaauaugucuucccgauaguggucuggccgaaagagaacugaaucaagcuggacaggaaacucugguuacugggugggguuaucacagcucccgugagaaggaagccaagcgcaaucggaccuuugugcugaauuuuauuaaaauccccgucgugccccauaaugaauguagcgagguaaugucaaauaugguuagugagaacaugcucugugcuggaauccucggcgaucggcaggaugccugugagggcgacucuggugggcccaugguggccucguuucacgguacuugguuccuugugggccuuguuaguuggggugaagggugcggacuccugcauaauuacggcgucuauaccaaggucucccgauaccucgacuggauccauggucauauucgcgacaaggaggccccucagaagucaugggccccguag

SEQ ID NO: 5015 - RNA, 1047 nt, Artificial Sequence
  Description of Artificial Sequence: Synthetic coding sequence
augaacgguaccgagggucccaacuuuuaugucccuuuuuccaaugcaacaggaguugugcgcuccccauucgaguauccucaguauuaucucgccgagccuuggcaguuuucuauguuggcagccuacauguuccuucucaucguucugggauuuccgaucaauuucuugacuuuguauguuacagugcagcauaagaagcucagaacaccgcuaaauuauauccuguugaaccuggccguagccgaccuguuuaugguucugggaggcuuuaccucaacccuguauacuagccugcauggcuacuuugucuuuggaccaacuggcugcaaucucgaaggcuucuucgcuacccucggaggggagauugcccuguggagccuggucgucuuggccaucgagcgcuacguuguugugugcaagccaaugucaaacuuucguuucggcgagaaucacgcaauuaugggaguggccuuuacguggguuauggcccuugcuugugcagcaccgccccuggcagguuggagcagauauaucccagaaggacuucagugcaguuguggcaucgacuacuacacgcugaagcccgaggucaauaacgagucguuuguuauuuacauguucgugguucauuucacaauccccaugauuauuauauucuuuuguuacggacagcucguguucaccgucaaagaagcugccgcccagcagcaggaaucagccaccacucagaaggccgaaaaggaagugacccgcaugguuauaauaaugguaauugccuuucugaucuguugggugccauacgcgucuguugccuuuuacaucuuuacacaccagggaucuaacuucggaccuauauuuaugaccauucccgcguucuuugccaaguccgccgccaucuauaacccaguaaucuacaucaugaugaauaaacaguuuagaaacugcaugcuuaccacuaucuguugcggcaagaauccccugggagaugacgaggcuuccgcuacuguuucuaagacugagacuucucagguagcuccagcuuag

SEQ ID NO: 5016 - RNA, 1257 nt, Artificial Sequence
  Description of Artificial Sequence: Synthetic coding sequence
augccaucuuccgucucguggggcauucuucuucuggccgggcucuguugucuggucccagugagucuugcagaggacccccaaggugacgccgcucaaaaaacugacaccucgcaccacgaccaagaccauccaacauucaacaagaucacccccaaucucgcagaguuugcauucucacuuuacagacagcuagcccaccaaucaaacucuacuaacaucuucuucuccccagucucgauagcaaccgccuucgccaugcuuucuuuagggacuaaggcagauacucaugacgagauccuggagggacugaacuuuaaucugaccgaaaucccugaggcccagauccaugaaggcuuccaggagcuauuacggacccuuaaccagccagauucacagcuccagcugaccacagguaacggacuguuccuauccgaaggucugaagcuagucgauaaguuccucgaagaugugaagaaacuuuaucacagugaagccuuuacugucaacuuuggcgacacugaagaggcuaaaaagcagauaaacgacuauguggaaaagggaacucagggcaaaauuguggaucuggucaaggaacucgauagggauaccguguuugcucuaguuaacuacauuuuuuucaaaggaaaaugggagcgcccguucgaggugaaggauacagaagaagaggauuuucacguggaccaggucacaaccguaaagguuccaaugaugaagcgccuggggauguuuaacauacagcauuguaagaaacucucuuccuggguccuucugaugaaguaucuuggcaacgcgacagccaucuucuuccuacccgacgaaggaaaguugcagcaccucgaaaacgagcugacucacgauaucaucaccaaauuucuggagaaugaggaccgccguagcgccucucugcaccugcccaaacucucuaucacaggcaccuaugaucuuaaauccguucugggccagcugggcauuaccaagguuuuuuccaacggggcggaucuaagcggagugacugaggaagcuccccugaaacucagcaaggcuguccacaaagcaguucugaccauagacgaaaaaggcacagaggccgcuggugccauguuucuugaggcuauuccaauguccauuccacccgaagugaaguucaacaaaccuuucgucuuucucaugaucgaacagaauacaaagucuccccucuucaugggcaaaguggucaauccuacccaaaaauag

SEQ ID NO: 5017 - RNA, 1257 nt, Artificial Sequence
  Description of Artificial Sequence: Synthetic coding sequence
augccaagcuccguguccugggguauccugcugcuggcaggucuuugcugucuugucccagugucccuggcugaagauccccagggcgaugccgcacagaagaccgacacaucucaucacgaccaagaucacccuacuuucaauaaaaucaccccuaauuuagcggaguuugcguucucacucuacaggcagcuugcccaccagucaaacuccacaaacauauucuucucaccugucucaaucgccacugccuuugcuaugcugagucuggguaccaaggcugauacucacgaugaaauccucgagggucuaaauuuuaacuuaaccgagauuccagaggcucaaauacacgaggguuuucaagaauugcucaggacccucaaucagccggauagucaguuacaacucacaaccgguaacggacuuuuccugucugagggucuuaagcuggucgauaaauuccuugaggauguaaagaagcuguaccacagugaggccuuuaccgucaauuucggagacacugaagaagcaaaaaagcaaauuaacgacuacguggagaaagggacucaaggaaagaucgucgaucuagugaaggaauuggacagagauacuguuuuugcacuggugaauuacaucuucuuuaaaggaaagugggaacguccauuugagguuaaagacaccgaggaggaggauuuucacgucgaucaggugacuacugugaagguuccaaugaugaagagacucggcauguuuaacauacaacacuguaaaaagcuuucuucauggguccugcucaugaaauacuugggaaaugcaacagccauuuuuuuccugccugacgagggcaagcuccaacaucuugagaaugagcuaacccaugacauuauaacgaaauuucuggagaacgaagaucgcagaagugccucccugcaccugccaaaacucaguauaaccgguaccuacgaucugaagucuguccugggccagcuuggaauuacgaaggucuucaguaauggcgcggaucugucuggagugaccgaggaagccccguugaagcucuccaaggccgugcacaaggcgguucuuacuauugaugaaaaagguacggaagccgcaggcgcaauguuccuggaggcaaucccaauguccauaccuccggaagugaaguucaacaagccuuucgucuuccugaugaucgaacagaacaccaaauccccucuauucaugggaaaagucgugaauccuacacagaaauag

SEQ ID NO: 5018 - RNA, 1257 nt, Artificial Sequence
  Description of Artificial Sequence: Synthetic coding sequence
augccuaguaguguuaguugggggauucucuuauuggccggucucugcugucuuguuccagugucauuggcagaggacccucagggcgaugcagcacaaaagacugauacuucucaccacgaucaagaccacccuacguuuaacaagaucacacccaaucuugcugaauuugcauucagccucuacagacagcucgcucaucagaguaacucuacuaacaucuucuucagcccugucucuauagccaccgccuucgccauguuaucacucgggacaaaagcagacacacaugacgagauucucgaaggcuuaaacuuuaauuuaaccgagauccccgaagcccaaauucacgaggguuuucaagagcuacugcggacccugaaccagccagacagccaguugcagcucaccaccggcaauggccuuuuucugucugagggucugaaacugguagacaaauuccucgaggauguaaagaaauuguaucacucagaagcguuuacugugaacuuuggugauacagaagaggcaaaaaagcagauaaaugacuaugucgaaaagggcacccagggaaagauuguggaccuggugaaggaacuugacagagauacaguauucgcucuugucaacuauaucuucuuuaaaggcaagugggagaggccauucgaggugaaggauaccgaagaggaagauuuccacgucgaucaagucaccacagugaaggugccuaugaugaagaggcuuggaauguucaauauccagcacuguaagaaacucagcaguuggguucuccugaugaaguaccuagggaacgccacagcuauauuuuuccugccagacgaggggaagcuccagcaccucgagaaugagcugacucacgacaucaucacaaaguuccuggaaaaugaagauaggcgaucugccagucuucaccucccaaaacugucuauuacuggcacauacgaccugaaguccgucuugggucagcuggggauaaccaagguguucagcaauggcgcagaucugucuggggucacagaggaagccccccuuaaacucuccaaagcugugcauaaggcaguccuaacaaucgaugaaaagggcacugaggccgccggagcuauguuccuagaggcuauaccuaugucgaucccuccggaaguuaaguucaauaaaccguucguauuccucaugauagagcagaacaccaaaucaccccuguucaugggaaaaguggucaacccuacacagaaauag

SEQ ID NO: 5019 - RNA, 1080 nt, Artificial Sequence
  Description of Artificial Sequence: Synthetic coding sequence
augcccuccagcguuuccugggggauccugcuccuggccggccugugcugucucgugcccgugucgcucgccgaggauccccagggggacgccgcccagaaaacagauaccucccaucacgaucaagaucauccuaccuuuaauaagauuacuccuaaucuagcggaguuugccuuuucccuauacaggcagcuugcgcaccaaucaaauuccacaaauauuuuuuuuucuccgguaucgaucgccaccgcuuucgccaugcugagccuuggcacuaaagcugauacacaugacgagauuuuagaaggucugaacuuuaacuugacagagauaccugaggcgcagauucacgaagguuuccaggaauugcugcgcacgcugaaccaacccgauucgcaacuccaguuaaccacuggcaacggccuuuuccuguccgagggccugaaacugguugauaaauucuuagaagaugugaagaagcucuaucacagcgaggcauuuaccgugaacuuuggugacacagaagaagcaaagaagcagauuaaugauuaugucgagaaggggacacagggcaagauuguggaccuggugaaagagcuggaucgagauaccguuuucgcccuggugaacuauauauuuuuuaaaggaaagugggaaagaccauucgaagugaaggacaccgaagaagaagacuuucacguggaccagguaacuacaguuaaagugccuaugaugaaacggcugggaauguuuaauauccagcacugcaaaaaauuaaguagcuggguguugcugaugaaauaucuagggaacgcgacagcuaucuucuuccucccggaugaagggaagcuccagcacuuggagaacgaauugacgcacgauaucauuacuaaauuccuggagaaugaagaccgccgcuccgccucauugcaucugccaaaacucucaaucacgggaacuuaugaccugaaaagcgugcugggucaguuaggcaucacaaagguguuuucaaacggagccgacuuaagcggcgugaccgaggaggccccccugaaacugagcaagguuagaagcccauag

SEQ ID NO: 5020 - RNA, 1257 nt, Artificial Sequence
  Description of Artificial Sequence: Synthetic coding sequence
augccuucuuccguuucauggggaauucugcuacuggccggauuguguugucuggugccagugaguuuagcagaggauccccagggggaugccgcccaaaagacagauacuagccaccaugaucaagaccauccaacauuuaacaagauaaccccgaaccuagccgaauuugcuuucucccuguacagacaguuggcccaucaauccaacucuaccaauauauucuucucaccaguuuccaucgcuacagccuuugcgaugcugucuuuggggaccaaagccgacacacacgacgaaauucuggaagggcucaauuucaauuuaacagaaaucccagaagcccagauccacgagggauuccaggaacugcugaggacucucaaccagccugauagucagcugcagcucaccaccggcaacggucuuuuucuuagcgaaggccuuaaguugguggacaaauuccuggaagaugucaaaaaacucuaucacucugaggcguucacaguuaacuuuggcgacaccgaagaggccaaaaagcagauuaaugacuacguggaaaagggaacccagggaaaaaucguggaccucgugaaggaguuagacagagacacaguuuuugccuuggugaacuacaucuuuuucaagggaaaaugggaacgacccuucgaaguaaaggacacagaggaagaagauuuucauguggaccagguuacaaccguuaaggugccuaugaugaaaagacugggaauguucaacauacagcacugcaagaaauugagcagcuggguacugcuaaugaaguauuuggggaaugcaacagccauuuucuuucugcccgacgaggguaaacugcagcaccuugagaacgaacugacacaugacauuauuaccaaauuucuugaaaacgaagacagaagaagugcgucacugcaucugccaaaguuguccaucaccgguacauacgauuuaaaauccgugcucggccaguuaggcaucaccaagguguuuagcaauggcgcagaucuauccgguguaacugaagaggccccacugaagcugucaaaggccguucacaaagcaguacugaccaucgaugagaagggcacagaggccgccggcgcuauguuucuggaggcuauucccaugucaaucccccccgaagugaaguucaauaagcccuuugucuucuuaaugauugaacagaauacuaagucaccccuguucauggggaaagucgugaauccgacccaaaaguag

SEQ ID NO: 5021 - RNA, 1257 nt, Artificial Sequence
  Description of Artificial Sequence: Synthetic coding sequence
augcccagcucagucucauggggaauuuugcugcuggccggccugugcugcuuggugcccgucagccuugcagaggacccccagggagaugccgcacagaaaaccgauaccucucaccacgaucaggaccauccaaccuucaacaaaauuaccccaaaccucgcagaauuugccuuuucccucuauaggcagcuugcccaccaguccaacaguacuaacaucuuuuuuagcccgguauccaucgccaccgccuuugccaugcuaagccucgggacaaaagccgacacacacgacgaaauccuggaagggcugaauuuuaaucugacugagauaccugaggcgcagauucacgaggguuuccaagaacuauuaaggacgcugaaccagccggacucucaacugcagcugacuacuggcaauggucuuuuucucagugagggucucaagcuggucgauaaguuccuagaggaugugaaaaaacucuaccauucugaagcauuuaccgugaacuuuggugacacagaagaggccaaaaagcaaauuaacgacuauguugaaaagggcacucaggggaagauaguggauuuagugaaagaguuagacagggauaccguguuugcucucgucaauuauauauuuuuuaaaggcaaaugggagcgcccauucgaggucaaggacaccgaggaagaggacuuccacguugaccagguaaccacuguuaaggucccuaugaugaagcgacuggggauguucaacauacagcacugcaagaaguugaguucuuggguucucuugaugaaguaucuggggaaugccaccgcaaucuuuuuucuuccugacgaaggcaagcugcagcaccuggaaaacgagcugacccacgauauaauuacgaaguuccuggagaaugaagacagacgaagugccagucugcaccuuccaaagcugucaaucacaggcacguaugaccucaagucagugcucggccaguugggcaucacaaagguuuucuccaauggcgcugaucuuaguggggucacugaagaagcaccccucaagcugucgaaagcagugcacaaagcuguucugacaaucgaugaaaaggguacugaggccgcuggugccauguuucuggaagcgaucccuaugaguauuccucccgaggugaaguucaacaaacccuucguguuuuuaaugauugaacagaacacuaaaagcccuuuguucaugggaaaagugguuaauccaacacagaaauag

SEQ ID NO: 5022 - RNA, 1257 nt, Artificial Sequence
  Description of Artificial Sequence: Synthetic coding sequence
augccaucuucaguauccuggggcaucuuguuguuagccggcuuguguugccugguucccgugucccuggcagaggauccccaaggugacgcagcgcaaaaaacggauacaagucaccacgaucaggaccauccuacauucaacaagauuacuccuaacuuggcagaguucgccuucucucuguacagacagcuugcacaucagucgaauucuacuaacauuuuuuucagucccgugaguaucgccaccgccuuugcuaugcuuucucuggguacuaaagcugacacccacgacgaaauucuggaggggcugaacuuuaaccugaccgaaauuccugaagcacagauccacgaaggcuuucaagagcugcugcggacucucaaccagccugacagccaacugcaguugacuaccggaaacggccuguuccuaagcgaaggccugaaguuggucgauaaguuuuuggaagauguuaagaaguuauaccauucggaagcauuuacuguaaacuucggcgacacagaagaggccaagaaacagaucaaugauuacgucgaaaaagggacgcaaggaaagaucgucgaccuuguuaaagaacuggaccgagacacagucuucgcacuugugaauuacauauucuuuaaaggcaaaugggagcgaccuuucgagguaaaagacacagaagaggaagacuuucacguugaucaggugaccacagugaaggugcccaugaugaaaaggcuagguauguuuaauauucagcacuguaagaagcucaguaguuggguccugcuuaugaaauaccuaggcaacgcgacggccaucuuuuuucuuccugaugaagggaaguugcagcaccuggaaaacgagcugacucaugauaucauuacuaaauuucucgagaaugaagaucgcaggagcgcaucguuacaucugccaaagcugucuauuaccgguacauacgaccucaaguccgugcucggccaauuggguaucacuaagguguuuagcaauggagcagaccuaucaggaguuacugaggaagcaccacugaaacucucgaaggcugugcauaaagcugugcucacaaucgacgaaaaggggacugaggccgccggagcgauguuccuagaagccaucccaaugucuauuccuccagaggugaaauuuaacaaacccuucguguucuugaugauagagcagaauaccaaguccccauuguuuaugggcaagguggucaacccuacccagaaguag

SEQ ID NO: 5023 - RNA, 1257 nt, Artificial Sequence
  Description of Artificial Sequence: Synthetic coding sequence
augccaucuuccgugaguuggggcauacuccuccuagccggucucugcugucucgugccagugucccuggccgaggacccccagggcgacgcugcacaaaagaccgauaccucacaccacgaccaggaucauccuacuuucaauaaaaucaccccgaaccuagcggaguuugccuuuucccucuacagacaguuagcacaucagucaaauucaacgaacaucuucuucucaccgguuucuauugccaccgcauucgccauguuaagucucgggaccaaggcugauacccacgacgaaauacuggaaggccucaauuuuaaucugacugaaauuccggaggcgcagauucacgaagguuuucaggagcuccuucgaacucuaaaucaaccugauucucagcugcagcucacuacugggaauggguuauuccugagugagggucugaaacugguggacaaguuccuggaggacgugaagaaacuuuaucacagcgaagcuuucaccgucaacuuuggcgacacugaagaggcuaagaaacagauuaacgauuauguugagaaggguacucaggguaaaauuguggaccugguuaaagaauuagaucgugacacugucuuugcccugguaaacuacaucuuuuuuaaggggaaaugggagagacccuuugaggugaaggacacugaagaagaggacuuccauguagaucaggucacuaccguaaaagugcccaugaugaagcgcuuaggaauguucaacauacagcauuguaaaaaauugucuucauggguacuccugaugaaauauuuagggaaugcuaccgcaauuuuuuuccuccccgaugaaggcaaguugcagcaucuugagaacgaauugacccacgauauuauuacuaaauuccuagagaaugaggauagaaggagcgcgucauuacaccugcccaaacucagcaucaccggaacauaugaucugaagucuguuuugggacagcucgguauuacuaagguguucuccaacggugcugaccugucgggaguaaccgaagaagccccgcuaaaguugagcaaggcugugcacaaagcugugcuaacaaucgacgagaaggguaccgaggcagcuggcgcaauguuccuggaggccauuccuaugucaauccccccugagguaaaguucaauaaaccuuucguauuucugaugauugaacaaaauaccaaguccccuuuguuuauggggaaggucgugaacccuacacagaaauag

SEQ ID NO: 5024 - RNA, 1257 nt, Artificial Sequence
  Description of Artificial Sequence: Synthetic coding sequence
augccaaguaguguuucauggggaauacuccugcuagccggguugugcugucucguacccgugucacucgccgaggauccgcagggggaugcagcccaaaagacugacaccagucaucacgaucaagaccacccaaccuucaacaaaauuaccccaaacuuggccgaguucgcguuuucccuguaucgccagcucgcccaccaaaguaacucaaccaauaucuucuuuuccccuguauccaucgcuacagcauuugcgauguuaucccuaggcaccaaggccgacacacacgaugagauucuggagggccucaauuucaaucugaccgagauccccgaggcccaaauccaugagggauuucaggaguugcuccggacacugaaccagcccgacucacagcugcaacuuacuaccgguaauggacuguucuugagcgagggccugaagcucguugauaaguuucucgaagaugugaaaaaguuguaccauagcgaagcguuuaccgucaacuuuggcgacacugaagaggcaaaaaaacaaauaaaugauuacguggagaagggaacacaggguaaaauuguggacuuaguaaaagaacuugaccgggacacuguuuucgcccuuguuaacuauauuuucuucaaagguaagugggaacggccuuucgaggugaaagacacugaggaggaagauuuccacguggaucaggugacuaccgugaaaguuccuaugaugaagagacuuggcauguuuaacauacagcacugcaaaaagcuauccagcuggguacugcucaugaaguacuugggaaacgcuaccgccauuuucuuucuacccgacgaaggcaagcuccaacaucuagaaaacgaacugacccacgauauuaucaccaaauucuuggagaacgaagacagaaggucggcgucacuacauuuaccaaagcugucuauaaccgguaccuaugaccuaaagagcguccuagggcaauugggcauaacuaagguuuuuucuaauggagccgaucuuucaggagugaccgaggaagcaccucugaaacuguccaaagccguccacaaggcgguccugacgauugacgagaaagggaccgaggcugcuggugcuauguuucuggaggccaucccaaugucaauucccccugaggugaaguuuaacaagccauuuguuuuucucaugaucgagcagaauaccaagucgccacuguuuauggggaagguggucaauccaacccaaaaauag

SEQ ID NO: 5025 - RNA, 279 nt, Artificial Sequence
  Description of Artificial Sequence: Synthetic coding sequence
augccguccuccguguccuggggaauccugcugcucgccggccugugcugucuggucccuguuagccucgcugaagacccccagggggacgccgcucagaagaccgacacaagccaccaugaucaggaucauccaacauucaauaaaauuacucccaaccuugcugaauucgccuuuucacucuaucgccaguuagcccaucagagcaauucuaccaacaucuuuuuuagcccggugucgauugccaccgccuuugcuauguuaucccuuggcaccuag

SEQ ID NO: 5026 - RNA, 471 nt, Artificial Sequence
  Description of Artificial Sequence: Synthetic coding sequence
augccaagcucuguguccugggguauccuccuucuggcaggcuuguguugcuugguaccaguaucccucgcagaggacccacaaggugacgcugcacagaaaacagauacuagccaccaugaccaagaccacccuacguucaacaaaauuacgcccaaccucgcugaauuugcuuucagucuauaccgacaacuagcacaccagucuaauagcacaaacaucuucuucagccccgugaguauugcuaccgcauucgccauguugucacuaggaacaaaggcugacacacacgaugagauccuggaggggcucaauuucaaucucacagaaauacccgaggcucagauucaugagggauuucaggagcuguuacgaacucugaaccaaccugauucccagcugcaguuaaccaccgggaaugggcuguuccucuccgaagguuugaaguugguggauaaguuucuagaguag

SEQ ID NO: 5027 - RNA, 354 nt, Artificial Sequence
  Description of Artificial Sequence: Synthetic coding sequence
augccaagcaguguauccugggggauucuucuccuagccggucucuguugucuugucccugugucucuggccgaggauccccagggcgacgcugcacaaaagacagauaccucucaucaugaucaggaccaccccacauucaacaaaaucacccccaaucuugccgaauuugccuucucacuguaucgccaacucgcccaccaguccaauagcacaaacauauucuuuucccccguguccauugccacugccuucgcuaugcugagucucggaacuaaagccgauacacacgacgagauucuggaagguuuaaauuucaaucuuaccgaaauccccgaagcccaaauucacuag

SEQ ID NO: 5028 - RNA, 69 nt, Artificial Sequence
  Description of Artificial Sequence: Synthetic coding sequence
augccuuccuccguuaguuggggaauucuacuucuggccggcuuauguugcuuggugcccguguccuag

SEQ ID NO: 5029 - RNA, 435 nt, Artificial Sequence
  Description of Artificial Sequence: Synthetic coding sequence
augcccucaucuguguccuggggaauccuacugcuggcgggacugugcugccuaguuccggugaguuuagcagaagacccccagggggaugcugcccagaaaacugacacgucacaucaugaccaagaucauccuacuuuuaacaagauaaccccuaaccuagcggaguucgccuuuuccuuauauagacaacucgcucaucaaucuaauucuacaaacaucuuuuuuagccccgucagcauagcuaccgccuuugccaugcugucccuugggaccaaggcagauacucaugacgagauccuagaaggccuaaacuucaauuuaaccgaaaucccugaggcucagauacaugaaggguuucaagagcuucuccgcacccucaaccagccugacagucaacuccagcuaacaacagguaacggucuauuucucuag

SEQ ID NO: 5030 - RNA, 780 nt, Artificial Sequence
  Description of Artificial Sequence: Synthetic coding sequence
auguacaguaacguuaucggaaccguaacaaguggaaagaggaaagucuaucugcuaagccuccugcuaaucggauucugggauugcguuacuugccacggcagccccgucgauauuugcaccgcaaagccacgcgacauacccaugaacccaauguguauauaccggaguccagaaaagaaagcgacagaggacgagggguccgaacaaaaaauaccugaagccacuaaccgcagagucugggagcugaguaaggcaaacucucgauucgccacaaccuucuaucaacaucuggccgacaguaaaaacgauaaugauaacauauuccuguccccacuuuccaucucaacagcuuuugccaugaccaaacugggagcauguaaugacacccuucaacaauugauggaaguguucaaguuugacaccauuagugaaaaaaccuccgaucagauucacuucuuuuuugccaagcugaacugccgcuuauauagaaaggccaacaagaguuccaaacuaguaagcgccaaucgccuguuuggugauaaaagccugacauucaacgaccuauacguguccgacgccuuccauaaggccuuucucgaaguaaacgaggaagggucugaagcugccgccuccacggccguagugauugcuggccggagucuuaauccuaaccgcgucacuuuuaaagcaaaccggccauuccucgucuucauucgggaggugccccuaaauacaauuauuuucaugggcagaguagcuaaccccugugucaaauag

SEQ ID NO: 5031 - RNA, 1395 nt, Artificial Sequence
  Description of Artificial Sequence: Synthetic coding sequence
auguauagcaacguuauugguaccgugacauccggcaaaaggaaagucuaccugcugucucuguuauugauaggguuuugggacugcguaaccugccacggaagcccaguagauaucuguaccgcaaaaccucgcgacaucccuaugaaccccaugugcaucuaucggaguccugagaaaaaagcaacagaggacgaggguuccgagcagaagauucccgaagcuacaaaccggcgaguaugggagcuguccaaggcuaacucaagauuugcuacgacauucuaccaacaccucgccgacuccaagaacgauaaugauaacauuuuucucucuccuuugagcauaucaacagccuuugccaugaccaaguugggugccugcaacgauacucuucaacagcugauggagguguuuaaauucgacaccauauccgagaagaccagcgaucagauucauuucuuuuucgcuaaacucaacuguagauuguaccgcaaggccaauaaauccucuaagcucgugucagcgaaucgauuguuuggcgauaaaagccucaccuuuaacgagacauaucaggacauuucugaacuagucuauggugcgaagcuccagccccuagacuucaaggagaacgcugagcagucuagggccgcuaucaacaaauggguuaguaauaagacagaaggcagaaucaccgauguuauaccgucagaggccaucaacgaauuaaccguuuuagugcuggugaauaccaucuacuuuaaaggacuguggaagagcaaguuuucacccgaaaacacccggaaagaacucuuuuauaaagcugauggagagagcuguucagcuucgaugauguaucaggagggaaaauuccgcuaucgucgagucgcugaggguacucaaguacuggaauugccuuuuaaaggcgaugauaucacaauggugcucauacucccaaagccugagaagucacuggccaaggucgagaaggaguuaaccccagaaguguugcaagaguggcuggaugaacucgaagaaaugaugcugguggugcacaugccccguuuccgcauugaggacggguuuucacuuaaagagcaauuacaggacaugggccuaguagaccucuucagccccgagaagucaaagcugccuggcauaguggcugaaggcagggacgacuuguacgucucggacgccuuucacaaagcauuccucgaagugaaugaagaagguuccgaagcggcagccagcaccgcuguggugaucgcuggacggagccugaauccgaaucgugugaccuucaaagcuaauaggccuuuccucguuuucaucagggaggucccucugaacaccauuaucuuuauggggagggucgcuaaucccugcgucaaauag

SEQ ID NO: 5032 - RNA, 1503 nt, Artificial Sequence
  Description of Artificial Sequence: Synthetic coding sequence
auggcaagucgacugacgcuguugacacugcuguugcuccuccuugcuggcgaccgggcuuccucaaaucccaaugcuacuaguucauccagucaggaucccgagucucuucaagauaggggcgagggcaaggucgccacaacagugaucuccaaaaugcucuucguggaaccaauccucgaggugucuucucugccaaccacaaauuccaccacgaauucagccaccaagauuacugccaacacuacggacgaaccuaccacgcagccaacuacugaaccgacaacucaaccaaccauucagcccacacagccaacuacucaacugccuacagacucucccacccagcccacuacaggcucauuuuguccaggcccugucacccuguguucugacuuggagucucauuccacugaagccguccuuggggaugcacuugucgacuuuagcuugaaacuuuaccacgccuuuucagccaugaaaaaaguugagaccaacauggccuuuucaccuuucucuauugcauccuugcugacccaggucuuacuaggugccggcgagaacacuaagaccaauuuagaaucaauuuugagcuacccuaaggacuuuacgugugugcaucaggcacucaaaggcuucacaacaaagggggucaccagcguuucacaaauauuucacagcccagaccucgcaauucgagauacauucgucaacgcauccaggacccucuacucuuccucccccagagugcuguccaacaauucugacgcaaaucuugaacucaucaauaccuggguugcaaaaaauacaaacaauaagauaucucggcuccuggauucucuuccuagcgacacucggcugguuuugcucaaugcuaucuaucucuccgccaaauggaaaaccaccuucgacccuaagaaaacccgcauggaaccauuucacuucaagaauagcgugauuaaggugccuaugaugaauagcaagaaauaccccgucgcacacuucaucgaccaaacucugaaagccaaagugggacagcuacaacucagccauaaucuaucacuggugauccucgucccacagaaucucaagcauaggcuggaagacauggagcaagcccugucuccaaguguauucaaggcuauuauggaaaaacuggagaugaguaaauuccagccaacacugcuuacccugccacgcauuaaagugaccacaucacaggacaugcuuucuaucauggaaaagcuggaauucuuugacuuuucuuaugaccugaaccuauguggccucacggaagaucccgaucuccaggucucagcuaugcaacaccagacaguccuggaauugacagagacuggcguagaggccgccgcugcgagugcaaucaguguugcccgcacauuauuaguuuuugaagugcaacagccuuuucucuucgugcuuugggaccagcaacacaaauuuccaguuuuuaugggccgcguuuaugauccaagggcguag

SEQ ID NO: 5033 - RNA, 1518 nt, Artificial Sequence
  Description of Artificial Sequence: Synthetic coding sequence
auggccagcagacugacacuccucacucuacugcuccuguuacuugccggauuucuggaaccccaagaccgcgcauccucaaaccccaaugccacaucauccagcucccaggaccccgagagcuugcaggacaggggcgaaggcaaaguggcaacaacaguaaucuccaaaauguuauuugucgaaccuauucucgaggugaguagccuccccaccacuaacagcacaacgaacagcgcaacuaagaucacagcaaacacaaccgaugaaccuaccacccagcccaccacagaaccgacaacucaaccgacuauucagcccacucagcccaccacucagcugccuacggauuccccaacccagcccacaacggguagcuuuugucccggacccguuacccuguguucugaucucgagucucacagcacugaagccguccugggcgaugcccuaguugacuucucucucaaacucuaucacgccuuuagugccaugaagaaaguggaaacaaacauggccuuuaguccauuuucgauugcauccuuacuuacgcagguguugcugggugccggcgagaauacaaaaaccaaccuagaauccauucugaguuacccaaaggacuucacaugcgugcaucaagcacugaaggguuucacuaccaaagggguaaccucaguaucccagaucuuccacucccccgaucuggcuauccgcgauaccuuugugaaugcaucacggacccuuuauagcaguagcccaaggguccucuccaauaacagcgacgcuaaccucgagcugaucaacaccuggguugcaaaaaauacuaacaacaagauuuccagacuccuggacucauugccgagugauacccggcuuguuuuauugaacgcaaucuacuuauccgcaaaauggaaaaccacauucgaccccaagaaaacccguauggaaccauuccacuucaagaacuccgugaucaagguuccgaugaugaacucaaagaaguaucccgucgcucacuucaucgaucagaccuugaaggcgaaggugggucaguugcagcugucccauaaccugucauuagugauucuuguaccccagaaucuuaagcaucgacuagaagauauggaacaggcgcucucaccgaguguguuuaaagcaauuauggaaaaacuugaaaugagcaaauuccaaccgaccuuacugacgcugccaagaaucaaagucacaacaagucaggauaugcuguccaucauggagaaauuggaauucuucgacuucucauacgauuuaaaucuuugcggguuaacagaggauccagaccugcaagugucugccaugcagcaucagaccguccuggagcugacagaaacugggguggaggccgcagcagcuuccgccauuucaguggcuagaacccucuugguuuuugaggugcaacagccauuucuuuucguccugugggaccagcagcacaaauuccccguguuuaugggacgcguauaugauccccgugccuag

SEQ ID NO: 5034 - RNA, 1347 nt, Artificial Sequence
  Description of Artificial Sequence: Synthetic coding sequence
auguuguucguugaaccaauucuggaagucucuaguuuacccacaacaaauagcaccacaaacuccgcgacaaaaauuaccgccaauaccacagacgaaccgacuacacagccgacaacagagcccacuacgcagcccaccauucagcccacccaaccuacuacccagcugccuacagauuccccuacacagccgacaaccggaaguuuuugccccgggcccgugacacugugcagcgacuuagaaucccauucaacugaggcaguucuuggcgaugcacugguggauuucucacuuaagcuuuaucacgcuuucagcgcuaugaaaaaggucgaaacaaacauggccuucucgccauuuuccauagcuucucuuuugacucagguguuacugggagccggggagaauacgaaaacgaaccuggagucaauacuaaguuauccgaaggauuuuaccugcguacaccaggcucugaaaggcuuuacaaccaaaggggucacauccgucagccagauuuuucauucucccgaccuagcaaucagggauacauucgugaacgcuucaagaacacuuuauagcagcagcccacgggugcugucuaauaacuccgacgccaauuuggagcucauuaacacuuggguggccaagaacaccaacaacaaaauuagccgucuccuggacucccucccauccgauacaagauuaguucuucucaaugccaucuaccuuucugccaaguggaaaacaacauuugacccuaagaaaacuaggauggagccuuuccauuuuaagaauucaguuaucaagguaccuaugaugaacucuaagaaauauccuguugcccacuuuauugaucagacucucaaggcaaaggugggccaguugcaguugucgcacaaucuaucccucguuauccuggucccucaaaaucugaagcaccgccuggaagauauggagcaagcucucuccccaucugucuuuaaagcuauaauggaaaagcuugaaauguccaaguuccagccuacacugcucacacucccacgcauaaaagucacuaccucccaggacaugcugagcaucauggaaaaacuggaauuuuuugacuucucuuaugauuuaaacuuaugcggguuaaccgaggauccugaccugcaggugucugcuaugcagcaccaaaccguccuagagcuaacagaaacuggcguggaagccgcugccgcaagcgccaucagcguggcacguacacugcuugucuuugaaguucagcagcccuuccucuuuguuuugugggaucaacaacauaaauuuccgguuuuuaugggccgaguguacgauccaagggccuag

SEQ ID NO: 5035 - RNA, 483 nt, Artificial Sequence
  Description of Artificial Sequence: Synthetic coding sequence
auggcaucccgccucacccugcucacccuucuacuccuccuucuggcuggcgaccgggcuaguaguaaccccaaugcaaccucuagcaguucucaggauccagagucccuccaagacagaggugaggggaaaguugcaaccacugugaucucuaaaauguuauuuguggagccuauucuggaaguaagcagccuacccacaacaaauucaacuaccaauuccgccacgaagauaacagcuaacacgacagacgagccaacaacucaaccuacgaccgagcccacuacucaacccaccauucagccuacccagccuacaacucaacugccuaccgauagcccuacucagcccacaacuggcucuuuuugcccuggcccugugacacugugcagugaucuggagagccacaguaccgaggcaguguugggugacgcacuggucgauuucucuuuaaaacuuuaucaugccuuuucagccauguag

SEQ ID NO: 5036 - RNA, 402 nt, Artificial Sequence
  Description of Artificial Sequence: Synthetic coding sequence
auggccucucgacucacccuccucacucucuuacuguugcuguuggcuggagacagagcuucuagcaauccaaacgccacaaguuccagcucacaggacccagaaagcuugcaggaccgcggugaaggcaagguggccacuacggugauuuccaagaugcucuuugucgaacccauucuggagguaagcucucucccaacaacaaacagcacaacgaauuccgccacaaagaucacagcuaacacgaccgaugagcccacaacgcagccaacaacagaacccaccacgcagcccacaauacaaccgacccagcccacgacacagcuuccuacugacagccccacucaaccaggcuacgcccuaaaccauggagaaauaggcauucugcgguuuuuucuuuag

SEQ ID NO: 5037 - RNA, 1335 nt, Artificial Sequence
  Description of Artificial Sequence: Synthetic coding sequence
augugccucuguucuggaaggaaaacaauuuuggaaaucuaccccggucaauuucaacccucuuugugucauaaguucauugcccucagcgacaaggagggaaaacucuugcgcaacuauacccaaaacauagacacacuagagcaaguggccggcauacaaagaaucauucagugccacggaagcuucgcuacugccuccugccucauauguaaauauaaaguggauugcgaagcaguaaggggggauaucuucaaucaaguaguuccacgaugccccagaugcccagcugacgagccucuggccauaaugaaacccgaaaucguguuuuuuggugagaaccugccugaacaguuccaucgugccaugaaguacgacaaggacgagguugaccuguuaauugugaucggaaguucucugaaggugcgcccaguugcccugauaccuucauccauuccucacgagguuccucagauacuuauuaauagggagccuuugccucaccuacauuucgauguugaacugcugggggacugcgauguuaucauaaacgaacuuugucacagacucgggggcgaauacgcuaaacugugcugcaaucccgugaagcuauccgaaaucacagaaaagcccccgcggacacagaaggaacuggcuuaucuuagugagcuccccccaacgccacuucacguaucggaagauucaucuucuccugagcgaacauccccccccgacucaagcgugauugucacccugcucgaccaggccgcaaaauccaaugacgaucuugacgucagcgagaguaagggcugcauggaagaaaaaccccaggagguucagaccagucguaacguugaaaguaucgccgaacagauggaaaacccugaccugaaaaaugugggcucuagcaccggcgaaaaaaacgaaagaacauccgucgccggaaccguccgaaagugcuggccuaacaggguggcuaaagagcaaaucucccgccggcuggacggcaaccaauaucuuuuccucccgccuaaucgauacauuuuccauggagccgaaguguacuccgacucugaggacgacguacuguccuccucaagcugcggaucgaacuccgauagugggacaugucaaucgccuagucuggaggagcccauggaagaugaguccgaaaucgaggaguuuuacaacggccuggaagacgagccugaugucccagagagggcgggcggggcuggcuuuggcaccgauggugacgaccaagaagccauuaaugaggcaauuucuguaaagcaggaagucacagauaugaacuaccccucuaauaaaaguuag

SEQ ID NO: 5038 - RNA, 1335 nt, Artificial Sequence
  Description of Artificial Sequence: Synthetic coding sequence
augugccuguguuccggacguaagacuauccuugaaauauaccccggacaguuccagccuagccugugccacaaauuuaucgcgcugagugacaaggagggaaagcuucuacgcaacuacacccaaaauaucgacacucucgaacagguggccggaauucagcgcaucauccagugccacggaagcuuugccacagccagcugucuuauauguaaguacaaaguugacugcgaagcuguccgcggagauaucuuuaaucaaguugugccacguugccccaggugucccgcggaugagcccuuggccauuaugaagccagaaauuguguuuuuuggugagaaccugcccgagcaauuucaccgcgcaaugaaguacgacaaagacgagguggaccugcugaucgugauuggaagcucacugaaaguuaggccugucgcguugaucccuucauccaucccccacgagguaccacaaauuuugaucaauagagaaccguuaccacaccugcacuucgacguggaacuccugggcgacugcgacgucaucauuaaugaacucugccaucgacucgggggggaguaugcaaaacugugcugcaacccuguuaaacugucugagauuacagaaaaaccgccacgaacacagaaagagcucgcauaucucagcgaacuccccccaacaccgcugcauguuucagaggacagcucuagcccggaaagaacuagcccaccagauucaagcgugauugugacccugcuggaucaggcugcuaaaaguaaugacgaccucgacgugucagaaucgaaaggauguauggaagaaaagccucaggaagugcagacaucgcgcaacguugaaucaaucgccgagcagauggagaacccugaccucaagaauguagguagcuccacaggcgagaagaaugagcguacuagcgucgcagggacagucagaaaauguuggccuaaccgaguagccaaggaacagauaagucgcagacuggacgggaaucaguacuuguuccucccuccaaaccgcuauauuuuccacggugcugaggucuacagugacagcgaagacgacguacucucuagcucguccugcggcucaaacucugacaguggaacaugccagagcccuucuuuagaggagccuauggaggacgagucugagaucgaggaauucuacaauggacuggaggacgaacccgacgucccagaaagagcuggaggcgcuggauucggcacugacggagacgaucaggaggcgaucaaugaggccauuucugugaaacaagaaguuacagacaugaacuauccaagcaacaaauccuag

SEQ ID NO: 5039 - RNA, 1359 nt, Artificial Sequence
  Description of Artificial Sequence: Synthetic coding sequence
auguuugauaucgaauacuucagaaaagaucccaggcccuucuucaaguuugcaaaagagaucuauccuggccaguuucagccaucuuugugccauaaauucauugcacugagcgacaaggaagggaagcuguugcggaauuacacacagaacaucgauacucuggaacagguggcugggauccagcggauuauccagugucauggcucauucgcuacugccucaugucucaucuguaaguacaaagucgauugugaagccgugcgcggugacaucuucaaccagguuguaccucguuguccacggugccccgcagacgaaccacucgccaucaugaaaccggaaauuguuuuuuucggggaaaaucugccugagcaauuucacagagccaugaaguaugauaaagaugagguugaccugcucauuguaaucgggaguucgcucaagguuaggccuguggcgcugauucccagcucuaucccacaugaggugccucagauccugauaaaucgugagccccuuccccaccugcacuuugaugucgagcuuuuaggagauugcgaugugauaaucaaugaguugugucaucgacuaggaggugaguaugccaaauuauguuguaaccccgugaaacugagcgaaauuacugagaaaccuccucguacccaaaaggaauuagcauaucuuucggagcugcccccaaccccgcugcacgugucugaggacagcucaagcccggagaggacaucaccaccggauagcuccgucauugugacacuguuggaccaggcagccaaauccaacgacgaucuagacguauccgagagcaaggguuguauggaagaaaagccucaggaaguucagacaucccgcaacguggaaagcauagcugagcaaauggagaauccagauuugaagaacguuggguccucaacuggagaaaaaaacgaacguaccucaguagcaggcacgguccgaaaguguuggccuaaccggguugccaaagaacagauaagcagaaggcucgacgggaaccaguaucuauuucuccccccuaauagguauauuuuccacggcgcugagguuuacuccgacagcgaagaugaugucuugagcucaucuuccugcggcucaaauuccgauagcggaacaugucagucucccucccuagaagaacccauggaggaugagucugagauugaagaauuuuauaacgggcuggaggaugaacccgacguacccgaacgggccgggggagcugguuucgggaccgauggagaugaucaggaagcgauuaaugaggccauuagcgucaagcaagaagucacugacaugaacuaccccuccaacaagaguuag

SEQ ID NO: 5040 - RNA, 987 nt, Artificial Sequence
  Description of Artificial Sequence: Synthetic coding sequence
augagcguaaauuacgcugcuggguugagcccauacgcagauaaggguaaaugcggccuuccugagauuuuugaucccccugaggaacucgagcggaaggugugggagcuggcacgccuagucuggcaaagcuccaguguagucuuucacacaggagcagggauuagcacagcaucuggaauacccgacuuuagagggccacacggcguguggacuauggaggagcgcggcuuagccccuaaguucgauacaaccuuugaaagcgcccgacccacacaaacacauauggcccugguccagcuagagagagugggauugcugcgguuuuugguaagucagaacguugauggacuccacgugagauccggauuuccucgagacaaauuagccgaauuacacggcaacauguucguugaagaaugcgcgaagugcaaaacccaguauguucgggauacuguaguggggacaaugggcuugaaagcuaccggccgccucugcaccguggcaaaagcaaggggcuugcgagcuugccggaacgcagaccuuucaauuacgcucgggaccagucuccagauuagacccuccgguaaccuaccacuugcuacuaagagaagggggggucgcuugguuaucgucaaucuccagccgacaaaacacgaccgucacgcugaccuuaggauucacggauacguagacgaaguaaugacccgucugaugaaacaccuagggcuugagaucccugcuugggauggcccccgcguccuagaacgggcucuuccuccacuaccccguccuccaacccccaagcuggagccgaaggaggaaaguccuacuaggaucaauggauccauuccugcaggucccaaacaagagccaugugcacagcacaaugguagcgagcccgccaguccuaaaagagagcggccaacaucuccugccccacaucgucccccgaaacgugugaaggccaaagccguaccuucauag

SEQ ID NO: 5041 - RNA, 1068 nt, Artificial Sequence
  Description of Artificial Sequence: Synthetic coding sequence
augucuguuaacuacgccgcuggccugucaccauaugcagacaagggcaagugcggacugcccgaaauuuucgacccucccgaggaauuggaacggaaagugugggaacucgcccgacucgucuggcagagcaguucaguuguauuucacaccggagcagggaucucuacugcguccggaauccccgauuuccgagggccccacgguguuuggacaauggaggaaagggggcuagcacccaaguucgauaccacuuuugagagcgccagaccuacccaaacucauauggcucugguacagcuggagcgcgucgggcugcugagauuccuggugucacagaacguugacggacugcacgugagguccgguuuuccgcgcgauaaacuugccgaauuacacgggaauauguuuguggaggagugcgcuaaaugcaagacacaauacguaagggacaccguugucggaacuauggggcugaaggcaacggggcgcuuguguaccgucgcuaaagcucggggacuucgugccuguagaggugaacugcgagauacaauccucgacugggaagacagccucccagaccgcgacuuagcacuggcugaugaagcuuccagaaacgccgaucugagcauuacccucggaacuucccugcagauccgccccagcgggaaccugccguuagcuacgaagcggagagguggacgcuuagugaucgugaauuugcagccgacaaagcacgaucgccaugcugaucucaggauacauggcuauguggacgaggugaugaccagacugaugaaacauuuggguuuggagaucccagcuugggauggaccuaggguacuagagagagcgcucccgccuuuaccaagaccacccacuccuaaacuggagccaaaggaggagucuccaacuagaauaaacgguuccauuccagcuggcccuaagcaggagcccugugcacaacacaauggauccgagccugcaagcccuaagcgagagagaccuacaucgcccgccccccacagaccucccaaaagagugaaagccaaggccgugccuagcuag

SEQ ID NO: 5042 - RNA, 852 nt, Artificial Sequence
  Description of Artificial Sequence: Synthetic coding sequence
auggaggagagaggacuggcacccaaguuugauaccacuuucgaguccgcaagaccaacacagacucacauggcccuggugcaacuggaacgggugggccugcuccgauucuuggugucacagaacguggacggccuccauguccggucuggauuuccgagggacaaguuagccgagcugcauggaaauauguucguggaggaaugcgcuaaguguaaaacacaauauguuagggacaccguuguuggaacuaugggccugaaggcaaccgggagauugugcacuguggcaaaagcccgaggccucagagcuuguaggggggaacugagggauaccauccuugacugggaagacucacuccccgaucgcgaccuugcccuugccgaugaggcgucucggaacgccgaccucucgaucaccuuggguaccucccuccagauucguccgagcggcaauuuacccuuagccacuaagaggagaggaggccgacuggugauuguaaaucuucagccaacuaagcacgacaggcaugccgauuuaagaauacacggauaugucgaugaagugaugacgcgccugaugaaacacuugggacuugagaucccugcaugggauggaccccgcguacucgagcgggccuuacccccacuuccgaggccccccaccccuaaguuagagccuaaagaggaaagcccuaccagaauuaacggauccauacccgccggaccgaaacaagagccaugcgcccagcacaacggaagugagccugcuagccccaaacgggagcggccaacaaguccagccccucauagaccaccgaagcggguuaaagccaaggcagucccuaguuag

SEQ ID NO: 5043 - RNA, 2496 nt, Artificial Sequence
  Description of Artificial Sequence: Synthetic coding sequence
auggagcggccguggggagccgcggauggccugucaagguggccucaugggcucgguuugcuuuuguuacugcagcuucugccaccaaguacucucagccaggacagauuggaugcgccacccccacccgcugcaccccugccaagaugguccggacccauugggguguccugggggcuucgugccgcggccgcagggggagcuuucccacguggggggagauggcgcagguccgccccaggggaagaugaagaaugugggcgggugcgggauuuuguagcaaagcucgccaacaauacgcaccagcacguguuugacgaccugcgcgggagcguuagucugaguuggguuggugacuccacuggcgugauacuuguucucaccacguuucacgucccacuuguuaucaugaccuuuggccaaucuaaacuguaucgaagugaggacuacgggaaaaauuucaaagauaucacugacuugaucaacaauaccuucauccggacugaguuuggcauggcuaucggaccugagaauagcgggaaaguaguuuugacagccgaagugaguggcgggucaagaggaggcaggauauuccgcucuagugauuucgcgaaaaauuuugugcagaccgaccuacccuuucauccauuaacgcagaugauguacagcccgcaaaauucugauuaccugcuggcgcugagcacagagaacggucugugggugucaaaaaauuucggcgguaagugggaagaaauccauaaggcgguguguuuagcuaaaugggggagugacaacaccaucuucuuuacaacauacgcaaacggcagcugcaaggcagauuugggggcgcuggagcuguggcggaccagcgaucucggcaagagcuuuaagacaaucggagugaagaucuauucuuuuggcuuggguggucgguuucucuucgcuucugugauggcggacaaggacacaacgcgccggauccauguguccacagaccaaggagacacauggucuauggcucaguugccuucggugggacaggaacaguuuuacucgaucuuggccgccaacgacgauauggucuucaugcacgucgacgagccuggagauacggguuuugguaccaucuucaccagcgaugaccgaggcaucguguauucaaagagcuuggaucgccaccuguacacaaccacggggggagagacagacuucacuaauguaacuagucuacgugggguguacauaaccucugugcuuagugaggacaacuccauacaaacaaugauuaccuuugaucaggguggacgguggacccaccugcgaaaaccugagaacagugagugugacgccaccgcaaagaacaaaaacgagugcucacuacauauucacgcuagcuacagcauuagucagaaacuaaaugugccgauggcaccccuaucugagcccaacgccgugggaaucgucaucgcacacgggucggucggcgaugcaauaucaguuauggugccagacguuuacaucucagaugacggcggcuauucuuggaccaagaugcuugaaggaccacacuacuacaccauauuggacagcgggggaaucauaguggcuauugaacacagcagucgucccaucaacgugaucaaguuuuccacugacgaagggcagugcuggcaaacauacaccuuuacuagagauccuauuuauuuuacgggccuggcauccgaaccaggcgcacgcuccaugaauauuucaauuuggggauuuacugagucauuucucacaucacaauggguaucauauaccaucgauuuuaaggauauauuggagaggaauugcgaagagaaggauuacaccauuugguuagcacauuccacagacccggaagacuaugaagauggcugcauuuuaggguacaaagaacaguuucuaagguugagaaaaucaucagucugccagaacggccgggauuaugucgugaccaagcaaccuagcaucugucuuuguucacucgaagauuuuuugugugacuuugguuauuaucgacccgaaaaugauagcaaaugcguggaacagccagagcucaaaggccacgaucucgaguucugccuguacgggagggaagaacaucuuacaacgaauggcuacagaaaaauuccaggcgauaagugccagggcggcgugaacccgguaagagaagugaaggaucugaagaagaaauguacuuccaacuuucuguccccugagaaacagaacagcaaguccaacuccguccccauuauauuggcuauugucggccucaugcuggucacaguuguggcgggugugcuuaucgucaagaaguauguuugcggcgggagauuucuugugcaccgauacuccguacugcagcagcaugcugaggccaacggcguggauggcguugacgcccuggauacagcuucccacaccaacaaaucuggauaucaugaugauucagaugaggaccuacuugaguag

SEQ ID NO: 5044 - RNA, 2085 nt, Artificial Sequence
  Description of Artificial Sequence: Synthetic coding sequence
augacuuuuggacagaguaaacucuaccgauccgaggauuacgggaagaacuuuaaggacauuaccgauuugauuaacaauacuuucauuaggacagaguuuggcauggcaauuggucccgagaacucaggaaagguggugcugacugcagagguuucgggggggucaagagggggacgcauuuuccgguccucagacuucgcaaaaaacuucgugcagacugaucugccuuuccacccacucacacagaugauguacagcccgcagaacagcgauuacuugcuggcucucuccaccgaaaauggguugugggucucgaaaaauuucgggggcaagugggaagaaauccacaaggccguaugucuugcgaaauggggcuccgacaauacaauauuuuucacaacguacgcgaauggcaguugcacugaucucggugcccuugaacuguggcgcacaucagaucuuggaaaaucguucaagacgaucggagugaagaucuauucauucgggcugggagggcgcuuccuguucgccuccgugauggccgauaaagacaccacucgccgaauucacgugucuaccgaucagggcgauacuugguccauggcucaacugccguccguggggcaggagcaguucuacuccauccuugcugcaaaugacgacaugguguucaugcacguugacgagccaggcgauacuggcuucggaaccauauucacuagugaugaccgugguauuguuuacagcaaaucucucgacagacacuuguacacaacgaccggaggggaaaccgauuucacaaaugugacuagccugagagguguguacauuacauccgugcugagugaggauaauucuauacaaacaaugauuacuuucgaccaggggggucgcuggacucaccucagaaagccagagaacucagagugugacgcuaccgcuaaaaacaaaaacgagugcucucugcauauucaugccuccuauuccauuucacagaagcugaauguucccauggcaccacuguccgagcccaaugcaguuggaauaguuaucgcacacgggagcgugggcgaugccauaucugugauggugccagauguuuacauaagugaugaugggggauauaguuggacuaaaaugcuggaaggcccgcacuauuacacuauccuugacuccggggggaucaucgucgccaucgagcauagcaguaggccaauuaacgugauuaaauuuucuacagaugagggacaguguuggcagacuuauacguucacuagagacccuaucuauuucacagggcuugcuucagaaccgggcgcucgaaguaugaauauuuccaucuggggauucacagaauccuuuuugacaucacagugggucucauacacaaucgauuucaaggacaucuuagaacggaacugcgaggaaaaggacuacaccaucuggcuggcccauagcacagaccccgaggacuaugaagauggauguauucucggguacaaggaacaguuucuccgccugcgcaagagcagugugugucagaacggucgggacuaugugguuacuaagcagcccuccauuugucuuuguucacuggaggacuuucuuugugacuuuggcuacuaccgacccgagaacgacuccaagugcguagagcagccugaguugaaagggcacgaccucgaguuuuguuuauauggcagagaggaacacuuaaccacaaauggguaccggaagaucccuggugacaagugccaggggggaguuaauccagucagagagguuaaagauuuaaaaaagaaguguacgaguaacuuuuuguccccagaaaagcaaaauagcaaauccaacuccguaccgauuauccucgcgauuguaggcuugaugcuggugacugugguggccgguguuuugauugugaaaaaauauguauguggaggaagauucuugguccaucguuacucgguucugcagcaacacgccgaggccaacggugucgauggaguagacgcacucgauacagcaucccacacuaauaagucagguuaccaugacgauagcgacgaggauuugcuggaauag

SEQ ID NO: 5045 - RNA, 1536 nt, Artificial Sequence
  Description of Artificial Sequence: Synthetic coding sequence
augggaguguugaaguuuaagcacauuuucuucagguccuuugugaaaagcagcggaguaucccaaauuguguuuaccuuucuccucauccccuguugucuuacacugaacuucagagccccgccagucaucccgaacgugccauuuuugugggcuuggaaugccccuagcgaauuuugccuggggaaauuugaugagccauuagacaugagccuguuuuccuucaucgggucuccucguauuaaugcgaccggacaggggguaacaauuuucuacgucgacagguugggauauuacccuuacauugauuccaucacuggcgucacagucaacggcgggauuccucaaaagaucucccuacaagaccaucucgauaaagccaagaaggauauaaccuuuuauaugccgguggauaaucucgggauggcaguuauagacugggaagaguggcggccuaccugggcacgcaauuggaagccgaaggauguguauaaaaaccgcucuauugaauugguucagcagcaaaauguccagcugagccugacagaggccacugagaaagccaagcaggaauuugaaaaggccgguaaggacuuuuuaguggagacgauuaaacuagguaaacugcuccgacccaaccaccuaugggguuauuaucuguuccccgauugcuauaaccaucacuacaagaagcccggcuacaauggcucaugcuuuaauguagagauaaaacguaacgaugauuuaucauggcuguggaaugaaucaacggcccuguacccuucuaucuauuugaacacccagcaaaguccagucgcugcuacccucuacguucgcaaccgugugcgagaagcuauacgcguuaguaagaucccagacgcuaagucaccacugccaguuuuugcuuacacccgaauuguguucacugaucaagugcugaaguuuuugucccaagacgagcugguauauaccuucggagaaacuguggcguugggagcuucagguaucguaauaugggguaccuugucuauaaugaggaguaugaaaaguugccuguuacucgacaauuacauggagaccauccucaacccguacauaauuaacgugacuuuggcugcuaagaugugcucacaagugcuuugccaggagcagggcgucuguauuaggaagaauuggaacucuagugacuaucugcaccuuaacccagacaauuucgcuauccagcuggagaaggguggaaaauucacagucagggggaaaccaacacuagaggaccuagagcaguuuagcgagaaauucuauuguucaugcuacagcacccucucauguaaagagaaggcagacguuaaagacacagacgccguugaugucuguaucgcagacgggguguguaucgacgcauuccugaagccuccgauggaaaccgaggaaccacagaucuuuuacaacgccucucccagcacucugucugcuacgauguuuaucuggagacuggaggugugggaucaaggaaucagccggauaggguuuuuuuag

SEQ ID NO: 5046 - RNA, 1530 nt, Artificial Sequence
  Description of Artificial Sequence: Synthetic coding sequence
augggggugcuaaaauuuaagcacaucuucuucagauccuuugugaaguccucuggagugucacagauuguguucacuuucuuacucauuccuuguugccuuacgcucaacuuucgcgccccaccagucauccccaacgugccauuucucugggcauggaacgccccaucugaguuuugccuggguaaauuugacgaaccccuugacaugucguuguuuucauucaucggcucaccgaggauuaacgcuaccggccagggcgucaccauuuuuuacguggacaggcuuggauacuacccuuacauugauagcauuacuggcguuaccguuaacggagguauuccccagaaaauuucgcuucaagaccaucucgauaaagccaaaaaagauauuaccuucuacaugccaguugacaaucugggcauggccgugaucgauugggaggaauggcggccaacuugggcccggaacuggaagccaaaggacgucuauaagaauaggagcaucgaacuugugcaacaacagaauguucagcuaagccugaccgaagcgaccgagaaggccaagcaggaauuugagaaggccgggaaggacuuccuuguggagacgauuaagcuggguaagcuacucaggccuaaccaucuuugggguuacuaccucuuucccgauuguuauaaccaccacuauaagaagcccggcuacaacgguuccuguuuuaacguugaaauaaaaagaaaugaugaccugaguuggcuguggaaugaaaguaccgcccuguauccgagcauauaucugaauacccagcagucucccguugcggcaacucuauauguacgaaauaggguucgcgaagccaucaggguuaguaaaauuccugacgccaaauccccacucccgguguucgcguacaccaggaucguguucacagaccagguacugaaauuucuuucgcaagaugaacucguuuacaccuucggcgagacaguugcgcugggagcuaguggcaucgucaucugggggacucuuucaaucaugcgcuccaugaagucauguuugcuccuggauaacuauauggagacuauucuaaauccuuacaucauuaaugucacucucgcagcuaagauguguagccagguacuuugucaagagcaaggcgucuguauaaggaagaauuggaauucaagcgauuaccuucaccuaaaccccgauaacuuugcaauucaacuggagaagggugguaaauuuacgguaagagggaagcccacccuggaagaucuugaacaguucagugagaaguucuacugcuccugcuacucuacccucucauguaaagaaaaagccgacgugaaggauaccgacgcagucgacguuugcauagccgacggagucugcauugaugcauuccugaagcccccgauggagaccgaagaaccucagaucuucuauaaugcaucaccauccacccugucugccacuauguuuaucgugagcauccuguuucuuauuaucagcucggucgccucgcucuag

SEQ ID NO: 5047 - RNA, 243 nt, Artificial Sequence
  Description of Artificial Sequence: Synthetic coding sequence
augggcguacucaaauucaaacauauuuucuuccgauccuuugugaaguccuccgguguuucucagaucguuuuuacauuucuccugauaccuuguuguuugacacugaauuuuagagccccgccaguaaucccuaauguuccuuuuuuaugggcauggaacgcccccuccgaauuuugucuuggcaaguucgacgaaccacuugacaugucacuguucagcuucauuggguccccacgcuag

SEQ ID NO: 5048 - RNA, 1530 nt, Artificial Sequence
  Description of Artificial Sequence: Synthetic coding sequence
augggcguacugaaguucaaacacaucuuuuuucgcucauucgucaagaguuccggcgugucccaaauugucuucaccuuucucuugauccccuguugucuuacacuuaacuuccgggccccgccgguuauucccaacgugccguuccuuugggcuuggaaugcacccucugaauucugccuaggaaaauuugacgagccccuggauaugagucuguuuaguuuuauugggucuccuaggauuaaugcuaccggacagggcguuacaaucuucuacguugauagauuggguuacuauccauauauugacuccauaaccggugucaccgugaauggagggauuccccaaaagaucucucugcaggaccauuuagauaaagcaaagaaggacauuacuuuuuauaugcccguggacaaucuuggcauggcuguaauugauugggaagaguggaggcccacuugggcacgcaauuggaaaccaaaggaugucuauaagaaucgcaguauugaacuaguccaacagcagaacguccaguuaucccugaccgaagcuacugaaaaagccaaacaagaguuugaaaaggccggaaaagauuuccucguggagacgaucaagcuaggcaaguugcugaggccaaaccaucucugggguuauuaccuuuuucccgauugcuacaaccaucauuacaaaaaaccaggauauaacggcucaugcuucaacguggaaauuaagcgcaacgacgaucucagcuggcuuuggaacgaguccacagcacuguaucccagcaucuacuugaauacucagcagucaccaguggcugcuacgcucuaugugcggaaccgggugagagaagcuauucgcgugaguaagauacccgaugcaaaaagcccacugcccguauuugcguacacaaggaucguauuuacagaucagguucugaaguuccuuagccaggaugaguugguguacaccuucggagaaacagucgcauuaggcgcuucuggcaucguuauauggggaacacugagcaucaugaggucuaugaaaagcugccucuugcuggauaacuacauggaaaccauucugaacccauauauuaucaaugugacacucgcugccaaaaugugcagucagguuuuaugucaggagcagggggugugcauuagaaagaauuggaacuccucugacuaucuucaucuuaacccagauaacuucgcuauccaguuagagaagggugguaaguuuaccgugcgcggcaagcccacucucgaggacuuggagcaguuuagcgagaaauucuacuguucauguuauucaacacugucauguaaggagaaagccgacgugaaggauaccgacgcuguagauguguguauugccgacggggucuguaucgaugcuuuccucaaaccaccgauggaaacugaggagccgcagaucuuuuacaacgcaucucccucuacacuguccgccaccauguuuauugucucuauccuguuucucauuaucuccuccguagcaucccuuuag

SEQ ID NO: 5049 - RNA, 1530 nt, Artificial Sequence
  Description of Artificial Sequence: Synthetic coding sequence
augggggugcugaaguucaaacauaucuuuuucagguccuucgucaaguccucuggcgugucacagaucgucuucacguuccugcucauuccaugcugcuuaacucugaacuuucgcgcaccaccuguaauuccuaacgugccguuccuuugggccuggaacgcaccaucggaguucugccuggggaaauucgaugaaccacucgacaugucacuuuucagcuuuaucgguagucccagaaucaacgcaacaggacagggggucaccauauucuacgucgauagacugggcuauuaucccuacaucgauagcaucacgggcguuaccguuaauggcggaaucccucagaagaucucucuucaggaucaucucgauaaagccaagaaagacauuacauuuuauaugccagucgauaaccuugguauggcagugauagacugggaagaauggcgcccuaccugggcucggaacuggaagccgaaggacguguauaagaaucgaucaauugaacugguccagcagcaaaauguccaguuaagccugacggaagccaccgagaaggcaaaacaggaguuugaaaaggccgguaaagauuuucugguugagaccaucaaguuggggaagcuucugaggccaaaucaccugugggguuacuaccuuuucccugauugcuauaaccaucacuacaagaaaccaggcuacaauggcagcugcuuuaaugucgaaauuaaacgaaacgaugacuugucguggcuguggaacgagagcaccgcuuuguauccuucuaucuaccugaauacccagcagucccccgucgccgcaaccuuauauguacggaaccgcguccgagaggcaauucgggugagcaagauucccgacgccaagagcccgcugccuguuuucgccuacacccgcaucguguucacggaucagguacucaaauuccuaucccaggacgagcucguguacacauucggggaaacuguggcacugggggcgucuggaauugugauuuggggaacucugagcauaaugcguucgaugaaaucuugccuccuuuuagacaauuacauggagacaauccuaaauccguacauuaucaaugucacccuggcagccaaaauguguucacagguauuaugucaagaacaaggugucuguauccgcaagaacuggaauuccuccgauuauuugcaucugaaucccgauaauuuugccauacagcucgaaaaagggggcaaauuuacaguucgaggcaaaccuacccuggaggauuuggaacaauucuccgaaaaauuuuauuguucaugcuacucgacccucucaugcaaagaaaaagcagacguuaaggauacagaugcaguggauguguguaucgcugauggagucuguauugacgcuuucuuaaagcccccgauggagacggaagaaccucagauauucuauaaugcuagccccagcacccucucagccacaauguuuauaguguccauucuguuucuuaucauuagcagcguggcuucccuguag

SEQ ID NO: 5050 - RNA, 1764 nt, Artificial Sequence
  Description of Artificial Sequence: Synthetic coding sequence
augcccagauacggagcaucccuucgccagucaugccccagauccggacgagagcaggggcaagauggaaccgccggggcuccuggcuugcucuggaugggacuuguguuagcacucgcuuuggcccucgcucuggcucuggcucugucagacuccagaguguuaugggcuccagcugaggcacacccccugucuccccagggacaccccgcccgacuucaucggaucgucccucgauuacgggauguguuuggauggggcaauuuaacuuguccaauauguaaaggucuguucacagccaucaacuugggacucaagaaggaaccaaaugucgcaaggguuggcucagucgcgauuaaacuaugcaaucugcucaagaucgcccccccugccgugugccagagcauuguacaccuguuugaggacgacaugguggagguauggagacgcagcguacugucuccauccgaagcuugcggccugcucuuggguaguacaugcggucauugggauaucuucucaucauggaacauuucccucccaacugucccgaagccaccucccaaacccccaucuccccccgcaccuggcgcaccagugagccgaauucucuucuuaaccgaccuucauugggaucacgacuaccuugaaggaacagaccccgacugcgcggacccucucugcugccgccggggcuccggacugccgccugcgucacguccaggugcuggauacuggggagaauauaguaagugugaucucccccuaagaacccuagaaagucugcucuccggccugggaccugccggacccuuugacaugguguauuggacaggagacauucccgcucacgacgucuggcaucagacacggcaggaucagcuacgcgcgcugacuacugucacugcucuggugagaaaauuucugggaccggucccaguguaccccgccgucggcaaccaugagaguacgccuguuaacagcuucccaccaccuuucaucgaaggcaaucauucuagccggugguuauacgaggcuauggcgaaagcuugggagccauggcucccggccgaagcucuacgcacacuaagguaucugucgucgguggaaacacaggaggguaaacguaaaguacacauaaucggucacauaccacccggucacugccucaaaagcugguccuggaacuauuaucggauuguggccagguaugagaacacccuagccgcucaguuuuucggccauacccauguggaugaauuugagguauucuaugacgaggaaacacuaucucguccucuagcuguggcauuccucgcuccuucugcuaccacauauauuggguuaaacccaggcuaccgcguauaccagauagauggcaauuacucugggucaucucacguaguccuugaucacgagaccuauauccugaaucugacacaggccaacaucccgggugccaucccccacuggcaguuacucuaccgagcuagagaaaccuacgggcucccgaauacacugccaaccgcauggcacaaccuaguguaucgcaugagaggcgacaugcagcucuuccaaacauucugguucuuauaucauaaaggucauccaccauccgaaccaugcggaaccccaugcagacucgccacucuaugcgcccaacucuccgcucgugcagauuccccagcacugugcaggcauuugaugccagacgguucccugcccgaggcucagagcuuguggccaagacccuuguucugcuag

SEQ ID NO: 5051 - RNA, 1896 nt, Artificial Sequence
  Description of Artificial Sequence: Synthetic coding sequence
augccucgguauggcgcuucguugagacaguccugcccacgauccggcagggaacaaggccaggacggaacggcaggggcucccggguuacuuuggaugggacucgugcuggccuuagcucucgcacuggcauuagcacuggcacucucagacagucgugugcugugggcaccagcagaggcgcauccuuuauccccacaggggcaucccgcucgcuuacacaggauuguaccgagauuacgugacgucuucggauggggaaaucugaccugcccuauuugcaaaggacuguucacggcuauaaaccugggguugaaaaaagaaccaaacguagcucgggugggaucugucgccaucaagcugugcaauuuguuaaagauagcaccaccagccgugugucaaaguauugugcacuuguuugaagacgauaugguggagguguggcgccgaucgguccuuucuccuagcgaagcuuguggccugcuucuggggucuacgugcggucauugggacauuuucuccucuuggaacauuagucuaccaaccgucccaaagcccccccccaagccuccaucucccccagcaccuggcgcccccgugucuagaauucuguuccugacagacuugcacugggaucaugauuaccucgaggguacugaccccgacugcgccgacccucuaugcugucgccggggcucuggacugccaccagcaagccgccccggggccgguuacuggggggaauauucuaaaugcgaucugccacucaggacccuggagaguuugcugagcggccuggggccugcuggaccauucgacauggucuauuggacaggcgauauacccgcacaugacguguggcaccagacaaggcaggaucagcugagagcccuuaccacaguaacagcacucgugaggaaauuuuuaggaccugucccuguguacccugccguggguaaucacgaguccacucccgugaauagcuuuccaccaccauuuaucgagggcaaucauagcagucgauggcucuaugaagcaauggccaaggccugggagccauggcuccccgcugaggcccuucgcacccucaggauuggcggauuuuaugcucuuuccccuuacccgggauugcgccugauuagccucaauaugaacuuuugcagccgggagaauuucuggcuccuuauaaacagcacagaccccgcaggacaacuucaguggcuuguuggagaacugcaggcugccgaggaccggggugacaagguucauaucaucggacacaucccaccggggcacugccuaaaaagcugguccuggaacuauuauagaaucguggcuagguaugagaauacacuggcugcucaauuuuuuggccacacucauguugacgaauucgagguguucuaugacgaggaaacacucagcagacccuuggcugucgcauuuuuggcuccauccgccacaacauacauuggccucaacccuggguacagaguguaccagaucgauggaaacuauaguggcuccucucacguggugcuugaccacgagacuuauauccugaaucuuacacaagccaauauaccuggggccauuccucauuggcaguugcuuuaucgagcucgcgaaacauacgggcuuccaaacacacugcccacugccuggcauaaucuaguauaccgcaugagaggagacaugcagcucuuucaaacuuucugguucuuauaccauaaagggcacccccccucagagccaugcggaacccccugccgccuggcaacauuaugcgcucagcuguccgcccgugccgauucucccgccuugugucgccauuugaugccugaugggagccuuccggaagcacagucccuguggccacguccucucuucuguuag

SEQ ID NO: 5052 - RNA, 1728 nt, Artificial Sequence
  Description of Artificial Sequence: Synthetic coding sequence
augcccagguacggagcuagccugcggcagucauguccaaggaguggccgagagcagggucaggacggaacagccggagcuccagguuuauuauggauggggcuggugcucgcccuggcuuuggcccuugcgcuagcucuggcuuugagugauagccggguucucugggccccagcggaggcacacccacugucaccucagggccauccugcuagauugcaucggaucguaccgaggcugcgggauguguuuggaugggggaaucuaaccuguccgaucugcaagggucuguuuaccgccaucaaccucggucuuaagaaggagcccaacguugcuaggguggggagcguggccauuaaacugugcaauuuacuuaagauagccccucccgccgugugccaguccaucgugcaucuguuugaggacgacaugguagagguguggcgaagaucgguucuuaguccgucugaagccugcgggcucuuacucgguagcaccuguggucauugggacauuuuuagcaguuggaauaucagccuucccacggugcccaaaccaccccccaaaccuccaagucccccagcuccuggagccccuguaucccgaauucuguucuugaccgaucugcauugggaccacgacuaccuggaagguaccgauccagacugcgcagaccccuuaugcugccgacgcgguucaggacugccacccgcaucucggccaggagcaggauauuggggcgaauauuccaagugugaccuaccccugcguacacucgagucuuuacuguccggacuaggucccgcaggcccauuugauaugguuuauuggaccggcgacaucccugcccaugacguguggcaucagacccgccaggaccaguugcgugccuugacaacagucacugcauuggugagaaaguuucucgggccugucccagucuaucccgccguggggaaccaugagucaacacccgucaauaguuuccccccuccuuuuaucgagggcaaucauagcagucgguggcuguaugaagcgauggccaaggcaugggaaccguggcuuccugccgaggccuuacguacucugcgcaaggugcauauaauaggccauaucccccccgggcauugucucaagucauggagcuggaauuauuaccgaauagucgcucgcuacgaaaauacacuugcugcucaguucuucggucauacccacgucgaugaguuugaaguuuucuaugacgaggaaacccuguccaggccucuagccguggccuuucuggcacccucugcaacgaccuauaucggccugaauccaggguacaggguguaucagauagauggcaacuauuccgggagcagucacguggugcuugaucaugaaacauauauucugaauuugacgcaggccaauaucccaggcgccauaccccacuggcaauuacuguaccgagcgcgcgaaaccuaugggcuccccaauacucugccaaccgccuggcacaaccugguguaccguaugcgcggcgacaugcaacucuuucaaacauucugguuccuuuaccauaagggccacccgccuagugagccaugugggacaccuugccgucuugccacacucugugcccaauugagcgcccgcgccgauucacccgcccugugccgccauuuaaugcccgauggaucccuccccgaagcucagagccuguggccuagaccuuuguuuugcuag

SEQ ID NO: 5053 - RNA, 1893 nt, Artificial Sequence
  Description of Artificial Sequence: Synthetic coding sequence
augccucguuacggagcaucacugaggcaguccugccccaggucuggccgggagcagggccaggacggaacugcaggugccccgggccuccuauggaugggucugguucuggcacuggcccuggcucuagcccucgcucuggcucucucugacagucgggugcugugggcaccugccgaggcacauccccucucuccacagggacauccagcacggcuccaucgcauuguuccccgccuucgagacguuuuuggcugggguaaucugacauguccuaucugcaagggcuuguucacugcuauuaauuuaggcuugaaagagccuaauguggcccgcguggggagcguagccaucaagcugugcaaucugcugaagaucgcccccccugcagucugccaguccaucguccaucuguucgaagacgacauggucgaaguguggaggcguagcguguugagcccauccgaagccugcggccuguuguuaggcucuacuugcggccauugggacaucuucuccucuuggaauauaucuuuaccaacggugcccaaaccucccccgaagccaccaagcccaccagccccaggcgcuccuguuuccagaauccuguuucugaccgaccuacauugggaccacgacuacuuggaggggaccgaucccgauugcgccgauccacugugcugccgccgggguagcggcuuacccccugcuucaaggcccggagcaggguacuggggggaauacucgaaaugcgaccuaccuuugaggacacuggaaucucugcucucuggcuugggaccugccggaccuuuugauaugguuuacuggacuggcgacauuccugcccaugauguguggcaucagacuaggcaggaucaacugagagccuuaacaaccguaaccgcccuggucaggaaauuccugggaccuguacccguuuauccugccguuggcaaccaugaaagcacacccgucaauucauuuccuccuccauucauugagggcaaccauuccucucguuggcuguaugaggcuauggccaaagcuugggagccgugguugcccgcugaagcacugcgcaccuugcguauugggggcuuuuacgcccuguccccuuaucccggccucagacugauuucccuuaacaugaacuucugcucgagggaaaacuuuugguugcuaauuaauagcacugaccccgccggacaauuacaauggcucguuggcgaacuucaggccgccgaggacagaggagauaaaguucacauuaucggccacauuccaccuggacauugccuuaagagcuggagcuggaacuacuaccguauuguugcuagguacgaaaauacgcuugccgcucaguuuuucggccauacucauguggacgaauucgagguauucuaugacgaggagacauuaucacggccgcucgcuguagcauuucucgccccaucugccacuacuuacaucggguugaacccaggcuaccgcguguaucagaucgacgggaacuacuccggaaguucgcacguugugcucgaccaugagaccuauauucugaaccugacacaggcuaacauuccaggagcaauaccacacuggcagcugcuauaccgugcgcgcgagacuuauggucuacccaauacuuugcccacugcauggcauaauuuggucuauaggaugaggggcgauaugcaacucuuucagacuuucugguuccuuuaucauaaaggccauccucccucggagccaugugggacaccgugcagacuggccacccucugugcccagcugagcgccagggcggauucuccagcacugugcaggcacuugaugccagauggaucucucccggaagcucaaucucuguggccgagaccucuguucuguuag

SEQ ID NO: 5054 - RNA, 1101 nt, Artificial Sequence
  Description of Artificial Sequence: Synthetic coding sequence
augccccguuacggugccucccuccgccaaaguugccccaggaguggccgagagcagggccaggauggcacugcuggugcgccaggacuccucuggaugggacugguacuggcccucgcccucgccuuggcguuggcucucgccuuaagcgauagcagggugcugugggccccagcugaagcucacccgcuuaguccccaaggccauccugcuaggcugcaccggauaguaccucgccuuagagauguguucggcuggggaaaccucacgugcccuauauguaagggacucuuuacugcgaucaaucugggacugaagaaggaaccgaauguagccaggguuggcucuguagcaaucaaguuaugcaaucuacucaagauugccccccccgcugugugucagucgaucgugcaucuguuugaagacgacaugguggaaguguggcgucguucagugcugucucccucugaagccugcggucugcugcuagggucaacaugugggcauugggauaucuucuccuccuggaacaucucucugccuaccgugcccaagccgccgcccaagcccccaucucccccugcaccaggagcuccuguaagcagaauccucuuuuugacagaucuucauugggaucacgauuaccuagagggaacagauccugacugcgcagauccucucuguugcagacgcggaaguggcuugccucccgcaagucgaccaggagccggcuauuggggcgaauacucuaaaugcgacuugccucucaggacccucgagucacuguuaagcggucuuggcccagcggggccauuugacaugguguauuggaccggugauauucccgcucacgacguuuggcaucagacucggcaagaccagcugcgcgcccuuacuaccguaaccgcucugguucgcaaguuucuuggcccggugcccguguaccccgcuguaggcaaucacgaauccacccccgugaacucauuucccccuccauuuaucgaaggcaaccacaguaguagauggcucuaugaagcaauggccaaagccugggagccuugguuacccgcagaagcucuucgcacccugagaugcauuuag

SEQ ID NO: 5055 - RNA, 1209 nt, Artificial Sequence
  Description of Artificial Sequence: Synthetic coding sequence
augccccgguacggugcuucccuccgccagucauguccaagaagcggccgcgagcaggggcaggauggaacagcaggcgcaccugggcugcucuggauggggcucguucucgccuuagcccuggcacuggcucuagcuuuagcccuguccgauucacgcguccugugggcgcccgccgaagcacacccucuuucaccacaggggcaccccgcacgacuacaucgcauaguuccgcgucuacgggacgucuucgguuggggcaauuugacgugcccaauuugcaagggccuuuucacagcuaucaaccuuggauuaaagaaagaacccaauguugcuagaguuggcucuguggccauuaaguuguguaaccuguuaaaaaucgcucccccagccgucugucagucaaucgugcaucucuuugaggacgacaugguagaaguguggagaagaucuguacuguccccaagugaggccugcggccuccuucucgggagcacuugcggacauugggauauauucucaagcuggaauaucucucucccaacaguucccaagccuccccccaaacccccuucuccuccagcccccggcgcucccgugagccguauccuguuccugaccgaccuucauugggaccacgacuaucuggaagggacagaccccgauugugcugacccgcuguguugccgcaggggcuccgggcucccaccugcaagucggccaggugcaggguacuggggagaguacucuaagugugaucugccccucaggacccuggaaucccugcugucuggccucggcccagccgggccauuugacaugguguacuggacuggcgacauucccgcucacgacgucuggcaucaaacccgacaggaccaacugcgcgccuugacuacuguaaccgcccucguccguaaauuccugggaccaguuccugucuaucccgccgucggaaaucaugaaagcacucccgugaauaguuuucccccccccuuuaucgagggcaaccacuccucacggugguuguacgaagcgauggccaaggcuugggagccauggcuuccugcagaggcucugagaacccuucgguaucugucauccguagagacacaggaagggaaacgcaagaauuggggaguacugugcagcuuuccgauuccccggagcccgccacauuugagccaauacgaauuuuuguucccuuag

SEQ ID NO: 5056 - RNA, 1062 nt, Artificial Sequence
  Description of Artificial Sequence: Synthetic coding sequence
auggagcucaccgagcugcugcuuguggucaugcuucugcugacagccagacugacccugucaucccccgcuccgccagccugugaucugcgcguacugagcaaacugcucagagauagccauguacugcauucuagauugagccaauguccagaggugcauccacuuccaacgcccguucuucuccccgcugucgauuuuucucugggagaauggaagacccagauggaagagaccaaggcccaggauauucugggagccguuacccucuuacuugaaggagugauggcugcaaggggucagcuugguccuacaugucucucaagccugcucggccagcucucaggucagguccgguuauuacuuggagcacugcagagccugcuaggcacacagcugccaccacagggccggaccaccgcacacaaagauccuaaugcuauauucuuaucauuucagcaucugcuaaggggaaaggugcgcuuccuaaugcuggugggggguaguacccucugcgugcgucgcgcccccccuaccacugcagugccaagccgcacuagccuuguguugacacugaacgaacuaccaaaucgcacaagcggucuuuuggagaccaauuuuacagcuagcgcuagaacaacaggauccgggcuucucaaauggcagcagggcuuccgcgcuaaaauccccggccuccugaaucaaacaaguagaucuuuggaccagauuccgggcuaucugaauagaauacacgaacuucuuaaugguacccggggacucuucccggguccuagucgcagaacccuuggugcaccugauauuucuuccggcacuucagauacgggaaguuugcccccuaaccugcagcccggauauagccccucaccaacccaucccccuacuggucaguauacucuguuuccguugccacccacccuuccaacucccgucguucagcugcauccacuacuuccggaucccuccgcucccaccccaaccccaacaucuccuuuauugaauacauccuacacucacucacagaaucugagucaggaaggcuag

SEQ ID NO: 5057 - RNA, 945 nt, Artificial Sequence
  Description of Artificial Sequence: Synthetic coding sequence
auggaacuuacugagcuacuccuuguagucaugcuguugcuuacagcccggcugacacugagcagccccgccccuccugccugugaccuccguguauuaagcaagcucuugagggauagccacgugcuccacagucggcuuucccaauguccggaagugcacccucugccaaccccagucuuguugccggccguagacuucagucuaggcgaauggaagacccagauggaggagacgaaagcucaagauauccuaggggcagugacucuauuacucgaaggcgucauggcagcaagagggcaacucggacccaccugccuuucaucucuucugggccagcuaagugggcaggugagauugcuguuaggagcgcugcaaucauuacucggaacccagcucccaccucagggacggacaacggcccacaaggaucccaacgcuauauuucuuucuuuucaacaccugcuccgagggaagacaagcggauuguuggagacuaacuucacagcuagugcuagaaccaccggaucuggacuuuuaaaauggcaacaaggauuccgcgccaaaauuccuggccugcucaaucagaccucccguaguuuagaucagaucccuggguaccuaaaccggauccacgagcuucugaacggcacucguggacuguuucccgggccgagucgcaggacacucggggcgcccgacaucagcagcgggaccagcgacacagggucucucccgcccaaccuccaaccggguuauagcccaucaccgacacauccacccaccggucaguauacacucuuuccucuucccccuacacuccccacgccuguugugcaacuccacccccucuuacccgauccaucugcaccuacuccuacuccaaccucuccucuucugaauacuuccuacacccauagccagaauuugucgcaggagggauag

SEQ ID NO: 5058 - RNA, 861 nt, Artificial Sequence
  Description of Artificial Sequence: Synthetic coding sequence
auggaguugaccgaacuccuuuuaguugucaugcuccugcuuaccgcaagauuaacacugucuucacccgcaccgccugcaugcgaucugcgcgugcuauccaaauuacugagggauucucacgugcugcauucaagacugucgcagugccccgaaguccauccccuaccuacuccuguguugcugccagcaguagacuuuagccugggggaauggaagacccagauggaagagacaaaagcacaggacauucuaggagcggugacgcugcugcuagaaggcguuauggccgcccguggccaguugggccccaccugcuuguccagccuccuggggcaacucucaggacagguacgccuccuacugggugcucugcaaucgcugcucgggacccagcuuccuccccagggcagaacaacagcccacaaagacccuaacgcuauauucuugucuuuucagcacuuacuccgcggcaaggacuucuggaucgugggcgauaagcugcauugucuaagccagaauuacuggcugugggcaucugaaguugccgcaggcauucagucccaggacucuuggagugcugaacccaaucugcaagugcccggccccaacccacgaauccccgagcaggauacgcgaacucucgaguggaauucauggacccuuucguggacacugacacaggauccacggucuccuggacauuuccuacguaacauuaggcacagacuaccugccacccaaccgccugcauggaucuucucuuuucccaacccgucaaguuacuggaccguguacgcacugccaucaucaacacaccucgcccacccuugugggcccgccccaccaccugccucauag

SEQ ID NO: 5059 - RNA, 1050 nt, Artificial Sequence
  Description of Artificial Sequence: Synthetic coding sequence
auggagcucacggagcugcugcuuguagucauguuacugcucaccgcgaggcuuacacucucaaguccugccccaccugccugugaucuucggguacuuaguaagcuccugagagauucccacguucugcauucaaggcucucacagugcccagaaguacacccauuaccuacaccaguguuacugcccgccguggacuuuucgcucggggaauggaagacccagauggaagagaccaaggcccaagauauccugggugccgugacccugcugcucgaaggcgugauggcagcaagaggacagcugggcccuacaugccugaguaguuugcugggccaacucuccgggcaggugagacugcugcucggcgcccugcagucccucuuaggaacccagggacguacuacugcgcacaaagacccuaacgcgauuuuuuuaucauuccagcaucugcuccguggcaagguuagauuccuaaugcuagugggcggcaguacacucugugugcggagggccccuccuaccaccgccgugccgucacgcaccagucucgugcuuacacucaacgaacucccuaacagaacauccggccugcucgaaacaaauuuuacggcuucugcuaggacaacgggauccggcuuauugaaguggcagcagggcuucagggccaaaauacccggacuccucaaccaaacaucacgcagucuggaucagauccccggcuaccuaaaccggauccaugagcuccugaauggcacaagaggcuuauuucccggaccuuccaggaggacccucggugcuccugacauauccuccggcaccuccgauaccgggucucugccccccaaucugcagcccgguuacucucccuccccaacccacccgccgacaggccaguacacccuuuucccacugccuccaaccuuaccgacccccguugugcaacugcauccauugcugccagacccaagugcaccaaccccuacaccaacaucuccuuuacugaauacguccuauacccacucucagaauuuaucccaggaggguuag

SEQ ID NO: 5060 - RNA, 1239 nt, Artificial Sequence
  Description of Artificial Sequence: Synthetic coding sequence
augaagaugcaccugcagagggcccuaguuguuuuggcccugcucaauuuugcuacugugagucuuagccugagcacuugcaccacgcuggacuuuggccauauuaaaaaaaagagggucgaggcaauccgaggccagauccucucuaaauugaggcuaaccucccccccugaaccaacagugaugacccacgucccauaccaggugcuggcucuauacaauagcacgagggaacugcuggaggaaaugcauggggagagagaagaaggcugcacccaggagaacaccgagagcgaauauuacgcuaaggagauacacaaauuugauaugauacagggucucgcugagcacaaugaacucgccgugugccccaagggcauuacuuccaaagucuucagguuuaauguuagcucaguggagaagaauagaaccaaccucuucagggccgaguuuaggguacugcgcgugcccaauccguccuccaagcgcaaugagcagaggauagaacucuuccaaauucuucgcccggaugaacauaucgccaagcagcguuauaucggggguaagaaucucccaacgagaggcacagcagaauggcuuuccuuugaugugaccgauacuguccgugagugguuacuaagacgcgagucuaauuugggacuggaaaucaguauacauugucccugccacacauuccaacccaauggagauauucucgagaauauucacgaggugauggagauuaaauuuaagggcgucgacaacgaggaugaccacggaagaggcgaccuuggccggcuaaagaaacagaaagaucaccauaauccacauuugauucuuaugaugauucccccccaucgacuugauaacccuggacaaggaggccaaaggaaaaagagagccuuggauacaaacuauuguuucagaaaucuugaagagaauugcugcgugaggccccuuuacauugauuuuaggcaggauuugggguggaaguggguacaugagccuaaaggauauuacgcgaauuucugcagcggcccuugucccuaccugcggagcgccgacacgacccacagcaccgugcuagggcuuuauaauacccugaaucccgaggcuagugcauccccauguugcgugccucaggaccuggaaccucugaccauccuuuauuacguaggcagaacuccuaagguggagcagcuuagcaauaugguuguaaaaaguuguaaauguagcuag

SEQ ID NO: 5061 - RNA, 930 nt, Artificial Sequence
  Description of Artificial Sequence: Synthetic coding sequence
augaaaaugcacuugcagcgggccuuaguugugcuugcucuacugaacuuugccacggucucgcugagccugucaaccugcaccacccuggacuuugggcacaucaaaaagaaacgcgucgaggcgauccgagggcagauccuuagcaagcuccgucugacaucuccuccagaacccacagucaugacucacgugccuuaucaagugcuagcacucuacaacuccaccagagaacuacucgaggaaaugcacggcgaacgugaagaagggugcacccaagaaaauacggaauccgaguacuaugcaaaagagauacauaaauuugacaugauucagggacuggccgagcacaacgagcuugcaguuugcccaaagggcauaaccaguaaagucuucagauucaacgugagcagcguggagaaaaaccggaccaaucuuuucagggccgaguuuagaguccuuagagucccaaacccaucaucaaagcggaacgagcagagaauugaacucuuccagauucuccggcccgaugaacacauugcaaagcaacgcuacauaggaggcaaaaaccugcccacaagaggaacagccgaguggcucagcuuugacgugacagauacagugcgcgaauggcuucuacgcagggaaucaaauuugggacuggaaaucuccauacauugcccuugucauacauuucaacccaacggcgacauacucgaaaauauacacgaagucauggagauuaaguucaagggaguagauaacgaggaugaccauggaagaggagacuugggacgguugaagaagcaaaaggaucaccacaacccccaccugaucuugaugaugauucccccccauagacucgauaauccuggucagggcggacagaggaagaaaagagcucuggauacuaacuacuguuucagguag

SEQ ID NO: 5062 - RNA, 996 nt, Artificial Sequence
  Description of Artificial Sequence: Synthetic coding sequence
augaacggcacccgaaacugguguacccugguggauguccauccugaggaucaagccgcggucuaccucaaggguaggaguggggauaaaaugauccacgaaaagaacauaaaccagcugaagucugagguucaguacauucaagaggcccguaacugucuccaaaagcuccgugaagacauaagcuccaagcuagaccgaaaucugggagacuccuugcaccggcaggaaauucaggucgugcuggaaaagccaaacggguucagucaaucuccaacugccuuguacagcagcccuccugaaguggacaccuguauuaacgaggacguggagucgcugagaaaaacagugcaggaccuucuggccaagcugcaagaagccaaaaggcagcaccaaagcgacuguguugccuuugaagugacccucagccgcuaccagagggaagccgaacagaguaauguugcccuucaacgggaagaggaccgcguugaacaaaaagaggccgaaguaggcgagcugcaacggaggcuguuggggauggagacggagcaucaggcauuauuagccaaagugcgggaaggggaaguggcauuagaagaauuaagaucaaauaacgcugacugccaggcugaacgugagaaggccgcaacacuagagaaggaaguagccgguuugagggaaaagauacaccauuuagacgacaugcugaagucgcaacagagaaaagugagacagaugaucgagcaacugcagaauuccaaagccgugauccagucaaaggacgcaacuauucaagaacugaaggagaaaauugccuacuuagaagccgaaaaucuugagaugcacgaccggauggagcaucugauugaaaaacagaucagccauggcaauuuuucgacccaagcacgcgccaagacggagaaucccggcagcauucggaucucuaagccuccaagcccuaaaccuaugccagugaucagaguugucgagacuuag

SEQ ID NO: 5063 - RNA, 1098 nt, Artificial Sequence
  Description of Artificial Sequence: Synthetic coding sequence
augaacggcacuagaaacugguguacacugguggacguccacccggaggaccaggccgcugcaggcaggaagacauacgcuauggugucuagucacucagcuggccacagucucgcauccgaauuagucgaaagucaugacggacacgaagagaucauaaagguguacuugaaggggcgcucuggcgacaaaaugauucacgaaaagaauaucaaccagcucaagucagagguccaauacauacaggaagcaaggaacugucuacagaagcuaagagaggacauuucuaguaagcuggaccgcaaucugggagacagcuugcaucgacaggagauccaggucguguuggagaagcccaauggauucagucagagcccuaccgccuuauacaguuccccccccgagguugacaccugcauuaaugaggauguggagucccugcgcaaaaccguccaggauuuacuggccaaacuacaagaggccaaaaggcagcaccagucagacugcgucgccuuugaagugacacugagccgcuaccagcgagaagccgagcaauccaacguugcccugcaaagagaggaggaucgcguagaacaaaaggaagccgaagugggcgaguuacagcguagauuguugggcauggaaacugagcaccaagcacugcuugcaaaagucagggaaggcgagguggcccuugaggaacuuagaucuaacaacgcugauugccaagccgagcgugagaaagccgcgacccuggagaaagaaguugcugggcuccgggagaaaauccaccaucuggacgauaugcucaagucacagcagaggaaagugaggcaaaugauagagcagcuccagaauucaaaagcugugauucaguccaaagacgcgacaauucaggaauugaaggagaagaucgcuuacuuggaagcagaaaaucuugagaugcaugaucgaauggaacaccugaucgaaaagcagaucucucacgguaacuuuaguacccaggcuagggccaaaacugaaaaccccggcagcauaaggaucuccaagcccccgucacccaagccaaugccagugauuagagugguagaaaccuag

SEQ ID NO: 5064 - RNA, 1173 nt, Artificial Sequence
  Description of Artificial Sequence: Synthetic coding sequence
augaacggaacuagaaauuggugcacccuaguggacgugcauccagaggaccaagccgcagguagcguggacauucuaagacugacucuucagggcgaguuaaccggggacgaguuggagcauauugcccagaaggccggacgcaaaacauacgcuauggugucgagucacagcgcaggccacaguuuagcuagugaacuugucgaaagucaugacgggcacgaggagauaauaaagguguauuuaaaaggccguuccggggauaagaugauccacgagaagaacauuaaucagcugaagagugaaguacaguacauucaggaagccagaaauugccuacagaaacuccgggaggauaucucuuccaagcuggacaggaaccugggggacagucugcacagacaagaaauucaggucguucuggagaaaccuaauggcuucagucagucacccacagcgcuuuacucaucccccccugaggucgauaccugcaucaaugaagacgucgagagcuugcgaaagacuguucaggaccucuuggccaaacuucaggaagccaaacggcagcaucaaucugacugcguggcauucgaagugacccugucuagguaucagagagaggcagaacaguccaacguagccuugcaaagggaggaggaccggguagaacagaaggaagccgaggugggcgagcuacaaaggcggcuacuagguauggaaaccgagcaccaggcucuccuagcuaaggucagggagggagaggucgcccuggaggaauugagaucaaauaaugccgacugucaagcagaaagggaaaaagccgcuacccuagaaaaggaagucgccggccugagggagaagauacaccaccucgacgacaugcugaaaucgcagcaacgaaaagugcgucagaugauugaacaguugcaaaacucuaaagcuguuauccaauccaaggaugcgaccauccaggaacugaaggagaaaauugcauaccucgaggcagaaaauuuggaaaugcacgaccgcauggaacaucugauugagaagcaaaucucccacggcaauuucaguacccaggcccgugcuaagacugagaaccccggcaguauuaggauuucuaaaccucccaguccaaaaccgaugcccgucaucagaguuguggagacuuag

SEQ ID NO: 5065 - RNA, 600 nt, Artificial Sequence
  Description of Artificial Sequence: Synthetic coding sequence
augaacggaacgaggaacugguguacucuuguggauguccaccccgaagaucaggccgcugccgggcggaaaacuuacgcgaugguuucaucccauucugcuggucauagccuggcauccgagcucguugaaucucaugacggccacgaggagauuauuaaaguguauuugaagggcagauccggugauaaaaugauacaugaaaaaaauaucaaucagcugaaaucagaagugcaguauauccaggaagcucgaaauugucugcagaaacugagagaggauauuaguagcaagcuggaccgcaaucugggggacucccuucauagacaagaaauccagguggugcucgagaaaccaaauggguuuucucagucgccaacagccuuguacucaucuccgccagaggucgacacauguauuaaugaggacguugagagccuucgcaaaacgguucaagaucugcuggcaaaguuacaggaggcuaagcggcagcaccagucugacugugucgcuuuugaagucacguugucacgcuaccaacgcgaggcagagcaaaguaacguagcgcuucagagagaggaggauagguguccagaauag

SEQ ID NO: 5066 - RNA, 1230 nt, Artificial Sequence
  Description of Artificial Sequence: Synthetic coding sequence
augaguuccccagguaugacgagcuugcagcuggaaaaggaagagugcaugcagugcguaccuugcuccccuagaacccgaguggccuuauuggaacuguauagggccaugugucaggggucgguugacauuuuaagguugacuuuacagggggaacugacuggcgacgaguuagaacauauugcacagaaggcugggagaaagacauacgcaaugguguccagucauuccgccggacauucucuggcgucugagcugguagaaagccacgaugggcacgaggaaauaauuaaggucuaucugaagggaaggagcggcgacaaaaugauacacgagaaaaauaucaaucaauugaagagcgaagugcaauacauccaggaggcucgaaacugcuugcagaaacuuagagaagacaucuccucaaagcuagaccguaacuuaggugauucccuucacagacaagagauccaaguugugcuggaaaaacccaacggcuuuagccagagccccaccgcacuguauagcucuccccccgagguugacaccuguaucaaugaggacguggagagucugagaaagaccgugcaggaccugcuagccaaacuucaagaggcaaaacgucaacaccaaucagacugcguggcuuucgagguuaccuuaucaagauaccagcgggaagcagagcaguccaacguggccuugcaacgggaagaagaucgaguagaacagaaagaagcugagguuggcgagcugcaaagacggcuccugggaauggagaccgagcaucaggcucuacuagcuaaaguaagggagggugaaguggcucuggaggaguugaggucuaacaaugccgauugccaagcggagagggaaaaggcugcuacucuggaaaaagaaguagcaggguugagggaaaaaauccaccaccucgaugauaugcugaaaagccaacagcgaaaggugagacagaugauugagcagcugcagaauuccaaagccgugauccagucuaaggacgcuacuauacaggaguugaaggagaaaaucgcuuacuuggaagccgagaaccuggagaugcaugaccggauggagcaccuaaucgaaaaacagaucagucaugguaacuucagcacacaggcccgggcaaaaaccgaaaaucccggcucaauccgcauuucuaagcccccaucgccaaagccaaugcccgugaucagggucguugagacauag

SEQ ID NO: 5067 - RNA, 543 nt, Artificial Sequence
  Description of Artificial Sequence: Synthetic coding sequence
augaacggaacaaggaauuggugcacacuaguggaugugcauccagaggaccaagcugccgccggccguaagacuuacgcaauggucucaagucacucagccggccacucccuugcuuccgagcuaguggagucucacgauggccaugaggaaauaauuaaaguguaccuuaagggccgcuccggcgacaaaaugauucaugagaagaacaucaaucaguuaaaaucugaaguccaguauauucaagaggcccgaaacugucugcagaagcugcgugaagauauuuccaguaaacucgacagaaaccuuggcgacagcuugcaccgccaagagauccaagugguacuugagaaaccaaauggauuuucucaguccccuaccgcccuuaaagccggagauacggacguccaaagugacuggcgcaugucuugggggaacgaggucccuaguacgaauacagcccaguuucuggcaacuaauuguuuauucuuuuaucugcuccaccugcaaccgacccuuccauggccaccagcugaccgauag

SEQ ID NO: 5068 - RNA, 1182 nt, Artificial Sequence
  Description of Artificial Sequence: Synthetic coding sequence
auggaggaaccacagucagacccaagcguggaacccccccugagccaggagacauuuagugaccuuuggaaguuacuccccgagaacaacgugcucucaccccucccaagccaggcuauggaugaccugaugcucagccccgaugacaucgaacagugguucacggaagaucccgggccggaugaggcuccccguaugccggaagccgcacccccuguagccccugccccugccgcccccaccccagcugcucccgcgccagccccuuccuggccuuuauccagcucgguaccuucccagaagacuuaccaagguucauauggguuccggcucgguuuccugcauuccggcaccgccaagucaguuacuuguaccuacucccccgcuuugaauaaaauguuuugccagcuagcaaagacuugcccaguccaguuguggguggauucuaccccucccccugguacgcgcgugcgggcaauggcaaucuauaagcagagccagcacaugacugaggucguucggagaugcccccaccacgaacgauguagugacuccgacggccucgcccccccacagcaccucaucagagucgaggggaaccugagaguggaguauuuggaugauagaaacacuuuccgacacuccguggucgugccuuacgagccucccgaaguuggcagcgacugcaccacaauccauuauaacuauaugugcaacagcagcuguaugggcggaaugaaucggcgccccauccugacaauaauuacccuggaggauuccagcggaaauuugcugggacgcaauagcuucgaagugcggguaugugcuuguccuggcagagacagacgaaccgaggaagaaaaucuccguaaaaaaggcgaaccccaccaugaacuaccacccggaagcaccaaaagagccuugccaaacaauacgaguuccuccccccaaccuaagaaaaagccuuuggauggagaguacuuuacauugcagauucggggcagagagcguuucgagauguuuagggaacugaaugaggccuuggagcucaaggaugcgcaggccgggaaggagcccggcggcucucgcgcgcacagcagucaccuuaaaucuaaaaagggucaguccacgucuaggcacaagaaacuuauguucaaaaccgaaggcccugauagcgauuag

SEQ ID NO: 5069 - RNA, 1032 nt, Artificial Sequence
  Description of Artificial Sequence: Synthetic coding sequence
auggaagagccgcaauccgauccuaguguggaaccucccuugucccaggagacauuuucggaucuguggaaauugcugccugagaacaacguccuuagcccucuucccucccaggccauggaugaccuuaugcugagucccgacgauauagaacaaugguucacugaagauccaggaccagacgaggcaccccgaaugcccgaagcugcccccccuguugcccccgcgccagcugccccaaccccagcagcuccagcaccugcaccaagcuggccucugagcucuuccguuccuucacagaaaacguaucagggaucauauggcuuccgacucggguuccuccacuccggaacugccaagagcgugacuuguaccuauucacccgcacucaauaagauguuuugccagcucgcuaagacauguccugugcaacuauggguggacuccaccccaccaccaggcacaaggguccgggcuauggcaauauauaagcaaucccagcauaugaccgaggucguuaggaggugcccccaccacgaacgguguucagacuccgauggacuugcuccaccucagcaccugaucagaguagaggguaaucugaggguagaguaucuagaugaucgcaacaccuuucgccacuccgucgucgugcccuaugagccaccagagguuggauccgauugcaccaccauucacuauaauuacaugugcaacucuuccuguauggguggaaugaaccggcggccuauccucacuaucaucacucucgaggacagcucuggcaaccuucuuggacggaauuccuuugaggugagagugugcgcgugcccaggcagagaucgaagaaccgaggaggagaaccuacgcaagaaaggggagccacaccacgagcuuccaccaggaucuacuaagagagcucuacccaauaacacuucauccuccccgcagccgaagaaaaaaccucuggacggugaauacuucacauuacagaagacauuuccugcucggcacggcgggucacaccucuag

SEQ ID NO: 5070 - RNA, 1149 nt, Artificial Sequence
  Description of Artificial Sequence: Synthetic coding sequence
auggaggagccucaguccgacccuaguguggagcccccucuuagucaagaaacauucagugaucuguggaagcucuugccagagaacaauguucugucaccucuaccgucccaagccauggaugaccucaugcugagcccugacgauauagagcaaugguuuacagaggaucccggccccgaugaagccccaaggaugccagaggcugcacccccagucgcaccagcacccgccgcacccacaccagccgcccccgcucccgcaccaucuuggccacucucuaguuccgucccuagccaaaagacuuaucaaggaaguuacggcuuucggcucaccuguacauauucucccgcucugaauaaaauguucugucagcucgcgaagacauguccagugcaauuauggguggacagcaccccuccacccgguaccagaguucgggccauggcuaucuauaaacagucccagcauaugacggaaguggugagaagguguccccaccaugaacgcugcuccgauuccgauggcuuagcuccaccacaacaucuuauucgagucgaagguaacuugcguguggaguaccuugacgaccggaacacguuuagacacucggucguagugccuuacgagccccccgaagucggcagcgacugcacaaccauccauuauaacuacaugugcaacuccaguugcaugggcggaaugaaucggaggccaauccuuacgaucaucacucuggaagacucaaguggaaaccuucucggcagaaacaguuuugagguuagagugugcgccugcccaggaagagaucggcggaccgaggaggaaaaccuccgcaaaaagggugaaccucaccaugaguugccacccggcuccaccaagagagcccugcccaauaacacaucaucaagcccucagccaaagaaaaagccauuagacggcgaguauuuuacucuccaaauacgggggagagagagguucgaaauguuucgcgagcugaaugaagcccuggagcugaaggaugcccaggccgggaaagagcccggcggaucacgugcgcacaguucacaccugaaaagcaagaagggccagucaaccucccggcacaaaaaacuuauguucaaaacugaagggccagacagcgauuag

SEQ ID NO: 5071 - RNA, 858 nt, Artificial Sequence
  Description of Artificial Sequence: Synthetic coding sequence
auggaggagccucagucagacccaaguguggaaccuccacuaagccaagaaacauucucugacuuguggaagcuccugccugagaauaaugucuuguccccccugccuucacaagccauggaugaccuaaugcucuccccagaugacauugaacagugguuuaccgaggaccccgggcccgaugaagccccuaggaugccugaagcagcccccccuguugcaccugcaccggcagcuccaacgcccgccgcaccugcccccgccccuuccuggccacuuuccuccucaguuccaagccaaaagacauaucaggguucauacggcuucagacugggcuuucugcacuccgggaccgcuaagagugugaccuguaccuauagccccgcauugaacaagauguuuugucaguuagcuaagacaugcccagugcagcuuuggguagauaguacuccaccuccuggaacgcguguacgggccauggcuauauacaagcagucccaacacaugacagagguugucaggcgcugcccccaucacgagcggugcuccgauucggacggucucgccccgccucagcaucucauacggguggaagguaaucugcgcguggaguaucuugacgaucggaauaccuuucgccauagcgucguugugccuuaugaaccacccgagguaggaucugauuguacuacaauccauuacaauuacauguguaauucgucuugcaugggagggaugaaucggcguccaauucuuacuaucaucacccuggaggacucucggccccgucagguugaucacuuaagaagcggcguccaagacucauuagccaauaucgcgaagucccacuuguacuag

SEQ ID NO: 5072 - RNA, 273 nt, Artificial Sequence
  Description of Artificial Sequence: Synthetic coding sequence
auguuuugccaguuagcuaagaccugcccuguccagcuuuggguugauaguacgcccccacccgguacuagaguccgggccauggcaauuuacaagcagagccaacacaugacagaaguuguaagaagaugcccccaucacgaaagaugcagcgacucugacgggcuugccccuccgcagcaccuuauucggguagaagguaacuuaaggguggaauaccuugaugaucgcaacacuuuucgacauagcguggugucuggaagaagggguuag

SEQ ID NO: 5073 - RNA, 135 nt, Artificial Sequence
  Description of Artificial Sequence: Synthetic coding sequence
ccuuuaccaagccagcggaggaaucauuggauggaaaacauaagucccuucucccaccuuaaguccaagaaaggccaauccacuucacgucauaagaagcucauguuuaagaccgaaggaccagacucugacuag

SEQ ID NO: 5074 - RNA, 1026 nt, Artificial Sequence
  Description of Artificial Sequence: Synthetic coding sequence
auggaggagccucagucugaucccucuguugaaccaccccuuagucaggagaccuuuagcgaucuguggaaauuguuacccgagaauaacguacuuuccccucucccuucccaggcuauggaugaccucaugcugucccccgaugacauagagcagugguuuaccgaagauccaggcccagacgaagcaccucggaugccugaggcugcucccccuguggcaccugcucccgcggcucccacuccugcagcacccgcccccgcaccaucuuggccccugucaagcucaguccccagccaaaagaccuaucaaggauccuaugguuuuagguuaggauuccuucauuccggcaccgccaaaucugucacauguacauauagcccagcacucaacaagauguucugccagcuggcuaaaacuugcccaguccagcuguggguugacuccacccccccacccggaacacgcgugcgugccauggccauuuacaaacaaagccagcauaugaccgaagugguccguaggugcccccaucaugagcgcugcuccgacucagacggccuggccccaccccagcaucucauacgaguggaagggaaccugcgcguggaguaucuggacgacagaaacacuuuuagacauucagucgucguuccuuacgaaccuccugagguugguuccgacugcaccacuauacauuacaauuacauguguaauucuuccugcaugggcgggaugaacagaaggccuauccucaccaucaucacccuggaagacaguagugguaaucuguuaggcagaaacuccuuugaaguacgggugugcgccugcccaggucgggaucgccguaccgaggaggaaaaucuuaggaagaagggugagccacaucacgaauugccucccggauccacaaagcgcgcccuucccaacaauacaucaucuagcccccagcccaaaaaaaagccacuggauggggaguauuucacacugcaggaccagacauccuuucagaaagagaauuguuag

SEQ ID NO: 5075 - RNA, 1182 nt, Artificial Sequence
  Description of Artificial Sequence: Synthetic coding sequence
auggaggagccacaguccgauccuagugucgagccuccucugucucaagaaacuuuuucugaucuguggaaacugcugccugagaauaacguacugaguccuuugcccucacaagcaauggaugaucucaugcuaaguccagacgauaucgagcagugguuuacggaagacccaggaccagacgaagccccucguaugccggaggcugcaccaccuguugccccagcgccggcugccccuacaccugccgccccagcuccagccccauccuggccccuuuccuccucaguacccagucagaagacuuaucaagguucuuauggcuuucgccugggauuccugcacucugggaccgcaaaaagcgugaccugcacuuacagucccgcacuuaauaaaauguuuugccaacuugcgaaaacuuguccuguucaauuguggguugauagcacuccuccucccggcaccagaguacgcgcuauggcaauuuacaagcagucucaacauaugaccgaggucguucgccgaugcccucaccacgagagauguuccgauucggauggccucgcuccaccacagcacuugauucgagucgaagguaaccucaggguugaauaucuggacgauaggaauacuuuuaggcauucugugguugucccauacgagccuccggaaguugguucagacugcacgaccauccauuacaauuacaugugcaacagcuccuguaugggcgggaugaaccggcgcccgauucucacaauuaucacauuggaggauuccagcggcaaucuccucggacggaauaguuuugagguuagagucugugcaugccccgggcgugaccgccgcaccgaggaagagaaccugaggaaaaagggggagccucaccacgaacuuccaccaggcucuaccaaacgggcucugccaaauaauacaagcagcucaccucagccaaagaagaagccucuggacggcgaguacuuuacacuccaaauacgugggcgugagcgcuucgaaauguucagagagcugaacgaagcccuugagcugaaggaugcgcaggcaggaaaggagccuggcgguucuagagcccacaguucacauuuaaaauccaaaaagggccagucuaccuccagacacaagaaacucauguuuaaaacugaggguccagauagcgauuag

SEQ ID NO: 5076 - RNA, 1041 nt, Artificial Sequence
  Description of Artificial Sequence: Synthetic coding sequence
auggaagagccacaguccgacccuaguguggaaccaccucucucucaggaaaccuucagugaucucuggaaguuacugcccgagaacaacgugcuuuccccuuuacccucccaagcuauggaugaucugaugcucagcccagaugacaucgaacagugguucacggaagauccuggacccgacgaggcccccaggaugcccgaagcugcuccacccgucgccccagcuccagcugcccccacaccggccgcaccagccccagcaccaagcuggccgcugucuaguucaguaccaucgcagaaaacauaucaggggucguacggcuuuagacuggguuuuuuacauuccggcacagcgaagucaguuacaugcacuuacaguccugcucuaaauaagauguucugucaacuugcaaagacuugcccugugcagcucugggucgacaguacccccccaccaggaacacgagugcgugcuauggcuaucuauaagcagucgcagcauaugacugaggugguccgccgcugcccucaccacgagcguuguuccgauucagauggccuugcuccuccgcagcauuuaauaagaguggaggggaacuuacgaguggaauacuuagacgaucgcaauaccuuccggcacucgguuguugugcccuaugaaccaccggaggucggaagcgauuguaccacaauacacuauaacuacaugugcaacagcagcuguauggggggcaugaacaggcgucccauccugaccaucaucacccucgaagauagcuccggcaaucuccucggacggaauagcuuugagguucgcgugugugcuugucccggaagagacagaagaacugaggaggaaaaucuccgcaagaaaggcgaaccccaucaugaacuucccccuggaucaaccaagagagcccuacccaauaacaccaguagcuccccucaaccaaaaaaaaaaccccuugauggagaauauuuuaccuugcagaugcuauuagaccuuagaugguguuacuuccugaucaauucaucguag

SEQ ID NO: 5077 - RNA, 387 nt, Artificial Sequence
  Description of Artificial Sequence: Synthetic coding sequence
auggaggagccucaaagcgaccccuccguggagccaccccugucacaggagaccuuuucagaucuguggaaauugcugcccgaaaauaaugugcucucaccccugccgucucaggcaauggaugacuugaugcugagccccgaugacaucgagcaaugguucaccgaagacccaggaccugacgaagcaccacgaaugccugaagcugcuccuccagucgccccugcacccgccgcccccacucccgcagcccccgcuccugccccaucauggccacugagcaguagugucccaucccaaaagaccuaucaggguuccuacggauuucggcugggauuucugcacagcggcaccgcuaaauccguuacauguacauacucaccauag

SEQ ID NO: 5078 - RNA, 498 nt, Artificial Sequence
  Description of Artificial Sequence: Synthetic coding sequence
auggaagagccccaauccgauccaucagucgagccccccuugucacaggagacguucagugaccuguggaaacuguugccggagaacaaugugcugaguccccuaccaagucaagcuauggaugaucugaugcugucgccugaugacaucgaacagugguuuacagaggauccaggacccgaugaagcuccccgaaugcccgaggcagccccucccgucgcuccugcaccugcugccccuacaccugcugcccccgcuccagcucccuccuggccucugucguccaguguccccucacaaaaaaccuaccaaggcaguuacggcuuccgccugggauuuuugcauucgggcacugcaaaaucuguaacuugcaccuacuccccugcucugaacaaaauguuuugucaacuugccaaaacguguccgguccaacuuuggguugauuccacaccaccccccgguaccaggguccgagccauggcaaucuauaagcaauag

SEQ ID NO: 5079 - RNA, 600 nt, Artificial Sequence
  Description of Artificial Sequence: Synthetic coding sequence
auguuuugucagcuggcaaaaacuugccccguacaguuauggguggauucaacuccucccccuggcacacgugucagggccauggcaauauauaagcagagccagcacaugaccgagguugucagacgcuguccacaccacgagcgcuguuccgacucagauggacuugcccccccccaacaccugauacggguagaggguaacuuaaggguggaguaucuugacgauagaaacaccuucaggcacagcguuguugugcccuaugaacccccugaaguggggucugacuguaccaccauccacuauaauuauauguguaacaguucuugcaugggcggaaugaaccgccgaccuauccuaacgaucaucacacuugaagauagcuccggcaaucucuuaggaagaaacuccuucgaaguucgaguuugugcgugcccuggacgggauagaagaacagaagaggaaaaccucagaaaaaagggcgaaccacaucaugagcuuccuccugguuccacuaaacgagcccucccgaauaacacaucuuccaguccucagccgaaaaagaaaccccuggacggagaguacuuuacacuccaguag

SEQ ID NO: 5080 - RNA, 468 nt, Artificial Sequence
  Description of Artificial Sequence: Synthetic coding sequence
auggaagagccccagagugacccuuccguggaacccccucuaucccaggaaaccuuuagcgaccuguggaagcucuuacccgaaaacaacgugcucuacucaccagcccuuaauaaaauguucugucaauuagcgaaaaccugcccaguacagcuguggguggacucaacaccaccccccgggacgagagugcgggccauggcgauauauaagcaaagucagcauaugacagaagugguccgucgcugcccccaccaugagcgauguagcgacucagauggacuggccccuccucagcaccugauccguguagagggcaacuuacgaguggaguaccuugaugauagaaauaccuuuagacacagcguagugguuccuuacgagccacccgaggugggcuccgauugcacgacuauucacuacaauuauauguguaacucuagcuguaugggugguaugaacagguag

SEQ ID NO: 5081 - RNA, 468 nt, Artificial Sequence
  Description of Artificial Sequence: Synthetic coding sequence
auggaggaaccgcagagugauccaucaguagaaccgccucugucucaggagaccuuuuccgaccuuuggaaacuguugcccgagaauaaugugcuguacaguccagcccuaaacaaaauguuuugccagcucgcuaaaacuuguccuguucaauuaugggucgauuccacccccccaccaggcacccgggugcgcgcaauggcaauuuauaaacaaagccaacacaugaccgagguggugaggagauguccccaccacgaacgcuguuccgauuccgauggacuagcuccaccccaacaucuaauuagaguugagggcaaucugagggucgaguaucuggacgaccguaacacauuccgacauagcguugugguaccuuaugagccuccugagguuggcagcgauugcaccaccauccauuacaacuacaugugcaacuccucauguauggguggcaugaacagauag

SEQ ID NO: 5082 - RNA, 1470 nt, Artificial Sequence
  Description of Artificial Sequence: Synthetic coding sequence
auggcaggucaaaggguccuguuacuggucggcuuccugcugccugguguccuuuuaagcgaggcagccaaaauacugacaauuucuaccgucgacuucaaaaaagaagagaaaagcuaccaggugaucaguuggcucgcuccagaagaccaucagcgagaauucaagaaaagcuucgacuucuuucucgaggagacacucggcgggcggggaaaguuugagaauuugcugaaugugcuggaguacuuagcccugcaguguucucacuuccucaauagaaaagauaucauggauagccuuaagaacgagaacuuugauaugguuaucguggagaccuucgacuacugccccuuucucauugccgagaagcuuggaaagccuuucguugcuauacuuuccacuucguucgguucccuugaauucgggcuacccauccccuuauccuauguccccguuuuccgaagccuccucaccgaccacauggacuucuggggacgcguaaagaacuuucucauguucuucaguuuuugccgucgucaacaacacaugcaguccaccuucgacaauacuaucaaagaacacuucacugaggguucacgccccgugcugagucaucuucugcugaaagcugagcugugguuuaucaauagugauuuugcauucgauuuugcucgcccgcucuugccaaauaccguguacguggguggccugauggagaaaccaauuaaacccgugccucaggacuuagagaacuuuauagcaaaauucggagauucaggauucguucugguuacccugggaucuaugguaaacacaugccagaaccccgagauauuuaaagaaaugaacaacgcguucgcccaccuuccucagggcgugaucuggaagugucaguguucccacuggccgaaggacgugcaccuggccgcaaaugugaaaauuguggacugguugccucagucagaccugcuugcccauccaucgauccgccucuuugugacccacgggggccagaauaguaucauggaggcuauacagcauggagugccuauggucgggaucccucucuuuggcgaccagccggaaaacaugguuagaguagaggccaaaaaguuuggugugucaauucagcugaaaaaacugaaagcugagaccuuggcccugaaaaugaagcagauaauggaggauaagagauacaaauccgccgcuguggccgcaagcguuaucuugcgcagucacccccucucacccacgcagcgccucgugggcuggauugaccauguccuccaaaccgggggcgcaacccaucuuaaacccuaugucuuucagcagccuuggcacgagcaguacuuacucgaugucuuuguguuccuguugggguugacauugggaacacucuggcuuugcgguaagcuucucggcauggcggucugguggcugcggggggcccggaaaguaaaggagacguag

SEQ ID NO: 5083 - RNA, 1572 nt, Artificial Sequence
  Description of Artificial Sequence: Synthetic coding sequence
auggcgggucaacgcguccuucuguuagugggguuuuuguuaccugggguccuuuuaucugaagcugccaagauccugacuaucuccacugucgguggcagucacuaccuccugauggacagagugagucaaauccugcaggaucauggacacaauguaacaaugcucaaccacaaacgagggcccuucaugccagacuucaaaaaagaggagaagaguuaucaggugaucaguugguuagccccugaagaucaucaaagagaauuuaagaagaguuuugacuuuuuccuggaagaaacucugggcggacgcggaaaguuugagaaccugcuuaauguuuuagaauauuuggcucugcagugcucccauuuucuuaaccggaaagacauuauggauucuuugaaaaacgagaacuuugacauggugauagucgaaacauuugacuacuguccauucuuaaucgcggagaaacuggguaagcccuuuguggcuauacucagcaccucauuugggucacucgaauucgggcugccgauaccccugucauauguaccuguguuccgaucacugcucaccgaucauauggauuuuugggggcgaguaaagaacuuccucauguuuuuuucuuuuugcaggaggcagcaacacaugcagucuacauuugauaacacaauuaaggagcacuuuacugagggcucgcggccugugcucucccauuuacugcugaaagcugaguuaugguucauuaauucugacuucgcuuuugauuuugcucggccccuccugccuaacacuguguacguggguggauugauggagaaaccaaucaagccuguuccccaggaucucgagaauuuuaucgcuaaauuuggagacucuggguuugugcucguaacccugggcaguauggugaauacuugccagaacccggaaaucuucaaggagaugaauaaugccuucgcccaccucccacaaggcgugauuuggaagugccaguguucucauuggcccaaagacguccaucuagccgccaacgucaagauuguagacuggcugccacagagugaucuccucgcccacccauccauccgacuguuugugacgcauggaggucaaaauucaauaauggaggcaauacaacacggugucccaaugguggguaucccuuuguuuggggaccagccugaaaauauggucaggguugaagcaaaaaaguuugggguuuccauccaacugaaaaaguuaaaggcugagacuuuagcgcucaaaaugaagcagauaauggaagacaaacgcuacaagagcgcagcaguggccgccuccgugauucugcggagucauccacuuagucccacccagcggcuggucggcuggaucgaucacguucuccaaacgggaggcgcuacacauuuaaagccguacguguuccagcaaccauggcaugagcaguaccuucuggacguauuuguuuuuuugcuuggccuuacauuggggacucuguggcugugcgguaagcugcucggaauggcagucuggugguugaggggcgcgcgcaagguuaaagaaacuuag

SEQ ID NO: 5084 - RNA, 417 nt, Artificial Sequence
  Description of Artificial Sequence: Synthetic coding sequence
auggcuggacaacggguacuucugcucguuggauuccugcugcccggaguccugcuauccgaagccgcaaagaucuugacaauuucaaccgugggcggcagccacuaccuccugauggacagggucucacaaauacugcaagaucauggacacaaugucaccauguuaaaccacaagcggggcccauuuaugccagacuuuaaaaaagaggaaaaguccuaucaaguuaucagcuggcucgcccccgaggaccaucaacgggaauuuaaaaagaguuucgacuucuuucuugaagaaacacuaggaggacggggcaaauucgaaaaccugcugaacguucuggaguaucuggcucuccaaugcagucacuuccugaauagaaaagauaucauggauagccuuaagaacgaaaacuag

SEQ ID NO: 5085 - RNA, 666 nt, Artificial Sequence
  Description of Artificial Sequence: Synthetic coding sequence
auggucaacacgugucagaacccagagauuuuuaaggaaaugaauaacgccuucgcccacuuaccccaaggcguuaucuggaagugccaguguucacacuggccaaaagacgugcaucuggccgcuaaugugaagauuguggacuggcugccucagagcgacuugcucgcacaucccucaauucgccuguucguuacgcacggcggacagaauagcaucauggaagccauucaacauggagugccaaugguagguauaccccucuucggagaccaacccgagaauauggucagaguggaggcgaaaaaguuuggagugucaauacaauugaagaagcucaaagcagagacacuggcucugaagaugaaacagaucauggaggacaagagauacaaaucagcugcuguagccgccucuguaauucugaggagccacccacucucucccacacagagacugguugguuggauagaucacguacuccagacgggaggcgccacccacuugaaaccuuaugucuuucagcaaccuuggcaugaacaauauuugcuggauguuuuuguguuucugcugggauuaacauugggaacccuguggcuguguggaaaacuccucggcauggcagugugguggcuccgcggagcacguaaaguaaaagaaacguag

SEQ ID NO: 5086 - RNA, 954 nt, Artificial Sequence
  Description of Artificial Sequence: Synthetic coding sequence
cugaccgaccgacagacagacacugcaccuagucccagcuaucaucugcucccuggacggagaagaaccgucgacgcugcugccucuagaggacagggccccgaaccagcccccgggggcggcguugagggggugggcgcucgagggguggcccucaaacuguucgugcaauugcugggcuguucacgguuuggaggggccguagugagggcaggggaagcagaaccuagcggcgccgcccguucagcuagcucaggacgugaagaaccgcaaccagaagaaggcgaggaggaggaagaaaaagaagaagagcgcggcccccaguggaggcugggagcgcggaaaccuggauccuggacuggcgaggcugcagucugcgccgacagugcccccgcugccagggcaccucaggcacuggcccgggcaagcgggagagggggccggguugcccgucgcggggccgaagaguccggcccaccucacuccccaucucggcggggaagugcuucacgcgcagggccagguagagcuucagaaaccaugaauuuccuacuuucuuggguucauuggucucucgcacuccugcuuuacuuacaucaugcuaaguggucccaggcugcuccgauggcugagggaggagggcagaaccaccaugaagugguuaaguuuauggauguguaccagcgguccuacugccacccaaucgagacacucguugacauuuuucaggaauauccagaugagauugaguauauuuucaagccuucaugugugccccucaugcgcugcggaggcuguugcaacgacgaaggccucgaaugcgugccuaccgaagagucaaacaucacaaugcagauuaugaggauuaaaccacaccagggccaacacaucggggagaugaguuucuugcagcauaacaagugcgagugcagaugugacaaaccccguagguag

SEQ ID NO: 5087 - RNA, 1239 nt, Artificial Sequence
  Description of Artificial Sequence: Synthetic coding sequence
cuaacugaucgucagaccgacacagcgcccucuccgucauaccaucuacugccaggccgcagaagaaccgucgaugccgcagcauccagaggacaggguccugagcccgcucccgggggaggcguugagggggucggagcucggggcguggcguugaagcuguucgugcagcugcucgguuguucccguuucgguggugcuguggugcgcgcaggggaggcagaaccuucuggagcagcuaggagugcuaguucuggccgggaagaaccacagccggaggaaggcgaagaagaagaggagaaggaggaagagcgcgguccccaguggagauugggugccagaaagccaggaaguuggacuggagaggcagcuguaugcgccgacagugccccagccgcaagggcuccucaggcauuagcucgggcaucagggcgcggcggaagaguggcuagacgcggagcugaggagucaggccccccucauucuccuucuaggcggggaagugccagccgagcgggccccggcagggcuucagagaccaugaauuuucuacuuagcuggguacauuggagccuggcacuucuccucuaucuccaccacgccaaguggucucaggccgccccaauggcggaaggcgguggccaaaaccaccacgaaguagugaaguuuauggaugucuaccagcguaguuacugucacccuaucgagaccuugguugauauuuuccaggaguaccccgaugagauagaauauauauucaagccuucaugcguuccgcugaugagaugugguggaugcuguaaugaugaggggcucgaauguguuccgaccgaggaguccaacaucacaaugcaaaucaugcggauaaagccacaccagggccagcauaucggggagaugagcuuccuccagcacaauaagugcgaguguaggccuaagaaagauagggcucggcaagaaaaaaaaucagucagaggcaagggcaaaggccagaagcggaaacgcaagaaaucccgcuauaaaagcuggagcgucuauguaggcgcuagauguugucugaugcccuggagucuaccagguccccacccaugugguccuuguucggagagaaggaagcacuuguucgugcaggacccacagaccuguaaauguagcuguaagaacaccgacucuagauguaaggcccggcaacuugagcugaaugagcggacaugucgcugcgacaaaccgcggagauag

SEQ ID NO: 5088 - RNA, 984 nt, Artificial Sequence
  Description of Artificial Sequence: Synthetic coding sequence
cucacagaccgccaaacagauacagcacccucaccguccuaucaccugcuaccgggucguagacgcacaguagaugcagcagccaguagggggcaggggcccgagcccgcuccugguggagguguggaaggugugggcgcuaggggcguugcccugaagcuauucgugcagcuucuuggcugcucacgauuugggggagccguagugcgcgcaggcgaggccgagcccuccggggccgcccggucagcuucaagcggacgggaagaaccacagccugaggagggugaggaggaggaagaaaaagaggaggagagaggcccccaauggaggcuaggcgcccggaaaccuggaucguggaccggugaagcugcuguaugcgcagauucugcuccugcugcccgggcgccccaagcgcuugcuagagcuagcggaagaggaggcagggucgcccggagaggggccgaggaaagcgguccaccucacucacccucucgucgugggucugcaagccgugcuggaccaggucgugcgagugaaaccaugaauuuccugcugagcugggugcauuggucucucgcuuuguugcuguaucuccaucaugccaaguggucucaagcggcucccauggcugaggggggcggccagaaccaccacgaaguugugaaguuuauggauguuuaucaaagaaguuacugccaucccauagagacccucgucgacaucuuucaggaguauccagaugagauagaauacauuuuuaagcccaguugcgugcccuugaugagaugcggcgguuguuguaacgacgaaggauuggaaugcguuccuacagaagagagcaauauuacuaugcaaauuaugcggaucaagccacaccaaggccaacauauaggggagaugucauuccuccaacacaacaaaugugaaugucggccaaaaaaagacagagcgcgucaagagaaaugugacaagccccgaagguag

SEQ ID NO: 5089 - RNA, 1116 nt, Artificial Sequence
  Description of Artificial Sequence: Synthetic coding sequence
cugaccgauaggcaaacagauaccgccccuuccccaucguaucacuuacugccaggucggcgccggaccguagacgcugccgcuucucgcgggcagggaccagaacccgcacccgggggcggaguggagggcgucggggcucgaggaguggcgcuaaaacuuuucguacaguugcugggauguagccgguucgggggcgccguugucagagccggggaggcagaaccuaguggggccgcccgcagugcaagcagcggaagggaagagccucagccagaggaaggagaggaggaggaagagaaggaagaagagagaggaccacaguggcggcugggagcaagaaagccaggcucuuggacaggggaagcugcaguuugcgcagacucggcaccugcggcaagggcaccacaagcccucgccagagccuccgggaggggagggagaguggcgcguaggggggcagaggaaagcgggcccccacacuccccuucacggcgcgggucugccagucgagcaggccccggcagggcaagcgagacaaugaacuuucuguugaguuggguccacuggucccuggcgcugcucuuguaucugcaccaugcaaaauggucccaggccgcaccuauggcggaaggcgguggucagaaccaccacgagguaguuaaguucauggacguauaucagcgcagcuacugucacccgaucgagacacucguagacaucuuucaggaauaccccgacgagaucgaauauauauuuaaaccaaguugcgucccucucaugaggugugguggaugcuguaaugaugaaggcuuggagugcguaccgacugaggagagcaauauuaccaugcagauuaugagaaucaaaccacaccaaggacagcacauaggagagaugagcuuucuacagcacaacaagugcgaaugcagacccaaaaaagaucgggcucgccaagagaacccguguggaccgugcucagaacgcagaaagcaucuuuucgugcaggacccucagaccuguaaaugcucauguaaaaacacagacucacgguguaaggcucgucagcucgaguugaaugagagaacaugucgcugcgauaagccucgucgcuag

SEQ ID NO: 5090 - RNA, 444 nt, Artificial Sequence
  Description of Artificial Sequence: Synthetic coding sequence
augaauuucuuguugucauggguccauuggucccuugcccuccugcuguaccuccaccaugcuaaauggucacaggcugccccuauggccgaagggggaggccagaaccaccaugagguagugaaguuuauggacguauaccagcggucguauugucacccgauugaaacgcuaguugacauuuuucaagaauacccugacgaaauagaguauauauuuaaacccagcugcgugccucuaaugcgauguggaggguguugcaaugacgaaggccucgagugugugccuaccgaggagucuaauauuaccaugcagaucaugcgcauaaaaccccaccaaggccagcacaucggagagauguccuuucuucagcacaauaagugugagugcagaccgaaaaaggauagggccaggcaggaaaaaugugacaagccuagacguuag

SEQ ID NO: 5091 - RNA, 1170 nt, Artificial Sequence
  Description of Artificial Sequence: Synthetic coding sequence
cuaacugacagacaaaccgauaccgcuccaucaccaucuuaccaucuccugcccgggcggagacgaaccguggaugccgccgcuucuagaggacaggggccugagccugcaccaggaggcggaguagaagggguaggggcucgcggcguggcucugaaguuguuuguucagcuccugggaugcagccgguuugguggugccgucgugcgagcaggggaggccgaaccuaguggagcagcucggagcgcgaguaguggaagagaagaaccccaacccgaagagggagaagaggaggaggagaaagaggaagaacgagguccucaguggcgacucggcgcuagaaagccaggcucguggacaggagaggccgccguuugugccgacucugcuccagcagcuagggcgccgcaggcacuagcuagagcaucgggcagaggcggccggguggcacggcggggcgcagaggaaucaggucccccccauagcccaagucggcguggaagcgcgagcagggcaggccccgggagagcaucggaaaccaugaacuuccuacuguccuggguucacuggagccuugccuuauugcuuuauuugcaucaugccaaguggucucaagcagcuccaauggcugaaggaggaggccagaaccaccacgagguggucaaauucauggaugucuaccagcguucauacugucacccaauagagacuuuaguggauauauuucaggaguaccccgacgagauugaauauaucuucaaaccauccugugugccucucaugagauguggcggcugcugcaacgaugagggacucgaaugcgugccaacugaggaauccaacauuacaaugcagaucaugcgcauaaagccccaccagggucagcauaucggggaaaugaguuuucuucagcacaauaagugcgagugcagaccuaagaaggaucgagccaggcaagaaaaaaagucugugcgcgggaaaggcaaaggucagaaacggaagcgcaaaaaaucucggcccuguggcccaugcuccgaacgcagaaagcaucucuucgugcaagacccgcaaacauguaagugcucauguaagaauaccgacagccgguguaaggcccgucagcucgaacugaaugagcgaacaugccggugcgacaaaccacguagauag

SEQ ID NO: 5092 - RNA, 1065 nt, Artificial Sequence
  Description of Artificial Sequence: Synthetic coding sequence
cugacagaccgccaaacagacacugcuccaucuccaucuuaucaccugcugcccggacguagaaggacuguggaugcugcagcgucacguggacaagguccagagcccgcaccagggggugggguugaagggguuggagcaagaggcguggcgcugaaacucuuuguacaacugcuuggcugcucacgguucgggggagcuguuguccgugccggcgaagcugaaccgaguggugccgcuagaagcgcauccuccggaagggaagagccccagccagaggagggagaggaggaggaggaaaaggaagaggaacguggaccccaauggcggcuuggcgcaaggaagccugguuccuggacaggggaagccgccgugugugcagacagcgccccagcagcuagagcaccucaggcccuugccagagcaaguggucgaggcggccgaguagcccggcgaggagccgaggagagcggaccuccucauuccccuucaagaagaggguccgccaguagagcuggcccgggccgagccagcgaaacgaugaauuuucuccucagcugggugcacuggucacuugcgcugcuucucuaccugcaccaugcaaaguggucacaggcagccccuauggccgaagggggaggucagaaccaucaugaaguugugaaauuuauggacgucuaccagcgcucuuauugccaccccaucgaaacucuugucgacauauuucaggaguacccagaugagauugaguacaucuucaagccaaguugcgugccacugaugcgcuguggaggauguugcaacgacgaagggcuugaaugugugccuacagaagaaaguaacaucacgaugcagauaaugagaaucaagccacaccagggccagcauaucggcgagaugaguuuucugcaacacaauaagugugaaugcaggccuaagaaggaucgagcuaggcaggaaaacccuuguggaccuuguuccgagcgccggaagcaucuguuuguccaggauccacagaccuguaagugcucgugcaaaaauacagacagcagaugcaagauguag

SEQ ID NO: 5093 - RNA, 1188 nt, Artificial Sequence
  Description of Artificial Sequence: Synthetic coding sequence
cucaccgacagacagaccgacacagcaccgucaccaucuuaccaucugcugcccggucgcagaaggacaguggacgcagccgcaucuagagggcaagggccugaaccagcucccggaggggguguggagggcgugggcgcgcgaggcguggcucucaagcuguucguucaauuauugggauguagccgcuuugguggcgcagucguaagagcgggagaagccgagccuucgggcgccgcaagauccgccucaucagguagggaggagccgcaacccgaagagggagaagaagaggaagaaaaagaggaggaaaggggaccgcaguggcgacuuggggccaggaagccgggaagcuggacuggcgaagccgcugugugugcagauuccgcucccgcugcuagagcgccucaggcacuggccagggcuaguggccgcgggggcaggguggcucgaagaggagcugaggagaguggcccaccucacucccccagcaggagaggcagcgccucgcgagcgggccccgggagagccucagagaccaugaauuuuuugcugagcuggguucauuggagcuuggcccuuuugcuuuaccugcaccacgcuaaauggagucaggccgccccaauggcagaaggcggcggacagaaucaccaugagguaguuaaguucauggaugucuaucagaggagcuauugucaucccaucgagacccuggucgauauuuuucaagaauaccccgacgagaucgaauauauuuucaaaccuucaugcguuccccuuaugaggugcggagggugcuguaacgacgagggccucgagugcguuccgaccgaagaaagcaauaucaccaugcaaaucaugagaaucaaaccccaccaaggccaacauauaggagaaaugaguuuccuucaacauaacaagugcgaaugcagacccaagaaagacagggcaagacaggagaaaaagucagugcgggggaaggggaaaggucaaaaacggaaaagaaagaaaucuagguacaagagcuggagcguaccuuguggucccugcagcgagagacgcaagcaccuguucguccaagauccacagacuuguaagugcucaugcaaaaacacugacuccaggugcaaggcgcgccagcuggaacucaaugagcggacuugucgcugcgacaagcccaggagguag

SEQ ID NO: 5094 - RNA, 414 nt, Artificial Sequence
  Description of Artificial Sequence: Synthetic coding sequence
augaauuuccuacuuaguuggguucauuggucccuggcguugcugcuguaucuacaucaugcuaaauggucucaggcugcacccauggccgaggguggaggacagaaccaucacgaagucgucaaguuuauggacgucuaccagaggaguuacugccaucccauugagacauuagucgauaucuuccaggaauauccugacgagaucgaauauaucuuuaaaccauccugcgucccacuuaugcgcugcggcggcuguuguaacgacgagggucucgaaugcguaccuaccgaggaaucuaacauuaccaugcaaauuaugcgcaucaagccacaucagggccagcauaucggugaaauguccuuuuugcaacauaacaaaugcgaauguaggugcgacaaaccucggcgauag

SEQ ID NO: 5095 - RNA, 1116 nt, Artificial Sequence
  Description of Artificial Sequence: Synthetic coding sequence
cugacagacaggcagacugauaccgcaccuuccccauccuaccacuugcuaccagggcggaggagaacuguggaugcugcagcuuccagagggcaagggccagagcccgccccuggagggggaguugagggagugggugcuagaggggucgcucugaagcuguucgugcaauugcuggguugcagccgcuuugggggggcagucgugcgagcuggagaggcggaaccuucaggcgcugcucgcucagcaucauccggacgcgaggagccccaaccggaagagggagaggaagaggaggagaaagaagaagagcgggggccacaguggagacugggugccagaaagccugguucuuggacuggagaagcugcuguaugcgccgacuccgcgccugcggcccgcgccccucaggcccuugccagggcuagcggacgcggaggaagaguggcccggcgcggcgcagaagagucaggacccccccauaguccaucccgccgcggcagugccucaagagccggcccaggccgggcaagugaaacaaugaacuuccugcucucauggguccacuggucacucgcucuucuccuuuaucugcaucaugcuaaauggagccaggcggccccuauggccgaaggcggaggccagaaccaucacgaaguaguuaaauuuauggacguguaucagcguucuuauugucacccaauugagacuuugguggacauauuccaagaguacccugaugagauagaauacauuuuuaaacccuccugugucccauugaugagaugcggagguuguuguaacgacgaagggcucgagugugugccaacugaggaauccaauauuacuaugcagaucaugcggauaaaaccccaccagggacagcauaucggggaaaugaguuucuugcagcacaauaagugugagugucgaccuaaaaaggaccgagcacggcaggagaaccccugcggacccuguagcgaaagacgcaagcaucuuuucguccaggacccacaaacaugcaaauguagcugcaagaauaccgauagccgauguaaggcccggcaguuagagcugaaugagcguacaugcaggagccugacgcgcaaggacuag

SEQ ID NO: 5096 - RNA, 630 nt, Artificial Sequence
  Description of Artificial Sequence: Synthetic coding sequence
augaacuuucugcugucaugggugcauuggucucucgcccugcuguuguaccuacaucaugccaaguggucccaagcagcgccuauggcugagggcggcggucaaaaccaccacgaaguggugaaguuuauggacguauaccaacggagcuauugucacccgauugaaacccugguggauauuuuucaggaguaccccgacgagauugaguacauuuuuaaaccauccugcguaccgcugaugaggugcggcggcuguugcaaugacgaaggacuggagugcguuccuacagaagaaaguaacaucacgaugcagaucaugaggaucaagccucaucaaggccaacacauuggugaaauguccuuccugcaacauaauaagugugagugucgacccaagaaggauagggcucgacaggagaaaaaguccguacgaggaaaaggcaagggacagaagcgcaaacguaaaaagaguagacccuguggucccuguucagagaggagaaagcaucuguucguucaggauccucagacaugcaaaugcagcuguaaaaacacugauagccgcuguaaggcgcgacaacuagagcuaaacgaacgcaccugccggugugauaagccacggagauag

SEQ ID NO: 5097 - RNA, 576 nt, Artificial Sequence
  Description of Artificial Sequence: Synthetic coding sequence
augaauuucuuguuguccuggguccauuggucacucgccuuguugcuguacuuacaccacgcuaaguggucacaggccgcaccuauggcugagggaggaggccagaaucaucacgaggugguaaaauucauggauguauaccagcgcaguuauugucacccuauugagacucugguggacaucuuccaagaauaucccgacgaaaucgaauacauuuucaaaccaaguugcgugccauuaaugagaugcggagggugcugcaacgaugagggccucgagugcgucccgacugaagagagcaacaucaccaugcagauaaugcgcaucaagccacaccaaggccagcacaucggagaaauguccuuucuucagcauaauaagugugagugccgaccgaagaaggaucgagcccggcaggagaaccccugugggccaugcagugaaagaagaaagcauuuauucguacaggacccccagaccugcaaaugcucauguaaaaacaccgacuccagaugcaaagcacggcagcuagaacugaaugaaaggaccugccguucacucaccagaaaagacuag

SEQ ID NO: 5098 - RNA, 972 nt, Artificial Sequence
  Description of Artificial Sequence: Synthetic coding sequence
ugaagggggcagggucccgaacccgcaccuggagggggugucgaaggcgucggagcucggggagucgcgcugaaguuguucgugcagcuccucggauguucucgguuuggaggggccguggucagagcaggagaggccgaaccgaguggugccgcaagaagcgccagcucaggaagagaggagccccagccagaagaaggagaggaagaggaagaaaaagaggaagagaggggaccacaauggagguugggugcucguaagccuggaucguggaccggcgaagcagccgucugugcugacucagccccagccgcacgcgcgccgcaggcccuugcccgggcgaguggucggggggggcgcgucgccaggaggggagcagaggaaucuggcccuccacauucucccucccgccgaggaucagcuucacgcgcugguccaggaagggcauccgaaaccaugaauuuucugcuuuccuggguucauuggagccuggcucugcugcuguaccuucaucacgcaaaauggucccaagccgccccgauggccgaaggcgggggacagaaccaccacgaggucgugaaauucauggauguguaccagagguccuacugccacccgaucgaaacucuuguggauauauuccaagaguaccccgacgagaucgaguacauauuuaagccaagcugcgugccccugaugagauguggaggcuguuguaaugacgaaggucuggaaugugugccaacugaagaaagcaacauuaccaugcagaucaugcgaauuaaaccacaccagggccaacacaucggcgaaaugaguuuucugcagcacaauaagugugaaugucggcccaagaaggaccgcgcuagacaagagaaaaaaucuguccgaggaaagggaaaaggucagaaaaggaaaaggaagaaauccagauauaaaucuugguccgugugugacaagcccaggcguuag

SEQ ID NO: 5099 - RNA, 648 nt, Artificial Sequence
  Description of Artificial Sequence: Synthetic coding sequence
augaauuuucuguuaucuugggugcacuggucgcuggcacuccugcucuacuuacaucaugccaaguggagucaggcugcaccgauggccgagggaggcggccaaaaccaucacgaaguggugaaguuuauggacguguaucagaggagcuacugccacccuauagaaacccucgucgacauauuccaggaauauccugacgaaaucgaguacaucuucaaaccauccugcgugccccugaugagaugcgggggcuguugcaaugacgagggccucgaaugcguuccuacagaagagaguaauaucaccaugcaaauuaugagaaucaaaccacaccaaggucagcacauuggcgagauguccuucuuacaacacaauaagugcgaaugucgccccaaaaaagaucgagcuaggcaggagaagaagagugucagagguaaaggaaagggucagaaaagaaaaagaaagaagucucgauauaaaaguuggucaguacccuguggcccauguucggagaggagaaagcaccuguucguccaggauccacagacauguaaguguagcugcaagaauacagacuccagaugcaaagcccggcaguuggagcuaaacgaacgcacgugccggugugacaagccucgcagguag

SEQ ID NO: 5100 - RNA, 525 nt, Artificial Sequence
  Description of Artificial Sequence: Synthetic coding sequence
augaacuuccuucuaaguuggguccauuggucccuugccuugcuccucuaccugcaccacgcuaaauggagccaagccgcucccauggcagaggguggggggcaaaaccaucacgaaguaguuaaguucauggacgucuaccaacgaucauauugccaucccaucgagacucugguagacauuuuccaggaguauccggaugaaauugaauauaucuucaaaccuucgugcgugccauugaugagaugcgggggauguuguaaugaugaagggcuggagugugugccaaccgaggaguccaacauuacaaugcaaaucaugagaaucaagccccaucagggccagcauauuggcgaaauguccuuccugcagcauaacaagugcgaaugccggccuaaaaaagacagggcccgacaagagaaccccugcggaccgugcuccgaaagacgaaaacauuuauuugugcaggauccacagacauguaaauguucauguaagaauacugacuccaggugcaagauguag

SEQ ID NO: 5101 - RNA, 699 nt, Artificial Sequence
  Description of Artificial Sequence: Synthetic coding sequence
augaauuuccuccuguccugggugcacuggucccuagcacuucuccuuuaccuacaccacgcaaaauggucgcaagcggccccaauggccgaagguggaggacaaaaccaccacgagguggugaaauucauggauguguaucagcggucuuauugccauccuauugagaccuugguggacauuuuucaagaauaccccgacgaaauagaauauauuuuuaagcccucaugcgugccucuuaugagauguggcggcuguuguaacgaugaaggccuggagugcgugcccacugaggaguccaauauuacaaugcagauaaugagaaucaaaccccaccagggucaacauauuggcgaaaugucuuuucuccaacacaauaaaugcgaaugcaggccuaagaaagauagggcgcgccaagaaaaaaagucagucagaggaaagggaaaagggcagaagagaaagagaaagaaaagccguuacaaaucuuggagugucuacgugggggcgcggugcugccuuaugccauggagccucccuggaccucaucccugcggucccuguagcgaaagacgcaagcaccuguuuguucaggacccccaaacauguaaauguagcuguaagaacacagauagucgguguaaagcccgacagcuggaacugaacgaacgcacgugucgcugugacaagcccagaagguag

SEQ ID NO: 5102 - RNA, 576 nt, Artificial Sequence
  Description of Artificial Sequence: Synthetic coding sequence
augaacuuccugcucaguugggugcauuggucacuggcucuccuucucuaucugcaucaugcuaaauggucccaggcugccccgauggcagaaggggggggucagaaccaccaugaaguggugaaauuuauggacgucuaccagcggucguacugccacccuauugaaacacugguggauauuuuucaggaauaucccgacgaaaucgaauacaucuuuaaacccagcugcguuccccucaugcgaugugguggcuguugcaacgaugaaggucucgaaugcguccccaccgaagagucuaauauuacaaugcagauuaugcgaaucaaaccacaucagggucagcacauaggagagaugucuuuuuuacaacauaacaaaugcgaauguaggcccaaaaaagaccgggcccgccaagaaaaucccugcggaccuugcucagagcgccguaaacauuuguucgugcaagauccccagacguguaaauguuccugcaaaaauacagauuccagaugcaaggcucgacagcucgagcuuaacgagcgcacaugucgcugcgauaagccacgcagguag

SEQ ID NO: 5103 - RNA, 438 nt, Artificial Sequence
  Description of Artificial Sequence: Synthetic coding sequence
augaguacagagggcggaggccgccgcugucaggcccaggugucucggaggauuucuuuuagcgcaagucaccgacuuuacaguaaguuucugucagacgaagagaaucugaagcuguuuggcaaauguaauaaccccaaugggcacggacacaauuacaaagugguaguaacgguucacggagagauugacccugcuacaggaaugguaaugaaccucgcggaucugaaaaaauacauggaggaggccaucaugcagccacuggaccauaagaaucucgauauggauguuccuuacuucgcugacguagucuccacaaccgaaaacguagcuguguacaucugggauaaucugcaaaaggugcugccagugggaguguuguauaaaguuaaaguuuacgaaacugacaacaauaucgugguuuauaaaggugaguag

SEQ ID NO: 5104 - RNA, 4284 nt, Artificial Sequence
  Description of Artificial Sequence: Synthetic coding sequence
augcaccaaagacacccacgagcacgaugccccccauugugcguggcagggauccuugcaugcggcuuccuccugggcugcuggggccccucucauuuccagcaaucauguuugcaggcgcuagaaccucaggccgugucuuccuaccucucaccaggagcuccuuuaaaaggccgcccuccuucgcccggauuccagcgacaaagacagcgccagagacgugcugcaggaggcauucuucaucucgaauugcugguagcagugggccccgacguguuucaagcccaucaagaagacaccgagagguacguguugacuaaccuuaacauaggcgcagagcuccugagagaccccuccuuaggcgcacaguucagggugcauuuggugaaaauggugauacuuacugaaccagaaggagcaccgaauauuacugccaaucucacuagcucuuugcuuucugucugcggcuggagccaaacuauaaaucccgaagacgauacagacccaggccaugcugaccucgugcuauacauuacucgauucgaucuugaacuacccgaugggaaucggcaaguucgggggguuacccaguugggaggugccuguuccccaacuugguccugucuuauuacggaggauaccggcuuugaccuggguguaacaaucgcccacgaaaucggucacaguuucggauuggagcacgauggagccccagguuccgguuguggacccagcggacauguuauggcaagcgacggggcagcaccgagagcagggcuagccuggucaccaugcuccagacggcagcuacucucucucuugucugcgggcagagccagaugcguuugggaccccccuaggccacagccagggucagcaggacauccucccgaugcccaaccuggucuguacuauuccgcuaaugagcagugccggguugcuuuuggcccuaaagccgucgcaugcacauuugcacgggagcaccucgauaugugccaagcccuauccugccacaccgaucccuuagaucagucuaguuguucucgucugcucguaccucuguuggacgguacugaaugcgggguggagaaguggugcagcaagggucgaugccggucucuagucgaacuaacuccaauagccgcuguccacgggcgcuggucuucaugggggccacgcaguccaugcagccgauccugcgguggcggcguggucacccgcagaagacaguguaacaauccucggccugccuuuggcggccgggccugcguaggagcugaccuacaggcugagaugugcaauacgcaggcgugugaaaaaacccagcuggaguuuaugucacagcagugugcuagaaccgacggccaaccucugagaucaagucccgggggagcuaguuucuaccauuggggcgcagcuguuccucacucgcaaggcgaugcccucuguagacauaugugccgggccauuggagaaucauuuauuaugaaaagaggggacucuuuuuuggaugggacucguugcaugccuuccggcccaagagaggauggaacacucagccuaugcgugucugggucuugcaggacauuuggcugcgauggacguauggacucucaacaggugugggauagaugucaagucugcggaggggauaauaguacguguucacccagaaaagggucuuuuaccgccggucgggcccgggaguauguuacauuucugaccguaacgccaaaccucacaagcguguacauagccaaucacagaccacuguucacccaucuugccgugcgcaucgggggaagguacguaguugcuggcaaaauguccaucaguccuaauacuacuuacccuucccuucuagaggacggacgcgucgaguaccguguagcccugacggaggauagacugcccagacuugaggagauccggaucuggggcccccuacaggaggaugccgauauccagguguaccgcagauacggagaagaguacggcaaccuaaccagacccgauaucaccuuuacauauuuucaaccgaagcccaggcaagcauggguaugggcugcugugcgcgggcccuguucagugucauguggcgccggacucagaugggucaauuacaguugcuuagaucaagcaagaaaagagcugguggagacuguccagugccagggcucccagcaaccuccagccuggccagaagcgugcguccucgagccuuguccucccuacugggcagugggugauuucggaccauguuccgcaagcugcgguggggggcucagagagaggcccguuagauguguggaagcucagggcagccugcuaaagacccugccaccugcuagaugccgcgcgggggcucagcaaccagccgucgcucuggagacauguaacccacagccauguccugcgcggugggaggucuccgaaccaucgucuugcacauccgcuggcggagccgggcuggccuuggaaaacgaaaccugcguuccuggagcugacgggcuggaagccccuguuaccgaaggcccaggauccguugaugagaaguuaccugcuccugaacccugugucggcauguccugccccccuggcuggggccacuuggacgccacaucagcuggugagaaagcaccgucgccauggggauccauucgcacuggagcucaggcugcucacguguggacuccugcugcaggaaguuguagcgucucaugcggccgggguuuaauggaacugagauuucuuuguauggacuccgcucuuagggucccuguacaggaggagcucugcgggcuggccuccaaaccuggaucacggcgggaggugugccaggcuguaccuugcccagccagguggcaguauaaacuagcugcgugcagugugaguugcggaaggggcguggugagacggaucuuguauugcgccagagcacauggcgaggaugacggcgaagagauucugcuggauacccaaugccagggcuuaccucggccugaaccgcaggaagcuugcucacucgaacccuguccccccagauggaagguuaugucccugggaccauguagugcaucauguggacugggaaccgcucguaggucaguugccuguguccagcuugaccagggccaggauguagaagucgacgaagcagccugcgccgcauuagugcgcccagaggcauccgugccuugucugaucgccgauugcaccuauagguggcaugucggcacguggauggaaugcucugugucauguggagacggcauucagagacgccgagauacauguuuaggaccucaggcucaagcaccagugccagcagauuuuugucaacaccuuccuaagcccguuaccgugcguggaugcugggcagguccaugcgucggccaggguacuccgucauuggugccucacgaggaggccgccgcaccaggccgcacuacagcaacaccugcaggcgcaucacuagaguggucacaggcacggggacuucuguuuagcccggcuccgcagccucggaggcuccuucccgguccucaggagaauucgguucaaagcucagcauguggaaggcagcaccucgagccgaccgggaccaucgauaugagggggccaggucaggcagacugugcugucgccauagggagaccauuaggagaaguugucaccuuacgcgugcuggagaguucacugaauugcagugccggagacaugcucuuauugugggguagacugacuuggagaaagaugugccgaaaguuacucgauaugacauuuucguccaagacaaacacacuggucgugcggcagagauguggacgaccgggcggaggggugcuucugagguacggaucucagcucgcuccagagacauuuuacagggaaugugauaugcaguuguuuggccccuggggggagaucguuucacccagucuaagcccugccaccagcaacgcggggggaugccgccucuuuaucaacguugcuccacacgccagaauagcgauacacgcucuagcuacuaauaugggcgccggcacugaaggggcuaaugcaucauauauuuuaauccgcgacacacauucucuucgcacaacagcuuuucacggccagcagguauuguauugggagagugagagcagccaagcggaaauggaguuuucugagggcuuccugaaggcgcaggccucucugcgaggacaauacuggacacuacagagcugggugccagagaugcaggauccccagaguuggaaaggaaaagaaggaaccuag

SEQ ID NO: 5105 - RNA, 3309 nt, Artificial Sequence
  Description of Artificial Sequence: Synthetic coding sequence
auguuccaacugccagucaauaaccuuggaucccuccguaaggcgagaaagaccgugaagaaaauucugucugauauuggacucgaauacuguaaagaacacaucgaggacuucaagcaauuugaaccaaaugauuuuuaccuaaaaaacacaaccugggaagacgugggauuaugggacccaagcuugacuaaaaaucaagauuaucggacuaagcccuuuuguugcagcgcaugccccuucucauccaaguucuuuagcgcuuauaaaucacacuucagaaauguccauucagaggauuucgaaaaucgcauccuccuuaacugucccuacugcacauucaacgccgauaaaaaaacccuggaaacucauauuaaaaucuuccacgcuccaaaugccucugcucccucuaguagccuguccacuuuuaaagauaagaauaagaaugauggauugaaaccaaagcaggccgacuccguagaacaggcuguguacuacuguaaaaagugcaccuacagagaccccuuguacgaaauuguuagaaagcacaucuacagagagcacuuucagcauguggccgcaccuuauaucgcuaaagcuggagaaaagucauuaaauggugccgugccuuuggggagcaacgccagagaagaguccuccauucacuguaagcgaugucuguuuaugccuaaguccuacgaagcccuuguucagcacguuauugaggaccaugaacggauuggauaccaggugaccgcuaugaucgggcauacaaacguggugguuccacggucaaagccucugaugcuaauagcuccgaagccucaggacaagaaaucuaugggucucccuccccgcauaggaagucuggccaguggaaauguuaggucccuuccuucgcagcaaaugguaaaucgacugucuauuccaaaacccaaccucaauucuacaggaguaaacaugaugucuuccgugcaccugcaacagaacaauuauggaguaaagagcgucgggcagggauacucaguuggucaaaguaugcgccucggccucgggggaaaugcaccugucagcauuccucagcaaucccaaucagugaagcaacucuuacccagcgggaacggcaggagcuacggucuagggucugaacagagaagucaagcaccagcccgcuacucucuccagucugccaaugcuuccucacuuucaagcggucaacuaaaaagucccucucugucucaaucucaggccucaagaguauuaggccagucuuccucuaaaccugcugcugccgcaacuggacccccccccggcaacaccaguucuacccagaaguggaagauuuguacaauuuguaacgaacuuuucccagaaaauguauacucuguacauuuugaaaaggagcacaaagcugagaagguuccugcugucgcaaacuauaucaugaagauucacaauuuuacuucuaaaugccuuuacuguaaccgauauuuacccacggacacucuacuaaaucauaugcuaauacacggacuguccugcccuuauugccgcuccaccuucaacgacgucgaaaagauggcugcccacaugcguaugguccacauugacgaggagauggggccaaaaacagacagcacucuuucauuugaccuuacgcugcagcagggcucccacacaaauauacaccuguuagucacaacauacaaccugcgggacgcaccugccgaauccguagcuuaccacgcucaaaauaaucccccggucccccccaagccacaaccuaaagugcaggagaaggcugacaucccagucaagagcucaccacaggcagccguuccauacaaaaaggauguggguaagacgcuguguccucugugcuucagcauccucaaggguccaauuagcgaugcccuagcccaccacuuacgugagagacaccaggucauccaaaccguucaccccguggagaagaaacucaccuacaagugcauucacugccuaggcgucuacacaucuaauaugaccgcuucgaccaucacacuucaucucguccauugcagaggugugggcaaaacucaaaacggacaagacaagacgaaugccccaucccggcucaaccagaguccuagccucgcaccugucaaaagaacguacgagcagauggaauuuccccuuuuaaagaagcguaaacucgacgaugauagcgacagcccuaguuuuuuugaagaaaagccugaggaacccgucgugcuggcauuagaucccaaaggucaugaagaugauucauaugaggcccggaagucuuuucuuacaaaguacuuuaauaaacagccguauccuacacgccgcgaaauugaaaaacuugccgccucacucuggcuguggaagagcgacauugcuucccacuucagcaauaagagaaaaaaguguguuagggauugugaaaaauacaaaccaggcgugcuguuaggcuucaacaugaaggaacugaauaaagugaaacacgaaauggacuucgacgcugaauggcuguucgaaaaccaugaugaaaaagauucucgagugaacgcguccaagaccgccgauaagaaacuaaaccuggggaaggaggacgacucaucuucagacaguuuugagaaccuagaggaagaaucuaacgagagcggcucacccuuugauccaguguuugaaguugaaccuaaaauuagcaacgauaaccccgaggagcauguguugaaggugaucccugaggacgcgucugaaagcgaagagaaacuggaucagaaagaggacggaucuaaauacgagacuauucaucugaccgaggaaccaacaaaacugaugcacaacgcuagcgauagcgaaguugaucaagaugaugucguugaguggaaggacggagcaucccccagugaauccgggcccggcagccagcagguuucugacuuugaggauaauacaugcgagaugaagccuggcacauggagcgaugagagcucccagucagaggacgcuaggagcuccaagcccgcugccaaaaaaaaggcuacaaugcagggggaucgagaacaacugaaguggaaaaacucaaguuacggcaagguggaaggauucuggucaaaagaccaaucucaguggaaaaaugcuucugaaaaugaugagcggcugucgaauccccaaaucgaguggcagaauucaacaauagacuccgaagauggcgaacaguucgauaauaugacagacggugucgcggagccaaugcauggaucacuggcuggaguuaaacuuucaucccaacaggcguag

SEQ ID NO: 5106 - RNA, 3309 nt, Artificial Sequence
  Description of Artificial Sequence: Synthetic coding sequence
auguuccaguuacccguuaauaaucugggaagucugcguaaagcgcggaaaaccgucaaaaaaauccucuccgauauuggucuggaauacuguaaggaacauaucgaggauuuuaaacaauucgaaccuaacgauuuuuauuugaagaacaccacaugggaagacgucggccugugggaccccucccucacgaaaaaucaggauuaccgaacuaaaccauuuuguugcucagcaugcccuuuuagcucuaaauucuucuccgccuacaagagucacuuucgaaacguccacuccgaagacuucgagaacaggauccuccugaacuguccauacuguaccuuuaacgccgauaagaagacucuggagacucacauuaagaucuuccaugccccaaaugcgagcgcgccguccucaagccugagcacuuuuaaagacaaaaacaaaaacgacggacugaagccuaaacaagccgacucuguggaacaggcagucuacuauugcaaaaaguguaccuacagagauccacuauaugagauugugcguaaacauauauacagagaacacuuccagcauguugccgcacccuacauugccaaagccggcgagaagagucugaauggcgccgucccgcugggcagcaacgccagagaagaaucuagcauucauugcaaaagguguuuguucaugccaaaaagcuacgaggcuuugguccagcaugucaucgaagaccaugagcgaauaggguaucaaguaaccgccaugaucggacacacaaauguggugguuccccguuccaaaccccuaaugcucauugcccccaaaccucaagauaagaaguccaugggccuucccccccgcaucgguucauuagccagcgguaauguaaggucccuucccucccagcaaauggucaaucgacuguccauccccaaacccaaccugaauagcacaggggugaauaugauguccucagugcaucuccaacagaauaauuacggaguaaagucuguggggcagggauacuccguuggucaauccaugagacucggacugggcgguaacgcuccggucucaauuccccagcagucacaaucaguuaagcagcuuuugccaucuggcaacggaaggucguacggacugggaagcgaacaacgaagucaagcgcccgcucguuauagccuccaauccgcgaacgcuagcaguuuaucuaguggacaacugaaaucuccuagucugagucaaucgcaggccucccguguccugggccaauccucuucaaaacccgcugccgccgccaccggcccuccucccgggaauacuucaagcacacagaaauggaagaucugcacuauuuguaacgagcuguuuccagagaaugucuacuccguccacuucgaaaaagaacauaaggcugaaaaggucccugccguagccaacuauaucaugaagauucacaauuucacgagcaaaugccuauacuguaaucgcuaucuaccuaccgacaccuuacuuaaccacaugcugauccauggccuguccuguccauauugucgcucuaccuuuaacgacguggagaaaauggcagcgcauaugcguaugguucauauagaugaagagaugggcccuaaaacggacucaacgcuuuccuuugacuuaacacuucagcagggaucccacacaaacauccaucugcuugugacaacuuauaaucuccgcgaugcaccugccgagagugucgcuuaccacgcucaaaauaacccaccaguacccccuaaaccacagccaaaagugcaggagaaagcugauauuccugugaaaucaagcccacaagcagcugugccuuacaagaaagauguugguaaaaccuugugcccgcuauguuuuucaauccuuaaaggccccauuucggacgcccuggcccaccaccugagagaacgccaccagguuauacagacaguccauccuguggagaaaaagcugaccuacaaaugcauucauugccucgguguguauacuucgaacaugacagccaguaccaucaccuugcauuugguccacugcagaggcgugggaaagacccagaacggccaagacaagacaaaugcccccucucgccugaaccaaucacccagucuugcccccgugaaacgaacuuacgagcagauggaauuccccuugcuuaagaagaggaagcuggaugaugacuccgauagcccuucuuuuuucgaagagaaaccugaggaacccguggugcuugcuuuagacccaaagggccacgaggacgauucguaugaagcacgcaagucuuuccuaacuaaauauuuuaacaagcaaccuuauccuacucggcgugaaaucgagaaauuagccgcuagucucuggcucuggaaguccgauaucgccagucacuucagcaacaagcggaagaagugcguucgggacugcgaaaaauauaagcccgguguacuccuuggauuuaacaugaaagaacuuaacaaaguaaaacacgagauggacuuugaugcugaauggcuguucgagaaucacgaugaaaaagauaguagaguaaaugcuagcaagaccgcagauaaaaaguuaaaucuaggaaaagaggaugauucuaguucugacucuuuugaaaaccucgaggaggaauccaaugaaagcgguagcccauucgacccaguguuugagguagagcccaagaucuccaacgauaacccagaagaacacguguugaaaguuauaccggaagaugcuagcgagagugaggagaaacuggaccagaaagaagacggaucuaaguaugagacuauccaucucacugaagagccaacuaaauuaaugcauaacgccucugacagcgagguggaccaggaugauguugucgaauggaaggauggagcaucgccuucagagucagguccuggaagucaacaggucagcgauuuugaggauaacacaugcgaaaugaagccaggcacauggagcgacgagucaagccaaagcgaggacgcacgcagcagcaaaccagcagcuaaaaaaaaggcaacaaugcaaggagaccgagagcagcugaaguggaaaaauagcagcuaugguaaggucgagggcuuuuggaguaaggaucagucacaguggaagaaugccuccgaaaacgaugagcgauuguccaacccacagaucgaauggcaaaacagcacuauagauucugaggacggugaacaguuugauaauaugacagauggaguugcugagccaaugcauggcagccuggccggagucaaacugagcagccagcaggccuag

SEQ ID NO: 5107 - RNA, 3309 nt, Artificial Sequence
  Description of Artificial Sequence: Synthetic coding sequence
auguuccagcucccuguaaacaauuugggaagccuccggaaagccagaaaaaccgugaaaaaaauuuuaagugacauaggucuggaauauuguaaagaacacauagaagauuucaaacaauuugaaccaaacgauuuuuaccuuaaaaacacaacaugggaagacgucggauugugggauccuucucugaccaaaaaucaagacuaucggaccaaaccuuucugcuguucagccuguccuuucagcagcaaguucuuuagcgcguauaagucccauuucagaaacgugcacagcgaggauuucgagaacagaauuuuacucaacugcccauacuguacauucaacgcggacaagaagacacuggaaacgcacaucaaaauuuuccacgcccccaacgccucagcgccuucaucaucacuuucgaccuuuaaggacaaaaauaaaaaugauggacucaagccuaaacaggccgacucugucgagcaagccguuuauuacuguaagaagugcacguaccgcgacccuuuauacgagaucguccgaaaacauaucuaccgagaacacuuucaacacgucgcagccccuuacauugcuaaggcgggggaaaaaucgcugaauggagccgugcccuuagguaguaacgcaagagaggaauccagcauucauugcaaacggugucucuucaugcccaaguccuacgaggcuuuaguucagcauguaaucgaagaccaugagcgcauaggcuaccaggugaccgccaugauagggcauacuaacgucguugugcccagaagcaaaccccucaugcuaauugccccuaaaccacaagacaagaaaucaaugggacuuccaccaagaaucggcucacuugccagcgggaacguuagaagccugccuagccagcagauggugaaccgccucagcauccccaaaccgaauuugaauagcaccggaguaaauaugaugucaagcguccaucugcagcagaacaacuauggugugaaguccgugggccaaggauauucugugggacagagcaugcgguuggggcuuggcggaaaugccccuguaagcaucccucagcaaagucagagcguaaagcaacuccuuccauccggcaacggcagauccuauggcuugggcagugagcaaaggucccaggcgccagccagauacagucuccagucagccaaugcuucgagucuuuccucaggacaacuaaaaucacccagccugucccaaucacaagccagucgggucuuaggucagucuaguucaaagcccgccgccgcugcuaccggucccccccccgguaacacuuccuccacccagaaauggaagauuuguacaaucugcaacgagcuguuccccgagaacguguauaguguucacuucgagaaagaacacaaggccgaaaaggugccugcaguagcuaacuacaucaugaagauucacaacuucaccagcaagugccuguacuguaaccgcuaccuuccuacagauacccuacucaaucauauguugauccacgggcugucaugucccuacugccgcuccacuuuuaacgaugucgagaaaauggcagcacauaugcggaugguucauauugaugaggaaaugggcccgaagaccgauuccacucucaguuuugacuugacgcuccaacaaggaucccacaccaauauucaccucuuaguaacuacguauaaccuaagggaugcaccagcagagucaguggcuuaccacgcccagaacaaccccccugugccacccaagccucagccaaaaguucaggagaaggcugauauuccaguuaaaaguagcccgcaggccgcggucccuuacaaaaaggauguagguaagacuuuauguccacuguguuucuccauucuaaaagggcccaucagcgaugcuuuagcucaccaccuacgcgaacgacaccaaguuauccagaccgugcaccccguggagaaaaaacugaccuauaagugcauccacugucugggaguuuauacauccaauaugacugccucgacuauuaccuuacaccuggugcauuguagagggguuggcaagacccaaaaugggcaagacaagacuaacgcacccagcagguuaaaucagucaccuucuuuggccccagugaaaagaacauaugagcagauggaguuuccuuugcucaagaagcgaaagcucgaugacgauagugacagccccucuuuuuucgaagaaaaaccagaagaacccguaguauuagcucuggauccuaaaggccaugaagacgauucuuacgaggcaaggaagaguuuccugacaaaauauuucaauaaacagccuuauccuaccagacgcgaaauagaaaaacuggccgcaucuuuguggcuuuggaaaucugacauugcaucccauuuuuccaacaagagaaagaaaugugucagggacugugagaaauacaagccuggcgugcugcuuggcuucaacaugaaggaacugaacaaagucaagcaugagauggauuuugacgccgaaugguuguuugaaaaccacgacgagaaggauaguagaguuaaugcuucuaaaacggccgacaaaaagcugaaucucggcaaggaggaugauaguaguagcgacaguuucgagaaccuagaagaggaaaguaacgaauccggcucgcccuucgauccuguguucgagguagagccuaagauuucuaaugacaacccugaagagcacgugcugaagguaauuccugaggaugcgucugagucagaagaaaaacucgaucaaaaagaagacgguucaaaguaugagacaauccaucugaccgaagagccaacuaaguuaaugcacaaugcuuccgauucugagguggaucaggaugacguugucgaauggaaggauggagcgucgccaagugaauccggcccgggcucccaacaagugagcgacuuugaagauaauacuugcgaaaugaaaccugguaccuggucggaugagagcucacaaagcgaggacgcacgcuccucuaagccagcugcuaaaaagaaagccacaaugcagggggauagggaacagcuuaaauggaagaacaguucauacgggaaggucgaggguuucuggagcaaagaccagagccaguggaagaaugcauccgaaaacgacgagagacugaguaauccacagauugaauggcagaauucaaccauugacuccgaagauggggaacaauucgauaauaugacagacggcguggccgagccgaugcacggguccuuggcgggugugaagcugagcagccagcaggccuag

SEQ ID NO: 5108 - RNA, 3309 nt, Artificial Sequence
  Description of Artificial Sequence: Synthetic coding sequence
auguuccagcuucccgugaauaaccuggguucccugcguaaggcgagaaaaacuguaaagaagauccugagugacauuggccuggaauauugcaaggagcauaucgaggacuucaagcaauucgaaccaaacgacuuuuaccugaaaaauacgaccugggaggacguugggcucugggaccccagucugacuaagaaucaagacuaucgcacuaaaccuuucugcuguuccgcaugccccuucucuagcaaauucuucuccgcauacaaaucacauuuucguaacguccacucugaagacuucgagaaccggauacugcugaacugcccuuauuguacuuuuaaugcugacaagaaaacccucgagacacacaucaagauuuuucacgcaccgaacgcuuccgcaccguccuccucacuuucaacuuuuaaagacaaaaacaagaacgauggccuaaaaccaaaacaagcugauaguguugagcaagcaguguacuacuguaagaaauguacguaccgcgauccucucuacgaaauuguuaggaaacacaucuaccgagaacacuuccagcacgucgcugcgccguacaucgcuaaagccggggagaagucgcugaauggagccgugccccucgggucuaacgcuagagaggagagcucuauucauuguaagcgauguuuauuuaugccaaagucauaugaggcgcucguccaacauguaaucgaggaccacgagagaauuggcuaucaaguuacugcuaugaucggacacacaaaugucguuguaccucguucaaagccgcugauguugauagcaccuaagccacaggacaagaaaaguaugggcuuacccccacgaaucggaagucucgcuaguggaaauguucgcucacucccaucucagcagauggucaaucggcuuucaauucccaagccuaacuugaacagcacgggcguuaauaugaugagcaguguccaucuccagcagaauaauuacggggugaaaucuguuggccaaggauauucuguggggcagaguaugcgauuagggcucggugguaacgcaccugugucaaucccccagcagagccaguccgucaaacagcuacuuccauccgguaauggcaggucuuauggacucgggucugagcagcggucacaagcaccagcaagguacucccuucagucagccaaugccaguucacucuccuccggucagcuuaagagccccaguuuaucccaaucucaagccagccggguguuaggacaaucuucauccaaaccggcagcagcugccaccggcccgccccccggaaacacaucaagcacccagaaguggaagaucugcaccauuuguaaugagcuauucccugagaacguuuauagcgugcauuucgaaaaagagcauaaagccgagaaagucccagccguugccaauuacaucaugaaaauucacaauuucaccagcaaaugcuuguauugcaauagguaccugcccaccgauacucuucucaaccacaugcucauucacggcuuaaguuguccauacugcagauccacauuuaacgauguggaaaagauggcugcccauaugcgcaugguacauaucgacgaggagaugggaccuaagacggauucuacccuaucauucgaucugacacugcaacagggaagucacaccaauauucaucugcuaguuacuacauacaaccuuagagaugcuccagccgaaucagucgccuaccacgcucagaacaauccuccugucccccccaagccucagccaaaaguucaagaaaaggcagacauaccugucaagucauccccacaagccgcaguccccuauaagaaggaugucggaaagacuuuauguccccuuugcuucuccauucuuaaaggcccaaucucagacgcacuggcccaccaucucagagagcgucaccaagucauucagacaguacacccugucgaaaaaaagcuuaccuacaaaugcauccauugucucggcguguacacaucuaauaugacagcuagcacuaucacccugcaccuggugcauugucggggcgugggcaagacccaaaauggucaggacaaaacuaaugccccauccagacucaaccagucucccucucuggcccccguaaagcgaaccuaugaacaaauggaguuuccccuccugaaaaaacgcaaacucgacgaugauucugauucuccgucuuuuuuugaagagaaaccggaagagccggucguacuggccuuagauccaaaagggcaugaagacgauucauaugaagcccgaaagaguuuccugacgaaguauuucaacaagcaacccuauccgacacgcagagagaucgagaagcucgcagccucgcucuggcucuggaaaagugacauugcaagccacuucuccaacaaaaggaaaaaauguguccgugacugugagaaguacaagccuggaguacugcuuggguuuaacaugaaggagcugaauaaaguaaaacacgaaauggauuuugacgcugaauggcucuucgaaaaccacgacgaaaaggacagccgcguaaacgccuccaaaacugccgauaaaaaacuaaauuuagggaaagaggaugauucaucuagugacagcuuugaaaaucuagaggaggagaguaacgaauccggcagccccuucgacccgguuuuugagguagagccuaaaauaaguaacgauaaucccgaagagcauguguugaaggucaucccggaagaugcuucagagagcgaagagaaacuggaccagaaggaggacggcaguaaguacgaaacuauccaucugacagaagagccgacaaaacucaugcauaaugcuucagauucagaggucgaccaggaugauguaguggaauggaaagacggcgcuucuccaagugagagugggccgggaucccaacaggugagcgauuucgaagauaauacgugcgaaaugaagccagguaccugguccgacgaaagcucgcagagugaagacgcuagaucuuccaaacccgcugcaaagaaaaaagccacgaugcagggcgaucgcgagcaacucaaguggaaaaacuccagcuacgggaaaguagaaggauucuggagcaaagaucagucacaguggaaaaaugcaucagagaaugaugaacggcucucaaauccccagaucgaguggcaaaauaguaccaucgacuccgaagacggugagcaauuugauaauaugaccgacggcguagccgagcccaugcauggaucacuggccgggguuaaacucucaagucagcaggccuag

SEQ ID NO: 5109 - RNA, 522 nt, Artificial Sequence
  Description of Artificial Sequence: Synthetic coding sequence
auguuucaacugccagucaacaaccucggaucgcuaaggaaagcacgaaagaccguuaagaagauccuguccgacauugguuuagaauacugcaaggaacauauagaggacuuuaaacaguuugaaccuaaugauuuuuaccuuaagaacaccacuugggaggacgugggacucugggacccuucacuuacuaaaaaucaggauuaucgaaccaagccuuucuguugcagcgccugccccuucucaucaaaauuuuuuuccgccuacaaaucacauuuuagaaacguccacagcgaggacuucgagaaccgaaucuuacugaauugccccuacuguaccuuuaaugccgacaaaaagacucucgagacucauauuaagauuuuccaugccccaaacgcuucugcacccuccaguagccucuccacauucaaagauaaaaauaaaaacgauggacugaagccaaaacaggccgacaguguagagcaggcuguguauuacuguaaaaaguguacuuaucgcuag

SEQ ID NO: 5110 - RNA, 441 nt, Artificial Sequence
  Description of Artificial Sequence: Synthetic coding sequence
augguaauccugaccgaaccugaaggcgccccuaacauaacagccaaccucaccucaucucuccugucuguauguggcuggucgcaaacaauuaaccccgaggacgacacagauccaggacacgccgaucucgugcuguauaucacucgguucgauuuagagcuacccgacggaaaucgacaagugcgcggggugacucagcucggaggcgcauguucaccuacaugguccuguuuaaucaccgaagauaccggguuugaccugggagugaccauugcacaugaaauuggucaucggaucugugcaagaccgucgccugcaacucagacacgguggaccaaagccgcugccgcugccucaagcuucuuaucuuggaugggccagaauguggcauggaggucuggcgcucccagagucgcagcagccccuugguggagcuag

SEQ ID NO: 5111 - RNA, 4116 nt, Artificial Sequence
  Description of Artificial Sequence: Synthetic coding sequence
augcaccaaagacacccccgagcacgcuguccgccucucugugucgcuggcauccuggcuugcggauucuuguuaggguguugggggccuucucacuuccagcagucuugcuuacaggcacuggaaccccaggcaguuucaaguuaccucucaccuggugccccucuaaagggacgcccuccaucuccagguuuucagaggcaacgccagaggcagcgcagagccgccggaggcauucugcaccuagaacugcuggucgcagucggaccugacguuuuccaggcucaccaggaagauaccgagcgguacguacugacuaaccucaauaucggcgccgaauuacugcgggauccuucccugggagcccaguuuagaguccaccucgugaagaugguuauccuuacugaacccgaaggagcuccgaacauuacagcuaacuugacgagcagccuacugucaguguguggcuggucgcagacaauuaaucccgaagaugacacugaucccggacacgcagaucuggugcuguauauuaccagauucgaucuggaacuacccgaugguaacaggcaggugaggggcgucacgcagcuggguggggcuuguagccccacaugguccugucucaucacagaagauacaggguucgaccucggagugacaaucgcacacgaaauaggccacagcuuugggcuggaacacgauggugccccuggauccggcugcggccccucaggccauguaauggcuuccgacggagcagcacccagagcaggcuuagccuggagccccugcagccgccgccagcuccucaguuuguuaucugccggccgggcaaggugugugugggauccuccccgcccucagcccgggucagccggacaucccccugaugcacagcccggucuguacuacucagcgaaugagcaaugcagagucgcauucggacccaaggccguagccuguaccuucgcgagagaacacuuggauaugugccaagccuuauccugccacaccgacccacuggaccagucauccugcucacgacuacuggugccgcuccuugacgguacggaaugcggaguggagaaguggugcucgaaaggacgcugccgaucuuugguugaacuuacgccgauugcugccguccacgggcgcuggucaucuuggggaccgcguucacccuguucuagaucaugcgggggcggaguggucaccagacggcggcaauguaacaauccaagaccugccuuuggcggccgcgcaugcgucggcgcugaucuucaagcagagauguguaauacucaggccugcgaaaaaacgcagcuggaauucaugucacaacaaugcgcaaggacagacgggcaacccuuacgaucgucuccuggcggggcauccuucuaucauuggggcgccgcaguuccacacucccaaggagaugcccugugcaggcacaugugucgggcuaucggcgaauccuuuaucaugaaaagaggcgauucuuuucuggacggcacuagguguaugcccucaggcccuagagaggauggaacucuuagucuauguguguccggaucaugcaggacauucggcugcgaugggagaauggacagccagcaagugugggaucggugccaggugugcggaggcgauaauuccacauguagcccacgcaaagguucauuuacagcugguagagcccgagaauacgugaccuuucugaccgucaccccgaauuuaaccucaguauacauagcaaaucacagaccccuguuuacucaucuggcagugcggaucgggggccgguacgugguugcugguaaaauguccauuaguccuaauaccacauaccccagcuuacuagaggauggccguguggaauauagagucgcucugaccgaggacagacugccccggcuggaagagauucgaauuuggggaccacuacaggaggacgcagacauucaaguguauagacguuacggugaagaguacgguaaccucacuaggccugauaucacauucacauacuuccaaccaaagccccgacaagcuuggguuugggcagcagugcgaggcccuuguucugugucuuguggcgcuggcuuacgcugggugaauuacucuugucuggaccaggcucgcaaggagcucguggaaacagugcagugccaagguucccagcaaccuccagcauggccugaagcuuguguccuggaaccauguccaccauauugggccgugggcgauuucggucccuguagcgcaucuugcggcggaggauugcgagaaagaccagugaggugcguugaggcacaggguagccugcucaagacucuuccccccgcuagaugcagagccggcgcucagcaaccugcaguggcacuggagacauguaacccacagccaugccccgccaggugggaggucucagaaccuagcagcugcaccagcgcaggcggagcagggcucgcccuagaaaacgagacuugcgugcccggagcugacggcuuggaagcaccugugacagagggacccgggucggucgacgagaaacuuccagcccccgaaccaugcgucgggaugagcugcccaccaggaugggggcauuuagaugccacaagugccggcgagaaagccccuaguccauggggaucaauucggacuggcgcccaagcugcacaugucuggacaccggcagcaggcucauguucggugucauguggcaggggcuuaauggaacugcgguuucuuuguauggacucugcucuccgggucccugugcaggaggaacuuuguggccuagccaguaaaccaggaagcaggcgggaaguaugucaggcaguaccuuguccugcaagauggcaguacaagcucgccgccuguagcguuuccugcggaagaggugugguucgaaggaucuuauauugugcacgugcacacggagaagacgauggggaggagaucuugcuggauacucagugccaaggacucccucguccugaaccccaggaggcuugcucucuggaaccuugcccgccgcguuggaaggucaugucccuggguccaugcagcgcaucaugcggauuaggcacagcucggagaaguguggcuuguguacagcuagaucagggccaagacguagagguggaugaagccgccugugcugccuuggugaggccagaagcaucuguaccauguuuaauugcugacuguacauaucgauggcauguagguacuuggauggaaugcucggugucguguggcgaugggauucaacggcggagagacaccugccugggaccccaagcgcaggcucccgugccagcagacuuuugucagcacuugccuaagccuguuaccgugcgagguuguugggccgggcccugcgucgggcagggggccugcgggaggcagcaucuggaaccuacagguacuauagauaugcgagggccaggacaggcugacugugcgguggccauuggccgcccacugggcgaaguugugacauugagaguacuugaaagcucccucaauuguagcgcgggcgacaugcuccuguuguggggcagguuaacuuggagaaaaauguguaggaaauugcuggacaugacauucucuucuaagacuaacacucuggucgucagacagcguugcggaagaccgggcgguggcgugcuccugcgcuacgggagccaacuggccccugaaacuuucuaucgugaaugcgacaugcagcuauuuggcccauggggagaaaucgugucaccaucacuuagcccagccaccuccaacgcaggagggugucggcucuuuaucaacgucgccccccacgccaggauagcaauucacgcacucgcuacaaauaugggcgccgggacagaaggugcaaacgcuucguauauacuaaucagagacacccacucacucaggacuacagcuuuucacggacagcagguauuguacugggaaucugaaaguagucaagcggagauggaauuuagugaaggguucuugaaggcgcaggccagcuuacgaggacaguauuggacccuccaguccugggugccagagaugcaggacccacaaucauggaagggcaaagaagggacuuag

SEQ ID NO: 5112 - RNA, 4023 nt, Artificial Sequence
  Description of Artificial Sequence: Synthetic coding sequence
augcaccagaggcacccucgggccagaugucccccccucugcguugcuggaauccucgcgugugguuucuugcucgguuguuggggccccagccacuuucagcaauccuguuuacaggcacuagagccucaggccguuucgucguaucucucuccgggugcaccccucaaaggcagaccucccuccccuggguuccagaggcagcgacagcggcagcggcgcgccgccggcgggauucuacaucuugagcuucuugucgcugugggaccagauguguuccaggcccaucaggaggacaccgagagauauguccugacuaaccugaacaucggagcagaacuguugcgcgauccuucucuuggagcccaauuucggguacaccuggucaaaauggugauauuaacagaaccagagggagccccaaauauuacagcuaacuuaaccucuucuuuacucaguguguguggcuggucucagaccauaaauccugaggaugacacggaccccggccaugccgaucucguccuuuauaucacacgcuucgacuuagaguugccagaugggaaccgccagguccgcggugucacucaacugggaggagccugcuccccuacuuggucuugccugaucaccgaggauacgggcuucgaucuggggguaacuauagcucacgaaaucggucauuccuucggcuuagaacaugacggggcuccaggaucuggauguggaccuuccggacacguuauggcuucugauggggcggcaccaagagcgggccuggcuuggucaccauguucacgucgccaguugcucagccuucugucagccaaugagcaaugcaggguugcuuuugguccaaaggcagucgcauguaccuucgcucgcgagcaccuagauaugugccaagcacugagcugucacaccgauccucucgaccaaaguucuugcucacgcuugcuggucccgcuccuagacggcacggaguguggaguggaaaagugguguagcaaggguagguguagaucucucgucgaacugacucccauugcagcgguccacgggagauggucuagcugggguccuagaaguccuuguagucgcagcuguggagguggcgucgugaccagaagacgucaguguaauaauccaagaccugcauucggaggccgugcgugugugggagcagaccuccaggcugaaaugugcaacacccaagccugugaaaagacccagcuggaauucaugucccaacaaugugcaagaacugacggccagccuuugcgcucuucaccuggaggcgcuaguuuuuaucacuggggagccgccguaccacauagucagggcgaugcacucugccgucauaugugucgagcuaucggagaaucauucauaaugaagaggggagacucauuccuugacggcaccagguguaugccauccggcccucgcgaagaugggacccugaguuuaugcgugagcggauccugccggaccuucgguugugaugggaggauggauagccagcaggugugggacaggugucagguguguggaggggacaauuccacuugcucaccaagaaaagggagcuucacagccgggagagcuagagaauacgucacuuucuuaacaguaaccccgaaccuuacaaguguauacauugcuaaucacagaccacuauucacccaccuugccguucgcauuggaggucgcuaugucgucgcugguaagaugucuauauccccgaacacaacguauccuagucugcuugaggaugggcgagucgaguaccgcguggcacuuacggaagaucgacugccccgcuuggaagaaauaagaauauggggaccccuucaagaggaugcugauauucagguguacaggagauauggcgaagaauaugggaaucucacgcgaccagauauaacguucaccuauuuucagccuaagccuagacaggccuggguaugggccgccgucagaggacccugcagcgugucuuguggggccgguuugcgguggguaaacuauaguugccuugaucaagcgcggaaagagcuuguugagacuguccagugccaggguagccagcagccuccugcauggccagaggcguguguacuggaacccugucccccuuauugggcagugggagacuucggaccuuguagcgcaucaugugggggcggacucagagagcggcccgugaggugcguggaggcgcaggggucucugcugaaaacauugccacccgcucguugccgcgccggcgcccagcagccagcugucgcacucgagaccuguaauccacagcccugcccugcccguugggaagugagugaacccagcaguugcacuuccgccggaggagcuggccucgcgcuagagaacgaaacuugcguuccuggcgcggauggcuuggaagcuccagugacagaaggaccugguagcgucgacgaaaagcuccccgccccugagcccugcguugguaugucuugcccacccggauggggucaucuggacgcaacaagugccggagagaaggcucccagcccuuggggaucuauuaggacgggagcccaagccgcccauguuuggacaccagcagcagguagcugcucaguuagcuguggaagaggucugauggagcucagauuuuugugcauggauagugcccugcgcguuccugugcaggaagaguuauguggccuggcaaguaaaccggguucucgaagagaagugugucaggcuguaccaugcccagcucgauggcaguacaagcuagcggccugcuccguguccugcggccgaggggugguuagaagaauucuguacugcgcacgcgcacauggugaggacgacggggaggagauucugcuggacacccaaugucagggauuaccucguccagaaccucaggaagccugcucauuagagcccugcccuccaagguggaaaguuaugagccugggacccuguucggccaguuguggccuggggacggcaagacguucaguugcauguguccaguuagaccagggucaggauguggagguggaugaggcagcuugugcugcccuggugcgcccagaggccuccgucccuugccugauugcagacugcacuuaccgcuggcacguggggacguggauggaaugcucuguuuccugcggagauggaauacaaagaaggagagauacgugccucggaccacaggcgcaagcaccagucccagcagacuucugccaacaucugcccaaaccaguuacuguucggggcuguugggccggcccuugcgucggccaaggugcuuguggccgccagcaucuggaaccuacaggaacaaucgacaugcgcggaccgggacaggcagacugugcaguugcgaucgguagaccucuuggagagguggugacguuaagagugcucgagucuucacugaauuguagugcaggcgauauguugcuucucuggggccggcucacuuggagaaagaugugucggaaacugcuggauaugaccuuuucaucuaagacuaacacacugguuguucgacagagguguggaagacccgggggggguguuuuacuccgguacgggucucaacuugccccugaaaccuucuacagagaaugugacaugcaguuguucggaccuuggggggaaauuguuaguccgucucugagcccagcaacguccaacgcagggggaugccgguuguuuauuaacguagcgccccacgcccgaaucgcuauucacgcucuggccacuaacaugggcgccgggacagaaggugcgaacgcgagcuacauccugauucgagacacucacucccugagaaccacagcuuuccacggccagcaaguguuguauugggaaucagaaagcucccaggccgagauggaguuuagcgagggauuucuuaaagcccaagccucgcuucgcggacaguauuggacacuacaaagcugggucccagagaugcaggauccccaaucauggaaaggaaaagagggcacauag

SEQ ID NO: 5113 - RNA, 672 nt, Artificial Sequence
  Description of Artificial Sequence: Synthetic coding sequence
augcgcggacccggacaagccgacugcgcaguagccauugggcggccucugggggagguuguuacuuugcguguguuggaaucuagccugaauugcucugcaggcgauauguuacuccugugggggagacuaacuuggcgaaaaauguguaggaaguugcuggacaugacauucuccuccaagaccaauaccuuggugguaaggcagagaugugguagacccggaggggggguacucuuaagguacgguagucagcuugcacccgaaaccuuuuacagagagugugacaugcagcuuuuuggaccauggggcgaaaucgucucaccaagucugagcccugcuacaucaaaugcugguggaugucgguuauucauuaauguggccccgcaugcacgcauugcaauacacgcucuagccacaaauaugggcgccggcacugagggugccaaugcgucauacauucugaucagggacacucacucgcugaggacaacagcuuuucacggacagcaggugcucuacugggagucugaaucuucucaagcugaaauggaauuuuccgaaggguuccugaaagcccaagcaucucuccgagggcaguacuggacauugcagagcugggucccagaaaugcaggauccccaaucauggaagggaaaagaaggaacuuag

SEQ ID NO: 5114 - RNA, 1035 nt, Artificial Sequence
  Description of Artificial Sequence: Synthetic coding sequence
augcaucagagacacccuagagcgagauguccuccuuuguguguggcaggaauucucgcaugcggguuuuuguugggaugcuggggaccgucucauuuucagcaaucuugcuugcaagcucuggaaccucaagccguuagcagcuaccucucuccaggggcgccauuaaagggcaggccaccaucucccggcuuccaaagacagagacagaggcagcggagagcagcaggcggaauuuugcaccuagaauugcuggucgcuguuggccccgacgucuuccaggcccaucaggaggacaccgagcgguaugugcucaccaaccuaaacaucggugcugaacuucugcgagauccaagucugggugcucaauuuaggguccaccugguaaaaauggugauucuaacagagccugaaggcgccccuaacauuaccgccaauuuaacaagcucguuacucagcguguguggguggucacagacaauaaaccccgaagaugauacagauccaggacacgcugacuuaguucuguacauuacaagauuugauuuggaacugccugacggaaauagacaagugcgaggcgugacccagcugggcggugcauguagcccaaccuggagcugccugaucaccgaagauacgggcuuugaucuaggggucaccaucgcccacgaaaucggccacuccuucggccuggaacacgauggugcaccggguucaggcugcggaccuucaggucauguuauggcaagcgacggcgcugcuccacgugccggucucgccuggucuccaugcuccagacgucaacugcuuucucugcuccgcccgguuccgcccucuccauugccauuacucgcaacucauuugugcgcuggaagaucacugucgcucgggccuucacaggaaccagcgcccggagguggaagaggaccccguacuccagugccaacccauaagcgaccccgauuucagacucugccuuccucauguccacugcuuagaccugcuagcucccguuguacccccagagacuag

SEQ ID NO: 5115 - RNA, 831 nt, Artificial Sequence
  Description of Artificial Sequence: Synthetic coding sequence
augcaccagcgccauccucgggcuagaugcccuccguuaugcguagccggaauucucgcaugcggauuccugcuuggaugcuggggaccuagccacuuucagcaaucguguuuacaggcauuggaaccccaggccguuuccucauaucuuagcccuggugcaccuuuaaaaggccgaccaccaaguccaggauuccagagacagaggcagagacagagaagagccgccggugguaucuugcaucucgaacuccuaguagccguuggaccggaugucuuccaggcccaccaggaggacaccgaacgguacguacugacuaaucugaauaucggcgcugaacucuugagagacccgagccugggggcacaauuuagaguccauuuggugaagauggucauccucacugaaccugagggcgcaccgaauauuacugcaaaccucacauccagccugcucucagucugcggcuggucacagacuaucaacccagaggaugacaccgaucccggccacgccgaucuugugcuguacauuacaagguuugacuuagaauuaccggacggcaauagacagguccgcggggucacacaacugggaggcgccuguuccccuacaugguccugucugauaacagaagacacgggcuucgacuuggggguuacuauugcccacgagauaggacaucguauaugcgcucgccccucaccugcuacgcagaccagauggacaaaggcagcugccgcagcuucauccuuuuuguccuggaugggucaaaacguugccuggcgaucuggcgccccacgaguugccgccgcaccuugguggucauag

SEQ ID NO: 5116 - RNA, 4284 nt, Artificial Sequence
  Description of Artificial Sequence: Synthetic coding sequence
augcaucagcgucaccccagagcuagaugcccuccucugugcguugccgggauucuggcaugcggauuucugcugggaugcuggggccccucccacuuccaacaaagcugccugcaagcucuugaaccccaagccgucuccucuuaccuguccccuggcgccccucugaaaggaagaccuccuagcccuggguuucagcgccaaagacagcggcaacgcagggccgcgggaggaauucuccauuuggaguugcuggucgcagugggcccagacguguuucaggcacaucaagaagacaccgagagauacguuuuaacaaaccugaauauuggcgcugaacuccuacgugacccaucucuaggcgcacaauuuagggugcaucuugucaagauggugauucuaacagaaccugagggcgccccuaacauuacggcaaacuuaaccucuucccugcugagugucuguggcuggagccagaccaucaauccagaggaugauacagauccaggccaugccgaccuuguucuguacauuacaagauucgaucuggaauugccugacggaaauaggcaggugcgcgggguaacccagcuuggcggugcuuguucccccaccuggucuugcuugauuacugaagauacuggauucgaccuuggagucacuaucgcacacgaaauuggucacucauucgggcuggagcacgacggagccccugguagcggaugugggccaagcggacaugugauggccucagacggcgccgccccccgagcaggccucgcuuggagcccuuguagucgcagacaacuccugagucugcugucagccggucgggcuagaugcgugugggacccucccaggccucagccaggcagcgcaggacaccccccagacgcacagcccggucuguauuauuccgcuaaugagcagugccguguugccuuugggccuaaagccgucgccugcaccuucgcucgcgagcaccucgacaugugccaggcuuugucaugucacaccgacccacuggaucaaaguaguugcucacgguuacugguaccacugcuugacgggacugaguguggaguugaaaagugguguagcaaaggccggugcagaucucuuguggaauugacucccauugcugccguccauggccggugguccuccuggggcccucgcucccccugcagccgcucuugugggggcggcguggugacaagaagacgccagugcaauaacccacggcccgcguuuggcggcagagcuugcgugggagccgaccuucaggccgaaaugugcaauacccaagccugcgagaaaacacagcucgaauuuaugucucagcagugcgcccgcaccgacggacagccucucagaucuucaccgggcggagcuucauucuaucacuggggcgcugcaguaccucacucacagggcgacgcccugugcagacauauguguagagccaucggggaauccuucauuaugaagagaggagacucauuucuggauggaacccgguguaugccgucgggaccuagagaagauggcaccuugucuuuaugugucuccggaucuugccgcacuuuuggcugcgacgguagaauggauagucaacaggucugggauagaugccaagucugcggcggcgacaauucaacaugcaguccacggaaagguucguucacagcagggcgagcacgagaguacgucacuuuccucacaguuacgccaaaucuaacaagcguuuauaucgcuaaucaucgaccacuguucacgcaucucgccgugagaaucggugggcguuaugucgucgccggaaaaaugucgaucucaccaaauacuaccuaccccagucuccuggaagacggucggguggaguaucgaguggcacugacugaagauagauugccccggcuggaggagauuagaauaugggggccauugcaagaagacgcagacauucaaguguacaggagguauggagaggaauaugguaaccuuacccguccugacaucacauucaccuauuuccagccuaaaccucggcaagcauggguaugggcagcuguuagagggccuuguuccgucucgugcggggccggccuacgauggguuaauuacuccuguuuagaucaggcacguaaggagcugguagagaccguacaaugccagggcucacagcagcccccggcuuggccugaggcuugcguacuugagccauguccuccauacugggcagucggggauuuuggaccuuguagugcuaguuguggcgguggauugagggagagaccuguaagaugcguggaagcucagggcagucucuuaaagacgcuuccucccgcccgcugucgugcuggugcacagcagcccgcuguugcuuuggaaacuugcaauccccagcccugucccgccagaugggaggucucugaacccucuaguuguacuagcgccggcggggcuggacucgccuuggaaaacgaaacaugcguccccggcgccgauggccuagaagcaccaguuacagaaggacccggauccguagacgaaaagcugcccgcgcccgaaccuugcguuggcaugucuugcccccccgguuggggucaucucgacgccaccucugcgggagaaaaagcuccuucuccaugggguagcauaagaaccggugcgcaagccgcacacguguggaccccagcagcaggaaguugcuccgucucaugcggccgcggacucauggagcuaagguuucuuugcauggauagcgcccuuagagucccaguucaggaggagcugugugggcuggccagcaagcccggcucucgaagggaaguuugccaggccguaccuugccccgcccgcuggcaguauaaacucgcugccuguagcguauccugcggaagaggagucguccggagaauacuguauugugccagagcccacggagaagaugacggggaagagauuuuacuggacacacaaugccagggccugccaaggccugaaccacaggaagcguguagccuggagcccugccccccucgguggaaagucaugucucucggucccugcucugcauccugcggccuggguaccgccaggagaucaguggccugcguacaguuggaucagggacaggauguggaagucgacgaagccgccugugccgcacuugugcggcccgaagcuagugugccuugcuuaauagcugauuguacuuaccgguggcaugucgguacguggauggagugcucuguuuccugcggcgauggcauccagcguagaagggacacaugucucggaccucaggcucaggcucccgugcccgccgacuucugccagcaucuaccaaagcccgugacuguaagaggaugcugggccggacccugugugggucagggcaccccuucucuggucccgcaugaagaagcugccgcccccggccgcacuacugcaacucccgcuggcgcgucucuggaguggucccaagccaggggucugcuguucucucccgcaccgcagccacgucguuugcuucccgggccccaagagaacucagugcagagcagcgcauguggucgucagcaucuggaacccacuggaaccaucgacaugcggggccccggacaggccgacugcgccguggccaucggacgcccacucggcgagguagugacauuacggguacuggaaucaucccucaacuguucagccggcgauaugcuucuguuguggggaagacuuacuuggagaaaaauguguagaaaguugcuggacaugaccuucucuucuaagacaaauacccuuguuguccgccaaagaugugggagaccaggaggcggcguccuccuucgguaugguucucagcuagcaccugaaacauucuaccgggagugcgauaugcaacuauuuggacccuggggugagaucgugagcccuucauugucucccgccacuuccaaugccggagggugccggcucuuuauuaacgucgccccccaugcccguaucgcaauucacgcgcucgcuacuaauaugggggccgggaccgagggugccaaugcuagcuauauccuuauucgagauacucacucccugcgaacgacagccuuccauggacagcagguucuauacugggaaucagaaaguucccaagccgagauggaauucagcgaaggguuucugaaagcucaggcuucucuccggggacaauauuggacucuucaaucauggguaccagaaaugcaagacccacagaguuggaagggcaaagaaggaacuuag

SEQ ID NO: 5117 - RNA, 1095 nt, Artificial Sequence
  Description of Artificial Sequence: Synthetic coding sequence
auggauaugugccaggcauuaucuugucauacagauccccuugaccaaaguucuuguaguagguugcucgugccucugcuggacgggacugagugcgguguagagaagugguguaguaaaggacggugccguuccuuaguagaauugaccccgauugccgcuguacacgguagauggaguucuuggggaccacggucucccuguucuagaucuugcgguggaggcguagucacccgaagacgacaguguaauaacccucggcccgcauuugggggcagagcaugugugggggccgacuuacaagccgaaauguguaauacucaggccugcgaaaagacccagcuggaguucaugucucagcagugcgcaagaacagauggccagccucugcggucaagcccaggcggagccucauucuaucacuggggcgcagcugucccacauucgcagggggacgcgcuuuguagacacauguguagggcuaucggcgagucauucaucaugaaacgaggagauagcuuucuggacgggacucgaugcaugccaaguggaccaagagaggacggaacacucucccuuugcguaucugguucauguaggaccuuuggaugugauggcagaauggauucccagcaggugugggaccgaugccagguuugcggaggggacaacucuacgugcucaccucgaaaaggcaguuucacagcagggagggcaagggaguaugugacauuucugacaguaacaccuaaucugaccagugucuacaucgccaaccaucggccacuguuuacgcacuuggcuguccguaucgguggaagauaugugguugccggcaaaaugaguaucucuccuaauacuacuuacccaagucugcuugaggacggacgaguggaguauaggguugcccuaaccgaagauagacucccaagacucgaggagauuaggauauggggaccucugcaagaagacgccgauauacaaguggggggaguucgugcccaguugaugcacaucucuugguggucaagaccaggccucggugaaagggauuugugcgcacgugggcguuggcccggcggauccucagauuag

SEQ ID NO: 5118 - RNA, 1344 nt, Artificial Sequence
  Description of Artificial Sequence: Synthetic coding sequence
auguccgccucuaaaauuccgcuguuuaagaugaaagauuuaauccugauauuaugccuuuuagagauguccuuugcugugccuuuuuucccgcaacagagcggaacacccggaauggcaucacucagcuuggaaacaaugcggcagcuugguucucuacagagacuuaacacauugucgcaauacucucguuacggauucgggaaaagcuucaauucacucuggaugcauggacuucuucccccacauagcagccugccauggaugcguccgagagaacacgaaacccagcaauaugaauacagucugcccgugcaccccccaccucucccaucucagccaagcuugaagccucaacagccaggucugaagccuuuucugcagagugcagccgccacaacuaaccaagcuacagcacugaaagaagcccuucagcccccuauucacuugggacaccugcccuugcaagagggagagcugccucugguacagcagcaggucgcaccauccgacaaacccccaaagcccgaacugcccggaguggacuucgcagauccccaaggaccaucucugcccggaauggauuucccggauccacaaggacccucguuaccaggccucgacuuugcugauccucaagggaguaccauuuuucagauugcucgucucauaagccacgguccgaugccgcagaauaaacagucaccccuguaccccgguauguuauacgugccauuuggcgcgaaccagcuaaacgcucccgccaggcucgggauuaugagcuccgaagaagucgcugggggcagagaagacccuauggcauacggugcuauguuuccuggcuuuggagguaugagacccggguuugaaggcaugccccacaaucccgcaaugggcggugauuuuacccuggaguuugauucacccgucgccgcgacaaagggacccgaaaacgaagaagguggugcacaggguuccccuaugcccgaagccaaccccgacaaccucgagaacccugcauuuuugacugaacuggaacccgccccgcacgcgggcuugcuggcccuccccaaggacgacauuccaggacucccgcgaagcccuucuggaaaaaugaaaggccucccuagcgucacuccugccgcagccgacccacuuaugacuccugagcucgccgacguuuaccgcacuuaugaugccgauaugacaacaagcguagauuuccaggaagaagcuacuauggauaccacaauggcucccaacucucuucagacgagcaugcccgguaacaaggcgcaggaaccagaaaugaugcacgacgcauggcacuuccaagaacccuag

SEQ ID NO: 5119 - RNA, 1299 nt, Artificial Sequence
  Description of Artificial Sequence: Synthetic coding sequence
augagugcaucaaagaucccacuguuuaagaugaaagauuugauuuuaauccuaugucuccuggaaaugucuuuugcagucccauuuuuuccucagcagagcggcacacccgguauggccagccuuucccucgagacaaugcgccaauuagguucucuacagcgacuuaacaccuuaucccaguauucaagauauggcuuuggcaaaaguuuuaacucacuauggaugcacgggcuucucccaccccacucaucccugccuuggaugcggccaagggaacaugaaacgcagcagccaagccuaaaaccccagcaaccagggcuuaagcccuuucuucagucagccgccgcuacaaccaaucaggccacugcccucaaagaggcccuccagcccccaauucaucucggucaccugccacugcaggagggagagcugccgcuuguucagcaacaggucgcaccaagcgauaagccaccuaaaccggaguugccagggguggacuucgcagacccacagggccccagccuucccggcauggacuucccagauccccaaggccccucauugccuggacuugauuucgccgauccucagggcucuacgaucuuccaaaucgcuagacugauaucacauggaccgaugccacaaaacaagcagucaccgcuauacccuggaaugcuguacguuccuuucggggccaaccagcucaacgcccccgcaagacugggaauuaugucuuccgaagaaguggccggcggacgagaagacccuauggccuacggugcuauguuuccuggauuuggcgguaugagaccagguuucgagggcaugccccacaaucccgcuauggggggagacuuuacucuggaguucgacucuccaguggcagccacaaaaggccccgaaaaugaagagggcggcgcccagggaucccccaugcccgaggccaacccugauaacuuagagaauccagccuuucugacagaauuagaaccugcgccccacgccggucuacuugcgcuucccaaagacgauauucccggccuaccacguucccccucagguaaaaugaaaggacucccuucugugaccccagccgccgcugacccacucaugacgccggagcuugcugauguauaccggacauacgaugccgauaugaccacaagcguggauuuucaggaagaggccacaauggacacgaccauggccccuaacucacuucagacaucaaugccggggaacaaagcacaagaaccagagaugaugcacgaugcuuggcacuuucaagaaccuuag

SEQ ID NO: 5120 - RNA, 1341 nt, Artificial Sequence
  Description of Artificial Sequence: Synthetic coding sequence
augagcgcguccaaaauuccccuuuucaagaugaaagaccugauccugauacuuugcuugcuugaaaugagcuucgcagucccauucuucccucagcaaucuggcacacccggaauggccagucugucucucgaaacuaugcgccagcuggguucccuucagcgacucaauacucugagccaguacucccgcuauggcuuugggaagucauuuaacuccuuguggaugcauggccuacuucccccccacucuucccuccccuggaugcgaccaagagaacacgaaacacagcaguacgaauacagccugccagugcaucccccccccuugcccucucagccuuccuugaagccccagcaaccaggacucaagccauuucuccagagcgcagccgccaccacaaaucaggcuacagcucuuaaagaagccuuacagcccccaauccaccugggccauuuaccacuucaggagggagaacugccacuggugcagcagcaaguggcgccaucugacaaaccccccaagccggaacuccgcguggacuucgcugauccucagggccccagucucccuggcauggauuuccccgacccucagggcccaucgcugccgggacucgauuuugccgauccucaaggcuccacaaucuuucagaucgcacgcuuaauuucucacggcccaaugccucagaacaaacagucuccccuuuaucccgguauguuguacguucccuucggugcaaaccagcugaacgcaccugcgcggcuaggaauuauguccucagaggagguggcaggaggcagggaagaucccauggcuuacggugcaauguuuccuggcuucggugggaugagaccaggauucgaagguaugccccauaaccccgcaauggggggggacuuuacauuggaguucgacucuccaguggcagcaacuaaggguccugaaaaugaagaaggcggcgcacaaggcucucccaugcccgaggcaaacccagacaaucucgagaacccagccuuuuugacagaacuggaaccugcuccccacgccggccugcuggcccucccuaaagaugacauaccuggacugcccagauccccauccggaaaaaugaaaggacuaccuaguguaacucccgcagccgcagacccacugaugacgccagaacuggcggauguguacagaacguaugaugcagacaugacuacuucaguugauuuccaggaggaagccacgauggacacaacuauggcgccgaacucucuacagacaaguaugcccgggaauaaggcacaggaaccugagaugaugcaugaugccuggcacuuccaagaacccuag

SEQ ID NO: 5121 - RNA, 528 nt, Artificial Sequence
  Description of Artificial Sequence: Synthetic coding sequence
auggggacauggauccuguuugcaugccugcuuggggccgcuuucgccaugccagugcugaccccccucaagugguaccagucuauacgacccccuuauccaucauauggcuacgaacccaugggcggauggcugcaccaucagauaauccccguacugucucagcaacaccccccaacacacacacuucagccgcaccaccauauucccgucgugccagcucagcaacccgugaucccccagcaacccaugaugccuguuccaggacagcauucuaugacaccuauucaacaucaccaacccaaucugccacccccagcccagcaaccauaucagccgcagcccgugcagccccaaccacaucagccaaugcagccccaaccccccguccauccaaugcaaccccuaccaccccaaccuccacuucccccaauguuccccaugcagccuuugccaccaaugcucccugaccugacccucgaagccuggcccuccacugacaaaaccaaacgugaagaaguggacuag

SEQ ID NO: 5122 - RNA, 618 nt, Artificial Sequence
  Description of Artificial Sequence: Synthetic coding sequence
augggcacguggauuuuguuugcaugccuguuaggagcagcuuucgccaugccccugcccccccaucccggccaucccgguuacaucaauuucucuuacgaaaacucucacagccaagccaucaauguugaccgcacagcccucguccugacaccuuuaaagugguaucagucaauucggccaccauaccccucuuacggauaugagcccaugggcggcuggcugcaucaccaaaucauuccuguccucagucagcagcauccucccacacacacccuccagccccaccaucacauuccaguagucccagcacaacagccuguuauuccacagcagcccaugaugccugugcccggacagcacaguaugacuccaauccagcaccaccagccaaaccucccuccaccugcccagcaaccauaucaaccccagccuguucagccgcagccccaucagccaaugcagccccaaccucccguucaccccaugcaaccacuacccccgcagccaccacucccgccuauguuuccuaugcagccucuuccaccaaugcugccggaccugacccuagaagccuggcccagcaccgauaaaacgaaacgagaagaaguagauuag

SEQ ID NO: 5123 - RNA, 576 nt, Artificial Sequence
  Description of Artificial Sequence: Synthetic coding sequence
augggaacuuggauccuguucgcaugucuccucggcgcugcuuucgcaaugccuuugcccccucacccaggccauccuggauauauaaauuuuagcuacgaaguucuuacuccucucaagugguaucagucuauaagaccccccuauccaucauauggauaugagccuaugggaggaugguugcaccaucaaaucaucccaguccuaucucagcaacacccuccaacccauacccuccagccccaccaccacaucccugucgugcccgcccagcagccuguaauaccacagcaaccuaugaugcccguaccaggccaacacuccaugaccccaauucaacaccaccagccuaaccugccuccacccgcccaacaaccuuaucaaccccagcccguccagccucaaccacaccagccgaugcagccccaaccaccuguacauccaaugcagccucugccgccucaacccccacucccaccuauguucccaaugcaaccucugcccccuaugcugccagaucuaacccucgaagccuggccaucgaccgauaaaaccaagagagaggagguagacuag

SEQ ID NO: 5124 - RNA, 804 nt, Artificial Sequence
  Description of Artificial Sequence: Synthetic coding sequence
augaaggcggcuguucuaacccuggccgugcucuuucugacaggcucacaagcacgacacuucuggcaacaagaugaaccaccacagagcccuugggaucgggugaaagaucucgcaaccguauaugucgauguucugaaggacucaggcagagacuacgugagccaguucgaggggucagcgcucgguaagcaauuaaaccugaaacuuuuagauaacugggacucggugacuaguacuuuuuccaaacugagagagcagcuugguccggugacacaagaauuuugggauaaccuagagaaagaaacagagggucugaggcaggagaugucaaaagaccuggaggagguaaaagcaaaagugcagccuuauuuagacgauuuccagaagaaauggcaggaagagauggagcuguaucgccagaaaguugaaccucuccgggccgaguugcaggagggagcgagacaaaaacuucaugaacugcaggaaaagcugagcccacugggagaagaaaugagagaccgugcgagagcccacguugacgcauugcguacgcacuuagccccauauagugacgaguuacggcagugucuggcggccagacuagaggcucugaaagaaaaugguggggcgcguuuagcugaauaucaugccaaggccacggagcaccuuucuacccugagcgagaaggcuaaaccagcccuggaagaucuaagacagggucuccuccccgugcuggaaaguuuuaaaguaucauuucugagugcuuuagaagaguauacuaagaaauugaauacccaauag

SEQ ID NO: 5125 - RNA, 804 nt, Artificial Sequence
  Description of Artificial Sequence: Synthetic coding sequence
augaaggcggccgugcugacccuggccgugcucuuccuuacuggaagucaggcgagacauuuuuggcaacaggacgagccuccacaaucaccaugggaccgugucaaagaucuugccacaguuuaugucgacguauuaaaagauagcggacgagauuacguaagccaguucgagggcucagcacugggaaagcaauugaauuugaaacugcuagacaauugggauuccgucacaucgacuuuuaguaaacuucgagaacaguuaggccccgucacucaggaauucugggauaauuuggagaaagagaccgagggucuacggcaggaaauguccaaggaucuagaggaggugaaggcaaagguccagcccuaccuggaugacuuccagaaaaaguggcaggaagaaauggagcuguauaggcagaaggucgaaccacugagagcggaacuacaggagggggcccggcaaaaauuacaugaauugcaggagaaacuaagcccacuaggcgaggagaugagagauugcgcucgggcccacguugaugcacugcgaacacaccuggcgcccuauucugacgaacuuaggcagaggcuagcagcacgucuugaagcuuugaaggaaaaugguggagccaggcuggcggaauaccaugccaaggccacagagcauuugucuacccuuagugaaaaagccaagccagcacuggaagaucuuaggcaaggccuucucccugucuuagagaguuucaaaguaucauuccugucagcccuugaggaguacaccaagaaacuaaacacucaguag

SEQ ID NO: 5126 - RNA, 804 nt, Artificial Sequence
  Description of Artificial Sequence: Synthetic coding sequence
augaaggcggccgugcucacacuggccguucuuuuccugacaggaucucaggcgaggcauuucuggcagcaagaugaaccaccccagaguccuugggacagagugaaagacuuagccaccguuuacguugacguacuaaaagauucuggcagagacuacgugagccaguuugagggaucggcacucggaaagcaauugaacuugaaacugcuggauaauugggacagcgugacaucuacauucucuaaacuuagggaacagcugggaccugugacacaggaauucugggacaaucucgaaaaagagacagagggacugaggcaggagauguccaaggaccuagaagaaguaaaggccaagguccaaccuuaucuggaugauuuccaaaagaaguggcaggaagaaauggaacuguaucgucagaaagucgaaccacuccgggcugaguugcaggaaggggcaagacagaaacuucacgagcuccaggagaaacuauccccuuugggagaagaaaugagagaccgcgcacgugcccauguggacgcccugagaacacaucuagcgcccuauagcgacgaacugcgccagaggcucgcagccagauuggaagcacugaaagagaauggcggagcacgucuugcagaauaccacgccaaagccacagagcaucucucaaccuugagugagaaagccaaaccugcgcuagaggaccugcgccagggcuuacugccuguuuuggaaagcuuuaaaguaucuuuucugucugcacuggaagaauacaccaagaaauugaacacgcaguag

SEQ ID NO: 5127 - RNA, 804 nt, Artificial Sequence
  Description of Artificial Sequence: Synthetic coding sequence
augaaagccgccgucuugaccuuagcuguuuuguuccucacgggaucucaggcuaggcauuuuuggcaacaggacgagccuccccaaucuccuugggauagaguaaaagaucucgccacagucuauguggacgugcucaaagacagcggacgggauuauguaagucaauuugagggaagcgcacuggggaaacaacuaaaucugaaacuccuggauaauugggauagcgucacuagcacauucagcaaacuaagggaacaauugggucccgugacccaggaauuuugggacaaucucgaaaaagagaccgaaggccugcgacaggaaaugaguaaagaucuggaggaagugaaagcgaagguacagccauauuuggaugauuuucagaagaaauggcaagaagaaauggagcuguaucggcaaaaaguggagccuuugcgagcagaacugcaagagggcgcuaggcagaagcugcaugagcugcaagagaaguugagcccacuuggggaagagaugcgcgaucgggcccgagcacauguagacgcauugcggacacauuuagcccccuacuccgacgaacugaggcagagauuggccgcacgccuagaagcucucaaggaaaacggaggcgcuaggcucgccgaauaccaugccaaagccaccgaacaucugucuacccucucugagaaggcgaaaccagcuuuggaagaucugcgccagggcuuauugccuguucucgaaaguuucaaaguaaguuuccuaucggcauuggaagaguauacaaagaagcugaacacccaguag

SEQ ID NO: 5128 - RNA, 804 nt, Artificial Sequence
  Description of Artificial Sequence: Synthetic coding sequence
augaaagccgccgugcuuacguuagccgugcuguuccuaacaggcucucaagcuaggcauuuuuggcagcaggacgaaccaccgcaaaguccaugggauaggguuaaggaccuggcuacuguguacguggaugugcucaaggauagugggagggacuaugugagucaauuugagggauccgcucucggcaagcagcugaaucugaagcuuuuggauaauugggauuccgugacaucuacuuucucuaaacuccgggagcaguuaggccccgucacgcaagaauuuugggacaaucucgaaaaagagacagagggacugcggcaagaaaugaguaaggaccuggaggaagugaaagccaaggugcagccauacuuggacgauuuucagaagaaauggcaagaggagauggagcucuaucggcagaaaguugagccuuuaagagcggagcugcaggagggagcgagacagaagcuucacgagcuacaggagaaacuuucaccccugggcgaggaaaugcgggaccgagcccgagcgcaugucgacgcucugcguacccauuuagccccuuacagugaugaguuacgucagaggcuugcagcaagguuggaagcuuugaaagaaaacgguggggcaagacuggcagaauaccaugcaaaagcaaccgaacaccucucaacucugagcgagaaggccaagccugcguuggaggaucugcgacagggucugcuuccugugcuggaaucauuuaaagugaguuuucugagugcccuagaagaguauacaaagaaacuaaauacacaguag

SEQ ID NO: 5129 - RNA, 804 nt, Artificial Sequence
  Description of Artificial Sequence: Synthetic coding sequence
augaaagccgcggugcugacccucgcugugcucuuccugacggguucacaggcacgacacuucuggcaacaagaugagccaccacagagccccugggauagaguaaaagacuuggcuaccguuuacguggacguacuaaaagacagcggucgggacuacgugagucaguuugaagggagcgcucuaggaaaacagcugaaucugaagcuuuuggacaauugggacucaguaacaucuaccuucucaaagcugagagagcagcucggccccguuacccaggaauuuugggauaaucucgagaaggagacagagggccuccggcaagagaugaguaaggaucuggaggaagugaaagcaaagguucagccuuaucuagacgauuuucagaaaaaguggcaggaggagauggagcuguauagacagaaaguggaaccguugagagcagagcugcaagagggcgcccggcagaaguuacacgaauugcaagagaagcuauccccccuuggagaggagaugagggaccgggcacgagcacacguggacgccuuaagaacccaucuggcacccuacagugaugagcugcgacagcguuuggcugcccgacuggaggcgcucaaggagaauggaggagcccgucucgcagaauaccaugcuaaggccacugaacaccugagcacguuaucagaaaaagccaaacccgcucuggaggacuugagacaaggccuccucccuguucuagaaucauuuaaagugaguuuucugucggcccuggaggaauauacaaaaaagcucaauacccaauag

SEQ ID NO: 5130 - RNA, 798 nt, Artificial Sequence
  Description of Artificial Sequence: Synthetic coding sequence
augaaaaaagaaguaugcagcguggcuuuucuaaaggcaguuuucgcugaauuucucgccacacucauuuuugucuucuucggacucgggucugcacugaaauggccuagcgcccuccccaccaucuugcagauagcccucgccuucggauuggccauagggacccuugcccaggccuuaggccccgucucaggcggccauaucaaucccgcuaucacgcuggcacuucuugucgggaaccagauaucccucuuacgugccuuuuuuuacguugccgcucagcugguaggugccaucgccggcgcagggauccuguacggcguagcuccucugaaugcucgagggaaccuugccguaaacgcucuuaacaauaacaccacucagggacaggccaugguagucgaacucauucuuacuuuccaacucgcacugugcauuuucgccagcacugacagccgcagaaccucccccgucgggucccccgcccucucuaucggauuaucaguuacccugggucaccuugucgguaucuacuuuaccggguguucaaugaaucccgcacggucauucggcccggccgucgugaugaauagauuuucuccggcacauuggguguuuuggguaggaccuaucgugggugcgguuuuggcagccauccuguacuuuuaccugcuguuuccuaacucauugucucugucagaaaggguggcuauuauaaaggggacauacgaaccugacgaagacugggaagaacaacgggaagagaggaaaaaaacuauggaacugacuaccagauag

SEQ ID NO: 5131 - RNA, 663 nt, Artificial Sequence
  Description of Artificial Sequence: Synthetic coding sequence
auggaguuggguuuggggggacuaucaacucugagccacuguccauggccgcgacaacaaccugcucuuuggccuacucucgcugcguuggccuugcuuucuuccgucgcagaagccucccugggcucugcuccucgaucgccagccccaagggaaggcccaccucccguuuuggccucccccgcuggucaccugccgggaggcagaacugcaagaugguguucgggucgggccagacggccaccuccacaaccaucuagacccgcaccuccuccucccgccccacccucugcuuugccacgaggcggcagagccgcucgggccggcggaccuggaagccgagcucgugcagccggagcucggggcuguagacugaggagccaacuggugcccguuagggcacucgggcugggucauagaucugaugaauugguucguuuuagauucuguucuggcucuugccgcagagcgagaagcccucaugacuugucccucgcaagccuacuuggcgcuggcgcuuuacggcccccaccugggagcagacccguaagucagccuugcugucgacccacacguuacgaagcuguuucauucauggacguaaacucaacuuggcguaccguugacagauugagcgcuacugcuugcgggugucuaggcuag

SEQ ID NO: 5132 - RNA, 663 nt, Artificial Sequence
  Description of Artificial Sequence: Synthetic coding sequence
auggaacuuggucuggguggucugucuacauuaucccacugcccuuggccacggcagcagcccgcacuguggcccacacucgcggcccucgcgcuucuaucuagcguggcagaggcaucccuugguucagcuccaaggagcccagccccacgggagggcccucccccaguccuggcuucgccggcgggucaucucccuggcggucggaccgcaagauggugcucaggucgcgcccgaaggccccccccccaaccuagcaggcccgcgccuccucccccagcuccgccauccgcgcuuccgcggggaggccgugccgcgcgagcuggaggccccggcagucgggcuagagcugcaggcgcaagagguugcagacuuaggagucaguuaguuccugugagggcccuuggccucggacaccgaucugaugaacuuguuagauucagauuuugcucuggaucuugccgcagagcacgcucuccacaugauuugucucuggcuucucuccugggggcaggagcccuacgucccccgccggguucgcggccaguuagccagcccugcuguagacccacccgguaugaagccgucaguuucauggacgucaauucaacuuggagaacuguugaucggcugagcgcgaccgccuguggaugccugggguag

SEQ ID NO: 5133 - RNA, 687 nt, Artificial Sequence
  Description of Artificial Sequence: Synthetic coding sequence
auggaacuaggccuaggcggacuguccacccugucgcacugcccauggccaaggcagcaggcuccucugggucuguccgcacagccggcacuuuggccaacguuggccgcccuggcucucuugaguucgguagcugaagccaguuugggcagcgcuccuagaucccccgccccucgugaaggcccuccaccuguacuagccucucccgcaggucaccugcccggcggcagaacagcccgcuggugcucaggacgcgcacggcgcccaccuccucagccuagucgcccugcccccccuccuccagcaccuccgucggcucucccccggggugggagagcagcaagagccggcggaccagggagcagagcaagggcagcaggagccaggggauguagacugcgaagccagcuggugcccgugcgagcacuggggcugggacaucggagcgacgaacugguccguuuuagauucugcagugguagcuguagaagagccagaucuccucaugaucuaucacuggccucucuccucggcgccggcgcacugagaccucccccuggaagucgacccguuucacagccauguugccgcccgaccagauaugaagccguuaguuuuauggaugugaacucuacauggcgaacugucgauagguugagugcgacugcuuguggaugccugggcuag

SEQ ID NO: 5134 - RNA, 201 nt, Artificial Sequence; identical to SEQ ID NO: 4804
  Description of Artificial Sequence: Synthetic coding sequence

SEQ ID NO: 5135 - RNA, 270 nt, Artificial Sequence; identical to SEQ ID NO: 4805
  Description of Artificial Sequence: Synthetic coding sequence

SEQ ID NO: 5136 - RNA, 201 nt, Artificial Sequence; identical to SEQ ID NO: 4806
  Description of Artificial Sequence: Synthetic coding sequence

SEQ ID NO: 5137 - RNA, 270 nt, Artificial Sequence; identical to SEQ ID NO: 4807
  Description of Artificial Sequence: Synthetic coding sequence

SEQ ID NO: 5138 - RNA, 687 nt, Artificial Sequence
  Description of Artificial Sequence: Synthetic coding sequence
auggaauuaggacuggguggacuguccacccugagucacuguccauggccgagacagcaggcuccccuaggacucucugcccagccagcuuuauggccuacgcucgcagcucuagcccuuuuaaguucagucgcagaggcuucccuuggcucggccccacguucuccugcccccagagagggaccuccacccguacuggccuccccagccggacaccuuccagguggaagaacugccagauggugcagcgggagggcuagaagacccccgccacaaccuagcaggcccgcgccaccacccccagcaccaccuagcgccuuaccacgaggggggagagccgcccgggccggggggccuggaucuagggcgagagcggccggagcccgcgggugccgguuaaggucgcagcugguaccagugcgggcauuaggucucggccaccgcucugaugaacucguucgcuucagauuuuguucuggcaguugucgucgcgcuaggagcccccaugacuugucacuugccucacuguugggagccggcgcccugcggccgccaccagguucccgcccuguuucucaacccugcugucgaccaaccagguaugaagccguauccuuuauggacgucaauagcacuuggaggacaguagacagguugagcgccaccgcuugcggaugccuugguuag

SEQ ID NO: 5139 - RNA, 1602 nt, Artificial Sequence
  Description of Artificial Sequence: Synthetic coding sequence
auggggccaagaggugcugccagccugccccguggaccugguccuagaaggcuuuugcuuccagugguccugccgcuccugcuauugcuucuccuagcaccaccugggucuggagccggugcuaguagaccuccacaccugguuuuccucuuagcagacgacuugggcuggaacgacguaggcuuucaugguagucgaaucagaacgccacaccuugacgccuuggccgcaggaggggugcugcucgacaacuacuacacccaaccucuuugcacaccuaguaggucacagcugcucaccggucguuaccagaucagaacaggcuugcagcaccagauuauuuggccaugucagccguccugcguuccacuggacgagaaauuacugccccaacugcugaaggaggccggauacacgacucauauggugggaaaauggcauuuaggcauguaccgaaaggaaugucugcccacucgacgcggauucgacaccuauuucggauacuuguuaggcucagaagauuacuauagucaugaacgaugcacccuuauagaugcgcucaaugucacacguugcgcccuggacuucagagacggagaagaagucgccacaggauauaaaaauauguauagcacaaauaucuucaccaagcgcgccaucgcuuuaaucacaaaucaccccccagagaaaccccuuuuccuuuaccuggcccuucagucaguucaugagcccuugcaggucccugaagaguaccugaagcccuacgauuuuauucaggauaaaaauagacaccauuaugcuggaaugguguccuugauggaugaagcaguggguaacguuacugcagcgcucaaguccaguggucucuggaauaacacagucuucaucuuuagcacugauaacggaggacagacccucgccggagggaacaacuggccuuuaagagggagaaaguggucacugugggaagguggggugcgcggcguuggcuuuguagcuuccccccugcucaaacagaagggugugaaaaauagagaacuuauccauaucagcgacuggcucccaacacucguuaaacuugccaggggucacacuaauggaaccaagccccuggauggcuucgaugucuggaagacuauuuccgaaggaucgccuuccccgagaaucgaacugcugcacaauauagacccgaauuuuguggacagcagcccaugcccccgcaacucaauggcacccgcgaaagaugacuccagccuuccugaauacucagccuucaauacaucgguucaugcugccauucgacacggcaauuggaaauuguugacaggcuauccuggguguggcuacugguuucccccuccuucccaauacaauguguccgaaaucccuucuucagacccgccuacaaaaacuuuguggcuuuuugauaucgaucgagauccugaggagagacaugaucuguccagagaguacccgcauaucguuacuaaguugcucucaagauugcaguuuuaucacaagcauagcguaccaguuuauuuuccagcacaagaucccagaugcgaccccaaagcuacaggggugugggggccauggauguag

SEQ ID NO: 5140 - RNA, 1602 nt, Artificial Sequence
  Description of Artificial Sequence: Synthetic coding sequence
augggcccccggggcgccgccucucucccacggggucccggaccaaggcgacuccuccugccagucguucucccguugcucuuacuccuauuacuggcaccaccuggaagcggcgccggcgcaucccgcccaccccaucuggucuuuuuauuggcagacgaccugggauggaacgacgucggguuucacggcucuagaauucggacaccucauuuagaugcucuagccgcaggcgguguucuacucgauaauuacuauacccagccacuaugcacgccaucuagaucucaguuguugaccggaagauaucaaaucagaacuggacuacagcaccaaauuaucuggcccugccagccauccugcguaccuuuggacgaaaagcuguuaccccaacugcucaaagaggccggcuauaccacucacaugguggggaaguggcaucucggaauguaucgcaaagaaugucuacccacgagacgcgguuucgacacuuauuuuggguaccuuuuaggcagugaagacuauuacucucacgaaagaugcacacuuaucgaugcucugaauguuacaaggugugcucuagacuuccgggacggugaggagguugcuaccggcuacaaaaauauguacucuaccaauauuuucacuaaaagagcgaucgcccuuaucaccaaccacccaccugagaagccccucuuccuauaccuggcucugcaaagcguucacgaacccuugcaaguaccggaggaauaucugaaacccuacgauuuuauccaagacaagaacagacaccacuacgcagggauggugagucugauggaugaagcagucggcaacguaacagcugcccucaagaguuccggccuauggaacaauacgguguuuauuuucagcacagauaacggcggacagacgcuggcagguggcaauaauuggccgcugaggggccgcaaauggagcuugugggagggaggaguccgggggguggguuuuguugcaucuccacuguugaagcagaaaggcguaaaaaaccgcgaauuaauucauaucucugauuggcugccaacucucguuaaauuggcuaggggacauacaaaugggaccaaaccauuagauggguuugauguuuggaaaacaauaagcgagggcagcccaucucccagaaucgaacugcugcauaauauagaucccaacuuuguggauuccucacccugcccacguaacuccauggcuccagcaaaggaugauuccucccuccccgaauauuccgccuuuaacacaaguguacaugcagccauccgccaugggaauuggaagcuucugacggguuauccugggugcggguauugguucccuccucccucacaguauaacguauccgaaaucccaagcagcgauccccccaccaagacuuugugguuauuugauauugacagagaucccgaggagaggcacgauuuaucccgcgaguauccccacaucgugacgaaacuacuuaguagauugcaguuuuaucauaaacacaguguacccgucuacuuucccgcccaggacccaagaugcgacccaaaagcgacgggcguuuggggcccauggauguag

SEQ ID NO: 5141 - RNA, 1242 nt, Artificial Sequence
  Description of Artificial Sequence: Synthetic coding sequence
augggcccccguggagcagcuucacucccccguggacccggaccgagacgccuucuacucccagucguacugccucugcuccuucugcugcugcuggccccaccagguucuggugccggcgccucccgccccccucaccuaguuuuccugcuugccgacgaccuggguuggaaugaugugggauuccauggcuccaggauucggacgccccaccucgaugcccucgcagccgguggcguucugcuugauaacuauuauacacagccccuaugcacgccgucacguagccagcuguugaccgguagauaccagauucggacaggacuucaacaucagaucaucuggcccugccagccuaguuguguaccucuggacgagaaacuacugccacagcuucucaaggaagccggauauacaacucacauggugggcaaguggcauuugggcauguacagaaaggaaugucuuccuacuagacgaggcuucgacaccuacuuuggauacuuacugggaucugaagauuauuacagucacgagagaugcacgcucauugacgccuuaaauguuacccguugcgcucuggauuuucgggauggugaggagguagcaacuggauacaagaacauguauaguacaaauauauucaccaaaagggcgauagcucugaucaccaaucauccaccggaaaaaccccucuuccuguacuuggcucuacaaucaguucaugaaccucugcaggucccugaagaauacuugaaaccauacgauuucauccaagauaaaaaucggcaccacuacgcuggaaugguuagucucauggacgaggccgugggcaacgucacugcagcucuuaaaagcucaggccuguggaauaacacugucuuuauuuuuagcaccgauaauggcggacaaacacucgccgguggcaauaacuggccucugagaggcagaaaauggucgcucugggagggcggugugagaggagugggguuuguagcaucgccccuccuuaaacaaaagggcgugaaaaaucgugaacugauacauauuuccgauuggcucccuacccugguaaagcuggcucgcgggcacacaaacggaacaaagccucuggacggauuugacguguggaagacaaucagugaagguagcccuaguccgcggauugaacuacuucauaauauugaccccaacuuugucgacucuucuccuuacuggcccgaauguucccugcugcuuuag

SEQ ID NO: 5142 - RNA, 138 nt, Artificial Sequence; identical to SEQ ID NO: 4812
  Description of Artificial Sequence: Synthetic coding sequence

SEQ ID NO: 5143 - RNA, 1788 nt, Artificial Sequence
  Description of Artificial Sequence: Synthetic coding sequence
auggcaggcccgucaccuccccuucgcgcgggggugggcaggcgcuuacucgggguugcccaccccgaccugagacccugucuuuguggggagcuucaaguggaaggaggacccggaccgguuccaggcaugcuaaggacuuguuaugugaggagcccauggcggcgagguccaucaagugcaaggggcgagcaguccggaucaggccaccucgaacaagaagaaguacagagcggcagcuuauuguuuagacuccugcucuuucugucucgaucucccgcaucacguaaccagcgcaucuuguauacuguucuagaaugccagccucuauuugauagcucagacaugacgauugcagagugggugugucuggcacagacuauaaagcgacacuacgaacaguaccacggcuucguugucauccaugggaccgacaccauggcauuugcugcgucuaugcucucauuuauguuggaaaaccuccaaaaaacgguuauccugacuggcgcccaaguuccaauucacgcacuuugguccgacggccgcgaaaacuuacugggcgcccuacucauggcaggucaguacgucauaccugaagucugucucuucuuucagaaccaguuguuccggggaaauagagcaaccaagguggacgcuagaagguucgccgcuuucugcucuccuaaucucuuaccucucgcgacugucggcgccgauauuacaaucaaucgcgaguuaguccgaaaaguagacggcaaagcuggcuuaguggugcacagcagcauggagcaagacguaggacuccugaggcuuuaccccggcauucccgcugcauuagugagggcuuuccuacagcccccucuuaaaggaguugucauggaaacuuucggguccggaaacggacccaccaaaccagaccuuuugcaagaacuuagaguugcuacugagagaggccugguuaucguaaauuguacgcauugucugcagggcgcagugacgacggacuaugccgcagggauggccauggcaggagcaggcguuauuuccggauucgacaugacuagcgaagcggcccuugcaaaacuguccuacguucucgggcagccuggccugagccucgacguacggaaggaacuguugacuaaggaucugcguggcgaaaugacacccccguccgucgaggagagacgccccucccugcaagguaauacucugggaggugguguguccugguuacucucacugucagguucccaggaagcugaugcacugaggaacgcacucgugccuucucuggccugcgccgcggcacaugcaggcgacguggaggcucuucaggcucuuguagaguuaggaucagaccuaggccucguagacuuuaacggacaaaccccacuccaugcagcugcccgaggaggccauacagaggcggucacaaugcuacuucagcgaggugucgacguuaauacuagggacaccgacggcuuuagcccccugcugcuggcugucagagggaggcauccggggguuaucgggcugcugagagaagcgggagcaucacuuucuacacaagaguuggaagaggccggaacugagcugugcaggcuggccuauagagccgacuuagagggauugcaggugugguggcaggcaggagcagaucugggacaaccaggauacgauggccauagcgccuugcacgucgccgaagcugcugggaaccucgcugugguugccuuucugcaaucacuggaaggcgcuguuggggcccaggcgccaugucccuag

SEQ ID NO: 5144 - RNA, 1740 nt, Artificial Sequence
  Description of Artificial Sequence: Synthetic coding sequence
auggcuagagcggugggcccugaaagaagacugcuggccguguacacaggggguaccauugguaugaggucugaauuaggggucuuggugccaggaaccggacuagcagccauacugagaacacuccccauguuucaugacgaggagcacgcacgcgcucgcggacugucagaagacaccuugguccucccacccgcuucacggaaucagcguauucuauauacuguucuugagugucaaccccuguuugauuccagcgauaugacaauagcagaauggguuugccuggcccagacuaucaaacgucauuaugaacaguaccauggcuucgucgucauacacgggaccgauacaauggccuucgccgcuucaauguugagcuuuauguuagaaaacuugcagaaaaccgugauucucaccggugcgcaagugccuauucaugcccuaugguccgacgggagagagaaucuccuuggcgcacuucucauggccggacaauaugugauacccgaagucugucuguucuuucagaaccaguuguuuaggggaaaucgggccaccaaaguggaugcacguagguuugcugcauucuguagcccuaaccuccugccauuggccacuguuggcgcggauaucaccauuaauagggagcucguccgcaagguagacggcaaggccgggcuuguggugcacucaucuauggaacaagacgucggucugcuucgccuguauccagguauccccgcggcccuggugcgugccuuccuccaacccccccugaagggugucguuauggaaacuuuuggcagcggcaauggcccgacaaagccggauuuguugcaggaacucagagucgcaacugaaaggggauuaguaauuguuaauugcacgcauugucuccagggcgccgugacgaccgacuaugccgcaggaauggccauggcuggcgcaggggugauuagcggauuugacaugacaucugaggcagcucuugccaagcucagcuacguccucggccagccaggccugucccuggauguacggaaagaacuucuuacuaaagaucugcguggcgaaaugaccccgcccucagucgaggagaggagaccaagcuuacagggcaauacgcuuggggggggaguaagcugguuauugagucuuagcggcagucaggaggccgaugcucugcgaaaugccuuaguucccuccuuggcuugugccgcugcccaugccggagauguugaggcccugcaagcccugguggaauugggauccgauuugggucucguggauuuuaauggacaaacaccccuacacgccgccgcacguggcggacacacugaagcugugaccaugcuccuccagagagguguagacgugaauaccagagacaccgauggauucagcccucuuuuacucgccgugcgcggacggcacccaggggucauuggcuugcuacgggaagcaggugccagccucucuacacaggaauuagaagaggccgguaccgagcugugucgucuagccuauagggcagaucucgaaggauugcagguuugguggcaggcaggcgcagaucugggccagcccggcuaugauggacacucugcacugcacguggcugaagcugcugguaacuuagccguuguggcauuucuccagagucucgagggugcuguaggugcccaggccccaugcccugaaccgucaugcuuucaagaaguguugccgggcgucuag

SEQ ID NO: 5145 - RNA, 423 nt, Artificial Sequence
  Description of Artificial Sequence: Synthetic coding sequence
gcugcugcucggggcggucacacugaggccgugacaaugcugcuucagcgcggaguugaugugaacacaagagauaccgauggguuuucuccauuguugcuggcugugagggggagacauccgggaguuauaggacuucucagggaagccggcgcgaguuuguccacccaggaguuggaggaggcagggacagaacugugccgguuggcuuauagggcagaccuggaaggccuucaagugugguggcaggccggggccgaccuuggacaaccuggauaugacggacauucugcacugcacguugcagaggcagcugggaaucuggccgucguugcauuuuuacagucccuggagggagcuguuggugcacaagccccuugcccagaaccaaguuguuuucaggagguguugcccgguguuuag

SEQ ID NO: 5146 - RNA, 1722 nt, Artificial Sequence
  Description of Artificial Sequence: Synthetic coding sequence
auggccagagccgucggccccgaaagaagacuucuggccguuuacaccggcgguacaauuggcaugcguucugagcuuggcguucugguuccaggaacaggacucgcugcaauucuacgaacucucccuauguuccacgaugaggaacacgcaagggcacguggacucucugaggauacacugguacugccaccagccucucggaaccaaagaauucuauacacagucuuggagugccagccucuauuugauucaucagauaugaccauugcagagugggucugucucgcccaaaccauaaagagacacuacgagcaauaccauggcuuuguaguuauccacgggacggacacaauggccuucgcggcuagcaugcucaguuucaugcuugaaaaccugcaaaagaccgugauccucaccggggcccaaguccccauccacgcccucuggucugaugguagagagaaccuguuaggugcacuccugauggcuggacaguacguuauaccugaagugugucucuuuuuucaaaaccaacucuuuagaggcaaccgagccaccaaaguagaugcaagacgcuucgcugccuucuguagcccaaauuuacugccauuggccaccguuggugccgauauaacaauaaaucgugaacuaguucggaaaguggauggaaaggcaggauugguugugcacagcaguauggagcaggaugucggucuccugcgguuauauccaggcauucccgccgccuugguccgggccuuuuuacagcccccacugaagggcguggucauggagacuuucgggagcgguaacggccccacaaaaccagaccuccuacaagagcugcguguugcuaccgagaggggccuggugauuguuaauuguacucacugucuccagggcgcgguuacaaccgacuaugcugcugggauggcaauggccggggcuggagugaucucaggauuugacaugaccucugaagccgcuuuggccaagcugaguuaugugcuggggcagcccgggcuuucucuggauguacguaaagagcuacucacaaaggaccuucggggcgaaaugacuccuccuaguguugaagaacgcaggccgucccugcaagguaacacgcuuggagggggugugucuugguuacuaucucugucggggagccaggaagccgacgcgcucaggaaugccuuggucccaucucucgccugcgccgccgcccaugcaggagauguggaggcccugcaagcucucgucgagcugggaucugaucuuggauuaguggauuucaauggacaaacuccauugcaugcugccgcccgugggggacauacagaggccgugaccaugcuguuacaaagaggaguggaugugaacacacgggauacugacggauuuaguccucugcugcucgccgugcggggacgucaucccggcguuaucggccuucuucgcgaagcaggggcaucccuaucuacucaggaacuggaagaggcuggcacagaacucuguagacuggcuuaccgggcggaucuugaaggacuucaggucugguggcaagcaggagcagaucuggggcagccuggauaugauggacauucugcucugcauguggccgaagcagcuggaaaucuggcaguggucgcguuccugcagucucuggaaggagccgugggagcucaggcacccugccccgaaguccucccuggcgucuag

SEQ ID NO: 5147 - RNA, 4398 nt, Artificial Sequence
  Description of Artificial Sequence: Synthetic coding sequence
augccugagcaagagcggcagauuacagcuagagaaggagcaagucguaaaauacugaguaaacucagcuugccaacuagagccugggaacccgccaugaaaaaaucauucgcuuucgauaacgucggcuacgaagggggacuagacggccucggaccgagcucucaggucgcgaccaguaccguucggauccugggaaugaccugucaaaguugugugaaauccaucgaggaccguaucucuaacuugaaagguauuaucucaaugaaaguuagucuugaacaggguucugcaacugucaaguacguacccuccguugugugucuucaacaggugugccaucaaaucggggauauggguuucgaggcuuccaucgcugagggaaaggcugccagcuggcccagccgcucacuucccgcacaggaggccguaguuaagcugagggucgagggcaugacaugucaaucaugcgugaguaguauagagggaaaaguucgaaaguugcaaggagucgugagagugaaagucagucugagcaaccaggaagccguuauaacuuaccagccguaccuaauccaaccggaagaucucagggaccauguaaacgauauggguuucgaagcugccaucaagucuaaaguugccccucugagucugggaccuaucgauauugaacgucuucagaguacaaauccaaaaagaccccugucauccgccaaucaaaacuucaauaacagugagacacugggacaccagggaucucacgugguuacccuacagcugaggauugacgguaugcauugcaaaucuuguguauugaauauagaggaaaauauuggucagcuucugggaguacagucaauccagguuuccuuggaaaacaaaaccgcucaagugaaauaugacccaucaugcacaucccccguugcccugcaacgcgccaucgaagccuugccacccggaaauuucaaaguaagccuccccgauggggcggaaggcucaggcaccgaccauaggucuuccagcucucacucaccuggaagccccccccgaaaccagguucagggcacgugcagcaccaccuuaaucgcuaucgccgguaugacuugugccucauguguacacucuaucgaagggaugauaagccaacuggagggcguacagcagauaagcgucucccucgcugaagggaccgcaaccguccucuauaauccgucuguuauuucuccagaagaguuacgugcagcaauugaggauaugggauuugaggcuaguguaguguccgagucuugcucuaccaacccacuuggcaaccauucggccgguaacagcaugguucagacaacagacgguacaccaacuuccguucaagagguggccccacacaccggacgucugccagcuaaucacgccccugauauucuggccaagaguccccagucgacccgcgcaguugccccgcagaagugcuuccugcagauuaaaggaaugacgugcgcuagcugugugucuaacaucgaaaggaauuugcagaaggaggcugguguccuuagugugcuggucgcgcucauggcagguaaagcagaaaucaaauacgauccagagguuauccagccauuggagaucgcacaguucauacaggacuuaggauucgaggcagcuguaauggaagauuaugccgggucagauggaaauaucgagcucaccaucaccggaaugacaugcgccuccuguguccauaacauugaaucaaaacucacacgaaccaacggcauuacguacgcauccgucgcucucgccacuuccaaagccuuagucaaguuugauccagaaauuaucggcccacgugauauuauuaaaaucaucgaagaaauuggcuuccacgccucucuagcccaacguaauccgaacgcccaucaccuggaucacaaaauggagaucaaacaauggaaaaagaguuucuugugcagucucguguucggaauucccgugauggcacuaaugauauauaugcugauucccuccaacgagccgcaucaaucuaugguacuggaccacaacauuauuccugggcuuuccauucucaaccuaaucuuuuuuauucuuuguaccuucgugcagcugcuaggaggaugguauuucuacguccaagccuacaagucacuucgacaccgcagcgcgaauauggacguucugaucgugcuggcuacuucaaucgcauacguguauagucuagugauccugguuguugcuguggccgagaaagcggagagauccccugucacguuuuucgauacacccccaauguuguuugucuucaucgcgcuaggccguuggcucgaacaccuugcaaagucaaagaccucggaggcccucgccaaguuaaugucccugcaggcaacggaagcgaccguuguaacccugggugaggauaaucugauaauuagggaggaacaggucccuauggaacucgugcaaagaggcgauauagugaaggucgucccaggaggcaaguucccggucgacgguaagguguuggaaggcaauaccauggcugaugaaucacugaucaccggagaggcaaugccuguuaccaagaagccugguaguaccgugauugcugguagcauaaacgcccauggauccguguuaauuaaagccacacauguagguaacgacacuacccuagcucagaucgucaaacucgucgaagaggcccagaugucaaaagcucccauacaacaacuggccgauagguuuucaggcuacuuuguuccguuuaucauuaucaugucuacucuuacacucguugucuggaucgugaucggguuuauagacuucgggguaguacagagauacuucccuaauccgaacaagcacaucagucaaacagaggugaucauaagauuugcguuucaaaccucuauaaccgucuugugcauugccugccccugcucacucggacucgcgaccccuaccgccgugaugguuggcacgggcgucgcugcucagaauggaauauugaucaagggggggaagccacuugagauggcucauaaaauaaagacugugauguucgauaaaaccggaacaauuacacacgguguaccucgggugaugcggguccugcuccugggcgauguagcaacccuuccccugcgcaagguucuagccguaguagguacagccgaagcaucaagugagcauccucugggcguugccgugaccaaguauugcaaagaagagcugggcacagagacccucggauacuguacagacuuucaagccguuccagguugcgggauuggguguaaggugucuaacgucgaagggauccucgcccacagugagcguccgcugagugcuccugcuucucaucucaacgaggccggcucuuuacccgcggagaaagacgccgucccccagacauucuccgugcuuauuggaaauagggaaugguuacgcaggaauggccugacaauuucaucugacguuuccgaugccaugacugaccacgagaugaaagggcagacagcaauucuggucgcgaucgauggaguccugugcgggaugauugcuauugcagaugccgugaagcaggaagccgcucuggcuguucacacuuugcagagcaugggcguagaugucgucuugauuacaggugacaaucggaaaacagcaagagcuauagcaacacaagugggcauuaauaagguauuugccgagguccucccaucccauaaagucgccaagguacaggagcugcagaacaaaggcaagaagguggccauggugggagauggcguaaaugacucaccugcccuagcucaagccgacaugggcgucgcaaucggcacaggcacagauguugcuauugaagcagccgacgucguccuaaucagaaaugaucuacuggaugucguggcuucuauccaccuuucuaaaagaaccgugcgccgaauucggaucaaccugguacuggcacucauuuacaauuuggugggcauuccaaucgcagccggaguauucaugcccauaggaaucgugcuucagccauggauggguucugcagcaauggccgcgucaaguguuucaguggugcuuaguuccuugcaacugaagugcuauaagaaaccggaucuggaaagauacgaggcacaagcccacggccacaugaaaccucucaccgcuucucaagucucagugcacaucggaauggaugacagguggagagauuccccccgcgcgaccccuugggaucaaguauccuauguaagccaagugucgcuuucaagccugaccucugauaaaccaagcagacauuccgccgcugcugaugacgacggagauaaguggucccuacuacucaauggacgggacgaggaacaauauaucuag

SEQ ID NO: 5148 - RNA, 3777 nt, Artificial Sequence
  Description of Artificial Sequence: Synthetic coding sequence
augcccgagcaggagcgucagaucaccgcacgagaaggggccagcagaaagauucucagcaagcugucccugccuacaagagcaugggagccagcaaugaagaaaaguuucgcuuuugacaaugucggauaugaaggaggccuagacggucugggcccauccagccagguugcaacauccaccguccguauucugggaaugaccugucagagcuguguuaagucaauagaggaccggaucaguaauuugaaggguaucauuagcaugaaagucagcuuggaacaaggauccgcuacugucaaguacguuccaaguguggugugccugcagcaagucugucaccaaauuggggauaugggauucgaggcuuccaucgcagaaggcaaagcagccuccuggccaucacgcagccuccccgcucaagaagcuguggucaagcuccgcguugaaggaaugaccugccaaucuugcgucucuagcauagagggaaaggugcgaaaacugcagggcguggucaggguaaaagucuccuuguccaaucaggaagccgucauaacuuaccagcccuaccuaauacaacccgaggaucugcgagaccacgugaacgauauggguuuugaagcugcgauuaagaguaaaguugcaccacugucgcuuggaccuauugauauagaacgccuccagagcaccaaccccaagaggccccucucuucagcaaaucagaacuucaacaauagugagacccugggucaccaaggaagccacgucguaacuuugcaauugagaauugauggaaugcacuguaaauccugugugcucaauauugaggaaaauauuggccaguugcuggggguccagagcauccaggucucccuggagaauaagaccgcacagguuaaguaugacccaucaugcacaucuccagucgcacugcagcgugccaucgaagcccuucccccuggaaacuuuaaagucucacugccugacggagcugagggguccgguacugaucaucgcuccagcucuagucauagcccugggucccccccucgaaaucaggugcaagguaccuguucuacgacccugauugcaaucgccgguaugacaugugccagcuguguccacuccauagaaggaaugauuucacaacuggaaggaguucagcaaaucagcgucucacuggcagagggcacagcgacagugcucuacaauccuaguguaaucagccccgaagaacugcgugcagcaaucgaagauauggguuucgaggccucagucgugagugagucauguucaacaaacccucuaggcaaucacagugccgguaauuccauggugcagacaaccgaugguaccccuaccucaguccaagaaguggcgccacauacagggagguuacccgcaaaucaugcacccgauauauuagcgaaaucuccccaaagcaccagggccgucgccccacagaaauguuuccuucagaucaaaggaaugaccugcgccucaugcgugucuaacauugagcgaaaccuucagaaagaggcgggaguguuaucgguccucguggcacucauggcaggcaaggcagaaauuaaauacgauccagaaguaauucagccucuggagaucgcgcaguuuauucaggaccugggguucgaagcagccgugauggaggauuaugcagggagugacggaaauauugagcuaacaaucaccgguaugaccugugcauccugugugcauaauaucgaaagcaaguuaacuagaacaaacggaauuacauacgccagcguggcccuugcaacaucgaaagcuuuggugaaguucgacccagagaucaucggcccccgcgauauuauuaagaucaucgagagcaagacaucugaagcccuggcaaaacugaugagccuacaggccaccgaagcaacugugguuaccuuaggugaggauaaucugauuauaagagaagaacagguaccaauggagcuaguacaacggggggauauaguuaaagucguucccggaggcaaauucccugucgaugguaaggugcuggaaggaaacacuauggccgacgaaucacuuauuaccggugaggcaaugcccguaaccaagaaaccuggaaguaccguaauugccggcaguauaaacgcccacggaagugucuuaaucaaagcaacccauguggggaaugacaccacacuggcucaaaucgugaagcucguggaagaagcgcagaugucuaaaaaucccaauaagcauaucucucagaccgaagucauaauccgcuucgcuuuucagacuaguauaaccguccucugcaucgcaugcccuugcucucucggauuagcgacaccuaccgcagugauggugggcacaggaguagccgcccagaacggaauuuuaaucaagggagguaagccccuggagauggcucauaagauaaaaaccguaauguuugacaaaacugguaccauuacgcauggagugcccagagugaugagaguccugcugcuaggagaugucgcuacacucccccugaggaagguauuagcugucgugggaacagcagaggcuucaagcgagcaccccuuaggcguggccgucaccaaauauugcaaagaggaacuggggacugagacuuugggcuacugcaccgacuuucaagcagucccagguuguggcauaggauguaaggucuccaauguugagggcauacucgcccauucagaaagaccgcuuagcgcuccagcaucccaccuuaacgaagccgggucccugccagcagaaaaagacgccgugccccagaccuuuucuguccugaucggaaaucgugaauggcugcgacgcaauggcuuaacgaucagcagcgacgugucagacgccaugacggaucacgagaugaagggccagaccgcuauccugguggccaucgacggaguguuaugugguaugauugcuaucgcugaugcaguaaaacaggaggccgcacucgccguacacaccuugcagucuauggggguggauguagugcuuauuaccggagacaaccgcaagacggcccgagccauugccacacaggugggaauuaauaaaguguuugcagaaguccugccuucccauaaggucgccaaagugcaagaauugcaaaacaaagggaagaaaguugcaauggugggagacggaguaaacgacagcccugcacuugcucaggcugauaugggcgucgccaucggaacuggaacugauguagcuaucgaagccgccgacguuguguugauuaggaaugacuuacucgacguuguugcauccauccacuuaucuaagcgaaccguucggcgcauucguaucaaucucgugcuggcucucauauacaacuuggucggcaucccuauagcugccggagucuucaugccuauaggaaucguguuacaacccuggaugggguccgccgcaauggcugcuuccagugugagcguuguccuuagcagccugcaacucaagugcuacaagaaacccgaucuggaaagguacgaagcucaggcgcacggucauaugaaaccccuaacggcuagccaagugucuguccacauagguauggacgauagguggagagacuccccccgcgcuacccccugggaccagguuagcuacgugucacaggucucauuaucuucuuugacuuccgauaaacccucuaggcauucugccgcagccgacgacgauggagacaaguggagucucuuacugaaugggcgagaugaagaacaguauaucuag

SEQ ID NO: 5149 - RNA, 4065 nt, Artificial Sequence
  Description of Artificial Sequence: Synthetic coding sequence
augccagaacaggaaagacaaauuacagcaagggaaggcgcgucacgcaaaauccucagcaagcuuagucuuccaacucgcgcaugggaaccugcuaugaaaaagucuuuugcauucgacaauguggguuacgaggguggguuagacggacugggcccuuccucccagguggcaacaaguacaguacgaauccucggcaugaccugucagucuugugugaagucuauugaagaccgcauuuccaaccugaaggggauuauuagcaugaaagugagccuagagcaagggucggccaccgucaaguacgugcccagcgucgugugucuccaacagguaugucaucaaauaggggacaugggauucgaggccucuaucgcagaggggaaagcugcguccuggccauccagaucuuugccugcucaggaagcagucgugaaacuucgaguggagggcaugacgugccaaucauguguuucuagcauugaaggaaaggugcgcaaauugcagggggucgucagaguuaaaguaagccugucuaaucaggaagcugucauuaccuaucaaccauaccugauucagccagaggaccucagggaucacguaaaugacaugggauucgaggcagcaauuaaaucuaaggucgcaccacuaucacugggccccaucgacaucgaacgacugcagaguacaaauccaaaacgcccuuuaaguucagcaaaccaaaacuucaacaauagcgagacuuuaggccaccaggggagucacgugguuacccuccaguuaaggauugauggaaugcacugcaugauuucccagcuugaaggggugcagcagauuagugugucucuggcagagggaaccgcaacaguuuuauacaauccuucugugauuagcccugaagaauugcgggcugccauugaagacaugggauuugaagcuuccguggucuccgaaucuugcaguacuaacccucuggguaaucauagcgccggaaauuccaugguccaaacaaccgaugggacuccuacaaguguucaagaagucgcuccucacacuggacgccugccugcuaaccacgcucccgauauucuugccaaaucuccccagucgacaagggcgguggcaccccagaaguguuucuuacagauuaaagggaugacuugcgccagcugcgugucuaauauagaacggaaucugcagaaagaggcuggcguccuuucaguucugguugcccugauggccggaaaagccgagauaaaauaugacccagaggugauucaaccacuugaaaucgcacaguuuauucaggaccugggauuugaggcggccgugauggaggauuaugcaggaagcgacggcaauaucgaauugacaaucacaggaaugacuugcgccuccugcgugcacaauauagagaguaagcugacccgcacaaauggaaucaccuacgccucuguugcccucgcuaccucgaaagcacuaguuaaauuugaccccgagaucauuggaccacgggauaucauuaaaaucauugaagagauaggauuccaugcaucacuugcccagagaaacccaaacgcucaucacuuggaucacaaaauggagaucaagcaauggaagaagucauuucugugcuccuugguguuuggcauuccggugauggcccugaugauauauaugcuuauuccaucaaaugaaccucaucaaucaaugguacucgaucauaacauuaucccuggccucaguaucuugaaucucaucuuuuucauucuuuguaccuuugugcagcuccuuggagggugguauuucuaugugcaagccuacaagucauuaaggcaucgcuccgcgaauauggacgugcuaauugugcucgccacuucuaucgcuuacguuuauucgcuugucaucuugguuguagcgguugcagagaaagccgaacgaucucccgucacauuuuucgauaccccacccaugcucuucguguucauugcucuugguagauggcuggagcaccuugccaaaucaaaaaccagcgaagcucuggccaaguugaugucacugcaagccaccgaagccaccguggugacucuuggggaagauaaucucauuauccgagaagagcaggugccaauggagcuaguccagcgcggcgacauugugaaaguuguaccaggagggaaguuuccaguugacggcaagguacuggaaggaaacacuauggcugaugaaagucugaucaccggcgaggcuaugccagucacuaagaagccggggaguacaguaauugcugggucuauuaacgcgcacgguuccguucugauuaaagcaacgcacguugguaacgacacaacucuggcacaaauaguaaagcucguggaagaggcucaaaugucuaaggcccccauccaacagcucgcggauagauucagcggguacuucgugcccuucauuauaauuaugaguacucuaacauuggugguguggauagucauuggcuucaucgauuucgggguggugcagcgauauuuuccuaauccgaacaaacacaucucccagacugagguuaucauccguuuugccuuucagaccucuaucacgguccucugcauagccugcccauguagccuaggccuggcuaccccuacugcgguaauggucgguacugguguagcagcccagaauggaauauuaauuaaaggagggaagccgcuggaaauggcucauaaaaucaagacgguuauguucgacaagacugguacuaucacucauggaguuccaaggguaaugcgagucuuacuuuuaggagaugucgccacacuaccacucaggaagguccucgccguuguuggcaccgcagaggccucgucggaacacccucuuggcgucgcagucacaaaauauuguaaggaggaacucgggacagagacauugggauacugcacggauuuccaggcuguucccgggugugggauuggcugcaaggugucaaaugucgaaggcauacuggcccacagcgagcguccccugagugcaccagcuucccacuugaaugaggcagggucacuccccgcagaaaaagaugccguuccccagaccuucucagugcugaucgggaacagagaauggcugaggagaaauggucucacuaucagcagcgacgugucugacgccaugacggaucaugaaaugaaggggcaaacagccauccuuguagcgauugacggaguguuauguggcaugauugcgaucgcugacgcuguaaaacaagaggcagcacuagccguacacacccugcaaagcauggguguggacgucgugcucaucacgggcgacaaucguaagaccgcuagagccauugcaacucaagucgguaucaacaaggucuucgccgaaguccuucccucacauaagguagcgaagguacaagagcugcagaacaaaggcaaaaaaguggcaauggugggugauggcguaaacgauucuccagcucucgcucaggcugauauggggguggcuauaggaaccgggacagacguagcuaucgaagccgcagauguugugcugauuagaaaugaccuacuugauguuguagccucaauacaucugucuaagcgaacugugcguaggauuaggauuaaccugguacucgcucugauuuauaaccugguaggaaucccgauagcggcggggguauucaugccgauagguaucguguuacaaccauggaugggaucagccgccauggcugcuucuucuguaucagugguauuguccucucugcagcugaaaugcuacaaaaaaccugaccucgaaagauacgaagcucaggcccacggacacaugaaaccucugaccgccucccaagucagcgugcauauugggauggacgaucgcuggagggauaguccgcgcgccacacccugggaucaagucucuuacgugagccaagugucccuaucuucucucacauccgauaaaccuuccagacauucagccgccgccgaugaugacggagacaaguggucccuuuugcuaaacggacgggaugaagagcaguacaucuag

SEQ ID NO: 5150 - RNA, 3108 nt, Artificial Sequence
  Description of Artificial Sequence: Synthetic coding sequence
augcccgagcaagaacgacagauaacggccagagagggagccucaagaaaaauccugagcaaacugagcuugccaacaagagcuugggaaccagcuaugaaaaaaagcuucgcguuugauaacguuggauacgagggaggacuggacgggcucgggcccaguucccagguugccacaagcacugugcgaauauuagggaugacaugucagucaugcgucaaguccaucgaagaucgaauuuccaaccugaaggguaucauuucuaugaaaguuucauuggagcagggcagugccacaguaaaauacguaccauccgucgugugucugcaacaagugugucaucagauuggagauauggguuucgaagcgucuauagcggaaggaaaggcugcgagcuggccaucucgaagccucccagcucaggaggccgucgucaagcuccgcgucgaagggaugacaugucaguccugcgucucuucuauagaggguaaggugcguaaacugcagggaguugugagaguaaagguuagccugagcaaucaagaagcaguuaucacguaucagccauaucuuauucagcccgaggaccugagggaccaugugaaugacaugggguucgaagccgcaauuaaaucuaaagucgccccucuaucacuggggccuaucgauauugagagauugcagucuacuaauccuaaacgcccacucagcuccgcuaaucagaacuuuaacaauagugaaacuuuaggccaucaagggagucauguaguuacucuccaacugcgcaucgauggcaugcacugcaagucuugugucuugaauaucgaggagaacaucggccagcugcugggaguccagucaauccaaguaagucuggagaauaaaacagcccaggucaaguacgaucccucaugcaccuccccuguggcucugcaacgcgcuauugaggcccucccuccagguaauuucaaagucucccuccccgacggagcagaagguagcggcaccgaccauagguccucaaguucacacagcccgggaucgccgcccagaaaccaggugcaggggacuugcaguacaacccugaucgcuauugccggaaugacgugcgccucuugcguccauagcaucgaagggaugaucagccaacuggaaggugugcagcaaauuagugugucccucgcagaagguacagcaacugugcuuuacaaccccucaguuaucagccccgaggaacuucgugcagccaucgaggacaugggauucgaagccuccguggugucuggcgaggcuaugccugucacuaagaagcccgguucaacaguuaucgccggaagcauuaacgcacaugguuccguucugaucaaggcuacccacgugggcaacgacacgaccuuggcacaaaucgugaagcuuguggaagaagcccagaugucuaaagcucccauacaacagcuugcagauagauuuuccggcuauuucguccccuucaucaucauaaugaguacacugacauuaguuguauggaucgugaucggcuuuauagauuucggagucgugcaacgcuacuuccccaacccaaauaagcacaucucucaaacagaagucaucauccgcuuugccuuccagacaucuaucacuguccucugcauugccugucccugcagccucggcuuggcaacaccaacugcagugaugguuggaacuggaguagcugcccagaauggcauccucaucaaagggggaaaaccacuggaaauggcacauaagauuaagaccgucauguuugauaaaacugggaccauuacccauggugucccaagagugaugagagugcuccugcuaggggacgucgcuacccuuccccugagaaaaguauuggcagucgugggaacagcugaagccagcucugaacacccccuagggguggcaguuaccaaauacugcaaggaggaacugggcaccgaaacuuuaggauauuguacggacuuccaagcggucccuggaugcggcaucgguugcaaagugaguaacguggagggaauuuuggcccacucugaaaggccccucucugcaccagcgucucaccugaacgaagccggaagucugccagcagaaaaggacgcugugccgcagacauucuccguccugaucggaaaccgcgaauggcugagacgcaaugggcugacuaucucaagcgacgugagugacgcaaugaccgaccacgaaaugaaaggacaaacugccauucugguggcuaucgacgguguacuauguggaaugauugcaauugcugaugccgugaaacaggaagccgcucuggcuguacacacucugcagaguaugggcguugauguggucuugaucacuggggacaauagaaaaaccgccagggccaucgcuacacagguuggcauaaauaaaguguucgccgaggucuugcccucccauaaagucgccaaaguccaggaacugcagaauaaaggaaagaaaguggcuauggugggggauggaguaaaugacucuccagcuuuggcccaggcagauaugggaguugcuauuggaaccgggacagacguggcaauugaggcagcugacgucgugcuuauucggaaugaccucuuggauguaguggcuucgauccaucuaucuaaacgcacagucagaagaauucggauuaauuuaguucucgcacugaucuauaaccuuguagguauaccaaucgccgccggaguguucaugcccauugggaucguguugcagcccuggaugggauccgcagcgauggccgcuagcucggugucagucgugcucucuagcuugcagcugaagugcuauaaaaaaccugaucuggagcguuacgaggcacaggcucacggucacaugaaaccccugaccgcuucucaggugucugugcauaucggcauggaugaucgauggagagacuccccgagagcuacccccugggaucaaguuucauaugugucacaaguuucacucaguucucugaccuccgauaaaccuagcagacacagugccgccgcggaugaugauggagauaaauggagccuccugcuaaaugguagagacgaagaacaguauauauag

SEQ ID NO: 5151 - RNA, 2031 nt, Artificial Sequence
  Description of Artificial Sequence: Synthetic coding sequence
auggaugugcugauugugcuggccaccuccaucgcuuacguguacagucucguaauccucguugucgcaguugccgaaaaagcugagcggagcccagugaccuuuuuugacaccccuccaauguuguucguauuuaucgcuuuaggacgaugguuggagcacuuggccaagucuaagacaucagaggcccuugcaaaguuaaugagccuccaggccacagaggcuacaguugucaccuugggagaagauaaccucauaaucagggaggaacaagugcccauggagcugguucagagaggagacaucgugaagguagucccuggcgguaaguuccccguagauggaaagguacuugaaggcaacaccauggcugaugagagccuuauuacuggugaagcaaugccagucacuaagaagccaggcucuacugucauugcuggaaguauuaacgcacacgguagcguuuugaucaaagcaacccacguagggaaugacacaacacuggcucagaucguuaagcucguggaagaggcccaaaugagcaaggcaccgauucagcaguuagccgaucgcuuuaguggauauuuuguucccuucaucaucauuaugucgacauugacacucguugucuggauaguaaucggguucaucgacuucggaguaguccaaagauauuucccaaaccccaauaagcauauuagccagaccgaagucaucauccguuucgcauuucagacuaguaucaccgugcucugcauugcuugcccuugcagucuuggcuuggccacacccacugccgugauggucggaaccggaguggcagcccagaaugggauccugaucaagggaggaaaaccuuuggaaauggcacacaaggaacuagguacagaaacccuuggcuacugcaccgauuuucaggccgucccuggauguggcauaggauguaaaguaucgaauguugaagggauccuggcccacucugagcgaccacuguccgcaccugccucucaucucaacgaagccggaagucugcccgccgaaaaagacgcagugccccaaacuuucagcguucuuaucggaaaucgggaauggcucagacgaaauggacugacgaucucgagcgaugucagcgacgcaaugacagaucaugaaaugaaaggccagaccgcuauucugguggcaaucgacgguguacuuugcggcaugaucgcgauugcagaugccgugaaacaggaagccgcucuggccgugcauacucuccaaucaaugggcguggacgugguccucaucacaggcgauaaccgaaaaaccgcacgagcuauagcgacccaagugggaauuaacaaaguauuugcugagguguugccaucccauaagguagccaaaguccaagaauuacagaacaaaggcaagaaagucgcuaugguuggcgacggcguuaaugacagccccgcacuggcucaggccgacaugggaguagccaucgggaccggaaccgacguagccauugaagcugcagacgugguacucauccgaaacgacuuacuggacguuguggccuccauacaucucuccaaaaggacgguucgucgaauucgcauaaaccugguacuugcccugaucuacaaccuuguagggaucccaauugccgcaggaguuuucaugccgauuggaaucgugcuacaaccguggaugggauccgccgccauggcugccuccagcguuagcguggucuuaucauccuuacaguugaaaugcuauaaaaagcccgauuuggaaagauaugaagcucaggcucacggccauaugaaaccccugacagcaucccaagugagcgugcauaucggcauggacgacagguggcgggauagcccaagggccacccccugggaccaggugaguuauguuagucaaguuucucucucaagccugacuucugacaagccuuccagacacagcgcugcugcugacgaugacggagacaaguggucuuuacucuugaaugggcgggacgaagagcaguauaucuag

SEQ ID NO: 5152 - RNA, 4203 nt, Artificial Sequence
  Description of Artificial Sequence: Synthetic coding sequence
augccugaacaagaacgacagaucaccgccagggaaggagcuucccggaagauucuuucuaaacugucacugccuacaagagcaugggaacccgcaaugaaaaagaguuuugccuucgacaauguaggauacgagggcggccucgacggcuuaggcccaaguucucaagucgcaaccagcacaguccggauccuuggaaugacgugccaguccugugucaaaucaauugaggaccggaucagcaauuugaaagggaucauaucuaugaaaguaagccuggagcagggaucagcuacugucaaguacgucccaagcgucgugugccuucagcaggugugccaucagauuggugauaugggauucgaagccucaaucgccgaaggcaaagcggcgaguuggcccagcagaucgcuuccagcacaggaggcuguggucaagcuccggguugaagggaugaccugucagagcuguguaagcucaauagaaggaaaagugcgaaaacuacagggggucgugagaguaaaggucucguuaaguaaccaagaagcagucauuaccuaccagcccuauuuaauucaaccagaagaccugagagaucacgugaacgauaugggcuucgaagcagccauuaagagcaagguagcuccacuuagccuuggcccaauagauaucgaacgacuucaaucaacaaacccaaagcgccccuugagcuccgcaaaucaaaauuuuaacaauuccgagacccugggacaccaaggaagccacguagugaccuugcagcuaaggaucgacggcaugcauugcaagucauguguccucaauauugaagaaaacaucggucaacugcuggguguccagucuauucaagucucacuggaaaauaagaccgcccagguuaaauaugaucccagcuguaccagcccaguagcacugcagcgugcaauagaagccuuaccuccagggaauuuuaaagucaguuuacccgauggggcugaggggagcggcaccgaucaucguucuucuagcagccauagcccaggaagccccccccggaaccaaguacagggaaccuguuccacaacguuaauugcuauugccggcaugacaugcgcaucuugugugcacaguauagaaggaaugaucagccaacuggaaggaguacagcaaaucagcgucucacucgcagaaggcacagcuacgguacucuacaacccaucagugauaucuccagaggaacuaagagcugccaucgaggacaugggcuuugaggccagcgucgucucugaaucgugcagcacaaaucccuuagggaaucacucagccggcaauucuauggugcaaaccaccgacgguacuccaaccagcgugcaagaagucgccccucauacaggaagguugccagccaaucacgccccagacauccuggcuaagucaccacaaucaacccgcgcuguggcaccccagaaguguuucuuacaaauuaagggcaugacaugcgcgaguugcguaucaaacaucgaacguaacuuacagaaggaagccggaguacugucaguguugguggcucuuauggcuggaaaggccgagauuaaguacgauccggaagugauacagccgcucgagauugcucaauucauucaggaccuuggauuugaggcggccgucauggaagacuaugcaggcucagacggaaacauagaauugaccauuacuggaaugacgugcgcuagcugcguccacaacaucgaaagcaagcuuacacgaacuaacgggaucacuuaugccuccgucgcauuagcuaccuccaaggcacucguaaaguuugacccugagaucaucgggccccgcgacauuauaaaaauuauagaggaaauuggauuucacgcuagccuugcacagcguaaccccaacgcucaucacuuggaccacaaaauggaaauuaagcaguggaaaaaauccuuccugugcucccucguguuuggcauacccguaauggcacucaugauuuacaugcucaucccuuccaacgagccucaucagucaaugguguuagaucacaauauuauaccuggauugucuauucucaaccucauauucuuuauucugugcacguuuguccagcugcucggugggugguauuucuauguccaggccuacaaaucccucagacaccgcuccgcgaacauggacgugcugauaguguuagccacgagcaucgcauauguauauucacuugugauccugguaguagccgucgccgaaaaggcagaaagaagucccguaaccuucuucgauacaccaccuauguuauucguguucauugcguugggccggugguuggagcaccucgcaaagucuaagacgucagaagcucuggcuaagcuaaugagucuucaagcuacagaagcaacugucgucacucugggagaggacaaccuuauuauucgcgaagagcaaguccccauggagcugguucagagaggugauaucgugaaggucgucccuggcggcaaguuuccugucgacgggaaaguccuugaggggaacacaauggccgaugaaagucugauaaccggagaagcuaugccgguaacuaagaaaccuggauccaccgugaucgcuggcucaauaaacgcacauggcaguguguugaucaaagcuacccaugucgguaaugacaccacucuugcccaaauuguuaaacugguggaagaagcacaaaugucaaaggcucccauccaacaguuagcugaccgauucucuggcuauuuugugcccuuuauuauuaucaugagcacuuuaacacuuguuguuuggauagucauaggcuuuaucgauuuuggcgugguucagagauauuucccgaucaaaaccgugauguuugauaagacaggcacgaucacccauggcgucccccgcguuaugcgugugcugcuacuuggggacguggcuacuuugccccuacgaaaagugcuggccgugguuggaaccgccgaagcuaguagugaacaccccuuagguguagcuguuacgaaguacugcaaagaagaguuaggcacggagacucugggauacuguaccgacuuucaggcuguaccuggcuguggaauuggaugcaagguuuccaauguugagggaauuuuggcacauucagagcgccccuuguccgcucccgccucucaccuuaaugaagccggcagucuaccagccgagaaggacgccgugccacagaccuuuagcguccucauugggaaucgugaauggcucaggagaaauggauugacuauuaguagcgacguaagcgacgccaugacggaucacgagaugaagggacagacagcuauauugguggcaauagauggcguacugugcgggaugauagcaauagcagacgcugugaagcaggaagcugcucuagccguucacacucuacagaguauggguguagacgugguauugauuacaggugauaauaggaagaccgcucgggccauugccacucaaguggguauuaauaaaguauuugcagaaguacuaccgagucauaaaguggcuaagguucaggagcuacaaaacaaaggaaaaaaggucgccaugguuggggauggaguuaaugacagcccagcacucgcucaggcggacaugggaguagcaaucggcacgggaacugauguggccauagaagccgccgacgugguccucauccgcaaugaccugcuagacguuguagccagcauccacuugucaaagagaacugugcguaggauucguaucaacuuggucuuagcacugauuuauaaccugguugggauacccaucgccgccgggguguucaugccaaucgggauaguacugcaaccauggaugggaucugccgcaauggcagccagcagcgucuccgugguucuguccagccugcaacuuaaauguuauaagaaacccgaccuggaaagguacgaagcucaagcccacggucauaugaaaccucugaccgcaagucaggugucugugcacaucgggauggacgacagguggagagauucgccuagggccacccccugggaucaaguaucauacgugucccaaguuucuuuauccagcuuaacauccgauaagccaucucgccacucagccgcagcugaugaugacggagauaaauggagccucuugcuaaacggcagagaugaggaacaauacaucuag

SEQ ID NO: 5153 - RNA, 4164 nt, Artificial Sequence
  Description of Artificial Sequence: Synthetic coding sequence
augccugaacaagaacggcaaaucaccgcgcgcgaaggcgcaagccguaaaauucugucaaaacugucacucccaacaagagccugggaaccggccaugaaaaagucuuuugcguucgauaacguuggauaugagggggggcuggacgggcucggcccuucaagccagguugcaacuagcacaguccgcauucugggcaugacaugucaauccugcguaaaaucgauagaggaucgaauuagcaaucucaaagguaucauaucuaugaagguuucacuggagcaaggauccgccaccguuaaauauguuccaucggugguaugucugcaacagguuugucaccagauuggggacaugggguuugaagcaagcauugcugaaggcaaggcugcguccuggccaagccgauccuugccggcccaagaagccgucgugaaacuccgaguagaggggaugacuugucaguccugugucaguucuauugaagguaagguccggaaauugcagggugucguucgcgucaaaguuucccugaguaaccaagaagcugugaucacuuaccaaccuuaccugauacagcccgaggaccugcgggaccaugucaacgacaugggcuuugaggcugccaucaaaagcaaaguagccccacugucacuaggucccaucgauauugagcguuugcaaucgacuaacccuaagcgaccucuuagcucagccaaucaaaauuucaauaacucagaaacacuugggcaccagggaucccaugugguuacacuucaguuacgcaucgauggcaugcauuguaaaagcugugucuuaaacauagaggaaaauaucgggcaguuguuaggcgugcagagcauucaaguuagccuugaaaacaagacagcucaggucaaauaugacccuuccuguacuucuccuguggcguuacagagagccauagaagcacuuccacccgggaauuucaaggugagccugccagacggugcugaaggauccggcacagaucaccgauccucgucaucacacuccccuggcagucccccacggaaccaagugcaagggacgugcucuacaacacucaucgcgaucgccggcaugacuugugcuucaugugugcacagcaucgaagggaugauuucacaauuagaggguguccaacaaauuuccguaucacuagccgaaggaacagccacugugcuuuacaauccaagcgucauauccccugaggaacucagagcugcuaucgaagacauggguuuugaggcgucggugguuuccgaaucauguaguacuaauccccuggggaaucauucagcuggaaacucgauggugcagaccaccgacgguaccccuacaucuguccaggagguugccccccacaccggacggcucccugccaaccaugcccccgauauccucgcuaaauccccucaaucaacacgugcuguagccccacagaaauguuucuugcagauuaagggcaugaccugugccagcugcguaucuaacauugaacggaaucuacagaaagaagcaggaguacucagcguuuugguggcacucauggcuggaaaggcagagaucaaguacgacccagaagugauucaaccucuagagaucgcccaguuuauacaggaucugggauuugaagcagccgucauggaagacuaugccggcagugauggcaacaucgagcuaacaauuacuggcaugacuugugccucuugugugcacaauaucgagucaaagcuuacacgaacaaauggcaucacuuacgcgucggucgcccucgccacaucaaaggcuuuaguaaaauucgaucccgaaauuaucggcccucgcgauauaauuaaaaucaucgaggaaaucggcuuccacgcuucccuggcacaacggaacccaaaugcucaucaccucgaccacaaaauggaaauaaagcaauggaagaagucguuccuguguuccuugguguucgguauccccguaauggcgcuaaugaucuacaugcuaauucccuccaacgaaccacaccagucaaugguccucgaccauaauaucaucccagggcugagcaucuuaaaucucaucuuuuucaucuuauguaccuucgugcagagcaagacauccgaggcccucgcuaagcugaugucacuucaagcuacagaagccaccgucguuacacucggagaagauaaucucauuauaagggaggagcaggucccuauggaacuggugcagagaggagauauuguuaaagugguccccggagggaaauuccccgucgacgggaagguccuugaaggcaauaccauggccgaugaaagccucauuaccggcgaagccaugcccgucaccaaaaaacccgguucaacagugauagcagguucgaucaaugcccacggaucagugcugaucaaagcgacccacguggggaacgacacaacacuugcucaaaucgucaaacucguugaggaagcccagaugaguaaggcucccauccagcagcucgccgaucgcuuuagcgguuacuuuguccccuuuaucaucauuaugucuacccugacccucgucguguggaucguuaucggauuuaucgauuuuggcguaguacagagauauuuucccaaccccaauaaacacauaucgcagacagaaguaauuauucgcuuugccuuccagaccucaauuacaguacuuuguaucgccuguccuuguucacuuggucuagcaacccccacggccgugauggucggaacagggguggcagcccaaaauggcauccugaucaaaggagggaaaccuuuagaaauggcccacaagauaaaaacggugauguuugacaagaccgguacaaucacccacggcguuccacgcguaaugagagugcuccuccuuggcgauguagcaacccucccccuccguaaaguucucgccgucgucgggaccgcagaggcaagcucugagcacccacuagggguagcagucacgaaauauuguaaagaagaauuggguacugaaacuuuaggcuacuguacagacuuccaggcagugcccgguugugguauuggguguaaagugucaaacguggagggcauucuggcacacagcgaacggccccugagcgcaccugccucccaucugaacgaggcuggcucacugcccgccgaaaaggacgcugucccucagaccuuuuccguacuaauuggcaauagagaguggcuucgacgcaacggucuuacuaucucguccgacgugucagacgcaaugacagaucaugaaaugaagggccagacagccaucuuaguggcgauugauggcguucuaugcgggaugaucgcuaucgcagacgcuguuaaacaggaagccgcucuagccguacacacacuacaaagcaugggaguugaugugguucuaaucacuggagauaaccgcaaaacagccagagcaauagcgacgcaggugggcauuaacaagguguucgcagagguucuccccagccacaaggucgccaagguccaagaacugcagaacaaaggaaagaaagucgcaauggugggagauggcguaaacgacuccccggcacuugcacaggccgauauggggguagcaaucgguacaggcacugacguggccaucgaagccgccgaugugguucucauacgaaacgaccuauuagacguuguugccucaauacaucucucgaaacgcacaguccgacgaaucaggauuaaccuagugcuggcccuaauuuacaaccucgugggcauaccaaucgcugcuggaguguucaugccaaucgguaucgugcugcaaccuuggaugggauccgccgcuauggccgccaguagcgugagcguaguguugucaucauuacagcugaagugcuauaagaagcccgaucuggagagauaugaggcccaggcacauggacauaugaaaccccugacagcaucucaggucucagugcacauagguauggacgaucgguggagagacaguccacgcgccaccccuugggaccagguuaguuauguuagucaggugucccuauccucucuaaccuccgacaaacccucccgacauucagccgccgcagaugacgauggggacaaguggagucugcuucugaacgggcgcgaugaagagcaguauauauag

SEQ ID NO: 5154 - RNA, 1587 nt, Artificial Sequence
  Description of Artificial Sequence: Synthetic coding sequence
augaagaaguccuuugcguuugauaacguagguuacgagggugguuuggauggacugggaccuucuagccaggucgccacaucuaccgucaggauccugggaaugacaugccagucuugcgugaagucuauugaggauaggauaagcaaccuuaaagguauaaucuccaugaaagugucucuggaacagggcucagccacuguaaaguacgugcccagcguugugugucuccaacagguaugucaucagaucggugauaugggguuugaagcgaguaucgcugaagguaaggcagccagcuggccaucccguucucuuccugcucaggaagccgugguuaaacugcgagucgaaggcaugacaugucaaagcugugucagcucuauagaaggaaaaguuagaaagcuucagggcguagugcgugucaaaguuucccugagcaaccaagaagcaguaaucaccuaccaaccauaccugauccagccagaggaccuacgcgaucauguuaacgauaugggcuucgaagcagccaucaaauccaaaguggcgcccuuaagccugggaccuauugauauugagagacuccaaucuacgaauccuaaaagaccuuuaucuuccgccaaucaaaauuucaacaauagcgagaccuuaggccaucagggcagucaugugguaacgcuccagcugcguauugacggaaugcauuguaaguccugcguccuuaacaucgaggagaauauagggcagcuucuaggagugcagucaauucaagugucacuugaaaauaaaacugcacaagugaaauacgaucccucuuguacaagcccaguagcccugcagcgcgcaaucgaagcgcugccccccggcaacuuuaaagucucacucccugacggugccgagggauccgggacagaucaccguucuuccucaucacacagcccaggcucccccccaagaaaccaaguucaaggaaccugcagcacaacccucauugccauugccgguaugaccugcgcauccugugugcacucaauugaagguaugauuucccaacucgagggugugcagcagauuuccguaagucuggccgagggaacagcuaccguccuguacaacccuagcgucauuagcccagaagagcugcgcgccgccauagaagauaugggcuuugaagcaagugucgucagcgaauccuguaguaccaaccccuuggggaaccacagcgccggaaacagcaugguccaaaccaccgauggaaccccaacuuccgugcaagaaguggccccucacaccgguaggcugccugcuaaccacgcccccgacauucuggcaaaguccccgcaaagcacucgagcagucgcuccacagaaauguuuucuucagaucaaggguaugacaugugcaucaugcgucaguaauaucgaaagaaacuugcaaaaggaagccgccccacguuggguugugcugcuaaggucgggacugcaaaucuccgaaacacagguuagccagcauggacgagcucaccggccaggacacaagcauugccucugucuuuucagcggccauccugggggauguugcggguag

SEQ ID NO: 5155 - RNA, 1296 nt, Artificial Sequence
  Description of Artificial Sequence: Synthetic coding sequence
augcacgugcguucccuaagggcugccgcuccucauagcuuuguugcucuuugggcgccccucuuuuuacugcgcuccgcccuagccgauuuuagccucgacaacgaagugcauucuuccuuuauacauagaaggcugcgcucucaggagcgcagggagaugcaacgcgaaauccuuucaauccucggacucccucacagaccccggccucaucugcaaggaaaacacaacuccgcaccgauguucaugcucgaucuguacaacgcuauggcugucgaagaaggcggagggccaggcggccaaggguucuccuaucccuacaaagccguauucucgacacaaggcccaccccuugccagccuccaggauucccauuuuuuaacagacgcugacauggugaugaguuucgugaauuuagucgagcacgacaaggaguuuuuucacccucgguaucaccaccgcgaguuccguuuugaucugagcaaaauaccugaaggugaagccgugacugcugcugaauuucggauauacaaggacuacauacgagaaagguuugauaaugagacuuuuagaaucagcguauaucaggucuuacaggaacaccuggggagggaaagcgacuuguuccuguuagacucccgaacacugugggccuccgaggagggauggcugguguuugacauuacugcuacuucgaaccacuggguggugaacccucggcauaacuugggccugcagcuauccguagagacuuuagacggacagagcauuaacccuaaacuagcgggccuuauugggaggcaugguccucagaauaagcaaccuuucauggucgcauucuucaaagccaccgaaguccacuuuagaagcauucgguccaccggaucaaagcagagaagccaaaacagaagcaagacucccaagaaccaggaagcccugcgcauggcuaaugucgccgaaaauaguaguucagaccagcgccaagccuguaaaaaacaugagcuguaugugucauuuagggaccuuggcuggcaagauuggauaauugcaccugagggauaugcugcguacuauugugagggcgaaugcgcauuuccucuuaacagcuauaugaacgcaaccaaccacgcuaucguccagacacugguccacuucauuaauccagagacuguacccaagcccuguugcgcuccgacccaacugaacgcaaucucaguuuuauacuuugacgacuccagcaaugugauccugaagaaauaucgaaauaugguugugcgggcuuguggaugucacuag

SEQ ID NO: 5156 - RNA, 1098 nt, Artificial Sequence
  Description of Artificial Sequence: Synthetic coding sequence
augcacgucaggucccuucgcgccgccgcaccccauucuuuugucgcucuuugggcgccccuuuuccuucucagaagcgcucuugccgauuucagucuagauaaugaagugcacagcagcuucauccaucgccgccugcgcucacaggaaagaagagaaaugcagagggaaauucucucgauacuuggucugccccaucggccgagaccgcaucuucagggcaagcacaacagugcuccaauguucaugcuagaucuguacaaugccauggcaguggaggaagguggaggccccgggggucaaggauuuaguuauccauauaaagccguuuucaguacacaaggcccuccccuggcuagccuccaggacucccacuuucuaaccgacgccgauauggugaugucauucgugaaccugguagagcacgauaaggaauuuuuucauccccgcuaccaucaucgagaauuccgcuuugauuugagcaaaauaccugagggggaagcggucacagccgcugaguuucggauauacaaagacuauauucgcgagagauuugacaaugagacguuuagaauauccgucuaccagguacuucaagaacaucuaggcagggagagcgaccuguuuuuguuggauucacgcacacuuugggcguccgaggagggcuggcugguauuugacauuacggcaaccucaaaucacuggguaguuaacccccgacauaaucucggucugcagcugaguguugaaacucucgaugagaauucaucgucugaccagagacaggccuguaaaaagcaugaacuuuacguguccuucagagaucucggauggcaagacuggaucaucgccccagagggguaugccgcuuauuacugugagggagaaugcgcauuuccucucaauagcuacaugaaugcgacuaaccacgccauuguacagacauugguucacuucauaaacccugaaacuguccccaaaccuuguugugccccaacucaauuaaacgcaaucagugugcucuauuuugaugauuccucuaaugugauucuuaagaaguaucggaacaugguugugagagcuuguggaugucauuag

SEQ ID NO: 5157 - RNA, 513 nt, Artificial Sequence
  Description of Artificial Sequence: Synthetic coding sequence
augaagacccagcgcgauggccauucccugggacguuggagucuuguccugcuguuguuggggcugguuaugccacucgccauuaucgcucaaguacuuucuuacaaagaagcuguacuucgugcuauagacggaaucaaucagcggucuucugacgcuaauuuauaccgccuacuggaccuugauccccgaccaacuauggacggggacccugacacccccaagcccgucaguuuuacugugaaagaaacuguuugcccgcguacgacccagcagaguccugaagauugcgacuucaaaaaggacgggcuggugaagcgauguaugggaaccguuacccugaaucaggcaagaggcucuuucgacauuagcugugacaaagauaacaaaagguuugcccuguugggcgauuuuuuuagaaagucaaaagagaaaaucggcaaggaauucaaaagaauuguacagagaaucaaggauuuccugagaaaccugguaccaaggacugaaucguag

SEQ ID NO: 5158 - RNA, 1692 nt, Artificial Sequence
  Description of Artificial Sequence: Synthetic coding sequence
gcuuguuguuguggugggggauguacauguugcgguuguacaugcacuaccggaugcugcacuacguguaccugcugugcuugcgcauguacaacuggaacaaccacaggcgcuggcgcaugcuguacaggaggcugcgccgcuggagguacgggaugcggaggugcggggugcugcuguaccuguugcgccggugcagcugggaccgguugcgguggaacgugugcugcaggcuguggcgggugugcuggguguggaggagccggcgccugugggggguguggagcaggcuguugugcgggcggcgcagcuugcuguacuugcuguugcugcugcuguggguguggcacaugcugcuguugcgcuggguguacuacgugcugcugcgccggaugugguacaggagguugcggaggcugcgguggagccgcauguugcuguugcuguggaggggcgggggcagcagcaggcgccgcgacugcggcggcuggggcauguacaggaggggccaccgccugcgccggggggacauguugcgccacaacugcuugcgggaccugcgccaccacaugcacaggaugugcuggggguugcugugcugcuaccacuacagcuacaggcgcgggcggggcagccacuuguugugcugcaggugcuacaggagccgccacuacaacagggggagcgggaugugcagggggugccggcgccggcggcuguugugguaccacuacuggaacgugcacuggaugugcaggcacaggaugcuguuguugugccggaggcugcacaggaugcacauguugcugcgccggguguggguguacuaccugcuguugcgccgcaugcgccggggcggggggggcuuguugugccacgugcacuggcgccaccggagcaacaacgugcgccacugcugggggaugugccugugccgccgcgugugcuacgggagccgcugccacaggagccugcaccacaacaggggcugcuggcacaacuacguguuguaccaccugcgccgcgacugccgcagccgcagcuugugccggagccugcgccgccaccgcgaccgggacuaccgcaacaugcgcaggggcuacaugcgcggcagccuguacuuguugcggggcauguuguugcugcgcugcauguggggcaggagcaaccacauguugcaccggugccgccggagccgcaugcacggguugcggcgcgggaggagcuggugguacuggcggugggugcugcacguguacaacgugcgcgggaugcggggcuggcuguacggggggagcguguaccggcuguacaugcuguuguaccggcggggccgguugugcuugcggugccggcacuacuugcgccgggggagcagcaggcggauguacuugugcuggaggcgcugccggggccgguggugcaggggcagggugugcagggugugccgcuggaugugguggggccgcaaccgccaccuguacauguggggcuacagguugugccaccgccgcaacaggaugcgcaggaacaacuggagggacaggcggagggggauguugcgcaacuggggccugcgggggaggaggaugcugcugcgguggggcagcgugcacgugugcguguugugcuggauguaccacugcuggcugcgccggauguggcuguacauguggcggguguaccggauag

SEQ ID NO: 5159 - RNA, 3198 nt, Artificial Sequence
  Description of Artificial Sequence: Synthetic coding sequence
augaaaaucuugauccuggguauauuccuauuuuuaugcaguacccccgcaugggcuaaagaaaagcacuauuauauuggaaucaucgagacaacgugggacuacgccagcgaccauggagagaaaaaacugaucagcguggauaccgaacacucaaacauuuaccugcagaaugguccugaucgcaucggccgacuguauaaaaaagcacucuaccuccaguacacugacgaaaccuucaggacgacgauugaaaaacccguguggcuuggcuuccuuggacccaucauuaaagcagaaaccggagacaaagucuacguccacuugaagaaucucgcuagccgcccauacaccuuccauucccacggcaucacauauuacaaggagcacgagggcgcaauauacccagacaacacaacugauuuccagagggcagaugauaaaguguacccaggcgaacaauauaccuacaugcucuuggccacugaggagcaauccccuggugagggugauggaaacugcguuacacggauuuaccauucccacauugaugcacccaaggacauugcuuccgggcuuauuggaccacugaucauuugcaagaaggacucacucgauaaagaaaaagaaaaacauauagauagggaauucgugguaauguuuucggucguggacgaaaauuucuccugguacuuggaggacaauauuaagacuuacugcucggaacccgagaaaguugacaaagacaacgaagauuuucaggagaguaacagaauguauuccgugaauggcuacacuuucggcagccuuccaggcuuaaguaugugcgccgaagaucggguaaagugguaucuauuugggauggggaacgaggucgaugugcacgcagcuuucuuccacggccaggcccugaccaauaaaaauuauagaaucgacacuaucaaucucuucccugcaacccucuucgaugccuacauggucgcccaaaauccaggggaguggaugcuuagcugccaaaauuuaaaucaucuuaaggccggccuccaggcuuuuuuccaagugcaagaaugcaacaagagcucgucuaaagauaacaucagagguaagcauguucgccauuacuauaucgccgcagaagaaauuauuuggaacuaugcgccuucggguaucgauaucuucacaaaagagaacuugacugcuccugggagcgacuccgccguguuuuuugagcaagguacuacgagaaucggcggcucauacaaaaaauuaguuuaccgggaguacacagaugcaaguuuuacgaaucgaaaggaaagggguccagaggaggaacaucuggguauccuuggaccuguuauuugggcggaaguuggagauacaauuagaguaacguuccacaauaaaggggcguacccucucagcauugagccaaucggagugcgauucaacaagaauaaugaaggcacauacuacucacccaauuacaacccgcagagucguuccguucccccauccgcuucacacgucgcuccaacugaaacuuuuacuuaugaguggacuguacccaaagaaguaggacccaccaacgccgauccugugugcuuggccaaaauguauuauucagcuguggagccaaccaaagacaucuuuacaggguugaucggaccaaugaagaucuguaaaaaagggagccuucacgcuaauggccgccagaaggacguggauaaagaguucuaucuguuuccaacuguauuugaugaaaaugagucuuuguugcuggaggacaacaucagaauguuuaccacagccccugaucagguggacaaggaggaugaagauuuucaggaaucaaauaaaaugcauuccaugaauggauuuauguauggaaaucaaccagguuugacuauguguaaaggagauucaguagucugguacuuguuuagugcugguaaugaagccgauguccacggaauauauuucagugggaauacuuauuuauggcggggggaaaggcgagacacugcuaacuuauuuccacagaccucacuaacucugcacauguggccagauacagaaggcacuuucaauguugagugucuuacaaccgaucacuauacaggcggaaugaaacaaaaguacaccguaaaucaaugucgacgccagucagaagacucuacguuuuauuugggggagcgcaccuacuacaucgcggccguagagguggaaugggauuacagcccacagcgggagugggaaaaagaacuacaucaucuccaagagcagaaugugucaaacgccuuccuggacaaaggggaauuuuacauagggagcaaauacaaaaaagucgucuaucgucaguacacggauucaaccuuucgcgugcccguagagagaaaagccgaggaggagcaccuggggauccucgguccacaacuucacgccgacgugggugacaaaguaaagauaauuuucaaaaacauggcuacacggccuuauagcauucaugcucacggaguccagacagagucaagcacaguuaccccuacacucccuggugaaacgcucacauacguauggaaaauccccgaaagauccggcgccgguacugaagacagugccugcaucccuugggcauauuauuccaccgucgaucaggugaaagaucuauauucaggucucaucgggccacucaucguuugcagacggccuuauuugaagguuuuuaauccuagaagaaaacucgaguuugcacuauuguuccuuguguucgaugaaaaugaaaguugguauuuagaugauaauaucaaaacauacucggaucaccccgaaaagguaaauaaagaugaugaggaguucaucgagagcaacaaaaugcaugcaauuaauggccggauguucgggaaccuccagggauugacuaugcauguuggggaugaggucaacugguacuuaaugggcaugggaaacgagaucgaucugcacacagugcauuuucacggacauuccuuccaauacaaacaccgaggcgucuauagcuccgacguauuugauauuuucccuggcacauaccaaacucuagagauguuucccagaacaccagguaucuggcuucuucauugucaugugacagaccauauacacgcgggaauggagacuacuuauacaguccugcagaacgaggauacaaaaagcggguag

SEQ ID NO: 5160 - RNA, 1869 nt, Artificial Sequence
  Description of Artificial Sequence: Synthetic coding sequence
auggcacacgugagagggcugcaauuaccuggaugcuuagcacucgccgcacucuguucccuagugcauucacaacacguguuccucgcaccucagcaggcucgcucccuguugcaaagagugcgucgugcaaauacauuucuugaagaaguccgcaaggggaaccuagaaagggagugcgucgaggagacaugcaguuacgaagaagccuuugaagcucucgagaguucuacugcaacggauguguucugggccaaauacacagcaugugagaccgcucguacaccucgugauaaacuggcagcuugucuagaagggaauugugcagagggucugggaacaaacuacagaggucaugugaauauuaccagaagcgguaucgaaugucagcuuuggcgcagccgguauccacacaagccugaaauuaauaguacuacucauccgggagcugacuugcaagagaauuuuugucguaacccagauucuucaacuacugggccguggugcuauaccacagaucccaccguacggcgacaggaauguagcaucccuguguguggccaggaucaggugacuguggcaaugaccccgaggagugaagggaguucugugaaucugucuccuccauuggagcaaugugugcccgaccgcgggcagcaguaucagggaagacuggcuguaaccacccacgggcugccaugccuagcuugggcaucugcacaggcaaaagcucugagcaaacaucaagacuuuaauucugcuguucagcugguggaaaauuucugcagaaaucccgacggagacgaggaaggggugugguguuauguggcuggcaaacccggcgauuuuggguacugugaucucaacuacugcgaagaggccguugaagaagaaacuggagauggacuggaugaagauucugaccgggcuaucgaagggaggacugccacaagcgaauaucagacuuuuuucaacccccggacuuuuggcagcggugaagccgacuguggucuuaggccucuguuugagaaaaagucacucgaggauaaaacagagcgggaguuguuggagagcuauauagacggaagaaucguggaagggucagacgcagaaaucggcaugucuccuuggcaagucauguuguucagaaagagcccucaagaacuacuguguggagcaagucugauuucagauagguggguucugaccgccgcacacugucugcuguacccaccuugggauaagaacuucacugagaaugaccuccucguaaggauuggcaaacauucccggacaagauaugaacggaauauagagaaaauauccaugcuggaaaagaucuacauacacccaagguauaacuggagagaaaaucuggaucgcgacauugcucuuaugaaacugaaaaaaccuguagcuuucuccgacuauauucacccaguaugccuuccugaccgcgagacugccgccuccuuguugcaggcgggcuauaaagguaggguuacagggugggguaacuuaaaggagacauggacagccaauguuggaaaaggucagccaaguguucuucagguggugaaccugcccauuguggaacggccugugugcaaggacuccacaagaauacggaucacagacaauauguuuugcgcuggauacaaacccgaugaggguaagcggggagaugcaugcgagggcgauagcggcggaccuuucguaaugaaaagucccuuuaauaaucggugguaucaaauggggaucgucucauggggggagggcugugauagggacggaaaguauggcuucuacacccacguauuuagacugaaaaaguggauccagaaaguaauugaucaguucggcgaauag

SEQ ID NO: 5161 - RNA, 195 nt, Artificial Sequence; identical to SEQ ID NO: 4831
  Description of Artificial Sequence: Synthetic coding sequence

SEQ ID NO: 5162 - RNA, 1752 nt, Artificial Sequence
  Description of Artificial Sequence: Synthetic coding sequence
auggcacauguacggggccugcagcucccuggaugucuugcauuggccgccuuguguagccugguucauagucaacauguguuuuuggccccucagcaagccagaucacuacugcagcgagugcgccgugcaaacacauuuuuggaagaaguacgcaaaggcaaccucgagagggaguguguggaagagacuuguaguuaugaggaggccuucgaggcccucgaguccagcacugcuacagacguguuuugggccaaauauacagccugcgagaccgcuagaaccccccgcgauaaguuggccgccugucucgaaggcaauugcgccgagggucuuggcacgaacuaccgaggccacguaaacauuacaagaagcggcaucgaaugucaacuuuggcgcucccgauauccacacaagccugaaauaaacucaaccacacacccaggcgcugauuuacaagagaauuucugccgaaauccagacucuucaacuaccgggccauggugcuacacaacagauccuacuguucggcggcaagaguguucuauccccguuuguggccaggaccaggucacagucgcgaugacaccccgauccgaggguucuucuguaaaucuuaguccuccuuuggaacagugcguuccugauagaggccagcaguaucaggguaggcucgcagugacgacacacggauugcccugccuugcaugggcuagugcacaggccaaagccuuauccaaacaccaagacuuuaauucagcagugcaacuuguugagaauuuuugucguaacccggacggcgacgaggaagggguguggugcuauguugcaggcaaaccgggagauuucggauauugcgauuugaauuauugcgaggaggcagucgaggaagaaacgggcgacggacuggaugaggacagcgaucgagcuaucgaaggacggacagccacaagcgaguaccagaccuucuucaacccacgaaccuuuggcuccggcgaggcugauugcgggcugcgaccacuguucgagaagaaaucauuagaagacaagacagagagggagcugcucgaaucuuauaucgacggucgcaucguugaggguucugaugcugaaauugguaugucaccuuggcaagugauguuauuucgcaaaagcccccaggaacuuuuguguggagccucucugauuagcgauagguggguccuaacagcugcccauugucuguuguacccuccaugggauaaaaauuuuacugagaaugauuuacuaguucgaauuggcaagcacucacggacucgguacgaacggaauaucgaaaaaauaucuaugcucgagaaaauauauauacauccgucucuuuugcaggcuggcuacaaggguagagucacgggcuggggaaaucugaaggaaacauggaccgcuaaugugggcaaaggccagcccucugugcugcaaguugugaaccuuccuauagucgagaggccaguuugcaaagacuccacacguauccgaaucacagauaauauguuuugcgcaggauacaaaccagacgagggaaagagaggcgaugccugcgaaggagacagugggggcccauucguaaugaagucaccuuuuaauaaucgaugguaccaaaugggcauugugucguggggagaaggaugugacagagauggcaaauacggcuuuuacacacauguuuuccgauugaagaaauggauccagaaagugaucgaucaguuuggcgaguag

SEQ ID NO: 5163 - RNA, 1272 nt, Artificial Sequence
  Description of Artificial Sequence: Synthetic coding sequence
augcagagagugaauaugauuauggcugagagcccagggcucauaacuaucugccugcuuggcuaucuguugucugcugaaugcacugucuuccuagaucacgaaaaugccaauaagauccuuaauagaccuaaaagauacaauuccggaaagcuggaggaguuuguucaagggaaccuggagcgcgaaugcauggaggaaaaauguucauucgaagaagcccgagaaguguuugaaaacacggaaagaacgaccgaauuuuggaaacaguacguggaugugaccuguaacaucaaaaacggaaggugcgagcaguucugcaagaauucggcugauaauaagguaguaugcucaugcacggaaggguacagacuagcagagaaccagaagagcugcgaacccgcuguuccuuucccauguggaagggugucagucagucaaacaagcaaacugaccagggccgaaacuguguuucccgauguggauuaugugaauucuacagaagccgagacaauacuagacaacaucacucaaaguacccaaucuuuuaacgacuucacucgggugguaggcggcgaagaugccaagcccggccaguucccauggcaggugguguuaaaugguaaggucgacgcguuuuguggggggagcaucguaaaugaaaaauggaucgugacagcugcucauuguguagaaacgggagucaaaauuacugugguggccggcgaacauaauaucgaagaaacagagcauaccgaacagaaaagaaacguaauccggaucaucccacaucacaacuauaacgcagcuauaaacaaguauaaucaugacauagcgcuacuggaacucgacgaaccucuggugcucaacucauaugugacuccaauauguaucgcagacaaagaauauaccaacauuuuuuugaaauucggauccggauacgucuccggcuggggucgcguauuccacaaaggacggagcgcucugguccugcaguaucugagggugccauugguugauagggccacaugcuugcgaaguacaaaauucacaaucuacaauaauauguucugcgccggauuucacgaggggggcagggauaguugccagggagauagcggagguccccauguaacugagguggaaggaaccaguuuccuuacaggcauuaucucuuggggugaggagugugcaaugaaggggaaauacggaauauacacaaaagucucuagauacgucaauuggauuaaagagaaaaccaagcucacuuag

SEQ ID NO: 5164 - RNA, 1335 nt, Artificial Sequence
  Description of Artificial Sequence: Synthetic coding sequence
auggugagccaggcucuuaggcuccugugucugcugcugggcuugcaggggugucucgcugccgucuuuguaacacaggaagaggcccacgggguccugcauaggagacgccgugccaaugcuuuucuggaagaacugcgaccuggcucccuugagcgggaaugcaaagaagaacaguguuccuucgaagaggcccgggagauuuuuaaagaugccgaaagaacgaagcuauuuuggauaaguuauuccgauggagaccagugcgcaaguagcccuugccagaauggagguaguugcaaagaucagcuccagucuuauaucugcuuuugucugccagcauuugaaggucggaacugugaaacucacaaggaugaucaacugauuugcgucaacgagaacggggguugugaacaguauugcucagaccauacaggcacgaaacgcuccugucggugccaugagggcuacucccuucuugcagauggagugucuuguacaccuacagucgaauaccccugcgggaaaauaccaauucuggaaaagaggaacgccagcaaaccacaaggaaggaucguggguggaaaaguguguccuaagggagaaugcccauggcaagugcuccuguuggucaacggugcccagcuguguggaggcacauuaauuaacacaauuugggucguuucugcugcucauugcuucgacaaaauuaagaacuggcggaaccucauugcgguccucggagagcacgaucuaagcgagcaugacggcgacgaacagagcagaagagucgcucaggugaucauuccuucuacuuacguccccggcacaacaaaccaugauauugcgcuucuccggcugcaccagcccgucguucugaccgaccacgucguuccucugugucugccugagcgaacauucagugagcggacacuggccuucgugcgauucagucucgugucuggauggggacagcuguuagaucgaggagcaacugccuuagagcucaugguccugaacguuccccgacuuaugacucaagauugccuucagcaguccagaaaggucggagauagucccaacauuacugaauauauguucugugcaggguauucugauggaucaaaagacucuuguaagggcgauagcggaggcccccacgcaacucacuaccgcggcacgugguacuuaacugggauuguuagcuggggccaaggaugugcgacuguugggcacuucggcgucuauacgagggucucucaauacauagaaugguuacagaagcugaugaggagcgaaccccgcccugggguccuuuuaagagcaccguuucccuag

SEQ ID NO: 5165 - RNA, 1401 nt, Artificial Sequence
  Description of Artificial Sequence: Synthetic coding sequence
auggucagucaagcccucagguugcucuguuuauugcugggauugcaggguugccuggcugcuggagggguugccaaagccucaggaggagaaaccagagacaugcccuggaaaccggggccacaccgcguguucgugacccaagaagaggcccacggggugcuucacaggcgaaggagggcaaaugccuuucucgaggagcuccggccgggaucacuggaacgggaauguaaagaagaacaguguucauuugaggaagccagagagauuuuuaaggacgccgaacgcaccaaguuauuuuggauuuccuauuccgacggagaccagugugcguccagcccuugccaaaaugguggaucuuguaaagaccagcugcagagcuauauaugcuuuugucuuccugccuucgagggccguaauugcgagacucauaaagacgaccaauuaauaugugugaaugagaacggagggugcgaacaauacugcucagaccauacaggaacaaagcgaaguugccggugucaugagggguauaguuuguuagcggacggagugaguugcaccccuacaguagaauaucccuguggcaagauccccauccuggaaaagagaaacgccuccaagccucaaggcagaauugugggaggaaaggugugccccaaaggggaguguccuuggcaaguccugcuucugguuaauggagcucaacuaugcggaggaacucucaucaacacgauuuggguaguuagcgccgcucacuguuucgauaagauaaaaaauuggcggaaucugauugcugugcuuggcgagcaugaccuaagugaacaugacggagaugaacagaguaggcgaguggcacaagugauaauaccaaguacuuacguuccuggcaccacaaaccacgauaucgcccugcuaaggcugcaccagccaguaguguugaccgaccacguuguuccccuuugccucccagaaaggacauucuccgaaagaaccuuggcguuugugagauucucacuaguguccggauggggucaacugcuggacaggggggccaccgcacuggaauuaaugguuuuaaacgugccccgucucaugacgcaggacugucugcaacaaucaagaaaaguuggcgauagcccuaauauaaccgaguauauguuuugugcugguuauucugacgggucaaaagacagcuguaagggagauuccggggguccccaugcuacccauuauagaggaacgugguacuugacagggauuguaaguuggggacaaggcugugcuacugugggacauuuuggaguuuacaccaggguaucucaauauaucgaguggcugcagaagcugaugaggagugaaccucggccgggugugcugcugagagcucccuucccauag

SEQ ID NO: 5166 - RNA, 1194 nt, Artificial Sequence
  Description of Artificial Sequence: Synthetic coding sequence
augggcaacgugaaucggcagggacagcauugccgugacuucauaaugguaucucaggccuuacggcucuuaugucuuuuacuuggauugcagggcugccuugccgccgacggagaccagugcgcuucuuccccuugccagaauggcggaucaugcaaggaucaacugcagaguuacauuugcuuuugccugccugcuuucgagggacggaacugugaaacucauaaggaugaucagcuuauaugcgugaaugaaaauggcggaugcgaacaguauugcucagaucauacaggaacuaaacgauccuguagaugucacgaaggcuacucacuacuugcugauggcguuagcugcaccccuacuguagaauauccaugugggaaaauccccauuuuagagaagcgaaacgcuaguaagccucaaggucggaucguaggcggaaaaguuugucccaagggcgagugucccuggcaggugcugcuacuggugaacggcgcucaacugugugggggaacccugaucaauacuaucugggugguaucugcagcccauuguuucgacaagauuaaaaacuggaggaaccugauugcagugcuuggagagcacgaucuuagcgaacaugauggugacgaacagagcagacgaguggcccaggucauuaucccuaguaccuaugugccuggaacuaccaaucacgauauugcucuucuccggcuucaucagccagugguucugaccgaccacguggugccccugugccucccagaaaggaccuucucagaacguacccuggcuuucgugcguuucucucugguaucaggauggggacagcugcuugacaggggagcaaccgcucuggaguuaaugguccuuaacguuccccgccuuaugacccaggacugucuacagcagucuagaaagguaggugauagccccaauauaaccgaguacauguucugcgcaggauacagcgacggcuccaaggauagcugcaagggcgauaguggggguccucacgccacgcauuacaggggcacaugguaccucacuggcaucgucucaugggggcaagguugugcaacagucgggcacuucgguguguacacuagagugagucaauacauagaauggcugcagaaacuuaugcgaagcgaaccucguccggggguccuccucagggcaccauuucccuag

SEQ ID NO: 5167 - RNA, 651 nt, Artificial Sequence
  Description of Artificial Sequence: Synthetic coding sequence
augaggauccaggacccgggcaaagucuuuuuuggcaacguggauagcucaggaauuaaacacaacauauucaacccaccuauuauugcacgcuauauucgucuccacccuacacacuauagcauaagaucaacauuacgaauggaacuuaugggaugcgaccuaaauucauguuccaugcccuuaggaauggaauccaaagccauaucugaugcccagauuaccgccagcucuuacuucacaaauauguuugcaaccuggucccccuccaaagcccguuugcaucugcagggccggagcaacgcuuggcgcccucaggugaauaauccuaaagagugguugcagguggacuuccaaaaaaccaugaaagucacuggcguuacaacccaaggcguuaaaucacugcugaccaguauguaugugaaggaauucuugauuaguucaagccaggacggccaucaguggacccuuuuuuuccagaacggcaaaguaaagguuuuccagggcaaccaggacucuuucacuccaguggucaacucacuugauccuccucucuuaaccagauauuuacgaauccacccacaaagcuggguccaccagaucgcccuuagaauggaaguguuagguugugaagcacaagaucuuuacuag

SEQ ID NO: 5168 - RNA, 7056 nt, Artificial Sequence
  Description of Artificial Sequence: Synthetic coding sequence
augcagauugaacucucgacuugcuuuuuucucugucuguuaagauucuguuuuagcgccacaaggcgguauuaucugggagccguugaacuaucaugggacuacaugcagucagaccugggugagcuuccagucgacgcccgauuuccaccucgaguuccaaaaagcuuccccuuuaacacuagcguagucuauaagaaaacauuguucguugaauuuaccgaucaucuguuuaauaucgcuaagcccagaccucccuggaugggacuguuaggacccacaauacaagccgaggucuaugacaccgucgucauuacauuaaagaacauggcuucacaccccgucucacuucacgccgugggggucaguuauuggaaggcgucugagggagccgaauaugacgaucaaaccagccagagagagaaggaggaugauaaaguuuucccagggggcucacacacauacguauggcaagugcuuaaggaaaauggaccaauggccuccgacccacugugccugacuuacucauaucucagucaugucgaccucgucaaagaccuuaacucaggacuaaucggagcucuucuggugugcagagaaggaagccucgcuaaagagaaaacacaaacauuacacaaauuuauucuguuguuugccguuuucgacgaggggaagucauggcacucagaaacgaaaaacagucugaugcaggauagagacgccgcuuccgcucgcgcauggccaaagaugcacacggugaauggcuacguuaaccgcucucucccaggucucauuggcugucauagaaaauccgucuauuggcacguaauuggaauggguacuaccccagagguccauagcaucuucuuagaaggucacacuuuccuugugcguaaccacagacaagccucacuggaaauuagccccauaacauuccugacugcccaaacacuucuuauggaccuuggccaauucuuacucuuuugccauauuagcucacaccaacacgauggaauggaggccuaugugaaaguggauucaugcccagaggaaccucaguuaagaaugaagaauaaugaagaggccgaggauuaugaugacgacuuaaccgauucagaaauggaugucgugagguucgacgacgauaauagcccaagcuucauucagauuaggucaguugcuaagaagcaucccaaaacuuggguucauuacaucgcugcugaagaagaagacugggacuaugccccacugguccuggcccccgacgacagaagcuauaagucccaguaccuaaacaacgggccucaaagaaucgguagaaaauauaaaaagguuagguuuauggcauacacagacgagacauucaaaaccagggaagcaauacaacaugagagcggaauauuaggcccacugcuuuacggagaggucggagacacacuccugauaaucuucaagaaccaggcuucuagacccuauaauauuuacccccacggcaucacugauguucgcccuuuauacucccggagacuccccaagggugugaaacaucuuaaggacuucccuauuuugccuggagaaauuuucaaguauaaguggaccgugaccguggaggaugggccaaccaaaagugacccccggugcuugacucgguacuacucuaguuucguaaacauggaaagagaucuagccagcggucuuauagggccucuccugaucuguuauaaggaauccguugaccagaggggcaaucagauuauguccgauaagcgcaacguuauacuuuucucuguguuugacgagaacagaagcugguaucuaaccgagaauauccagagauuuuuaccuaacccagccggaguucagcuggaggauccagaguuccaagcuaguaacauuaugcacucuaucaauggauacgucuucgauucccuucagcugucaguuugucuucacgagguugccuacugguacauccuguccauuggagcccaaaccgauuuccuauccguguuuuuuaguggcuacacguucaaacauaaaaugguuuaugaagacacucucacacuuuuuccauuuagcggggaaaccguuuucaugucuauggaaaaccccggccuauggauucugggaugucacaauagcgauuuucggaaccgcggcaugacagcccuccucaaagucucuucaugcgauaagaacaccggcgacuauuacgaggacagcuaugaagauauuuccgccuaucugcuaucaaaaaacaaugccaucgaaccacgaucauucagccagaacucgagacacccgucaacucggcagaaacaguucaacgcuaccacgauuccagagaacgauaucgagaagacugaucccugguuugcccaccgaacaccaaugcccaagauucaaaauguguccucuagcgaucugcugauguuauugagacagagcccaaccccucauggacugagccugucugaccuucaggaagccaaguacgaaacuuucagcgacgauccuucuccaggagcaauugauuccaacaauagucugagcgaaaugacgcacuuucgaccgcaauuacaccacuccggagauaugguuuucacuccugaguccggucugcaguuaagacuuaacgaaaaacucggcacuacugcugccacagaguugaagaagcuggauuuuaaggugucuucuaccaguaauaaccuuaucaguacuauccccucagacaacuuggccgccgggacagacaacaccucaagccuagggccacccucaaugccgguccauuacgauagccaguuggacaccacccuguucgggaaaaaguccaguccccucacagaauccggaggaccacuuagcuugucagaagagaauaaugauucuaaacugcuggagagugggcugaugaauucccaagaaucaagcuggggaaagaacgucuccuccacugaaucuggucguuuauucaaggguaagagagcucacggaccugcucugcugacaaaggacaaugcguuauucaaggucucuauuucacuccucaaaaccaauaagacauccaauaacucugccacgaacagaaagacacacaucgacggcccuucguuacuaauugaaaacucaccuuccgucuggcaaaacauccuggagucugauacagaauucaaaaaggucacgccucugauccacgacagaauguuaauggauaagaacgcaacagcuuugagacucaaucauaugucaaacaaaacgaccagcagcaaaaacauggagauggugcagcagaaaaaagaggguccaaucccaccugaugcgcagaaccccgauaugaguuuuuuuaagaugcucuuuuugccugagagugcaagauggauacagaggacccacggcaagaacucuuugaauucuggacaggggccuaguccgaagcaguuagugucacuuggaccugagaaaucuguagaaggucagaauuuucuuucugaaaagaauaaaguggugguuggcaaaggagaauuuacuaaggacgugggcuugaaagagauggucuucccuucuagccguaaucuuuuucuaacaaaccuugacaaccugcacgaaaauaacacccacaaccaggaaaaaaagauacaggaagaaauagagaaaaaagagacuuuaauccaggaaaaugugguguugccucaaauucacacugucacagggaccaagaauuuuaugaagaaccuguuucugcugucaacacgucaaaacgucgagggaaguuacgauggugcuuacgcaccagugcuccaagacuuuagaucucugaacgacucaacuaaccgcaccaaaaagcacacugcccauuuuucgaagaagggcgaagaagaaaaccuugaagggcugggcaaucaaaccaagcagaucguugaaaaauaugccugcacuacaagaaucucgccaaauacuucacaacagaauuucgucacucaacgguccaagagagcccugaaacaguuuaggcugccccuggaagaaacagaacuugagaagcguaucaucguggacgacacaucaacacaauggucuaagaauaugaagcaccugacacccuccacgcuaacucagauugacuauaaugaaaaggagaaaggcgccauaacccagaguccucuguccgauugccuaacucggagccacucuaucccacaggcaaacagaucaccucuccccauagcuaagguauccucauuccccagcauucgacccaucuaucugacucggguccuuuuucaagacaacucuucucauuuacccgccgcguccuaucgcaaaaaggacucaggaguccaagagucuagucauuuucuacaaggagcaaaaaagaauaaccugagccuggccauacucacccuugagaugacuggagaccagagagaaguggguagccuaggcaccuccgcuacgaauucagucacauacaaaaaaguugagaauaccgugcuaccaaagccugaucuuccaaagacauccggcaaaguugagcuacuucccaaaguacacaucuaccagaaagaccuauucccuacagagacuagcaacgggagcccuggacaccuggaucugguugaaggguccuugcuccagggaacggagggagcuaucaaauggaaugaggcaaauaggccagggaaagugcccuuucuacggguggcaaccgaauccucagcaaaaacuccaaguaagcucuuagauccccuugccugggauaaucauuacggcacucagauuccuaaagaagaguggaagagucaagagaagucacccgagaagacugcuuuuaaaaaaaaagauacuaucuuauccuugaacgcuugugagucaaaccaugcuauugcagcuaucaaugaaggacagaacaaaccugaaaucgaggucacgugggcuaaacagggaagaacugagagacugugcucucaaaacccccccguucugaaacgucaccagagggagauaacccgcacuacacuccagagcgaucaagaagagauugacuacgacgauacuauuaguguggaaaugaagaaagaggauuuugauauuuaugaugaagaugagaaucaaucacccagaucauuccaaaagaaaacaaggcacuauuuuaucgcagcaguugagcgucugugggauuacggcaugucaucgucuccucaugugcugagaaaccgggcucaaagugggagcguaccucaguuuaaaaaaguggucuuccaagaguucacagacggauccuuuacacagccacuguaccgaggcgagcugaacgagcaccuuggguuacugggccccuacauaagagcagagguggaagacaacaucauggucacuuuccgcaaucaggccucccgcccguauucauucuauucuucguuaauuucuuaugaggaagaucaaaggcaaggagccgagcccaggaagaauuucgugaaaccgaacgaaacuaagacguacuucuggaagguacagcaucauauggcacccacaaaagacgaauucgacugcaaagccugggccuacuuuucagacgucgauuuggaaaaggaugugcacucuggccucauugguccccuucuaguaugucauacuaauacacuuaaccccgcucacggacgacagguuacuguucaggaauucgcuuuguuuuuuacuaucuucgaugagacuaagaguugguacuuuacagaaaacauggaacggaacugucgagccccuugcaacauucagauggaagacccuaccuuuaaagaaaauuaucguuuucacgcaauuaaugguuacauuauggacacguuacccggacucgucauggcccaggaccagcgaauaagaugguaucucuugucaauggggucuaacgagaacauccacuccauccacuucucaggccacguauuuaccguuagaaaaaaggaggaauauaaaauggcucuuuauaaccuauaccccggaguuuucgagacuguggaaaugcugcccucuaaggcugguauuuggcguguggaaugccuuaucggcgaacaccuccaugcuggcaugaguacccucuuccuaguguauucgaacaagugccaaacuccacucggaauggcuuccggucacauccgggacuuucagaucacugcuagcggacaguauggccaaugggcaccuaaauuggcgcgauuacacuacaguggcucuauuaaugcuugguccacuaaagagccauucaguuggauaaaggucgaccuacucgcaccuaugauuauccauggcauaaaaacgcaaggcgccaggcaaaaguucuccucuuuauauauuucacaguuuaucauaauguauuccuuagacggaaaaaaguggcaaacguacagggguaauagcacaggcacucuuauggucuucuucgguaacguagauuccagcgguauaaaacauaauaucuuuaaucccccuaucauugcucgcuacauaaggcuacacccaacgcacuacucuaucagaucuacacuacgaauggaacuuauggggugugaucuaaauaguugcuccaugccccucggaauggaaucaaaggcuaucagcgacgcucaaaucacggccuccagcuacuuuacaaauauguuugccacuuggucuccaucaaaagccagacuacaucuucaggggagaucaaacgcuuggcgcccucaagugaauaauccaaaagaauggcugcagguggacuuccaaaaaacuaugaaggugacaggggugacuacucagggcgugaaaagcuugcuuaccucuauguaugucaaagaauucuuaauaucuuccucccaggacggucaccaauggacacuuuucuuucagaacgggaaagugaagguguuucaggguaaccaagauagcuucacuccaguaguaaacagccucgacccacccuugcucacucgcuaccucagaauccauccgcagucuuggguacaucaaauugcauugcgaauggagguacugggcugugaagcccaggacuuauacuag

SEQ ID NO: 5169 - RNA, 999 nt, Artificial Sequence
  Description of Artificial Sequence: Synthetic coding sequence
auggguagaccccugcacuugguccugcugucagccucacuugcuggacugcuguuacucggagaaucgcuguuuauuaggagggaacaggcuaauaauauucuggcucgggucacaagagccaacucguuucuggaagagaugaagaagggccaccuugagagagaauguauggaggaaaccugcucauaugaggaagcaagggaagucuuugaagauagcgauaagacuaacgaauuuuggaacaaauauaaggacggcgaccaaugcgaaacaagcccaugccagaaccaaggaaaauguaaggacggccuaggugaguauacaugcaccugccucgaaggcuuugaggguaagaauugcgaguuauuuacacggaagcuuuguucacuggauaauggagauugcgaucaguuuugucaugaagagcagaauagcguggugugcagcugcgcuagaggguacacccucgccgauaauggaaaggcuuguaucccgacuggcccuuaucccugcggaaagcaaacgcuggaaaggcggaaaagaucaguggcacaggcuacaucuucuucuggagaagcaccagauagcauuacuuggaaaccauaugacgccgcugacuuagacccaacagaaaaucccuucgaccugcucgacuuuaaccagacccaaccugaacgcggcgauaauaaucuuaccagaauuguggggggucaggaauguaaagacggcgagugucccuggcaagcccuccucauuaaugaagagaacgagggguuuugcggaggcacaauacuaagcgaguucuauauacuuaccgcagcucacugccuguaccaggcaaaacgauuuaaaggcaccggaacacgaucccgccguagagccgugcgacgcuguaccagauggagauggaguuccuccaccacaggaucacagagacgcccaaugacuucuacauccccgugcucggguucccgaccaccuuccccaagcgcauag

SEQ ID NO: 5170 - RNA, 1467 nt, Artificial Sequence
  Description of Artificial Sequence: Synthetic coding sequence
augggccgcccuuuacauuugguuuuacugagugcaucauuggccggauugcuuuugcugggggaaucucuauuuauucggagagaacaagccaacaacauacuggcccgugugacuagagcaaauaguuuucucgaagaaaugaagaaagggcaccuggagagagaaugcauggaagaaaccuguucauaugaagaagcccgggagguguucgaagacucugauaaaaccaacgaauucuggaacaaguacaaagacggggaccagugcgaaaccucccccugccagaaccaggguaaguguaaagacggacugggcgaauacacuugcacguguuuagagggauuugaagguaagaauugugaauuauuuacaaggaaacucugcucccuggacaacggagauugcgaucaauucugucaugaagaacaaaacucagucguguguuccugugcccgcggcuacacccucgcagauaauggaaaagccugcaucccuacuggcccuuaccccugugggaagcaaacucuugagcgaaggaagcgcucaguggcucaggccaccuccucuagcggagaggcuccugacagcaucaccuggaaacccuacgacgcugcugaucuugacccaacugagaaucccuucgacuuacucgauuuuaaucagacacagccggaacgaggagauaauaaucuaacccgcaucgugggaggucaggaaugcaaagacggcgaaugccccuggcaagccuuguugaucaaugaggaaaaugaagguuucugugggggaacgaucuugagugaguucuacauucuuacugccgcucauugucuguaccaggccaaacguuuuaaagugcgugucggggaccgcaacaccgaacaagaagagggcggagaagccguccacgagguagaaguggugauuaagcauaauagguuuaccaaggaaaccuacgauuucgauauugcuguccugaggcucaagacaccuauaaccuuucgcaugaacguugcuccugcaugucugccugagagagauugggcagaaucgacacuuaugacacagaaaacaggaauuguuaguggguucggacgcacgcacgaaaaagggagacagucuacaagacugaagaugcuagaagugccguauguugacaggaauaguuguaagcugagcucgucuuuuaucauaacacagaacauguucugcgcaggcuacgauacgaagcaggaagacgcuugccaaggggauucuggagguccgcaugugacucgcuucaaagauacguauuucgucaccgguaucgucagcuggggcgaaggcugugcacggaaggggaaguacggaaucuauaccaaaguuacugcauuucuuaaauggauugauagaucaaugaaaaccagaggacuuccuaaagccaaaagccacgcccccgaagucauuacaaguucaccuuuaaaguag

SEQ ID NO: 5171 - RNA, 1005 nt, Artificial Sequence
  Description of Artificial Sequence: Synthetic coding sequence
augggcaggccuuugcacuugguguuacuguccgcgucauuggcaggccuacuacuacucggagagagccuuuucauaagacgggagcaggcuaauaacaucuuagcuagagugacacgagccaacagcuuccuggaggagaugaaaaagggccauuuagagagggagugcauggaagagacauguucauaugaggaggcgagagagguauuugaagauucggauaaaacaaaugaguucuggaacaaauacaaagacggcgaucaaugcgaaacaucaccuugucagaaccagggcaaguguaaggacgggcugggcgaguauaccugcacuugccuggaaggauucgaaggcaagaauugugagcuguucacucguaaacuuugcagccuggacaacggcgacugugaccaauuuugccaugaggaacagaacagcgucguguguuccugcgccagagguuauacacucgcagacaauggaaaagccuguauuccgaccgguccuuacccuugcggaaaacagacacuagaaagaagaaaacgcucgguggcacaggcaaccagcucaucuggagaagccccagacucaauuacuuggaaaccguacgacgcugccgaccuggacccaaccgagaauccuuucgaccugcuugauuuuaaucagacccagccugaacguggagauaacaaccucacgaggauaguugguggccaggaaugcaaagacggggaauguccuuggcaagcucuguugauuaacgaagagaacgaaggcuuuugcggcggcacaauacuaagugaauuuuacaucuuaacagcugcgcauuguuuauaccaagcgaagcgcuuuaaaguuagaggcacagguacucggaguagacgcagggcagucaggagaugcacgagauggcgauggucaucuagcaccacuggcucacagcgccgaccuaugacaucuaccucccccugcucgggcucaagaccaccuucuccuucagcauag

SEQ ID NO: 5172 - RNA, 1722 nt, Artificial Sequence
  Description of Artificial Sequence: Synthetic coding sequence
augaucuucuuguaccaggucguucacuucauccuguuuacuucugucucuggcgagugcguuacucagcuucugaaagacacaugcuuugaaggcggagacauuacuacuguguuuaccccgucugcuaaguauugucaggugguguguacuuaucauccccgcuguuugcuguucacguucaccgcagaaucaccuucagaagaucccacacguugguuuacuuguguucuaaaagauagcgugacugagacccucccccgugucaauagaacugcugcuauuucuggguauuccuucaagcaauguucucaucagauuuccgugaacaacaucugucuucugaaacacacacagacuggaacacccacucgcauuaccaagcuugacaaaguggugagcggcuuuagccuuaaguccugcgcucugucuaaccuggcauguauaagagacaucuuccccaauaccgucuucgccgacucgaauaucgauuccguuauggcgccugacgcguuugucugcggucgcauaugcacucaucaccccggauguuuauuuuucacauuuuucucacaggaguggccaaaggagucccaaagaaaucugugcuugcuuaaaacuucggaguccggacuaccauccacuaggauaaagaagucgaaggcccucaguggguucucccugcaauccugucggcacuccaucccagucuuuugccauagcuccuucuaccacgauacugacuuucugggcgaagaacuugacauuguggccgccaagucacacgaagccugccaaaaacuuuguaccaacgcugugcguugucaguucuuuacguacacgccugcacaggcaucauguaacgagggaaaaggaaaauguuauuuaaaacuuagcucaaacggauccccaacuaaaauccuacacggcagaggcggcaucagcggauacacucuccgacucugcaaaauggacaacgaguguaccacaaagaucaaaccgagaauugucggcggaacggcaucugugagaggggaguggccauggcaggugacgcuccauacuacgucuccaacucagaggcaucuaugcggaggaucaaucauaggcaaccaauggauccuuacugcugcccauuguuuuuacggaguggaaagucccaaaauccugagaguuuauagcgguauacugaaccagagcgagaucaaggaggauacaagcuuuuucggagugcaggaaauaaucauacaugaucaguauaagauggccgaguccggcuacgacauugccuugcucaaacuugagacgaccgugaauuauaccgacagccagcgaccgaucugccuacccucgaagggagaccgcaacgucaucuacacugauuguugggugacaggauggggauacagaaaacuacgugacaaaauacagaauacucuacagaaggcuaagauuccgcuaguuacaaacgaggaaugucagaaaagguaccguggccacaaaauuacacacaagaugauaugcgcaggauaucgggaaggcggaaaagacgcuuguaagggagauagcggaggaccacugucuuguaagcacaacgaaguguggcaccuuguggguaucacauccuggggggaaggcugugcgcaaagagaaagaccuggcgucuacacaaacguuguugaauauguugacuggauucuugagaagacucaggcggucuag

SEQ ID NO: 5173 - RNA, 1878 nt, Artificial Sequence
  Description of Artificial Sequence: Synthetic coding sequence
augauuuuuuuguaucagguaguucauuucaucuuauucacauccguaaguggcgaguguguaacucaguugcugaaagacacaugcuucgaggggggggauaucacgacaguauuuacgccaagugccaaauauugccaaguuguaugcacauaccauccccguuguuugcuguucaccuucacugcagagagccccuccgaggaucccacucgcugguuuacaugcgugcuuaaagauucggugacagaaacacuuccaagggucaauaggacagcggccauuucaggguauucauucaaacagugcagccaucagauauccgccuguaacaaagauauuuacgucgaucuggacaugaaaggaauuaacuacaauaguagcguugccaaauccgcccaggagugccaagagcgcugcacugaugauguccacugccacuucuucacuuacgccacacgccaauuucccucacuggaacacagaaacaucugucugcugaagcacacucagacuggcacccccacacguauaaccaaacucgauaagguuguuuccggcuucucacuuaaaucuugugcccucucgaaccuggccuguauccgugacauuuuccccaacacugucuucgcugauucaaacaucgauucuguaauggcuccagaugcuuucguguguggccgaaucugcacucaccaucccggcugucuauucuucacuuucuuuucacaagaguggccaaaagagucacagcguaaucuuugcuuauugaaaaccagcgagaguggauuaccguccacacgcaucaaaaagucuaaagcguuauccgguuucucucugcaaagcuguagacacuccaucccagucuucugccacucaucuuucuaucacgauacugauuuccugggcgaagagcucgauauuguggcagccaaaucacacgaagccugccagaagcucuguaccaacgcagugaggugccaauucuucacuuacacuccagcccaggcaucuuguaaugagggcaaaggaaagugcuaccuuaaacugagcuccaacgguucaccuacuaagauucuccacggacgcggagguauuucaggauacacccuacgguuauguaagauggauaaugaguguacaaccaaaauaaagccuagaaucgugggaggcacagccagcgugagaggggaguggccuuggcaagugacccuccacaccacuuccccuacucagagacaccugugcggcgguucaaucaucggaaaucaguggauucucacagcagcccacugcuucuauggcguagaguccccuaaaauacuuagagucuauucuggaauucugaaccagagcgaaaucaaggaggauaccucauuuuucggaguacaggagaucaucauccaugaccaguacaaaauggcugaguccgguuacgauauagcucugcucaaauuggaaaccacugugaacuauacugauagccagagaccaauuugucugccuucgaaaggggaccgcaauguaaucuauaccgacuguugggugacaggcuggggauacagaaaacugcgagacaagauccagaacacauuacaaaaggccaaaaucccgcuggugacuaaugaggagugccagaaaagauacagaggacacaaaauuacucauaagaugaucugugcaggauaucgggaggggggcaaagaugccugcaagggagauagugggggaccccugagcuguaaacauaaugaaguguggcacuuagucgguauuacuuccuggggugaagggugcgcacaaagggagcgccccgggguauauacgaauguuguagaguacguggacuggaucuuagaaaaaacucaagcuguguag

SEQ ID NO: 5174 - RNA, 633 nt, Artificial Sequence
  Description of Artificial Sequence: Synthetic coding sequence
uaaucuggauucucucugaaaucuugugcucugucaaaucuugcuugcauacgcgauaucuuccccaauacugucuucgccgacucuaacaucgauucuguaauggcccccgaugcuuucgucuguggacggauauguacccaucaccccgggugucuuuucuuuacauucuuuagucaggaguggcccaaagaaucccagcguaaucugugcuugcugaagacaucugaaucaggcuuacccucgacgcggauaaagaaauccaaagcacuuaguggauucucgcugcagucuugucggcacagcauccccguguuuugccauucuuccuucuaccaugacacugacuuucugggcgaggagcuggauauaguggccgcaaaaucccaugaggcaugucaaaaacuuuguaccaaugcaguccgaugccaauuuuucaccuauacaccagcucaggccucaugcaaugaaggcaaggggaaauguuaccucaaacugucaagcaacggaagucccacgaagauccuccacggccgcggcggcauuucuggcuauacacuacggcucugcaagauggacaaugaacugaggggcgcgccaaugaaaauaucuggcuggcuuaaaacaucguag

SEQ ID NO: 5175 - RNA, 8835 nt, Artificial Sequence
  Description of Artificial Sequence: Synthetic coding sequence
augacacuuaggcuccugguagcugcccuuugcgcaggcauucucgcagaagcuccucgggugcgagcccagcaccgcgaacgcgugacauguacccggcuauacgccgcggauauuguuuuuuugcucgauggaagcuccucaaucggaagauccaacuuucgagagguccgcucauucuuagaggguuugguccugcccuucucaggggccgccucggcccagggagugcgcuuugcuacuguacaauacuccgaugacccccguacugaauucggacuugacgcgcugggauccggcggcgauguaauuagagcuauacgagagcuguccuauaagggcggaaacacccgaacaggugcugccauccugcauguggcagaucaugucuuccugccccagcuugcccguccuggagugcccaaaguauguauccuaaucacagaugggaagucucaggaccuuguugauaccgcagcccaaagguuaaagggucagggcgugaaguuauucgcuguaggaauuaagaacgccgacccugaagagcugaagagagucgcuagucaaccuaccucagauuucuuuuucuucgugaaugauuuuucuauucugcggaccuugcugccacucgugucacgaagggucuguacaacagcugggggcgucccggugacccgaccuccugaugacucaaccucagccccucgagaccuuguucuguccgaaccgagcagccaaucacugcgagugcaguggacagccgccucaggucccguuacugguuacaagguccaauauaccccacugaccggacugggccagccauuaccuucagaacgccaggaagugaacgugcccgcuggcgaaaccucugugcgauuacguggacugaggcccuugacggaguaucaggugacaguuauugcgcuauacgccaacucaauuggggaggcaguauccggcaccgccagaacuaccgcccucgaaggucccgaguugaccauccaaaacacuaccgcccacucacuacuugucgccuggcgcucagucccuggagcaacaggguaucgggugacuuggcgcgugcucuccggcggcccaacacagcagcaagagcuuggaccggggcagggcucagugcuucugagagaccuggagccuggaacagauuacgagguaacaguguccacacucuucggucgcucugugggccccgcuacuagucuuauggcacgaaccgaugccagcguggaacagacgcucagacccgugauacugggaccaacaagcauucugcuaagcuggaaccucgugccugaagcccgaggcuaccgccuggaauggaggagagaaaccgggcuugaacccccucaaaaaguugugcugccuuccgacgugacuagguaucaacuggacgggcuucagccaggaacugaauacaggcucacacuauacacccuucuggaaggccaugaagucgcuacuccagccaccguggugcccacuggaccugagcugcccguuucacccgugaccgaucuccaggccacugaguuaccuggacaacgggugcgugugucuuggucccccguuccuggugcuacccaguaccgcauuaucguuagaucuacacagggcgucgaaaggacccucguuuugccgggcucucaaacugccuucgaccuggaugaugugcaggcaggacucuccuacaccgugagggugucggcacgagugggcccaagagaagggagcgcuaguguuuugacugugagacgcgagccugagaccccccucgccguuccagggcuccgggucguuguaucggaugccacccguguucgaguggcuuggggaccugugccaggcgcauccggcuuucgcaucagcuggaguacaggcaguggaccagaaaguagucagacuuuaccgccagauucaacggccaccgacaucacagggcuccagcccggcacaacuuaucaaguggcagugaguguguuaagaggaagagaagagggccccgcugcuguuauaguugcccguaccgacccucuaggcccggucagaacaguacauguaacucaggccucaucuuccucuguuacuauuacauggacccgagugccuggcgcuaccgguuaccgggugagcuggcauagugcccacggaccugagaagagccaguuagucucuggcgaagccacaguagcugagcuggacggucucgaacccgacacagaguacacaguccacgugagggcucacguugcuggcguagauggaccacccgcgaguguagucguucguacagcuccggagccugugggaagggugagcagauugcagauacuuaacgcuucaagcgaugucuuaagaaucacaugggugggcgucacuggugcuaccgcauauagauuggcuuggggcaggucugaggggggccccaugagacaccagauauugccaggaaauaccgacuccgccgaaauccguggacuggaaggaggggucagcuacucagucagggucaccgcacugguuggagauagagaggggacuccaguuuccauagucgucacgacgcccccugaggcgccgcccgcacugggaacacuucacguaguccagagaggagaacauagccugagguugcguugggaaccagugccgagggcacaggguuuuuuguugcacuggcaaccugaaggcggccaggaacaaucccgcguguuagggccugaauuauccucuuaccaucucgacggcuuagaaccggccacgcaguaucgaguacggcuuaguguccugggucccgcuggagagggcccuuccgcugaaguuaccgcgcggacugagucuccccgcgugcccuccaucgaauugagggucguggacacgucuaucgauaguguuacguuagcauggacccccgugucuagagccucuuccuacauccugagcuggagaccauugcguggaccuggccaggaagugccgggcucaccacaaacucugccgggcaucaguagcucacagagagugacgggacucgaaccggggguguccuauauuuucagucugacacccgugcuggauggugugcgcgguccagaagcguccgucacccaaaccccuguguguccccgaggccuagcugacgucgucuuucucccccacgcaacucaggacaaugcucaccgugccgaagccacacgcagaguguuagaaagguugguucuggcucucgguccccuggggccccaagccgugcaggugggacuucugucauacucucauaggccguccccccuguuuccucucaacgguagccacgauuuagguaucauauuacaaagaauucgagacaugccauauauggacccauccggcaauaaccugggcaccgcugucguuacugcacacagguauaugcuagcccccgaugcucccggccgcagacagcacguuccaggaguaaugguguuacugguggacgaaccccuucgaggcgauauauuuucaccaauuagagaagcccaagcauccggucucaacguagucaugcuaggcauggcaggcgccgaucccgagcaacuccggcguuuggcaccuggcauggauucuguucagacuuuuuuugcagucgacgauggaccaucucuggaucaggcagucagcggguuggccacugcccugugucaggcuagcuuuacuacucaaccacgacccgagccuuguccugucuacuguccaaaaggccaaaaaggugagccuggugagaugggauugaggggccagguaggcccccccggugaccccggucuuccuggccgcacaggagccccagggccacagggucccccgggaagugccaccgcuaaaggagaaagaggauuuccuggagcugacggccgcccugguuccccaggacgagcaggcaacccagguacccccggcgcaccagggcugaagggaagcccaggauugccgggcccaagaggagaucccggcgagcgcggcccaagaggccccaagggcgagccaggcgccccugggcaagucauuggcggggagggcccuggcuuaccagggaggaagggcgacccuggaccuucuggaccccccggccccagaggcccgcucggugacccugguccacgcggaccccccggauuaccaggaacagcuaugaagggggauaagggugacaggggugagcggggaccaccaggaccuggagaaggcggcauagcucccggagaaccaggucugccuggccugccgggguccccaggaccacagggccccguugguccuccugggaagaagggugaaaaaggugacuccgaggacggugccccagguuugccuggacagccaggaagccccggugagcaggguccuagaggucccccuggagcgauugggccuaagggugaccgaggguuucccggcccccugggugaagcuggagagaagggcgaaagagguccuccgggcccagcuggaagccgaggcuugcccggaguugcugguagacccggagcuaaaggccccgaggggccccccggaccgacuggcaggcaaggggaaaaaggagagcccggaagaccgggggacccugcagugguagggccagcugucgccggaccuaaaggcgaaaagggagaugugggcccugcaggaccucgcggcgccacuggugugcagggagagagagguccaccuggccuagucuugccuggcgaccccgggccaaaaggugauccgggagacagggggcccaucggacucacagguagagccggaccaccaggcgauagcggcccacccggggaaaaaggcgacccagggcgccccgggccuccagggcccguuggaccacgcgggagggacggcgaaguaggcgaaaaaggagaugagggacccccaggggauccaggccugccagggaaggcaggugagcgaggacuaagaggcgcgccaggagugagagggcccgucggcgagaagggagaucagggagauccuggcgaggacggcagaaacggcucgcccgggagcagcggaccuaagggagauaggggggagccuggcccaccaggccccccuggucguuugguggacacaggcccuggagcuagggagaagggcgaacccggggacagaggucaggagggcccacguggaccuaaaggagacccuggacuuccaggcgcccccggcgaacgcggcaucgaagguuuucgaggacccccaggaccgcagggagaccccgggguaagaggaccagccggcgagaaaggagaccgaggcccuccaggucuugacgguagaagcggcuuggacggcaaacccggcgcagcugguccaagcgggccaaauggcgcagccgguaaggcgggcgacccagggagagauggacugccaggccuccgcggugagcagggacugcccggaccaaguggaccuccagggcugccugguaaaccuggcgaagaugguaaacccggccugaacgggaaaaauggagaacccggcgauccuggcgaagauggaaggaagggggagaagggcgacaguggcgccucuggaagggaaggcagggauggccccaagggcgaacgcggugcaccugggauccuuggcccucaggggccucccggucucccuggccccgucggaccaccaggacaggguuucccuggcguccccggcgguacaggcccaaagggagauagaggagagacagguucuaaaggggaacaaggucugccaggcgagagaggucuaaggggggaacccggcagugucccuaacguggacagguuacuugaaacagcugggaucaaggcaucagcccugcgggaaauuguggagaccugggacgaaucauccggauccuuccuaccugucccugaacguaggcgcggacccaaaggugacagcggagaacagggcccacccggaaaggagggcccuauaggcuucccaggggaaagagggcugaaaggagaucgcggugauccgggaccucagggaccgcccggccuugcauugggcgagagaggaccaccagggccaucggggcuggcuggcgaaccagggaagccagggauacccggccugccagggagggcgggcggcguaggcgaagcagguagaccaggggagaggggcgagagaggcgagaagggagagagaggcgaacagggcagagacggucccccuggccucccaggaacccccggacccccgggcccccccgggcccaaggugucgguggaugaacccggccccggccugucgggcgaacagggacccccagguuuaaagggcgccaaaggugaaccgggaucaaacggcgaucaaggacccaagggcgaccgaggugugccaggaaucaaaggagacagaggugaaccggggccaagaggacaagauggaaacccuggccucccgggggaaagaggcauggccgguccugaaggcaaaccagggcugcaggggcccagaggcccaccuggaccgguuggaggucacggggacccaggcccccccggcgcucccggccuugccggaccugcuggcccucagggccccucuggacugaaaggggaacccggugagacugggccccccggaagaggauuaacaggcccuaccggagccgucggacugccagggccuccuggcccaagcggacucguugggccgcaggggucucccgggcugcccggacaaguaggagagacgggcaagccgggcgcaccagggagagauggggcaucagggaaagauggggaccggggaucuccaggcgugcccgggucgccaggcuuaccgggaccugugggcccaaaaggagagccaggaccuaccggagcaccgggacaagcagucgugggucuuccaggagcuaagggugagaagggcgcgccaggcgggcucgccggagacuuggugggggaaccuggggccaagggcgauagggggcuuccuggacccagaggcgaaaaaggugaagccggaagggcuggggaaccuggcgacccgggcgaagauggccagaaaggggcaccagguccuaaaggauucaaaggugaucccggcguaggcguucccgggucuccugggccccccggaccacccggugugaaaggagauuuggguuuaccaggacugccaggagcacccggcguagucggguuuccaggacaaacaggaccccgcggggagauggggcaaccaggaccuuccggggaacgaggccuagcuggucccccuggaagggaaggcauuccgggaccacugggaccucccggcccuccaggcucuguggggccaccgggugcgucaggccugaaaggugacaagggggauccagguguugggcugccuggaccacggggggaacgaggcgagccuggcauuagaggggaggauggaagaccaggucaggagggaccaaggggauuaacgggucccccgggaagucgaggagagcguggugagaaaggagauguggggagcgccgggcucaagggggacaaaggugauucugccgugauccucgguccuccaggaccuaggggcgcgaagggugauaugggcgaaagaggaccacggggauuggacggagauaaagggccucgaggcgauaauggcgauccaggcgauaagggcucaaaaggcgaaccuggcgacaaaggguccgcuggacucccuggacugagaggguuacugggaccacaaggccagccuggagcggcuggcauuccaggugauccagguagccccggaaaggauggagugccgggcauuaggggugaaaagggggaugugggcuuuauggggcccagaggguugaagggggaacgcggagugaaaggggccuguggacuagacggagagaagggggauaagggugaggcuggaccuccaggacggccgggcuuagcuggacauaagggggaaaugggagaaccaggagugccaggucagagcggggcuccagguaaagaaggccugauuggaccaaagggcgacagaggguuugauggccaaccuggaccaaaaggcgaccagggcgagaagggagagcgaggaacgccaggaauaggggguuucccagguccaagugggaacgacggaagcgcagggccaccaggcccacccggcuccgugggaccuaggggucccgaaggguuacagggccagaagggagaaaggggaccccccggagaaagagucgugggugcgcccggaguucccggcgcuccuggcgagaggggagaacagggccgacccggacccgccggaccccguggcgaaaaaggcgaagcugcgcugacagaggaugauauccggggcuucguaaggcaagagaugucucagcauugugcuugucagggucaguucauugcaucagguagucguccucuuccuagcuacgcagccgauaccgcuggaucucaacuucaugccgucccagugcugaggguuucacaugcugaggaagaagagcgugugccuccugaagaugaugaauauucagaauacagcgaguacaguguggaggaauaucaggaucccgaggcacccugggacuccgacgacccaugcagccucccccuugaugaagguucauguaccgcauauacacugaggugguaucauagggcugugacaggaaguaccgaggcaugccauccuuuuguguauggggggugcggagguaaugccaacagauuugggacacgggaagcaugugaacgaagguguccgccucgcgucguccagagccaaggcacaggaacugcacaggacuag

SEQ ID NO: 5176 - RNA, 8739 nt, Artificial Sequence
  Description of Artificial Sequence: Synthetic coding sequence
augacucugcgacuuuuggucgcugcccuuugugcuggcauauuagccgaggccccccgcguucgcgcacaacaucgcgaaagaguuaccugcacuaggcuuuacgccgccgacaucguguuucugcuggauggaagcagcaguaucggaaggucuaacuuccgugaagugagaagcuuucuugaaggucuggucuugcccuucuccggagcugcuagcgcucaaggcgucagauucgcuacugugcaguauagugacgauccucggacugaauuuggcuuggacgcacucggcucagggggagacguuauccgugcaauucgggaguugucauacaaagggggcaacacuagaaccggcgccgcgaucuugcauguugccgaucacgucuuccuaccacaguuagccagaccuggagugccaaaggucugcauccucauaaccgauggcaagagucaggaccucgucgauaccgccgcacagagacucaaaggccaaggagugaagcuuuucgccgugggcaucaaaaacgcugauccagaggaauugaaaagaguggcaucucagccgacuucugacuuuuuuuucuucguuaacgauuuuaguauucugcguacgcuuuuacccuuaguguccaggagagucuguacgaccgccggaggcguacccguuacccgcccgccagacgacucgacaucagccccacgcgaccuggucuugagcgaaccgagcucccaaucccugagggugcaauggaccgccgcaagcggcccagugacagguuacaaagugcaguauacaccucugacagggcucggucagccucuucccagcgaaagacaagaagugaacguucccgccggcgagaccucaguacgacuuagaggacugcgcccauuaaccgaauaccaggucaccgucauugcucuuuaugcuaauagcauuggagaggccgucuccggcaccgcgcggacgacagcucuggaaggaccugaacucacaauccagaacacgacagcucacucucucuuaguugccuggcggucaguuccaggcgccacaggcuaccgggugacauggcgaguacucagugggggcccuacucagcaacaagaauuaggcccuggccaggguagcguccugcuucgagaucuagaacccggcaccgauuaugagguuaccguuucaacucuuuucggacggagcguggguccagccacaucuuugauggcccgcacagaugccagcguagaacagacauuacgacccguaauucucgguccaaccagcauucuguugucauggaaucucgugcccgaagcccgcgguuaucgccucgaguggcggcgcgaaacuggacuggaaccuccccaaaagguuguguuaccgucggacgucacccgcuaccaauuggauggucugcagccaggaacagaauacagacugacccuguacacacuuuuggagggacacgaaguagccacuccugcgaccguggugcccacugggccugaacugccugucucuccugugaccgaccuccaagcuacugagcuaccaggccagagaguucgcguaucuuggagcccagucccgggcgcuacucaguaucguauaauagucagaucaacacagggaguggagcgcacgcuggugcucccugguucacaaacugcauucgaccuagaugacgugcaggccgguuugaguuacaccgugaggguuuccgcuagggucggcccucgagaagguuccgcuucuguucucacggucagacgugaaccugagacuccucucgcagugcccggacuucgcguuguggugagugaugcuacuagggugaggguggcaugggggcccguaccaggggcguccggcuuuagaauaagcuggaguacuggcuccggcccagaaagcucucagacacugccaccagacaguacugccacugauauaacaggguugcagcccggcacaacguaccaaguggcuguaucuguucuuagaggaagagaggaagguccugccgccgucaucguugcccggacagauccuuuaggacccgugcggacagugcauguaacucaggcuagcucuagcagcguuaccaucacuuggacgcgugucccaggagcuacugguuaccgcgugucauggcacucggcccacggcccugaaaaaucgcaacugguuuccggcgaggcaacaguggcggaacuugacggucucgaaccagauacagaauacaccgugcaugucagagcucauguggccggcgucgauggcccccccgcuuccgugguaguucggacagcuccagaaccugucggcagagucucccguuugcagauucugaaugcuuccagugaugucuuacgcauuacaugggucggagugaccggcgcuacugccuauagacuagccuggggcagaagcgaaggaggaccuaugaggcaccaaauacuacccggaaauacagauagcgccgaaauuagaggccuugaaggcggggucucuuacucgguccgagugacugcgcuugucggugaccgugaggggacccccgugaguauagucgugacuacacccccagaagcccccccugcccucggcacccugcacguugugcaaaggggcgaacauucucuaaggcuacggugggagccagugccacgggcucagggcuuuuuacugcauuggcagcccgaaggcggucaggaacaaagucgagugcugggcccugagcuuagcuccuaucacuuagaugggcuugaaccagcaacacaguacagagucagacuguccgucuugggaccugcgggggaaggacccucugcugagguuacggccagaacugagucuccccgaguaccuagcauugagcuccgcguaguugacacuagcaucgauagugugacccuggccuggacuccugugucuagagcaucuucuuauauucugaguuggaggccucucagaggaccgggccaagaagucccaggcaguccacagaccuugccugggauaucaaguucccagagggugacuggucuagagcccggcgugucauauaucuucucucuuaccccaguuuuagauggcgugcguggcccagaagcauccgugacacagaccccagucugcccuagaggccuugcugacgucguguuccugccccaugcaacucaagacaaugcccaccgugccgaggcuacaagacggguccuugaaagguuagugcucgcccuggguccgcugggaccacaagccgugcaggugggucuauuaagcuacagucacagaccgucgccguuauucccccucaauggaucacaugaccugggcauuauucuacaacguauucgcgacaugcccuacauggacccauccggcaauaaccuuggaaccgccguagugacagcacacagguacaugcuggcuccagaugccccugguaggcgucagcacgucccugggguuauggugcuguugguugaugaaccccucagaggagacaucuuuucgccgauucgugaagcacaggcauccgguuuaaaugucguuaugcucggcauggcaggagccgacccagaacagcuuaggagacuggccccaggcauggauucugugcaaaccuuuuuugccgucgacgacggaccuucacucgaucaggcagugucugggcuggcaaccgcuuugugccaagcaucuuucacaacacagccucggcccgaaccuugucccguuuacuguccaaaaggccagaaaggcgagccaggagaaaugggacugcgcggacaaguggggccaccgggagaucccgggcuuccuggacggacaggugcgccaggcccgcagggacccccaggaucggcaaccgccaagggggagcgcggguucccaggugcagaugguagaccagguucuccuggaagagccggaaaccccgguacuccuggugcacccggcuugaaggggaguccaggccucccaggaccaagaggggauccaggggagcgaggaccaagagguccuaaaggugaaccuggggcaccaggacaggugaucgguggugaaggaccuggguugcccggucgcaagggagauccuggaccuucuggaccacccggcccccguggcccuuuaggggaccccgggccucgagguccaccuggccucccaggaaccgccaugaagggggacaagggcgauaggggcgagcgcggcccucccgggcccggagaaggcgggauugcucccggcgagccaggacugcccggauuaccagggucaccugggccccagggccccgucggcccgccagggaaaaaaggcgaaaagggagauagugaggacggcgccccaggauugccugggcaacccggcucaccgggcgaacaagggcccagaggaccucccggagcaaucgggccaaaaggagauaggggguucccaggaccguugggagaggcuggagagaagggcgagagaggcccaccgggcccggcagguucccguggccucccggggguggcuggacggcccggcgccaaaggccccgaaggaccccccggcccuaccgggcgacaaggcgaaaagggagaaccuggacgcccuggagauccugcaguggucgggccagcaguggccggacccaaaggggagaaaggcgacgugggaccugcagguccuagaggagcuacaggggugcagggagaaagagguccaccaggccucguuuuaccaggagauccaggaccaaaaggggaucccggggauaggggaccaauuggacugacuggucgagcgggacccccaggcgauucagggccuccaggcgagaaaggcgauccaggcagaccugguccaccaggaccaguuggccccagggggcgggauggugaggucggugaaaaaggcgaugagggaccaccaggagauccaggcuugccugguaaggcuggcgagcgcggacugcguggcgcuccugggguucgaggucccgugggugagaagggggaucagggagaccccggagaagauggacggaacggcucuccaggaagcaguggaccuaagggcgauagaggcgaaccuggccccccgggcccaccuggacggcucguagacacugggccgggcgcaagagagaaaggggaaccuggagauagagggcaggagggcccccgaggcccaaaaggagauccuggccucccuggagcucccggagaacgagguaucgaaggguuuaggggcccacccggaccacaaggagacccgggcguacgcgggccagcuggagagaaaggagauagagggccaccagggcuagauggccgguccgggcuggacggcaaaccaggcgcagcaggucccucaggcccaaauggcgcugccggaaaagccggcgaccccgggcgugauggacugcccggccuaaggggagaacagggccuuccaggucccagcggucccccaggucugccaggaaagcccggcgaggauggcaaaccuggucugaauggcaagaacggcgaaccaggcgauccaggugaagacgggaggaaaggugagaaaggggauuccggugccucgggucgcgaaggauuccccgguguacccggugggacuggccccaaaggagacagaggcgagaccggaucaaagggcgagcagggacucccaggagagagaggccuccgcggcgaaccuggaucugugcccaauguggaucgcuugcuggaaacugccggaauaaaagcuuccgcgcuucgggagauuguggaaacuugggaugaaucaagcggcucauuuuuacccgucccugaaaggagaagagguccaaagggugauaguggagaacagggcccuccaggcaaagaaggcccaaucggguucccaggagagcguggacuaaagggugauagaggagauccggguccucaggggccgccaggacuggcccuuggagagcgggggccucccggacccagugggcuggcgggugaacccgggaagccggggauuccagggcugccggggagggcgggcgggguuggggaggcaggcagacccggcgaacgcggggagagaggagaaaaaggggaaagaggcgaacaggggagagauggacccccaggacuuccugggacacccggcccacccggacccccaggucccaaaguuucgguggacgagccggggcccgggcugagcggcgaacaggggcccccagguuugaagggggccaaaggagaaccaggaagcaacggcgaccagggacccaaaggugauagggguguuccaggaauuaagggagaucguggagagcccggaccucggggacaggauggaaacccgggucugccuggugagagggguauggccggaccagaggguaagcccggacugcaagggccccgcggcccacccggcccagucggcggacacggcgacccuggccccccgggcgccccuggcuuagccggucccgccggaccucaaggcccuaguggauuaaaaggcgaaccaggagaaaccgggccccccggaagagggcugacagggccuacaggcgcuguagggcuucccggaccaccgggccccagcggguugguugggccucagggcagucccgguuuaccagggcaaguaggcgagacaggaaaacccggagccccugggagagauggugcuucuggcaaagauggcgaucgcggaaguccaggagugccuggaagcccugguuuacccggaccugugggcccuaaaggggaaccuggaccuaccggagcccccggccaagcaguagucggucuacccggagccaaaggcgaaaagggagcccccgguggucucgccggggaccuggugggagaaccaggagcuaagggugauaggggacucccgggcccacgcggagagaaaggagaagcaggccgagccggcgaaccgggcgauccaggggaagauggccaaaagggcgcacccgggcccaaaggcuucaaaggugaucccgguguuggcgugcccggaaguccuggcccuccaggcccaccuggugugaagggggaucuggguuuaccuggccugcccggagcuccaggcgucgucggauuuccgggccagacuggaccucgcggcgagaugggacaaccgggacccaguggggaaagagggcuggccggcccuccugggcgugagggaaucccgggcccucugggaccuccaggaccgcccggaucuguaggccccccuggcgcuucggggcuuaagggcgacaagggcgauccagguguaggacugccugguccgcgcggcgaacggggcgagcccgggauucggggggaagacgggcgaccaggacaggaagggccacguggacugacagggccgcccgggaguagaggagagcgaggagagaaaggugacgucggcagcgcuggcuugaaaggagacaaaggcgauagugccguuauucuuggacccccuggaccaaggggugccaaaggagacaugggcgagcguggaccaagaggauuagauggcgauaaagggcccagaggugacaauggcgacccuggcgauaaagggaguaagggggagccuggagauaaaggaagugcaggucugccuggcuugcgcgguuugcucggcccccagggacagccuggcgcagccggaaucccgggcgauccuggaagccccggcaaagauggagugccagguauuagaggcgagaaaggcgauguuggauucaugggaccaagaggccugaagggcgagcgcgggguuaaaggcgccugcggcuuggauggagagaagggcgauaagggcgaagcuggaccaccuggcagaccuggccuggccgggcacaaaggcgagaugggcgaaccuggcguaccuggacagucuggggccccgggaaaggaaggucucaucggccccaagggugacagagguuuugacggacagccuggccccaagggagaucaaggagagaaaggggaaaggggcacaccugguaucggcggauuccccggcccgucaggcaaugacggaagugcugguccacccggccccccuggcagugucggacccagaggcccagagggacugcagggacagaaaggagaacguggacccccuggcgaaaggguuguuggggcucccggagucccuggggcuccuggggagcgaggcgaacagggcagaccagggccugcuggaccacgcggagagaaaggggaggcugcccugacugaagacgauaucaggggguuugugagacaagaaaugagucagcacugugcuugucagggucaauuuaucgcauccggaagccgcccccugccaagcuacgcagcagauaccgccgggucacaacuccacgccguaccagugcugcgagugucucaugccgaagaggaagaacgaguuccccccgaagaugacgaauauuccgaauacucugaguauagcguggaagaguaccaggaccccgaagcaccuugggauagugacgauccguguagccucccgcuagacgagggcucuugcacugcuuacacacugcgcugguaccaucgggccgugacgggguccacagaagccugccauccguucguguacggcgguugugguggcaacgcuaacagauucggaacaagagaagcaugcgaacggaggugccccccaagggucguucaaucucagggcacagguacagcucaagacuag

SEQ ID NO: 5177 - RNA, 435 nt, Artificial Sequence
  Description of Artificial Sequence: Synthetic coding sequence
auguggcugcagucacuucuacuccuuggcaccgucgccugcucuauauccgccccugcacgguccccaagcccaucaacucagccaugggagcacgugaacgcaauccaagaggccagaagacuguugaaccuuagcagagauaccgccgccgaaaugaaugagaccguggaggugaucagcgagauguucgacuuacaagaaccaaccugucugcagacacgauuggagcuuuacaagcaaggauuacgaggcucacugacaaaacuaaaaggaccccucaccaugauggccagucauuacaaacaacacugccccccgacgccugaaacuucuugcgcuacacaaauuaucacuuuugagaguuuuaaagaaaaucucaaggauuuuuuacugguaauucccuuugauugcugggagcccguacaggaauag

SEQ ID NO: 5178 - RNA, 603 nt, Artificial Sequence
  Description of Artificial Sequence: Synthetic coding sequence
augucccccgaaccagcccucuccccugcucugcaacuccucuuguggcauucugcucuguggaccguucaagaggccacuccccucggucccgcuuccucacuuccucaaagcuuccuucucaagugucuagaacaggugcgcaaaauucaaggggauggcgcugcgcugcaggaaaagcugugugcaacauacaagcucugucaccccgaagaacucgugcugcuugggcauucauugggaaucccuugggccccucugucuagcugucccucucaggcccuccagcuugcuggcugucucucacaacuucacuccggacucuuccucuaccaggggcugcuccaggcccucgaaggaaucucacccgaacugggaccaacacuggauacucugcagcuugaugucgccgacuuugcaaccaccauuuggcagcagauggaggaauuggguauggcucccgcccugcaaccuacccaaggcgcaaugccagcguucgccucugcauuucagcgcagggccggcggcguccucguagcgucucaucuccaguccuuucuagaaguuaguuaucgcguccugcggcaucuggcucagccguag

SEQ ID NO: 5179 - RNA, 516 nt, Artificial Sequence
  Description of Artificial Sequence: Synthetic coding sequence
auggccggacccgcaacucaaagccccaugaaacuaauggcucugcagcugcugcuguggcauucagcuuuauggacggugcaggaagcuacacccuugggcccagccuccagucugccucaguccuuucuacugaaguguuuggaacaggugcgaaaaauccaaggagauggagcagcccugcaggaaaagcuggugucugaggccgggugcuugucacaacuucacuccggacuguuucuuuaucaaggacuacuccaagcccucgagggaaucagcccagaacuuggaccaacccuggauacccuccagcuggacguggcagacuuugcaaccacaaucuggcagcaaauggaagaacucggcauggcaccugcacuccagcccacacagggggcaaugccugcguucgccuccgcauuccaaagacgcgcaggcgguguccuaguugccagccaucuacagucauuccucgaaguauccuaccgaguccuaagacaucuggcccagccuuag

SEQ ID NO: 5180 - RNA, 615 nt, Artificial Sequence
  Description of Artificial Sequence: Synthetic coding sequence
auggcaggaccugcuacucaaagcccaaugaaacuuauggcccuucagcuauuauuguggcacuccgcgcucuggaccguucaggaggccaccccucucggcccugcaagcucccucccucagaguuuccuacuuaagugcuuagagcaaguccgcaaaauucagggcgauggagcugccuuacaggaaaaacugugcgccaccuacaaauuaugucauccggaggagcugguacuucucgggcauucccugggaauuccaugggcuccacucagcucuuguccaagucaagcauugcaacucgccgggugccugagccaacugcacuccggcuuauuucuguaucagggucuucuccaggcacucgaagguauuuccccugaacucggccccacucuagauacccugcagcucgaugucgcugauuucgcuaccacaauuuggcagcaaauggaggaacuggggauggcuccugcccugcagccuacacagggagcuaugccugcauuugccagugcauuccaaaggagggccgggggcgugcugguggcaucacauuugcaguccuuccuggaaguuagcuaucggguucuccggcaccuugcucagccauag

SEQ ID NO: 5181 - RNA, 3696 nt, Artificial Sequence
  Description of Artificial Sequence: Synthetic coding sequence
augagacugcucgcuaagaucaucugucuuauguugugggcaauauguguagcugaagauuguaaugaacuuccaccaaggcgaaauaccgaaauucuuacugguagcuggagugaccagacuuacccugagggcacacaggccauauacaagugcaggccuggcuacaggucccuuggcaaugugauaauggugugcaggaagggcgaauggguggccuugaauccacucagaaaaugucagaaacggccuuguggacaccccggcgauacacccuucgggacuuucacuuugaccggugggaauguguuugaauauggugugaaggccguguacacaugcaacgagggauaucagcuuuuaggagagauuaauuaucgugaaugugacacagauggauggacaaacgacauuccuauuugcgaagucgugaagugccuccccguaacagcaccugaaaaugggaaaauugucuccagugcuauggaaccagaucgcgaguaccauuuuggacaggcagugagauuuguaugcaacagcggauacaagaucgaaggggaugaagaaaugcacugcuccgaugaugguuuuugguccaaggagaaaccgaaguguguagagauuucaugcaaguccccagacgugauuaacgguucacccauaucacagaagauuauuuauaaggaaaacgaacgauuucaguacaagugcaacaugggcuacgaauacucagagagaggagaugcaguuuguacagagucaggauggcguccacugcccucuugugaagagaaguccugcgauaauccauacauuccuaacggagauuacagcccgcuuagaauuaaacacagaacaggagacgagauuaccuaccaguguaggaauggguuuuaucccgccacgagaggcaauacggccaaguguacuucuacuggauggauccccgcaccuagaugcacuuuaaagcccugugacuaccccgacauaaaacacggcggccuuuaccacgaaaacaugcgaagaccauauuucccuguagcuguggguaaauacuacucuuacuauugcgaugagcauuuugaaacaccuucugggucuuauugggaccacauccacuguacucaggacggcuggucacccgccguccccuguuuacgcaaaugcuacuuucccuaucuggaaaacggguauaaccagaaccacggaaggaaguucgugcagggaaaaucgaucgacguggccugucaccccgguuaugcauuaccaaaagcacagaccaccguuaccugcauggaaaaugguuggagcccuacaccucgcuguauucgcgucaagaccuguucuaaaagcaguaucgacauagagaacggcuuuaucagcgaaucccaguauaccuaugcucucaaggaaaaggcuaaauaccaguguaaguugggauauguaacagcugacggcgaaacgucuggaaguaucaccugcgguaaggauggauggucagcccagcccacaugcauuaaguccugcgacauuccugucuuuaugaaugcacguacuaaaaaugauuucaccugguuuaagcugaacgauacccuagauuaugagugucacgauggcuaugaaagcaacacgggcucuacgacaggcucaauugucugugguuauaacggauggucugaccuuccaaucugcuaugaacgagagugcgagcucccaaaaaucgauguucaccuggucccugauagaaaaaaagaccaguauaaaguuggugagguguugaaauuuuccuguaaacccggauucaccauaguugggccuaauuccguacaauguuaccacuuuggucucucgccagaccugccuauaugcaaggagcaggugcaaagcugcggaccaccaccagagcuguugaauggaaaugucaaagaaaaaacaaaggaagaauacggccacagcgaggucgucgaguacuacuguaacccacgguuucugaugaagggcccgaacaagauccaguguguagacggggaauggaccacuuugccaguaugcauuguagaggaauccaccugcggagauauuccugaacucgaacaugguugggcccagcuguccucaccaccuuacuauuacggcgacagcguugaauuuaauugcucugaaucauuuacaaugauuggacaucggucaaucacuuguauucacggcgucuggacccaacuuccccaaugcguggcuaucgacaaguugaaaaaauguaaaaguaguaaucuuaucauucuggaggaacaucucaagaacaagaaagaauucgaucauaauagcaauauucgcuaccgaugcagaggcaaggaaggguggauucauacggugugcaucaaugguagaugggauccugagguaaauuguuccauggcccaaauccagcuaugcccaccaccuccucaaaucccuaacagccauaacaugaccacaacccugaacuacagagacggagagaagguguccguccuuugccaggaaaauuaucucauccaggagggugaggagaucacuuguaaagauggaagguggcagaguauaccccugugcgucgagaaaauuccuuguagccaaccuccacaaauagaacauggcacaauuaacucuuccagaagcucccaagaaucauaugcacacggcacuaaacugucuuauacuugcgaaggcggcuuccggauuagugaggaaaacgaaaccacguguuauauggguaaauggaguucuccuccucaaugcgaaggacucccgugcaaguccccgccagagauuagccacggaguuguggcccauaugucagauuccuaccaguauggugaagaagugacuuacaaaugcuuugaaggcuuugguauugauggccccgcaaucgcuaaaugccugggugagaaguggucacacccucccucuuguaucaaaacggacugucucucccugccauccuuugagaaugccaucccuaugggcgaaaagaaggauguguauaaagcuggugaacagguaacguauaccugugccaccuauuauaaaauggacggagcuucaaaugugaccuguauaaauucucgguggacaggacgccccacuugcagagacacaucaugugugaauccaccuacagugcagaacgcauacauaguuucgcggcagaugucaaaguauccaaguggcgaacgagucagguaucagugcagauccccauacgaaauguuuggcgacgaggaagucaugugcuugaacggcaauuggacugaaccaccacaauguaaagauucgacuggcaagugcggccccccuccuccaaucgauaauggagacauaacaucuuuuccccuuaguguguaugcaccggccaguucaguggaguaccaaugccagaaccuauaccaguuagagggcaauaaaagaauuaccugccgaaacggccaauggucugagccuccuaaaugccugcaucccugugugauuucaagagagauaauggaaaacuacaacauagcucuucgauggacagccaaacaaaaguuguauucccgcacgggcgagucuguggaauuugucugcaaaagaggauauaggcucagcucucgcucccacacacuccguacaacauguugggacggaaaacucgaauaccccacaugcgcaaagagauag

SEQ ID NO: 5182 - RNA, 1350 nt, Artificial Sequence
  Description of Artificial Sequence: Synthetic coding sequence
augaggcuucucgcaaaaauuaucugucuaauguuaugggcuaucugcguagcggaggacugcaaugagcugcccccacgccgaaauaccgagaucuugaccgguaguuggucugaucagacuuauccugaagguacgcaagcuaucuacaaaugccggccaggguaccgcagccugggcaacgucaucaugguuuguagaaagggcgaauggguggcucugaacccacuuaggaagugucaaaagcguccaugcggucacccaggggauacaccauuuggaaccuuuacccuuacuggugggaacguguucgaguacggaguaaaggcaguuuacaccuguaacgaagguuaucaacuacuaggggaaauuaauuauagggaaugcgacacggaugguuggaccaaugauauucccaucugcgaggucgucaaaugccuuccuguuacagcacccgagaacggaaaaauuguguccucugccauggagccagauagagaguaucacuucggucaagcgguaagguucguuugcaauucaggguauaagauugagggagacgaggaaaugcacugcucugaugacggguucugguccaaagagaagccuaaaugcguagagaucucuugcaagagcccugacgucaucaaugguucacccaucagccagaagauaauauauaaggaaaacgaaagguuccaauauaagugcaauauggguuacgaauauagugagagaggcgaugcuguguguacugaaagugguuggcguccacuaccauccugcgaagagaagucuugcgauaaccccuauauaccuaacggagacuauucuccucuacggauuaaacauagaaccggagaugaaauuacuuaccagugucggaauggauucuacccggcaacaagggguaauaccgcaaaaugcacuucaaccggcuggauccccgcaccuagaugcacacugaagcccugugauuacccagacauuaagcauggaggacuuuaucaugaaaauaugagacggcccuauuuccccguggcagucggcaaauacuacagcuauuacugcgaugaacacuuugagacgccaagcggaucuuauugggaucauauccacugcacacaagacggauggaguccagccgucccuugccugcguaaauguuauuuccccuaccucgagaauggcuacaaccagaaucauggcagaaaauucguccaagguaaaucaaucgauguggccugccauccaggauaugcccucccuaaagcucaaacuacuguuacauguauggaaaauggauggagccccacacccaggugcauccgagugaucuuucagcuguag

SEQ ID NO: 5183 - RNA, 1350 nt, Artificial Sequence
  Description of Artificial Sequence: Synthetic coding sequence
augcggcugcuagcuaaaauuauaugccugauguugugggcuaucugcguggcggaagacugcaacgagcuuccucccagacguaauacagagauuuuaacggguuccuggagugaucaaacauauccagaaggaacacaagcaauuuauaagugccguccaggcuauagaucauuagguaaugucauuauggugugcagaaagggagaaugggucgcccugaauccucugcgcaaaugucagaaacgcccuugcggccaucccggagauacaccuuuuggcacauuuacccucaccggggggaauguguucgaauauggugugaaggcuguauauaccuguaacgaggguuaccaguugcugggagagauuaacuaccgugaaugcgauacagauggauggacuaacgacauucccauaugcgaaguugucaaaugccugcccguuacagccccagaaaacggaaaaaucgucucaagcgcaauggagccagacagggaauaccacuuuggccaggcggucagguucgugugcaauucuggauacaaaaucgagggcgaugaggagaugcauuguagcgaugauggauuuuggucgaaagagaagccaaaguguguggaaaucucauguaaaaguccugacgugauuaacggcaguccuauuucccagaagauaaucuacaaggaaaaugaaagauuucaguacaaauguaacaugggcuacgaguacucugagagaggcgacgccguguguacagagucaggcuggaggccguuaccguccugcgaagagaaguccugugauaaccccuauauucccaacggcgacuacagcccccuaaggauuaaacauagaacaggcgacgagaucaccuaccagugccggaauggauucuacccugcuacucgagguaacacagcuaagugcacgucuaccggcuggauuccugccccacguugcaccuuaaaaccuugcgauuauccugauauuaaacacgguggcuuguaccacgaaaacaugagacgcccauacuucccagucgcuguugggaaauacuacucuuacuacugcgaugaacacuuugaaacccccuccgggucuuauugggaccauauacauuguacgcaggauggauggucacccgccgucccaugcuuacgaaaauguuacuuccccuaucucgaaaaugguuauaaccagaaucauggccgcaaauucguucaggguaagaguauugacguggcaugucacccagguuacgcacuccccaaggcgcagacaaccgucacuugcauggaaaacggauggucaccaacgccgagaugcauucgaguuaguuuuacacuuuag

SEQ ID NO: 5184 - RNA, 591 nt, Artificial Sequence
  Description of Artificial Sequence: Synthetic coding sequence
augcgccugccgcugcuggucagcgccggaguccugcucgucgcacuguugccaugcccaccuugcagagcauuacucucaaggggacccgucccuggggcacgacaagccccccagcacccgcagccacucgauuucuuucagccuccuccacagagcgagcagccccaacagccacaggcccgcccaguacuacuucggaugggugaggaguauuuucugcgccuagggaacuuaaacaagucaccugcagccccuuugucaccagcauccucacuuuuggcuggcggaucuggaaguagaccuaguccggagcaggccacugccaauuuuuuuaggguccuuuugcagcagcuccucuuaccucggcgaucauuggauuccccagcggcucuggcugaacguggcgcaagaaaugcacucggcggacaucaagaggcccccgaaagagaaaggagaagcgaagaaccacccaucucccuagaucucacauuucauuuguuacgugaagucuuagaaauggcaagagccgagcaacuggcucagcaagcucacucuaaccgaaaauuaauggagaucauugggaaauag

SEQ ID NO: 5185 - RNA, 4443 nt, Artificial Sequence
  Description of Artificial Sequence: Synthetic coding sequence
augcagcgguccccuuuagagaaggcuagcgugguuucuaaguuauuuuucucauggacaagaccuauucuccggaaaggguauagacagcgacucgaauugagugacauuuaccagauaccuucuguagacucagcugauaaucuuagugaaaaguuagaaagagaaugggaccgcgaguuagccucgaagaaaaauccuaaacugaucaaugccuugaggcggugcuucuucuggcgauuuauguucuacggcaucuuuuuguaccugggcgaaguaacaaaagccguccaaccgcuucugcucggucguaucauugcaagcuacgauccggacaauaaggaagaacggagcauugcuauuuacuugggaauaggccugugucugcuguucaucguacggacucuccuccuccauccagccauuuucggccugcaccauaucggcaugcaaaugaggauugccauguuuucucugaucuacaaaaaaacccuuaagcugagcucucgcguucuggacaaaaucuccauuggacaguuaguuagccugcuuuccaacaaucuaaauaaauucgacgagggccucgccuuggcccauuuuguguggauugcaccccuccaagucgcccugcugaugggacugaucugggaguuacuccaggcaagugcauuuugcggacuuggguuccugauugugcuggcauuguuccaagccggacuaggaaggaugaugaugaaguaucgagaucagcgagcuggcaaaaucucagaaaggcucgugauuaccagugaaaugaucgagaauauccagagcgugaaggcuuauugcugggaagaggccauggaaaagaugauugagaacuuacgacaaacugaguugaaacucacucggaaagcugccuaugucagguauuucaacucuagcgcuuucuucuuuucuggguuuuuuguugucuuuuugucuguccugccauaugcucuuauuaaggguaucauuuugcgaaaaaucuuuacgacaauuucuuuuugcauaguccucagaauggccgugacccgccaauuuccuugggcuguccagacuugguacgauucccucggcgcaauaaacaaaauacaggauuuucugcagaagcaggaguacaaaacucuagaguacaaucuuaccacuaccgagguuguuauggagaaugugaccgcuuuuugggaagaaggguucggcgaacuguucgaaaaggccaaacagaauaauaauaacagaaagaccucuaacggagacgauucacucuuuuuuuccaauuucucuuuguugggaacgcccguccugaaagauaucaacuucaaaauugaacguggucagcuccuggcuguggcuggaaguacaggagcugguaaaacaucccugcuuauggugauuaugggagagcuugaaccuucugagggcaaaauuaaacauuccgggcggaucaguuucugcucucaauuuucauggaucaugccugguacaaucaaggaaaacauuaucuuuggcguuagcuaugacgaguaucgauacagauccgugauuaaggccugccaacuggaggaagacauaucaaaauuugcugaaaaagacaauaucgugcuaggggaaggagggaucacacucagugguggucagcgcgcccgaaucucacuugcgcgggcagucuacaaagaugccgaucuguacuugcuugauagucccuucggguaccuggacguccuuacagaaaaagagaucuuugagucuugcguguguaaauugauggccaacaaaacuaggauacugguaaccucuaagauggagcaccugaaaaaagcugacaagaucuugauucuucacgaggggaguucguauuuuuauggcacauucucugaauugcaaaaucuucagccggacuuuucaucaaaacucauggguugugacucauucgaucaauucagcgccgaacguagaaauucuauuuugaccgaaaccuugcaucgguuuagccucgaaggagacgcgccuguguccuggacggagacaaagaaacagucguucaagcagaccggagaauuuggcgaaaaaaggaagaauucuaucuuaaacccaaucaauucuauucggaaauuuagcauagugcagaagacgccuuuacaaaugaaugguauugaggaggauuccgaugaaccauuagagcgaagauuaucucucgugccugauagcgaacagggcgaagcaauccucccccggauaagcgugaucucaacuggacccacgcugcaggccagacgccgacagagcguucucaacuuaaugacacauuccgugaaucaaggacagaauauacauagaaaaaccacagccucuacaagaaagguuucucuggcuccucaggccaacuugacagaauuagacauauacucaagaaggcugucucaggagacuggauuggaaauauccgaagaaauuaaugaggaggaucugaaggaguguuucuuugacgacauggagucgauucccgcuguuaccaccuggaauacguaccugagguacaucacuguacauaagucauuaauauucgugcuuauauggugccuagugauauuccuagcugaagucgccgccucucuuguuguccuauggcuacuuggcaacacuccauuacaagacaagggaaauuccacacauucacgaaacaacaguuacgccgucaucaucacaaguacaaguagcuauuacguguuuuauaucuaugucggagucgccgauacucuccucgccaugggauucuuccgcggguugccauugguccauacccuuaucacugucucaaagauucuccaccauaaaaugcuacauagugugcuucaagcgcccaugucaacccugaacacccugaaagcugggggcaucuuaaaucgauucuccaaggacaucgcuauucuggacgaccugcuuccucuuacgauuuuugauuucauccaacucuugcucauagucauaggcgcaauagccguaguagcuguguuacaaccauauauauucguagccaccguuccuguaauugucgcuuuuaucaugcugcgggcauacuuucuucagacaagccagcagcuaaaacaacuggagucagagggucgaucuccuauauuuacacaccugguuacaagccucaagggauuauggacacuucgggcauucggacgucagccauauuuugaaacccuuuuccacaaagcccugaaccuccacacagcuaauugguuucuguaucucucuaccuugcguugguuucagaugagaaucgaaaugaucuuuguuauauuuuuuaucgccguuacauuuaucaguauccugacaaccggugagggagaagggagaguugggauaauucuaacgcuugcgaugaacaucaugaguacucugcagugggccguaaauucaucuauugacgucgacucucuuaugcggagugucucaagagucuuuaaauucauugauaugccaacagaaggcaagccuacuaaaagcacaaagcccuauaagaauggacaacuuaguaaagucaugaucaucgaaaauagccacguuaagaaagaugauauuuggcccuccggcggacaaaugacggucaaggaucuuacggccaaauacaccgagggcgggaacgcgauccuugaaaauauuucauuuaguauuucaccagggcaaagggucgggcuuuuagggcgaacaggcagcggcaagucuacacuauuauccgccuuuuuaagacugcucaauaccgaaggugaaauucagauugacggcgugagcugggauucuauaacacuacagcaguggcgaaaagcguucggcgugauuccucaaaagguauuuaucuuuagcggaacauuucgcaagaaccuugauccauacgaacaauggagcgaucaggaaauuuggaaagucgccgacgaagugggucuacguagcgugauugagcaguuccccggaaagcuggacuuugucuuaguggaugggggauguguauuaucccacggacacaagcaacucaugugcuuggcaaggaguguucuuagcaaagccaaaauacugcuucucgacgaaccgagugcccaccuggaccccgucaccuaucagauuauucgcagaacauugaaacaagcuuucgccgacugcacugucauucucugugagcauagaauagaagcaaugcuggagugucagcaguuccuggucaucgaagaaaacaagguacggcaauaugauaguauccaaaaacuucucaaugagcguagucucuuccgucaggccaucucaccaucugauaggguuaagcucuucccccaccguaacuccucuaaauguaagucuaagccacagaucgcagccuuaaaagaagaaacagaggaagagguucaggauaccagacucuag

SEQ ID NO: 5186 - RNA, 4317 nt, Artificial Sequence
  Description of Artificial Sequence: Synthetic coding sequence
augcagcgcucaccacuugagaaagccagcguuguuuccaaauuauuuuuuuccuggaccagaccuauacugcgaaaaggguaccgacaaaggcuggaguuaucugauaucuaccagauucccucuguggacuccgcagacaaccuuucugaaaaacuugaacgcgagugggauagggaauuggcaucaaaaaaaaacccaaaacugauaaaugcacugcgaagaugcuucuucuggagguucauguucuacggcaucuuucuguacuugggcgaggugacaaaagccgugcagccccuguugcuuggacggaucaucgccagcuaugaucccgauaacaaagaggaacgcucuauagccauauaucugggcaucggccugugucugcucuuuaucgucaggacucugcuacuccacccagccauuuucggccuucaucauaucgggaugcagaugcgaauagcaauguucagccucauauacaaaaagggacucgcccucgcacauuucgucuggauugccccucugcaggucgcucuauugaugggccucauaugggaacuucuucaagcuagugccuuuugcgggcuagguuuucuuauugugcuggcacucuuucaggcaggcuugggcagaaugaugaugaaguacagagaccagcgagcgggcaagauuagugaacggcuggugauuacaagcgagaugaucgagaauauacaguccgugaaggcuuacuguugggaagaggcgauggagaaaaugaucgaaaaucugcgacagacugaacuaaagcugaccagaaaggcugccuacguccgcuacuuuaacucaagcgcuuucuucuuuagcggcuucuucgugguguuccuuuccguucuccccuaugcgcugaucaaaggcauuauccugcgcaaaaucuuuacaacuauaucguuuuguaucguuuugagaauggcuguuacccgacaguuuccaugggcagugcagacaugguaugauucacuaggcgccauuaauaaaauccaagacuuucuccagaagcaggaauauaaaaccuuagaauauaauuuaacaaccacagagguagucauggaaaaugugacagccuucugggaggagggauucggagagcuguucgagaaagcuaaacaaaacaauaauaaccgcaaaaccagcaacggcgacgauagccucuucuucaguaauuucagccuccucgggacucccguacugaaagacaucaacuucaagauugaacgcgggcaguugcuggccguggcggggagcacaggcgcgggaaagaccucuuuguugaugguuauuaugggcgaacuggaaccaagcgaagggaagaucaagcauuccggacgcauaagcuucugcucacaguuuaguuggauuaugccugggacuaucaaggagaacauuauuuucggcgugaguuacgacgaguacagauauagaagcgugaucaaagcuugucaacucgaagaagacaucagcaaguuugccgagaaagauaauauuguacuuggggagggcggcauuaccuuaagugggggacagcgggcgcgcaucucuuuggcaagagccguguacaaggacgcagaucucuaccugcucgacucgcccuuuggguaucuggaugugcucacggaaaaagagauuuuugagucaugugugugcaaacugauggcuaauaaaacgagaauucugguuacaagcaaaauggagcacuugaagaaagcggacaagauucuaauauuacacgaagguaguucauauuuuuauggcacauuuagcgagcugcagaaucugcaaccagacuucucauccaaacugauggguugcgacagcuucgaucaauuuagugcagaacggcgaaauaguauccuuacagagacacugcauagguucaguuuagagggagacgcuccugucucauggacggagacuaaaaagcagucuuuuaagcagacuggggaauuuggcgaaaaacggaagaacucaauuuugaauccuaucaauucuauuagaaaauuuucgauaguccaaaaaacuccacuucagaugaauggcaucgaggaggacagcgaugagccacuagaacggagacugagccucgugccugacuccgagcagggagaggcaauauuaccucggauuuccgugauuucuacuggccccacccugcaggcuaggagaagacaaagcgucuugaacuugaugacacacucuguaaaccagggucagaacauacaccggaagacuacagcuagcacacgaaagguuucacuggcuccacaggcaaaucucaccgagcucgacauauauuccagacggcugucucaagaaaccggacuggagaucagugaagaaauaaaugaagaagaccuaaaggaaugcuuuuuugacgauauggaaucaauacccgccgucacuacauggaacacauaccuaagguacauuaccgugcauaagagccucaucuuuguauugauuuggugccucguaauuuuucucgccgaaguugcagcaagucuuguuguccuguggcuccucgguaauaccccacuucaggauaagggaaacuccacacacucuaggaacaauucuuacgcagucauuaucaccuccacaucaaguuacuauguuuuuuacaucuaugugggcguugcagacacacugcucgccauggguuucuuccggggccucccacuggugcacacucuuauuaccguuuccaaaauucuucaucauaagaugcuccauagugugcuucaggcuccuaugucaacccugaacacccucaaggcuggagggauucucaauagauucuccaaggauaucgcaauauuagacgauuugcugccuuuaacaauauucgauuucauucaacugcuucucaucgugaucggagccauugccguagucgccgugcuucaacccuacauauucguugcuaccguuccggugauagucgcuuucauaaugcugagggccuauuuucuacagacaucucaacaacugaagcagcuggagucagagggaagauccccaauuuucacacauuuggugacaucccuaaaaggacuguggacucuccgugccuucggccggcagccauacuuugaaacacuguuccauaaagcccuuaaucuucacaccgccaacugguuucuauaucuuagcacacugcguugguuccagaugcgaauugaaaugaucuucguuauuuuuuucaucgccgugacauucauuaguauccugacaacuggggaaggcgaaggccgagucgggauuauuuugacacuugcuaugaacauuaugucaacacuucaaugggccgucaauuccucgaucgauguugacucuuugaugcgcuccgucagucgaguguucaaguucaucgacaugccaacagagggcaaaccaacgaaauccacuaaaccguacaaaaauggacaacugagcaaggucaugauuaucgagaacagccaugugaaaaaggaugauauuuggcccuccggagggcagaugacaguuaaagaccuuacagccaaguacacagaaggggggaacgcgauuuuggagaacaucucuuucucaauuaguccgggacagcgcgugggauugcuuggaaggacugggaguggcaagagcaccuugcugucagcauuucuucgguuauugaacacagagggggaaauccaaaucgacggagugaguugggacagcauuacgcuccagcaguggcgaaaggccuucggggugauaccccagaaaguuuucauuuuuagcgggacauuuaggaaaaaucuggauccguacgagcaauggagcgaucaggaaauuuggaaagucgcggaugaggucgggcuacgcucugugaucgagcaguuuccgggcaagcuggauuuuguguuaguagacggagguugcguguuaucgcacggacauaagcagcucaugugccuggcaagauccgugcucuccaaggccaagauucuccuucuggacgaaccuucagcucacuuagauccugucacauaucagauuauuagaagaacccuaaagcaggcauucgccgauugcaccgugauacuuugcgaacaccggauugaagcuauguuagagugccagcaguuccuggugaucgaagagaacaaggugcgucaauacgauuccauccaaaaguugcugaacgaaagaagucuuuuucggcaagcuaucagcccuagugacagagugaaauuauucccccaucguaacucaaguaagugcaaaagcaagccccagaucgccgcccucaaauag

SEQ ID NO: 5187 - RNA, 4260 nt, Artificial Sequence
  Description of Artificial Sequence: Synthetic coding sequence
augcagcgguccccuuuggagaaagccaguguugucagcaaacuguuuuucaguuggacacgaccuauacugcggaaaggcuaccggcagagacuggaacuuagugacaucuaucagauccccaguguagauucugccgauaauuuaagcgaaaaacuggaaagggaaugggauagagaauuggcgagcaaaaagaacccaaaacugaucaacgcauuaaggcgcuguuuuuuuuggagguucauguuuuauggaaucuucuuauaccucggcgaagucacgaaagccguccaaccccuucuuuuaggccgaauuauagccaguuaugaccccgacaauaaggaagagagauccauagccauuuacuugggaauugguuuaugucuguuauuuauaguccgcacucugcuccugcaccccgccaucuucggcuuacaccacauuggaaugcaaaugagaauugcuauguuuagccugauuuauaagaagacauugaagcuaucaucucgagugcuggacaaaauuucaauugggcagcuggugucauuguugucuaauaaccuuaacaaguuugacgaaggccucgcacucgcccauuucguuuggaucgcaccuuugcaaguagcucuucugauggguuugaucugggagcuguuacaggcuucagccuuuugcggucucggguuccugaucgugcuugcuuuauuccaagcagggcugggacggaugaugaugaaauauagggaccagcgugccggcaagauauccgagaggcucguuauuaccucugaaaugaucgaaaauauacagucuguaaaagcguauuguugggaggaagcaauggagaaaaugauugagaaucuuaggcaaacagaacugaaacugacucggaaagcagccuacguucgguacuuuaacucuuccgcuuuuuuuuucucaggcuucuucgugguguuccuaucggugcugcccuacgcccugauuaaaggcaucaucuuacggaaaauuuuuaccaccaucucuuucuguaucguucucagaauggcagugacccgucaguucccgugggcaguccagaccugguacgacucgcuuggcgcuauuaauaaaauacaggauuuccuccaaaaacaagaauacaagacucucgaguauaaccugacaacaaccgaagucguaauggaaaacgugaccgcauucugggaggagacuagccuccuuaugguuauuaugggagagcucgaaccauccgaaggcaagauuaagcauucuggacggauaaguuuuugcagccaguucuccuggaucaugccugggaccauaaaagagaauauaauuuucggagucuccuacgaugaauacagguaccgaagugugaucaaggcuugccaauuggaggaagauauuucaaaauuugcugaaaaagacaacauaguacuuggggaggguggaaucacacugaguggcggacagcgagcccgaaucagucuagcaagggccguuuacaaggacgcugaccucuaucuccuggauucucccuuuggcuauuuagaugugcuaacugagaaagaaauuuucgaauccugcguguguaagcugauggcgaauaagacccgaaucuuaguuacuucuaaaauggaacaccuuaagaaagccgacaaaauccugauuuugcacgaaggcagcagcuauuuuuacggcacuuucucugagcuucagaauuugcaaccugacuucucuucaaaacuaaugggaugugauucguuugaucaguucagcgcagaacggagaaauucaauacuaacggaaacccuccacagauuuagccucgaaggcgaugcgcccgucucauggaccgagacuaagaagcagaguuucaagcagacaggugaguucggugaaaaaagaaaaaauuccauacugaacccuauaaacucuauucgcaaguuuagcaucguacagaagaccccacuucaaaugaacggaauagaagaggacuccgaugagcccuuagaaagacgcuugagcuuggugccagauucugaacagggggaagccauucuaccaaggauaagcguaaucagcaccggccccacucuucaggcccgccgccgacaaucaguucuuaaucuuaugacucacaguguaaaucaaggccaaaacauccauagaaagaccaccgccuccacacgaaaggucagccucgccccacaagcaaaucucacugaauuggauaucuacucucgcagacugucacaggagaccggauuagagaucuccgaggagauaaaugaagaagaucugaaggagugcuucuuugacgauauggagucuauucccgccgucacaaccuggaacaccuaucuucgcuacauaacaguacacaagucuuugauauucgugcuaauuuggugcuuaguaauuuuccuggcagaggucgcagcuagucucgucguucucugguuacucgggaauacacccuugcaggacaaaggcaacucuacacacagcagaaacaacuccuaugcagucaucaucacaagcacuucauccuacuacgucuuuuacaucuacgucggcguggcugauacccuucuggcgaugggcuucuuccguggucugcccuuagugcacacccuaaucacugugucaaagauacugcaucacaaaaugcugcacucuguccuccaagccccaauguccacccuaaacacucugaaagcaggcggcauacucaaccgguuuaguaaagacaucgccauccucgaugaucugcuuccauuaacaauauuugauuuuauucagcugcuccuaauugucauuggugcgaucgcaguagucgccguacuacagccguauauauuuguugccacuguaccagucaucguugcuuucaucaugcuccgcgccuacuuuuuacagaccucacagcaacugaaacaguuggagagugaaggccggucaccuaucuucacgcaccuuguuacaaguuuaaaaggccuuuggacucuccgagccuuuggucgacagccauauuucgagacacuuuuccacaaggcccucaauuuacacacagccaacugguuucuuuaucugucaacacuccgcugguuccagaugaggauugagaugauuuucguuaucuucuuuauugccguuaccuucaucucuauacugaccacuggggagggagagggacgcgucggaaucauccuuacccuugccaugaacauaaugucaacuuugcagugggcugucaauucuagcauugaugucgauagccuuaugcggucuguaagucggguguuuaaguucaucgacaugccuacagagggcaagccuacuaaaucuacaaaaccuuacaaaaauggacaguugucuaaggugaugauuauagaaaacagucaugugaagaaggacgauauuuggccaagcgggggacaaaugacagugaaggacuuaaccgcaaaguauacugaagggggcaacgcaauucucgaaaauaucucguucaguaucucgccaggacagcgagucggacugcuaggacggacaggguccgguaaaucaacacuucugagcgcuuuuuugagacugcugaacacagagggcgagauccagauugacggagugaguugggacucuauaacauuacagcaguggagaaaagccuuuggagugauuccacaaaagguuuucaucuucuccgguacauuucgcaagaaccuagauccauacgaacaguggagugaucaggagaucuggaagguagccgacgaagugggccuuagaucagugauugagcaguuuccugggaaguuggacuuuguucugguggacgggggaugugugcuuucucacggccacaagcaauuaauguguuuagcacggucaguucugucuaaagccaaaauccuguuguuagaugagccuuccgcucauuuggauccaguuacguaucagaucauccgaagaacucuaaaacaggcuuucgcagacugcacaguuauauuaugugagcaucgcaucgaggccauguuggagugccagcaguuuuuagucaucgaagagaauaaggugcggcaguaugauaguauucagaaacuucuuaaugagcgcagccuguucagacaagcaauaagucccuccgaccgcgucaagcuguucccucaucgcaauucuaguaaauguaaguccaaaccucagaucgccgcacugaaagaagaaacugaagaagagguccaagauaccagauuauag

SEQ ID NO: 5188 - RNA, 573 nt, Artificial Sequence
  Description of Artificial Sequence: Synthetic coding sequence
ugaaaaggacuguggacucugagagccuucggacggcaaccuuauuuugagacucuguuccauaaagcccugaaucugcauacagcuaauugguucuuauaccuauccacccugcgcugguuucaaaugcgcaucgagaugaucuuuguaaucuucuucauagcugugacauucaucuccauacugaccaccggcgaaggcgaagggagaguggguaucauucugacacuagccaugaacauuaugucaacacugcagugggccgugaauucuucgauugaugucgauucccugaugcgcagugugucacgcguauucaaauucauagacaugcccacggagggcaaaccaacuaagucuaccaaacccuacaaaaauggucagcugucaaagguuaugauuauugagaacagccaugugaagaaagaugauauuuggccuagcgguggucagaugacaguuaaggaucuaaccgccaaguauacagagggcggaaaugcuauuuuagaaaauauuucauucucuauuucuccaggacaacgggugagauucgagcacugucugcuuuguuag

SEQ ID NO: 5189 - RNA, 1104 nt, Artificial Sequence
  Description of Artificial Sequence: Synthetic coding sequence
augauaagaaauuggcucacaaucuucauuuuguuuccucucaagcuaguugaaaaaugcgagagcucugugucucuuacggugccuccuguuguaaaguuggagaacggaucaucgaccaauguuagccuuacacucagaccuccacugaacgcuacgcuggugauuacauuugaaauuaccuuuagaucuaagaauauuacaauccucgagcuccccgacgagguugucgugccaccaggcgugacuaauucauccuuucagguuacgucccaaaaugucggucaguugacuguguacuugcaugguaaucauucuaaucaaacugggccuagaauaagauuucucgucauuagauccagcgccauaucuaucauuaaccagguaauaggcuggauuuauuuuguugcuuggagcauaaguuucuacccgcaaguaauuaugaacuggcgccgaaagucuguuauuggccucuccuuugauuucguagcacugaaccugacuggauucguggcauauaguguguuuaacauaggacuguugugggugccuuauaucaaggagcaguuucuccuaaaauaccccaauggcguuaaccccguuaauuccaacgaugucuuuuuuagccugcacgcaguaguccugacacucauuaucauaguucaauguugcuuauaugagaggggaggucaaagaguaagcuggcccgcaauuggauuucuaguccuggcuuggcuguuugcguucgugaccaugauuguugccgcuguuggugugacaaccuggcuucaguuuuuguucuguuuuagcuauauuaaacuggccguaacuuuagugaaguauuuuccacaggcuuacaugaauuucuacuacaagucaaccgagggauggagcauagguaacguauuauuggacuucacuggcggcucuuuuucuuugcuccaaauguuccuccagagcuacaacaacgaucaguggacgcucauuuucggcgacccaacaaaauucgggcuaggcguauucucaauugucuucgacguuguguucuucauucagcacuucugucucuacaggaaaaggccuggguaugaucaacuuaauuag

SEQ ID NO: 5190 - RNA, 204 nt, Artificial Sequence; identical to SEQ ID NO: 4860
  Description of Artificial Sequence: Synthetic coding sequence

SEQ ID NO: 5191 - RNA, 204 nt, Artificial Sequence; identical to SEQ ID NO: 4861
  Description of Artificial Sequence: Synthetic coding sequence

SEQ ID NO: 5192 - RNA, 195 nt, Artificial Sequence; identical to SEQ ID NO: 4862
  Description of Artificial Sequence: Synthetic coding sequence

SEQ ID NO: 5193 - RNA, 195 nt, Artificial Sequence; identical to SEQ ID NO: 4863
  Description of Artificial Sequence: Synthetic coding sequence

SEQ ID NO: 5194 - RNA, 849 nt, Artificial Sequence
  Description of Artificial Sequence: Synthetic coding sequence
augaggggaaugaaacugcugggggcacuccuugcucucgcagcucugcuccagggagcggucagucugaaaauugcugcuuuuaauauccagacuuuuggggaaacgaaaaugagcaacgccacccucguaucuuauaucguucagauccuuuccagauacgacauugcucugguccaagagguuagggauucgcauuuaacagcuguaggcaaacuccuggacaauuuaaaucaagacgcucccgauacauaucacuacgucgucucggaaccacucgggagaaacucuuauaaagaacgcuacuuauuuguguacaggcccgaucaagucucagccguggacucuuauuauuaugaugacggcugcgagccaugcggaaaugauaccuuuaacagagagccggccauugucagauuuuucucgcgauucacagaagugcgugaguuugcuaucgucccucuccaugcggccccaggugaugcaguggccgaaaucgacgcacuuuacgauguguauuuggacguucaggagaaguggggacucgaggacguuauguugaugggugacuucaacgcagggugcaguuacguaagaccaucucagugguccagcauacgccuuuggacaagucccacuuuccaaugguuaaucccagauuccgccgauacuacugccacaccuacgcacugcgcauacgaucguaucguuguagccggcaugcuguugcguggagccgucguccccgacucagcacucccguuuaacuuccaggcugcauacgguuuauccgaccaacucgcccaggcuauuuccgaccauuacccagucgaggugaugcucaaauag

SEQ ID NO: 5195 - RNA, 849 nt, Artificial Sequence
  Description of Artificial Sequence: Synthetic coding sequence
augcggggcaugaagcugcuaggagcccuauuggcucuugccgcccugcuucagggggcagucucacugaaaauagcugcuuuuaacauccagacuuuuggagaaacgaagaugucaaacgccacccuagugucuuauauuguucagaucuuauccagguaugauauagcacucgugcaggaggucagagauagucaccuaaccgccgugggcaaacuccucgauaaucucaaucaggaugcuccagacacuuaccacuacgucgucagugagccacuugguagaaacaguuauaaagagcgcuaccuuuuuguguaucggccagaucagguuucugcaguugacaguuacuauuacgacgacgggugcgaaccuugcggaaaugacacuuuuaacagggaacccgccauaguucgcuucuuuuccagauucacugaagugagagaguucgcuauaguuccccuccaugccgcuccuggggaugcuguugcagaaaucgaugccuuguaugauguguaucucgauguucaggaaaaauggggucuggaagacguuaugcucaugggagacuucaaugcuggauguaguuauguucgccccucucaauggaguuccauuagacuguggacaucaccaacuuuucaauggcugauucccgacucugccgacacaaccgccaccccaacucacugugccuacgaccgcauuguuguggccggaaugcuauuacggggggccgugguuccugacucagcguuaccauuuaacuuccaagccgcauacgggcucucugaccaacuugcucaagcaauuuccgaccacuauccuguggagguaaugcucaaguag

SEQ ID NO: 5196 - RNA, 564 nt, Artificial Sequence
  Description of Artificial Sequence: Synthetic coding sequence
augcaccagacaccuauuaccacuuggucugugagucauugggauggcaccgcaaucagaagcgcuacauguucuugcacuggcuugacuaggugcuugcguuggaccgcaacgaccacaaugauggccgcaucaccagcaggaaccacuccaucaacagagucccagccacucucuggcaguucacccggaagucaggauguuaugcugaugggagauuucaacgccgguugcucuuacguucgccccucgcagugguccaguauucgucuguggaccaguccuacuuuucaauggcugauuccagauucugcggauacaacagcuacaccaacucacugcgcauacgaucguauugugguugccggaaugcuccuccgcggcgcaguugugccagacuccgcucugccauuuaacuuccaggcugccuacggucugucggaucagcuguucuccguacacacauguuccggcgcuggucuuggagaaagacacggccugcccgcuuccgcagcccucccaucuaauaccugucgcgcuggcacgcauagaguguccaccuag

SEQ ID NO: 5197 - RNA, 6243 nt, Artificial Sequence
  Description of Artificial Sequence: Synthetic coding sequence
augcugcguguguuuauccuguaugccgaaaacgugcacacaccagacacggacaucucugacgcauacuguucagcaguuuucgcuggggugaagaagcgcaccaagguuaucaaaaacagcgugaauccaguguggaacgaaggauuugaaugggaucuaaagggaaucccccuagaccaaggaagugaacugcauguugucgucaaggaccaugagaccauggguagaaaucgguuccugggagaagccaaggucccucuccgcgaaguucucgcuacccccucucugagugcuagcuuuaacgccccccugcuagacaccaagaagcaaccaacuggcgcaucacuuguuuugcaggugagcuacacaccccuuccaggggcugucccacucuucccacccccgaccccucuagaacccucucccacccucccagaucuugaugucguggccgacacgggcggggaagaagauaccgaagaccaaggccuuacuggagaugaggcugaacccuucuuagaccaaagcggugggcccggagccccuacaacgccucgcaaacugccaagcagacccccaccucacuacccagguauuaagcgcaagcgauccgcaccaaccucccgcaaguugcuuuccgauaagccccaagauuuucagaucagagugcagguaaucgagggccgccagcuaccaggcguuaacaucaaacccgucguuaaggugaccgcagccgggcagacaaaacgcacacgaauccauaagggcaacucaccccuguuuaacgagacccuguucuuuaaccuuuuugacucuccuggagaacuuuuugacgagccaaucuucaucacuguaguggacagcaggucccugagaacugacgcucugcuaggggaauuucguauggauguuggaacaauuuauagagagcccagacacgcauaccuccgcaaguggcuguugcucagcgaccccgacgacuuuuccgcuggcgcaaggggguaccugaagacuagccuuuguguacuuggaccuggugacgaggcaccccucgagcguaaagauccuuccgaagacaaagaggacauagagucgaaucugcugagacccacaggaguugcucucaggggggcucacuucugucugaaaguguuuagagcugaagauuuaccgcagauggacgacgccgucauggacaacguuaaacagauuuuuggcuucgagucaaauaagaagaauuuggucgauccguucguggaggucucguuugccggaaagaugcuaugcucaaagauacuggaaaaaacagcuaacccucaguggaaucaaaauaucacuuuaccggcuauguucccuucaaugugugaaaaaaugcgaauacggauaaucgauugggauagacuuacccacaaugauaucgucgcuacaaccuauuuaucaauguccaagauaucugcgcccggaggggagaucgaggaggagccugccggcgccguuaaaccaaguaaagccagcgauuuggaugauuaccuuggguuucugccuaccuucgggccauguuauaucaacuuguaugguuccccuagagaauucacagguuucccugauccauauacugagcugaacacaggcaaaggcgaaggugucgcuuacagaggccggcugcugcucucccuggaaacuaaguuaguagagcauagugagcaaaaagucgaagacuugccagccgaugauauccugcgaguggagaaauaccuaagacggagaaaauauucccuguuugccgccuucuauagcgcuacgauguuacaggacguagacgacgcaauucaauucgaagugaguauuggcaacuauggaaauaaguuugauaugaccugccuaccacucgccucaacgacacaguacuccagggccguuuucgacggaugucauuauuauuaucuccccuggggaaacguuaaaccagucguugugcuuucuaguuauugggaagauaucucccacagaaucgaaacucaaaaucagcugcuggggaucgccgaucgccuugaagccggccucgaacagguccaucuggcacucaaagcccaguguagcaccgaggacguggauucgcugguggcccagcugacugaugaacugauagccgguugcagccaaccucugggcgacauucaugaaaccccaucugccacacacuuggaccaguauuuauaccaauuaaggacacaccaccucucccagauuaccgaagcugcccuggcccugaaauuaggccauagcgagcucccagcugccuuagaacaggccgaagacuggcucuugagacuccgggcccucgccgaggagccacagaacagccugccagacauugugauauggaugcuacaaggagauaagcggguggcuuaccaacgaguuccagcucaccaaguguuguuuaguaggcgaggcgccaauuacuguggaaagaacuguggaaagcuccaaacaaucuucuugaaauaucccauggagaaagugccuggugcuaggaugccgguucaaauaagggugaaacuuugguuuggguugucagucgacgaaaaggaauucaaccaauuugccgaagguaagcuuucaguguuugcagagaccuacgagaaugagaccaaacuugcucuaguuggaaauugggguacuacaggccugacauaccccaaauuuagcgaugugacaggaaaaaucaaacuaccuaaagacagcuuucgccccagcgcugguuggacaugggccggcgauugguuugugugcccagagaagacccugcuccaugauauggacgcagggcaccucagcuuugucgaagaaguguucgagaaucagaccagauuacccggaggacaauggaucuacaugucagauaacuauacggaugucaauggcgaaaagguuuuaccaaaagaugacauugagugcccacugggauggaagugggaggacgaggaauggucuacugaucucaauagagcuguggacgagcaagguugggaguacagcauuacaaucccccccgaacggaagccgaagcauuggguaccagcagagaagauguacuauacccaccggaggcggcggugggucaggcuuagacgcagggaucugagccagauggaagcacuaaaaaggcaccgucaagccgaggcagagggagaaggaugggaguaugcgagccuguucggcuggaaguuucaccuggaguauaggaaaacagaugcguucagacgacggagauggcggagacggauggaaccccuugaaaagaccggacccgcagcaguuuuugcucucgagggugcccugggaggcgucauggacgacaagagcgaggauagcaugagcguaagcacccugaguuucggaguuaaccggcccaccaucucuugcauuuuugacuacggcaauagguaccaccugagauguuauauguaccaggcucgagacuuagcagccauggauaaagauuccuucuccgacccauaugccaucgucuccuuucuccaccaaucgcagaagaccguggucgugaagaauacccucaacccaaccugggaucagacguugaucuuuuacgaaauugagauauucggggaaccagccacuguagcggaacaaccuccuucuaucguuguggaauuauacgaucaugacacuuauggcgccgaugaauuuaugggacgcuguauuugccagcccucuuuagaaagaaugccuagacuagcaugguuuccucuuaccagggguagccaacccuccggcgaacuucuggccucuuuugagcugauucagcgggagaagccggccauacaucacaucccaggcuuugaaguucaggagaccagcagaauucuggacgaaagugaagacacagaccuaccuuaccccccaccucaaagagaggccaauaucuacauggugccacaaaacauuaagccugcucugcagcggaccgcuauugagauacuagcguggggccuccguaauaugaagagcuaucaacuugcaaauaucuccucccccagcuuagucgucgaaugcggaggccaaacugugcaguccugcgugauccggaaccucaggaaaaacccuaacuucgauauuugcacauuguucauggaaguuaugcugccucgagaagaacuguauugucccccuauuacaguuaaagugaucgacaacagacaguucgguaggaggccagugguaggccaguguaccauacgcagccuugaaucauuccucugugacccuuacuccgccgagucucccagcccucagggcggccccgacgacgugagccugcuaaguccuggugaagauguauugaucgauaucgaugacaaagaaccacucaucccuauccaggaggaagaauucaucgauuggugguccaaauucuucgccucaaucggagagcgcgaaaaaugugggagcuaccuugaaaaagauuuugauacucucaaaguguaugauacacagcuagagaacguggaggcuuucgagggacuuucagauuuuuguaacacguucaagcuguaucgcggaaagacucaggaagagacugaagaccccagcgucauuggcgaguucaaagggcuguuuaaaauuuacccuuugcccgaggacccagcuauaccuaugcccccuagacaguuccaccaauuagccgcacagggcccgcaagagugccuaguaagaauauacaucgugagagccuucggacuacagccaaaagaccccaacggaaagugugaccccuacauuaagaucuccauaggaaagaaaucuguauccgaccaagacaacuauauucccugcacucuggagcccgucuucggcaaaauguucgaacucaccuguacccucccuuuggaaaaagaucugaagaucacucucuaugacuaugauuugcucucaaaggaugagaaaaucggagagacggugguugaucuugaaaaucgcuugcucucaaaguuuggagcacgcugcggacuaccccagacauacugcgucagcggcccaaaucaauggcgggaccaauugcgacccucacagcuccuucaccuguuuugccagcaacacagagucaaggcuccaguguaucguaccgacaggguuauguuucaggauaaggaauauucaauugaagaaauugaagcuggccgcauuccaaacccccaucucgguccggucgaagaacgauuagcacuccauguccuccaacaacaaggccuggugcccgaacauguagaaucucgaccccucuacaguccacuucaaccugauauagaacagggcaaacuucagauguggguugaccuguuuccgaaggcccucggccggccuggaccuccuuuuaacauaaccccaagacgagcccgccgguucuuucuacguuguaucauuuggaacacaagggacgugauauuggacgaccuguccuuaacuggagagaagaugagugauauuuacgugaaaggauggaugaucggauucgaggaacauaaacagaaaacugacgugcauuaucgcaguuuagggggugaaggcaacuuuaacuggcgcuuuauauuuccuuuugacuaucugcccgcugagcaaguauguacaauagccaaaaaggaugccuucuggaggcuggacaaaaccgaaucuaaaauucccgcgcgggugguguuucaaauaugggauaaugacaaauucucauucgaugauuuucuaggaucuuugcagcucgaucugaaccgaaugccuaaaccugcgaaaacggcaaaaaaauguaguuuggaccagcuugaugacgccuuucacccagagugguuuguuagucuguucgagcagaagacugugaaagggugguggccuuguguugccgaagaaggugagaaaaagauccucgcuggcaaacuggaaaugacauuagaaaucguggccgaguccgaacacgaagagagaccagcuggucagggcagagaugagccaaacaugaacccaaaacuugaagauccaagaagaccggauacgucguuucucugguuuaccagccccuacaagaccaugaaguuuauuuuguggcgucgcuuuagaugggccauaauucuuuucaucauucuuuucauccuguuacuuuuccuugcaaucuuuaucuacgcauuccccaauuacgcagccaugaagcucgugaaaccauucuccuag

SEQ ID NO: 5198 - RNA, 6246 nt, Artificial Sequence
  Description of Artificial Sequence: Synthetic coding sequence
augcugugcugcuuauuagugagagcuucuaacuugccaagcgcaaagaaagaccgccgaucagaccccguugcuagccugacuuucaggggagucaagaaaaggacaaaagugauuaaaaacuccgucaaccccguguggaaugaaggauuugaaugggaucucaaaggcaucccucuugaucaaggcucugaacugcacguaguggugaaagaccaugaaaccaugggacgcaaccguuucuuaggagaggcuaaggugccccuucgcgaggugcuggcaacaccuucccugagugccagcuuuaacgccccccuuuuagauacuaaaaagcaacccaccggugcuagccugguccuacagguaucuuacacuccccucccuggagcuguaccccuuuuccccccccccaccccgcuugaaccuucacccacccuccccgaccuugauguugucgcagauaccgggggugaagaggauacagaagaccaagggcuuacuggcgacgaggccgagccauuccuggaucaaucuggaggacccggcgcuccuaccacuccuaggaaacugccgucccgcccccccccccacuaucccgggaucaaaaggaagcgauccgcacccacuucaagaaaacuacucucugauaaaccucaagacuuccaaauccggguucaagugaucgagggacgccagcucccaggcgucaauauuaaaccaguuguuaaagucacugccgcgggucaaaccaagcguacacgcauucauaaggggaauuccccuuuguuuaaugaaacacucuuuuuuaaccuuuucgacuccccaggcgaacucuucgacgagcccauuuucauuacaguuguagauagucguucccugcgaacggaugcacugcuaggugaguuccguauggaugucgggacaaucuaccgugagccccggcaugcuuaccuucguaaauggcuucuccuuagcgacccagacgauuucagugcgggagcaagaggguauuugaagacaagccugugugugcucggaccuggcgacgaagcuccccuugaaagaaaagacccuagcgaggacaaagaggauauagagucgaaucuucugagaccuaccggcguggcgcuucgcggugcacauuuuugccuuaagguauuccgcgcagaagaucuuccucagauggaugacgcagugauggauaaugugaaacagauauuuggcuuugagucuaacaaaaagaaccucgucgaccccuuuguggaggugucguucgccggaaaaaugcuaugcuccaagauccucgagaagacugccaacccacaauggaaccagaacaucacacucccagcaauguucccaucuaugugcgaaaaaaugagaaucagaaucaucgauugggaucgucucacucauaacgacaucgucgcaaccacguaccuuuccaugucaaaaaucuccgcgccuggaggagagauugaagaggagcccgccggcgcagugaagccuagcaaagcauccgaccuugacgacuaccugggauuccugcccacauuuggccccugcuacauuaaccuuuacggaagcccgagggaguucaccggcuuuccagauccauauacagagcugaauacuggcaaaggugaaggcguagccuaucgcgggagacuguuacugaguuuggagacaaaacuuguggaacauagugaacagaagguggaggaucugccugcugaugacaucuuacgggucgagaaguacuuacgacggagaaaauauaguuuguucgcugccuuuuauucagcuacaaugcugcaagauguggaugaugccauccaguuugaagucuccauuggaaacuacggaaacaaauucgacaugacuugccuuccucuggcuuccacaacacaguauucaagggcuguguuugacggaugucauuauuacuacuuaccuuggggcaacguuaaacccgugguagugcugucuucuuacugggaggauaucucacaccggauugaaacacagaaccagcugcugggaauagccgaccgccucgaagcaggacuugaacaagugcaccuagcccugaaagcacagugcaguaccgaagacguugacucucucguugcacagcuaacagaugaacugaucgcagguugcucccagccucucggcgauauccacgagacgccuuccgccacgcaucuggaccaauauuuauaucagcugaggacccaccaccugucgcaaauuaccgaagcugcccuagcucugaaauugggacauucugaauugcccgccgcccuggaacaggcugaagacuggcuucugcgccuccgagcucuugcugaagaaccccaaaacucucuuccggacauuguuauuuggaugcugcagggcgauaagagaguagcuuaccagcgggugccagcacaccaggugcucuuuuccagacggggugccaacuauugcggaaagaacuguggaaaauugcagaccaucuuucuaaaauacccuauggaaaaggucccaggagcucguaugccagugcaaauaaggguaaaacuuugguucggguugaguguggaugagaaggaguucaaucaauuugcugagggcaaacugucuguauucgccgaaacuuacgaaaacgagaccaaauuagcuuugguagggaacuggggaaccacuggccugaccuacccuaaguuuucagaugugaccggcaaaaucaaguuaccaaaagauaguuuucgcccgucggcuggauggaccugggcaggagauugguuugugugcccggaaaaaacccugcuacacgauauggacgcaggacaccuuucuuuuguugaggagguuuuugaaaaccagacacgacugccaggaggacaguggaucuacaugucugacaacuacaccgacgucaacggcgagaagguauugccuaaagaugauauagaguguccccuaggguggaagugggaggacgaggaguggucgacugaucuaaacagagcaguugacgagcagggaugggaguauucuauaacuauuccaccagagagaaagccaaagcauuggguucccgcugagaagauguacuacacacacagacgcaggcggugggucagacugcgacggagggacuugagccagauggaggcccuuaagcggcauagacaagcugaagccgaaggagaggggugggaauacgcuaguuuguuuggguggaaauuucaccuggaguaccgcaagacggacgcauucagacgucggcgauggaggaggcggauggaaccucuugagaagacagguccagccgcaguauuugcccucgagggagcucucgggggagugauggaugauaagagugaggauuccaugucaguuucgaccuugucguucggcguaaauagacccacaaucuccuguaucuucgacuacgggaacagauaccacuugcguuguuacauguaccaagcccgugaccucgccgcgauggauaaagacucuuucucugaccccuacgccaucgucagcuuccuucaucagucccagaaaacagucguugugaaaaauacccugaacccgacuugggaccaaacgcuaauuuucuacgagauugagaucuucggggagcccgcuacaguugccgagcagccaccaagcaucgugguggagcucuaugaccacgauaccuacggcgcugacgaauuuaugggucguugcauuugccaacccucucucgagcguaugccucggcuugcuugguuuccccuaacacgggguucacagccuuccggagagcuacuggccagcuuugaacuuauucaacgugagaaacccgcuauucaccacaucccaggcuuugaagugcaggagacuagccgaauccuugaugagagcgaggacacagaucugcccuaucccccaccacagcgagaagccaacauuuauauggucccucagaacauaaagcccgcccuucaacggacggcaauugaaauucucgcauggggcuugaggaacaugaagucauaucagcuggccaauauuaguagccccucacuggucguagaguguggcgggcaaacuguccagagcugugugauaagaaaccugcgaaaaaaccccaauuuugauauuuguacucuguucauggaagugaugcugccaagagaagagcuuuauugcccaccuaucacagugaaaguaaucgacaauagacaguucggacggagacccgugguaggccagugcacaauccguagucucgaguccuuucucugugauccauacucggcagaaagcccaagcccgcagggcggcccagacgaugugucacuauuaucuccaggcgaggacgugcuuauugacaucgacgacaaagaaccccuuaucccaauccaggaagaagaguuuauugauugguggucaaaguucuucgcaagcauuggugaaagagaaaaaugugggaguuaucuggagaaagacuucgauacuuuaaagguguaugauacccagcuggagaaugucgaagcauucgaggguuuaucagauuuuuguaacacauuuaagcucuacagaggcaaaacacaggaagagacagaagauccuagcgugauuggugaguucaaaggccuauuuaagauuuauccauugcccgaagauccggccaucccuaugccuccccggcaauuccaucagcucgcugcucagggcccucaggaaugccugguucggauauauaucguucgcgcauuuggccugcagccaaaggauccuaacggcaagugcgauccguauauuaagauuucuaucgggaaaaaaagugucagugaucaggauaacuacauuccauguacucuggagcccgucuucggcaagauguucgaacuuacaugcacucugccccuggaaaaggaucugaaaauuaccuuguacgacuacgaucuacugagcaaagacgaaaagaucggcgagaccguuguggauuuggaaaaccguuugcuuucaaaguucggggcccgaugcggccugccacaaacguauugcguguccggaccuaaccaauggagagaucaguuaaggccuucccaacugcuacaucuuuucugccagcagcaucgcgucaaggcaccaguguauagaacugaucggguaauguuucaggacaaagaauauucuaucgaggagaucgaggccgggcgcauucccaauccucaucuggggccuguagaagagcggcuggcacugcacguauuacaacagcaagggcuugugccagaacacguagaauccagaccccucuacucaccucuacaacccgauauagaacaggggaaguuacagauguggguggaucuauucccuaaggcucugggccguccaggaccucccuucaacauuacccccagacgcgcccgucgauuuuuccugagaugcauuaucuggaacacuagggacguaauccucgacgaccugagucucaccggugaaaaaauguccgauauuuacgugaaaggauggaugauaggcuuugaagagcacaagcagaagacagaugugcacuacagaagucucggcggcgaaggaaacuucaacuggcgcuuuauuuucccuuuugauuaccuuccagcagaacaggugugcacaauugcgaaaaaagacgccuuuuggcgauuggacaaaacugagucaaagauaccggcccgggucguuuuccagaucugggacaaugauaaguuuagcuucgacgacuuuuugggcucccuccaguuggacuugaauagaaugccaaaacccgcgaagacugccaagaaguguucccucgaccaauuggacgacgcguuucauccagagugguucgucagcuuauuugaacagaagacagucaaagguugguggccgugcgucgcagaggaaggugaaaagaaaauccuugcuggcaaauuagaaaugacucucgagauuguugccgaguccgagcaugaggaacggccggccggucaaggacgcgacgaacccaauaugaacccuaagcuagaggacccuaggagacccgauaccaguuuucuuugguuuaccucacccuauaagacaaugaaauuuauacuguggcggagauuucgaugggcuaucauccuuuuuaucauccuguucauacugcuucuguuucuggccaucuuuaucuacgcuuuccccaauuaugcagcaaugaagcuugugaaacccuucucuuag

SEQ ID NO: 5199 - RNA, 6309 nt, Artificial Sequence
  Description of Artificial Sequence: Synthetic coding sequence
augcuuuguugccuccuggugagagccucgaaucugccuagcgccaagaaagaucguagaagugacccaguggccucccugacuuuucggggcgugaaaaagcgaaccaaaguuaucaagaacagcgucaacccaguguggaacgaaggcuuugagugggaccucaagggcaucccccuggaucagggcucugagcuacaugugguuguuaaagaccaugagacgaugggcagaaacagguuucuaggagaagccaaggucccucuccgcgaagucuuagcuacuccuucccugagugccucuuuuaacgccccccugcuagauacaaaaaaacaaccuacaggcgcaucacucgucuugcaggugaguuacacaccacuaccaggcgcuguuccccucuucccaccacccacaccucucgagcccuccccaacucugccugaccuagauguugucgcggacaccggaggggaagaggauaccgaagaucaagguuugacaggagacgaagcugagccuuuccuugaccaaagcggcggaccuggggcaccuacaacacccagaaagcugccuucccggccucccccucauuauccaggcaucaaacgaaagcguagcgcacccaccucacgcaaacuuuuaucugacaagccccaggauuuccagauacgggugcaagugauugagggaagacagcucccagggguaaauaucaaaccaguaguuaaagugacagcugcaggccagaccaagcgcaccagaauccacaagggcaacagcccccuguucaaugaaacauuguuuuucaaccucuucgauaguccuggcgaacuuuucgaugaaccaaucuuuauuacagugguggauagcaggaguuugaggacugacgcguugcuuggugaguuccgaauggauguggggacuauuuacagggaaccccggcaugcauaucugaggaaauggcuguuacuaucugauccugaugauuucuccgcuggagcccgcggauaucugaaaacaucucuuugcguacucggaccaggugacgaagcuccccucgaacggaaggaucccagcgaggacaaagaagacaucgaguccaaccuuuuacgcccuacuggaguggcacuucgcggcgcacauuucugucugaagguguuucgagcagaagacuuaccacaaauggacgaugccgucauggacaaugugaaacaaauuuuugguuuugagagcaacaaaaagaaccuaguugaucccuucguugagguuucuuucgccggcaagaugcuuuguuccaaaauucuggagaagacagcaaauccucaguggaaucagaauaucacccuuccugcuauguucccguccaugugugaaaaaaugagaauucggaucauugacugggaccgacugacccacaaugauauugucgccaccaccuaucuguccaugaguaaaauaucugcgccaggaggagaaauugaggaagagccugcuggugccgugaaaccgaguaaggccuccgaccuugaugacuaccuuggguuccuucccacauucggacccuguuacauaaaccucuaugguucuccucgcgaauucacuggauucccggacccuuacaccgaacuuaauacaggcaagggggagggcguagcauaucggggucgccugcugcugucucucgaaacuaagcucguggaacacucugaacaaaaagucgaagaccuccccgcugacgacauccugagaguagagaaauaucuucgcagacgcaaauacagcuuauucgcagccuucuacucagcgacaaugcugcaggacguggaugacgcgauucaguucgaaguguccaucgggaauuaugguaacaaauuugauaugacaugccucccauuggcauccaccacccaauauucaagagcagucuuugacggcugucacuacuacuaccugccguggggcaacguuaaacccguaguggugcuauccagcuacugggaggacauuucucauaggaucgaaacacagaaccagcuauuggggaucgccgacagacuagaggccggacuagaacaggugcaccucgcccuuaaagcccagugcucgacagaagacguggauucucuaguggcucagcugaccgaugaacucauugcuggguguucccaaccucucggcgacauucacgagaccccgucugccacacaccucgaccaguaucucuaucaacuacgaacccaccaucucucacaaaucaccgaagcugcguuagcacugaaacugggucauucagaacuaccugcugccuuggagcaagccgaggauugguuauugagacucagggcccuggcagaagagccccagaacucccugcccgauaucguuauuuggauguuacaaggugauaaaaggguagcuuaucaaagagucccugcacaccaaguucucuuuaguagaaggggagcaaacuauugcggaaaaaauuguggcaagcugcagaccauuuucuugaaauaucccauggagaaaguaccuggagcccggaugcccguucagaucagaguuaagcugugguucggucuuuccguggacgaaaaagaguuuaaccaguucgccgagggcaaguuaagcguguuugcugagacuuacgaaaacgagaccaagcuggccuugguuggaaacuggggcacaacuggacuaacuuaccccaaauucagcgauguaaccgggaaaauuaaacugccuaaagauucuuucaggcccagcgcugguuggacaugggcgggggauugguucgucugcccagaaaagaccuugcuacacgacauggaugccggccaccuaagcuuugucgaggagguguuugaaaaccagaccagauuacccggaggacaguggauuuacaugagcgacaacuauacagaugugaacggagaaaagguguugccgaaagaugauauugaguguccgcuuggguggaagugggaagaugaagaguggucuaccgaucuuaacagggcuguggacgaacaaggaugggaguauuccauaacgauuccaccagagcgcaaacccaaacauuggguccccgcugaaaaaauguauuacacacaccgcagaagacgcuggguaaggcugagacgcagagaccuaagucagauggaggcacuuaagagacauaggcaggccgaggcugaaggcgaaggaugggaguacgcaucucuguuuggauggaaguuucaccuagaauaccggaagacugaugcauucagacguaggcgguggcgucggaggauggagccuuuagagaaaacuggccccgccgcagucuuugcccuugaaggagcccuagggggugucauggacgauaaaagcgaggauucgauguccguaucuacacuguccuucggaguuaacagaccaaccauaaguugcaucuucgauuaugggaauagauaccaucuuagauguuauauguaucaggcacgcgaucucgcagccauggacaaggacucauucagcgaccccuacgcaaucgugagcuuuuugcaucagucucagaagaccgucguggucaaaaacacacuaaauccuacuugggaucaaacacugauuuuuuacgagauugagauuuucggcgagccugcuacaguggccgagcaaccccccucaauaguaguugaacuuuaugaccacgauacauauggugcugacgaguucauggggaggugcaucugccaaccaucccuggagcgaaugccccgacuugccugguuuccucugacacgaggcucucagcccuccggagaguugcuagcuagcuuugaacugauacagagagagaaacccgccauucaccauaucccugguuucgaaguccaagaaacgucucgcauacucgacgagagcgaagacacagaccucccauacccgccuccccagagagaggccaacaucuauauggugccccaaaacauaaaaccggcccuccaacgcacugcaauugaaauacuggcauggggucugcgaaauaugaaaucguaccaguuggccaacaucuccucuccuagucuggucguugaaugcgggggccaaacgguccagagcugcgucaucagaaaccuccguaaaaacccuaauuuugacaucugcacacuuuucauggaggugaugcugccuagagaagaacuguacugcccuccuauuacaguaaagguaaucgacaaccgacaguuuggacgacgcccaguggucggacagugcacaauucgcucccuagaaagcuucuuaugugacccuuacagcgccgagucaccgucaccacagggcggcccugaugacgugucccucuuaucacccggcgaggauguacuaauugacauagaugacaaggagccacuuaucccaauccaguuagccgacggguugucgaguuuagcacccacuaauacagcuucaccucccaguucaccccacgaagaagaguuuaucgauugguggaguaaguuuuuugccucgaucggagaaagagaaaaaugcggcucuuaccuggagaaggauuucgauacccugaagguauacgacacccagcuugagaacguggaggccuucgaagggcugucugauuucugcaauacauuuaaacuuuaccgugggaagacgcaagaagagaccgaggauccuucuguuaucggcgaauucaaaggacuguuuaaaaucuauccacugccagaggacccugcuaucccgaugccaccucgucaguuccaccaguuagcugcucaaggcccucaagaaugcuuggugcggaucuacaucgugcgagcuuucggccuucagccaaaagacccuaauggcaaaugcgauccauacauuaaaaucagcaucgguaaaaagucaguuucagaucaggauaauuacauaccaugcacacuggagccggucuuugggaaaauguucgaacucaccuguacacuuccacuggagaaggaucugaaaauuacacucuacgacuacgaucuucugucaaaagaugagaaaauuggcgaaacugucgucgaucuugagaauagacugcugucgaaguuuggcgcaaggugcggauugccacagacuuauugcguuuccggacccaaccaguggcgggaucagcugagaccgagccagcuucuucaccuauuuugccagcagcaucgagugaaggccccaguuuauagaaccgaucgcguuauguuccaggauaaggaauacucuaucgaggaaaucgaagccggccggaucccaaacccucaucuggggccuguagaagagagacucgcucugcauguccuacagcagcagggacucguuccagaacacguagaaagccguccccucuacaguccacuucagccggauaucgagcagggcaagcuucagauguggguggauuuauuccccaaagccuuggggcggcccggacccccuuucaacauuaccccuagacgggccagaagguucuuucucagauguauuauuuggaacaccagagaugugauacucgaugaccucucuuuaacuggugaaaaaaugagcgacauauauguuaagggauggaugauuggauucgaggaacauaaacaaaagacagacguucacuacaggucucucggcggcgagggcaacuuuaauuggagauuuauauuucccuucgacuaccuuccagcugagcagguuuguaccauugcuaagaaagaugccuuuuggagacucgauaaaacugaaagcaagauuccugcccgcguagucuuucaaauaugggauaaugauaaguucucuuuugacgacuucuuaggaucucuccaguuggaucucaacagaaugccgaaaccagccaaaacagccaagaaauguucucucgaucaacuggaugacgcuuuucacccagaaugguucgugagucuguucgagcagaagaccguaaaagguugguggccauguguggccgaggagggggaaaagaagauacucgccggcaaauuagaaaugacauuggaaaucguugcugagagcgagcaugaggaacgcccugccggccagggccgcgaugagccuaauaugaaccccaaauuggaggauccuagaagacccgacaccagcuuucugugguucaccaguccuuacaaaacuaugaaguuuauuuuguggagacgauuucguugggccauuauccuauuuaucauucuuuucauccucuuacuguuucuggccauauucaucuacgcuuucccgaauuaugcagcuaugaaacucgugaaaccuuucuccuag

SEQ ID NO: 5200 - RNA, 6357 nt, Artificial Sequence
  Description of Artificial Sequence: Synthetic coding sequence
augcugagagucuucauccucuaugcugaaaaugugcauacccccgauacagacauuuccgacgcuuauuguagugccguguuugccgguguuaagaagagaacaaaggugaucaagaauucuguuaacccggucuggaacgaaggauuugaaugggaucugaagggcaucccccuugaucaaggcucagaacuucacgugguugugaaggaccacgaaaccauggggaggaauagguuccugggagaagcuaaaguaccacuucgugaaguccucgccaccccaucacugucugccucauucaacgccccacuucuggauacaaagaaacaaccuaccggggcaucacucgugcuacaggugagcuacacuccacugcccggugcugucccacucuuuccaccaccaaccccccucgagcccuccccuacccugccggaccuggauguugucgccggaggcggccagucuagagccgaaaccuggucccugcucucagacucuaccauggauaccagguacagcggaaagaaguggccugcuccaacugauacaggaggcgaggaagauacugaagaccaaggacugaccggagacgaagccgaaccuuuccuggaccagucaggcggacccggcgcacccacaacaccuagaaaacugcccucccgaccuccuccccauuaucccggcaucaagcguaagagaagcgcuccgacaucucgcaaguuacuaucagauaagccucaagacuuccagauccgcguucaagucaucgaggggcggcaauugccuggcgugaacaucaagccuguuguuaaagucaccgccgccggccagaccaaaagaacacgaauacauaagggaaacucgccgcuauucaaugaaacucuuuuuuuuaaccucuucgauucccccggugagcuauucgacgagccuauuuucauaacagugguggacagccgcucuuugaggacugacgcccuuuuaggcgaauuucgcauggacgucggaaccaucuaucgcgagccgcgccacgcauauuugagaaaauggcugcugcucucagacccugaugacuucucagccggggcacgcggguaucucaagacaucacucugcguguuaggaccuggagaugaagccccccuagagagaaaggauccgucagaagacaaagaagauauagaaagcaaccuacugcgacccacaggcguugcacuccgcggggcucauuucugccugaaaguguucagagccgaggacuugccucagauggaugacgcagugauggacaacgugaaacagauuuucggauucgagucgaacaaaaaaaaccucguugacccauucguagaaguaucauucgcugguaaaauguuguguucgaagaucuuagagaagacagcuaauccucaauggaaucagaauauaacccuaccugcuauguuuccaucaaugugcgagaaaaugagaauacgaaucauugacugggacagauugacacacaaugacauuguagcuaccacguacuuaucuaugagcaagaucuccgcuccuggcggcgaaaucgaaguugaugauuaccuuggguuucugcccacauucggcccauguuacauaaauuuguacggcucuccaagggaguuuacaggauuuccagacccuuacaccgagcugaacacgggaaaaggugaaggcguugccuaucggggaagacuacucuugaguuuggagacaaaacugguggaacacucugaacaaaaggucgaagaucucccggccgacgacauacugagaguggaaaaguaucuuaggcgccgaaaauacagcuuguuugccgcuuuuuacagugccaccaugcuucaagauguggaugacgcuauacaguucgaaguauccaucgguaacuacggaaacaaguuugacaugacaugcuugccacucgcuagcacuacccaguacucuagagccgucuuugauggaugccacuacuauuauuuaccuuggggcaauguuaaaccagugguuguguuaucaucguauugggaggauaucagucaccgaaucgaaacccagaaucagcuauuaggaaucgccgaccgacucgaagcggggcuggagcaagugcaucuggcacuaaaggcccagugcagcacggaagauguggacagucuaguggcccagcuuacugaugagcucaucgcaggcuguucucaaccacuuggcgacauucacgagacuccuucagcgacccaccuagaccaauacuuauaccaacugaggacucaccacuuaucccagaucacugaggcagcauuagcgcuuaaacuagggcacagcgaacucccugcagcucuugaacaggcugaagacuggcugcuuagguuacgggcucucgccgaagaaccccaaaauagccugccugauauuguaaucuggaugcugcagggggacaagagaguggcauaucagcgagugccagcccaucagguccuguuuucacgacgcggcgcuaauuauuguggcaaaaacugugguaagcuacagaccaucuuccuaaaauaucccauggaaaaagucccuggugccaggaugccugugcagauccguguaaaacugugguuuggacugucaguugacgaaaaggaauuuaaucaguucgcagaaggcaaacuauccguguucgccgaaaccuaugaaaaugaaacaaaauuggccuugguuggaaauuggggcacgacaggacugacauacccaaaauucagugacguaacuggcaaaauuaagcuuccaaaagauucauuccgaccaucagcggguuggacuugggccggcgauugguucguguguccugaaaaaacgcugcuccacgauauggacgccgggcaucucucauuuguugaagagguuuucgaaaaucagacccgucuuccaggggggcaauggaucuauaugagugauaacuauaccgaugugaacggugagaaggugcugccuaaagaugauauagagugcccucuuggauggaaaugggaagaugaggaauggucaaccgaccugaaccgggccgucgacgaacagggcugggaguauagcaucacgauucccccagaaagaaaaccaaaacauugggucccagcagagaagauguacuacacucacaggagacgucgcugggugagacuuaggagaagagaccugucacagauggaagcccugaagagacaccgacaggcugaagccgagggcgaggguugggaauacgcaagccuguuuggcuggaaguuucaucuggaauacaggaagacagacgccuucagacgucgaagauggcgaaggaggauggaaccccuggaaaaaaccggcccagccgccguguuugcccuggaaggugcuuuaggaggcguuauggaugauaaaagcgaagauucuauguccguuaguacccucuccuuuggaguuaaccguccaacgauuucauguaucuuugauuacggcaaccgcuaccacuuacgguguuauauguaccaggcaagggaucuggcugccauggauaaggacucauucucugaccccuaugcaauagugucauuccugcaucaaagccaaaagacuguggucguuaagaauacccuuaauccuacuugggaucaaacacugaucuuuuaugaaauagaaaucuuuggugagcccgcaacagucgcggaacaacccccaagcauuguggucgaauuauacgaucacgacacauacggcgcagacgaauucaugggaagauguauuugccagcccucucucgaacgcaugccaagacuggccugguucccccuuaccaggggcagucaaccuuccggggagcuucuggcuuccuuugagcucauccagcgagaaaagccugcaauucaccauaucccaggauuugaggugcaagagaccagccgcauucuggaugaauccgaggacaccgaccucccuuacccccccccucagagagaagcgaacauuuauaugguaccacagaacaucaaaccugcccugcaacgaacagcuauugaaauccuggccuggggacugaggaauaugaaguccuaccaacucgcaaacauuagcucaccgucauuaguuguugaaugcgggggccaaacaguccagucuugugugauaagaaaccugcgaaagaacccuaacuucgacauuuguacucucuucauggaagucauguuaccaagagaggagcuauacugcccuccaaucaccgugaaagugaucgauaaucggcaguucggcagaagaccugucgucggucagugcacaauucgcagucuugagaguuuuuuaugcgaccccuacuccgccgagucucccucaccccaagggggcccugaugacgugagccugcuuuccccaggcgaggacguucuuaucgacauugaugacaaggaaccauuaaucccuauacaacuggccgacggccugagcucccuugcgcccacaaacacggccagccccccuagcucaccccaugaagaggaauuuauugauugguggucuaaauucuuugccucuaucggugaaagagagaagugcgggucuuaccuggaaaaagacuuugacacauugaaaguguaugacacgcagcuggagaauguggaagcuuuugaagguuuaagugacuucuguaauaccuuuaagcuguacagagguaagacccaagaagagacagaggacccuagcgucaucggcgaguuuaaaggacucuuuaagaucuacccacugcccgaggauccugccauuccuaugcccccucggcaguuccaucaguuagcagcacagggcccccaggagugcuuaguccgaaucuacaucguccgagcauuuggcuugcagccaaaggauccuaaugggaaaugcgaccccuacauuaaaauaaguauuggaaaaaaaucaguuagcgaucaggauaacuacauuccuugcacccuggagcccgucuuuggcaaaauguuugaacuaacuuguacauuaccgcucgagaaagaucugaaaaucacccuguacgacuacgaccuacuuagcaaagaugaaaaaauuggggagaccgucgucgaucuugaaaaccgcuugcugaguaaguuuggcgcucgcugcggccucccacaaaccuacuguguguccggcccuaaccaauggcgggaucaguugcgucccucccaacugcugcaccuuuuuugccagcagcauagaguuaaagcccccguguaccguaccgacagagugauguuucaagauaaagaguauucuaucgaagagauugaggcagguagaauuccgaauccgcaccucggcccagucgaagagcgauuagcccugcacguguuacagcaacaaggccugguacccgaacacgucgaauccagaccuuuguacaguccccuccaaccugauaucgaacaggguaagcugcaaauguggguugaucucuuccccaaggcauugggccgccccggaccaccguucaauaucacaccacgucgagcgcggcgcuucuuucuccgauguaucauuuggaauacacgagaugugauccuggaugaccucagucugaccggcgaaaagaugucagauaucuauguuaaaggauggaugaucggcuucgaggagcauaagcagaaaaccgacguucauuacaggagccuuggaggcgagggaaacuuuaauuggcgauuuauuuucccauucgacuaucuucccgcggaacaggucugcacaauugccaaaaaagacgcauucuggaggcucgacaaaaccgaaagcaagauccccgcccgcgucguguuucagauuugggauaacgacaaguucagcuucgaugauuuucuaggaucccuucaauuagaccuuaaucgcaugccgaaaccagcuaaaacggccaaaaagugcagucuggaccagcuggacgacgccuuccacccugaaugguucguaucucucuucgagcagaaaacaguuaaaggaugguggccguguguagccgaagagggagaaaagaaaauacuggcaggaaagcuggagaugacacuugaaauuguggcugaaagcgaacaugaagaaagaccugccggccaaggucgugaugaaccgaacaugaauccaaaacuugaggacccaagacgaccagauacaaguuuucuaugguuuacaucgccuuauaaaacaaugaaauucauccucuggcgccgguuccgaugggcuauaauccuuuucauuauucucuuuauacucuuguuguuccuagccaucuuuaucuaugcauuucccaauuacgccgccaugaaacuuguuaagccuuucaguuag

SEQ ID NO: 5201 - RNA, 6339 nt, Artificial Sequence
  Description of Artificial Sequence: Synthetic coding sequence
augcucuguugccucuuaguccgugcuagcaaucugccaagugcgaagaaagacaggcguucagacccaguggcaagccucacguuccggggggucaaaaaaagaacaaaggucauaaaaaauucagucaacccugucuggaaugaaggguuugagugggaucugaagggaauaccguuagaccagggaagugagcuccacgugguuguuaaggaccaugagacgauggguagaaaccgauuucuaggcgaggccaagguaccacugcgggaagugcuggcaacuccaucacuaagcgcuucuuucaaugcccccuugcucgauaccaaaaagcagccuaccggggcaagucuuguccuccaaguguccuacaccccacugccaggugcgguaccccucuucccccccccgacaccacucgaaccuucgccuacccucccugaccuugacgucgucgcuggcggcggucagagucgcgccgagacuuggucccugcuuucagauucaacuauggauacacgcuauucaggcaaaaaauggccugccccuaccgacaccggcggagaagaggacaccgaagaccaagguuuaacgggcgaugaagcugagccauuccuugaccaguccggugggcccggugcacccaccacuccuagaaaacuucccagccggcccccuccccacuacccaggcaucaaacgaaaaagauccgcucccacguccagaaagcucuuguccgauaaaccccaggacuuccaaauuagaguucaggucauugaaggucggcagcuucccggcgugaauauuaagcccguggucaaagucaccgccgcugggcaaacuaagcgaacccgaauccacaagggcaauucuccauuguucaaugaaacucuuuuuuuuaaccuguucgauucucccggcgagcucuucgaugagcccauauucauuacuguugucgacucucgaaguuugagaacugaugcguuauugggagaguuccguauggacgugggcaccauuuauagagaaccccgccaugccuaccucagaaagugguugcuauuaucagauccugacgauuucucugccggggcccguggcuacuuaaagacuucccucuguguucucgggccaggagaugaagccccacuugaacgcaaggauccuuccgaagacaaagaagauaucgaaaguaauuugcuaaggccaacgggugucgcccucagaggagcccauuuuugucuuaagguauuucgggccgaggaccuuccccaaauggacgacgccgugauggauaaugugaaacagaucuuuggguucgagagcaacaagaaaaaccugguggacccauucguugagguuucuuuugccggaaagaugcucuguagcaagauacuggagaaaacagccaauccccaauggaaccagaacauuacccugccagcaauguuuccgucuaugugugagaaaaugaggauaaggauaaucgacugggacagacugacacacaaugauaucguggcuaccaccuaccugucuaugagcaagaucagcgccccuggaggggaaaucgaagaagagccagcuggagccguuaagccuucaaaggccucugaccuugaugauuaccucggauuucuaccuacauuuggaccaugcuacaucaaccucuacggauccccgcgcgaguuuacaggcuuuccggauccuuacacagaguuaaauacggguaagggcgagggaguugccuaccgggggcgucucuuacuuucucuggaaacaaaacuaguugagcauagcgagcaaaaaguggaggaucuucccgccgacgauauccuccgggucgaaaaauaccuucgcagacgaaaauacagccuuuucgcugccuuuuauuccgcuacaaugcugcaagauguagacgacgcuauccaguuugaaguaucuauaggcaauuacggcaauaaauuugacaugacaugccugccucucgcguccacaacgcaguauagccgcgcggucuucgacggcugucauuauuacuaucuuccaugggguaacguuaagccugucguggugcucuccagcuauugggaggacauuucacaccggauugagacccagaaccagcugcucggaaucgcggacagauuagaggcuggccucgagcaggugcaccucgcgcuuaaggcucaguguagcaccgaagacguggacucccuggucgcacaacucacagaugagcugaucgccggauguagccagcccuuaggagauauacaugaaacgccgucagcuacacaccucgaccaguaccuauaucagcuaagaacacaccauuugucucagaucaccgaagccgcucucgcacuaaagcucggucacagcgaacucccagccgcccuggaacaggccgaggacugguuguugcgacucagggcucucgcugaagaaccacagaacucacuacccgacaucgugaucuggaugcuucaaggagacaagcguguagcuuaccagcgcgugccugcucaucaagugcuguucagccggcgcggugcuaacuauuguggcaaaaacugugggaaacuccagaccauauuucucaaguacccaauggagaaggugccuggugcccguaugcccgugcagaucagaguuaaauuaugguucgguuugagcguagaugaaaaggaauuuaaucaauuugccgagggaaaauuaagcguguucgcagaaacuuacgaaaacgagacaaaguuagcccucgugggcaauugggggacgaccggacugacauaccccaaauucagcgacgucaccgggaaaauuaagcucccuaaggacagcuucagaccaagcgccgguuggaccugggccggagauugguucguauguccagaaaagacacuacugcaugacauggaugccggccacuuaucauucguggaggaggucuucgaaaaccagaccaggcugccaggcgggcaauggauauacaugagugacaacuacaccgacgucaauggagaaaagguccugccaaaggaugauaucgaauguccucuggguuggaagugggaggaugaggaauggaguacugaccucaauagagccguagacgaacaagguugggaauacagcauuaccauccccccugaacggaagccaaaacacuggguaccagcagaaaagauguauuauacucaucgcagacgaagauggguccgguuaaggagaagagaccugucccagauggaagcacuaaagagacaucgccaagcugaggccgaaggugaaggaugggaguaugcuagucuguuugguuggaaauuucaucuugaauacaggaaaaccgaugcauucagacgccggcgauggagaagaagaauggagccgcuggagaagacagggccagcugcuguguuugcauuggagggcgcgcugggaggugugauggacgauaagagugaggauaguauguccgugucuacccugucauuuggagucaacaggccuacaauuucauguauuuuugauuaugguaaucgguaccaccucagaugcuauauguaucaggcuagggaccuggccgcuauggauaaagauucuuuuuccgacccuuacgccauagugucuuuccuccaucagagccagaaaacaguaguuguuaaaaauacacucaaucccaccugggaccaaacccugauuuucuaugagaucgaaauauucggcgagccugcuaccguugcugaacaaccaccaagcauaguagucgaguuguaugaucacgacacauacggugccgaugaauucaugggacggugcauuugccagccuagucuggaaaggaugccaaggcuagcgugguucccccucacaagaggaagccaaccuucaggagagcuuuuggcuucuuucgagcugauccaaagagagaaaccagccauccaccacauccccggauucgaaguccaggaaaccaguaggauucucgacgagagugaagacacagauuuaccguauccaccaccacagagggaagcgaauaucuacauggugccgcagaauauuaagcccgcguugcagagaacugccauagaaaucuuagcuuggggacugaggaauaugaagucguaccaguuagccaauauaucuagucccucccucguggucgagugugggggccaaacuguccaguccugugugauccgaaaccuacguaagaacccaaacuuugauaucugcacuuuguucauggaggugaugcugccacgagaagaacuguauugccccccuauaaccguaaaagugaucgauaacaggcaguucggacgucgcccaguggugggucaguguacgaucaggucacuugagagcuuccugugcgaccccuauucagccgagagcccaucuccacaagguggccccgacgacgugucucuucugucccccggagaggacguccuuauugacauagaugacaaggagccuuuaauccccauccaagaagaagaauuuauagacugguggagcaaguucuucgccaguaucggagaacgggaaaaaugugggucauaccuugaaaaagacuuugacacacugaaaguguacgacacucaguuggaaaacguggaagcuuuugaaggccucucagauuucugcaacaccuuuaaguuauaccggggaaagacacaggaagaaacagaagaucccagcguaauuggcgaauuuaaaggccuguucaaaauauacccccuccccgaggaccccgccauccccaugccaccgagacaguuucaucaacuggcggcgcaagggccccaagaaugucugguuaggauuuauauugucagagcguucgguuugcagccuaaagacccuaacgguaaaugcgauccguacaucaagauuucuauuggaaagaagaguguaagugaccaggacaauuauauucccuguacccuggagccgguguuuggcaaaauguucgaacugacauguacacugccucuugagaaagaccuuaaaauuacccuuuaugauuaugauuugcucaguaaggacgagaagauuggcgaaaccgucguggauuuagaaaaccgccuucugucuaaauuuggcgcucgcuguggacugccucagacuuacuguguguccgggccaaaucaguggcgggaccagcuuagacccucccagcuccuccaccucuuuugucagcagcacagggucaaggccccaguguacagaaccgaccgcgugauguuccaggauaaagaauacaguaucgaagaaaucgaagccgggcguauacccaauccacaccucgggccuguugaggaacggcuggcgcugcacgucuugcaacaacagggacuaguucccgaacaugucgaaagccguccucuguauucaccucuacagccggacauugagcagggaaaacugcagaugugggucgaccuuuuccccaaggcucucggacgccccgggccuccuuucaacaucacacccaggagggcaaggcgcuucuucuuacgcugcaucauuuggaauacacgagaugugauccuggacgaucuaucgcugacgggugaaaaaaugagugauauauacguaaaaggauggaugauaggauuugaggaacauaagcagaaaaccgacgugcauuaccguucucuuggcggggaaggaaacuucaacuggagauucauauuccccuucgauuaucuuccagcagaacagguuuguacuaucgccaaaaaggaugcauucuggagacucgauaaaacagaaagcaagauccccgccagagucguguuccagaucugggauaacgauaaguucucuuuugaugacuucuuagguucguugcaacucgaucucaauagaaugccaaaaccggcaaaaacugccaagaaguguaguuuggaccaguuagaugaugcuuuccaucccgaaugguuugucagucuuuucgagcagaaaacuguaaaggguugguggccauguguggccgaagagggggagaaaaaaauuuuagccggcaagcuggaaaugacacuggaaaucguggccgaguccgagcacgaagaaagacccgcugggcaaggccgagacgagcccaauaugaauccuaaacuggaagacccucggcggccugacaccuccuucuugugguuuacaucuccauauaagaccaugaaguucauucuguggcgacguuuucgaugggcaaucauacuuuucaucauacuguucauucuucuccuguuucucgcaaucuucauuuacgcuuuucccaauuacgcagccaugaaguuaguuaaaccauucucauag

SEQ ID NO: 5202 - RNA, 6267 nt, Artificial Sequence
  Description of Artificial Sequence: Synthetic coding sequence
augcuguguugccugcuaguccgcgcuucuaaccucccgucugcuaagaaagaccgacgcucugauccuguugccucgcugacguuucgaggggucaaaaagcguacuaaggucauuaaaaacagugugaacccgguauggaacgaagguuucgagugggaucucaagggcaucccccuagaccagggcuccgaguuacacguugugguaaaggaucacgagacuaugggccgcaaccguuuccucggcgaagcaaaagugccccugcgcgaaguuuuagccaccccuucauuguccgccagcuucaaugcgccucugcuggauaccaagaaacagccuacuggagcaagccucgugcugcaggucagcuacacaccauugccaggcgcuguaccucuguucccuccccccacgccacuugaaccuuccccuacccuaccagaccuugacguuguggcagauacuggaggcgaagaagauaccgaagaucagggucugacuggagacgaagccgaaccguuuuuagaucaaucuggaggccccggcgcuccuaccacaccccguaaacuccccuccagaccuccuccacacuacccagggauuaaaagaaagcggucugccccaaccucuagaaaacuccuaucugacaagccacaggauuuccagauucggguccaagugauugaggggcggcagcugccugggguaaacauaaagccuguggucaaagugacggcugcuggacaaacuaagcgaacaagaauacacaagggcaacucuccacuguucaaugaaacacuguuuuuuaaucuguuugacucccccggggaauuauuugaugaaccgaucuuuauuaccguuguggauucaagaucuuuacggaccgaugcuuuacugggcgaguuucggauggacgucgggaccauuuauagagaaccgagacaugcuuaucucagaaaauggcuucuccuuuccgacccugaugacuuuucggccggugcucggggcuaccugaaaacuucacugugugugcuaggaccuggagaugaggccccacuggaaaggaaagacccaagcgaggauaaagaggacauagaaucgaauuugcugaggccuacuggaguugcgcugaggggcgcccacuucugcuugaagguguuccgggccgaggaccuaccccagauggacgaugcaguuauggacaacguaaaacagauuuucggguuugaauccaacaagaagaaccuggucgauccauucguagagguuagcuuugcugguaaaauguuauguagcaagauacuggagaaaacugcuaauccacaauggaaccaaaacaucacuuugcccgcuauguuuccuagcaugugugagaaaaugcgaauuagaauaauugauugggaucgccuaacccauaaugauaucguggccacaacguaccuaagcaugucuaaaauaagcgcaccagguggggagaucgaggucgaugauuacuuaggcuuccucccuaccuuugguccuugcuauauaaaucuauacggauccccaagagaauuuacgggauuucccgaccccuacacugaguuaaacacagguaaaggagagggcguugccuacagaggacggcugcuguugagucuugaaacaaagcuugucgagcacuccgagcagaagguggaggaccuaccagcagacgauauucuuagaguagaaaaauaccuccgacgccggaaauauucacuguuugcugcuuucuauuccgcuacaaugcugcaagacguugacgaugcgauucaguuugaggucucuauaggcaauuauggcaauaaguuugauaugaccugucuaccgcuggcuagcaccacacaauacaguagggcaguuuuugaugggugucauuacuauuaccuuccguggggaaacgugaagccggugguugucuugagcagcuauugggaggacauuucucauaggauugaaacgcagaaucagcugcuggggaucgcggaucgguuggaagccgggcuggaacagguccaucuggccuugaaagcucaguguaguacagaggaugucgauaguuuggucgcccaguugacagaugaauugaucgccggguguucacaaccccucggggacauacaugagacaccaucagccacccaucucgaccaguaccuuuaccagcuacggacgcaccaccucagucaaauaacagaggcugcacuugcgcugaaauuaggccacuccgaacuuccugcugcacuggagcaagccgaagacuggcuccugagauugagagcccucgccgaagagccucaaaacagccugccagacauuguaauuuggaugcugcaaggugacaagagaguugcauaccagcggguccccgcacaucagguguuauucucgaggagaggcgccaauuauugcggaaaaaacuguggcaaacuccagacaauauuuuuaaaauacccaauggaaaaaguuccaggggcuagaaugccugugcagauucgagugaaguugugguuuggacucucaguggacgagaaagaguucaaucaguucgccgagggaaaacuguccguauucgcugaaacuuacgagaacgaaaccaaacuugcacucgucggcaacuggggaacuacaggccucacguauccaaaauucagugacgucacaggaaaaauuaaacugccuaaggauuccuuucgaccaagugccggguggaccugggcuggggauugguuugugugcccugagaagacacuuuugcacgacauggacgccggacauuuaagcuucguagaggaggucuuugaaaaccaaacucgcuuaccaggcggccaguggauuuacaugucugacaauuacaccgauguaaauggcgaaaagguucuuccuaaagacgacauugaguguccacuuggcuggaaaugggaggaugaagaguggucuacagaucucaaucgcgcaguagacgaacagggcugggaguauucaauuacgaucccccccgaacgcaagccuaagcauugggucccagcggaaaagauguacuauacacaccgaaggcguagauggguacgacugcgacgcagagaucucucucaaauggaagcccugaaaaggcauaggcaagccgaagccgaaggagaagguugggaauacgcuucgcuguucgguuggaaguuucaccuugaauacaggaagacagacgcguuucggcgcagacgauggcggaggagaauggaaccacuggaaaagacugggccagcagccgucuucgcacuugagggugcgcucggcggcgugauggaugauaaaagugaagauaguaugucugugucuaccuuaucauuuggaguaaaccgccccacaauuucaugcauuuucgacuacggcaaucgauaccaucugcggugcuacauguaucaggcgagagacuuagcagcaauggauaaagauucauuuagcgaucccuacgcaaucgucaguuuccuccaccagucacagaagaccguuguugugaagaacacucucaaccccacuugggaccaaacauugauuuuuuacgaaaucgagauuuucggagagccggcuacaguagccgaacagccaccaucuaucguaguggaauuauaugaucacgacacuuauggcgcagaugaauucauggggcgcuguaucugccaacccagccuggagagaaugccucgccuugcgugguuuccucugacacgagggucgcaaccuaguggcgagcuuuuagcgagcuuugaacugauccagagagaaaagccggccauucaccauauacccgguuucgaggugcaggagacaaguagaaucuuggacgaaucagaggauaccgaccuacccuaucccccuccccagagggaggcaaauauuuauaugguuccucaaaacauuaaacccgcacuucagagaacagcaaucgaaauccuugcuuggggccugagaaacaugaaauccuaccaacucgcaaauaucuccucucccucacuggugguugaaugcggcggccagacaguacagaguugugucauacggaaccugaggaagaauccuaacuucgacauuuguacacuguuuauggaggucaugcugccaagagaggagcucuacugcccaccgauuacagugaagguuaucgauaaucggcaguuuggacgacggcccguggucggccaauguacaaucagaagccuugaauccuuccuuugugacccauauucagccgagagcccuuccccucaagguggucccgaugauguuucgcuucuuucuccaggagaggacgugcugaucgacaucgaugacaaagagccccugauccccauccagcucgccgacggacucagcucucucgcuccaacaaauacagccagcccacccagcaguccacacgaggaagaguuuauagauuggugguccaaauuuuucgccagcauuggugagcgggagaaguguggcaguuaucuugaaaaagacuucgacacgcuaaaaguauaugacacgcaguuggagaauguggaagccuuugaagggcugucugauuucuguaacacuuuuaagcuguacagaggaaaaacacaagaagaaacugaagacccuucugugauuggcgaauuuaaggguuuguucaaaauuuauccccucccugaagauccugccaucccgaugcccccucgucaauuccaucagcuggcagcgcaagggccucaggaaugucuggugagaauuuauaucguaagagcauuuggucuacagccaaaagauccaaauggcaagugcgauccguauauuaagauaucaauagggaagaagagcgugucagaucaggacaauuacauccccuguacccuggagcccguauucggaaaaauguucgaauugaccuguacacuaccccuugagaaggauuugaaaauuaccuuauaugacuacgaccugcuuucuaaggaugagaagaucggcgaaacuguuguagaccuugagaauagacugcugucaaaauucggugcucguuguggacuaccccaaacauacugcguuucggguccaaaucaguggcgcgaccagcugagaccgucacaacuuuugcaccuauuuugucaacagcacagaguuaaggcaccggucuaucgcaccgaucgaguaauguuucaggauaaggaauacuccauugaagagauugaagcuggccggaucccaaacccacaccuggggccgguggaagaacgccuggcucugcauguguuacagcaacagggacucgugccugagcacguggagucuagaccccuuuacucuccuuuacaaccagacauugaacagggaaagcugcagauguggguagacuuguuuccuaaggcacuaggaagacccggacccccauucaacauuacccccagacgggccaggagguuuuuccugagauguaucauuuggaauacucgggacgucauuuuagacgacuuaagucucaccggcgagaagaugagcgacauuuacguuaagggauggaugauugguuuugaggagcauaagcagaaaacggacguucacuaucggagucucggcggcgaagguaacuuuaauuggcgcuuuaucuuuccuuucgacuaccugcccgcggaacagguguguacuauagcuaaaaaggacgcguuuuggcggcuugauaagacugaaagcaaaauaccagcucgaguaguuuuucaaauaugggauaacgauaaauuuucauucgacgacuuuuugggcagccugcagcuagacuugaaucgaaugccuaagccagcgaaaacggcgaaaaaauguucccucgaccaacuugaugaugcuuuucaccccgagugguucgugucccuguuugagcaaaaaacuguaaaagguugguggcccugcguggcagaggaaggcgagaaaaaaauccucgccgggaaacuggagaugacauuggaaaucguggccgaauccgaacacgaggagagaccugcagggcaaggucgcgaugagccaaacaugaauccaaaguuggaggacccuagacgcccagacacaucuuuucugugguucacaucucccuauaagacuaugaaauucauccuguggcguagguucaggugggccauaauccuguuuauaauauuguucauacuacuauuguucuuggcuauuuuuaucuaugcuuuccccaauuacgcagcuaugaaacuggugaaaccauucaguuag

SEQ ID NO: 5203 - RNA, 6294 nt, Artificial Sequence
  Description of Artificial Sequence: Synthetic coding sequence
augcuucggguuuucauacuuuaugccgaaaauguacauacacccgacacugacauuucggacgcguacugcagcgccguguuugccggaguuaagaaaaggaccaaaguuauaaagaauagugugaacccuguauggaaugagggcuucgaaugggaccucaagggcaucccacuggaccagggcucagagcugcacguuguuguuaaggaucacgagacuaugggccggaacagauuucuuggcgaggccaaagugccacucagagagguuuuagccacaccaagucuaucagcaagcuuuaaugccccccugcucgauacuaaaaagcaaccuacgggagcuucccucguguuacaggugaguuauaccccccuaccuggcgcuguuccucucuuuccaccaccuaccccccucgaacccagcccuacgcugccagauuuggauguaguagccggaggcgggcaaaguagggcagaaaccuggagccugcuaagcgauucgacgauggacacgagauacucaggcaagaaauggcccgcccccaccgauacuggaggcgaagaagacacagaggaccagggccugacuggcgaugaagcugaacccuuccuugaucaguccgguggcccgggggcuccuacuacaccacgcaaauuaccuagcagaccaccuccccacuaucccggcauuaagcgaaaacggucggcccccaccucccgaaagcuguugagcgauaaaccacaggacuuucaaauucgaguccaaguaaucgagggccgccagcuacccgguguaaacauaaagccagucgucaaagugaccgccgcgggccagacaaagcgcacccgaauucauaagggcaauucucccuuauuuaaugaaacucuguuuuuuaauuuguuugauuccccuggugagcuuuucgacgagcccauuuucaucacugucguggauucuagaucccugcgcacugaugcucuccucggcgaguuuaggauggacguugggacgaucuauagagaaccucgccaugcauaccuaaggaaauggcuacuccucucagacccagacgacuuuagcgcgggcgcacgggguuaucugaaaacuucacuguguguguuaggacccggugaugaggccccccuagaacgcaaagauccauccgaggacaaagaagacauugaaucuaaucugcucagaccuacuggaguggcucugcggggcgcccacuucugucugaaaguguuccgcgcggaagaucuaccccagauggacgacgcgguaauggauaacgugaagcagauuuucggguucgagucaaacaagaagaauuuaguggauccuuucguagaggugagcuuugcugggaagaugcugugcagcaagauccuggaaaaaacagcuaauccacaguggaaccagaauauuacacugccugcuauguuuccaucaaugugugaaaaaaugagaauuagaauuaucgauugggacagacuaacgcacaacgauaucgucgcaaccacuuaucucucaaugucuaagauuagcgcgccaggaggagagaucgaaguggaugacuaucuuggcuuccuacccacauucggaccaugcuacaucaaucuauacggaucucccagggaauucacagguuuuccugauccauacacagaacucaacaccgguaaaggcgaaggcgucgcuuacagaggucgucuucuccugagcuuggagaccaaacucguagagcacagugaacaaaaaguggaggaccugccugccgaugacauuuuacgaguugagaaguaccuccggcgccgaaaguacuccuuguuugccgccuuuuacucagccacuaugcuacaagaugucgaugaugcaauucaauuugaagugagcaucggaaauuaugguaauaaguuugauaugacaugccucccucuagccaguaccacgcaguauucacgcgcaguguuugaugggugucacuauuacuaucuucccuggggaaaugucaagccagugguaguucugucaucauauugggaagauaucucccacagaauugagacccaaaaccagcuccuuggcaucgcugauaggcucgaagcuggccucgaacagguccaucucgcucugaaggcccaguguucgacugaggauguugauucuuugguggcucaacuuaccgaugagcugauugcuggguguucgcagccacucggcgauauccacgagaccccaucagcuacucaucucgaucaguaccucuaucagcucaggacucaccaucuuucccaaauaacugaggcugcccuggcacuuaagcucggacacucagaauuaccugcagcccuugaacaagccgaggauugguugcuuagauugcgggcucucgcugaagaaccucaaaacucucuuccggacaucgucauuuggaugcugcaaggggauaagcgaguggccuaucagcguguaccagcccaucaaguacucuuuucaagacgaggagccaacuacugugggaagaauugcggcaaacuccagacuaucuuccucaaguauccuauggaaaaggucccuggugcgaggaugcccguccagauccgcgugaaacuuugguucgggcucagcguugacgaaaaggaguuuaaucaauucgccgagggaaagcuaucugucuucgcagaaacguaugagaaugagacuaagcucgcacuggucgggaacuggggcacgaccggcuuaacauacccaaaguucagugacguuacuggcaagauaaagcugccaaaggauucauuuaggcccagcgcugguuggacaugggccggggauugguuugugugcccagaaaaaacacugcuucaugacauggacgcuggacauuuaucauuugucgaggagguguucgaaaaucaaacaagauuaccuggcggccaguggaucuacauguccgauaauuauacagaugucaauggagaaaaaguucugcccaaagacgacaucgaauguccacugggcuggaaaugggaggacgaagaauggagcaccgaucuaaacagagcagucgacgagcaaggaugggaauauucgauaacuauuccuccggaacguaagccgaagcacugggugccagccgagaaaauguauuacacccaucgcagaagacguugggugcgccugagacgccgcgaucuuagucagauggaggcauuaaaaagacaccggcaggcagaagcugagggugaaggaugggaauaugccagcuuauuuggauggaaguuccacuuggaauaucgaaagaccgacgccuucaggagacgccgguggagacggcggauggagccccuggagaaaacagguccagcugcgguauucgcucuugagggugcauuaggcggaguuauggaugacaagagugaagauaguaugucagugaguacuuuaagcuucggcguuaaccgcccuacaaucuccugcauauucgacuacgguaaucgguaucaccuucgcugcuauauguaccaggcucgggaccuugcugccauggacaaagauagcuuuuccgauccuuaugccaucgucucguuccuacaccagagucaaaagacugucguugugaagaauacauugaacccaacuugggaccagacccugauauucuaugagauugagaucuucggugagcccgccaccguagcagaacaaccuccuagcauagucguggaauuguaugaucacgauaccuauggagcagacgaguuuaugggaaggugcauaugccagccauccuuggaacguaugccacgauuagccugguuuccucugacucgcgggucccaaccuuccggggagcuuuuggccuccuuugaauuaauucagcgcgagaagcccgccauccaucauauacccggcuucgaaguacaagaaaccaguagaauccucgacgaguccgaggacacugacuugccuuacccacccccccagcgggaggccaacauuuacaugguuccucaaaacauuaagccagccuuacaaagaaccgcgaucgagauucucgccuggggucucagaaauaugaaguccuaccaacuugccaacauuucuuccccaucgcucguaguagaaugcgggggccagaccguccaaucgugugugauucgaaaucugagaaagaauccuaacuucgauauaugcacauuguucauggaaguuaugcucccccgggaagagcuauauugcccaccuauuaccguaaagguaauagauaaucgucaguuuggaagaaggccugugguaggucaguguacaauccggagccucgagucuuuucuuugugauccauacagcgcagagucaccaucaccucagggagggcccgacgacguuucccucuuguccccaggcgaagacgugcugauugauaucgaugauaaggagccucucaucccaauccaagaggaggaauucauagacugguggucaaaauuuuucgcuuccauuggagaacgcgagaaaugcggauccuaccucgaaaaggacuucgauacccuaaaaguauacgacacccaacuugaaaauguggaggcuuucgaaggccucucagacuucugcaauacauuuaaauuguaucgcggaaaaacccaggaggagacagaagacccaagcgugauuggggaauucaagggccuuuuuaagauuuauccacuucccgaggacccugccaucccuaugcccccacgucaguuccaccaacucgcugcccaagguccccaggaaugucuaguacgcauauauaucguuagagccuucggucugcagccuaaagauccaaacggcaaaugugaccccuacauaaagauaagcaucgguaaaaaaucagugucugaccaagauaauuauauccccuguaccuuagagcccgucuuuggcaagauguuugagcugacaugcacacuaccacucgaaaaggauuugaagaucaccuuguacgauuacgaccuguugucaaaggaugagaagauuggcgagacagugguggaucuugagaaccgguuacuuuccaaguucggugcacguuguggucugccccaaacuuauugcgucucuggaccuaaucaguggagagaccagcuccggcccucucaguugcugcaccuauuuugucagcagcaucgcguuaaagcgccaguguauagaaccgaccgagugauguuccaggacaaggaguauucuauugaagaaaucgaggccggcagaaucccuaauccacaccugggcccuguggaagagcggcuugccuuacacguucuccagcagcaaggucucguuccagaacacguugagucucggccccuuuacagcccauugcagcccgauauugagcagggaaagcuccagauguggguugaucucuuucccaaagcgcuaggcaggcccggucccccuuuuaauauuacuccuagacgcgcacgcagauuuuuccuaagauguauaaucuggaauacacgggauguuauccucgacgaccugagucuuacaggugaaaagaugucugacauauacgugaaaggauggaugauuggauuugaagaacauaagcagaagaccgacgugcauuauagaaguuuggguggcgaaggcaauuuuaacuggcgcuucaucuuuccuuucgacuaucugcccgccgaacagguguguacuaucgcaaagaaagaugcauucuggcgccuugacaagacugaauccaaaauucccgcaagagugguuuuccaaauuugggauaaugacaaguuuuccuuugaugauuuccugggaagucuccagcuagaccugaacaggaugccuaaacccgccaaaacugccaaaaaauguucuuuagaccagcuggacgaugccuuucacccugaaugguucguuucauuauuugagcaaaagaccgugaaggguugguggccauguguagccgaagaaggcgagaagaagauuuuagccgggaaacuggaaaugacauuggaaauaguggcagagagcgaacacgaagaacggccagcagggcagggucgggacgagcccaauaugaacccuaaauuggaagacccuaggagaccugauacguccuuuuugugguuuacaaguccauacaagacaaugaaauuuauucucuggcgucgguuccgaugggcaauaauucuguuuaucauacuuuuuauccuccucuuauuccucgccaucuuuauuuacgccuuuccaaacuacgcagccaugaaguuaguuaaacccuucucuuag

SEQ ID NO: 5204 - RNA, 6360 nt, Artificial Sequence
  Description of Artificial Sequence: Synthetic coding sequence
auguuaugcugcuuacuaguacgcgcuucuaaccucccuagugccaagaaggauaggcggucggaucccguggcuucgcugacauuuagagguguuaaaaaacggacuaaggugauaaagaauucggugaacccuguguggaacgaaggcuuugaaugggaccuaaagggaaucccccuggaucagggaagcgaacugcauguuguggugaaagaucacgagacaaugggcaggaaucgauuccugggcgaagcgaaaguuccgcugcgagaaguuuuagccacaccuucauuguccgcgagcuucaacgccccgcuccuugacacaaagaaacagcccacaggugccucgcucgugcuucaagugucuuacacaccauuaccgggggcagugccccuguuuccaccuccaacacccuuagaaccuucuccaacauugcccgaucucgacgucgucgcuggaggcggacagagccgagcagaaacguggucccuacucucagauucgaccauggacaccagauacagcggaaagaaauggccugccccaacagacacuggcggcgaagaagauaccgaagaucagggucuuaccggcgaugaggccgaaccauuuuuggaucagucaggcggaccaggcgcucccacaacuccucguaaauugccguccaggccccccccccacuaucccggaauuaagcgaaaaagauccgcaccaacaagccgaaaacuguuauccgacaagccucaggauuuucagauacggguucaggucaucgaaggucggcagcuaccgggcgugaauaucaaaccggucgucaaggugacugccgcugggcagaccaagcgcacaagaauucacaaaggaaacucuccauuauuuaaugagacgcuguuuuuuaaucucuuugauaguccaggagaacuguucgacgagcccaucuuuauuacaguugucgauucgagaagccuacgcaccgacgcccuauuaggcgaguuuagaauggaugugggaacuaucuauagagagccuaggcacgcuuaucucagaaaguggcuacugcuaucagacccugaugacuucagcgccggagcccguggguaccuaaaaacuagucucugugugcuagguccuggcgacgaggccccuuuggaacgcaaggauccaagcgaggauaaggaagacaucgaaaguaaucugcugagaccaaccggaguggcguugagaggugcccauuuuugucugaaaguguucagagcagaggaucugccccagauggaugaugccgugauggauaacguuaaacaaauuuucggcuuugagucuaauaaaaaaaaucuggucgauccuuucgucgaaguuucguucgccggaaagauguuauguuccaaaauucucgaaaagaccgcuaacccucaauggaaccaaaauauuacauuaccagccauguuucccaguaugugcgaaaagaugcggauccgcauaauugauugggaccgccucacucacaaugauaucguugcgacuacuuauuugagcaugagcaagauuagcgcucccgggggugaaaucgaggucgacgacuaucugggcuuucugccaaccuuugguccaugcuauaucaaucuauacggcucuccccgcgaauuuaccggguuuccugacccuuacacugaacuuaacacaggcaaaggagagggcgucgcuuaccgugggcgccugcuacugucccuugagacaaaacucguggagcacucagagcaaaaagucgaggaucucccugccgaugacauccuucgcguggaaaaauaccuuaggagacgcaaauacucauuauucgccgcuuucuacucagcaacuauguugcaggauguggacgaugcaauucaguuugaagucagcauugggaacuacgggaauaaguucgauaugaccugccuuccacuggcauccacaacucaguauucaagggccguguucgacggaugucauuacuacuaucugccuuggggaaacgugaaaccugucgucgugcuuucuucauauugggaggauauuagucaucgcauagagacucagaaucagcuucugggaaucgccgaccgacuggaggccggacuggagcaggugcaucuugcccuuaaagcccagugcucuaccgaagacguagauucucucguggcucaguuaacggacgagcuuaucgccggaugcucucagcccuugggcgacauucaugaaacaccauccgcuacgcauuuagaucaguaccucuaccaguuacgcacacaccaucugucccagaucaccgaggcagcauuagcccucaaguuaggucacuccgaauugccggcugcgcucgagcaggcugaagacugguuacuuagguugcgagcucuagccgaagagccucagaacaguuugcccgauaucguuaucuggaugcugcaaggagauaaaaggguagcguaccaacgaguaccagcgcaccaaguccuguucucucggaggggcgcgaacuacugcgggaagaauuguggaaagcugcagaccaucuucuuaaaguaucccauggagaaagugccaggcgccaggaugcccguucaaaucagagugaagcugugguuugguuuaagcgucgaugagaaagaguuuaaucaguucgccgaaggaaaguuauccguguuugcugaaaccuaugaaaaugagacaaagcuugcacuugucgggaauuggggaacuacaggauugacuuaccccaaguuuagcgacguuacuggcaaaaucaaacuacccaaagacuccuuuaggccauccgcuggauggacgugggccggcgacugguuugugugcccagaaaagacacuccugcaugacauggaugcaggccacuugaguuucgucgaagagguauuugagaaucagacaagacugccuggaggccaauggauuuauaugagugacaacuacaccgaugucaauggcgagaagguucuacccaaagaugauaucgaguguccccuuggcuggaaaugggaggaugaggaguggucgacugaccucaaccgggccguugaugagcaagggugggaguacaguaucacgauuccccccgagaggaaaccaaagcacuggguccccgcugagaaaauguacuacacacacaggaggagacggugggucaggcuacggagaagagaccuuucccaaauggaagcccuaaagagacacagacaggcagaggcugaaggcgaagguugggaguaugcaucucuguucggauggaaauuucaccucgaguaccgcaagacagacgccuuucggagacgucguuggagacgaagaauggaaccccuggagaagacgggcccugcagcaguguucgccuuagaaggcgcccuggguggcgucauggaugacaagucugaggauucuauguccguauccacucugucauucgguguuaaccggcccacuauaucuuguauuuucgauuauggcaauagauaccaucuuagauguuacauguaccaggcccgggacuuggcugccauggauaaagauucauucucugacccauacgcuaucgugaguuuccugcaccaaagccagaagacagucguugugaaaaauacucuaaauccuaccugggaccaaacacugaucuuuuacgaaauugagauuuuuggagagccugcaacuguggccgaacaaccaccgaguaucguuguagaacuguaugaccacgacacuuacggggcagacgaguucaugggccgcugcauuugucaacccucccuggagcguaugccucgacuggccugguuuccgcugacacgggguucucagcccucuggagaguuacuugcuucguuugagcugauucaacgcgaaaaacccgcaauccaucauaucccuggauuugaagugcaggaaaccagccgcauacuagacgaaagugaagauacagaucucccauauccuccuccccagcgcgaagccaauauauacaugguuccucagaacaucaaaccugcauugcagcggaccgcaauugagauucuagcuugggggcugcgaaauaugaaguccuaucagcuugcuaauaucaguagcccuucccucgucgucgagugcggaggacagaccgugcaaucuugugugaucagaaaccugagaaagaaccccaauuuugacauauguacacuauucauggaaguaaugcugccuagagaagagcucuauugcccuccaauuaccgugaagguuaucgacaaccgucaguuuggacguaggccaguugucggucagugcacuauuaggucucucgaaaguuuccugugugacccguacucugccgagagucccuccccacaaggcggcccugaugauguuuccuugcuuagccccggagaagacguccugaucgauauugacgacaaagagccucugauccccauucagcuggcugauggccugucuagcuuagccccgacgaacacagccucaccacccagcuccccccacgaggaggaauucaucgacuggugguccaaauucuuugcaucaaucggagagagagagaaguguggaucguaccuggagaaggacuuugauacauugaagguuuaugauacacaacuggagaauguagaagcauuugagggucuaagcgauuucuguaacaccuuuaagcuguacaggggaaagacucaggaagagaccgaggacccaucugugauaggcgaguuuaaaggcuuguucaaaaucuaucccuugccugaagaucccgccaucccgaugccuccccggcaguuccaccaacuggccgcucaaggaccucaggaaugucuggugcgaaucuacaucguaagagccuucggucugcaaccuaaagacccaaauggaaagugugauccguauauaaaaauaaguaucgguaagaaauccgugagugaucaggacaacuacauacccuguacauuggagccuguuuucggaaaaauguuugaacugacuugcacauuaccauuagagaaagaccugaaaaucacgcuuuacgacuaugaccugcuaucuaaagacgagaaaaucggcgaaaccgucguggacuuggaaaauagacuccuuagcaaauucggugcccgcugcggauuaccucagacguauuguguuucaggcccaaaucaauggagagaucagcuucgcccuucucaacugcuccaccuuuuuugucagcagcaccgcgugaaggcuccagucuacaggaccgauagagugauguuucaggacaaggaauauucuauagaagagaucgaggccgguagaauacccaauccacacuuggguccagucgaagagagacuagcucugcacgugcuccagcagcagggacuugugccugagcacgucgaauccaggccucuguacucaccuuuacagccugacauugaacagggaaaauuacagaugugggucgaucuguuccccaaagccuugggccgaccuggaccuccuuucaauaucaccccaagacgagcuaggcgauuuuuucugcggugcauaaucuggaacacacgcgaugugauacuggacgaucugagccucacuggcgaaaagaugagugauauauauguaaaaggauggaugaucgguuucgaggaacacaagcaaaagacugauguccauuaccgcucccugggcggcgagggcaauuucaacuggcgcuucaucuucccuuuugacuaccuacccgcagaacagguguguacuauugcaaaaaaggacgccuucuggagauuagacaagacagaaaguaaaauccccgcuagagugguauuccagaucugggacaacgauaaauucuccuucgacgacuuuuugggaucccugcaacucgaccuuaaucggaugccuaaacccgccaagacugcuaagaaguguagccuggaccagcuggacgacgcauuucaucccgagugguucguguccuuauuugagcagaaaacagugaaggguugguggccuugugucgcggaggagggcgagaagaaaauccuggcaggaaaauuggagaugacacuugaaauaguugcagaauccgaacaugaggagcgaccggccggacagggcagagaugagccuaacaugaacccuaaacucgaggaccccagacgaccagauaccucauuccuuugguucacauccccauacaaaaccaugaaauucauccuuuggcgacguuuucgaugggcgauuauccucuucaucauucuguucauuuuacugcuauucuuggcaaucuuuauauaugcuuuuccaaacuacgccgcaaugaaauuaguuaaaccuuucuccuag

SEQ ID NO: 5205 - RNA, 6297 nt, Artificial Sequence
  Description of Artificial Sequence: Synthetic coding sequence
augcuuugcuguuuacuagugagagcaucaaaccugcccuccgccaagaaggauagaagaagugacccaguggcaucacugacguuucggggcgugaaaaagagaacuaaaguaaucaaaaacucuguuaaccccguuuggaaugaaggcuuugaaugggaccugaaaggaauaccuuuagaccagggaagugaacugcacguuguagucaaagaucaugagacuaugggucguaauagauuccucggggaagcaaaagugccucugcgcgaaguucuggcaacccccucucugagcgccucuuuuaaugccccucugcuugauacuaagaagcagcccacuggugcaucucucgugcugcaaguuucuuauaccccauugccaggagccguuccauuauuucccccucccacaccauuagagcccucuccgacacugcccgaccuggacgugguggcuggggguggccagucacgcgccgagacuuggagccugcuuagugacucaaccauggacacaagauauagcggaaaaaaauggccggccccaacugauacagggggagaagaagacacagaagaccaagguuugaccggagacgaagcugagccuuuucuagaccagucuggcggucccggagcgccaaccaccccucggaagcuccccucucgaccaccuccucauuaccccgggauaaaacgcaaacgaucagcccccaccuccaggaagcuucucucagacaaaccacaggacuuccagauucgcguccaggucaucgaagggcgccaacucccaggcgucaauaucaaacccguugugaaaguaacugccgccggccaaacaaagcgaacuaggauucauaaaggaaauuccccacuguucaaugagacucuguucuucaaucucuucgauucccccggcgaguuauucgaugagccuauuuucauuacagucguggacucucggucccucagaacagacgcucuccugggugaauuuaggauggauguggguacuauuuaccgugaaccucggcacgccuaccugcgaaaguggcuccuuuuaucagauccagacgauuuuucggcaggggccagaggauaccugaagaccuccuuguguguuuugggucccggcgaugaggcgcccuuggaaagaaaagaccccucggaagauaaggaagauauugagucuaaucuccuuagacccaccggugucgcucugcguggagcccacuucugucugaagguguuucgggccgaagauuugccacagauggacgaugcugucauggacaauguaaaacagaucuuuggguuugaauccaacaagaaaaaucucguagaccccuucgucgagguuagcuucgcggguaaaaugcuguguucuaaaauacuagagaaaacugcgaauccccaauggaaccagaauaucacucucccugccauguuuccaaguaugugcgaaaaaaugagaauucggaucaucgauugggacagacucacacauaaugauauuguugccaccacauaccuuucuaugucuaaaaucucagcaccagggggagagauugagguagaugauuaucugggguuuuugcccaccuucggccccugcuacaucaaccuguauggcucuccaagggaauuuacaggauuuccggauccguacacagaacugaacacugggaaaggugagggcguagcauacaggggacggcuccuccucucacuggaaacaaaauuaguagagcacagcgaacaaaaaguagaagaucuacccgcugacgauauauuacggguugagaaauauuugagacgccggaaauacucacuguuugcugccuuuuauuccgccacaaugcuccaggauguggacgacgccauucaguucgaggugucaauaggaaauuacgggaacaaguuugauaugaccuguuugccauuggcuaguacuacacaauacuccagggccguuuuugacggaugucacuauuauuaccuaccuuggggaaacgugaaacccguagugguauuauccuccuacugggaagauaucagccacagaauugaaacacagaaucaguuguugggcauagcagaccgccuugaggcuggauuagagcaaguucaccuagccuugaaggcccagugcagcacugaagacguggacucacugguugcucaacugaccgacgaacucauugcuggcugcucucagccccuuggcgacauucacgagacccccagcgcgacccaccuagaucaauaucuuuaucaacuucggacgcaccaccucagucagaucacagaagccgccuuagcgcuuaaacuaggacauucugaacuccccgccgccuuagagcaggcagaagauuggcugcuucgcuugcgugcauuagcagaagaaccgcagaauagccugcccgauaucgugauauggaugcuccagggggacaagcgcguagccuaucaaagaguuccugcacaucaaguuuuauucucaaggaggggggccaacuauuguggaaagaacuguggcaaacuucagacuauauucuugaaauacccuauggaaaaggugcccggugcucggaugcccgugcaaaucaggguuaaacugugguuuggccugucagucgacgagaaggaauucaaccaguucgcugaaggaaaauuguccguguucgcagagaccuacgaaaacgagacuaaacuagcucuggugggcaacugggguacuaccggccugacguauccuaaauucucugauguuacaggcaaaaucaaacuucccaaagacagcuuuaggccaucugccggauggacaugggccggugauugguuuguguguccugaaaaaacauuacuucacgacauggacgcuggacaucucucauucguugaagagguuuuugagaaccagacaaggcugccaggaggccaguggauuuacauguccgauaacuacaccgauguuaacggagaaaaggugcugccaaaagacgacauugaguguccgcucggauggaaaugggaagaugaggaguggaguacugauuugaaucgcgcaguugacgagcaggguugggaguacagcaucacaaucccacccgagagaaagccuaaacacugggugcccgcggagaaaauguauuauacgcaccgcaggcggcggugggucagauuaaggcguagggaccucagucagauggaagcacuaaaacggcaccgccaagccgaagccgagggggaagguugggaguaugccagcuuguuuggauggaaguuucaucuggaguauagaaagacggacgcuuuuagacgucgcagguggcgaagacguauggaaccccuagaaaaaacaggcccagcugccguguucgcccucgagggugcucuugguggagugauggaugauaaaagugaggacagcaugucgguguccacccugagcuuuggggugaauagaccuacaauuaguugcaucuuugacuacgggaaucgcuaccaucugagaugcuacauguaccaggcccgagaucuggcagcuauggauaaggauuccuuuucagaccccuaugcuaucgucucuuuuuugcaucaaucacagaaaaccgucguugucaaaaacacccuuaauccuaccugggaccagacguugaucuuuuaugaaaucgagauuuuuggagagcccgcaacaguggcugagcaacccccuucaauuguuguggaguuguacgaccacgauaccuacggagccgaugaauucaugggucgcuguauuugucagccaucucuggaacguaugccucgguuggccugguuuccauuaaccaggggaagccaacccucaggugagcugcuggcaucauucgagcugauacagagggagaagcccgccauucaccauaucccaggcuucgaagugcaagaaaccuccaggauccuggacgaaucagaggacaccgacuuaccuuacccucccccccagcgugaggccaacaucuacaugguuccccagaauaucaagccugcgcugcaaagaacagccauugagauacucgccuggggacuuaggaacaugaaaucauaucaauuagccaauauuucgucucccagucugguaguggaauguggaggucagacaguucagagcugcgucauccggaaccugcguaaaaacccuaacuuugacaucuguaccuuguucauggaagugaugcuuccccgagaagaguuauacugccccccaaucacagugaaggugaucgacaaccgacaauuuggcaggagaccaguaguuggucaguguacaauccgaucucucgaauccuuucucugcgauccguacuccgccgaguccccaaguccacagggcggccccgacgaugucagccugcugucaccuggagaggacgugcugaucgauauugaugacaaagagccccugauuccaauucaggaggaggaguuuauagacugguggucgaaguuuuucgccucuaucggagaacgugaaaaaugcggcucguaucuggagaaagacuuugacacccucaagguguacgauacacaguuagagaaugucgaagccuuugagggacuuagcgacuuuuguaauaccuucaagcucuaccgagguaagacacaggaggaaaccgaagacccuagcgugauuggugaauucaaggggcuguucaagaucuacccccugccugaagauccugccaucccuaugccacccagacaauuccaccagcuggcugcccaaggaccacaagaauguuuggugcgcauuuacaucgugagagcuuuuggccugcaacccaaagaccccaacggaaagugcgauccauacauuaaaaucuccaucgguaagaaaaguguaagcgaccaggacaacuacauaccuuguacauuggaaccugucuuuggaaagauguuugagcugacgugcacccucccccuggagaaggaccuuaaaaucacacucuaugacuacgaucugcuuaguaaggaugagaaaauuggcgagacgguuguugaucuggaaaauaggcuacugaguaaguucggcgcccgcugcggacugccccagacauacugcgucuccggaccuaaccaauggagggaucagcuucggccuucccaguuacuacaucuuuucugucagcagcaucgcguaaaggccccuguguaccgaacagaccguguuauguuucaggacaaggaguacuccaucgaggagauugaggcuggccguauucccaauccccaccucggcccaguggaagaacgccuggcacuacacguccugcagcagcaaggauuggucccugaacacgucgaaaguaggccacuguacuccccucugcagccugacauugaacaaggcaagcugcagauguggguggaccucuuucccaaggcacucggccgaccaggcccuccuuucaauaucacaccacggcgagcaagacgcuuuuucuugagauguauuauauggaacaccagagacgugauuuuggacgacuuauccuuaaccggagagaaaaugagugacaucuauguuaagggguggaugaucggcuucgaagaacacaagcagaaaacggacgugcauuauagguccuugggcggagaaggaaacuuuaacuggagauuuaucuucccauuugacuaccugccagccgaacagguguguacaauagcgaaaaaggaugcguuuuggcggcuggacaagaccgaaucuaaaauucccgccagaguaguuuuucagauuugggauaaugacaaauucagcuucgaugauuuccucggcucacugcagcuugaccuuaaucgcaugccaaaaccggcaaaaacugcaaaaaaguguucgcuagaucagcucgaugacgcuuuucacccagagugguuuguaucauuguucgagcagaagaccgugaagggaugguggccaugugucgcugaagagggagagaaaaagauacucgccggcaaacuagaaaugacacuggagauuguagcugaaucggaacaugaggaacgaccugcugggcagggccgagacgagccaaacaugaaccccaaacuggaggauccgcggcgcccagauacauccuuucugugguuuaccucaccauauaagacaaugaaguuuauucucuggcggagguuuagaugggccaucauccuuuucauaauucuuuucauccugcuguuauucuuggcgaucuucauauacgcauucccgaauuacgcagcaaugaaacugguaaaaccuuuuucuuag

SEQ ID NO: 5206 - RNA, 6336 nt, Artificial Sequence
  Description of Artificial Sequence: Synthetic coding sequence
augcugagaguguucauuuuauaugccgaaaauguucacacaccagacacugacauaucugaugcauacugcuccgcuguuuucgcuggagugaaaaaaagaaccaagguaauuaaaaacucuguaaauccaguguggaacgaagguuucgaaugggaucuaaaaggcaucccccuugaucaagguucggaauugcaugugguugugaaggaucaugagaccaugggccguaauagauucuugggggaagcuaaggucccauuacgcgagguccucgccaccccaagcuugucggccuccuuuaacgcuccacugcuggauacuaaaaaacagccgacuggggcuagccucguguugcaaguuuccuacacuccucugccaggugcugucccucuguuucccccccccaccccacucgagcccuccccuacgcucccugacuuggauguagucgcaggagggggacagucaagggcugagacuuggagccuccugucagauagcaccauggacacacgcuacucaggaaagaaauggccagcccccaccgacacaggaggagaagaagacaccgaagaucagggguuaaccggagaugaggcggagccauuucuagaccaguccggaggacccggcgcccccacuacaccacggaagcugccaucucgcccaccuccccacuaccccggcauuaaaaggaaaagauccgccccaaccucccguaagcuucucucagacaaaccccaggauuuccagaucagggugcaagugauugaggguaggcaacucccaggaguuaauauaaagccagugguuaaaguuaccgccgcaggacagacuaagcgaacaagaauccacaagggcaacucacccuuauuuaacgagacacucuucuucaaccuguucgauucaccuggcgaacucuuugaugaacccauauuuauuaccguaguugauucucguucacuucgaaccgacgccuuacuuggagaauuucgcauggaugugggcaccaucuaucgcgagccuagacaugcuuaccuccggaaauggcucuugcugucagacccugacgacuucucugcuggugcaagaggguaccugaagaccucacugugugucuuaggcccaggggacgaagcuccucuugagcguaaagauccuuccgaagacaaagaggacauagaaaguaaccugcuccggccuaccgggguugcccucaggggcgcacauuuuugcuugaaaguuuuucgcgccgaagaccucccacagauggaugacgcugucauggacaauguaaaacagaucuucggguucgagucaaauaagaaaaaucugguggacccauuugucgagguguccuuugccggcaaaaugcucugcuccaaaauacuagagaaaacugcuaacccucaguggaaccagaacauaacuuuaccagccauguucccaucuaugugugaaaaaaugaggaucaggaucaucgauugggaucgucuaacccacaaugacauuguagcgacaacauaccucagcaugucuaaaaucagugcccccggcggcgagaucgaggaagagcccgcaggugcaguaaaaccaucgaaggcaucagaucuugaugauuaccugggauuucucccaacguucggucccugcuacaucaaccuuuauggcucgccaagagaauucacuggcuuuccagaccccuacaccgagcucaauaccgguaagggagaaggaguggcauacagaggacgccugcuauuaucucuugagaccaagcucguggagcacagcgagcagaaaguagaagauuuaccugcggaugacauuuuaaggguggaaaaauaccugcggaggaggaaauauagucuguuugcagcguuuuacagcgcuacuaugcuacaggaugucgacgaugcgauccaguuugaaguuaguauugggaauuaugguaauaaauuugacaugacuugucugccucuggcuucuaccacucaguacucaagagcuguuuuugauggcugucauuauuauuaccugccuugggggaacgugaaacccguggugguguugaguuccuacugggaggauaucucucaucggauugaaacacagaaucagcuccugggcaucgccgaccgucuggaggcaggguuggagcagguucaccuggcccuaaaagcgcaauguucuacagaagauguugauucccugguagcacagcugacagacgaacucaucgcuggcugcucacaaccacugggggacauucaugaaacaccuagugcuacacaccuugaucaguaucucuaccaguugcggacccaucaccucucucagauuacugaggccgcucuagcucugaaacuuggccauucagaacuucccgccgcacuagagcaggcugaagacugguuguuaagacugagagcacucgccgaggaaccacagaauagccuccccgauauugugauauggaugcuacagggugacaaaagaguggccuaucaaagagugccagcccaucaaguacuguucagccggcgaggggccaacuacugcgguaagaacuguggcaagcugcaaacaauuuuuuugaaauauccaauggaaaagguuccuggugcacguaugccggugcagauccgcguuaagcuuugguuuggcuugagcgucgacgagaaggaauucaaccaguuugccgaggggaaacugucaguauuugcagaaacauaugaaaaugagacuaaauuagcgcugguagggaacuggggaacaaccggacucacuuauccuaaguucagugacgucaccggaaaaauuaagcugccuaaagacaguuucagaccuagcgcaggauggacgugggcuggagauugguucgucuguccggagaagacucugcugcacgauauggacgcaggacaucucucuuuuguggaagaaguguuugagaaucagacuagacugcccggcggucaguggaucuauaugagcgacaacuauacggacgucaauggagaaaaagugcugccaaaggacgacauugagugucccuuaggguggaaaugggaagacgaagaguggucuacagacuuaaaccgggcuguggacgaacagggaugggaauacucgaucacaaucccaccugaaagaaagcccaagcauugggugcccgcugagaaaauguauuacacacauaggcggaggagauggguaagguugagaagaagagaccuaucccagauggaggcccuuaaaaggcacaggcaggcugaggcugagggugaggggugggaguaugcaucacuuuucgguuggaaguuucaccucgaauauagaaaaacagacgcuuuucggaggcggcgauggcggcgcagaauggaaccgcuggaaaagacagggccagcugcaguauuugcacuggaaggggcccuuggaggcguuauggacgauaagagcgaggauagcaugagcguuucgacccuuucauuuggcguuaacagaccuacuauaaguuguaucuucgauuacggaaauagauaccaccuccgguguuauauguaucaggcuagggaccuggccgcuauggacaaggacuccuucuccgaucccuacgcaaucgugucuuuucugcaccagucucagaaaaccgucguuguuaaaaauacucugaauccaacuugggaccagacccugaucuuuuacgagauugagaucuuuggcgaaccagcuacuguugccgaacagcccccaucaaucguuguggaacuguacgaccacgauacauauggugcugaugaauucaugggcagaugcaucugucaaccuucucucgaacgaaugcccagauuggcuugguuuccccugacucgaggcagccagcccagcggcgaacuccuggcauccuucgagcugauacaacgcgaaaagccugcuauccaucauauaccuggguucgaagugcaggagaccucucggauccuugacgaguccgaagauacggaucuccccuacccucccccucaaagggaggcuaacauauacauggugccucagaacauaaagccugcccugcaacgcacagcaauugaaauucuggccuggggucuucgcaacaugaaaucuuaucagcuggcuaauauuucuuccccuagcuuagucgucgaguguggcggacaaaccguucaaagcugugugauccguaaccugaggaaaaauccuaacuuugauaucugcacgcucuuuauggaagucaugcuccccagagaggagcucuacugccccccaauuaccgugaaaguaauugacaaucgccaauucggacgccgucccguggucggccaaugcacaauacggucucuggagucuuuucuaugugaucccuacuccgccgaguccccuagcccucagggcggcccagacgacgugucccuucucucccccggugaagaugugcuaaucgacauagaugauaaagaaccccuuauccccauucaggaagaagaguuuaucgacugguggucgaaguuuuuugcaaguaucggagagagagagaagugcgggucauaccuugaaaaggauuuugauacacuuaaggucuaugacacccaacuggagaaugucgaagcauuugaggggcugucugacuucugcaacacauuuaaacuguaccgcggaaaaacccaagaggaaacagaagacccuagugugauaggagaauuuaagggccuguuuaagauauacccacugcccgaagaccccgccauccccaugccuccccggcaguuccaccagcuggcagcgcaagggccccaggaaugccuaguuagaaucuacauagugcgcgccuucggccugcagcccaaagauccaaauggcaaaugugauccuuauauuaagaucucuauaggcaaaaaguccgucucagaccaagauaauuauauucccuguacccuggaacccgucuucggaaaaauguucgaacuaacuuguacgcuuccacuugagaaagaccuaaagauuacauuguaugacuacgaucugcucucaaaagacgagaagauuggagaaacugugguugaucuggaaaaccgccuucugucaaaauuuggggcucgauguggauugccccagaccuacugugugucagggccgaaucaguggcgugaucaacugcgcccgucacagcuucugcaccuguuuugucaacaacaucgcguuaaagcacccguguaucggacggacagagugauguuccaagacaaggaguacagcaucgaagagaucgaagccgguagaauuccaaacccacaccuggggccuguugaagaacggcuagcccuucauguguuacaacagcagggucuugugccugagcacguggaaucacgcccacuguauucaccgcugcagccugacaucgagcagggcaaacuucagauguggguugaccuuuuuccgaaagcucugggccggccgggucccccuuuuaauauuacacccagaagagcuaggcgguuuuucuuacgcugcaucauuuggaacacccgugacgucauucuggaugauuuaagccugacuggagagaaaaugagcgauaucuacgugaaagguuggaugauuggguuugaagagcacaaacagaagacagauguucacuaucgcucacugggaggcgaagggaacuucaacuggagguucauuuucccauuugacuaccuacccgccgagcagguuuguaccaucgcuaaaaaggacgccuuuuggagacuugauaaaacagagucaaagauaccggcucgaguggucuuccagauuugggauaacgacaaguuuaguuuugaugauuuucugggaucucugcagcuugauuuaaauaggaugcccaaacccgccaaaacugcaaagaaguguagucuggaccaacuugacgaugccuuucaccccgagugguucgucucucucuuugaacagaagacagugaaagggugguggccgugugucgcagaggaaggugaaaagaaaauccuggcugguaagcuggaaaugacguuagaaauuguggcagaaagcgagcaugaggaacgccccgcugggcaaggacgugacgaacccaacaugaacccuaaguuagaagacccgagaagaccagacaccuccuuccugugguucacaagcccuuacaaaaccaugaaguuuauccucuggcggagauuccggugggccaucauccuguuuaucauucuauuuaucuuguuguuguuucucgccauauucaucuaugccuuccccaauuaugccgcaaugaaacucgucaaacccuuuucuuag

SEQ ID NO: 5207 - RNA, 6306 nt, Artificial Sequence
  Description of Artificial Sequence: Synthetic coding sequence
auguuaagagucuucauacuguaugccgaaaacguucauacccccgacacugauauaucagaugcguacuguucagcaguuuucgcaggcgugaagaagaggaccaaagugauaaaaaauagcgugaacccaguauggaacgagggcuucgagugggaccucaaggggauaccccuggaccagggcucagaacuucauguagugguuaaagaucacgaaaccaugggccggaauagauuuuugggcgaggcgaaaguccccuugcgagaaguuuuggcuacacccagccugagugcgaguuucaacgcgccauuacuagacaccaaaaaacagcccacgggcgccucucuuguccuucaggugucuuacacuccacugcccggcgccgucccacuuuuuccccccccuacaccuuuagaaccaucgccuacucugccugaucuggacgugguggccgauaccggcggcgaggaggacacagaagaccagggcuuaaccggcgacgaggcagagccguuccuagaccaaaguggcggaccuggagccccgacuacccccagaaaauugccaagcagaccaccaccccacuaccccggcaucaaaaggaaacggucagcucccaccucucgaaagcugcugucugacaagccccaggauuuccaaauuaggguucaggugaucgagggacgccagcuaccuggaguuaacaucaagcccguagugaaggucaccgccgcuggacagaccaagagaacacggauucauaaaggaaauucgccucuuuuuaacgaaacacucuucuucaaccuguuugacucacccggagaguuauucgaugaaccuauuuucaucaccguggucgauaguagaucccugcgcacagaugcacugcuuggcgaauucagaauggacgugggaacaaucuaucgggaaccccggcaugccuaucuuagaaaaugguugcuguuguccgacccugaugacuuuuccgccggugcccgcggcuaucugaagacaagucugugcgugcugggccccggcgacgaggcgccccuggaacggaaagauccuagcgaggauaaagaggauauugagucgaaucucuugagaccuacuggcguggccuugagaggggcacauuucuguuugaaaguguuccgugcggaagaucugccccaaauggaugaugcggugauggauaauguuaaacagauuuucggcuuugaaucuaacaaaaaaaaccugguugacccuuucguagagguuagcuucgcuggaaaaaugcucugcagcaagauccuagaaaagacggccaauccacaauggaaccaaaacaucacacuuccagcuauguuuccaucuaugugugagaaaaugcgaauacgaaucaucgauugggauagacuaacgcacaacgacauaguagcgacuacuuaucuguccaugaguaaaauaucugcacccggaggugaaaucgaagaagagccagcuggugcuguuaagcccucuaaagcuucagaccuggaugauuaccuuggauuucugccaaccuucggacccuguuacauuaaccuguauggaucuccucgagaauuuacuggguuucccgacccauacacugagcucaacaccgguaagggggagggaguagccuacagagguagacugcuguugagccuggaaacuaaacuggucgaacauucugaacaaaaaguugaagauuugccggcagacgacauccuucggguugaaaaauaccugcggagacggaaguauaguuuauuugcugcauuuuauagugccacaaugcugcaggauguggacgaugcaauacaguucgagguaagcaucggaaacuacgggaacaaguuugacaugaccugucugccacucgcuucgaccacacaguacucuagagccguguucgacggaugucacuacuauuacuugccaugggggaacgucaaaccaguuguuguacugagcucauacugggaagauauaucccacagaauugagacccaaaaccagcugcuuggcauugccgacaggcucgaagcuggccuagagcaaguucaccucgcucuuaaagcacaauguucaacagaagacguggauucacucguugcccagcugacagaugaguugauugcaggaugcucacagccucugggagauauucacgaaacucccuccgcuacacaucucgaucaguaucucuaucaacuccgaacacaucaucucucacagaucacggaagccgcucuugcgcugaaauuggggcacucugagcuccccgccgcacucgaacaggccgaagacuggcugcugcggcugcgcgcauuggccgaggaaccccagaacucucucccagauaucgucaucuggaugcuccaaggugauaagagggucgccuaucagagaguucccgcucaccagguccuguuuagcaggcgaggagcuaacuauugugggaaaaacugugguaaacugcagacaauuuucuugaaauacccuauggaaaaagugccaggagcucgcaugccugugcaaauccgagugaagcugugguucgggcugagcguugaugagaaggaguuuaaccaguucgccgagggaaaacucagcguuuucgccgagacauacgagaaugaaacuaaacuagcgcuggucggaaauuggggaacuaccgguuuaacguaucccaaguucucagauguaacaggcaaaaucaaacuccccaaagauagcuuuagacccuccgcaggauggacuugggccggcgacugguuugugugcccugaaaagacccuucuucacgauauggaugcaggucaucuguccuucguggaagaaguauuugagaaccaaacgagacugccuggaggccaguggaucuacaugucugauaauuacacagauguuaauggugaaaaaguuuuaccaaaggacgauauugaaugcccacucggcuggaagugggaagaugaggaguggucaacagaucuaaaccgggccguggaugaacaagggugggaguacaguaucaccaucccccccgaaagaaaaccuaaacauugggugccugcagagaaaauguacuauacgcacagacgcaggagaugggugagacugaggaggcgggaccucucccagauggaggcucugaaaaggcaccgucaagcugaagccgagggcgagggcugggaguacgcgagccuauucggcuggaaauuccaccuagaguaucguaagacugaugccuucaggagacgcagauggaggaggagaauggaaccucucgagaaaaccggacccgcagccguuuucgcccuggagggcgcucuuggaggagucauggacgauaaaucugaggacucuaugaguguuucaacauugaguuuuggcgugaaccguccgaccaucucuuguauauucgacuacgguaacagauaucaucuccgcugcuauauguaucaggcacgggacuuggccgcaauggauaaagacaguuuuucagaccccuacgccaucguuuccuuucuucaccaaucucaaaagacuguaguugucaaaaauacucugaauccuacuugggaccagacacugauauucuacgaaauugaaaucuucggcgaacccgccaccguagccgaacagccccccucuauugucguugaacuguacgaucaugacaccuacggcgcugaugaauucaugggaagauguauaugccagccgucacuggaacgaaugccccgccucgccugguucccacugacccgagguucucagccuuccggggaacuccuugcuagcuucgagcugauccaaagagaaaaaccagcaauccaucacauuccaggcuucgaagugcaggagacguccagaaucuuagacgaaucugaggauacugaccugcccuacccaccaccucagagagaggcuaacaucuacauggugccccagaacauuaaacccgcucugcaacgcacggcaauugaaauccuggcuugggggcugcgaaauaugaaaagcuaucaguuggccaacaucuccuccccuucauuagucgucgaguguggcgggcagacagugcaguccugcgucaucagaaauuugcgaaagaaccccaauuucgauaucuguacuuuauuuauggaggucaugcugccccgugaagagcucuauugccccccaauuacagugaaggugaucgauaacagacaguucgguaggagacccgugguaggucaaugcaccauuaggucccucgaaucauuucucugugaucccuauucagcggaauccccuucuccacaggguggccccgaugauguaagucuguugucuccuggcgaagacgugcugauugacauagacgauaaagaaccccucauuccaauccagcuggcagacggacucagcucacuggcacccacgaacacagcaucuccacccucuucaccucacgaagaagaguucauugacugguggucuaaguuuuucgcaucaaucggcgagcgugaaaaauguggcucuuaccuggaaaaagauuuugauacguuaaaaguuuacgauacucagcucgagaacguugaggcguuugaaggccuuucagacuucugcaauacauucaaacuguauagaggcaagacgcaggaggaaacugaggauccaucaguaaucggugaauucaaaggcuuguucaaaauauaucccuugccagaggaucccgccaucccaaugccccccagacaauuucaccaguuggccgcucagggcccacaggagugccugguuaggauuuacaucguccgggcuuucggacuucagccuaaagaccccaauggaaagugcgauccauacaucaaaauaagcauuggaaaaaagaguguuagugaucaggacaauuacauucccuguaccuuggaaccugucuucgguaagauguucgaacugaccuguacguugccacucgagaaagacuugaaaaucacccuauacgauuaugauuugcucaguaaagaugaaaagaucggcgagacuguaguagacuuggagaaccgacugcucucaaaauuuggugcccguuguggucucccacaaacguacuguguguccggcccaaaccaguggcgcgaccaauugaggccaagucagcucuuacaccuuuuuugccagcagcauagggugaaagcuccaguauauaggaccgauagggugauguuucaggauaaagaguauagcauugaagaaauagaagcgggaaggauuccuaauccucaccuugggccaguggaagagcgauuggcacugcacgucuugcagcaacaggguuuggugccugaacacgucgagucaagaccuuuauacuccccucuacagccugauauugaacaggggaaacugcagauguggguugacuuauucccaaaagcucuggguaggccuggaccucccuucaauaucacaccaagacgagcccgaagauucuuucugcgaugcaucaucuggaacacacgcgaugugaucuuagaugaccugucacugaccggggaaaaaaugagcgauauuuaugugaaaggcuggaugauugguuuugaggaacacaaacagaaaacugacgugcacuaccgaucucucggcggagaaggaaacuuuaacuggagauuuaucuucccuuucgacuaucuccccgccgagcaaguuugcaccaucgccaagaaggaugcauuuuggagacucgauaaaaccgaaagcaagauaccugcuagagucguguuucagaucugggauaaugauaaguucaguuucgacgacuuccugggaagccuccagcuugaucugaauagaaugcccaaacccgcuaaaaccgcgaaaaaaugcagccuggaccaacucgacgacgcuuuucacccugagugguuugucagucuguucgaacaaaagacaguuaaagggugguggccguguguggcagaagagggugagaagaagauccuggccgggaaauuggaaaugacacuagaaaucguugcugaauccgagcaugaagaaagaccagccggccagggucgcgacgaaccgaacaugaauccaaaauuggaagauccacgaagaccagauacuucauuccucugguucacuucaccguacaaaaccaugaaauucaucuuguggagacgcuuccggugggccaucauccuuuuuauuauccuguuuauucuucuccuguuccuugcaaucuucauuuaugccuuuccaaacuaugcagccaugaagcuggucaaaccguuuagcuag

SEQ ID NO: 5208 - RNA, 447 nt, Artificial Sequence
  Description of Artificial Sequence: Synthetic coding sequence
auggguuacccagaaguggagcggagagagcuguuaccugcugcugccccucgcgaaagaggaucucaggguuguggaugcgggggagcaccugccagagcuggcgagggaaauucuuguuuguuguuucugggcuucuucggucugucuuuggcguugcaccuucuuacccuguguugcuaccuggaguugagaucugagcuaaggcgagaaagaggagccgaaucuaggcuagguggcaguggcacuccugguaccucaggcacccugucgagccucggcggucucgauccagacucucccaucaccucucaccugggccagccaucuccuaagcagcagccacuagaaccgggggaagcagcacuacacucagauucgcaagacggucaccaggacuucgauuauauuauaucauucucguaugguuuacaaggcuucuguuag

SEQ ID NO: 5209 - RNA, 1176 nt, Artificial Sequence
  Description of Artificial Sequence: Synthetic coding sequence
augggcuauccggaaguggagcgacgagaacugcugccugccgccgcuccgagagaaagagggucccaggguuguggcugugggggugcaccugcccgugcaggcgagggcaacuccugucucuuauuucugggcuuuuuuggccucucucuggcauuacacuuauugacgcucuguugcuaccuggaacugaggagcgaacuuagaagggaacgaggcgcagaaagcagguuaggcggaucagggacacccggaacuuccggaacucugagcucucucgguggacucgacccugacagucccaucacuucacaccuagggcagccauccccaaaacagcaaccacuggagccuggagaggccgcgcuucauucggauucccaggauggacaucagauggcauugcugaacuuuuucuuccccgaugagaaaccauacucagaggaggaauccagacgcgugcgccgcaacaaacggucuaaaagcaacgaaggcgcggacggaccagugaaaaauaagaaaaaaggaaagaaagcuggaccaccaggacccaacggaccccccggaccccccgguccucccggcccccagggcccucccggcauucccggaauuccaggaauccccggaacaacugucauggggccuccggggccccccggcccuccuggaccucaggggccaccuggccuucaaggcccauccggugccgccgacaaagccggaacuagagagaaucaaccugcuguggugcauuuacaagggcagggaucagcgauacaaguuaagaacgaucuuaguggagggguucugaaugacuggucucgaaucacuaugaauccaaagguuuucaaguugcauccccgaagcggcgaauuggagguguuaguagaugguacauauuucauauauucacaggucgaagucuauuauauuaauuucaccgacuuugcaagcuacgaagucgugguugacgaaaagccauucuugcaauguacuaggucuauugagacaggcaaaaccaauuacaauacuuguuauaccgccggggucugccuccucaaagccaggcagaagauagcugucaagauggugcaugcagauaucucuauuaauaugucuaaacacacaaccuuuuuuggggccaucagacugggagaagcaccugccucauag

SEQ ID NO: 5210 - RNA, 1170 nt, Artificial Sequence
  Description of Artificial Sequence: Synthetic coding sequence
auggguuaucccgagguggaacgaagagaacuucugccagcggcagcuccacgggaaagaggcucccaaggguguggaugcggaggggcccccgccagggcaggggagggaaacagcugucugcucuuccuaggcuucuuuggacugucccucgcgcuccacuuguugacccuguguugcuaucuggaauuacgcagcgagcuaagaagggaacguggcgcugagagcaggcugggcggcucugguacucccggaacuagugggacacuaucuucccuggguggacuugaccccgacuccccuauaacaucacaucucggccagccgaguccuaagcagcagccucuugagcccggugaagcugcccuucauagcgacucacaggacgggcaucagauggccuugcuaaauuuuuucuuuccagacgaaaaacccuacucugaggaggagucucggcgcgugcguagaaacaaaagaucaaaaucuaaugagggagccgacggucccgucaaaaauaagaaaaaagguaaaaaggcugguccuccaggucccaaugguccuccuggcccuccaggcccuccuggaccccaaggcccuccagguauucccggaauccccggcaucccaggaacuacgguaauggggcccccuggcccucccggaccucccggaccccaggguccuccaggauugcaggguccguccggagcugcugacaaagccggaaccagagaaaaccagcccgccgugguacaucuucagggccagggaagugcaauucagguuaagaaugacuuaagugggggugugcuuaaugacuggucacgcauuacaaugaacccuaagguguuuaaacugcacccgcggagcggagaguuagaaguucugguugauggcacuuauuuuauuuacagucagguuuauuacaucaacuucacagacuucgcuucauaugagguagugguggacgagaaacccuuucugcaguguaccagaucaauugagaccggcaagacaaauuauaacaccugcuacacugcuggcgucuguuuacuuaaggcuagacagaaaauugcuguuaagauggugcaugcugacaucucaauuaauaugucuaagcacacaacuuucuucggagcuauccgccuaggcgaggcacccgcaucauag

SEQ ID NO: 5211 - RNA, 408 nt, Artificial Sequence
  Description of Artificial Sequence: Synthetic coding sequence
auggguuacccugagguggaaagaagagagcuauuaccagcugcugcccccagagaaagaggaucacagggaugugguuguggcggcgccccggcaagggccggagaaggcaacuccugucuccuguucuuaggcuucuucgggcucucccuugcuuuacauuugcugaccuugugcugcuauuuggaguugagaagcgaacucagacgagaaagaggggcagaaucgcgacugggcggguccggcacucccggcaccagcgguacucugucuagccuuggcggcuuagaccccgacucccccaucaccagccaucucggucagcccucucccaagcagcaaccgcuugagccuggcgaagcagcacuccauucagauucgcaggauggccaccaaggacaccaguag

SEQ ID NO: 5212 - RNA, 1161 nt, Artificial Sequence
  Description of Artificial Sequence: Synthetic coding sequence
auggguuacccugaaguggagaggagggaacugcugccugccgccgccccucgggagagagggagccagggaugcggauguggcggcgcaccugcgcgggcuggugaggggaauucgugccuucucuuccugggcuuuuucggccuaucuuuggcacuacaucuucugacuuugugcuguuaccucgagcuccgcuccgaacuaagaagagagagaggggccgagucacgccuaggcggcucagguaccccagguacguccggcacauuauccagcuugggaggacucgaucccgauuccccgaucaccagucaccugggccagccuuccccuaagcaacaaccucucgagccaggggaagcugcccuacacagugauagucaggacgggcaucaaauggcucuauugaauuuuuucuuucccgaugaaaagcccuauuccgaggaagagucccggcgcgugaggagaaacaagaggagcaaaucaaacgaaggugcugacgggccugucaagaacaagaaaaaagggaagaaagccggaccacccgggccuaacggaccacccggaccgccuggaccaccgggaccucagggaccaccaggaauuccaggaauucccggcaucccaggcacuaccgugaugggaccgccuggaccacccgguccucccgggccucagggcccucccgguuugcagggcccaucaggagcagcagacaaagcagguaccagagagaaccagcccgcagugguacaccugcagggacaaggaucagccauacaaguuaagaaugggggggugcugaacgauuggagucggauuacaaugaaccccaagguguuuaagcugcacccgcgcucaggggaacuggaagugcugguggacggaacguacuuuaucuauucucaagucuauuauauaaauuucacugauuuugcuagcuaugaagugguugucgaugaaaaaccuuuccugcagugcacuaggaguaucgaaacaggaaaaacaaacuauaauacauguuacacagccggcguuugucuccuuaaagcgcggcaaaagauagcgguuaaaaugguucacgccgacaucagcauaaacauguccaaacacacuaccuuuuucggagcuauuagacuaggggaggcccccgcaucauag

SEQ ID NO: 5213 - RNA, 447 nt, Artificial Sequence
  Description of Artificial Sequence: Synthetic coding sequence
augggauauccugaaguugagagacgggaacuucuuccagcagcagcaccgagagagagaggaucccaaggcugcggcugugggggagcaccggcacgggccggagaggggaauagcugccuacuguuuuuaggguucuucggguugagucuggcccuucaccuguuaacacugugcugcuaccuggaacugagaucggaauuaagacgggaaaggggagccgagagcagacucgguggaucagggaccccuggaaccagcggcaccuuaucgucguuaggcggccuggauccagauucuccaaucaccagucaucuuggacagccuucacccaaacagcaaccacuggaaccaggcgaggccgcauuacauucagauagccaggaugggcaccaggauuuugacuacauuauuucauuuucauacggguugcaaggguuuugcuag

SEQ ID NO: 5214 - RNA, 3429 nt, Artificial Sequence
  Description of Artificial Sequence: Synthetic coding sequence
auguuaguucucagaugcaggcugggcacaucuuuucccaagcuggauaauuugguaccaaagggcaaaaugaagauucuuuuaguguuuuugggccuauugggaaacaguguugcaaugccuaugcacaugccccgcaugcccgguuuuaguuccaagagcgaggaaaugaugagguauaaucaauuuaacuuuaugaaugguccgcauauggcccaccuuggacccuucuucgguaacggccuuccccagcaguucccacaguaccaaaugccgauguggccucagcccccucccaauaccuggcacccaagaaagucauccgcccccaaacgccacaauaaaacugaccaaacacaggagacccagaagcccaaucagacccagagcaagaaaccaccccagaagagaccacugaaacaaccgucucauaaccagccccagcccgaagaggaagcccagccaccacaggcauuccccccuuuuggaaaugggcuguucccauaucagcagccgccuuggcaaauaccucagagacugccaccaccugguuacggccggccuccaauauccaacgaagaaggcggaaaccccuauuucggcuacuuugguuaucacggcuuuggaggccguccuccauauuauucagaagagauguuugaacaggauuuugagaaaccuaaagaggaagacccaccuaaggcagagucaccagggacggagccaacugcuaacuccacggucacagaaaccaacucaacucagccaaacccuaaaggaucgcaagggggaaacgacacaucucccaccggcaauuccacaccagggcucaacacugggaacaauccacccgcucagaacggaaucggccccuugccggcaguaaacgcuucaggucaaggagggccaggcucccaaauccccuggagaccaucccagccaaacauccgcgagaaccauccauaucccaacauaagaaauuucccuucaggucgccaaugguacuucaccgggaccguuauggggcaccgccagaaucguccuuucuaccgaaaucaacaaguccagcgcggaccaagauggaacuucuuugccugggaacggaaacagguagcucguccaggcaaccccguuuaccauaaagccuacccccccacgucaagagggaauuauccuaacuacgccgguaaccccgccaaccucagacgaaagccucagggacccaauaagcauccuguuggaacuacaguagccccgcucggaccaaagccaggacccgucguaagaaaugagaaaauccagaauccuaaggagaaaccauuaggaccaaaggaacaaaucauuguaccuacuaagaauccgacuagcccauggaggaacagccaacaguaugaagugaacaaaaguaacuacaaacugccucauagcgagggcuauaugcccguaccaaauuucaacuccgucgaucagcacgaaaauucuuacuacccgaggggcgacucuagaaaggugcccaauucagacgggcagacucaaagucagaaucuaccgaagggaaucguacuagggucaaggagaaugccauaugaaagugagaccaaccaaagcgaacugaaacacucaucuuaucaaccagcuguguauccugaagagauccccagccccgcaaaagaacacuuuccagcaggccguaauaccugggaccaucaagagauuuccccucccuuuaaagaagauccgggucggcaggaggaacaucugccacauccaucacacggcucucgaggcucuguauuuuacccagaauacaacccauacgacccuagagaaaacagccccuacuugcgcggcaauaccugggaugaacgggaugauagcccaaacaccaugggccagaaggagagcccacuguaucccaucaacaccccggaucagaaagaaauuguaccuuacaaugaggaggaccccgucgacccgacaggagacgaaguguuucccggacaaaauagauggggugaggaguugucauuuaagggcggaccuaccgugagacacuaugaaggagagcaguacacuuccaaucagccgaaggaauaccugccauauagucuggauaaccccuccaaacccagagaagacuucuauuacuccgaauuuuauccuuggucccccgacgaaaauuuucccagcuacaacaccgcauccacuaugccuccucccaucgaaucaaggggcuacuauguuaacaaugcugccggcccggaagaaucuacguuguucccuagcagaaacagcugggaccacaggauccaggcgcagggccagcgugaacgucguccuuauuucaaucgcaacauuugggaucaggcuacccaccugcagaaagcucccgcuagacccccugaccagaaggggaaccagccauauuacagcaauacucccgcaggacugcagaagaauccaauuuggcaugaaggagaaaaucugaacuaugguaugcagaucacgcgcaugaacucaccugagagagaacacucauccuuccccaauuucaucccccccucuuauccaucaggacaaaaggaagcgcaccuguuccauuugagucaaaggggaucuuguugcgccggcucaaguacaggcccuaaagacaacccacuugcacuccaagacuauacgccaaguuauggauuggcucccggcgagaaucaagacacgucuccccuuuacacggauggaucccauacuaagcaaacucgcgacaucaucucuccuacaucuauuuuaccgggucaacgcaacaguuccgagaaaagagagucucaaaauccuuuucgugacgacguuuccacacugcggcguaauacgccuugcucuaucaaaaaucagcucggucaaaaagaaauuaugccuuuccccgaagcuucaucacugcaguccaaaaacacgccaugcuuaaagaacgauuugggaggggacgguaacaauauuuuagaacaagucuuugaagacaaccagcuuaacgaacgaacaguggaccugacuccagagcagcuagucauuggcacaccggaugagggaucuaaucccgaaggaauccagucacaagugcaggagaacgagagcgagcgacaacagcagaggccuagcaacauccuccaccucccuuguuuuggaucaaaacucgccaaacaucacaguagcaccacgggcacccccucaagcgaugggagacaauccccuuucgacggcgacucuaucacaccaacagaaaauccaaacacauuagucgaacuggccacagaagagcaguucaaaucaaucaauguggaccccuuggaugcugacgagcauagcccauucgaauucuuacagcgggggacaaacguccaggaucaggugcaggauugccuccuccuacaagcguag

SEQ ID NO: 5215 - RNA, 582 nt, Artificial Sequence
  Description of Artificial Sequence: Synthetic coding sequence
auggguguccacgaguguccagcuuggcuuuggcuucuguuaagccuucucagucucccucucggguugcccguccuuggcgccccaccgcggcuuauuugugacucuagagugcuggaacgcuaucuucuugaagcaaaagaagccgagaauauuacuacaggcugugcugaacacugcucuuuaaacgaaaauauuaccgucccugacacaaaaguuaacuuuuacgcuuggaaacgaauggagguuggccaacaggccguugagguauggcaggggcucgcccuguugucugaagccguucuuagaggacaagcuuuacuggugaacagcagccaaccaugggagccacuucaguuacacgucgauaaagccguuagcggucugcguagucugaccacucuccuacgcgcccugggagcucagaaagaggcaaucucccccccugacgcagcguccgcugccccucugcggaccauuacagccgacacuuuccggaagcuguuccgcguguacucaaauuuucuuagaggcaaauugaaauuguauacaggcgaggcaugucguaccggcgauagauag

SEQ ID NO: 5216 - RNA, 192 nt, Artificial Sequence; identical to SEQ ID NO: 4886
  Description of Artificial Sequence: Synthetic coding sequence

SEQ ID NO: 5217 - RNA, 390 nt, Artificial Sequence
  Description of Artificial Sequence: Synthetic coding sequence
augaaaacucuucaguucuucuuucucuucuguuguuggaaggccaucugcuguaacucaugcgaacugaccaauauuacaauagcgaucgaaaaagaggaguguagguuuugcaucucuaucaacacuaccuggugugcuggcuacuguuacacucgagaucuuguuuacaaagaucccgcgcgacccaaaauccaaaagaccugcacuuuuaaagagcuuguauaugaaaccgugcgcguacccggaugcgcucaccaugcggacucccucuacaccuacccuguagcuacacaaugucauuguggcaagugugauuccgacaguacagacuguacagucagagguuugggucccagcuauuguaguuuuggcgagaugaaggaauag

SEQ ID NO: 5218 - RNA, 390 nt, Artificial Sequence
  Description of Artificial Sequence: Synthetic coding sequence
augaaaacacugcaguuuuuuuuucuguuuugcuguuggaaggccaucugcugcaauucaugcgaguugaccaauauuacuauugccauugagaaagaagagugucguuucuguaucaguauuaauaccacuuggugugcaggcuacugcuacacuagggacuuagucuauaaagacccugcucgaccuaaaauccagaaaaccugcacuuuuaaagagcugguuuaugagacagugcgaguuccaggaugcgcucaccaugcugauucacuguacaccuacccugucgcuacacaaugccacugugguaaaugugacucagauaguacagauugcacaguaagaggccugggaccuucauacugcucauucggugaaaugaaagaauag

SEQ ID NO: 5219 - RNA, 390 nt, Artificial Sequence
  Description of Artificial Sequence: Synthetic coding sequence
augaagacacugcaauucuuuuuccuuuucugcugcuggaaagccauuuguuguaacagcugugagcugacgaacaucaccaucgccauugaaaaagaggaaugccgauuuuguaucucaaucaauaccaccuggugugccggcuacuguuauaccagagaccucgucuauaaagauccagcccguccgaagauccagaaaacuuguaccuuuaaagaacugguauacgagaccguacgagucccggguugcgcacaucacgcagauucucucuacaccuauccuguugcuacccaaugucacuguggcaaaugugauucagacucaacugauuguaccguucgaggucugggacccaguuacuguucauuuggugagaugaaggaguag

SEQ ID NO: 5220 - RNA, 1569 nt, Artificial Sequence
  Description of Artificial Sequence: Synthetic coding sequence
auggccgccguggucgccgcuacaagaugguggcaguugcuucuuguucucucugcagccggaaugggggccaguggugcuccccagccaccuaauauucuguugcuccuaauggaugacaugggauggggggacuugggggucuauggggaacccucucgcgaaacuccaaaucuugacaggauggcugccgaaggccugcuauucccuaacuuuuauagugccaauccccugugcucaccaucaagagcugcccugcuuacaggacgcuugccaaucagaaacggcuuuuauaccacuaacgcucacgcacggaacgcauauacaccacaggaaaucguuggggguauccccgauucagaacagcugcuccccgagcuccugaagaaagccgguuaugugagcaagauagucgggaaauggcaccuuggacaccgaccacaauuucauccccucaaacauggauucgaugagugguucgguucccccaauugccacuuuggaccuuacgauaauaaagcucgccccaauauaccuguuuaucgcgacugggagauggucggacgcuacuaugaggaguucccaauuaacuuaaaaacaggcgaggccaaucucacccaaaucuaccugcaggaagcccuugacuuuauaaaacggcaagcucgccaccauccguucuuccucuacugggcgguggacgcgacccaugcaccuguauacgcuagcaaaccauuccucgggaccucacagcgcgggcgcuauggagaugccguucgugagauugaugauucaauuggaaagauucucgagcuccuacaagaccugcauguugccgacaacacauuuguguucuucacuuccgauaacggagcagcacuuauuuccgcuccagaacagggagguucgaacggccccuuccugugcggaaaacaaacgacauuugaaggcgggaugagagagccagcacuagccugguggccuggacauguaacagcaggacaaguuucccaucaacuagggucgauuauggaucuguuuaccacaaguuuagcacucgccggacuuaccccacccucggacagggccauugauggacucaaccugcuaccuacgcuauugcaagggcgucucauggaucgccccauauucuauuaccggggagauaccuuaauggcagccacauugggacaacacaaggcacauuuuuggacuuggacuaauucgugggaaaacuucagacaggggaucgacuuuugccccggccagaacgugagcggugucacaacacauaaccuggaggaucacacuaagcugccccuaaucuuucaccugggucgcgaucccggcgagcgauucccuuuaaguuuugcuucugccgaauaccaagaagcucugucgagaauaacuucagucgugcaacagcaccaggaagccuuaguaccggcacagccgcaacuaaacguguguaacugggccguaaugaauugggcuccaccuggcugcgaaaaacuaggaaaaugccugaccccuccagaaaguaucccgaagaaguguuuguggucacauuag

SEQ ID NO: 5221 - RNA, 261 nt, Artificial Sequence; identical to SEQ ID NO: 4891
  Description of Artificial Sequence: Synthetic coding sequence

SEQ ID NO: 5222 - RNA, 1344 nt, Artificial Sequence
  Description of Artificial Sequence: Synthetic coding sequence
auggcagccgugguggcggcgacccggugguggcagcuguugcugguuuugucggccgcaggaaugggcgcguccggugcaccaggccaaagggcauauacuccccaagaaauugucgggggcauuccggauagugaacaacugcucccagaacuuuuaaagaaagcagguuacgucagcaaaaucguggggaaauggcacuugggccaccggccacaguuccauccucucaaacacggauucgaugaaugguuugggucuccuaauugucacuuugguccauacgacaauaaggcccgcccaaacaucccaguguaccgugacugggagauggugggacguuacuaugaagaauuuccaaucaaucuaaagacaggcgaagcuaaucuuacccagauuuaucugcaggaggccuuagauuuuaucaaacggcaggccaggcaccaucccuuuuuccuguacugggccgucgaugcuacgcaugcuccugucuacgcauccaaaccuuuccugggaacuagucagagaggaagauauggcgaugcaguacgagagauugaugacuccauaggcaagauucuggaacugcugcaggauuugcacguggcagauaacacuuuuguguuuuucacgagcgauaauggcgccgcccucaucuccgccccagaacaaggugguucgaauggaccauuccuuugcgggaaacaaacaaccuuugaaggcgggaugcgugagccagcgcuugcuugguggccagggcacguaaccgccggccaggucucccaccagcugggcuccauuauggaucuguucacgacuucucuagcccuugccggccugacaccuccauccgacagagcuaucgacggacugaaucugcuuccuacauugcuucaaggaagacuuauggaccggccaaucuucuacuaucgaggagacacacugauggcagcuacccucggccagcauaaagcacauuucuggacuuggaccaacuccugggagaacuuuaggcaggggauugauuucuguccuggacagaaugugucuggcgugacuacacauaacuuggaagaucauaccaaacuuccucuaauauuucaccuggguagagauccgggagagcgcuuucccuugaguuucgcuuccgcagaauaucaagaagcacucagcagaaucacaagcgucgugcagcagcaucaagaagcucuugugcccgcucagccgcaacucaacguguguaacugggccgugaugaauugggcccccccagguugugaaaaacugggcaagugucugacccccccugagucuauccccaagaagugcuuguggucccauuag

SEQ ID NO: 5223 - RNA, 636 nt, Artificial Sequence
  Description of Artificial Sequence: Synthetic coding sequence
augaaguuaugggauguagucgcaguuugcuuggucuuacuccacacggcuagcgcauucccuuuacccgccggcaaaagaccucccgaggcuccagcugaggaucgaucuuuaggaagacggagagcucccuuugcacucagcucagacucaaacaugccggaggacuauccugaucaguucgaugauguuauggacuuuauucaagccacaaucaagcggcuuaagcgauccccagacaaacagauggcgguccugccucgcagagagagaaacagacaagcagcggcagcuaacccggagaacagccgcgggaaaggccgacggggacagagaggcaagaauagggggugcgugcuuacugcaauccacuuaaaugugacagaccuuggucuuggauaugagacuaaagaggaacucaucuuucgauauugcucaggaagcugugaugcagcugaaaccacuuacgauaaaauuuugaagaaccuuuccagaaauagacggcugguaucugacaaggugggucaagccuguuguaggccuauugcuuuugaugacgacuugagcuuucuugacgauaaucugguuuaccacauuuugcgcaagcauucugcaaaacgauguggcuguaucuag

SEQ ID NO: 5224 - RNA, 558 nt, Artificial Sequence
  Description of Artificial Sequence: Synthetic coding sequence
augaagcugugggacguaguagcagugugucucguccugcugcacacugcuagcgcguucccucucccagccgcuaacaugccagaggacuacccggaucaguucgacgauguuauggauuucauccaggcuacuauaaaaagauugaagcggagccccgauaaacagauggcugugcuccccagaagagagagaaacagacaggcagcugccgccaauccagaaaacagccggggcaaggggcgaagaggacaacgggguaaaaauaggggcugugucuugacugcaauccaccugaacgucaccgauuuaggguuaggguacgaaacuaaggaggaauugaucuuuagguauugcucgggaaguugugaugccgccgaaacaacuuaugauaaaauccugaagaacuugucucguaaccgccggcuugugagcgauaaggugggacaggccuguugcagacccauugccuuugaugaugauuuguccuuucuggaugauaauuugguuuaccauauuuuacggaaacauucugcaaaaagaugcggcuguauauag

SEQ ID NO: 5225 - RNA, 687 nt, Artificial Sequence
  Description of Artificial Sequence: Synthetic coding sequence
augcaaagccucccaaacucaaacggagcagccgccgggagagauuuuaagaugaaacuuugggaugugguugcugucugccucgugcuacugcacacugcaucagcauucccccuuccugccgguaaacggccuccagaagcuccugcggaggaucgaagcuugggacgccgccgagcccccuuugcucugucuuccgauucuaauaugccagaggauuauccugaucaguucgaugacguaauggacuucauccaagcaacgauuaagagacucaaacgcuccccugacaaacagauggcuguauuaccgaggagggagagaaaucgccaagccgccgcggcaaaccccgaaaacuccagaggcaaggggaggcguggacaaagaggaaagaaccggggaugugugcugacagcuauucaccucaaugugacugauuuaggacugggauacgagacaaaggaagagcugauuuuccgcuacugcuccggcucgugcgaugcugcagaaacuaccuacgacaagauccugaagaaccucucacggaaucgcagacuggugucugacaaggucggucaagcaugcugccgccccaucgcuuuugaugacgaucucuccuuccuagaugacaaccuuguuuaccauauucuccgaaagcacuccgcaaagcgcuguggguguauuuag

SEQ ID NO: 5226 - RNA, 186 nt, Artificial Sequence; identical to SEQ ID NO: 4896
  Description of Artificial Sequence: Synthetic coding sequence

SEQ ID NO: 5227 - RNA, 186 nt, Artificial Sequence; identical to SEQ ID NO: 4897
  Description of Artificial Sequence: Synthetic coding sequence

SEQ ID NO: 5228 - RNA, 558 nt, Artificial Sequence
  Description of Artificial Sequence: Synthetic coding sequence
augaaauugugggacgucguggccguaugccucguacuacugcauacagcuucagcuuucccccucccagccgccaacaugccagaggauuauccugaucaauucgacgaugucauggacuucauccaagcgacuauuaagcggcuuaaaagaucuccugauaaacagauggcaguccugccacgaagagaacguaaccgucaggcugccgcagcuaauccugaaaauucacggggcaagggccggagaggucaacgcggcaagaaucgugggugcgugcuaacugcaauucaucuaaacgucaccgauuuaggucugggcuaugaaaccaaggaggagcugauuuuuagguacuguagcgguucgugugaugcagcugaaaccaccuacgauaaaauccugaaaaaucugucacgcaaccggcgucuggucucugauaaagucggacaagcuuguugucgcccgauugcauucgaugacgaucugagcuuucuugacgacaaucuaguuuaccacauacugagaaaacacuccgccaagcgcugcgggugcauuuag

SEQ ID NO: 5229 - RNA, 609 nt, Artificial Sequence
  Description of Artificial Sequence: Synthetic coding sequence
augcaaagcuuacccaacucuaauggugcagccgcuggccgagauuucaagaugaaacuuugggaugugguggcagucugcuuagucuuacuucauaccgcuagcgccuuuccccugcccgcagcuaauaugcccgaggacuaccccgaucaguuugaugacguuauggauuuuauucaggcaacuauuaaacguuuaaagcguagccccgauaagcagauggcagugcugccaaggagggagcgaaaccggcaggccgcggccgcuaaccccgagaauucacgcgggaagggacguaggggucagagagggaagaauagagggugugugcugaccgcuauccauuuaaaugugacugaccugggauugggguacgaaacuaaagaggaguuaaucuuucgcuauugcucgggcuccugcgacgccgcugaaaccacuuaugauaaaauacugaaaaacuugucccgcaacagaagacuggugucagacaaaguaggucaagccugcuguagaccaauugcauuugacgaugaucugucuuuuuuggaugacaaccugguguaccauauauuaagaaaacacuccgcgaagcggugugggugcauuuag

SEQ ID NO: 5230 - RNA, 543 nt, Artificial Sequence
  Description of Artificial Sequence: Synthetic coding sequence
augaagaguaucuacuucguugcuggacucuucguuaugcuuguucaaggaucuuggcagaggucauugcaggacacagaagaaaagagucgaucuuucuccgcgucucaggcugacccucucuccgauccugaccagaugaaugaagauaaaagacauagccagggaacauucaccucagacuacucuaaauaucuggacucaagacgcgcccaggauuucgugcaauggcugaugaauacuaagaggaaucgaaauaacauugcaaagcgacaugacgaguucgaacgccacgcagagggcaccuuuaccucugaugugaguaguuaucuugaagggcaagcagcgaaagaauucauagcuuggcuaguuaagggacgcggaagaagagacuuccccgaagagguugcaaucguugaagaauuaggcagacgccacgcggaugggucuuuuagugaugagaugaauacaauccuggacaauuuggcagcgagagauuuuaucaacuggcuuauacagacaaagaucacugacaggaaguag

SEQ ID NO: 5231 - RNA, 543 nt, Artificial Sequence
  Description of Artificial Sequence: Synthetic coding sequence
augaaauccauauauuuuguugccggucucuuuguaaugcucguacaagguucauggcaacgcucacuucaggacacagaagagaaaucuaggucauuuagcgcuucccaggccgacccuuuaucggacccggaucaaaugaacgaagauaaaagacacucgcaagggaccuucacaucagacuacuccaaguaucucgauuccaggcgggcucaagauuucgugcaaugguugaugaacacgaagcgcaaccgcaauaacaucgcaaagaggcaugaugaguuugaaagacaugcugaaggaacuuucacaagcgauguaaguagcuacuuggagggucaagcugcuaaggaguuuauagcaugguuagugaagggccgcggacggagagacuuucccgaagagguugcuaucguggaagagcuggguaggaggcaugcugacggaucuuuuucagaugaaaugaacacaauccuugauaaccuugccgccagagauuuuauuaauuggcuuauucagaccaagauuaccgaccggaaguag

SEQ ID NO: 5232 - RNA, 2859 nt, Artificial Sequence
  Description of Artificial Sequence: Synthetic coding sequence
auggguguccgccauccuccaugcagccaccgcuuacucgcagucugcgcacucguuucccuagccacagccgcccucuugggccauauauuacugcaugauuuucuucuggucccccgggaacugucaggauccaguccuguuuuagaagaaacucauccagcacaccagcagggcgcuucccgccccggcccccgugaugcacaggcucaccccggcagaccucgcgcaguccccacucagugugauguccccccaaauagcagauuugacugcgcccccgauaaagccaucacgcaggagcagugcgaagcaagaggauguuguuauauuccugcaaaacagggacugcaaggcgcgcagaugggccagccuuggugcuuuuuccccccuaguuaccccaguuauaaacuggagaaccugucauccagcgagaugggcuacaccgccacauugaccagaacgacacccacauucuucccuaaagauauucuuacacuacgccuagacgucaugauggagacggaaaaucgccuacauuuuacaaucaaggaucccgccaacagacgcuaugaggugccccuggaaacgccacacgugcacagccgagcccccaguccucuauacaguguagaguuuuccgaagaaccuuucgguguaaucguccgacgccagcuugauggacgcguccugcugaauacuacggucgcuccucuauucuuugccgaucaguuccuacagcuuuccacaucuuuacccagccaguauaucacaggccuagcagagcaccucuccccccucaugcugaguaccucauggacgagaaucacccuguggaauagagaccuggccccuacccccggagcuaaucuuuauggcagucacccauucuaccuagcacuggaggauggcgggucggcgcacggaguguuccuccugaauucuaaugcaauggauguaguucugcaacccucucccgcucugucauggcggucuacaggcggcauccuagauguuuacauauuccuuggccccgagccaaagucgguugugcagcaauaccuggaugugguaggcuacccuuucaugccgccuuauuggggccuggguuuucaucucugcagguggggguacagcucaacagcuauuacuaggcaggugguugaaaacaugaccagggcucacuucccacuugauguucaguggaacgacuuagacuauauggauucgcggcgugauuuuacauuuaacaaagacggcuucagggacuuccccgccaugguucaagaacugcaccagggaggcagaagauauaugaugaucguagacccugcuauuucuucaagugguccugccgguuccuacaggccuuacgacgaaggccugagacguggaguguucaucacaaaugaaacaggacaaccacucaucgggaagguuuggccaggauccaccgcauuuccugacuuuacaaauccaacggcauuagcauggugggaggauaugguagcugaguuucacgaccagguuccuuucgacggcauguggauugauaugaaugagcccaguaauuuuauacgcgguagcgaggacggcugccccaauaacgagcuggagaauccgccauauguacccgggguaguaggcgguacauugcaagcagcuacaauuugcgccuccagccaccaguuccugagcacgcauuacaaccugcacaaccuuuaugguuuaacagaagcuauagcaucccacagagcccucgucaaagcgcgcggcacaagaccauuugugaucucaaggucaaccuuugccgggcacgggcgguacgcuggacacuggacaggagaugugugguccaguugggaacaguuagcaaguaguguaccugagauccuccaauuuaaccugcugggggucccauugguuggugcugacgugugcggcuuucuagggaauacuagugaagagcuuuguguuagauggacccagcucggcgcauuuuaccccuucaugaggaaucauaauucuuugcuauccuugccacaggaaccauacagcuuuagugagcccgcucagcaggcaaugaggaaggcacugacauugagguaugcucuccucccucauuuguacacucuguuccaccaagcccacguugcuggagaaaccguugcaagaccccuguuccuggaauuccccaaggacucuuccacuuggaccguggaccaucagcuguuguggggagaagcccuuuugauuacccccgugcuccaggccggcaaggcugaagugacaggguauuuuccucuaggaacuugguaugaccuccagaccgucccuguugaagcucugggaucccucccuccuccacccgccgccccaagggaaccagcuauccacagugaagggcagugggugacuuugccugcuccacucgacacgauuaaugugcacuugagggcaggcuauauuauuccguuacaaggcccagggcucaccaccacugagucucgucagcaacccauggcacucgccguugccuuaacuaaaggcggugaagcucggggagaacuguuuugggacgauggagaaucauuagaaguuuuagaacgcggagcuuacacucaaguuauuuuucuggcccggaacaacacgaucguuaaugaacuggugcgggugacgagcgaaggcgcuggauuacagcugcagaaggugacagucuuaggggucgcuacagcuccacagcagguucuuucaaacggcgucccaguauccaauuucacuuauuccccagacaccaagguucucgauauuugcguauccuugcuaaugggggaacaguuucucgugagcugguguuag

SEQ ID NO: 5233 - RNA, 2859 nt, Artificial Sequence
  Description of Artificial Sequence: Synthetic coding sequence
augggaguacgucaucccccaugcagccaccgguuguuggcuguuugugcacucguuucccuggcaaccgcugcuuuguuaggccacauucuuuuacacgacuuccuacucgucccccgcgaauugagcggaucaucuccaguccuugaggagacccaccccgcgcaccagcaaggggccagccggcccggcccaagagaugcacaggcccaucccgggaggccucgcgcugugccgacccagugugacgugcccccuaacucacgauucgauugcgccccagacaaagccauuacucaggaacagugugaagcacguggcuguugcuauauucccgcuaaacagggucugcagggagcucagaugggucaacccuggugcuucuuucccccgucauacccuagcuacaagcuagaaaaccucucuuccagcgagauggguuauaccgcaacucucacccgcacaacccccacuuuuuucccuaaagauauauugacccugcggcuggaugugaugauggagacugaaaaucgacuccacuucaccauaaaggauccugcuaacagaagauacgaagugccucuagaaacgccucacguccacagucgggcuccaucccccuuguauucuguggaauuuucagaagaaccauuuggagugaucguccguaggcaguuggacggcagagugcugcucaacaccaccguggcccccuuauuuuucgcugaucaauucuugcagcugucuacaagccuucccucacaguacauuacuggucuggcugaacacuuaucaccccucauguugucaacuuccuggaccagaaucacuuuauggaaucgcgaucuggcuccgacaccaggcgccaauuuguacggcagucacccuuuuuaccucgcccucgaggauggagggagugcccauggaguuuucuuacuuaacagcaacgcaauggaugugguucugcaaccuuccccggcccucucuuggcgcucaaccggaggaauucucgacguguauauuuucuugggaccagaacccaaaucaguugugcagcaauauuuggacgugguaggcuauccuuuuaugccccccuauuggggucucggcuuccaucugugucgguggggauacaguucuacagcaaucaccagacagguuguagagaacaugacacgcgcucacuucccucuggacguccaauggaacgacuuagacuauauggauucacgacgggacuucacauucaauaaagacggguuucgcgauuucccugcgaugguucaagagcugcaucagggcgggcgccgguacaugaugaucgucgauccugcaaucaguucguccggaccugccgguuccuaucgaccauaugacgaaggauuacgcagagggguuuucauaacuaaugagaccggccagcccuuaauaggaaagguauggccugguucuaccgcauucccugauuuuacuaauccgacugcucuggccuggugggaggauaugguugcugaauuccaugaccaggugccuuuugauggaauguggauugacaugaaugaaccgagcaauuuuauuagagguuccgaggauggcuguccaaacaacgagcuagaaaacccaccauaugucccuggaguaguuggagggacacugcaggcugcuaccaucugugcauccucgcaccaguuccugaguacucauuauaaccugcacaaucucuaugggcugacugaagcuaucgcuucccauagggcuuuagugaaggcccgggguacccgaccuuuuguuauaucaagaucuaccuuugcuggacauggaagguacgcuggccauuggaccggcgacgucuggucaucaugggagcaguuagcuaguucagugccugaaauacuccaguucaaccugcucggcguuccccuggugggugcagauguguguggcuuuuuaggaaauaccagcgaggaguuaugcgugagguggacucagcugggcgcuuucuauccuuucaugcguaaucauaauaguuuguuaaguuugccccaggagccuuacaguuucagcgagccagcccaacaggccaugcgaaaagcacugacacugcguuacgccuuguugccacaccuguauacccuuuuccaucaggcgcacgucgcaggagaaacuguagcucgaccuuuguuccucgaauuccccaaagacucuucaacguggacggucgaucaccaacuccucuggggcgaggcacuacuuauuacuccugugcugcaggccggaaaagcggaagugacuggcuacuuuccacucggcacuugguacgaucuccaaacaguucccgucgaagcuuuagguucucugcccccacccccugccgcuccccgugaaccugcuauccauagugagggacagugggucacucugccagccccauuagacacaaucaauguccaccugcgagccggcuauauaaucccauugcagggaccgggccuaaccacgacggaaagcaggcaacagcccauggcacuggcuguagcgcuuacuaaagggggagaggcacguggcgaauuauucugggaugauggugaaagucuggaaguucuggagagaggggcuuacacccaggucaucuuuuuggcgcgaaauaacacaaucgugaacgaacugguuagaguuacaagcgagggcgccggccuacaacuacagaaagugaccgucuugggugucgccaccgccccccaacagguucuuucgaauggcgucccaguuucaaacuucaccuacucuccagauacgaaaguccucgauauaugcgugucauuacugaugggcgagcaauuucuugugucgugguguuag

SEQ ID NO: 5234 - RNA, 1611 nt, Artificial Sequence
  Description of Artificial Sequence: Synthetic coding sequence
auggaguuuucaucgcccucucgagaggaaugcccaaaaccguugucacgcguuuccauuauggcggguucacucacuggacugcuguuacugcaggccgugaguugggcuuccggcgcuagaccuugcauuccaaagaguuuuggcuauaguucggugguuugcguguguaaugcuacguauugugauucuuucgauccccccacuuuuccagcccuggguaccuucucacguuaugagucuaccagaagcggcagacgcauggaacuuucuauggggccaauucaggcaaaucauaccgguacaggccugcugcuuacccuucagccagagcagaaguuccagaaaguuaaggguuucgguggggcaaugacagaugccgcagcucugaauauauuggcccucuccccuccagcucagaaucucuuacucaagucauacuuuucagaagaaggcauuggcuacaacauuaucagaguuccaauggcauccugcgauuuuuccauccgaacuuacacuuacgccgauacacccgacgacuuucagcuccacaacuucagccucccagaagaagauacuaaacuuaagauuccuuugauccaccgcgcucugcaguuggcacaaagaccugugucacuucuggccucuccuuggaccuccccgacauggcuuaagaccaauggcgcugugaacgguaagggaucucugaagggucagccaggagacaucuaucaccaaaccugggccagauauuuugugaaguuccuggaugccuaugccgaacauaaacugcaguuuugggccguaaccgccgaaaaugaaccaagugcaggacuccugagcggauauccuuuucaaugucuaggcuucacuccagaacaccagagagacuuuauagccagggacuuagggccaacccuggcaaauagcacucaucauaauguaagauuacucaugcucgacgaucagagacuccuacugccgcauugggcuaaagugguguuaacugaccccgaagcagccaaguacguucauggaauugcagugcauugguaucuggauuuccucgcgccagccaaggccaccuuaggcgaaacacaucgacucuuuccaaacacuaugcucuuugcuuccgaggcaugugugggcagcaaauuuugggaacagaguguuagguuaggcucuugggacaggggcaugcaguauagucacucgauuaucacaaaccugcuguaccacguugucggcuggacagauuggaacuuggccuugaauccugaagggggucccaauuggguucguaacuuugucgauucuccuaucauugucgauaucaccaaagacacguucuauaaacaaccuauguucuaccaucugggccauuucucaaaguuuaucccggaagguucccagagaguugggcucgucgcuucucaaaagaaugaucucgacgcuguggcauuaaugcauccggacggcucagcuguuguugucgugcugaaucgcuccaguaaggacgucccucucacaauuaaggacccagccgucggauuccuugaaacuauuucacccggguacucaauucacacauaucuauggagaagacaguag

SEQ ID NO: 5235 - RNA, 1611 nt, Artificial Sequence
  Description of Artificial Sequence: Synthetic coding sequence
auggaguuuaguucccccaguagggaagaaugucccaagccccugucacgagucaguauuauggcuggaucucugaccggccugcugcuguuacaagccgucucuugggcauccggcgcccguccauguauaccuaaguccuuuggcuauucuucagucgugugcgugugcaaugcuaccuauugugauucauucgauccuccaaccuuuccggcucuggggacuuuuaguagguacgagucuacccguagcgguaggcgcauggagcuuucuaugggaccaauucaggcaaaucauacuggcaccggcuuacucuugacacuucagccagagcaaaaguuucagaaagugaaggguuuuggaggcgcuaugaccgaugcugcugccuugaauauccucgccuuguccccacccgcccaaaaucuguuacucaaaucuuauuuuuccgaagaagguaucggcuacaacauuaucagaguuccgauggccucaugugacuuuucuauccggacuuacacauaugcagauacccccgaugacuuccagcuucauaacuucucacucccagaggaggauacaaaacuuaagauucccuugauacaucgcgccuuacagcuagcucagagaccuguuucacuguuggcaagccccuggacauccccaaccugguuaaagacaaauggcgccgugaauggaaaagguagccuuaagggucaaccuggcgacaucuaucaucaaacaugggcgagguacuuugugaaguuucucgaugcguacgcugagcacaaauuacaguucugggccgugaccgcagagaaugaacccagcgccgggcuucugaguggguaucccuuccagugccuggguuucacccccgaacaccagagagacuucauugcgagggauuuggggccaacccuugccaacucaacacaucacaacguucgccuguugaugcuggacgaccagcgccuccuccucccccauugggccaaggucguccugacugaccccgaagcagccaaauacguacaugguauugcugugcacugguaccuugacuuucucgcuccugccaaagcaacccuuggagagacccacagacuguucccuaauaccaugcucuuugcaagugaggcauguguaggcucgaaauuuugggaacaaagcguccgccuaggcuccugggaucgcgguaugcaguauucacacucaaucauaacuaauuugcuguaccaugugguuggcuggacugauuggaaccuugcccuaaauccugaggggggcccgaacugggugcguaacuuuguggauucaccaauuauuguagauauuacuaaggauacuuuuuauaaacagccuauguuuuaucaccuggggcauuucaguaaauuuauaccugaagggucucagagaguaggucuaguggccagucaaaagaaugacuuagaugcuguagcucugaugcaccccgaugggagcgccgucgugguuguucucaauagauccuccaaagaugugccgcuaaccauaaaagaucccgccguuggcuuccuagagacaauuuccccuggauauuccauacacacauaucuguggcgcagacaguag

SEQ ID NO: 5236 - RNA, 1566 nt, Artificial Sequence
  Description of Artificial Sequence: Synthetic coding sequence
auggaauucucaagcccuucucgcgaggagugucccaaaccccugucucgagugucuauuauggcuggcucacugacaggucuccuguuacuucaggcagugucuugggcuucaggagcccggccaugcaucccuaagagcuucggguauuccucuguggucugugugugcaacgcgaccuacugcgacucuuucgauccaccuacauuucccgccuuggguacuuucucacgcuacgaaagcacacggucaggacgccgaauggaacugucuaugggccccauucaagcuaaccacaccggaaccgggcugcuuuuaacccuucaaccugaugccgcagcucugaacauuuuggcuuugagucccccugcucagaaccugcugcucaaaucauauuuuagcgaagaggggauaggcuacaacauaauccgaguccccauggccuccugcgacuuuucaauaaggacuuacacguacgccgacacaccugaugauuuccaacuccacaauuucucacugcccgaagaagacacuaaguugaagauaccacugauacaccgggcccugcagcucgcacaaagaccggugagucugcucgccucucccuggacaucucccacauggcucaaaaccaauggcgcggucaauggaaagggaagucuuaaaggccaaccuggggauaucuaucaccagacaugggcacguuauuucgugaaauuucuagacgcuuaugcugaacacaagcugcaauuuugggccgugacagcugaaaaugagccauccgccggucuacuuucggguuauccguuucagugcuuaggguucacucccgagcaucagcgcgacuucauugcuagagaucuaggacccacacuugcgaacucuacacaccacaaugugaggcuauugaugcuagaugaucagcgguuacuacuaccacacugggcuaaaguggugcucacggauccugaagccgcaaaguauguccacgggauugcuguucauugguacuuggauuuucuggcaccagcaaaagccacucucggcgaaacccaucggcucuuucccaacaccaugcuguucgcuagcgaggccuguguugguagcaaguucugggagcaauccgugagauuaggaucuugggacagaggcaugcaguauucacacucuauaauuaccaaccuucucuaccacguggugggauggaccgacuggaauuuagccuuaaauccugaagggggccccaauuggguaagaaauuucguggacuccccaauuaucgucgacauuacaaaggacacauucuauaaacagccaauguucuaucaccuggggcacuucucuaaguuuaucccagaaggaagccagcgaguggggcuggucgccucccagaaaaacgacuuggaugccguugcucuaaugcacccagauggaagcgcagucguggugguguugaaucggagcucaaaggacgucccccugaccauuaaagacccugccguuggcuuucuugagacaauaucaccuggcuauucuauucauacauaucucuggcgcagacaguag

SEQ ID NO: 5237 - RNA, 1464 nt, Artificial Sequence
  Description of Artificial Sequence: Synthetic coding sequence
auggaauucuccuccccuagcagagaagaaugcccuaagccacuuucacguguuaguauuauggcaggcucacucaccggacuguugcuucugcaggcugucucaugggcgucuggcgcccgcccuuguauuccaaaaaguuucggcuauucuagcgucguaugcguguguaacgccaccuauugugacucuuucgaucccccaaccuuucccgcucuggguacuuuuucuagguaugagagcacacggucagggcggcggauggaacucagcauggggccuauacaggccaaccauacaggaacggggauugguuauaauaucauucgcgugccaauggccagcugcgacuucaguauucgaacauacacuuacgccgacaccccugaugauuuucagcuucacaauuucaguuuaccagaagaggauacaaagcuaaaaauaccccugauccacagagcgcuucaguuagcccaacgaccugucucccuccucgcaucucccuggacauccccuacauggcugaagacuaauggugccguuaacgggaagggaucccucaaaggccagccgggcgacaucuaucaccagacaugggcacgcuacuucguaaaauuucuggaugcuuaugcagaacacaaacugcaguucugggccguaacagcugaaaaugaaccguccgcggggcuauuaagcggauacccuuuccagugucugggcuucaccccugaacaccagcgggacuucauagcaagggauuugggaccgacacucgcuaacagcacucaccacaauguccgcuugcucaugcucgacgaccaaagauuguuacucccacacugggcaaaggugguguuaacugaccccgaagcugcaaaguacguucacgggauugccgugcacugguaccuugacuuccuugcgcccgccaaagccacacugggagaaacucacagacuuuuccccaacacuauguuauucgccucugaagccugugugggcucaaaauuuugggaacagucaguccgacugggaucaugggaucgcgggaugcaguauucccauagcaucaucacgaaccuucuguaucacgugguuggcuggacagacuggaauuuggcacugaauccagaagguggaccaaacugggugcggaacuucguggauucgccgaucauuguggauauuacaaaggacacauucuacaagcaaccuauguucuaccauuuaggacacuuuuccaaauucauaccagagggaagucagcgggugggccuaguggcaucacagaagaaugauuuggacgccguagcccugaugcaccccgacgguuccgccguaguaguuguucugaacagauccagcaaggacguuccacuaaccaucaaggauccagcagugggauuucuggaaaccaucagucccggauacucuauccauacuuaucucuggagacggcaauag

SEQ ID NO: 5238 - RNA, 1350 nt, Artificial Sequence
  Description of Artificial Sequence: Synthetic coding sequence
auggagcuaucaaugggaccaauucaggccaaucauacugggacagggcuucugcugaccuugcagccugaacaaaaauuucaaaaaguuaagggauuuggaggcgccaugacggaugccgccgcacugaauauucuggcacuaucuccccccgcacaaaaccuguugcugaaaucauacuuuucggaggaggguaucggauauaauaucauucgggugcccauggcaucaugcgacuuuucuaucagaaccuauaccuacgcugauacaccugacgauuuucaacuucacaauuuuagccugcccgaagaagauacaaaguuaaaaaucccacuaauucacagagcccuccagcuagcucagaggccaguuagccuauuggccagcccauggaccucacccaccuggcugaagacuaacggggccgucaauggaaaaggcucuuugaaagggcagcccggagauauuuaucaucagacuugggcuagauacuucguaaaauuucuggaugcguacgccgagcacaagcuccaauuuugggcuguuaccgccgagaaugagcccuccgccggucuccugucagguuauccauuccaaugccugggcuuuacaccugaacaccagcgugacuuuaucgcacgugaucuaggcccuacuuuggccaauagcacccaccacaauguacgacuacugaugcuagaugaucagcggcuccuguuaccccacugggcuaaggugguucugacugacccugaggccgccaaguacgugcacggcauugcgguccauugguaccuugacuuccuagcacccgccaaggcuacccucggagaaacccauaggcucuucccuaacaccaugcuguuugcuucagaagcgugcguugguuccaaguucugggaacagagcguuagacuuggcagcugggacagggguaugcaauauucacauagcaucaucacuaaucugcuauaccauguagugggauggacggacuggaacuuggcucugaaccccgaagggggucccaauugggugaggaauuuuguugauucaccaaucauuguugacauuacuaaggauacuuucuacaagcaaccuauguucuaucaccuaggacauuuuuccaaauucauuccagaggguucccaacgugugggacuaguagcuucacagaagaacgaucucgaugcggucgcacugaugcaucccgacggcucagcuguggucgucguacugaaucgcucuucuaaagacguaccacugaccauuaaagaccccgcagugggcuuccuugaaacaaucucuccuggcuacuccauucacaccuaccuauggcgacgacaguag

SEQ ID NO: 5239 - RNA, 1482 nt, Artificial Sequence
  Description of Artificial Sequence: Synthetic coding sequence
augacacuucgagggugguccuuucaaguucuucccgagaguaacgcaacuuacugugauuccuuugaucccccgaccuucccagcccuugguacauucaguagauacgaauccacuagaucugggcgcagaauggaacucaguaugggaccaauccaggcgaaccauacgggaacuggacuucugcuaacgcugcagcccgaacaaaaauuccagaaaguuaaaggguuuggaggcgcuaugacugaugcugcugcccucaauauccuggcccucagcccacccgcgcagaaccuucugcucaaaucauacuuuagcgaagaggggauuggcuauaacauuaucagaguuccuauggcuucuugcgauuucuccauucgcacguacacuuacgccgacacccccgaugauuuccaacuacacaacuuuagccuuccugaagaagacacgaagcugaaaaucccccuaauucacagagcgcugcagcucgcccagcgucccguuucucuacuggcuucucccuggacuuccccuacauggcucaagacuaacggugccguuaacggaaaggggucucuuaagggccaaccaggagauaucuaccaccagacuugggccagauauuucgugaaguuccucgacgcauaugccgagcauaaauuacaguuuugggcggucacagcugagaacgagcccagcgcuggacugcuuuccggauaccccuuucaaugcuugggcuucacacccgaacaucagcgagauuuuauagcaagggaucuagggccuacacucgcuaauucuacacaucauaacguucgacuccucaugcuugacgaccagcggcugcuccucccucauugggcuaaaguuguuuugacugauccggaggcugccaaauacguucauggaauugcgguucauugguaccuugacuuccuggcgccagcgaaggccacccugggggaaacacaccgccucuuuccaaacaccaugcuuuuugcuagugaggccuguguaggaucuaaauucugggaacagucugugagacucgguucaugggacagggggaugcaauauagccauuccauuaucacuaacuuacuguaccauguggucggauggaccgacuggaaccuagcucugaauccugaagguggaccaaacugggugagaaauuuuguugacuccccaauaauuguugacaucacuaaggacaccuucuacaagcaacccauguuuuaccaucucggacauuucucaaaauuuaucccugaaggcucccagagaguaggccuaguggcuagccaaaaaaaugaccuggaugcaguggcucucaugcauccggacgguagugcugucgugguuguccuuaaccguaguagcaaagacguuccucugacuaucaaagaccccgcugugggcuuccuggaaacaaucucuccuggguauucuauucacacauaucuguggcgaaggcaauag

SEQ ID NO: 5240 - RNA, 1272 nt, Artificial Sequence
  Description of Artificial Sequence: Synthetic coding sequence
auggaauuuucuuccccuagccgggaggaaugccccaaaccucugucccgagugucuauaauggccgguucacucacuggacugcuacuccugcaggcugugucaugggccuccggaaucggcuacaauauuauuagaguuccaauggcuuccugugacuucuccauuagaacauauacauacgcugacaccccugaugacuuccagcuccacaauuuuagccugccugaagaagauacgaagcucaaaaucccucuuauccacagagcccuccaacuagcccaacgcccaguaucucuucuggcuagucccuggaccucaccaacaugguugaagaccaacggcgcagucaauggcaaggggaguuugaaaggacaacccggagauaucuaccaucaaacaugggccagauacuucgugaaauuccuugacgcuuacgccgaacacaaguuacaguuuugggcugucacggcagagaaugaaccaucagcgggccugcuuagcggcuaucccuuccagugccugggcuucaccccagaacaucagcgcgacuucauugcaagagauuugggcccuacguuagcuaauuccacucaccacaacguucguuugcugauguuagaugaccagcgacuccugcugccgcauugggcaaaggugguucucacagaucccgaggccgcaaaauaugugcacgggauugcuguucacugguaucuggacuuuuuagcaccggcuaaagccacucuuggcgagacacaucgccuguuccccaacaccaugcuauuugccuccgaggccugcguagggaguaaguucugggaacaaagcguucgucugggcucaugggacagaggcaugcaguacucacauucuauaauuacaaaccugcuguaucacgucgugggauggaccgacuggaaccuagcuuuaaacccugaaggcgguccgaacuggguucgaaauuucguggauagcccuauuauagucgacauuacaaaggauacauuuuacaagcagcccauguuuuaucaccuuggccauuuuaguaaguuuauucccgaagguucucagcgcgugggccugguagccucccagaagaaugaccuggacgcuguagcccugaugcacccagauggcagcgcagugguggugguacugaaccggaguucaaaggaugucccccucacaaucaaggaccccgcugugggauuccucgagaccauuucacccggcuauucuauccauacauaucuguggcgaagacaguag

SEQ ID NO: 5241 - RNA, 351 nt, Artificial Sequence
  Description of Artificial Sequence: Synthetic coding sequence
auggacuauuaucgaaaguacgccgcaauuuucuugguaacccugagcguauucuugcaugugcuucauuccgcuccagacguacaggacuguccagaauguacucuccaggagaaccccuuuuucucucaaccaggcgcucccauucuccagugcaugggcuguuguuucucgcgagcguauccgaccccgcugaggucaaagaaaacaaugcugguacagaagaacguuaccucugaaucaacauguuguguugcuaaaucauauaacagggugacaguaaugggcggauuuaaggucgagaaccacacugccugccauuguuccacauguuauuaccauaagucuuag

SEQ ID NO: 5242 - RNA, 654 nt, Artificial Sequence
  Description of Artificial Sequence: Synthetic coding sequence
auggccacagggucccguaccucacuacuucucgccuucggccuauugugucugccuuggcuccaggaagguagugcauucccgacaaucccacucucaagauuguucgauaacgcaauguuaagagcacaucgccuacaccagcuggccuucgauacuuaccaggaauuugaagaagcguacauacccaaggagcaaaaauauuccuuccugcagaacccucagacaucucuuugcuucagcgaguccauccccaccccuucuaaccgagaagaaacucagcaaaaguccaacuuggaauuguugaggauuucauuacugcugauacagucauggcuugaaccugugcaauuccuccgaucaguguuugcuaauucucucguguauggggcuagcgacucaaacguguacgaucuucugaaagaccuagaagagggcauccagacuuugaugggccguuuggaggauggcagcccaaggaccgggcagaucuuuaaacagacguauuccaaauucgacaccaacucccacaaugacgacgcccuccugaaaaacuacggccuucuguacuguuuucguaaagacauggacaaaguggaaacguuuuuacgaauagugcaauguaggaguguggaaggaagcugcggguuuuag

SEQ ID NO: 5243 - RNA, 369 nt, Artificial Sequence
  Description of Artificial Sequence: Synthetic coding sequence
auggccaccgguucccguacauccuuacuccucgcauuugggcuuuuguguuuaccuuggcuucaggagggcucugcauuucccaccauuccacuguccagacuuuuugauaaugccaugcugcgggcccacaggcuccaccagcucgccuuugacaccuaccaggaauuuaggcucgaggacggcucgccacgcacgggucagaucuucaagcaaacauacagcaaauucgauacuaacucucacaacgacgaugcacugcuuaagaauuacggccuucuguacuguuuucgaaaggauauggauaagguugagacuuuucuaagaauagugcaaugcagaaguguggagggaucguguggauucuag

SEQ ID NO: 5244 - RNA, 534 nt, Artificial Sequence
  Description of Artificial Sequence: Synthetic coding sequence
auggccacugggucccggaccagccuccugcuugcuuucggucuguugugccucccuugguugcaggaggggucggcuuuuccuacuauaccgcucucucguuuauuugacaaugcuaugcuuagagcucauagauuacaucagcuugcauuugacacuuaucaggaauucaaccuugagcuccuccgaaucucccuccuccuuauccagucauggcucgaaccgguacaauuuuugcgcagcgucuucgccaauucucucguuuauggggcgucugauucaaauguuuaugaucuccugaaggaccucgaagaaggaauccagaccuugaugggucggcucgaggauggcagcccuagaacaggccaaaucuucaagcaaacauacuccaaauuugauacaaacucucauaaugacgaugcucuacuuaaaaauuacggauugcucuacugcuuucggaaagacauggauaaagucgagacguuucuuagaaucgugcaguguagaucuguggagggcuccuguggcuuuuag

SEQ ID NO: 5245 - RNA, 609 nt, Artificial Sequence
  Description of Artificial Sequence: Synthetic coding sequence
auggcuaccggguccagaaccuccuuauugcucgccuucggacuacugugccugccuuggcugcaggaagguucugcuuucccaacuauaccacuguccagauuguucgauaaugccaugcucagagcccaucgccugcaccagcuugcuuuugauacguaccaagaauucaacccacaaacaagucugugcuuuuccgaaucuauaccaacacccagcaacagagaggagacgcagcaaaaguccaaccucgagcuucucaggaucucccugcugcucauucagucuuggcuggagccaguucaguuucuucgcucaguauuugccaacucuuuaguguauggcgcuagugauagcaacguguaugacuugcugaaagauuuggaggaaggcauucagacucugaugggccggcuggaagauggauccccacgaacuggucaaauuuucaaacagacauacagcaaauucgauacaaacucucacaacgacgacgcacugcugaaaaauuacggguugcucuacuguuuuagaaaagacauggauaaggucgaaacauuccugagaaucguucagugcagguccguggaaggcuccugcggguuuuag

SEQ ID NO: 5246 - RNA, 771 nt, Artificial Sequence
  Description of Artificial Sequence: Synthetic coding sequence
auggccgccggaucccguaccagucuguuauuggcauucggauuguuaugucugucauggcugcaagaaggauccgcauucccaacaaucccccuuuccaggcuguucgauaacgcgaugcuccgcgcccgcaggcuguaucagcuugcauaugacacuuaucaagaguucgaagaagccuacaucuugaaagaacagaaauacucuuuccugcaaaacccccagacgagucuuuguuucucugaaucuaucccgacacccagcaauagaguuaaaacccagcagaaaucuaaccuugaacuucuccggauuucguuauugcuuauccaguccuggcuugaaccaguucagcuucuuaggaguguguuugccaacagcuugguuuacggugcauccgacuccaacguguaucgacaccugaaagauuuagaagagggaauccagacucucauguggguuaggguugccccuggcauccccaacccuggcgcuccucuggcaucgcgugauuggggagaaaaacacuguugcccgcuguuuuccucucaggcccucacucaggagaauuccccauauucaucuuuuccacugguuaacccaccaggcuuauccuuacagccuggcggggaggggggaaaauggaugaacgaacgaggcagagagcagugccccagcgcauggccauuguugcuguucuugcauuuugcggaagcugggagguggcagccuccugacugggcagaccuucaaucaguguuacaacagguguag

SEQ ID NO: 5247 - RNA, 654 nt, Artificial Sequence
  Description of Artificial Sequence: Synthetic coding sequence
auggccgcaggaucucgaaccagucuguugcuggcauuuggccugcucugucucuccuggcugcaggagggauccgcauuuccuacaauacccuuaucccgacucuuugauaaugcuaugcuccgggcgcgccgucuguaccagcucgccuaugauaccuaucaggaauucgaagaggcuuauaucuugaaagagcagaaguacucauuucuccaaaauccucagacaucuuuauguuuuucagaguccaucccuacucccucuaaccgugucaaaacccagcagaaaucuaaucuggaacugcucagaauuucccuccuacucauacaaucauggcuagaacccguucagcugcucaggucagucuuugcaaacucccuuguguauggcgccucagacuccaacgucuaucggcacuuaaaggaucuagaagaagguauccaaacgcucauguggcggcuggaagaugggagcccccgcaccggacagaucuuuaaccaauccuacucuaaauucgacacaaagucccauaacgaugaugcgcuccuuaaaaacuaugggcuccucuauugcuuccggaaagacauggacaagguggaaacauuucuucgaauagugcagugccggucuguggaaggaucuugcggguuuuag

SEQ ID NO: 5248 - RNA, 609 nt, Artificial Sequence
  Description of Artificial Sequence: Synthetic coding sequence
auggccgccgguagccgcacaucacuucuccucgcuuuugggcuccuuugccucucauggcuacaggagggaagugccuuuccaaccaucccacuaucucgucuguucgacaaugccaugcuuagagcaagacggcuguaccaacuggccuaugauacauaccaggaauuuaacccacaaacuucucuuuguuuuagugaguccauucccacaccaucuaaucgcgugaaaacacagcagaaauccaaccuugaacugcugcggaucagccuacuacuuauucagaguuggcuggagccaguacaauugcuuaggucaguguucgcgaacaguuugguguauggugcuuccgauucuaacguguauaggcaucugaaagaccuggaggagggcauacagaccuuaauguggcgguuagaagacggauccccccgaacgggucagaucuuuaaccaguccuacagcaaguuugauaccaaaucccauaaugacgaugcgcuucugaaaaacuacgggcuguuauacuguuuccguaaagauauggacaaaguugagacauuucuuaggauugugcaaugcaggucuguggagggaucaugcggcuucuag

SEQ ID NO: 5249 - RNA, 738 nt, Artificial Sequence
  Description of Artificial Sequence: Synthetic coding sequence
auggcggcaggcucccguacaucccuccuucucgcguuuggccuccugugccucucguggcugcaggaagggucagccuuuccgaccaucccgcugagccgacuguucgacaacgcaaugcugagggcuagacggcuguaucaacuggcguacgacaccuaucaagaauuugaagaagccuacauucuaaaggaacaaaaguacuccuuucuacaaaacccccagaccucucugugcuuuuccgaaucuauaccuacacccucaaaccgagugaagacccagcagaagaguaaucucgaacuauuaagaaucagucuccuccucauucagucauggcucgaaccagugcaacugcugagguccguguuugcuaauaguuuagucuauggggcuuccgacucaaauguguaucgacaccuaaaggacuuggaggaaggcauccagacauuaaucggcuggaaaauggccgcaccugggcucggcagaucuucaaucuccccuaccgccucucugacccagaaccgaaccacuaugacccauuguucucgaaccacugguugcaguacugccuccgggcgcacuuggacaaggucccgccacucuugcgccagcuguuccgcugcacucuggagagcagccgucgcgucauccuguccuggggguauucccgugacucccccacaguguuuguccuggucuuggaagguccuucuccaauguccacccgccuugucuuag

SEQ ID NO: 5250 - RNA, 753 nt, Artificial Sequence
  Description of Artificial Sequence: Synthetic coding sequence
auggaaaagggaccuguuagggcgcccgcugagaagccaaggggcgcaagauguucaaauggcuuuccagagagagaucccccccgcccagggccaucccggccagcagagaaaccaccccgcccagaagcuaaaagugcccaacccgcggaugguuggaagggagagaggccccggagugaagaggacaacgaacuaaaucugccuaauuuggcugcugcauacuccucgauuuugucaagccugggcgaaaauccacagcggcaaggcuuacugaaaacacccuggagggcugcaucugcuaugcaauucuuuacaaagggcuaucaggaaaccauauccgacguacucaacgaugcuauuuucgaugaagaccacgaugagauggugauagugaaagauaucgauauguucuccaugugugagcaucaucucguaccauucguagggaaagugcacaucggcuaucuccccaacaagcaggugcuaggacugaguaagcuggccagaaucguagagauuuauucacgaaggcuccagguucaagaacgccuuacaaagcagauugcuguggcgauaacggaagcuuugcgccccgcgggugucggcguagugguagaggccacacacauguguauggugaugaggggugugcagaaaaugaauuccaaaacggugaccucaaccaugcugggcgucuuucgagaggacccaaaaacacgggaggaauuucuaaccuugauuagaucauag

SEQ ID NO: 5251 - RNA, 693 nt, Artificial Sequence
  Description of Artificial Sequence: Synthetic coding sequence
auggaaaagggucccguccgcgcucccgcagagaagccccgaggcgcucgauguaguaacgguuuuccagaaagagauccuccccgaccggguccaucccggccugcagaaaaaccuccccguccugaggcuaaguccgcacaacccgcagacggcuggaaaggggagcguccccgguccgaagaagauaacgagcuaaaucugccaaaucuggccgccgcuuacaguucuauccucuccaguuuaggcgaaaacccccagaggcagggucugcugaaaacacccuggagggcggcuagcgcaaugcaguuuuucaccaagggguaucaggaaaccauuuccgacgugcugaaugaugcuauauuugaugaagaccacgacgaaauggugauugucaaggauauagacauguuuucuaugugcgagcaccaucuggucccuuuuguuggcaagguacacauugguuaucugcccaacaagcaaguccuuggccugucuaagcucgcuagaaucguugaaauuuacuccaggcgucugcaaguucaggagcgacucacaaaacagauagcuguugcaaucaccgaggcguuaaggcccgcaggugucgguguaguuguggaagcuacgaaaucaaauaaauacaacaagggccucucauauuucuugcucgcuacuuuuuuguggcaauauuag

SEQ ID NO: 5252 - RNA, 753 nt, Artificial Sequence
  Description of Artificial Sequence: Synthetic coding sequence
auggaaaaagggccaguccgugcccccgccgagaaaccucgcggcgcccgauguucuaauggauuuccugaacgugauccacccaggccuggaccuaguagacccgcagaaaagccucccaggccagaagcuaagagcgcucagcccgcagaugguuggaagggggaaagaccccguucagaagaggauaacgaguugaaucuuccaaaucuggccgccgcuuauucuuccauuuuaaguucccugggcgagaacccacaacggcaaggacuucuuaaaacuccauggcgcgcagcaucugcaaugcaguucuucacaaaaggguaccaagaaacuauaucugacguucuaaaugaugccauuuucgacgaagaucacgaugaaaugguaauugucaaggauaucgauauguucagcaugugcgagcaccacuuagucccauucgugggcaagguucauauuggguauuugccuaauaaacagguucucggccuuucuaaacuagcacggauuguggaaaucuauucaaggcgucuucagguacaggaaagacuuacaaagcagauugccguugcaaucacugaggcccucagaccggcaggcgugggggucguugucgaagcaacucacaugugcaugguuaugaggggcguacagaaaaugaauucuaaaacaguuacuagcacaaugcuuggcgucuuucgggaggaucccaagacucgagaggaauuccuaacauuaauucgaucauag

SEQ ID NO: 5253 - RNA, 642 nt, Artificial Sequence
  Description of Artificial Sequence: Synthetic coding sequence
auggagaaaggccccgugcgagccccugcagaaaaacccagaggagcccgauguuccaacggauuucccgagcgggacccaccaaggccugggccaucucguccagcagagaaacccccacgucccgaggccaagagugcccagccugcagacggcuggaagggagaaagaccuagguccgaggaggacaacgaacugaaucugccuaaccuggcugcugccuacucauccauacuuuccucacuuggagaaaacccacagagacaaggccugcugaaaacaccuuggagagcugccuccgcuaugcaauuuuucacgaagggauaucaggagacaaucagugauguguugaacgacgcaaucuucgacgaagaucacgacgagauggugaucgugaaagauaucgauauguuuucaaugugcgaacaucaccuggugccauuugucggcaaagugcacaucggauaucuaccuaacaaacagguucucggacugagcaaacuggcgcguauugucgaaaucuauagcaggcgacugcagguucaggaaagguugaccaaacaaaucgccguggccauaaccgaggcgcucaggccagcugggguuggggucgucgucgaagcaacuagugcugagccauag

SEQ ID NO: 5254 - RNA, 702 nt, Artificial Sequence
  Description of Artificial Sequence: Synthetic coding sequence
auggaaaaggguccagugagagcuccagccgagaaaccacggggcgcccggugcaguaauggauuucccgaacgcgauccaccgcggccuggcccaucaagaccggcagaaaagccaccucguccggaagcuaagagcgcccagccugccgauggcuggaaaggagagcgaccacggucugaagaagacaaugaacugaaccugcccaaucuugccgccgccuauucaucuaucuugagcucucugggugagaauccccaacggcagggccugcugaaaacaccauggcgagccgcuagugcuaugcaguuuuucacuaagggcuaucaagaaaccaucagcgacguccucaacgaugcgaucuuugaugaagaccacgacgaaauggugaucgugaaagauauugacauguucuccaugugcgagcaccaccucgugcccuuugucggaaagguucacaucggauacuugccuaauaaacaggugcugggcuuaaguaagcuugcccgcauagucgagauauauucaagaaggcuccaaguccaagaaagguuaaccaaacaaaucgcuguggcuaucaccgaagcacuccguccugccgguguuggaguuguuguugaggccacuaagaguaauaaauacaauaaaggacucucucccuuacuuuccucaugucacuuguuuguugccauuuugaaauag

SEQ ID NO: 5255 - RNA, 1281 nt, Artificial Sequence
  Description of Artificial Sequence: Synthetic coding sequence
augggcgagcccggacaaagcccauccccuaggaguucacauggcagcccuccgacacuuagcacauuaaccuugcugcugcugcugugcggucacgcacauucucagugcaaaauuuugagauguaacgcggaauaugucucuaguacacucucucugcgggggggcggguccucuggagcccugagagggggaggaggaggugggcgcggaggcgguguugguuccggcggguuaugucgggcgcugagaagcuacgcgcuguguacacgccguacugcuagaacuugucgaggagaccucgcauuccauagcgcugugcacggaauugaggaucuaaugauccagcauaacuguucccgucagggaccaacugcacccccaccaccacgugguccagcucuccccggcgccggauccggucuuccugcgccugaccccugugauuacgagggcagauucagucgccuccacggacguccuccaggguuccuccauugugccuccuuuggcgauccacacguacgcucauuccaccaucauuuccacaccugucgcgugcagggugcguggccucuccucgauaacgacuuucucuucgugcaggcaacuucuuccccaauggcccucggagccaaugcuacagcgacaaggaaguuaaccaucauuuuuaaaaauaugcaggaaugcaucgaucaaaaggucuaccaagcugaaguugacaaucuacccgucgcauuugaggacgguucaauaaauggcggagaucgcccuggcgguaguagccucaguauucagaccgcaaaucccggaaaucacgucgagauccaagcugcuuacaucggcacaacuaucaucauaagacaaacugccggucagcugucuuuuucuaucaaaguggcagaagacgucgcaauggcauuuucugccgaacaggaccugcaguuaugcgucggcggcugccccccaagucagcgacuuagucgguccgagcgcaaucggagaggagccaucaccaucgauaccgcacggcgccucuguaaagaaggucucccuguggaggacgccuauuuccauaguuguguguuugauguacuuauuagcggggauccuaauuuuaccgucgccgcgcaggccgcacucgaagacgccagagcauuccugcccgauuuggagaaacugcaccuuuuucccuccgacgccggcguaccuuugucuagugcaaccuuacuugcaccacuuuuaagcggccucuuuguccugugguuauguauucaguag

SEQ ID NO: 5256 - RNA, 942 nt, Artificial Sequence
  Description of Artificial Sequence: Synthetic coding sequence
augauacaacauaacugcucucgccagggcccaacugccccccccccuccucgagguccagcacugccuggcgcuggcucgggcuugccggcuccggaucccugcgacuacgagggucgguucucaagacugcacgggaggcccccaggauuucuacacugcgcgucauucggagauccacacguccgguccuuccaucaccauuuccauacuugucggguucagggcgcuuggccauugcuugauaacgacuuucuguuuguacaggccacuucaaguccuauggcccuaggagcuaacgccaccgcuacuagaaaacuuacgauuauuuucaaaaauaugcaagaguguauugaccagaaaguuuaucaggccgaaguagauaaccugcccguagccuuugaagauggaucaaucaauggcggugaucgccccgguggaaguucacucagcauccagacugcaaacccuggcaaucacguggagauccaagccgcguacauugggacaacuaucauuauccgucagaccgcaggacagcuuagcuucucgaucaaggucgcggaggauguggcaauggcuuuuagcgcagagcaggaccugcaguugugcgucggcggaugcccccccucccaaaggcugagcagaagcgagcggaacagacguggagcaauaaccauagacacggcccgccggcugugcaaggagggccuucccguugaggacgccuacuuucauuccuguguuuuugauguacugauuagcggggacccaaacuucacaguggccgcccaggcagcacucgaggaugcacgagcuuuccuuccugaucuugaaaaguugcacuuauuccccagugacgcuggagugccccucagcucagcaacacuguuggccccucuccuuuccggucuguuugugcugugguuauguauccaauag

SEQ ID NO: 5257 - RNA, 282 nt, Artificial Sequence; identical to SEQ ID NO: 4927
  Description of Artificial Sequence: Synthetic coding sequence

SEQ ID NO: 5258 - RNA, 603 nt, Artificial Sequence
  Description of Artificial Sequence: Synthetic coding sequence
augcaggaauguaucgaucagaaaguuuaucaggccgaaguagauaaucugccugucgcauucgaagacggaucuauaaaugguggagauaggccaggggguaguagccucucuauucagacugcuaaucccgggaaucacguggaaauucaggcugcguauaucggaacaacaauuaucaucagacagaccgcgggccagcugucauucucuauuaagguggcugaggauguggcuauggcauucucugcugaacaggaccuccaguugugcguagguggauguccucccagccagaggcuauccagauccgaaagaaacaggaggggugccauuaccauugauacagcucggcgauuauguaaggaaggucugccuguggaggaugccuauuuucauuccuguguauucgacgucuuaaucaguggcgacccuaacuucaccguagccgcucaggcagcucuggaagaugcaagggcauuccugccugaccuggaaaaauuacaccuguuucccagcgaugcuggcgucccccuaagcuccgccacacuauuggcuccacugcucagcgggcuguucguucuauggcuauguauacaguag

SEQ ID NO: 5259 - RNA, 603 nt, Artificial Sequence
  Description of Artificial Sequence: Synthetic coding sequence
augcaggaguguaucgaucaaaagguguaccaggcagaagucgauaacuugccuguggcuuuugaagacgggucuauuaacgggggcgauaggccaggcggaaguagccugaguauccaaacugcgaacccugggaaccaugucgagauucaagcugcuuacauaggaacaaccaucaucaucagacaaaccgcuggacagcugagcuuuucaaucaagguugcagaggauguggccauggcauuuucugccgagcaggaccuucaauugugcguggggggauguccaccuucucaaagauuaucgagaagugagcgaaacagacgaggagccauuacgaucgauaccgccaggcgccuaugcaaagaaggccugccuguagaggaugcuuacuuucauucuugcguuuuugauguucugaucuccggugauccuaacuucacgguugcugcccaggcugcucuugaggacgcccgagcauuucucccagauuuagagaaguugcaccucuuuccaucugacgccggaguuccacuguccuccgcuacacugcuugccccucugcugagugggcuauucguguuauggcuuugcauacaguag

SEQ ID NO: 5260 - RNA, 1422 nt, Artificial Sequence
  Description of Artificial Sequence: Synthetic coding sequence
auggccgucauggcuccucgcacgcucgugcuccuacucuccggcgcucuggcucugacucagacaugggcggaaguccaacucguagaaagcggcgguggccucguccaaccugguggaagucugcgguugagcugugcagcaucaggguucaauaucaaagauacauacauccauuggguccgucaggcuccugguaaggguuuagaguggguggcccgaauuuaccccacaaacggauacacaagauacgcugacucugugaaagggagauucacaaucuccgccgacacuaguaaaaacacagcauaucuccaaaugaacucuuugcgagccgaggauacagccguguacuauuguucccggugggguggcgacggcuuuuaugcaauggacuauuggggucaaggcacucugguuacagugucuuccgccuccacuaagggccccuccguguuuccucucgcucccagcucuaaaagcacaucgggcggcacugcggcucuaggcugccuugugaaggauuacuuccccgaacccgugacagucucuuggaauagcggcgcguugacuaguggagugcacacguuuccugcgguccugcagucauccggccuauacucccugaguucuguagugacagugcccucgaguaguuuagggacccagacguauauuuguaaugugaaucauaaacccuccaacacuaaaguagacaaaaagguagaaccaaaaaguugugauaagacucacacauguccccccugccccgcaccagagcugcugggcggucccucugucuuucuuuuuccccccaagcccaaggauaccuugaugauuucuagaacaccagaagugacauguguggugguggacgucucccaugaagacccagaagugaaguuuaacugguacguggauggcguagaagugcauaacgcgaagacaaaaccuagggaagagcaguauaacucuacuuauagaguggucucagugcugacagugcuccaccaggauuggcuaaacggcaaggaauauaaguguaaagucuccaacaaagcccucccagcacccaucgaaaaaacaauuagcaaagcuaaagggcagccaagagaaccacaggucuauacucucccgccaagcagagacgaacuuaccaaaaaucaggucucucuuacuugucuagugaaaggcuuuuaccccucagacauugcggucgaaugggaaucgaacggccagccugagaacaacuacaaaacuacaccuccugugcuugauuccgaugguucauuuuuucuauauuccaaacugacgguggauaagucuagguggcaacaaggaaauguguuuagcugcagcguuaugcacgaagcacugcauaaucacuacacccagaaaucacuuucccugucuccaggauag

SEQ ID NO: 5261 - RNA, 717 nt, Artificial Sequence
  Description of Artificial Sequence: Synthetic coding sequence
auggccguuauggcuccgcggacucucguguuguugcugucuggugcucuugcucuaacgcagaccugggcagauauacaaaugacacaguccccauccagucuuucagcaagcgugggggaccggguaacuauuacgugucgggccagucaagauguuaacacagcugucgcgugguaccagcaaaaacccggaaaagcccccaaacuguuaaucuacucagccucuuuuuuguacuccggaguacccagucguuucuccggcucacgauccggcacugacuuuacgcugacaauuagcagccuccagccugaggacuuugccaccuacuauugccagcaacacuauacuacaccacccacauucgggcaaggaacaaaggucgaaauuaaacggacaguugccgcccccagcguauuuaucuuuccccccagcgacgagcagcuuaaaucuggaaccgcaucugugguuugccuacugaacaacuucuacccaagggaggccaagguacaguggaaaguagacaaugccuuacaguccgggaacagccaggaaagcgugacggagcaagauucaaaggacucuaccuauucccugagcucuacacuuacucugagcaaagcagauuaugagaagcauaaagucuaugccugugaaguuacacaccaagguuuaucgagcccagucaccaaaucguuuaauaggggggaaugcuag

SEQ ID NO: 5262 - RNA, 657 nt, Artificial Sequence
  Description of Artificial Sequence: Synthetic coding sequence
auggccacaagauccccaggcguaguaaucucugacgaugaacccggauaugaucuggaccuuuucuguauaccaaaccacuaugcagaagaccuggagagaguuuuuauaccacauggacugaucauggaucgaacagaaaggcuggcucgagacgugaugaaagagaugggagggcaccacauaguugcucucuguguguuaaaaggagguuauaaguucuuugcugaccugcucgauuacaucaaggcguuaaaucgcaacucugaccgcagcaucccgaugacugucgacuuuauccggcucaaauccuauuguaacgaccagaguacaggagauaucaaagugaucggcggugacgaucucucuacacuuaccggcaagaacgugcucauuguugaggacauuauugacaccggaaaaacuaugcagacauuacuuagucuugugaggcaguacaauccgaagauggugaaaguagcuuccuuacuugucaagagaacacccagauccguaggcuacaaaccagauuuuguuggcuuugaaauuccggacaaauuuguggucggcuacgcucuggacuauaaugaauauuucagagaccugaaucauguguguguaaucucugaaacuggcaaagcaaaauauaaggcauag

SEQ ID NO: 5263 - RNA, 657 nt, Artificial Sequence
  Description of Artificial Sequence: Synthetic coding sequence
auggcuacucggucacccggugugguuaucucagacgaugagccuggauacgaucuugaucuguucugcauaccaaaucacuacgcggaggaccuggagagaguguuuauuccacaugguuugauuauggacagaacugagcggcuggcccgggacguuaugaaagaaaugggcggccaucacauaguggcacuuuguguccuuaaaggcggcuauaaguucuucgccgaucugcuagauuauaucaaagccuuaaauagaaacagcgaccguucgauacccaugacuguugauuucauucgccugaaguccuauugcaaugaucagaguacgggcgacaucaaggucaucggcggagaugaucugucuacacugaccggaaaaucaaggcugcuggcagaagauauuauugauacggguaagacuaugcaaacacuccucucuuuagugcgacaauacaacccuaaaauggugaagguugcuagucuccuggugaaacguacgccucggagcguagguuauaaaccugauuucguuggcuucgaaauuccugauaaguuugugguuggguacgcguuagauuauaacgaguauuuccgggacuuaaaccacguauguguaauuagugagacugggaaagcgaaauauaaggcauag

SEQ ID NO: 5264 - RNA, 1653 nt, Artificial Sequence
  Description of Artificial Sequence: Synthetic coding sequence
augccuccuccacgcacuggcaggggacuguuguggcugggucuaguucugaguucuguaugcguagcacucggaucagaaacacaggccaacucaacuacugaugcccuuaacguccugcugauuauuguggacgacuugcggcccagccuaggguguuacggagacaaacugguaaggucacccaauauagaucaauuagcaucccacucucucuuguuccagaaugccuuugcccaacaagccgugugcgccccauccagaguguccuuuuugaccggccgucgccccgauaccacacgacuauacgauuucaauucauauuggcgcguacaugccgggaauuucaguaccaucccgcaguacuucaaagagaauggauacguaacaaugaguguugggaagguuuuucacccagggauuucaaguaaccacacugaugacuccccauauaguuggagcuucccuccuuaucacccaucaagcgaaaaguacgagaacacuaaaacaugucguggacccgauggugaacuccacgcaaaccucuuguguccaguggacguccuagauguaccugagggaacauuaccugacaaacagucaacagaacaggcaauacagcugcuugaaaagaugaagacaagugcaucccccuucuuucucgccguaggcuaucauaagccccacauuccguuucgguacccgaaggaauuucaaaagcuguacccuuuagagaacauaacccucgcccccgauccugaaguaccagauggccugccucccgucgcuuauaacccauggauggauauccgccagcgcgaagauguccaagcacucaauauuagcgugccuuauggcccuauccccguagauuuccaacgcaagauacgucagucauauuucgccucuguguccuaucuugauacacagguagggagacuacuuuccgcacuagaugacuugcaacucgcuaacuccaccauuauagccuuuacaagugaccacggcugggcccugggagagcauggcgaaugggccaaauacucgaauuucgaugucgccacacacgugccauuaauuuucuacgugccaggacguacugccucucuccccgaagccggagaaaagcucuuccccuaccuggaccccuuugacagcgccucgcaacugauggaacccgggcggcaaaguauggauuugguggagcugguguccuuauuccccacacucgccggacuugcugggcugcaggugcccccaagaugccccguuccuaguuuccacguggagcuaugcagggaggggaaaaacuuacugaaacacuuccgauuuagggaccuugaggaagaccccuacuuacccgguaacccaagagagcuaauagcauauucacaguauccgcgaccauccgauaucccacaauggaacuccgauaaacccucucugaaagacaucaagaucaugggcuacucaauccgcacaaucgacuauagguacacugugugggugggauuuaacccagaugaauucuuagcaaacuuuucugauauucaugcaggagaauuauacuuugucgauuccgauccucuccaggaccacaacauguacaacgauagccagggcggcgaucucuuucaauuacucaugccguag

SEQ ID NO: 5265 - RNA, 1032 nt, Artificial Sequence
  Description of Artificial Sequence: Synthetic coding sequence
augccaccacccagaaccggccguggacuguuaugguugggacuggugcuaucauccguguguguggcccuggggucugaaacccaagcaaauaguaccacugaugcucugaacgugcuauuaauuaucguagaugaccuaagaccaagucugggcuguuauggggacaagcuagugcgcucaccaaacauagaccaacuagcaagucauucucuguuauuucagaacgcuuuugcgcagcaagcagugugugcaccaucacgggugagcuuucugacaggucgacgaccagacacaaccaggcuuuacgauuucaacucuuauuggcguguccacgcuggcaauuucagcacuauuccucaauauuucaaagaaaauggcuacgugaccaugagcgugggcaaaguguuucacccugguauaagcucaaaccauacugaugacucccccuacuccugguccuucccuccguaccacccaaguucugaaaaauaugaaaacaccaaaaccugcaggggacccgacggugaguugcacgcgaaccuucucugcccugucgauguauuggacguacccgaagggacuuuacccgauaagcagagcaccgaacaggccauccagcuccuugaaaaaaugaagaccagugcuagcccauucuuucucgcaguuggcuaucacaagccacacaucccuuuccguuaccccaaagaguuccagaaacuguauccguuggagaauaucacucuggcuccugauccagaagugccagacggucuccccccagucgcauauaacccuuggauggacauuaggcaacgugaggacguucaggcucucaacaucagcgugccauacgguccgaucccugucgacuuccagcguaagauuaggcaguccuacuucgccuccguuucauauuuggacacacagguuggccgacuccucagugcucuggacgaucuacaacuggcuaauucaacaauuaucgccuucacuagugaccaugguuuccuuaugcgcaccaacaccuag

SEQ ID NO: 5266 - RNA, 939 nt, Artificial Sequence
  Description of Artificial Sequence: Synthetic coding sequence
augccaccgccccggacuggcagagggcuucuguggcugggucucgugcuuaguuccguguguguggcucucgguagcgaaacucaggccaauuccacaacugacgcccugaauguccugcucauuaucgucgaugaucugcgcccaucacugggaugcuacggugauaaauuagugcgguccccgaacaucgaccaguuagcuagccacucccugcucuuucagaacgccuuugcacagcaagcaguaugugccccuucccggguaucuuucuugacgggacgccgcccugauacaacuaggcuauacgacuucaacucuuauuggcgcguucacgccggcaacuuuuccacuaucccacaguauuuuaaagaaaacggcuacguaacuauguccgucggcaagguguuucacccuggaaucucaaguaaucauacugacgauaguccguauuccuggucuuuuccacccuaccacccuuccagugaaaaguacgaaaacacuaagacuugcagaggcccugacggagaacuccacgcuaaccuguuaugccccguugacgugcucgaugugcccgaggggacccuuccugauaaacaaagcacagaacaggcuauccagcuucuugaaaagaugaaaaccagcgcuagcccuuuuuuccucgccgucggcuaucauaaaccacauaucccauucagauaccccaaagaauuucagaaacuguauccacucgagaauaucacccucgccccggaccccgaggugccugacggucucccucccguugcuuauaacccuuggauggauauuagacaaagagaagaugugcaagcauugaacaucagugucccuuauggcccgauucccguggauuuccaagaagaccaguccucaacuggauucagacucaagacaagcagcacuagaaaauacaaguag

SEQ ID NO: 5267 - RNA, 540 nt, Artificial Sequence
  Description of Artificial Sequence: Synthetic coding sequence
augccucccccgagaaccggacgcggacuccuguggcuugggcucguucucuccuccguuugcgucgcacuuggcucugaaacucaggcuaauucuaccacugacgcccugaauguccuguuaaucauuguggaugaucuacgacccucacucggcugcuauggcgauaagcugguacgcucaccuaacaucgaccaguuggccagccacagucuccucuuucagaaugcauuugcccagcaggcuguuugugccccgucucgggugucuuuccucacuggccgccggcccgacacaacaagacuuuacgacuuuaauucuuacuggcgggugcacgcaggaaauuucagcacuaucccacaguacuucaaagagaacggcuacgucacaaugucaguuggcaaaguguuccaucccggaacugcuccgugccccgaguccggguuuucaugguuuguggugucagagucaaguauacccauccuaggcauggguuugucccugcaaucaccacuguuggccgggcgggugccaagguag

SEQ ID NO: 5268 - RNA, 261 nt, Artificial Sequence; identical to SEQ ID NO: 4938
  Description of Artificial Sequence: Synthetic coding sequence

SEQ ID NO: 5269 - RNA, 462 nt, Artificial Sequence
  Description of Artificial Sequence: Synthetic coding sequence
auggaucuggucgagcucgucucucuguucccaacccuggccgggcuggccggacuccaggugccuccucgaugccccguaccaaguuuucacguugagcugugccgagagggaaaaaacuugcucaaacacuuccgguucagagaccuggaagaagauccuuaccuccccggcaauccccgcgaacucaucgcauacucucaguauccucggccauccgacaucccgcaguggaacuccgauaaacccucauugaaagauaucaagaucaugggauauucaauucgaacaauugacuaccgcuauacuguauggguugguuuuaaucccgacgaguuuuuagccaauuuuucagacauucaugccggcgagcuguauuucguagauucugacccuuugcaggaccacaacauguauaaugauagccaggguggugaucuauuccaacugcugaugcccuag

SEQ ID NO: 5270 - RNA, 1020 nt, Artificial Sequence
  Description of Artificial Sequence: Synthetic coding sequence
augaagaccucugcauccccuuuuuuccuagcaguuggauaccacaagccacacauuccauucagauacccaaaagaauuucagaagcuguacccgcuggaaaauaucacacuugcaccugauccugaaguaccggauggucugccccccgucgccuauaauccguggauggauauucggcagcgugaggauguacaagcacucaauauuuccguuccauacggcccuaucccugucgacuuccagagaaaaaucagacagucauacuuugccagcguuucuuauuuagacacccagguuggccgccucuuguccgcccuugacgaccugcaacuggccaacucuacaauuaucgccuucacuagcgaucauggcugggcccugggggaacacggagagugggcaaaguauucaaauuucgauguggcgacccaugucccccugauuuucuacguacccggacggacugcuuccuugcccgaagcaggcgaaaaauuguuucccuacuuagacccuuucgacuccgcuucacaacuuauggaacccgggagacaauccauggacuugguggaauugguuucucuguucccaacgcucgcgggacuggcaggacuccagguccccccacgaugucccgugccgucauuccacguugaacuuuguagagaaggcaagaauuuacuuaagcacuuccgcuuucgcgacuuagaagaagaucccuauuuaccaggcaacccaagggagcugauagcauauucccaguauccgcgcccaagcgauaucccucaauggaacagcgacaagccuagucugaaggacaucaagaucaugggcuacuccauccgcaccauugacuacagguacaccguguggguuggcuuuaacccugacgaauucuuagcaaacuuuuccgauauucacgcgggagaacuuuacuuugucgacagcgacccucuucaagaccacaauauguacaacgauucccaaggcggugauuuguuucagcugcucaugcccuag

SEQ ID NO: 5271 - RNA, 1962 nt, Artificial Sequence
  Description of Artificial Sequence: Synthetic coding sequence
augcggccccucagaccacgcgccgcacucuuggcucuccucgcaucccuccucgcugccccucccguugccccggcagaggccccucaucucguucacguagaugccgcccgugcccucuggccauuacgaagauucuggcggucaacuggguucugucccccccugccucacucacaggcugaucaguauguauuauccugggaccagcagcugaaucuagcuuaugugggagccgucccacaucgggggaucaaacagguucgaacccacuggcugcuggagcuaguaacaacccgcgggucaaccggucgagggcucagcuacaacuuuacacaucucgacggguaucucgaucuucuccgggaaaaucagcugcugcccgguuucgagcucauggggucugcguccggacacuucaccgacuuugaggacaagcagcaagucuucgaguggaaggauuugguuaguucucuggcuagacgauacauaggcagguacggacucgcacacguaucuaaauggaauuuugaaaccuggaaugaacccgaucaccacgacuucgacaacguuucaaugacuaugcaggguuucuugaauuacuaugaugccugcagcgagggauugcgcgcagcuagcccagcccuucgucugggcggccccggagauucguuucauacccccccacgaagcccucugaguuggggccucuuaagacacugccacgacggcaccaacuucuucacaggggaggccggaguaagacucgauuauauuagucuacaccguaagggcgccagaucuaguaucagcauccuugagcaggagaaaguaguggcccagcagaucagacaacuguuucccaaguucgcagacacuccuaucuacaacgacgaagccgacccacuggucggauggagccucccucaaccauggagggccgaugucaccuaugcugcaaugguuguuaaggucauagcucagcaccaaaauuugcucuuagccaauacaaccuccgccuuccccuacgcucucuuguccaacgacaacgccuuucucagcuaucauccacaucccuuugcccaaagaacauugacagcaagguuucaggugaauaauacacgacccccccacguacaauugcuucggaaaccuguguuaacggccaugggacuguuggcacuacuugacgaggagcaguuaugggccgaaguuagucaagcgggcaccgugcuggacagcaaccauacuguuggcguucuggcauccgcucaccgaccgcaggguccugccgaugccuggagagcugcuguuuugauuuaugcuagugaugauacacgagcccacccuaauagguccgucgcuguaacccugcggcugagagguguccccccuggaccuggucucguauauguaacccgguaucuugacaacggacucuguucacccgauggcgaguggaggcgacuggggcgucccgucuucccgacagccgagcaauuuaggcgcaugcgcgccgcugaagacccuguugcagcugcaccucgaccgcucccugccggaggcaggcuuacccuucgaccagcccugcgacugccaagucuccuccugguucaugugugcgcacgcccagagaagccuccaggacaggugaccaggcugagggcucucccuuuaacacaaggccaguuagugcuuguuugguccgacgaacauguaggcucgaaaugcuuguggacauacgaaauccaauuuagccaggaugggaaagcauauacaccaguuagccgcaagccaaguacauucaaucuguuuguuuucagucccgauaccggcgccgucucgggcagcuaccguguaagggcacucgauuauugggcucguccaggcccuuucuccgauccugucccguaccuggaaguccccguuccacguggaccccccucucccggcaaccccuag

SEQ ID NO: 5272 - RNA, 2028 nt, Artificial Sequence
  Description of Artificial Sequence: Synthetic coding sequence
augagaccauugagacccagagcagcgcuuuuagcccugcuggcaagccugcuugcagcuccaccagucgcccccgccgaggcuccucauuugguucacguggacgcagcucgagcacuuuggccauugcgaagauuuuggcgcucuacaggauucuggggcagcacagguaggggccucucuuauaauuuuacacaccuugacgguuaucucgaccuccugagagaaaaucaguuguugccugguuuugaguuaauggggucggccuccggacauuucacagacuuugaagacaagcagcagguguuugaguggaaggaccuaguuuccagccuggcaagaagauauauugggagauauggacuagcccacguaagcaaauggaauuuugagaccuggaacgagccggaucaccaugacuuugauaauguuucaaugacuaugcagggcuucuugaauuauuaugaugcguguucggaagggcuucgggccgccucacccgcucucagacuuggggguccuggggacucguuucacacacccccccgcuccccuuuaucuuggggccuucugcgucauugccaugacgggacaaauuuuuucaccggcgaagcugggguccgguuggacuauauuucauugcauaggaaagugaggcccgcccccccaagcgccccaguguucugcgcucuuucccguugugcccccggaagagcagaucccggaggagccgaggccgcaccacccgcaggcugcgcccagcugcacuugcaucccggggccggcgaagguagaagagcagccgacccagccgcccuuccucagguacguggacacccacaucugcagcgacgaggcggaccugcaggcggacucguccccgccaccgcaguagagggcggcagagaucuucggggccauggcggggaagguggccccgcucagcgcccugcaaggccccccgccacauuccuuccacgccgagaucgccgugccguggcagccccccccggcccuuccugucccggacauccccagguaaucgcucaacaccagaaucugcugcuugccaacaccacaucugcauuuccuuacgcucugcucaguaaugacaaugccuuucuguccuaccacccucacccuuuugcacagcgaacccucaccgcccgauuucaaguuaauaacaccaggccaccucacgugcagcuacucaggaagccaguucugacugcuaugggucugcuugcauuguuagaugaggaacagcuaugggccgaggugucccaagccggcacaguacuggauaguaaucacaccgugggcguuuuagccuccgcucauaggccucagggaccugcugacgccuggcgcgccgccgugcuuaucuaugccagcgaugauacccgagcucauccuaacagaucuguggccgugacucucaggcugcguggugucccacccggcccuggccuuguuuacguaacccgguaccucgacaaugggcuguguuccccagacggcgaguggagaaggcuugggcggcccgucuuucccacggcugaacaguuccggaggaugagagccgccgaggacccggucgcagcagcgccacgcccacugcccgccgguggaaggcuaacacugagacccgccuuacgacuacccucgcugcuccuuguucacgugugugcucgcccugaaaaacccccaggacaagucaccagacucagggccuuaccucucacccagggccagcuagugcuuguguggucagaugaacauguuggaucuaagugcuuguggaccuacgagauucaguuuucucaggaugguaaggcuuauaccccggucagccgaaagcccuccacuuuuaaucuguucguauucagccccgacacuggugccguaucaggcucauaucgaguaagagcucuggacuauugggcccgccccggccccuucuccgaucccguaccauaccuagaaguucccgugcccagaggaccacccagccccgguaaucccuag

SEQ ID NO: 5273 - RNA, 603 nt, Artificial Sequence
  Description of Artificial Sequence: Synthetic coding sequence
auggcucuguggaugcgcuugcucccucuccuagcccuuuuagcacuuuggggccccgaccccgcagcggccuucgugaaccagcaucuauguggaagccaccuuguggaggcccuguaucucgucugcggcgaacgaggcuuuuuuuauacaccuaagacaagacgggaggccgaggaucugcaggcuuccgcacugucgcucuccaguagcaccucgacuuggccugaaggucuggaugccacagccagagcucccccugcucuagucguuaccgccaauauuggacaagccggcgggucgucguccagacaauuucggcaacgcgcacucgggacuucugauaguccgguguuauucauccauuguccgggugcggccggaacugcccaaggucucgaauaccgcgguagacgugucacaacugaguugguaugggaagaaguugauuccuccccacagccucaagguuccgaaucccucccugcacagcccccugcccagccagcuccacagccggagccacaacaggcccgagagcccuccccugaagugucuuguugcggccuguggcccagaaggccccagagaucccagaauuag

SEQ ID NO: 5274 - RNA, 333 nt, Artificial Sequence
  Description of Artificial Sequence: Synthetic coding sequence
auggcucuguggaugagacuguugccgcugcuggcucuccucgcuuuguggggcccggaucccgcugcagcuuucguuaaccagcauuuauguggaucacaccugguggaggcccuuuaccuugucugcggggaacguggauucuuuuauacaccaaaaacuagacgagaggcugaggaucugcaggugggacagguagaacugggcggagguccaggcgcaggcuccuugcaaccgcuggcucuggaagguucacuacagaagaggggcaucguagagcagugcuguacuucgauauguucccuguaucagcuugaaaauuauuguaauuag

SEQ ID NO: 5275 - RNA, 333 nt, Artificial Sequence
  Description of Artificial Sequence: Synthetic coding sequence
auggcccuuuggaugcgccuguugccgcugcuggcacuuuuagcucuguggggaccugauccagccgcagcguuuguuaaucagcaccugugcggcagccauuugguggaagcccuuuaccucguaugcggcgagcguggauuuuuuuacacaccuaaaaccaggagggaggccgaggacuuacagguaggccaggucgaacucggaggcggcccaggggcagguagucugcagccacucgcccucgaaggaaguuuacagaaaagagggaucgucgaacaguguuguaccuccaucuguucucuguaucagcucgaaaacuacuguaauuag

SEQ ID NO: 5276 - RNA, 333 nt, Artificial Sequence; identical to SEQ ID NO: 4946
  Description of Artificial Sequence: Synthetic coding sequence

SEQ ID NO: 5277 - RNA, 297 nt, Artificial Sequence; identical to SEQ ID NO: 4947
  Description of Artificial Sequence: Synthetic coding sequence

SEQ ID NO: 5278 - RNA, 333 nt, Artificial Sequence
  Description of Artificial Sequence: Synthetic coding sequence
auggcacuuuggaugcggcuacuuccguuacuggccuuacuagcucuuuggggaccagauccagccgcggccuucguuaaccaacaucuguguggcucacaccuagucgaagcccuuuaucuggugugcggggaaagaggauucuuuuauacugauaaaacccggagagaagccgaggaccugcagguaggacaaguggagcugggcggaggccccggagcagggucccuacagccucuggccuuagaggggucguugcaaaagagaggcauaguggaacaguguugcacuagcauauguucucucuaucagcucgaaaacuacuguaacuag

SEQ ID NO: 5279 - RNA, 333 nt, Artificial Sequence
  Description of Artificial Sequence: Synthetic coding sequence
auggcccuauggaugaggcugcucccacuccucgcccuacuugcacuuuggggaccagauccagccgccgccuucguuaaucagcaccugugcggcucucaccucguugaagcucucuaucucgugugcggggaacgugguuuuuucuauacuccaaagacacgucgggaagccgaagaucugcaggucggucaaguagaacugggcgggggaccaggggccggaagucugcagccucuugcccuagagggaagcuugcagaagagaggcauaguggaacaguguugcaccaguaucuguucguuauaccaacucgagaacuauugcggauag

SEQ ID NO: 5280 - RNA, 333 nt, Artificial Sequence
  Description of Artificial Sequence: Synthetic coding sequence
auggcacuuuggaugaggcugcucccauuacuggcucuacuggccuuguggggacccgaucccgcagccgcauuugugaagcagcaucugugugggagucacuugguugaggcccuguaucucgugugcggcgaaaggggauucuucuauacccccgaaacccgaagggaggcagaagacuugcaggucggacagguugaguugggagguggacccggugcuggaucccugcaacccuuggcccuggaaggaagccugcaaaagagggggauuguggagcagugcugcaccucgauuuguagucucuaccagcucgaaaacuauuguaauuag

SEQ ID NO: 5281 - RNA, 333 nt, Artificial Sequence
  Description of Artificial Sequence: Synthetic coding sequence
auggcccucuggaugcgccugcuucccuugcuugcuuuguuagcacuguggggaccagaucccgccgccgcauucguuaaccagcaccuaugugguucacaucugguggaagcccucuaucuugucugcggggagaggggcuuuuucuauacgaagccaaccagaagagaagcagaggacuuacaggugggucaggucgaauuggguggcggcccaggcgccgguucuuugcaaccgcuugcacucgaaggcucucuccaaaagcgaggaaucguggaacagugcuguacaucuauauguucccuguaucagcucgagaauuauuguaauuag

SEQ ID NO: 5282 - RNA, 570 nt, Artificial Sequence
  Description of Artificial Sequence: Synthetic coding sequence
auggccuuaucuuucucacuacuaauggccgugcuggugcuuucuuacaagucuauuugcucccucggaugugaccucccacagacgcacucccuugguaaucgacgagcacugaucuuauugggacaaaugggccggaucagccccuuuuccugucuuaaagaccgccaugauuucagaaucccacaggaagaguucgacgguaaccaauuccagaaggcccaggcgaucucuguacuucaugaaaugauacagcaaaccuucaaucuuuucuccacagaggauucgucugcugcaugggagcagagucuccuggagaaauucagcacugagcuuuaccagcagcuuaaugaccuugaagcaugugucauccaagagguuggcguugaagagaccccucuuaugaacgaggauaguauauuggcugugagaaaguacuuccaacggaucacccuguaucucaucgagaggaaauauagcccaugugccugggaagugguacgagccgaaaucaugcguagucucucauuuucuacgaaccugcaaaaacggcuucgcagaaaggauuag

SEQ ID NO: 5283 - RNA, 573 nt, Artificial Sequence
  Description of Artificial Sequence: Synthetic coding sequence
augauggccagccccuuugcucuccuuauggcacuugucgugcugucuugcaaaucuuccuguucccugggcugcgaccugccugaaacgcauucucucgacaaucggcgaacucucaugcuucuugcucagaugucucggauaucccccagcuccugcuuaauggaucggcacgacuucggcuucccccaagaagaguuugacgggaaccaguuucagaaagcccccgccauuuccguccugcacgagcuuauccagcaaauuuucaaccucuuuacgacuaaagacucuuccgccgcaugggacgaggaucuauuggacaaguuuugcaccgaauuauaccagcaacuaaaugacuuggaggcuuguguuaugcaagaagagcgugugggagagacgcccuugaugaaugcugauucuauccuggcugugaagaaauacuuucggagaauuacucuauaucuaacugaaaaaaaguacagccccugcgccugggaaguugucagagccgagaucaugcgaucccugagccucagcaccaaccuccaagagcggcugcgcagaaaggaguag

SEQ ID NO: 5284 - RNA, 570 nt, Artificial Sequence
  Description of Artificial Sequence: Synthetic coding sequence
auggcucugcccuuugcccucaugauggcccugguuguacugaguuguaaaaguucauguuccuugggauguaauuuaagccagacgcacucucucaauaauagaaggaccuugaugcucauggcacagaugcgcaggaucuccccuuuuuccugucuuaaagaccgccaugacuucgaauuuccacaagaagaguuugacgggaaucaauuucagaaagcucaggccauuucaguauuacaugaaaugaugcaacagacuuucaaccuguucaguaccaagaacuccucagcagcuugggaugaaacacugcuugagaaauuuuauaucgagcucuuccagcagaugaaugaccuugaggcuugcgugauccaagagguuggaguugaggagaccccacucaugaaugaagacuccauccuggccgucaaaaaguacuuucagcgaauuacccuguaucugauggaaaaaaaauauucuccaugcgccugggaaguuguucgggcagaaaucaugagaucccugucuuucucuaccaaccuucaaaaaagacuaagacgcaaagacuag

SEQ ID NO: 5285 - RNA, 570 nt, Artificial Sequence
  Description of Artificial Sequence: Synthetic coding sequence
auggcccucucauuuucucugcucauggccguacugguacucucauacaaguccauuuguucucuagguugugaccugccucaaacccauucucugggcaaucgacgcgcucugauucugcucgcccagaugggucgcauuucucacuucucuugccugaaagaccguuaugauuuuggguuuccacaggagguuuucgacggaaaccaguuccaaaaggcacaggcaauauccgccuuccaugaaaugauccagcaaacuuuuaaucuguucucaaccaaggacucuucggcagcuugggaugaaacauuguuagauaaguuuuacauugagcucuuucaacaauuaaacgaccuggaagcgugugugacacaagaaguaggaguggaagagauugcuuugaugaacgaagacagcauucuggcaguccgcaaauacuuucaaagaaucacccuguacuugaugggaaaaaaauacucgccaugugccugggaggucgugcgggccgaaauuaugagaucuuucaguuuuagcacaaaccuucaaaaaggccugaggagaaaggauuag

SEQ ID NO: 5286 - RNA, 570 nt, Artificial Sequence
  Description of Artificial Sequence: Synthetic coding sequence
auggcccuaaguuuuucccugcucauggcuguccucgugcucucauacaaaucgauaugcucguugggaugcgaccugccacagacacauucacuuggaaacagacgggcccuuaucuuacucgcucagaugggcagaaucaguccauucuccugccuaaaggaucgccacgacuucgggcuuccccaggaagaguucgacggcaaccaguuucagaaaacccaggcuaucucaguccuccaugaaaugauucagcaaaccuuuaauuuauuuuccaccgaagauucuucagcagcaugggagcaaucucuacuagagaaauucucuaccgaauuauaccagcaguugaauaaccuagaagccugugucauacaagaggucggaauggaagaaaccccccugaugaacgaagacaguaucuuggcagugagaaaguacuuccagcgcauuacucuguaucuaacugaaaaaaaguauaguccgugcgcuugggagguggugagagccgagauuaugcgaucacugagcuucucuacaaaucugcagaagauuuuaaggaggaaagauuag

SEQ ID NO: 5287 - RNA, 567 nt, Artificial Sequence
  Description of Artificial Sequence: Synthetic coding sequence
auggcccugacauucgcccuucugguggcccuccuaguccuguccugcaaguccagcuguucagugggcugcgaucugccccagacacauucccugggcucacgccgcacucucauguuacuagcccagaugcgccgaauuucucucuucucuugcuugaaagaccgucacgauuucggguucccacaggaagaauuuggaaaucaguuccaaaaagcggagacaauacccgugcugcaugaaaugauacaacagauauucaacuuauuuucuacuaaagauuccucggccgccugggaugaaacccuguuagauaaauucuacacagaacucuaccaacagcuuaaugaucucgaagcaugugucauucagggugugggcgugacagagaccccccugaugaaggaagauuccauauuggcaguccggaaauacuuucagcgaaucacucuauaccugaaagaaaagaaauacagcccuugugcgugggaaguggugcgcgcagaaauuaugcgcucauucagcuugagcacaaaucuacaagaaucauugcgaagcaaagaguag

SEQ ID NO: 5288 - RNA, 570 nt, Artificial Sequence
  Description of Artificial Sequence: Synthetic coding sequence
auggcccuuaguuuuucucucuuaauggccguguuggugcucagcuacaaaaguaucugcucccuaggcugcgaccugccccaaacucauucgcucgggaaccggcgcgcauugauuuuacuggcucaaaugggccgcaucagcccuuucucuugcuugaaagaccggcaugauuucggauuuccccaagaggaauucgacggaaaccaauuucagaaagcucaggccauuucuguucuucacgagaugauccaacaaacuuuuaaccuuuucaguacgaaagacucuagcgcuacgugggagcaaagccuccuggagaaguuuuccaccgaacugaaccaacaacuuaacgaccucgaagcuugcguaauccaggaaguggguguugaagagacuccgcuaaugaauguugacucaauacuggcaguaaaaaaauacuuucagaggaucacuuuguaccugaccgaaaaaaaauauucccccugcgcuugggaagucgucagagcagaaauaaugcggagcuuuagucuguccaagauauuccaagagagacuuaggcgcaaagaauag

SEQ ID NO: 5289 - RNA, 570 nt, Artificial Sequence
  Description of Artificial Sequence: Synthetic coding sequence
auggcccuaaguuuuucgcuucuaauggcagugcuaguuuugucuuacaagucaauauguaguuuggggugcgaccugccacagacucauagucucggaaacagaagggcccugauucuucucgcccagaugggacggauaagucacuucucuugucuuaaagacagacaugacuuuggauuuccugaggaagaguucgauggacaccaguuucagaaggcccaagcaauuuccguucuacaugagaugauucagcagacuuuuaaucuuuuuaguaccgaggauucuucagccgccugggagcagucucugcuugaaaaauucaguaccgaacucuaccaacagcuuaaugaucuggaagcuuguguuauacaggaagucggugucgaagaaacaccguugaugaaugaggacucuauccuggccgugaggaaguacuuucaaagaaucaccuuguaccucacugagaaaaaauacucuccuugugccugggaggucgugcgagcagaaauuaugaggucucugaguuucucuaccaaccuacagaagagacugagaagaaaagauuag

SEQ ID NO: 5290 - RNA, 570 nt, Artificial Sequence
  Description of Artificial Sequence: Synthetic coding sequence
auggcauugcccuuuguguuacucauggcccugguggugcuuaacuguaagagcauuuguucauugggaugcgaccugccccaaacacacucucucucaaacaggcguacacuuaugauuauggcacagaugggccguaucagcccauuuagcugucucaaagaccggcaugacuuuggauuuccccaagaagaauucgaugguaaccaauuucagaaagcucaggccaucuccguucuacacgaaaugauacaacaaacuuucaaucuuuucagcaccaaagauucuucugcuacaugggaugaaacucuucuggauaaauucuacaccgaacuauaucaacagcucaaugaccuggaggccugcaugaugcaggaggucggugucgaagauacuccgcuuaugaacguugacuccaucuuaacugugagaaaguacuuucagcgaaucacccuguauuuaaccgagaagaaauacucaccaugcgccugggagguaguccgugccgaaauuaugaggagcuuuagucugagcgccaauuuacaggaaagauugagacggaaagaauag

SEQ ID NO: 5291 - RNA, 570 nt, Artificial Sequence
  Description of Artificial Sequence: Synthetic coding sequence
auggcacuccccuucgccuuguugauggcauuagugguuuugucguguaaauccucauguucuuuagacugcgaccucccucagacccauagucugggccacaggcggacaaugauguugcucgcacagaugcgacgcaucucucuauucucaugccugaaggacagacacgauuuccgauucccacaggaagaauucgauggcaaucaguuccaaaaggcagaagcuauaaguguccuucacgaaguuauccagcagacuuucaacuuguucucaacuaaggauuccucaguagcaugggacgagcgacuguuggauaaauuauauacagaacucuaucaacagcugaacgauuuggaggcgugcguuaugcaggaagucuggguggggggaacaccacucaugaacgaggacucuauccuggccgugcgcaaauacuuccagcguauuacauuguacuuaaccgaaaagaaauacucaccaugugccugggagguggucagagcugaaauuaugcgaucuuucucuagcucccggaacuugcaggaacggcuuaggcggaaggaauag

SEQ ID NO: 5292 - RNA, 570 nt, Artificial Sequence
  Description of Artificial Sequence: Synthetic coding sequence
auggcgcggucguuuucccugcugauggugguguuaguccuguccuacaaaucuauuuguucucucggaugugauuugccucagacccacucucugcgcaacaggcgggcucuuauauuacuggcacagauggguagaauuucuccuuuuagcugucuaaaagacaggcaugaguucagauucccugaagaagaguuugauggacaccaguuucaaaagacgcaggcuauuucagugcugcacgagaugauucagcagacauuuaaucucuucucuacugaggauucaucugcugcuugggagcaaucacuccuagaaaaauuuucaaccgaauuguaucagcaacugaacgaccuugaggccugcguuauccaagagguggguguugaagagacuccuuuaaugaacgaagauuuuauccuugcaguucgcaaguacuuucagcggaucacuuuguauuugauggagaaaaaguacaguccgugcgcuugggaagucgucagggcagagaucaugagauccuucuccuuuuccacgaaucugaagaagggccuucgacggaaggacuag

SEQ ID NO: 5293 - RNA, 570 nt, Artificial Sequence
  Description of Artificial Sequence: Synthetic coding sequence
auggcucucaccuucuaucuacugguggcuuuggucgugcucuccuacaaaagcuuuaguuccuuaggcugugaccugccccagacacacucacuugggaaccgucgcgcccugauccuucucgcccagaugagacguaucucuccuuuuaguugucugaaagaccgacacgacuucgaauuuccucaagaagaguucgacgauaaacaguuccaaaaggcccaggccaucucaguuuuacaugaaaugauucagcagacuuuuaaucuuuuuucuaccaaagacuccagugccgcacucgacgagacccugcuugacgaguuuuauaucgagcuugaccaacagcuuaaugaucucgaauccuguguuaugcaggaaguuggagugaucgagucaccccuaauguacgaagauucaaucuuagccgucagaaaauauuuucaacgcauaacacucuaccugaccgaaaaaaaauacagcucaugcgcaugggaagucguccgugcagaaaucaugcgaaguuuuagccugaguaucaaccugcaaaagaggcugaaguccaaggaauag

SEQ ID NO: 5294 - RNA, 564 nt, Artificial Sequence
  Description of Artificial Sequence: Synthetic coding sequence
augaccaauaaaugcuuacuccaaauagcgcuuuugcuuuguuucuccacaaccgccuuaucaauguccuacaaccugcugggguuucuccaaaggagcagcaauuuucagugucagaagcucuuauggcagcucaacggaaggcucgaguacugcuuaaaggacagaaugaacuuugacauccccgaagagauuaagcaacugcagcaguuucaaaaggaggacgcggcucugacaaucuaugagauguuacagaauauauucgcaauuuuucgacaggacagcucuaguaccggauggaacgaaaccauuguggaaaaucugcuagcuaacguuuaccaucagaucaaucaucucaagaccguucuggaggagaaacuggaaaaggaagauuucacacgggguaaacugaugucaucccugcacuugaagagauauuacggccgaauccugcacuaccuuaaagccaaagaguacucucacugcgcauggacaauugugagaguggagauccugaggaacuuuuacuucaucaauagacugaccggauaccugcgcaacuag

SEQ ID NO: 5295 - RNA, 534 nt, Artificial Sequence
  Description of Artificial Sequence: Synthetic coding sequence
auguuccaugucucauuucgauauaucuucggacugcccccccuaauccuagugcuacuccccgucgcgagcagcgauugcgacaucgagggaaaggacgguaaacaguaugagaguguccucauggugaguauagaucaauugcuugacaguaugaaggaaauuggaucaaacugccugaauaaugaguuuaauuuuuucaaacgccauaucugcgacgccaauaaagaaggaauguuucuguuucgagccgcacguaaacucaggcaguuccuuaaaaugaauuccaccggugauuucgacuuacaucugcugaaaguaagcgaaggcacgacaauucugcuaaacuguacuggacaaguaaagggucggaaacccgcagcccuuggugaagcucagccuaccaagagucuggaggagaacaagagccugaaagaacagaagaagcucaacgaucuguguuuccuuaagcgccuccugcaagagauuaaaacauguuggaacaagaucuuaaugggaacuaaagagcacuag

SEQ ID NO: 5296 - RNA, 216 nt, Artificial Sequence; identical to SEQ ID NO: 4966
  Description of Artificial Sequence: Synthetic coding sequence

SEQ ID NO: 5297 - RNA, 393 nt, Artificial Sequence
  Description of Artificial Sequence: Synthetic coding sequence
gucaguuuucgguacauuuuugggcuuccgccccucauucuggucuugcuuccaguggccaguagugauugugacaucgaagggaaggacggcaaacaauacgaaucuguacuuaugguuaguaucgaucaguuguuagacuccaugaaagaaaucggcagcaacugucucaacaaugaguuuaauuucuuuaaacggcacaucugcgacgcuaacaaggucaaaggccgaaaaccagcugcucuaggcgaggcucaaccaacaaagucacuggaagaaaauaagucccuuaaggaacagaaaaagcugaacgaucuuugcuuucucaaacggcugcuucaggagauuaaaacauguuggaauaagauacuaaugggaacaaaagaacacuag

SEQ ID NO: 5298 - RNA, 216 nt, Artificial Sequence; identical to SEQ ID NO: 4968
  Description of Artificial Sequence: Synthetic coding sequence

SEQ ID NO: 5299 - RNA, 114 nt, Artificial Sequence; identical to SEQ ID NO: 4969
  Description of Artificial Sequence: Synthetic coding sequence

SEQ ID NO: 5300 - RNA, 402 nt, Artificial Sequence
  Description of Artificial Sequence: Synthetic coding sequence
auguuccacgucucguuucgcuacauuuuugggcugccuccucucauccugguccugcugcccguggcaucuuccgauugugacaucgaaggcaaggacggcaaacaauacgaaagcguacugaugguaagcauagaccagcugcucgauagcaugaaagaaauuggcuccaacugucuuaauaaugaauucaacuucuuuaaacgucacauuugcgacgcuaacaaggugaaggggagaaaaccagccgccuugggggaggcucaaccuacuaagucucuugaggagaacaaaucccuaaaggaacagaagaaauuaaaugaccucugcuuccucaagagauuacugcaagagauuaagacaugcuggaacaagauccuuaugggcaccaaggaacauuag

SEQ ID NO: 5301 - RNA, 114 nt, Artificial Sequence; identical to SEQ ID NO: 4971
  Description of Artificial Sequence: Synthetic coding sequence

SEQ ID NO: 5302 - RNA, 195 nt, Artificial Sequence; identical to SEQ ID NO: 4972
  Description of Artificial Sequence: Synthetic coding sequence

SEQ ID NO: 5303 - RNA, 660 nt, Artificial Sequence
  Description of Artificial Sequence: Synthetic coding sequence
augaaaaugagauuucucgggcugguuguguguuuggugcuauggacccuccauagcgaggguuccggaggaaagcugaccgcaguugauccagagacgaacaugaaugucagugagaucaucucuuacuggggauuccccuccgaagaauauuuagucgagaccgaagauggauauauucugugccucaauagaaucccacacggcagaaaaaaucacagcgauaaaggccccaaacccgucguguuccuccaacauggucugcuugcugauaguuccaauuggguaacgaaccuggccaauucuucucugggcuuuauucuggcagacgcaggcuucgacguguggaugggaaacagcagaggaaacaccuggagccguaagcauaagacucuuagcgucucccaggacgaauuuugggccuuuaguuaugaugaaauggcaaaauacgauuuaccugcaucaauuaacuuuauacugaauaaaaccggacaggaacagguauauuaugugggacacucacaaggcaccaccauuggcuuuauugccuuuagucagauccccgaacuggccaagcgcauaaagauguuuuucgcacuuggcccaguugcguccguugcauuuuguaccuccccuauggcaaaguugggacgucuuuag

SEQ ID NO: 5304 - RNA, 1200 nt, Artificial Sequence
  Description of Artificial Sequence: Synthetic coding sequence
augaagaugagguucuugggauuggucguuugccucguacucuggacacugcauucugaaggcucaggaggaaagcucacagccguggaccccgaaacaaacaugaauguaagugaaaucauuuccuacuggggauuccccuccgaagaguaccuugucgaaacagaggauggcuauauuuuaugccuaaaucgcauuccccauggucguaagaaucacuccgauaaaggaccaaaaccuguaguguuccuucagcauggacucuuggcugauaguucgaacugggugacaaaccuggcuaauucuagucucggauucauacuggccgaugcuggauucgauguguggauggggaauagccgggguaauacuuggucacgcaaacacaagacccugucuguuucacaggaugaauucugggccuuuucuuaugacgaaauggcgaaauaugauuuacccgccuccaucaauuucauacucaauaaaaccggucaagaacaggucuacuacguaggacauucacaaggcaccacuauaggcuuuaucgcuuuuucacagauuccagagcucgccaagcgaauuaaaauguuuuuugccuuaggccccguggcauccguggcauuuugcacuucccccauggcaaagcuagggcgacugccugaucaucugauuaaagaccuguuuggcgacaaggaguuccugccccaguccgcguuuuugaaaugguuggguacccacguguguacccauguuauccuaaaagagcuuuguggcaaccugugcuucuuguuauguggcuucaacgaaagaaaucuuaauaugagcaggguggauguuuacaccacacauucuccagccggaaccuccguacaaaauaugcuacauuggucucaggccgucaaguuucaaaaauuccaagcuuucgauugggggucuagugcaaagaacuacuuccauuacaaccagaguuauccucccacuuauaacgucaaggauaugcuugugccaaccgcaguaugguccggaggacacgauuggcucgcggacgucuacgaugugaauauacuccugacacagaucacuaaccuuguguuccaugaaucuaucccugaaugggagcaccucgacuuuaucuggggacuggacgcgccguggcgccuguauaacaaaaucauaaaucucaugcgcaaauaccaguag

SEQ ID NO: 5305 - RNA, 1074 nt, Artificial Sequence
  Description of Artificial Sequence: Synthetic coding sequence
augaaacugcggacauuagcuguuagcgccaccguuguuaaggacggagucagcggaguuugcuccuuucggugcagcgacguaucuggcguguuacccucaggaccuaaaccggugguuuuccuucagcacggauuguuagcggacucgucaaauuggguuacaaaccucgccaacuccucucugggguucauucucgccgacgcuggguuugacgucuggauggguaauucuaggggcaacacauggucacgcaaacacaagacccucucaguuucucaggaugaguuuugggccuuuucuuacgacgagauggccaaguaugaucuccccgcauccaucaacuucaucuuaaacaagacgggccaagaacaaguguacuacguggggcacucucaggggaccacuauuggguucauugccuuuucucaaauccccgagcucgcuaagagaauuaagauguucuuugccuuagggccaguugcaagcguugccuucugcaccaguccaauggccaaacuaggaagacugccugaccaccugauuaaagaucuguucggcgacaaggaguuccugccacaauccgcauuccucaaaugguuagguacacacguaugcacgcauguaauucuuaaagaacuuugugguaacuuauguuuccuucuguguggguucaaugaaagaaauuuaaacaugucucgcgucgauguuuacaccacacauaguccugcagguacuucagugcaaaauauguuacacuggucccaagcugugaaauuucagaaguuucaggcauuugacuggggaucaagugcaaagaauuauuuucacuacaaucaauccuauccuccaaccuacaacgugaaggacaugcuggugccuaccgccguauggucuggcggccacgacuggcucgcggacguguaugacguuaacauucuuuugacucagauuaccaaccucguuuuccacgaaaguauaccugaaugggagcauuuggacuucauuuggggacucgacgcacccuggagguuguauaacaaaaucauaaaucuuaugagaaaguaucaguag

SEQ ID NO: 5306 - RNA, 1200 nt, Artificial Sequence
  Description of Artificial Sequence: Synthetic coding sequence
augaagaugagauuuuuaggccucgucguuugucugguuuuguggacgcuacacucagaaggcucugggggcaaauuaacagccguggacccggaaaccaacaugaacguauccgaaaucauuagcuauuggggauuuccaagcgaagaauaucuuguugaaaccgaggauggcuacauccucugccugaaucgcaucccucauggcaggaaaaaucacagugacaaaggccccaaaccaguggucuuccugcagcacgggcuacuugccgauucaucuaacugggucacuaauuuggcaaauucaucucuuggguucauucuugcagacgcugguuucgacguauggauggguaauucaaggggaaacaccuggucgaggaaacauaaaacauugagcguaucucaggacgaguucugggcauucagcuaugaugaaauggcgaaauacgaccuaccagcauccauuaacuuuauccuaaauaagacagggcaggaacagguuuacuacgucggacauagucagggaacuacuauugguuucaucgcguuuucacaaaucccagaacucgcaaaaaggauuaagauguuuuucgcccucgguccaguggcaucugucgccuucuguaccuccccuauggcaaaacuuggccgcuuaccagaucaccugaucaaggauuuauuuggcgauaaagaauuucuuccccaguccgcauuccucaaauggcugggaacccacguguguacucacgugauccugaaggaacugugcggaaaucucugcuuccuucuuugcggguuuaacgagaggaaucugaauaugagcagaguugauguuuacacuacccauagucccgccggcacaucaguacaaaacaugcugcauuggucccaggccguuaaguuccaaaaauuucaggccuuugauugggggucaucagcaaagaacuacuuucauuauaaccaaaguuacccuccaaccuacaaugucaaggauaugcuggugccuaccgcaguuugguccggcgggcacgacuggcuugcagacguguacgacguaaauauucugcugacacaaauuaccaacuugguuuuccaugagucuauuccugagugggaacaucuggauuuuaucuggggcuuagaugccccuuggcggcuguauaauaaaaucaucaaucuuaugagaaaauaucaauag

SEQ ID NO: 5307 - RNA, 1032 nt, Artificial Sequence
  Description of Artificial Sequence: Synthetic coding sequence
auggccugcuuggaguuugugccuuuugauguacagaugugccuggaguuucucccaucaggccccaaaccagucgucuuccuccagcacggacuuuuagcagacagcagcaacugggugacaaaucuggcaaacaguucacugggauuuauucuugccgaugccggauucgauguuuggaugggaaacucuagaggaaauaccuggucaagaaaacauaagaccuuguccgugagccaagacgaguucugggcuuucucuuaugaugaaauggcuaaguacgaccugccagcuagcauuaacuucauccugaauaagacaggacaggaacaggucuauuaugugggacacucacaggggacuaccaucggguuuaucgcguucucccagauaccagagcucgccaaacggaucaaaauguucuuugcucuaggucccguggcuuccgucgccuuuugcaccuccccuauggccaaacucgguagacugccugaucaucugauuaaagaccuauuuggagacaaggaguuccuuccacagucagccuuucuuaaguggcugggaacacauguguguacacacguaauuuuaaaagagcucugcggcaaccucuguuuccugcuaugcgguuucaacgaacgcaacuugaauaugucccgcgucgacguguacacgacccacucaccugccggaaccuccguucaaaauaugcugcacuggucucaagcagucaaguuucagaaguuucaagccuucgacugggguagcuccgcaaaaaauuacuuucacuacaaucagucuuauccacccacguacaacgucaaggauaugcuagucccuacggcggucuggaguggcgggcaugacugguuggccgauguauacgacguuaacauccugcugacccagaucacgaaccugguauuccacgaguccauaccugagugggaacaccuugacuucauuuggggauuagaugccccauggagacuauauaacaagauuaucaaucuuaugcgcaaauaucaguag

SEQ ID NO: 5308 - RNA, 1206 nt, Artificial Sequence
  Description of Artificial Sequence: Synthetic coding sequence
auggcgugcuuggaguucguuccuuucgauguucagauguguuuggaauuccugccaucaggagaauuuguggucuuauugacaagcggcgugcaacuucaaacuuuuaccgucucaguaacugauuuaaaagggggcgcuucgggcgugguccggucaagccgcugggugcgcgguuucaccgauuucagaucaaaagcuguggacuuauguggacccaaaccggucguuuuucugcagcaugggcuccuggcagacagcaguaauuggguaaccaaucuagccaacucaucacugggcuucauuuuggccgacgccggguuugauguuuggauggguaacuccagaggaaacacauggucaaggaaacauaaaacccuuucagugagucaggacgaauucugggccuucagaguacccuuucucgacuauuccuaugaugagauggcaaaauacgauuuaccagcaaguauaaauuuuauucugaauaagaccggccaggagcagguguauuauguggggcacagccagggaacaaccaucggauuuauagccuuuucucagauuccggaacuagccaagagaaucaaaauguucuucgcgcuaggcccuguggccucaguugccuuuugcacaucaccaauggccaaacuuggaagauuacccgaccauuugaucaaggacuuauuuggcgacaaagaauucuugccccaaucugcuuuuuugaaauggcucgggacucacguuuguacccacguuauucugaaggaacucugcgguaaccuaugcuuccuucugugugguuuuaacgaaagaaauuugaacaugucccgcgucgacguguauaccacucacuccccagccggaacuucgguacaaaauaugcugcacuggagucaggcugugaaauuccagaaauuccaagccuucgacuggggaucaucagcuaaaaacuacuuucacuauaaccaauccuacccccccaccuacaacgucaaagauaugcucguuccuacagcuguuuggucaggcggacaugacugguuagcugacguguaugauguaaacauccugcuaacgcaaaucacaaauuuaguuuuccacgagucaauccccgagugggagcaccuugacuucauuuggggccuggaugccccauggcgccuguacaacaagaucaucaaccugaugcguaaauaccaguag

SEQ ID NO: 5309 - RNA, 873 nt, Artificial Sequence
  Description of Artificial Sequence: Synthetic coding sequence
augaaaaugagauuuuugggccugguagugugucugguuuuguggaccuugcacagcgaaggauccggagguaaacuuacugccguagacccagaaacaaacaugaacguaucggaaaucaucucuuauugggguuuuccuucugaggaauaccucguugaaacagaagacggguauaucuugugcuugaaucguauuccccauggccguaaaaaccacagugauaaagguccuaagcccguuguguucuugcagcauggccuguuggcugacaguucaaacugggugacgaacuuggcgaacucuagucugggcuucauccuggccgacgcaggauuugauguuuggauggguaacaguagagguaacaccuggucgcggaaacacaaaacacucucaguaagccaggacgaauucugggcguucaguuaugacgagauggccaaguacgaucuccccgccucaauaaacuucauacugaauaagaccggucaggaacaagucuauuacguaggucacucucaaggaacaacgauuggguucaucgcuuuuagucagauuccggaacuggccaaacggaucaaaauguucuucgcauugggucccguugcaucuguugccuucuguacgucacccauggccaaacugggacgauugcccgaccaucuuaucaaggaccuuuucggcgacaaagaguuucuuccacaaucugcauuccuuaaauggcugggaacucacguuuguacacacguuauccuuaaggaacuaugcggcaacuugugcuuuuugcugugcggguucaaugagcggaaucuuaacaugucaagagucgaugucuauacuacccacucaccugccggcacuuccguguag

SEQ ID NO: 5310 - RNA, 1200 nt, Artificial Sequence
  Description of Artificial Sequence: Synthetic coding sequence
augaaaaugcguuuucuuggcuugguggucugccugguacuguggacgcuccacucagaagguucagguggaaaacugacugccguagaccccgagacgaauaugaacguguccgaaauuaucucuuauugggguuuuccaagugaagaauaucuuguagaaaccgaagacggguacauucuguguuugaaccgcauaccccacggacggaagaaucacucugacaagggcccaaaaccgguaguguucuugcagcauggucuguuggcugauagcaguaacuggguuacuaaucucgcgaauagcagucucggcuucauccuggcggaugcuggauuugauguuuggauggguaacucccgcggaaacacuuggucccguaaacacaaaacuuugagcgugucacaggacgaauuuugggccuucaguuaugacgagauggcuaaguacgaucuccccgccagcauuaacuucauucuaaacaaaacaggacaagaacaaguauauuacguuggccacagccaaggcacaacgaucggguuuaucgcuuucucucaaaucccagaacucgcaaaacggauuaagauguucuuugcacucggccccguggcgucaguggcauuuuguacuaguccgauggccaagcucgggcggcucccugaucaucugauuaaagaucucuuuggggacaaggaguuucuuccccaguccgcauuuuuaaaauggcucggaacucacgugugcacucaugucaucuugaaggaacucuguggcaaccuguguuuucuguuguguggcuuuaacgaacgaaaucugaauaugucccgagucgauguauacacaacucauucaccagccgguacauccgugcagaauaugcugcacuggucucaagcagugaaguuccagaaauuucaagcuuuugacuggggcucuucagcaaagaauuauuuucacuauaaucaaagcuauccuccaacauacaauguaaaagacaugcuugugccaacagccguguggaguggcggucacgauuggcuggccgacguauacgacguaaacauccugcuuacacaaauuacaaaccuuguuuuccaugagucuauccccgagugggagcaccuggauuuuaucuggggacucgaugccccauggcggcuuuauaacaaaauaauaaauuuaaugcgcaaauaccaguag

SEQ ID NO: 5311 - RNA, 87 nt, Artificial Sequence; identical to SEQ ID NO: 4981
  Description of Artificial Sequence: Synthetic coding sequence

SEQ ID NO: 5312 - RNA, 1200 nt, Artificial Sequence
  Description of Artificial Sequence: Synthetic coding sequence
augaagaugcgcuuccuggggcucguaguuuguuuaguucuguggacacuucacagugaagggagcggugggaaguugaccgcaguugaccccgaaacuaauaugaauguuuccgaaaucauuagcuauuggggcuucccaucugaggaguaccuggucgagaccgaggaugguuacauacuuugccugaaucgaauuccacauggccgcaaaaaucacuccgacaaggggcccaaaccaguugucuuccugcagcacggacuccucgcugauaguagcaacuggguuacaaaccucgcuaacucgucucugggcuucauucuggcugaugccggauucgauguguggauggggaacagcagagguaauacauggucacgcaagcacaagacacucucagugucucaggaugaauucugggcuuucucauaugaugagauggcaaaauacgaucugccagcuucuauaaauuuuauuuuaaauaagaccgggcaggaacaagucuacuacgugggucauucacagggaacaacuauaggauucaucgcuuucucacaaauuccagaauuggcuaaaaggaucaagauguuuuucgcccuuggcccggucgccucuguugccuuuuguaccucuccaauggcuaagcugggucgucugcccgaucaccugaucaaagaccuauucggggauaaggaguuucucccucaaucugcguuccuuaaauggcucggcacucacguuugcacccacgucauucugaaggaacugugcggcaacuuauguuuucuauugugcggauuuaacgagcgcaacuugaauaugagcagagucgacguauacacaacacacucaccugcaggaaccagcgugcagaauaugcuccacuggucccaagcugugaaguuccaaaaauuucaggccuucgauuggggaucaagcgccaaaaacuacuuucauuauaaucaauccuacccacccaccuacaacguuaaagauaugcugguacccaccgccguuuggucagguggacaugauuggcuggcugacguuuaugacguaaauauccugcucacucaaauuacgaauuuggucuuucacgaguccauucccgaaugggagcaccucgauuuuaucuggggccuagacgccccuuggagacuguacaacaagauuauuaaucugaugcggaaauaccaauag

SEQ ID NO: 5313 - RNA, 411 nt, Artificial Sequence
  Description of Artificial Sequence: Synthetic coding sequence
augaaaaugagauuuuuaggacuugucgucugccuuguacuuuggacucugcacagugagggaucaggcggaaagcugacugcgguggaccccgagaccaacaugaacgucagcgagaucauuuccuauuggggauucccuucugaagaauaccugguagaaacugaagauggcuacauacuuugccugaaucggaucccccauggccgaaagaaccacuccgacaaaggucccaagcccguuguauuucuucagcacggacuacucgcugauucaagcaacugggucacaaaccuggcaaacuccagccuggguuucauauuagcugaugccggauucgacguguggauggggaacaguaggggaaauacauggaguagaaagcacguuacccuugaaccuggguguuag

SEQ ID NO: 5314 - RNA, 1428 nt, Artificial Sequence
  Description of Artificial Sequence: Synthetic coding sequence
auggagucaaaagcucuucuuguguugacucucgccgucuggcugcagucccugaccgccucgagaggaggaguggcagcagccgaccagagacgcgauuuuauugauauagaauccaaguuugcccuccguacccccgaagauacugcagaggauaccugucaucuuaucccagguguugcagaguccguugcuaccugucacuucaaucauaguuccaaaaccuucauggugauccacggauggacuguaacaggaauguacgagucaugggucccaaaacugguggccgcucucuauaaaagagaaccggauucuaacguuauugugguugacuggcugucuagggcucaagaacauuaccccgugagugcagguuauaccaagcugguugggcaggacguugcgagauuuauuaauuggauggaagaagaguucaauuacccacuggacaaugugcaccugcucggcuacucccuuggcgcacacgccgcaggcauugccgggucacugaccaauaaaaaaguaaaccgcaucacaggucuggacccagccgguccgaacuuugaauaugccgaggcucccucacgacugucccccgaugacgcagauuucgucgauguucugcacacguuuacuagaggaagcccugggcgcagcauagguauucaaaaacccguaggacauguggauaucuacccaaauggaggcacguuccagccuggauguaauaucggugaggcuauccgcgucauagccgaaagaggccugggggacguagaccagcuagugaagugcagccacgagcgcaguauccauuuauucaucgauucccugcugaaugaagagaauccaucuaaggcuuauaggugcucaagcaaagaagccuucgaaaaaggacuuugccuuucgugcagaaaaaaucguugcaauaaccucgguuaugagauuaauaaagucagagcuaagagaucuucuaagauguaucugaagacccgaucucaaaugccuuauaaaguuuuccacuaccaggucaagauacacuucagcggcaccgaaucagagacucacacuaaucaggcuuuugagaucuccuuguauggcacaguugccgagucagaaaauauucccuuuacacucccagaagucagcacgaacaaaaccuauuccuuuuuaauuuauaccgaggucgacaucggugaacugcucaugcuaaaacugaaauggaagucagauucuuacuucucguggagcgauugguggagcagcccaggauuugcuauacagaaaauuagaguuaaagccggugaaacccagaagaaagugaucuuuuguucaagagaaaagguuucucaccugcaaaaggguaaagccccugccguguucgugaaaugccaugauaagucacugaauaaaaaguccggcuag

SEQ ID NO: 5315 - RNA, 348 nt, Artificial Sequence
  Description of Artificial Sequence: Synthetic coding sequence
augguuauccauggcuggacugugacuggcauguacgaaaguuggguuccaaaacugguggccgcccuuuacaaacgcgagccggauucuaaugugauugucgucgauuggcuuucucgcgcacaggagcauuaccccgugucggcaggauauacuaaauugguuggucaggauguggcaagauuuauuaacuggauggaggaggaauucaacuacccccuugauaacgugcaccuguuaggguauagucugggugcccacgccgccgguaucgcuggcucacucacaaauaagaaggucaacagaaucaccggcuuagauccagcaggcccaaacuuugaauacuag

SEQ ID NO: 5316 - RNA, 321 nt, Artificial Sequence
  Description of Artificial Sequence: Synthetic coding sequence
auggaaucgaaagcuuuacugguccugacgcuggccgucuggcuucaaaguuuaaccgccuccaggggaggcguugccgccgcagaucagaggcgugauuuuauugacaucgagucuaaauuugcauuacgcacaccagaggauacugccgaagauaccugucacuuaauccccggcguagccgagagcguggccacuugccauuucaaccauaguucaaaaaccuuuauggucauucacggcuggaccgucaccgguauguacgaaucuugggugccuaaacuggucgcugcacuguacaaacgcgaaccagauucuuag

SEQ ID NO: 5317 - RNA, 393 nt, Artificial Sequence
  Description of Artificial Sequence: Synthetic coding sequence
auggaaagcaaagcccuguuagugcucacccuggccguauggcugcagucucugacagcuagccgugguggcguugccgcugcugaccagcguagggacuuuaucgauauugaguccaaauuugcccuccgcacaccugaagauaccgccgaggacaccugucaucucauacccggcgucgcugaaagcguugcuaccugccacuuuaaccauucguccaagaccuuuauggugauccacggguggacaguuaccgguauguacgagucguggguccccaaacuagucgcugcccuuuacaagagagagccugauucuaacgugaucgucguugacugguugagcagagcccaggagcacuaccccguaucggcuggguacacaaagcuguag

SEQ ID NO: 5318 - RNA, 1386 nt, Artificial Sequence
  Description of Artificial Sequence: Synthetic coding sequence
auggaaucuaaggcacugcuuguguugaccuuggcugccgcugaucagaggagagacuucaucgauauugaaagcaaauucgcccuucgcacuccugaggauacugcugaggauacaugccauuuaauccccggcguagcugagagcguugcuacgugucacuucaaccacaguucaaaaacuuucaugguaauucacggcuggacaguaaccggcauguaugagagcuggguuccaaaguuaguagccgcccuuuacaaacgugaacccgacuccaaugugauaguuguagauuggcugucccgugcccaagaacacuaccccguuucagcuggauacacaaaacucguaggacaggacguggcccgcuuuauuaacuggauggaggaggaguucaauuacccacuggauaauguacauuugcuaggauacucacugggggcccacgcagccggcaucgcuggcaguuuaacaaacaagaaggugaauagaauuacaggccuggaucccgcuggcccgaacuucgaguacgccgaggccccuucacgccugagcccugaugacgcggacuucgucgacgugcugcacaccuucacacgcgggucaccaggacguucuauugguauccagaaacccgucgggcacgucgacaucuauccaaaugggggaaccuuucaacccggaugcaauauuggcgaagcaaucagagucauagcugagagaggauugggagacguggaccagcucgugaaauguucccacgaacguucaauacaccuauuuaucgacucccuacugaaugaggagaacccaagcaaggcauaccguugcagcucuaaggaggccuucgaaaaaggauugugccugucaugucgaaaaaaccgcuguaauaaucucggcuacgaaauuaacaaaguacgcgcaaaacggaguucuaaaauguaccuuaagacccggagucagaugcccuauaaaguuuuucauuaccagguuaagauccauuuuuccgggacagagucugaaacucacaccaaccaagccuuugaaauaagccuuuacgguacaguugcugagucggagaacauucccuuuacccuuccagagguuaguacuaacaagacauacagcuuccuaauauacacugaaguagacauuggagaacuucugaugcuuaaacucaaauggaagucugauaguuacuuuaguugguccgacugguggagcuccccaggcuucgcaauucaaaaaauccgcgucaaagcaggcgagacccaaaagaaaguuauuuucugcucaagggagaaggucagccauuuacagaaaggaaaagcccccgcggucuucgucaagugccaugauaaaucacugaacaaaaagucaggguag

SEQ ID NO: 5319 - RNA, 828 nt, Artificial Sequence
  Description of Artificial Sequence: Synthetic coding sequence
auggugauucauggauggacggugacagguauguacgagaguuggguuccaaaacugguggcggcucuguauaaacgagaaccugacagcaaugugaucgucguugauuggcugaguagagcacaggagcacuaccccgugucagcuggauacacuaaacucguaggucaggauguggcccguuuuauaaacuggauggaagaggaguucaauuauccacuggauaacguccauuuacuuggcuacagccugggagcccaugccgcaggcaucgccgggucauugacaaauaagaaagucaaccguauuacgggcuuagauccugccggcccaaauuucgaauaugccgaagcuccuagucgauugucaccggaugaugcugacuucgucgaugugcugcacacuuucaccagaggcucacccgguagauccaucgguauccagaagccagugggacacguggacauuuauccaaacggagggacauuucagccaggcuguaauauuggcgaggcuaucagggugauugcagagcgcggcuuaggugacguggaucaauuggucaaguguucgcacgaaagaucaauucaccuuuucaucgauagucugcuuaacgaggaaaacccaucaaaggcauaucggugcuccaguaaagaagcauuugaaaagggauugugccugucuugcagaaagaaccgaugcaacaauuugggguaugagauuaauaaaguuagagcuaaaaggagcaguaaaauguacgaagacuccuucucggacgcuuuacaaagccucccucucccauccaaggauuccuucuucugggauuag

SEQ ID NO: 5320 - RNA, 540 nt, Artificial Sequence
  Description of Artificial Sequence: Synthetic coding sequence
auggguaggccuggacucggagcugccguaucugaccuuggggaggcuguaucgcucagucagggccuguuguugcugcucuuguuaaguaugggcggggcuugggccagccgagaaccucugcgcccauggugucacccuaucaaugcuauucuggccguugaaaaggaggggugcccaguaugcaucacaguaaauacuacaaucugugccggauauuguccaaccaugaugcggguuuuacaagccgucuuaccacccuuaccucagguagugugcacauaccgggauguucgauuugagucuauucggcucccgggcuguccacgcggcguagacccugugguauccuucccuguugcucucucaugucgaugcgggcccugucgaagaaguaccucugauugcggcggccccaaggaucacccccuuacaugugaccauccucagcaggccuccagcucuuccaaagacccuccacggucacuaccaucacccagccggcuucucgaaccggacaccccaaucuugccccaguag

SEQ ID NO: 5321 - RNA, 2253 nt, Artificial Sequence
  Description of Artificial Sequence: Synthetic coding sequence
augcuccgcgcgaagaaccaacuguuccuucuguccccccacuaucugaggcaggugaaagaaucaucaggguccagacugauucagcaacgguugcuccaucaacaacagccacugcaucccgaaugggcagcucucgcuaagaaacaacugaagggaaaaaauccagaggacuugauauggcauacaccagaggggauuuccaucaaacccuuguauagcaaacgcgacacuauggaccuuccagaagaacugccaggagucaagcccuuuacccgaggcccuuaucccaccauguacacuuuuagaccuuggacaauucgacaauaugcaggauucucaacagucgaggaauccaauaaguucuauaaagauaacaucaaagcuggacagcaagggcuuuccguggccuucgacuuggcgacccacagaggcuaugacuccgauaaccccagaguuagaggugacgugggcauggccgguguagcuauugauacggucgaagacacuaaaauacuguuugauggcaucccucuggagaaaaugagcguuagcaugacuaugaauggcgccgugauccccguccucgcaaauuucauugugacuggcgaggagcagggagugccaaaggaaaaacugacagguaccauucagaacgacaucuugaaggaauuuauggugagaaauacauauauuuuccccccugagcccucgaugaagauuauugcugacauauuugaauacacagccaaacacaugccgaaauucaacucuauaucuaucaguggguaccacaugcaggaagccggagccgacgcuauccuugaacuugcuuauacacuggccgacggccuagaguauuccagaacaggacugcaagcuggccuuacuauugacgaauuugcacccaggcuauccuuuuuuuggggaaucgggaugaacuuuuacauggaaaucgcaaaaaugcgggcaggaaggcgauuaugggcccaucuuauagaaaaaauguuccagcccaagaacaguaaaagccugcuacugagagcgcacugccagacaucugguuggucacucacugaacaggauccguauaacaacauugucaggacggccauugaagccauggccgcaguauucggcgggacucagucucugcauacaaacuccuuugaugaagcccuaggccuaccaacagucaaaucugcaagaaucgcacgaaacacccagaucauuauacaggaggaaagugggauaccuaaaguggccgauccauggggaggcaguuauaugauggaauguuuaacgaaugacguguacgaugccgcucucaagcugauuaaugagauugaggagauggggggcauggccaaggcaguggcagaaggaaucccaaaacugaggaucgaagaaugugcagccagacgccaggcaaggaucgauucaggcucugaggugauuguugggguaaacaaauaucagcuggaaaaggaggaugcuguagaaguacuggcaaucgauaauacuagcgugcgcaaccggcaaaucgaaaaguuaaaaaagauuaaguccucgagggaccaggccuuggcugaaagauguuuggcugcccucacggagugcgccgcuucaggcgauggcaauauacuggcuuuagcgguugaugcaagcagagcaagguguaccgugggggagauuacugaugcgcugaagaaaguauuuggagaacauaaagcuaaugauagaaugguaaguggugccuauagacaggaauucggcgaaucgaaggaaaucacaucagcgaucaaaagaguucacaaguucauggaacgugaaggccggagacccaggcuucucguggcuaagauggggcaggacgggcacgauagaggggcuaaagucauagcaaccggcuucgcugaccuggguuuugauguagacauugggccccuauuccagaccccgcgcgagguggcucaacaggccguagacgccgaugugcacgcuguugguauuuccacccuagccgccgggcauaaaacauugguuccagagcugauuaaagagcucaauucucuggguagacccgauauccuggugauguguggcggagugauucccccccaagauuacgaauuccuguuugaggugggcgugaguaauguauucggcccuggcacccggauccccaaagcugcugugcagguucuggacgacaucgaaaaauguuuggaaaagaaacaacagucuguguag

SEQ ID NO: 5322 - RNA, 594 nt, Artificial Sequence
  Description of Artificial Sequence: Synthetic coding sequence
accagguauuuagcgcgguguacuguaggagagaucacugacgcccuuaaaaaaguguuuggcgaacauaaggcuaaugauaggaugguuuccggagcguaucgccaggaauucggggagucaaaggaaaucacuuccgccauuaaacgggugcacaaguuuauggagagagaaggccggagaccgagacuuuugguagcuaaaaugggacaggauggacacgaccgcggagcaaaaguuaucgccacuggcuuugccgaccugggcuucgauguggauauuggaccucucuuucagacuccacgggaaguagcucaacaggccguggaugccgaugugcaugccguaggaaucucgacacucgccgccggacacaagacauuggugccagaacucauuaaagaacugaauucacuggguagaccggauaucuuggugaugugugguggcgucauaccgccacaagacuacgaauuuuuauuugaggucggaguaucaaacgucuucggaccugggaccaggaucccaaaagccgcugugcaggucuuggacgacauagagaagugucuugagaaaaaacagcaguccguauag

SEQ ID NO: 5323 - RNA, 405 nt, Artificial Sequence
  Description of Artificial Sequence: Synthetic coding sequence
auggacccucagaccgcacccucuagagcccugcugcuguuauuauuucuccacuuggcauuccugggcggcagaagucauccauuaggcucccccggauccgccucugaccuagagacuucuggauugcaggagcagaggaaucaccugcagggaaaauuaagugaacuucaaguugaacagaccucucuugagccucuccaggaaagcccgaggccgacaggcguguggaagagcagagaagucgcaacagaaggcauaagggggcaucgaaaaaugguacuguacacauuacgggcgccccggucuccaaaaaugguucagggaucuggaugcuuugguagaaagauggacagaaucuccuccucuucaggacuuggcuguaagguacuccguaggcauuag

SEQ ID NO: 5324 - RNA, 726 nt, Artificial Sequence
  Description of Artificial Sequence: Synthetic coding sequence
auguccaugcuuuucuacacccuuauuacagccuuuuuaaucgggauccaagcagaaccacacagugaaucuaacguaccagcuggacacacaauaccccaggcgcauuggacaaaauugcagcacaguuuggacacagcccugcgccgggcccggucugcucccgcugccgcuaucgccgcccgcguggcuggccaaacccgaaacaucacuguggauccaagguuauucaagaaaagacgacuccguagcccucgcguccuauucucaacccaacccccuagagaggccgcugacacucaggaucuggauuucgagguuggcggggcagcaccuuuuaauagaacgcauaggucuaagagaucaucaagccauccuauuuuccauagaggcgaauuuucagugugugauagugucagcguguggguaggugauaagacgacagccacagauauuaagggaaaggagguuaugguucucggugaggucaacauuaacaauucugucuucaaacaauacuuuuucgaaacaaagugcagggaccccaacccaguggacagcgggugccgaggaaucgacucuaaacauuggaacuccuacugcacuacaacccacacuuuugucaaagcccucaccauggacggaaagcaggcugcguggcgcuucauccgcauagauacugcuugugugugcguauuaucaaggaaggcggugcgaagagccuag

SEQ ID NO: 5325 - RNA, 1065 nt, Artificial Sequence
  Description of Artificial Sequence: Synthetic coding sequence
auguuguucaaucucagaauucuucuaaacaaugccgcuuuucgcaacggccauaauuuuaugguacgcaacuucagguguggucaaccccuccagaauaaggugcaauugaaaggacgcgaccugcuaacccugaaaaauuucacaggcgaagagaucaaauauaugcucuggcugagugcagaucuaaaauucagaauuaagcaaaaaggcgaauaucugccgcugcugcaagggaagucccuggguaugaucuuugagaagcgcagcaccaggacccgacuuagcacugaaacugguuucgcauugcucggcggccacccuugcuuucugacaacacaggauauacaucuggguguuaaugagucacugaccgauacggcacguguccugagcucuauggccgaugccguccucgcccggguguacaaacagucagaucucgauacacuggcgaaagaggccucaauccccaucauaaacggauuaagcgacuuauaccaccccauucagauacuugcggacuauuuaaccuugcaggagcacuauaguagccuaaaaggccucacucucucauggaucggagacggcaauaauauccuacacucaaucaugaugagugcugcaaaauuuggaaugcaccuucaagcagcuacuccuaaaggauacgagcccgaugcauccgugaccaaacuggcugaacaauaugccaaagagaacggcacgaagcuacuccugacaaaugauccccucgaggcggcacacgggggaaacgugcuaauuaccgacaccuggauuuccaugggacaggaggaggaaaaaaaaaaacgauuacaggcguuucagggauaccaaguaacgaugaagacggcaaagguggccgccagcgauuggacauuucugcauugucuuccccguaagcccgaagagguagacgacgagguguucuacucuccucgaagcuugguuuuuccugaggcugaaaauagaaaauggacuaucauggccguuauggucucucuccugacagauuacaguccccaauugcaaaaacccaaauucuag

SEQ ID NO: 5326 - RNA, 348 nt, Artificial Sequence
  Description of Artificial Sequence: Synthetic coding sequence
augaucccagcgaaggacauggcaaaggugaugaucgucaugcuagcaauauguuucuugacaaagagugacggcaagucagugaagaaaagaucggucagcgagauucaguuaaugcacaaccucggcaagcaucugaauaguauggagaggguggaaugguuacgaaagaaacuccaggacguucauaacuucguggcccuuggugcaccacucgccccgcgggaugcugguucucagaggccgcggaaaaaggaagauaauguacucguagagucgcacgaaaagagccuaggggaggccgauaaagcagauguuaacguccuuacgaaagccaaaucucaguag

SEQ ID NO: 5327 - RNA, 348 nt, Artificial Sequence
  Description of Artificial Sequence: Synthetic coding sequence
augauucccgcgaaggauauggccaagguaaugaucgugaugcuggcaauuuguuuccucaccaagucugaugggaagaguguaaagaaacggucuguuucugagauucagcugaugcauaaucugggcaaacaccugaauucuauggaacgcguugaauggcuucggaagaaacuccaagauguccacaauuucguugcguuaggcgcacccuuagcuccucgagaugcuggaagccagaggccacggaagaaagaagauaacgugcugguggagucucaugagaaaucacugggcgaagcugauaaggcugacguaaauguacucacaaaagcaaaaucucaauag

SEQ ID NO: 5328 - RNA, 354 nt, Artificial Sequence
  Description of Artificial Sequence: Synthetic coding sequence
augucuacggcagugcuugagaaucccggacuuggucggaaacucagugacuuuggucaagagaccucauauauagaagacaacugcaaccagaacggagccauuagucugaucuucucucugaaggaggaagugggagcccucgcaaaaguccuaagacuguucgaagaaaaugauguaaaccucacccacaucgaaaguaggccuucuagacugaagaaggacgaguacgaauucuuuacccaccucgacaagcguagccugcccgcccuaaccaacauuauuaagauccugcgucacgauauaggcgccaccguacacgagcucucccgcgauaagaagaaagacacauag

SEQ ID NO: 5329 - RNA, 411 nt, Artificial Sequence
  Description of Artificial Sequence: Synthetic coding sequence
augagcacagcugugcucgagaaccccggguuaggcagaaagcuuagugauuucggccaagagaccagcuauaucgaagacaauugcaaccagaauggagcgaucucucugaucuuuucucuaaaggaggaaguuggggcacucgcuaaagucuugagauuauuugaagaaaacgauguaaacuugacccacauagagucuagacccagccgcuuaaagaaggaugaguacgaguuuuuuacacaucuugacaagagaucccuuccagcccucacaaauaucaucaaaauccugagacacgacaucggcgcuacuguccacgaacugagcagggacaagaagaaagauacgguacccugguuuccccgcacuauucaagaauuggaucgcuuugccaaucaaauucuguag

SEQ ID NO: 5330 - RNA, 1359 nt, Artificial Sequence
  Description of Artificial Sequence: Synthetic coding sequence
augucuaccgccguauuagaaaauccaggacucggaagaaaacuguccgauuuuggucaagaaacaucuuacauagaggacaacugcaaccaaaacggagcaauuucgcuuaucuuuucucugaaggaagaggugggugcccuggcgaaggugcuucgucuguuugaagaaaaugacguaaaucucacacauauugagucccggcccucacgccucaagaaagacgaauacgaauucuuuacucaucuggacaagcguagccuuccugcccugacaaauauuaucaagauccugagacacgacauuggagcaaccgugcacgaauuaucaagagacaaaaagaaggauacaguuccuugguuuccuagaacaauucaggaguuggaucgauuugcaaaccaaauccuuucuuacggcgcugagcuugacgccgaccaccccggauucaaggacccaguguaccgggcucgcagaaagcaguucgccgauaucgcuuacaacuaccgacauggucagccuaucccucgugucgaauauauggaggaggaaaaaaagacuuggggcacuguuuuuaaaacauugaaaucccuuuauaagacccacgcgugcuaugaguacaaucacaucuuuccucugcucgaaaaguauugcggauuucaugaagauaauaucccgcagcuagaagacgugagccaguuucugcaaacauguacaggauuuagacugagaccugucgccggccuacucagcuccagagacuucuugggcggccuggcauuuagaguguuccacuguacucaguacaucagacauggcagcaagcccauguacacaccagaaccagacauaugccacgagcuacucggccaugugccccuauucagugaucgcucuuuugcccaguucucccaagagauuggacuugccucucucggggccccugacgaauacauugagaagcuugcaacaauuuauugguucacuguugaauucggccucugcaaacagggagauucuaucaaagcauacggggccggccuucucucuagcuuuggagaacuucaguauugcuugagugaaaagccaaaacugcucccucuagaguuagaaaaaacagcaauucagaacuauacugucacugaauuucaaccacucuacuauguugccgaaucuuuuaacgaugcgaaagaaaaagugcgcaacuuugcagcaaccaucccucgucccuucaguguccgauacgacccuuauacacagagaauagaagucuuggacaacacacagcagcuuaaaauacuggcagauuccauaaauagugagauugguauccucuguuccgcacuacagaaaauuaaauag

SEQ ID NO: 5331 - RNA, 882 nt, Artificial Sequence
  Description of Artificial Sequence: Synthetic coding sequence
auggacgccaugaaaagaggcuuguguugugugcugcugcuuuguggcgccgucuuuguaucacccagccaggagauccacgccagguuucgaaggggcgcaagaucauaccaagugauaugucgugacgaaaagacgcagaugauuuaucagcagcaucaaucuuggcugcgcccuguuuuaagaucuaaucguguugaguauugcuggugcaauagcgguagagcucagugucacuccguccccgucaaauccuguagcgaaccaagguguuucaacgguggcaccugccaacaggcucuguacuucuccgacuuugucugucagugcccugagggcuuugccggcaagugcugugaaaucgacacuagagccacuuguuacgaagaccagggaauuucuuaucguggcacauggucaacugccgaaucuggcgcagaauguacuaauuggaauaguucugcucuugcucaaaaacccuauagcggccgacguccagacgcuauccgacucgggcuagguaaucacaacuauuguagaaaccccgacagagauaguaaacccugguguuauguguucaaggcaggcaaguacucaucugaguuuugcaguacccccgcuugcagugagggaaauagugauuguuacuuugggaaugguucugcauacagggguacccauagccuuacugaauccggagccucaugucuaccuuggaauuccaugauccugauaggaaaaguuuauaccgcucaaaaccccuccgcacaggcacugggcuuaggcaaacacaacuacugucgguguagaacaggucgaagcgucuccucgccggcaaccgcuucaaugcgccccugccugcucuccauuagaucuggcuag

SEQ ID NO: 5332 - RNA, 1551 nt, Artificial Sequence
  Description of Artificial Sequence: Synthetic coding sequence
auggacgcgaugaaacgugggcugugcuguguucuccuuuuauguggcgcaguguuuguuuccccaucucaagagauccacgcucgguuucgcaggggagcccgaaguuaccaagguugcagugagccccgguguuucaauggcggaacaugccaacaggcucuguauuucagcgauuucguaugucaaugcccugagggauucgcaggaaagugcugugagauugauacucgagccacguguuacgaagaucagggcauuaguuauagaggaacuuggucaacugcugagagcggcgcagaguguacaaacuggaacagcucugcacuggcgcaaaagcccuacuccgggagacgaccagacgcuauccgauuaggacuugggaaucauaacuauugccgcaacccugaccgcgacucuaaaccauggugcuauguuuuuaaagcggguaaguacagcagcgaguucugcagcacacccgccugcucagaagggaacucggauugcuacuuugggaauggaagcgcauauaggggaacgcacagccugaccgaauccggggccagcugcuuacccuggaacuccaugauacugauugggaaagucuauaccgcgcagaaccccucugcacaggcucugggccugggaaaacacaauuauugcagaaauccggacggugacgcgaagccuuggugccauguacuuaagaacagacgccugaccugggaauacugcgacguuccuaguuguuccacauguggccugagacaguacucucaaccccaguuucgaaucaaaggagguuuguuugcagacauagccucucaucccuggcaggccgcuaucuuugccaagcaucgaaggagccccggagagcguuucuuguguggagguauucucauuucauccugcuggauucugucagcugcccacuguuuccaggaaagguuccccccacaucaccugaccgucauauuagggagaacuuacagaguugugccaggcgaagaggagcaaaaauucgaggucgaaaaguacauuguccacaaggaguucgaugacgacacauacgauaacgacaucgcccuucuccagcugaaaucggacucaagccgcugugcccaagaaucaaguguagugcggaccgucugucuuccgccagcugaucugcaacugccggacuggaccgaaugcgaacuuaguggcuauggaaaacaugaggcucugucucccuuuuacagugagaggcuuaaggaagcgcauguaaggcuguaccccucuucccgguguacaucucaacaccuuuugaaucguaccgugacugauaacauguugugcgcuggugauacccggucaggaggcccacaggccaacuuacacgacgcaugucaaggagauucugggggaccucugguuugccucaacgaugggcgaaugacccugguaggcaucauuuccugggggcugggaugcggacagaaagacgugcccgguguauauacgaaagucacgaauuauuuagauuggauuagagacaacaugagaccuuag

SEQ ID NO: 5333 - RNA, 1689 nt, Artificial Sequence
  Description of Artificial Sequence: Synthetic coding sequence
auggaugcuaugaagagaggccucugcuguguucuucuucucugcggcgccguguucguguccccaagccaggagauucaugcucgauuucgucggggcgcaaggucauaucaaguaauaugucgggacgagaagacccagaugauauaucagcagcaccaguccuggcugcgucccguauugaggucaaaucgaguggaauauuguuggugcaacucagguagggcccagugccauagcgugcccgugaaaucuugcuccgaacccagaugcuuuaauggaggaacuugucaacaagcauuguauuuuagugauuucgugugucagugucccgaaggcuucgccggcaaaugcugcgagauugauacaagagcaacuugcuacgaagaccaggguauuagcuaucgaggaacuugguccacugccgagaguggagcugaauguaccaacuggaacuccuccgcccuugcccaaaaaccuuacagcgggaggaggccagacgcaauuagacuuggacucggaaaucauaacuauugucgcaacccagaccgcgauuccaagccgugguguuauguuuuuaaggcaggaaaauauaguagcgaauuuugcucaacuccggccugcucagagggaaauagcgauuguuacuuuggcaacggaagcgcauacagagguacucauucacugaccgagucuggggccucaugccuucccuggaauucuaugauccuuauugguaagguguacacagcucagaauccauccgcgcaggcucugggacuugguaagcauaauuacugccgaaacccugauggagaugccaaaccuuggugccauguuuugaaaaauagacggcuuacgugggaauauugugaugugccuuccuguucgaccugcggucuuagacaauacucucagccucaguuuagaaucaaaggcggccuguuugcagauauugccucccacccuuggcaggccgcaauuuuugcuaagcaccggagaagucccggcgaaagauuccucugugggggaauacucauuuccuccuguuggauacucagcgcugcucauuguuuccaggaaagguucccuccgcaccacuuaacagucauucucggacgaaccuacagagucguuccaggcgaagaagaacagaaguucgagguggagaaauauaucgugcauaaagaauucgaugaugauacauaugacaacgauauugcccucuuacaacuuaagucugacuccucuaggugcgcccaggagagcucugucguuagaacuguuugccugccuccggcugaccugcagcugccagauuggacagaaugcgaacucucggguuaugguaagcacgaagcgcuuucaccauucuauagcgagcgguugaaagaggcgcacguccguuuguaccccaguucaagauguaccagccagcauuuacucaaccguacugugaccgauaacaugcucugcgcuggagauacaagaagcggaggcccacaagcgaaccuccaugacgcuugucagggugacucaggcggaccccuugugugucugaacgacggcagaaugaccuuagugggcauuauuagcuggggacugggauguggccagaaggacgugcccggcguuuauacaaaggugacaaacuauuuggauuggaucagagauaacaugaggccauag

SEQ ID NO: 5334 - RNA, 1311 nt, Artificial Sequence
  Description of Artificial Sequence: Synthetic coding sequence
auggaugcuaugaagagggguuuauguuguguccugcugcucugcggcgccguuuucgugucgccuucccaggagauccacgcucgguuucggagaggggcucggucauaucagguuauaugucgcgaugagaaaacucaaaugaucuaccagcaacaccaaagcuggcuccgcccaguccuaagaagcaauagaguagaguacugcugguguaauucgggccgggcccaaugccacucugugccagugaagagaaauuccgauugcuauuucgggaauggaagcgccuauaggggcacucauucacucacugagucuggcgccucaugccugccuuggaacucaaugauucugaucggcaaaguguacaccgcccagaauccaagcgcucaggcucuagggcucgggaaacacaauuacuguagaaaucccgacggagaugcuaagcccuggugccacguccugaaaaauagacgccuaacaugggaguacugugacgugccauccuguuccaccuguggucuccgacaauacucccagccucaauuuagaaucaaagguggucuguucgccgauaucgcaagccaccccuggcaagcugcaauauuugcuaaacaucgaagaucucccggggaaagauuucuguguggaggcauacugaucaguagcuguuggauccugagcgccgcccacuguuuccaggaacgauucccaccacaccaccugacgguaauuuuaggcaggacuuaccguguugucccuggagaggaggagcagaaauucgagguggaaaaauacauuguucacaaagaauucgaugacgacacauacgauaacgauaucgccuuacuucaacuuaagagugacuccaguagaugcgcccaggaaagcucuguuguaagaacugugugcuuaccucccgccgaucuccaacucccagacuggaccgaaugugaacuguccggauauggcaagcacgaggcacugucuccuuuuuauucugaaagacugaaagaggcucacguuagacuguaccccaguagucgcuguacuucccaacaucuucugaacagaacagucacagacaauauguugugcgccggggacacccgauccgggggaccccaggccaaucuccacgacgcaugucagggcgacuccggaggccccuuaguaugcuugaaugacgggagaaugacguuaguggggaucauuuccuggggauugggguguggacaaaaggacguaccaggaguguauacgaaggucacaaacuauuuggauuggaucagagauaauaugcgacccuag

SEQ ID NO: 5335 - RNA, 1500 nt, Artificial Sequence
  Description of Artificial Sequence: Synthetic coding sequence
auggacgcuaugaaacgcggacugugcuguguauuacugcuaugcggcgcugucuucgugagcccuucacaagagauccacgcccgauucagacgcggugccaggaguuaccaggugaucugcagggaugagaaaacgcaaaugaucuaucagcagcaccagucauggcugagacccgugcuuagaucaaauagagucgaguauuguuggugcaauucaggccgagcccagugucacagcguaccaguuaagaguugcuccgagccucgcugcuucaauggcggaaccugccagcaggccuuauacuucagcgauuuuguaugucaaugcccagagggauuugccggcaagugcugugagaucgauaguaagcccuggugcuauguguucaaagccggcaaauauucuuccgaauuuugcucaacacccgccugcagcgagggcaauagugacuguuacuuuggaaacgguucagcguauagggggacgcauagccugaccgaaucuggagccucuugucugccuuggaacagcaugauccucaucggcaaggucuauacagcucagaaccccucugcccaagcucucggccucggaaaacauaauuacuguagaaaucccgauggcgacgccaaaccuuggugccauguguugaagaacaggagacucacaugggaguacugugacgucccgagcuguucuaccuguggacuaagacaauauucucaaccccaauuucgcauaaagggcggacuguuugccgauaucgcuucucauccuuggcaggcugcaaucuucgcaaaacacagacguagcccgggcgagcgcuuucucuguggggguauccuuauuucuucuuguuggauacuuucugcagcacauugcuuucaggagcgguuuccuccccaucaucugacggugauccuaggccgaacauaccgcgugguacccggggaagaagagcagaaauuugaagucgaaaaauacauagugcacaaagaauucgacgacgacaccuacgacaacgauauugcacuuuuacaacugaagucagacagcucccgaugugcgcaagagucuucugucguccggacaguaugccucccacccgccgaccugcaguuacccgauuggacugaaugugagcucucaggcuacggcaaacacgaggcccugagccccuucuacagcgaaagacuuaaggaagcgcacgugcgccuguacccaucuucccgguguaccagucaacaucuacugaauaggaccgugaccgacaacauguuaugcgccggcgacacacgaucugguggcccacaagcuaaccuccaugaugcaugucagggcgauagcgggggacccuuaguuugucugaacgaugggagaaugacucuaguugguaucauuucuuggggacuagggugcggacagaaggaugugccggggguuuacaccaaaguaacgaacuaccucgauuggauccgagacaacaugcggccauag

SEQ ID NO: 5336 - RNA, 537 nt, Artificial Sequence
  Description of Artificial Sequence: Synthetic coding sequence
auggaugccaugaagcgaggccucuguugugugcuucugcuuuguggggcaguguuugucucaccaucacaggaaauucacgcucguuuccggaggggugcgagauccuaccaggucaucugucgggacgaaaaaacccaaaugauauaccaacagcaucaauccuggcucagaccuguucugcggucaaaccgcgucgaguauugcuggugcaacucuggccgcgcucaaugucacucugucccuguuaaaagcuguucggagccccgguguuucaauggcggcaccugucaacaagcacuguauuucuccgacuucgucugccagugucccgaaggauuugcagggaaauguugcgaaaucgacaccagagccacaugcuaugaggaucaagguauuagcuaucgaggaacauggucuacagccgagaguggcgcugaaugcaccaauuggaacucuucugcccucgcucagaaaccguauuccggccgccgcccugaugcaauccgcuuaggacugggcaaccauaacuauuag

SEQ ID NO: 5337 - RNA, 474 nt, Artificial Sequence
  Description of Artificial Sequence: Synthetic coding sequence
auggaugcaaugaagagggggcuguguuguguauuacuccucuguggcgccgucuucguuucccccagucaggagauacacgcacgcuucagacgcggugcacguaguuaccaagugauuugcagggacgagaagacacagaugauauaccaacaacaccagucuuggcucaggccuguccuacgguccaaucgggucgaguauugcuggugcaauucaggucgcgcucagugccauucaguuccagugaagaguuguagugagccaagguguuuuaauggcgggacuugucagcaggcucuauacuuuuccgauuuugugugccaguguccggagggcuucgcaggaaaaugcugcgagauugacaccagagcuacauguuacgaggaucaaggcauaucauaccgcgguacauggucuaccgccgaauccggugcugaaugcacuaacuggaacucauccgcccucgcuuag

SEQ ID NO: 5338 - RNA, 1422 nt, Artificial Sequence
  Description of Artificial Sequence: Synthetic coding sequence
auggaugccaugaaacgaggacuguguugugugcuuuugcuuugcggagccgucuuuguaagcccaucacaggagauccaugcaagauucaggcgaggggcgcguuccuaucaggucauaugcagagaugagaaaacucagaugaucuaccagcagcaucaaucauggcuacguccaguccugaggagcaaccgaguugaauauuguuggugcaauucuggccgcgcccagugccacuccgugccaguaaaaucuuguuccgagccucgcuguuucaauggagguacaugccaacaggcucuguauuucagugauuucguuugucagugccccgaaggcuucgccgggaaaugcugcgagauugguaacagcgauuguuacuuuggaaauggaagugcuuaccgaggaacccauagccugacagaauccggugccucuugcuugcccuggaacagcaugauacuuauugggaaaguguacaccgcacagaacccuucugcacaagcacugggacugggaaaacauaauuauugcaggaaccccgauggagacgcaaagccguggugccaugugcugaaaaacaggaggcucaccugggaguacugcgaugucccuagcuguucuaccuguggccugaggcaguauucacaaccccaguuuagaaucaaaggagggcuuuuugccgauaucgccucucauccuuggcaggcugcuaucuucgcuaaacaccggcgcucgcccggugaaagauuuuugugcggaggaaucuugauuucgucauguuggaucuuaagcgcugcacacugcuuccaagagcgguuccccccucaucaucucacaguuauucugggccggaccuaucgcgucguaccaggagaggaggaacaaaaauucgaagucgaaaaauauaucguccacaaagaauucgacgaugauacuuaugacaaugacauugcauugcuccagcugaaguccgauuccucucgcugugcccaagagucauccgucguuaggacuguuuguuuaccccccgcugaucugcagcugcccgauuggacagaaugugaacuaucaggguacggaaaacacgaagcucugucaccauuuuauagcgagcggcugaaggaagcccacguuagacucuaucccucaucgcgcuguacaagucaacaucuucugaaccggaccguuacugacaauaugcugugcgcuggcgauacaaggaguggcgguccccaggcuaauuugcacgaugcuugucagggugauagcgggggaccccugguaugcuuaaacgacggaaggaugacacuaguaggaaucaucucauggggccugggaugcggacagaaagaugugccaggaguguacaccaaggugaccaauuaucuggauuggauucgagacaauaugaggccauag

SEQ ID NO: 5339 - RNA, 1488 nt, Artificial Sequence
  Description of Artificial Sequence: Synthetic coding sequence
auguggcagcuuacaucacugcuccucuuugucgccaccuggggcauauccggcacgccugccccauuagauaguguuuuuagcucaucagaaagagcacaccagguacuucggauacguaaaagagccaauucuuuucuagaggaacugaggcacagcaguuuggaacgugaaugcauugaagaaaucugugacuuugaggaagcaaaggaaauuuuccaaaauguggacgauacucuggcguuuugguccaaacacguugacggagaucaaugccuaguccugccgcuggaacaccccugugcuucuuuaugcugcggucaugggaccuguauagauggaaucgggucauuuagcugcgacugccgauccgggugggaaggcagguuuugucagagaggugaaggugaaagauggaugcucgcaggaggaggggcaggacugggaccaggauggggaagagguacauccacuagcuguccucggccuccacuuccagcugaagugucuuuuuugaauugcucccuggacaauggcggguguacucacuauugcuuggaagagguaggguggaggcggugcuccugcgcacccggcuacaaacuuggggacgaccuccuccagugucacccagcugugaaauuccccuguggcagacccuggaaacgcauggagaagaaaagaucacauuugaagagagacaccgaagaccaggaggaccagguggauccuagacugauagacgguaaaaugacacguaggggugauagucccuggcagguggugcugcuggauucaaagaagaaauuagccugcggcgcugugcugauccaucccaguuggguccugacugcugcacacuguauggaugaaagcaagaaauuauuaguuagacugggggaauaugaucugcgucgcugggaaaaaugggaacuugaccuggauauaaaggaaguguuuguccaucccaacuauucaaagaguaccacggauaacgauauugcucugcuacaucuugcacaaccagccacacugucccaaacaauugugccuauuugucuccccgauagcggccuugccgaacgcgaacuuaaccaggccgggcaggaaacacucgucacugggugggguuaccauucuagccgugagaaggaagcuaaacgcaaccgcacuuuuguucucaacuuuaucaagauaccugucgugccucacaacgaaugcucagaggugaugucaaauauggugucagagaacaugcugugugcagggauuuuaggagauaggcaggacgccugcgagggcgacucaggcggccccaugguggcuaguuuucaugguacaugguuucuugugggccucguuucuuggggggagggauguggacuucuacauaauuauggcgucuauacaaaggugaguagauaucuugauuggauccacggacacaucagggacaaggaagcuccacagaagagcugggccccguag

SEQ ID NO: 5340 - RNA, 1386 nt, Artificial Sequence
  Description of Artificial Sequence: Synthetic coding sequence
auguggcagcucaccucacugcugcuguuuguagcuacuugggguaucucggggacccccgcuccguuagauuccguuuuuucaucauccgagagagcccaccaagugcucagaauccggaaacgcgccaauagcuuuuuagaggaguuacggcacaguagucuagaaagggaaugcauugaagaaauuugcgauuuugaggaagcuaaagagaucuuucagaauguagaugauacccuggccuuuugguccaaacacguagacggcgaucagugucuagugcuccccuuagagcacccaugcgcaagccugugcuguggacaugggacuuguauugacgguaucggcuccuuuucaugcgauugccgcuccgguugggaagggcgauuuugccagagagaaguguccuuucugaauugcagccuggacaacggagguugcacacauuacugucucgaagaaguuggcuggaggagaugcuccugugcaccugguuauaagcugggagacgacuugcugcagugccauccugcugucaaauuccccugcgguagacccuggaaaagaauggaaaagaagagaagucacuuaaagagggauacagaagaucaggaggaccaagucgacccuaggcugauagaugggaaaaugacaagaagaggagauagcccguggcagguuguacuucuagacagcaaaaagaagcucgccuguggggcagugcucauacacccuuccuggguccugacggccgcccacuguauggaugaauccaaaaagcuucugguaagauugggugaguaugaccuacgccgaugggaaaagugggaauuagaccucgacaucaaggaaguuuuugugcacccuaauuauucaaagucuacuacggacaacgacauugcccuccugcaccuagcucaacccgcaacuuugucacagacuauagucccaauuugccuucccgacucaggccucgcagaaagggaacuaaaccaggccgggcaggagacccuggucacuggguggggauaccacaguucacgcgagaaggaggcuaaacggaaccgcacuuuugugcugaauuuuauuaaaauacccgucguuccucacaacgaaugcagugaagugauguccaacaugguuucugaaaauaugcugugcgcuggaauauugggcgacagacaggacgcaugcgaaggagauuccggcggcccuaugguggcuaguuuucacgguacaugguuccuugucggucucguaucauggggcgagggcugcggauuguugcacaauuauggaguuuauaccaaagugagucgcuacuuagauuggauacacgggcacauacgcgauaaagaagcaccucagaagucuugggccccauag

SEQ ID NO: 5341 - RNA, 351 nt, Artificial Sequence
  Description of Artificial Sequence: Synthetic coding sequence
auguggcagcugacaagccuacuguuauuuguggccacguggggcaucucgggaacacccgcaccgcucgacucaguguucucaagcagcgaacgggcucaucagguacucagaauccguaaaagggcaaauuccuuuuuagaggaguugcgacacucaucacuggaaagagaguguauagaggagauuugugauuuugaagaagcuaaagagaucuuucaaaacgucgaugacacuuuagcguucuggucuaaacacguggauggagaucaaugccuaguguuaccucucgaacauccaugcgccucuuugugcuguggacaugggacuuguauugacggaauuggauag

SEQ ID NO: 5342 - RNA, 381 nt, Artificial Sequence
  Description of Artificial Sequence: Synthetic coding sequence
auguggcaauuaaccucuuuacuguuauucguggcaacuugggguauuucagggaccccugcucccuuggacagcgucuuuaguagcagcgagcgagcucaccaaguccuaaggauacgcaaacgagcuaauucuuuucucgaggagcuucgacacucuucucuggagcgcgaaugcauagaggagauaugugacuuugaagaagccaaggagaucuuccagaacguggaugacacuuuggccuuuuggucuaagcacguagauggugaucaaugccuaguucugccucuugaacauccuugugcgucccuguguugcggccauggcacguguaucgauggaauuggcucauucucuugugauuguagaucuggaugguag

SEQ ID NO: 5343 - RNA, 1551 nt, Artificial Sequence
  Description of Artificial Sequence: Synthetic coding sequence
auggccgcuggccgccguacauguucuaucaguacaaccagacccugugcgagcgcaucccguauguggcaacuuaccucucugcuccucuuuguggcuacuuggggcauuucuggaaccccggcaccccuggauuccgucuucuccucgucagaacgagcacaccagguccuccggauacgcaaacgggcgaacuccuuucuggaggagcuccgccauuccucucucgaacgcgaguguaucgaagaaaucugugacuucgaagaagcuaaggaaaucuuccaaaacguggaugauacccucgcguuuugguccaagcaugucgauggugaccagugucucguucucccgcuggaacauccuugcgcgucacuguguuguggacauggaaccuguauugacggcauagggagcuuuagcugcgauuguagauccgggugggagggcagauuuugccagaggggggagggagaaagauggaugcuugcuggaggcggggcugguuugggacccggauggggacgcgggacaagcaccaguugcccacgcccuccacuccccgccgaagucucauuucugaacuguucccuggauaacggcggcuguacccacuacugcuuggaagaagugggauggagacguuguuccugugcaccaggcuacaaguugggagaugaucugcugcagugccaccccgcugugaaguucccguguggacgcccuuggaagcgcauggaaaagaaaagaucccaucucaaaagagauacagaagaucaagaagaucaagucgauccaaggcuuauugaugguaagaugacccgucguggugacucccccuggcaggucguucugcuugauucuaagaaaaagcuggcuugcggggcaguacuuauccacccaucuugggugcucacagccgcccauuguauggacgaaucuaagaagcugcuaguccgccugggagaguaugauuuaaggagaugggagaagugggaguuagaucuggauaucaaagagguguucgugcauccuaauuacaguaaauccacaaccgauaaugauauugcccuucugcaccuugcacagccggcuacucuaucucaaacaauuguuccgauuugucucccugauaguggccuggcggaacgugaacucaaucaggcugggcaggagacccuagugacagguuggggcuaucacucaaguagggaaaaggaagccaaaagaaauagaacguuugugcuuaacuuuauuaaaauuccuguugugccucauaaugaaugcuccgaagugaugucgaacauggugucggaaaauaugcuuugcgcugggauucugggcgaccgccaggaugccugugaaggcgauucaggggggccgaugguugcaucuuuccaugggaccugguuuuuggugggauugguauccuggggcgaagguugcggacugcuucauaauuacggaguuuacacuaaagucucuagauaucucgauuggauacauggacacaucagagauaaagaagcuccccaaaaauccugggccccuuag

SEQ ID NO: 5344 - RNA, 1263 nt, Artificial Sequence
  Description of Artificial Sequence: Synthetic coding sequence
auguggaugacccacuggccauccggccccucaacuucuacagucaccagcgccuggaguuguccuugguccacuagggcaccagccugugccgccggaaccgccagggcauccacggccuccgcugcaucggccgcuacugcagcugcagcuggaagggcggcguccgccucagcagucagaggaagggggggguguuggagagggggugcgggccuagggccuggcugggggagaggaacaagcacaucaugcccacguccaccuuugccugccgagguuuccuuccugaauuguucgcuggauaacggaggaugcacccauuacugucuggaagaaguugguuggagaagaugcucaugugccccgggcuauaaacuaggggaugaucuccugcaaugccacccggcagucaaauuccccugcggucgaccuuggaaaagaauggagaagaagagaagucaucuuaagagggauacggaggaccaggaggaucagguugaccccagauuaauagaugguaagaugacccggcgcggugauucuccguggcaaguggugcuucucgacagcaaaaagaaguuggccuguggcgcaguauuaauacauccauccugggugcucaccgcugcgcauuguauggacgagaguaaaaaacuccugguuagacuuggagaauacgaccugagacgcugggaaaagugggagcucgaucucgacauuaaagaagucuuugugcauccuaacuauucaaagucaaccacagacaaugacaucgccuugcugcaccucgcucagcccgcuacuuuaucucagacuauugucccuauaugccugccagacuccggccucgcugaacgcgaacucaaucaggcaggucaagagacccugguuaccggguggggguaucauucuucucgggaaaaggaagcuaagagaaaccgaaccuucgugcugaacuucaucaaaauuccagucgucccccauaacgagugcagcgagguuaugaguaauaugguguccgaaaauaugcuuugcgcuggaauuuuaggagacagacaggaugcaugcgagggagauagcggagggccaaugguugcaucauuccaugggacuugguuucuggugggauugguuagcuggggggagggcugcggguugcugcacaacuacggcgucuauacuaaggugaguagauaccuggauuggauucacgggcauauuagggacaaagaagcaccgcaaaagucaugggcaccguag

SEQ ID NO: 5345 - RNA, 1047 nt, Artificial Sequence
  Description of Artificial Sequence: Synthetic coding sequence
augaauggcaccgaaggcccgaauuucuauguacccuuuuccaacgcaaccggcguggucagauccccauuugaauauccccaauacuaccuugcugaaccuuggcaguuuaguaugcuggcagcuuacauguuuuuguugauuguccugggauuuccaauaaauuuccuaacucuauaugugacagugcagcauaaaaaacugcggaccccucucaauuauauucuucuuaacuuggcugucgcugaccucuucaugguccugggagguuucacuucaacacuguauacaaguuuacacggauacuuugucuuuggccccacaggcugcaacuuggaaggauuuuuugccacccuggggggagaaaucgcacucuggucacucgugguacuggcgaucgaacgguacgucguaguguguaaaccaauguccaauuucagauuuggcgaaaaccacgcaauuaugggaguugccuucaccugggugauggcucuugccugugcugcgccgccuuuagccgggugguccagguacauccccgaaggccuacaaugcagcugcggaaucgacuauuacacacugaagcccgaaguaaauaacgagucauucgucaucuauauguucgucguacacuucacaauccccaugaucauuauuuucuucuguuauggucagcuggucuuuaccgucaaagaggccgcagcccagcaacaggagucagccacuacccagaaggccgaaaaagaagucacuaggaugguuaucauuaugguaaucgccuuucugaucuguuggguaccauaugcuuccguugccuucuacaucuuuacccaccaaggcuccaauuucggaccuaucuucaugaccauccccgcuuucuuugcaaaaucugcagcgaucuacaacccugugauauauauuaugaugaauaaacaauuucgcaauugcaugcugacuacaauuugcuguggaaagaauccucuuggcgacgaugaagcaucagcuacugugagcaagaccgaaacaucccaaguagccccggccuag

SEQ ID NO: 5346 - RNA, 1257 nt, Artificial Sequence
  Description of Artificial Sequence: Synthetic coding sequence
augccaagcucagucaguuggggcauccugcuccuugccggccuuuguuguuuggugcccguaucacuugcagaggauccccagggugaugccgcucagaagacagauacuucacaccacgaucaggaccaucccaccuuuaauaagauuaccccgaacuuggcagaauuugcuuucagucuguaccgucagcuagcucaucaaucuaacaguacuaauaucuuuuucuccccuguuucuaucgcuaccgccuuugcuaugcuuucauuaggcaccaaggcagacacccacgacgagauucuugagggucugaauuuuaaucugacagagauacccgaagcacaaauccacgagggguuucaggagcugcugcgcacccucaaucagccggacucacaacugcagcugaccacaggaaauggccuauuccuuagcgagggguugaagcucguggacaaguucuuggaggacgugaagaaacucuaucacucggaagcauucaccgugaauuucggggauaccgaagaggcgaagaaacaaaucaaugacuacguggagaagggaacccagggaaaaauaguugacuuggugaaagagcuggaucgggacacaguguucgcucucgugaauuacauuuucuuuaaaggcaagugggaacgucccuuugaggugaaagauacugaagaagaggauuuccauguggaucaagugacaacuguaaaaguccccaugaugaagagacuugggauguuuaauauccaacauuguaaaaaacugagcuccuggguguuacucaugaaguaccugggcaacgcgacugccauuuuuuuccugccagacgaggguaagcugcagcaucuggagaacgaacugacacaugauaucauuacuaaguuccucgaaaaugaagaucgucggagcgcaucccuccaucuaccaaaauuaagcaucacaggcacauaugauuugaaaagcguccugggccaguuaggaaucacaaaaguuuucucuaauggggcagauuugagcggcguaaccgaagaggcaccucugaaacugagcaaggcugugcauaaggcugugcucacaauugaugagaagggaacagaagccgcaggcgcuauguuccuugaagcaauuccgauguccaucccaccagaaguaaaguuuaacaaaccuuucguauuucuaaugauugaacagaauaccaaaucuccacucuucauggguaaagucguuaauccaacacaaaaguag

SEQ ID NO: 5347 - RNA, 1257 nt, Artificial Sequence
  Description of Artificial Sequence: Synthetic coding sequence
augccaucauccguguccuggggaauauuacuucuggccggacuuuguugucugguccccgugucgcuggcggaagacccacagggagacgcagcacagaagaccgacaccagucaccacgaccaagaucacccgacuuuuaauaaaaucacacccaaccuggccgaguucgcguucagucuguacagacagcucgcucaccaauccaacuccacuaacauauucuucucacccguuagcaucgccaccgcuuuugcuauguugucccucggaacuaaagcugacacacacgacgaaauacuggagggucuaaauuucaaucugacagaaauucccgaggcacaaauccacgagggauuucaggaguuacucaggacacuuaaucagcccgacucacaguugcaacuaacaacaggaaacggucuuuucuugucugaaggacucaagcucguugacaaguuucucgaagauguaaagaaauuauaccacucugaagccuuuacggucaacuucggggauacggaggaagccaagaagcagauuaaugacuacguagagaaggggacccagggaaagauuguugaucuugugaaggaacucgaucgggauacagucuucgcccuggucaauuauaucuucuuuaaggggaagugggaaagaccuuuugaaguuaaggacacagaggaggaggauuuucauguggaccagguuacaacugugaaggugcccaugaugaagaggcuagggauguuuaauauacagcacugcaagaaacuuuccagcugggucuuacucaugaaguaucuugguaacgcuacagcaaucuuuuuuuuaccagacgagggaaaauugcaacacuuagaaaaugaguugacacaugauauaauaacgaaguuucuggagaacgaagaccgacgcucugccuccuugcacuuaccaaaacuaucaauaaccggcaccuacgaucucaaguccguacuggggcaacucgggauuaccaaaguauuuuccaacggugcagaucuaucugggguuacagaggaggccccacuuaaacuaucgaaggccguucauaaagccgugcugacaauugacgagaagggcaccgaagcugcuggugcgauguuccuggaagccauaccuaugucaaucccuccugaggucaaauuuaauaagccauuuguguuccugaugaucgagcagaacaccaaaagcccucuuuuuaugggaaaaguugucaaccccacccagaaauag

SEQ ID NO: 5348 - RNA, 1257 nt, Artificial Sequence
  Description of Artificial Sequence: Synthetic coding sequence
augccuucaagcgugucuuggggcauuuugcuucuggccgguuuaugcugcuuggugcccgucucucucgccgaagauccacagggagacgcugcucagaaaacggauaccucccaucaugaucaagaccacccuacguuuaacaagauuacucccaauuuagcggaauuugcuuucucucuauacagacaacuggcccaccaguccaauagcacaaacaucuucuucucucccguuucgaucgcuacagccuucgccaugcugagccuggguacaaaagccgacacacaugaugaaauccuggaaggcuugaacuucaaucuuacagagauccccgaggcgcagauccaugagggauuucaagaauugcuucgaaccuuaaaucagccggauucccagcuccagcuuaccacagggaauggucucuuucuaucagagggccucaaacucgucgauaaauuccuggaagaugucaagaaacuguaccauuccgaagcauucacuguuaauuucggggacacagaagaagcuaaaaaacagaucaaugacuacguggaaaagggaacucaagggaaaauuguugaccugguaaaggaacuugauagagacacgguguucgcccuggugaauuauaucuucuuuaagggaaagugggagagaccauuugaagugaaagauaccgaagaagaagacuuucauguagaucagguaacuacagugaagguucccaugaugaaacgcuuaggcauguucaacauacagcauuguaaaaaacuauccagcugggugcuccugaugaaauaccuugguaaugcaacugccauauuuuuccuaccugacgaaggaaagcuccagcauuuggaaaaugagcucacacacgacauaaucacaaaauuucuggagaaugaagaucgccgaagcgcuagucugcaccugccaaagcucucuauaacugggacguaugaccuuaagagcgugcucggacaguuaggaauuacuaaaguguuuagcaacggggccgaccuguccggugucacugaggaagccccccuuaagcucagcaaggcuguccacaaagcugugcucaccaucgacgagaaaggaacagaggcugcuggagccauguuuuuagaagcaauaccuaugucaauucccccugaggugaaauuuaauaaaccauucguguuccucaugauagagcagaauaccaagucuccgcuguuuaugggcaaagucgugaauccuacucagaaauag

SEQ ID NO: 5349 - RNA, 1080 nt, Artificial Sequence
  Description of Artificial Sequence: Synthetic coding sequence
augccaaguaguguguccuggggaauucugcugcuggccggacuuugcugcuugguaccagugucccuggccgaagauccccaaggagaugcagcacagaaaaccgacacaagucaccacgaccaagaccauccgaccuucaauaagauuacaccgaaccucgcugaauucgccuucucccuguaccgacaguuagcucaccagucuaacucuaccaacauuuuuuucuccccagucuccaucgccaccgcauucgcuaugcugucucugggcaccaaagccgacacucaugacgagauacuugaaggguugaauuucaaucugaccgaaauuccagaagcccagauacacgagggauuccaggaacugcuuagaacauuaaaucagccugauucccaacugcaguugaccacagggaauggauuguucuuaagcgaaggccucaagcugguugauaaguuucuugaggacgugaaaaagcucuaucauucggaggcauuuacgguuaauuucggagauacagaggaagcaaaaaaacagauaaacgacuacgucgagaaagguacacagggcaagauuguggaucuuguaaaggaauuggaucgggauaccguguucgcucucgugaauuacauuuuuuuuaagggaaaaugggagagaccuuucgagguuaaagauaccgaggaggaggauuuccauguagaucagguaaccaccguuaaagugccaaugaugaaacgcuugggaauguucaacauccagcacuguaaaaaacuguccuccuggguccugcucaugaaguaccuugggaacgcgaccgcuaucuuuuuuuugccagaugaggguaaacugcagcaccuggagaaugaacugacccacgacauaauuacuaaguuucuggagaaugaggaucgucgcuccgcuucucuccaccugccuaagcugagcaucaccgguaccuacgaucuaaagagcguuuugggccaguugggcauaaccaaaguauuuaguaacggcgccgauuuaucaggcgugacagaggaagcuccacucaagcuuagcaaaguucggaguccauag

SEQ ID NO: 5350 - RNA, 1257 nt, Artificial Sequence
  Description of Artificial Sequence: Synthetic coding sequence
augcccagcagcguguccuggggcaucuuguugcucgcuggccugugcugucuggugccagucucccuugccgaggacccacaaggcgaugccgcccagaaaaccgauaccucucaccaugaccaagaccauccaaccuuuaauaagaucacgccaaaucuugcagaauuugcuuucagccuuuaccgccaacucgcccaucagucaaacuccacaaauauuuuuuucucuccuguguccaucgcuacugccuucgcaaugcucagccugggaacuaaggccgacacacaugaugagauucuggaaggauuaaauuuuaacuuaaccgagaucccugaagcgcaaauucaugaaggcuuucaggagcuucugcgcacucuuaaucagccagauucucaacuacagcucacaaccggcaauggacuuuucuugucugaaggacugaagcucguagacaaguuccuagaggaugucaaaaaguuauaccacuccgaagcuuucacaguuaauuuuggagacacagaggaggcaaaaaaacagauuaaugacuaugucgagaagggaacacagggcaagauuguggaucucgugaaggagcuggaccgagauacaguguuugccuuagucaauuacauuuuuuuuaaaggaaagugggaacgccccuuugaagucaaagacacugaagaagaggauuuccauguagaucaggugacuacaguaaagguuccaaugaugaagagacuugguauguucaauauacagcacugcaagaaguugagcuccuggguacuauugaugaaauacuugggaaaugcgaccgcuauuuucuuccucccagacgaaggaaagcuucaacaccuggagaacgaacucacacacgauauuauaacaaaguuucuugagaaugaagaccgacguucugcaucccugcaccugccaaagcucuccaucaccggcacauaugaccugaaaucagugcugggccagcuuggaauaacaaaggucuucucgaauggugccgaccuuagcggcguaacugaagaagccccacuuaagcuuuccaaggcuguccacaaagcugugcuuacaauugaugaaaaaggcaccgaggcagcuggggcaauguuccuggaagccauuccuaugucuauuccucccgaagucaaauuuaauaaaccuuuuguguuccugaugauugaacagaauaccaagucuccccucuucauggguaaagucguaaacccaacccaaaaauag

SEQ ID NO: 5351 - RNA, 1257 nt, Artificial Sequence
  Description of Artificial Sequence: Synthetic coding sequence
augccuaguagugucuccugggggauucuccuguuagcgggucucugcugcuuggugccugucagccucgccgaggauccccagggcgacgccgcacagaaaaccgacacuucacaccaugaccaagaccacccaacuuuuaauaaaauaacuccuaaccucgcugaauucgcuuuuagccuuuaccgucaacuugcccaccagucuaacucuaccaacaucuuuuucucaccaguauccaucgcaacagccuucgccaugcuuagcuuagggacuaaagccgauacacacgaugaaauacucgaggggcucaauuuuaacuuaacagaaauucccgaggcacaaauccaugagggguuucaggaacuucugcgaaccuugaaucagccggauucucaacuccaacucaccaccggaaacgggcuauuccuguccgaaggccuaaaauuaguugacaaguuccucgaggauguuaaaaaguuauaucacagugaggcuuuuacaguaaauuuuggggauaccgaggaggcaaaaaagcagaucaaugacuacguggagaagggcacacagggcaaaaucgucgauuugguaaaggaacuggaucgagacacagucuuugcacuggucaauuauauuuucuucaaagguaaaugggagcggccuuuugaagugaaggauaccgaggaggaagauuuccauguugaucaggucaccacagugaaggugcccaugaugaaaagacucggaauguuuaacauccaacauugcaaaaaacuguccagcugggucuugcugaugaaguaucuggggaacgcuacugcuaucuuuuucuugcccgaugaaggaaaauuacaacaccuggagaaugaauuaacucaugauauuauaacaaaauuucucgagaaugaagacagaaggagcgcuaguuugcacuuacccaaacugucuaucacaggcaccuaugaucugaaauccguguuggggcagcugggcaucacgaaggucuuuucuaacggcgcugaccuguccggagugacugaagaagccccccucaaguugucuaaggcuguucauaaggcuguguugaccaucgaugagaaagggaccgaggccgcgggcgcaauguuccucgaagcaauacccaugucuauacccccugaaguuaaauucaacaaacccuucguguuucugaugauagaacagaauacuaagucaccccucuuuaugggcaaaguuguaaaccccacacagaaauag

SEQ ID NO: 5352 - RNA, 1257 nt, Artificial Sequence
  Description of Artificial Sequence: Synthetic coding sequence
augcccuccuccguuucauggggcaucuuacucuuagcggggcucugcugccucguccccguaagccuggccgaagacccucaaggcgaugcugcccagaaaaccgauacaagccaucacgaccaagaucacccuacuuucaacaagauuacuccuaaccucgcagaguuugccuucucacuguaucggcaacuggcacaccaaucuaacucuacaaacauuuucuuuucccccgugucaaucgcuaccgccuucgccaugcucucccuagguacuaaggccgacacacaugaugaaaucuuggagggauugaacuucaacuuaacagaaauuccugaagcucaaauacaugaaggcuuucaagaacugcugagaacauugaaucagccugauucccaacuccagcuaacuaccggaaacggacuguuuuuaagcgaggguuugaaacugguggacaaauuccuggaagauguaaaaaaacuguaccacuccgaagccuuuacugucaauuucggcgauacagaggaggcaaaaaaacaaauuaaugauuacguagaaaaaggaacacagggaaaaauuguggaucuggugaaggagcuggacagagacaccguguuugcacugguuaauuauauuuuuuucaagggcaaaugggagcgaccauuugagguuaaagauacagaggaagaggacuuucacguugaucaggugacgacaguuaaggucccaaugaugaagagacugggaauguucaauauacagcauugcaagaaacugucuaguuggguucugcucaugaaauaccuagguaacgcuacugcaauauucuuccugccugacgaaggcaagcugcaacacuuagagaacgaacugacacacgauauuaucacgaaguuuuuggagaacgaagaucgcaggucagcaagccuucaccuaccaaaacugagcaucacaggaaccuacgaccugaaauccguacuaggccaacuggguaucacgaagguuuuuagcaauggcgccgauuugagcggcgugacugaagaggccccgcucaaacuuagcaaagcaguccacaaggccguccuaacuauugacgagaaggguaccgaagcugcuggggcgauguuccuggaagccauuccuaugagcauuccuccugagguaaaguuuaauaagccuuuuguguuucugaugauugagcagaacaccaaaucaccgcucuucaugggaaaagucgucaacccaacacagaaguag

SEQ ID NO: 5353 - RNA, 1257 nt, Artificial Sequence
  Description of Artificial Sequence: Synthetic coding sequence
augccuucaagcguaucuuggggcauacuuuuacucgcgggauuauguugcuuaguucccguaagucucgccgaggacccccaaggagacgccgcccagaagacugauaccagccaucacgaccaagaccacccuacuuucaauaagauaacuccgaaucuggccgaguuugccuucagucuguaucgccaguuggcccaccaauccaauucuaccaauaucuuuuucuccccuguaucuauagcuaccgccuucgcgaugcucucacucggcaccaaagcugauacccacgaugagaucuuggagggauugaacuuuaacuuaacugagaucccagaggcacagauccacgagggguuccaagaacugcugcguacccugaaccaaccugacucccagcuucaacuaacuacuggcaauggauuauuuuugucugaaggacugaaacugguagauaaauuccuggaggacgucaagaaacucuaucacagugaagcuuuuaccgugaauuuuggcgauacugaggaagcuaagaaacagauuaaugauuacguggaaaaggggacacaaggaaaaauagucgaucucgugaaagagcuugauagagauacagucuuugcguugguuaauuacauauuuuucaagggaaagugggaaaggcccuuugaaguaaaggacacagaagaggaggacuuccacguggaccaggugacgacugucaagguccccaugaugaaaagacuggguauguuuaauauucagcauugcaaaaagcucucuaguugggugcucuugaugaaauaucuagggaacgccaccgccauuuuuuuccucccagaugaagguaaauugcaacauuuagagaaugaacucacucaugacaucaucacuaaguuccuggaaaacgaggaccgaagaucugccagucuccaccugccuaaauuaagcauuacagggacuuacgacuugaagagcguccuggggcagcucggaaucacuaagguauuuucaaauggcgcagaccuguccggagucaccgaagaagccccacugaagcugagcaaagcagugcacaaggccguguugaccaucgacgaaaaggguacagaagccgcaggugcuauguuucuggaggccaucccaaugaguaucccgccugaaguuaaguucaacaaaccguucguguuccucaugauugagcaaaauaccaaauccccccucuucaugggaaaggucguuaauccaacacagaaauag

SEQ ID NO: 5354 - RNA, 1257 nt, Artificial Sequence
  Description of Artificial Sequence: Synthetic coding sequence
augcccucaagugucagcugggguauacugcuccucgcuggcuuauguugccuggucccagucagccucgccgaggacccacagggggacgcugcccagaaaaccgauaccucccaccacgaccaagaccauccaacauuuaauaaaauuacucccaaccucgccgaauucgcuuuuagcuuauauagacaacuggcccaucaauccaauucuacuaacaucuuuuucagccccgugaguaucgcgaccgcguuugccaugcugagccucggaaccaaagccgauacgcaugacgaaauccucgagggcuugaauuuuaauuugacggagauacccgaggcucagauucaugagggauuucaagaacugcucagaacccugaaucaacccgacagccaacuccagcucaccacagggaacgggcuauucuuguccgaagggcucaagcugguugacaaauuuuuggaggacgucaaaaaauuguaccacagcgaagcuuuuacagucaauuucggggauacagaagaagcgaagaaacagaucaacgauuacgucgaaaaaggcacucaaggaaaaaucguagaucucguuaaagaacuggaccgagacaccguuuuugcgcucgugaacuacaucuuuuuuaaaggcaaaugggaacggccuuucgaggucaaggacacagaggaggaagacuuucacguagaucaagugaccacagugaaaguaccuaugaugaaacgccuugggauguuuaacauccagcauuguaaaaagcucaguaguuggguccugcuaaugaaauaccuggggaaugcuacugcuauauucuuccuccccgaugaaggaaaacuacagcaucucgaaaacgagcugacccaugauauaauuacuaaauucuuggagaacgaagauagaagaagcgccuccuuacacuuaccuaagcuuuccaucacugggacuuacgaucuuaagucuguacuggggcaacuuggaaucacaaagguguucaguaauggggcugaccuauccggcgugacagaagaagcacccuuaaaacugaguaaggcugugcauaaggccguacugaccauugacgaaaaaggcacugaagcugcuggcgcgauguuucuggaagcuauaccuauguccaucccuccugagguaaaguucaauaaacccuucgucuuuuugaugaucgaacagaauacuaaaucuccacucuuuaugggcaaagucgugaaccccacucaaaaauag

SEQ ID NO: 5355 - RNA, 279 nt, Artificial Sequence; identical to SEQ ID NO: 5025
  Description of Artificial Sequence: Synthetic coding sequence

SEQ ID NO: 5356 - RNA, 471 nt, Artificial Sequence
  Description of Artificial Sequence: Synthetic coding sequence
augccaucuuccguaucuuggggcauccuccuccucgccggauuaugcugucugguccccguaucauuggccgaggacccccagggggaugccgcccaaaaaaccgacaccucccaucacgaccaagaccaucccacuuuuaacaaaaucacuccaaaccuggcagaauucgcauuuucccuguauagacaacuggcccaucagagcaauucaaccaauauauuuuuuucuccagugucaaucgcuacugcauucgccaugcugucucuggguacuaaagccgacacucaugacgagaucuuagaaggacugaauuucaaccugaccgagaucccagaggcacagauccaugaaggauuucaagagcuccuuaggacccugaaucagccugacucccagcugcaacucaccacgggaaauggccucuuccugucagagggcuuaaaauugguggacaaguuccucgaguag

SEQ ID NO: 5357 - RNA, 354 nt, Artificial Sequence
  Description of Artificial Sequence: Synthetic coding sequence
augccaucuuccgucuccuggggcauccuucuccuugcuggccuaugcugccugguccccgugucauuagcugaagacccacaaggugacgcugcgcagaagacagauacaucccaccacgaccaggaucaucccacuuucaacaaaauuacucccaaccucgccgaguucgccuucucccuauaccgacaguuagcucaccagaguaacucuacgaacauuuucuuuucccccgucagcaucgcaacagccuuugccaugcucucucugggcacaaaagcugauacccacgaugagauucuggaaggauuaaacuuuaaccuaaccgagaucccugaagcacaaauacauuag

SEQ ID NO: 5358 - RNA, 69 nt, Artificial Sequence; identical to SEQ ID NO: 5028
  Description of Artificial Sequence: Synthetic coding sequence

SEQ ID NO: 5359 - RNA, 435 nt, Artificial Sequence
  Description of Artificial Sequence: Synthetic coding sequence
augccauccagcgucucuugggguauucugcugcuugccggccugugcugcuuggugccagucagucucgcagaggauccacagggggaugcagcucagaaaaccgauaccagucaccacgaccaagaccauccuaccuucaacaaaaucacucccaaccuugccgaauucgccuuuucucucuauaggcagcuagcucaucaguccaauucaacaaauaucuucuuuagcccagugucuauagcuaccgcuuuugcuauguuaagucuuggcaccaaagccgauacacacgaugaaauacuagaaggccuaaacuucaauuuaaccgaaaucccugaggcucagauacaugaaggguuucaagagcuucuccgcacccucaaccagccugacagucaacuccagcuaacaacagguaacggucuauuucucuag

SEQ ID NO: 5360 - RNA, 780 nt, Artificial Sequence
  Description of Artificial Sequence: Synthetic coding sequence
auguacucuaauguuauaggcaccgugacuucugggaagaggaagguguaucucuuguccuugcugcucaucggauucugggacugcguaacuugucacggaucuccaguggacauuugcacagcuaaaccaagagauauccccaugaacccuauguguauuuacagauccccagaaaaaaaagccacagaagacgagggaagcgagcagaagauccccgaggcaacuaauagacgcgugugggaacucuccaaggcuaacucuagauucgccaccacuuucuaccagcauuuagcagacaguaaaaaugacaacgauaacaucuuccuauccccucugagcaucucaacagcauucgcuaugaccaaacucggagcuuguaaugauacccuucaacagcuaauggagguuuuuaaauucgauaccauuagugagaaaacuuccgaucagauacacuucuucuucgcuaaguugaacugcagacuguaccguaaagcgaauaagucuucuaaauuaguuucugcuaaccgacuguuuggugacaaaucuuuaacguuuaacgaccuguaugugagugacgccuuccauaaagccuuccuggaagugaaugaagaggggagcgaagcagcggcaaguacagcugucguuauugccgggagaucccucaacccgaacagagugaccuucaaagccaaccgcccuuuucuaguuuuuaucagggaaguaccauugaacaccauuaucuucauggggagaguggcuaauccgugcguuaaguag

SEQ ID NO: 5361 - RNA, 1395 nt, Artificial Sequence
  Description of Artificial Sequence: Synthetic coding sequence
auguauuccaacguuaucggcacugugacaucagggaagcgaaaggucuaccugcuuucccuucuuuugauuggguuuugggauugugugacgugucacggguccccaguggacaucugcacagccaaaccuagagauauuccaaugaacccgaugugcauuuaccgaaguccugaaaagaaggccaccgaagacgaagguucagaacaaaagauacccgaagccacaaauagaagagucugggaguuaucaaaagcuaauagcagauucgcaaccacuuuuuaccagcaucuugcagacagcaagaacgauaaugacaacaucuuccuuagcccacuguccauuucuacugcuuucgcuaugacaaagcuuggagccugcaacgacacccugcagcaacucauggaaguauuuaaguucgacacgaucagugagaaaaccagcgaccaaauucauuuuuucuuugcuaaacucaacugcagacuguaucgaaaagccaacaaauccucgaaguuagugagcgccaaccgacucuuuggggauaaaucccugaccuucaacgaaacauaucaagacaucagugagcugguauacggagcgaagcuucaaccgcuggacuucaaggaaaaugcagagcaaucaagagcugccauaaauaaguggguaucgaauaaaacagaaggaagaaucacagacguaauccccagcgaggcaaucaaugaauugacuguacuuguucucguuaacacaauauacuucaagggcuuauggaagaguaaguucucaccagaaaauacgcgaaaagagcuguuuuacaaggcugauggcgaguccuguucagcuuccaugauguaucaggagggcaaguuucgguauagacgaguugcagaggggacacagguccucgaauugcccuucaagggcgacgacauuacuaugguccucauacugccaaagcccgagaaaucucucgccaaaguggagaaagaacuuaccccugaaguguuacaagaauggcucgacgagcuggaggaaaugauguugguggugcacaugccucguuucagaauugaagacgguuuuagcuuaaaagagcaacuccaggacaugggccugguugauuuguuuaguccagaaaagucuaaguuaccuggcauugucgcugaaggaagagacgaucuuuaugucuccgaugcuuuccacaaggccuuucucgagguuaaugaagaagguucugaagccgcugccucuaccgcaguggugauagcuggccgaagccugaauccuaaccgcgucacauucaaagccaacaggcccuuucuugucuucaucagagaagucccacugaauaccaucauuuucauggguagagucgccaauccuugcgucaaguag

SEQ ID NO: 5362 - RNA, 1503 nt, Artificial Sequence
  Description of Artificial Sequence: Synthetic coding sequence
auggcauccagacucacacuacucacccuucuccugcugcugcucgcuggagauagagcaucauccaauccuaacgcuacaucuaguagcucccaagacccagagucccugcaagaucgaggcgaagggaaggucgccaccacugugaucuccaagauguuauucguggaaccaauucuagaaguguccucccucccgacaaccaacucgaccacaaacucggccaccaagaucacagcgaacacaaccgaugagcccacuacccagccaacuaccgaaccaaccacucagcccacaauacagcccacacagccaacuacucaacugccuacagacucucccacccagcccacuacaggcucauuuuguccaggcccugucacccuguguucugacuuggagucucauuccacugaagccguccuuggggaugcacuugucgacuuuagcuugaaacuuuaccacgccuuuucagccaugaaaaaaguugagaccaacauggccuuuucaccuuucucuauugcauccuugcugacccaggucuuacuaggugccggcgagaacacuaagaccaauuuagaaucaauuuugagcuacccuaaggauuuuacaugcgugcaccaggcacuuaaaggauucacaaccaaaggagucaccucuguuucacagauauuucacucuccugacuuagccauucgagacaccuucgucaacgccucccguacucuguauaguaguucaccuagaguucugucaaauaauucagacgccaaccuagagcucaucaacacaugggucgcuaaaaacacuaacaacaagaucucuaggcuccuugacagucugccaagugauacaaggcucguguuguugaacgccauauaccucagcgccaaguggaagacaaccuucgauccuaaaaaaacgcgaauggaaccauuccauuucaagaacagugugaucaaaguaccaaugaugaauaguaagaaguacccuguugcccauuucaucgaucaaacccucaaagcaaaagucggccagcuacagcuuagccauaaccucagcuuggugauucuuguaccacaaaaccuuaaacacaggcuggaggacauggaacaggcucuguccccaagcgucuucaaagcuaucauggaaaaacucgagaugucuaaauuucaaccuacauuacuuacucuaccgagaaucaaggugacuacuucacaggacaugcugaguauuauggagaaacuugaauucuucgacuuuucuuacgaucucaaucucugcggacugaccgaagacccagauuugcaagugucugccaugcagcaccagacuguccucgaguuaaccgaaacuggaguagaggcagcagcggccagugccaucucgguugcacggacucugcucguauuugaagugcaacaaccauuucuauuuguccuaugggaucagcagcauaaguucccaguguuuaugggaagaguguacgacccuagagccuag

SEQ ID NO: 5363 - RNA, 1518 nt, Artificial Sequence
  Description of Artificial Sequence: Synthetic coding sequence
auggccagcagacugacacuccucacucuacugcuccuguuacuugccggauuucuggaaccccaagaccgcgcauccucaaaccccaaugccacaucauccagcucccaggaccccgagagcuugcaggacaggggcgaaggcaaaguggcaacaacaguaaucuccaaaauguuauuugucgaaccuauucucgaggugaguagccuccccaccacuaacagcacaacgaacagcgcaacuaagaucacagcaaacacaaccgaugaaccuaccacccagcccaccacagaaccgacaacccagcccacuauccagccaacacaaccgacuacacaacugcccacugauaguccuacacagccuaccacagggagcuuuuguccagguccaguaacucuauguucugauuuagaaagccacucuacagaagccgugcugggggaugccuuaguugacuucucacucaaauuguaucacgccuuuagugccaugaaaaaggucgagacuaauauggcuuuuucaccguuuuccaucgcuucccuguuaacccagguguuacucggcgccggcgagaacacaaaaacaaauuuggagagcauccucagcuaucccaaagauuucacuuguguccaucaggcccucaaagguuuuacuaccaaaggagugacuucuguuucccagaucuuccauagccccgaccuggccauaagggauacauucgucaacgccagccgcacacucuacucuuccagccccagaguccucucaaauaauucagacgccaaccuggagcugaucaauaccuggguagcuaaaaacacuaauaauaagaucucucguuuauuggacucccucccuucugauacaagacugguccugcucaacgccauuuacuuaucagcaaaguggaaaacaacauuugauccaaagaaaaccagaauggagccauuccacuucaaaaacuccguuaucaaagucccuaugaugaauucaaaaaaauaccccguagcgcacuuuauagaccagaccuuaaaggcuaagguggggcaacugcaacuaucacacaaucucagcuuaguaauacuggugccacagaaucugaaacaccgccuggaagacauggagcaggcccucagcccuagcguuuucaaggcgaucauggaaaaacucgaaaugucaaaguuucagccuacucucuuaacguugccaaggauuaaagugaccacaagccaggacaugcucucuauuauggaaaagcuugaauuuuucgauuuuagcuacgacuuaaaccucugcggucucaccgaagaucccgaccuacaaguguccgcaaugcaacaucaaaccguguuggaguugaccgaaacuggcguggaggcagcagcagcauccgcaaucagcguggcucgaacucugcuuguguuugagguacagcaacccuuccuguucguucugugggaccagcagcacaaguuuccagucuucaugggcagaguuuaugauccaagagccuag

SEQ ID NO: 5364 - RNA, 1347 nt, Artificial Sequence
  Description of Artificial Sequence: Synthetic coding sequence
auguuauucguagaaccuauucuugaggugagcucauuaccaaccacuaauuccacaaccaacucugcuaccaaaauuaccgccaauacuaccgacgaaccaaccacccaacccaccaccgaaccaacuacacaaccuacaauucagcccacucaaccaaccacgcaacucccuaccgauucucccacccagccgacaacagguaguuucuguccuggaccagugacccuuuguuccgaccucgaaucccauucuacugaagcaguucuuggagacgcccucguggacuuuucacucaaacuguaccaugcuuuuagcgcaaugaaaaaggucgaaaccaacauggccuuuaguccauuuuccauagcuuccuuacugacccagguccugcugggggcaggcgaaaacacaaagaccaaucucgaaagcauuuugucauacccaaaagauuuuacuuguguccaccaagccuugaaaggcuucaccacgaaaggugucacuucagucagccagauuuuccauaguccagaucuugccaucagagacaccuuugucaaugccucuaggacccucuacuccuccaguccucgcgugcucucaaauaauucugaugcuaaccuggaacuuauuaauaccuggguggcaaaaaacacuaauaauaagaucucucgucuccucgauucuuuaccaagugauacaaggcuggugcuucucaacgccauauaucucucugcuaaauggaagaccacauucgacccgaaaaagaccaggauggaaccuuuucacuucaagaacucugucauuaaagugccgaugaugaacaguaaaaaauauccaguagcucacuucaucgaccaaacccugaaagccaaaguagggcagcugcaacucucucauaaucugagccuggucauauuagucccacaaaacuugaagcaucgucucgaagauauggagcaggcccuuuccccuagcguguucaaagcuauaauggaaaaacucgaaaugucgaaauuccagccaacccuccuuacgcuacccagaauaaaagugacuaccucccaggacaugcugucuaucauggaaaaacuggaauucuuugacuuuucuuaugaccuuaaccuuugcggguuaaccgaagaucccgaccuccagguaucggcgaugcaacaccaaacagugcuagaacugacugagacagguguggaagccgcagccgcaucggccaucuccguagcuagaacuuuauugguguuugagguccagcagccuuuucuguuuguccucugggaucagcagcacaaauucccaguuuucaugggccgaguguacgacccucgcgcauag

SEQ ID NO: 5365 - RNA, 483 nt, Artificial Sequence
  Description of Artificial Sequence: Synthetic coding sequence
auggcaucccgccucacccugcucacccuucuacuccuccuucuggcuggcgaccgggcuaguaguaaccccaaugcaaccucuagcaguucucaggauccagagucccuccaagacagaggugaggggaaaguugcaaccacugugaucucuaaaauguuauuuguggagccuauucuggaaguaagcagccuacccacaacaaauucaacuaccaauuccgccacgaagauaacagcuaacacgacagacgagccaacaacucaaccuacgaccgagcccacuacucaacccaccauucaacccacucagccaacgacccagcugcccacugauucucccacccagccaacuacugguucuuuuugucccgguccaguuacuuugugcucagauuuggaaagccauucuacugaagcagugcucggggacgcccucguugauuuuucucucaaauuguaccacgccuucuccgcaauguag

SEQ ID NO: 5366 - RNA, 402 nt, Artificial Sequence
  Description of Artificial Sequence: Synthetic coding sequence
auggccucccguuuaacccuucucaccuuacuguuacuccuuuuggcgggcgaccgggccucaagcaaucccaacgccacuaguaguaguucacaagauccggagucauuacaagaucggggggaggguaaaguugccacgacggucauauccaaaaugcuguuuguggagccaauccuugaagucagcucacuuccuacaacaaauucuacgaccaauuccgcgacaaagauaacugccaacacaacugaugagccuacaacacagccaaccaccgagcccacgacacagccuacaauucagcccacccaacccacaacucaacuacccacugacuccccaacccagcccgguuaugcccucaaucacggagagaucggcauucugcgcuucuuccucuag

SEQ ID NO: 5367 - RNA, 1335 nt, Artificial Sequence
  Description of Artificial Sequence: Synthetic coding sequence
augugccucuguucuggaaggaaaacaauuuuggaaaucuaccccggucaauuucaacccucuuugugucauaaguucauugcccucagcgacaaggagggaaaacucuugcgcaacuauacccaaaacauagacacacuagagcaaguggccggcauacaaagaaucauucagugccacggaagcuucgcuacugccuccugccucauauguaaauauaaaguggauugcgaagcaguaaggggggauaucuucaaucaaguaguuccacgaugccccagaugcccagcugacgagccucuugccauuaugaagcccgagaucguguuuuucggcgaaaacuuaccggagcaauuccaccgggcuaugaaguacgauaaggaugagguggaucugcuaauaguuaucggcucaucucucaagguccggcccguggcucuuaucccaucuaguauaccccacgaagucccucaaauucugaucaaucgcgaaccacugccucaccugcacuucgauguagaacuguugggagacugcgauguuauuauuaaugaacucugccaccgcuuaggaggagaguacgcgaaauuguguugcaacccaguuaagcugucagagauaacagaaaaacccccccgaacacagaaagaacuggcauaccucuccgagcugcccccaacccccuugcacgugagugaagauucuaguaguccugagcggaccucacccccugauucuagugugauagucacucuucuggaucaagcugcaaagucaaacgaugaucuggaugucagcgaauccaaagguugcauggaagagaagccccaagaggugcaaacaagcagaaacguggaaucaauagccgaacagauggaaaauccugacuugaaaaacgucggaaguuccaccggcgagaaaaacgagagaacauccguugccgguacugugcgcaaauguuggccaaaucguguugccaaagaacaaauuagccgccguuuagacggaaaccaauacuuguuccugccuccuaacagauauauuuuccacggggcggaggucuauuccgauagcgaagaugacguucuuaguaguucauccugugggagcaacagcgauucuggcaccugucaguccccuucacucgaagagccuauggaagaugagucugaaaucgaggaauucuauaacggccucgaggaugagccagaugucccagagagagccgguggugcugguuucggcacggacggggaugaccaggaagcgauuaaugaagcaaucucaguuaagcaggaagucaccgauaugaauuauccuaguaacaaaagcuag

SEQ ID NO: 5368 - RNA, 1335 nt, Artificial Sequence
  Description of Artificial Sequence: Synthetic coding sequence
augugccuguguucuggacgcaaaacaauccuugagaucuaucccggucaguuccaacccagcuugugucacaaauucauugcccuuagugauaaagaggggaagcuucugcggaauuauacccagaauaucgauacacuagagcagguugccgguauucagcggauuauacagugccacggcucauuugccaccgcaucuugccucaucugcaaguauaaaguugauugcgaagccgugagaggagacauauucaaccaagucgugccuagguguccccgaugcccugcggacgaaccuuuagccauuaugaagccagaaauuguguucuuuggugagaaucugccugaacaauuccauagagcgaugaaauaugacaaggacgagguagaccuucucauuguaauaggauccucauugaaggugagaccaguugcacuuauuccuucaucaauuccacacgaaguuccacagauccugauaaacagagaaccccugccccauuugcacuuugauguggaacuccuaggggacugugacguuauuauuaaugagcuuugucaccgucuggggggggaguacgcuaagcucugcugcaacccuguuaaacugucugagauuacagaaaaaccgccacgaacacagaaagagcucgcauaucucagcgaacuccccccaacaccgcugcauguuucagaggacagcucuagcccggaaagaacuagcccaccagauucaagcgugauugugacccugcuggaucaggcugcuaaaaguaaugacgaccucgacgugucagaaucgaaaggauguauggaagaaaagccucaggaagugcagacaucgcgcaacguugaaucaaucgccgagcagauggagaacccugaccucaagaauguaggcucauccacuggugagaaaaacgaaagaaccucuguagcuggaacagugagaaaauguuggcccaauagagucgcaaaggaacagaucucacgacgucuggauggaaaccaguaucuguuucucccucccaaccgguauauuuuucauggagccgagguguacucagauagugaggaugaugugcugaguucuuccagcugcggcagcaacucugauuccggaacuugucagagcccuucucuggaagaacccauggaagaugagagugagauugaggaguucuauaacggccuggaggaugaacccgacguucccgaacgggcaggcggcgccggauucggaaccgauggcgaugaccaggaagcaauaaaugaagcaauauccguaaaacaagaagugaccgacaugaacuaccccucaaauaaaucguag

SEQ ID NO: 5369 - RNA, 1359 nt, Artificial Sequence
  Description of Artificial Sequence: Synthetic coding sequence
auguuugauaucgaguauuucagaaaggauccuagacccuucuucaaauuugccaaagagaucuacccgggacaguuucagccuucauuaugccauaaauucaucgcacuaagcgacaaggaagggaagcucuuaagaaauuauacacaaaauauagacacucucgagcagguugccggcauucagcguauuauacaaugccacgguuccuuugccaccgcuucuugucuuaucuguaaguacaaaguugacugugaagccgugaggggggacauuuucaaucagguaguuccccgguguccccggugcccugcagacgaaccacuugcaaucaugaaacccgaaauaguguucuuuggcgaaaaucugccagaacaguuucaccgcgccaugaaguaugauaaggacgagguugaccugcugauuguuauugggaguuccuugaaaguucgaccuguggcccucauccccucuucuaucccucacgaaguuccgcagauacugaucaaucgcgagccucugccacaccugcacuuugaugucgaauuguugggugauugugaugugaucauuaaugaacucugccaucgucucgguggagaauacgccaagcucugcuguaauccaguuaagcucucugagauuacugaaaaacccccccgaacucagaaggagcuagccuaucugucagaacuccccccuacaccacuucaugucuccgaggacucuucaucuccugaacgaacgucuccacccgauucuucaguuaucgugacucuucuggaccaagccgcuaaauccaacgacgaucuggauguuucugaauccaaaggcuguauggaagaaaaaccacaagaagugcagaccagccguaauguugaguccauagcugagcaaauggagaacccugaccugaaaaacgugggaaguaguaccggagagaaaaacgagagaacuagcguggcaggaacaguccggaaauguuggccgaaucgaguagccaaagaacagauuaguaggaggcuggacggcaaccaguaccuuuuccucccucccaauagguauaucuuucacggcgccgaggucuauucagacuccgaggacgaugugcucagcucaagcucuuguggaagcaacagcgacagcgggacaugucagagccccucacuggaagagccaauggaggacgagagugaaaucgaggaguucuacaacggccuggaagaugagcccgacguuccagaaagggcaggcggcgcagguuucggaacagacggagaugaucaagaggcuaucaacgaagcaauuucggucaagcaagagguuacggacaugaauuacccaucaaauaagaguuag

SEQ ID NO: 5370 - RNA, 987 nt, Artificial Sequence
  Description of Artificial Sequence: Synthetic coding sequence
auguccgugaacuaugccgcgggucugaguccauacgcagauaaggggaaaugcggauugccggaaauauuugauccaccagaggaguuggaacggaaagugugggaacuggcaagacuagucuggcagucaucaaguguaguguuccacacuggagcggguaucucaacagcuagcggcaucccagacuuucgaggaccacacgggguuuggacaauggaggaaagaggucuggccccaaaguucgacaccacguucgaaagcgcuagacccacacaaacgcauauggcucuggugcagcuagagagagugggauugcugcgguuuuugguaagucagaacguugauggacuccacgugagauccggauuuccucgagacaaauuagccgaauuacacggcaacauguucguugaagaaugcgcgaagugcaaaacccaguauguucgggauacuguaguggggacaaugggcuugaaagcuaccggccgccucugcaccguggcaaaagcaaggggcuugcgagcuugccggaacgcagaccuuucaauuacgcucgggaccagucuccagauuagacccuccgguaaccuaccacuugccacgaagagacgcggcggucgacugguaaucguuaaccugcagccaacgaagcaugauaggcaugccgaccugaggauucauggauaugucgaugaagugaugacaagacugaugaaacaucugggucuggagauuccagccugggauggcccuaggguguuggagcgcgcuuugccgccucugccaagaccucccaccccuaaacuugagcccaaagaggaaucacccaccagaaucaacggaaguaucccagcaggcccgaagcaagagccaugcgcacagcacaacggaagcgagccugccagcccaaagagagaaagaccgacaucccccgcuccccaccgaccccccaaacgcgucaaagccaaggccgugcccaguuag

SEQ ID NO: 5371 - RNA, 1068 nt, Artificial Sequence
  Description of Artificial Sequence: Synthetic coding sequence
auguccgugaauuaugccgcuggccuuucaccuuaugcugacaagggcaaguguggacugcccgagaucuucgacccaccggaagaacuggagagaaagguuugggaauuggcccggcuggucuggcaguccuccuccgugguguuucauacuggugcaggaauuucaacugccucuggaauucccgacuuuagaggaccccaugguguuuggaccauggaagagcgagguuuagcuccuaaguuugauacaaccuuugagagcgcaagacccacucagacgcauauggcacucguccaguuggaacggguggggcucuugcgauuucuggugagccaaaauguggauggguugcaugucagaucaggcuucccuagggacaaacuggcagagcugcauggcaauauguucguugaggagugugcaaaaugcaaaacccaauaugucagagacacuguugugggaacuaugggacucaaggcaacgggaagacuauguacaguugccaaggcucguggucuccgugccugcaggggugagcucagagauacaauuuuggauugggaggauagccuuccagauagagaucuggcuuuagcugaugaagcaagccgaaacgccgaucugucuauuacauugggcacgagccugcagauccguccgagugguaaccucccacuagcgaccaaacggcgcggaggccgccuuguaauugugaaucuucagcccacaaagcaugaucgacacgccgaccucaggauccaugguuauguggaugaggugaugacacgucugaugaaacacuugggauuagagaucccagcuugggacggacccagaguucuugaaagggcccugcccccacugccuagacccccuacaccuaaauuggagccuaaagaggagucucccacaaggauuaauggcagcauccccgcaggcccaaagcaagaaccaugcgcucaacauaauggaagugagccagccucacccaagcgagagagacccacgagcccagccccacaucggcccccuaagcguguuaaggcaaaggcggucccguccuag

SEQ ID NO: 5372 - RNA, 852 nt, Artificial Sequence
  Description of Artificial Sequence: Synthetic coding sequence
auggaagagagagggcucgccccuaaauuugauacaacauuugagagcgcaagaccgacccagacacacauggcgcugguucaacuggaacggguggguuuauugagguuucuggugucucagaacgucgaugggcuccacgugagaucuggcuuccccagagacaaauuggcugaacuccacggaaauauguucgucgaggaaugcgccaaaugcaaaacacaguacguacgggacacaguggucggcacuauggggcugaaggcuaccgggcgccucuguacagucgccaaggcaaggggccucagagcuuguaggggggaacugagggauaccauccuugacugggaagacucacuccccgaucgcgaccuugcccuugccgaugaggcgucucggaacgccgaccucucgaucaccuuggguaccucccuccagauucguccgagcggcaauuuacccuuagccacuaagaggagaggaggccgacuggugauuguaaaucuucagccaacuaagcacgacaggcaugccgauuuaagaauacacggauaugucgaugaagugaugacgcgccugaugaaacacuugggacuugagauccccgcuugggauggaccuaggguuuuagaaagagcgcuacccccacucccuagaccccccacuccuaaauuggagccuaaggaggagucaccaacgaggauuaacggaaguauuccagcaggccccaagcaggagcccugugcacagcauaaugguucagagcccgcgucccccaaacgagagaggccuacaucccccgccccacaucgcccgccaaagagagucaaagccaaggccgugcccagcuag

SEQ ID NO: 5373 - RNA, 2496 nt, Artificial Sequence
  Description of Artificial Sequence: Synthetic coding sequence
auggagagaccuuggggcgcugcugacggucuuagucguuggccucauggauugggacuccucuugcugcuccagcuacugccucccucuacacuuagccaggaucgucuggacgccccccccccacccgccgcuccccuuccucguuggucugggccuaucgguguguccuggggacugagagccgcugcagcugggggugcuuuuccucgcggcggucgguggagaagguccgcacccggggaagacgaggaaugcggucgagugagggacuucgucgcaaaacuggcaaauaacacucaccagcauguuuucgaugaucugaggggaaguguuucucucucaugggugggcgacucaacaggcgugauucugguucugaccacuuuucaugucccucuggugaucaugacauucggacaaaguaaacuuuaccgcucagaagauuauggaaaaaacuuuaaagacaucacagauuugaucaauaacaccuucauucgcacagaauucggaauggccaucggcccggagaacucugguaaggugguacucacagcugaagugagcgggggcagccgggggggaagaauauuccguagcuccgauuuugcgaagaauuucguacaaaccgaccuccccuuccacccccuuacgcaaaugauguacuccccucagaauagugacuaccugcuggccuugagcacugagaauggauuaugggugaguaagaacuucgggggcaagugggaggaaauacacaaagcaguuugccuagcaaaauggggaucugacaacacaaucuuuuuuacuacauacgccaaugggucaugcaaggcggaucugggagcccucgaacuguggcggacgucugauuuagguaaaagcuuuaagaccauuggggugaaaauuuauucuuuugggcuuggcgguagauuccuguuugccucagugauggcagauaaagauacaacucgccgcauucacgucagcacagaucagggugauacguggaguauggcccagcuuccuucuguagggcaagaacaauucuauagcauccucgccgccaaugaugacaugguuuuuaugcauguagaugaacccggcgauacaggguuugguaccaucuuuacuagcgacgacagaggcauuguuuauucuaagucccuugauaggcaccucuacacaacaacggggggggagaccgacuuuacaaauguuacaucgcugcgcggaguguacauuaccucaguacuguccgaggacaauucuauucagacaaugauuaccuucgaccagggcggcagauggacccaccugaggaaaccugagaacucggagugcgaugccaccgcuaagaacaagaacgaaugcucgcuacacauacacgccucuuauaguaucucgcagaagcucaacguacccauggcgccguugucggaacccaaugccguagguaucgugaucgcucauggaucagucggcgaugcaauaagcgugauggugccagacguuuacaucucagaugacggcggcuauucuuggaccaagaugcuugaaggaccacacuacuacaccauauuggacagcgggggaaucauaguggcuauugaacacagcagucgucccaucaacgugaucaaguuuuccacugacgaagggcagugcuggcaaacauacaccuuuacuagagauccuauuuauuuuacgggccuggcauccgaaccaggcgcacgcuccaugaauauuucaauuuggggauuuacugagucauuucucacaucacaauggguaucauauaccaucgauuuuaaggauauauuggagaggaauugcgaagagaaggauuacaccauuugguuagcacauuccacagacccggaagacuaugaagauggcugcauuuuaggguacaaagaacaguuucuaagguugagaaaaucaucagucugccagaacggccgggauuaugucgugaccaagcaaccuagcaucugucuuuguucacucgaagauuuuuugugugacuuugguuauuaucgacccgaaaaugauagcaaaugcguggaacagccagagcucaaaggccacgaucucgaguucugccucuaugggcgugaagagcaccucaccacuaauggauauagaaagauacccggagacaaaugccaaggcggcguuaaccccguuagagaagugaaggaccuuaagaaaaaauguacaaguaauuuucucuccccagaaaagcagaacaguaagucuaacagugugccuauuauccuggcaaucgucgguuuaauguuaguaacuguggucgcaggaguacugauugugaagaaguauguuugcggagggcgauuucuggugcaucgguacagcguucugcagcagcaugcggaggcgaauggaguugacggggucgaugcucuggacacugccucucacacaaacaaaucuggauaccacgaugauucugacgaagaccugcucgaguag

SEQ ID NO: 5374 - RNA, 2085 nt, Artificial Sequence
  Description of Artificial Sequence: Synthetic coding sequence
augacauucggccaauccaagcucuauagaucugaagacuacgggaaaaauuuuaaagauaucaccgaccuuaucaauaacacguuuauacgcacagaguucggcauggcuauuggaccugaaaauucuggaaaagucguacugacagcggaagucucuggcgggucaaggggcgggcgaauauuccggucaucagauuucgccaaaaacuuuguccagacugaucucccguuucacccucugacccagaugauguacagcccacagaacuccgacuaucugcuagcucuuucaacagagaauggucuguggguaaguaagaauuuuggcggaaaaugggaagaaauucauaaagcuguaugccucgcuaaguggggcuccgacaauacuaucuucuucaccacguacgcuaacgguuccuguacggauuugggcgcuuuagagcucuggcggaccagcgacuuaggaaaauccuucaagacuaucggcguuaagaucuacucuuucggauugggaggcagauuccuguucgcaagcguuauggccgauaaagacacaacuaggagaauacacguuucuacugaccagggcgauacuuggucuauggcucagcuaccgagcgugggccaggagcaguuuuacagcauacuggcagcaaacgacgauaugguuuuuaugcacguggacgagccaggugacaccggauuuggaaccaucuucacaagugaugaccguggcaucguauauagcaaaucacucgacagacacuuguacacaacgaccggcggcgaaacugacuucacuaaugucacaucucuccggggggucuacauuacuucagugcucuccgaggauaacucuauccaaacuaugauuacauuugaucaaggaggaagauggacacaccuaagaaaaccagagaacagcgaaugugaugccacugccaaaaauaaaaacgaguguucucuacauauacaugcuaguuauucuaucucccaaaaauugaacgugccuauggccccccugagcgaaccuaacgcagugggcauugugauagcccacggaucagugggugacgcaaucucugugaugguacccgacguauauauaagcgacgauggcggcuauuccuggacaaagaugcuggaggggccccauuacuacacaauccucgacucaggugggauuauuguugccaucgagcauaguucucgcccaauuaacgucauaaaguucucuacugaugagggacaauguuggcagaccuauacuuucaccagggaucccaucuauuucaccggcuuagccucugaaccuggagcucgcucuaugaacauuaguauuuggggcuucacugaauccuuucucacuucucaaugggucagcuauaccauagacuuuaaagacauccuggagcgcaacugugaggaaaaagauuacacgaucugguuagcacauucgacagacccggaggauuacgaagacggaugcauuuugggauacaaagaacaguuccuccggcucaggaaauccagcgugugccaaaaugggagggauuacguugucacuaaacaaccaagcaucugucugugcagucuagaagauuuucugugcgauuuuggguauuaccggccagaaaacgauuccaaauguguggagcagccugaauuaaaaggucaugaucucgaguucugcuuauaugggcgagaagaacauuuaacaacaaacggcuaccgaaaaauaccuggcgacaaaugccaggggggagucaacccugugcgagaagugaaggaucugaagaagaaaugcaccuccaauuuucuaucccccgagaaacagaacucgaagucuaauuccgugcccauuauacuugcaaucgugggacuaaugcuugucaccgucguugccggcguuuuaaucgugaagaaguauguuugcggagggagauuuuuggugcacagguauucgguguugcagcagcaugccgaggcuaauggcguagauggaguggaugcauuagauaccgccucucacaccaacaaaaguggguaccacgaugacuccgacgaggaccuuuuggaauag

SEQ ID NO: 5375 - RNA, 1536 nt, Artificial Sequence
  Description of Artificial Sequence: Synthetic coding sequence
augggagugcugaaguuuaaacacauauuuuucagaaguuucgucaagucuucuggugugucucaaaucguguucacuuuucuucugaucccuuguugucugacucucaauuuucgugccccuccugucauaccuaauguucccuuucucugggccuggaaugccccaucggaguuuugucuggguaaauucgaugagccccuggauaugagucuguucagcuucauugguucacccaggauuaaugccacaggucagggaguuaccauuuuuuacguugaucgacucggauacuacccauauauagacucuauaacaggcgugacaguaaauggcggcauuccucaaaagaucucacuucaagaccaucucgauaaggcaaaaaaagacauaacuuucuacaugccuguugacaacuugggcauggccguaaucgacugggaagaguggagaccaacgugggccagaaauuggaaaccuaaggauguguacaaaaaccgcagcauugaacucguacagcagcagaauguccaguugucccugacagaggcuacagagaaagccaagcaggaguuugagaaggccgguaaggacuuccucguggaaacuaucaaacucgguaaacuguuacgcccaaaccaucucuggggcuacuaccuuuuuccugauuguuacaaucaccacuauaaaaaaccgggauacaacggcucuuguuuuaaugucgaaaucaaaagaaaugaugaccugucguggcucuggaaugaaucuaccgcuuuguaccccagcaucuaccugaacacgcagcagucuccgguagccgccacuuuguaugugcguaauagagugcgugaagcaauucgugugucuaaaauccccgaugccaaaagcccauugcccguguuugcuuacacccgaauuguguucacugaucaagugcugaaguuuuugucccaagacgagcugguauauaccuucggagaaacuguggcguugggagcuucagguaucguaauaugggguaccuugucuauaaugaggaguaugaaaaguugccuguuacucgacaauuacauggagaccauccucaacccguacauaauuaacgugacuuuggcugcuaagaugugcucacaagugcuuugccaggagcagggcgucuguauuaggaagaauuggaacucuagugacuaucugcaccuuaauccggacaauuuugccauucagcuggaaaaggguggcaaauuuacuguuaggggaaagccaacccuugaagauuuggaacaguucucagagaaauuuuacugcagcugcuacucuacccugucauguaaagagaaggccgauguuaaagacaccgacgcuguggacguaugcauugccgacggagucuguaucgacgcuuuccuaaagccucccauggagacagaagaaccucagauuuucuacaacgcaagcccauccacucuguccgcuacuauguuuaucuggcgccuggaggucugggaucaaggcauaucuagaaucggcuucuuuuag

SEQ ID NO: 5376 - RNA, 1530 nt, Artificial Sequence
  Description of Artificial Sequence: Synthetic coding sequence
augggaguauuaaaguucaagcacaucuucuuucguucuuucguuaaguccagugggguuucucagauuguguucaccuuucugcugauuccauguugccugacucuuaacuucagggccccaccaguaauuccaaaugugccauuucucugggcguggaaugccccuucugaguuuugccugggcaaauucgacgagccacuggacaugagccuguucucauucauugguagcccccguauaaacgccaccggacaaggcgugacuaucuuuuacguugaucgccucggauauuauccguauauugauucgaucacagggguuacaguaaauggggggaucccucaaaaaaucagucuucaagaucaccucgauaaagcaaagaaagacauaaccuucuauaugcccguggacaaccuuggaauggcaguaauagacugggaggaauggaggccaaccugggcccggaacuggaagccuaaagaugucuauaaaaaucguuccauugaguuggugcaacagcagaacguccaacugucucuaacugaggcuacagagaaagccaagcaggaauuugaaaaggcugggaaagacuuccucguagagacgaucaagcugggaaaauuauuaagaccgaaccaucuuuggggauacuaccuguuucccgacuguuauaaccaucacuacaaaaaaccaggguauaacggauccugcuucaauguggagauaaaaagaaacgaugaccuuucuuggcuauggaacgagucuaccgcacucuacccaucuaucuaucugaacacacaacagucccccgucgcagccacucucuaugugcguaaccgagugagggaagcuaucagggugucuaagauuccugacgcuaaguccccccucccugucuuugcuuacacuaggaucguauucaccgaucaagugcugaaguuuuugucucaggaugaacuugucuauacauucggagagacuguugcucucggugccucagguauagugaucugggggacucuuucaauuaugcgcucaaugaaauccugucugcuccuggacaacuauauggagacuauccuuaauccauacaucaucaacguaacgcucgcagccaaaaugugcagucaagugcugugucaggaacagggcgucugcauuagaaaaaacuggaacuccucugacuauuugcaccuuaacccugauaacuucgccauacagcucgagaaaggagguaaguuuaccguacggggcaagccaacucuagaggaucuagaacaguuuagugagaaauucuacugcuccuguuacuccacacugagcuguaaagaaaaggcugacgugaaagauaccgacgcuguggaugucugcaucgcagauggcguguguauugaugccuuucuuaaaccgccaauggaaaccgaggaaccccaaauuuucuacaaugcuucccccaguacccuuucggcaaccauguucauuguaaguauucuuuuucuuauuaucucaucagucgccagccucuag

SEQ ID NO: 5377 - RNA, 243 nt, Artificial Sequence; identical to SEQ ID NO: 5047
  Description of Artificial Sequence: Synthetic coding sequence

SEQ ID NO: 5378 - RNA, 1530 nt, Artificial Sequence
  Description of Artificial Sequence: Synthetic coding sequence
augggcguguugaaauuuaagcauaucuuuuuuaggucuuucgugaaaagcuccggcgugucccagaucguguuuacuuuccuccugauuccguguugccugacccucaauuuccgagcacccccagugauuccaaacguccccuuccuuugggcuuggaaugccccuucugaguucugucuuggaaaguucgacgaaccauuagacaugucauuauucucauucauugguaguccacguaucaaugcaacuggccagggcgugacuauuuuuuacguagaccguuuggguuacuauccauacaucgauagcauaaccggagugacugugaauggcggaauuccacaaaagauuucccugcaggaucaucuggauaaggccaaaaaagacauaacguucuauaugccuguugacaaccugggaauggcuguuauugacugggaagaguggagaccuacgugggcccgcaacuggaaacccaaggauguuuauaaaaacagaucaaucgaacugguucagcaacagaacguacagcucucgcugaccgaggcuacugagaaagcaaaacaagaguucgaaaaggcaggaaaggauuuucugguggagacgauuaaacucggcaaacuguugcgccccaaccaccuuuggggcuauuaccucuuccccgacuguuauaaucaccacuacaagaaacccggcuacaacggcucaugcuucaacguugaaaucaaacggaaugacgaccucucauggcuauggaaugagagcaccgcccucuacccuucaauauaucucaacacucagcaaucaccaguggcagcuacccucuaugugcguaaccgcgugcgggaagccauucgagucucuaaaauuccagacgcaaaaucaccgcucccaguguuugcuuauacccguauugucuucacggaucaagugcuaaaauucuuaucucaggaugagcuuguguacaccuuuggcgaaacuguggcucugggggcaucugggaucgugauauggggaacgcuuuccaucaugcggucaaugaaaagcugucuccuacucgauaacuauauggaaacuauccugaacccauacaucaucaauguuacuuuggccgcuaagaugugcagucagguccucugucaggagcaaggcguuugcaucaggaaaaacuggaacaguagugauuaccugcaucuaaacccagauaauuuugcgauccaguuagagaaggggggaaaauuuacugugcgcggcaagccaacccucgaggaccuggaacaauuuucugagaaguucuauugcucuuguuacuccacuuugaguugcaaggagaaagcagauguuaaggacacugaugcugucgauguguguaucgcugacggaguuuguaucgaugcguuccugaagccacccauggaaacggaagagccgcagauauucuauaacgccucgccuuccacguugagugcuaccauguuuauugugucuauuuuguuucuuauuaucucuucuguggcaucucuuuag

SEQ ID NO: 5379 - RNA, 1530 nt, Artificial Sequence
  Description of Artificial Sequence: Synthetic coding sequence
augggcguccucaaguuuaagcauaucuuuuucagguccuucguuaagucuucuggugucucgcagauagucuuuacuuuuuuacuaauucccugcugccugacucugaauuuucgcgccccccccguuauuccaaaugugccuuucuugugggccuggaaugcccccucggaguucugccuaggaaaguuugaugaaccgcucgacaugucucucuucagcuucauuggauccccaagaaucaacgcaaccggucaaggcgugaccauuuuuuacgucgauaggcucggcuacuauccuuacaucgacuccauuaccggcgucaccgugaauggcgggauuccucagaagauaucucugcaagaucaucuggauaaggccaaaaaagacaucacauuuuauaugccuguggacaauuuggguauggcugugauugacugggaagaguggcggcccaccugggcuaggaacuggaaaccuaaggacguguauaaaaaucgguccaucgaacugguacagcaacaaaauguccaacugucccugaccgaggcgacugaaaaagcgaaacaagaauuugagaaagccggcaaagacuuccugguagaaaccauuaaguugggaaagcugcuccggcccaaccaucuuuggggguacuaccuguuccccgacugcuauaaucaccacuacaaaaagccuggauacaauggcuccugcuucaacguugaaaucaagcggaacgacgaucuuucauggcuuuggaacgaauccacagcauuguacccuuccauauaucugaauacccaacagucucccguugcugccacucucuauguucgcaacagagucagggaagcaauccgaguuucaaagaucccagacgcaaaauccccucuaccgguguuugccuauacccgcaucguguuuacggaucagguuuuaaaauuucugagccaggaugaacugguuuacacuuucggagagacugucgcccugggggcaagcgguauugugauuuggggaacucucagcauuaugcguaguaugaagucuugucuucugcuggauaauuauauggaaaccaucuuaaaccccuacauuauuaacguaacccuugcugcuaagauguguagccaaguuuugugucaggagcaaggagucuguaucagaaaaaauuggaauagcucggacuaucugcacuuaaaucccgauaauuuugccauacagcucgaaaaagggggcaaauuuacaguucgaggcaaaccuacccuggaggauuuggaacaauucuccgaaaaauuuuauuguucaugcuacucgacccucucaugcaaagaaaaagcagacguuaaggauacagaugcaguggauguguguaucgcugauggagucuguauugacgcuuucuuaaagcccccgauggagacggaagaaccucagauauucuauaaugcuagccccagcacccucucagccacaauguuuauaguguccauucuguuucuuauuaucucuuccguugccagucucuag

SEQ ID NO: 5380 - RNA, 1764 nt, Artificial Sequence
  Description of Artificial Sequence: Synthetic coding sequence
augcccagauauggcgcuucauuacgccaaagcugcccucgaucaggcagggaacaaggucaggacgggacagcuggggcucccgggcuuuuguggaugggacuuguacuggcccuugcgcucgcccuugcgcuggcccuggcacugagcgacucccguguucuuugggcuccugcagaagcacauccucuuucaccucaaggacacccugcuagguuacaucgaaucgugccccgauuaagagaugucuucggaugggggaaucugacaugcccaauuuguaagggacuguuuaccgccaucaaucuuggccuuaaaaaagaacccaauguggcucgcgugggcagcgucgcuaucaaacucuguaaccuccucaaaauugccccucccgcagucugucagucaauuguucaccuuuuugaagacgauauggucgaggucuggaggcgcucugugcugucuccaagugaagccuguggcuuacuccuagguaguacaugcggucacugggacaucuucuccaguuggaauaucucccugcccacuguaccuaagccucccccgaaaccaccuagcccaccagcuccuggagcgccggugagucguaucuuguuuuuaaccgaccuccauugggaccacgacuauuuggaagguaccgauccagauugcgccgauccucuaugcugcagacggggcucaggcuugccacccgcaucgaggccaggagcgggauacuggggagaauacucaaagugugaccugccucuuaggacauuggaaucucuguugucuggacugggcccagcuggcccuuuugauauggucuauuggacuggcgacauaccugcccacgacguguggcaccagacucgacaagaccaacuccgggcucugacuacugugacggcgcuggucagaaaauucuuaggcccagugccagucuacccagccguaggcaaucacgaaucaacaccagucaacaguuuuccucccccuuuuauugaggguaaccacucaucacgcuggcuguacgaggcgauggcuaaggcuugggaaccuuggcugcccgcagaggcacugcgcacauuacgcuaucugucuagcgucgaaacucaagagggcaagagaaaagugcacaucaucggucauauuccacccgggcauugucuuaaaucguggucuuggaauuauuauagaaucguagcacgcuaugaaaauacccuugcagcucaguucuuuggacauacacacguggaugaauucgagguauuuuacgacgaagagacacuaagccguccccuggccguagccuuccuggccccaucagcuaccacauacaucggacugaauccuggguaccggguuuaucagaucgaugguaauuauaguggguccucucaugucgugcuggaucacgaaacuuauauccuuaaucucacccaggccaacaucccaggagcaaucccucacuggcagcugcuuuaucgcgcccgagaaaccuaugggcugccaaacacccuuccuacagccuggcacaaccuuguuuaucgcaugcgaggugacaugcaauuauuccagacauucugguuucuguaccacaagggucacccccccagcgaaccgugcggaaccccaugcagguuagcuaccuuaugcgcucaacuaagugcgagagcagacuccccggcgcuaugccgccaccugaugccagauggaagccuuccggaagcccagucuuuguggccacguccuuuguuuuguuag

SEQ ID NO: 5381 - RNA, 1896 nt, Artificial Sequence
  Description of Artificial Sequence: Synthetic coding sequence
augccccgcuacggagccuccuuacgacaaagcugucccagaagcgguagggaacaggggcaagaugggacagccggugcacccggacugcuauggaugggccugguucuggcacuggccuuggcucucgcacuagcacuugcgcugagugauucucgcguucugugggccccggcagaagcucacccccuaucgccacaaggucauccggccaggcuacaucguaucguccccagacugagagauguauucgguugggguaaucucaccuguccaaucugcaaaggccucuuuacugccauuaaccuaggucuaaaaaaggaaccgaacguggccagagucggcuccguggcuauaaaauugugcaaucuguuaaagauugcccccccagcagucugccaaucaaucgugcauuuguuugaggaugacaugguggaaguguggcgaagaucagucuugucccccagcgaagccugcgggcuguuacucgggagcaccugcggccacugggacaucuucucuaguuggaauaucucacugccuaccgugccuaaaccaccaccuaaaccuccaagcccacccgccccuggcgcccccgugagccgcauccucuuuuugaccgaucuccacugggaucacgacuaccuagaaggcaccgaucccgacugugcagacccucuguguugccggcgcggguccggucuaccccccgcaucccgcccaggcgccggauacuggggugaguacuccaaaugcgaucuccccuuacggacgcuggaaucucuuuugucaggcuuaggccccgcugggcccuuugauaugguguauuggacaggcgacauccccgcccaugacguauggcaucagacacgccaagaucagcuucgcgcccugacaacaguuaccgcccuuguuagaaaguuucuuggacccguucccguguacccugcagugggcaaucaugaaucaacaccagugaacucguuccccccuccuuucaucgagggcaaucacucuucgcggugguuauaugaggccauggcaaaagcuugggagcccuggcugccggcugaggcgcugcgaacccucagaaucgguggcuucuacgcccucucgcccuacccuggauuacgauugaucagccugaacaugaauuucugcucuagagagaauuuuugguuacugauaaacucaacagauccugccggccaacuacagugguuaguaggugagcugcaggccgccgaggacagaggagauaagguccacaucauaggacauaucccccccgggcauuguuuaaagucauggaguuggaauuacuaccggauugucgcccgauacgagaauacuuuggccgcacaauucuucgggcauacacacguugacgaauucgagguauucuaugaugaggagacccuaagccguccucucgcuguggccuuuuuggccccuuccgcaaccacguacaucggacugaacccagguuaccguguuuaccagauagauggaaacuauaguggaagcucucauguuguucucgaccacgaaaccuauaucuuaaaccuuacucaggcaaauauucccggugcgauuccccauuggcagcuccucuaccgcgcacgggaaaccuauggacuaccgaauacccugccuaccgcauggcacaaccugguguauagaaugcgcggcgacaugcaauuguuccaaacuuucugguuccuuuaccacaagggucacccaccuucggagccgugcggcaccccuugccggcuggccacacuaugcgcucaacucagugcccgcgccgacucccccgcccugugcagacaucugaugccggacgguucacugccagaagcccagucucuguggccccgaccucuguuuugcuag

SEQ ID NO: 5382 - RNA, 1728 nt, Artificial Sequence
  Description of Artificial Sequence: Synthetic coding sequence
augccccgguauggagcaaguuuaaggcaguccuguccccggucaggucgcgagcaaggacaggauggaacugcaggugcgcccggccucuuguggaugggacugguacucgcccuggcucuggcccuggccuuagcucuugcacuguccgauucaagaguucuuugggcuccugcagaagcccacccauuauccccucagggucacccagccagacugcacaggauugugccuagguuaagagauguguucggaugggggaaccuuaccuguccuauuuguaagggauuauuuaccgcuauaaaccuggguuugaagaaggaaccaaacguagcaagaguugguucgguggccauuaaauuaugcaaucuccucaaaaucgccccaccagcagucugucagaguaucguccaucuguucgaagaugacaugguugaagucuggcgcagauccguguuaagccccuccgaagcuugcggcuugcuucuuggauccaccuguggucacugggauauauucucguccuggaauauuucguugcccacagucccuaaacccccaccaaaacccccgagccccccagcaccaggcgccccaguuucccggauacuuuuucugaccgaucuucacugggaucacgauuaucucgaaggcaccgacccagauugugcugacccucugugcuguagacgggggagcggacuucccccggcaaguagaccuggcgcuggcuacuggggggaguacaguaagugugaucuuccucuaaggacacuggaaagucugcugaguggccugggaccugccgggcccuuugauaugguauauuggacuggagauauccccgcacaugauguauggcaucagacccgccaggaccaacugagagcccucaccaccgugacagcccuugucagaaaauuccuuggcccuguaccaguguauccagccgucggaaaucaugaaagcacuccagucaacucauuuccuccaccuuucauagaagggaaccacaguucuagauggcucuacgaagccauggcuaaagcuugggaacccuggcuucccgcggaagcucugcgaacgcuccggaagguucauauaaucggccacauuccuccagggcacugccucaaaucuuggucauggaacuacuaccgcauuguggccagguaugaaaacacgcuggcagcccaguucuucggccacacccacguugaugaguuugaaguguuuuaugacgaagaaacccuaagccgaccccuugccguagccuuuuuagcucccuccgccacaacuuauauagggcugaaucccgguuaccggguauaucaaauugacggaaauuauucugggagcucucacguagugcuugaucacgaaaccuacauccugaacuugacccaggcuaacaucccaggagccauaccacacuggcaacucuuguaccgagcuagggagacuuacggacugccgaauaccuuaccaacggccuggcauaaccugguguaccguaugcgcggcgacaugcaacucuuucaaacauucugguuccuuuaccauaagggccacccgccuagugagccaugugggacaccuugccgucuugccacacucugugcccaauugagcgcccgcgccgauucacccgcccugugccgccauuuaaugcccgauggaucccuccccgaagcucagagccuguggccuagaccuuuguuuugcuag

SEQ ID NO: 5383 - RNA, 1893 nt, Artificial Sequence
  Description of Artificial Sequence: Synthetic coding sequence
augccacgcuauggugcgucgcuucggcaaucuuguccuaggucaggucgggaacaagggcaggauggaacagcaggagcgccuggucuucuguggaugggauugguucuugcccucgcacuggcccucgccuuagcccuggcucuuagcgauucgcgggugcucugggcuccggcugaggcccacccgcuguccccacagggucaccccgcaagacuucauagaauugucccaaggcucagagacgucuuuggcugggguaaccugacuugcccuaucugcaaagggcuuuucaccgcuauaaaccucggccugaaagaaccuaauguggcccgugucggcagcguugcuaucaaguuauguaaccuccugaagauugcgccucccgccgucugucagucgauugugcaucuguuugaagaugauaugguggaaguguggagaagaucagugcucagccccucagaagccugugggcuccuucuaggcagcacuugcggacauugggauaucuuuucuucauggaacaucagccuuccuaccgugcccaagccuccaccuaaaccuccaagccccccggcacccggcgcaccaguuucccgcauccucuuucuaaccgaucugcauugggaucacgauuaccucgagggcacagaccccgauugcgcugacccccugugcugucgaagagguucuggacuaccccccgccucccgcccuggcgcagguuacuggggagaauauaguaagugugacuugccucugcgaacccuugagucgcuucucucuggccuuggaccagcagggcccuucgauaugguguacuggacaggagacaucccggcccaugacguuuggcaccagaccaggcaggaccaacuacgggccuuaacaaccguuacugcccuugugagaaaguuccugggaccuguacccguuuacccggcagugggcaaccaugaguccacaccaguuaauaguuuucccccgcccuucauugaggguaaccacuccagccguuggcucuacgaagcuauggcaaaagccugggaaccuuggcugccagcagaagcgcuccguacccuucgaaucgguggauucuacgcgcugucuccauacccgggucugcgccucaucucucuuaauaugaauuucugcucgagagagaacuucuggcuuuugauuaacucaaccgauccggccggacaauuacaauggcucguuggcgaacuucaggccgccgaggacagaggagauaaaguucacauuaucggccacauuccaccuggacauugccuuaagagcuggagcuggaacuacuaccguauuguugcuagguacgaaaauacgcuugccgcucaguuuuucggccauacucauguggacgaauucgagguauucuaugacgaggagacauuaucacggccgcucgcuguagcauuucucgccccaucugccacuacuuacaucggguugaacccaggcuaccgcguguaucagaucgacgguaauuauagcggcagcagucacgucguacuagaccacgaaacuuauauccucaaccuaacacaggcaaauauacccggggcuauaccacacuggcaguuguuauaucgcgcuagggagaccuauggacucccgaauacacuuccuacugccuggcacaaccucgucuacagaaugagaggggacaugcaguuauuucagaccuuuugguuccuuuaucacaaaggucauccucccucagaacccuguggcacacccugucgccucgcuacucugugugcccagcucuccgcccgagccgacuccccagcccugugccgacaucucaugcccgacggcagcuuaccagaagcacaaucuuuguggccacgcccccucuuuuguuag

SEQ ID NO: 5384 - RNA, 1101 nt, Artificial Sequence
  Description of Artificial Sequence: Synthetic coding sequence
augcccagauacggcgcaagccuccgucaaucaugcccuagaagcggcagggaacagggucaagacggcaccgccggcgcuccuggccugcuuuggaugggacuuguucucgcauuggcccuagcccuugcacuggcuuuagccuugagugauucuagaguacuuugggcaccagcugaagcucauccccuuucaccccaggggcaucccgcucgacugcacaggauagugccucgccugcgagauguguucggcugggggaacuugacuuguccuauuugcaagggucuguucaccgcuauuaaccuaggacucaaaaaagagcccaacguagcaagaguugguagcguugcaauuaagcuguguaaucuccuaaaaauugcacccccugccguaugccagucaauaguccaccuguuugaagaugauaugguugaaguguggcgucgcuccguacuuucgccuagugaagccuguggccuccucuuagggaguacuugcggccacugggauaucuucucaucuuggaauaucagucuacccacggucccuaagccacccccgaaaccuccaaguccgcccgcaccaggagcacccgugucaagaauucucuuccuaacagaccuucacugggaccacgacuaccucgaaggaaccgacccugauugcgcugacccccucuguugcaggcgcggcuccggacuaccccccgccagccgccccggcgccggcuacuggggcgaauacucuaaaugugacuugccccugcgcacacuggaaucccuccuuagcggacuggguccugcgggcccauucgacaugguguauuggacgggcgauauuccagcccacgacguauggcaccagacacgccaggaccagcuaagagcccugacgacuguuaccgcucucguaagaaaauuuuuggggccugugcccgucuaucccgcugugggcaaccaugaaucaacaccuguaaacaguuuuccucccccuuucaucgaagggaaucauucuaguagguggcuuuaugaggccauggcaaaagccugggagcccugguuaccagccgaagcauuacggacacuccgauguauuuag

SEQ ID NO: 5385 - RNA, 1209 nt, Artificial Sequence
  Description of Artificial Sequence: Synthetic coding sequence
augcccagauacggagccagucugagacagaguugcccuagaagcgggcgugaacaggggcaagaugggacugccggugcccccggucugcuguggaugggauuaguccuugcacucgcccucgcccucgccuuagcccuagccuuaucagauucucggguguuaugggccccugccgaggcccacccgcucaguccccagggacauccggcaaggcugcaucggaucgucccaagacuucgagauguguuuggauggggaaaucuuacaugcccaaucugcaagggauuauucaccgcaaucaaccuuggauuaaagaaagaacccaauguugcuagaguuggcucuguggccauuaaguuguguaaccuguuaaaaaucgcucccccagccgucugucagucaaucgugcaucucuuugaggacgacaugguagaaguguggagaagaucuguacuguccccaagugaggccugcggccuccuucucgggagcacuugcggacauugggauauauucucaagcuggaauaucucucucccaacaguucccaagccuccccccaaacccccuucuccuccagcccccggcgcucccgugucccggauucuauuuuuaacugaccugcacugggaucacgauuaccuugaaggcacagacccugacugcgcugauccauuguguugucgucgagguucgggacugccaccugcuagccgacccggcgccgguuacuggggcgaguacuccaaaugcgaucugccacuacguacucucgagagcuuacuguccggucucgggccugcuggaccauuugacauggucuacuggacgggcgauauuccggcccaugacgucuggcaccagacucgacaagaucagcuccgugcgcugacaacuguuaccgcacucguuaggaaauuuuuagggccgguacccguuuauccagcggugggcaaccaugaaaguacaccuguuaacagcuuuccaccuccuuuuaucgaaggcaaccacucaucucgguggcuauacgaggcaauggccaaagcuugggaacccuggcucccugccgaagcccuucgcacucuuagauaucuuaguagcguagagacacaagaggggaagagaaaaaacuggggugugcucuguagcuuccccauuccacgcuccccaccccaccugucccaguacgaguuccuuuucccauag

SEQ ID NO: 5386 - RNA, 1062 nt, Artificial Sequence
  Description of Artificial Sequence: Synthetic coding sequence
auggaacugaccgagcugcuucuuguggucaugcuuuugcugacugccagacucacacucuccucucccgcacccccggccugcgaccugcgcguacuuucuaaacugcuacgcgacucacauguccuccauucucgacugucccaauguccggagguccacccccuaccuacccccguucuccuuccagccguagacuuuucccugggagaguggaagacccagauggaagaaaccaaggcucaggauauacugggcgcugucacacuucuguuggaagguguaauggccgcccgaggccagcucggaccaaccugccuuucuucacuccucggacagcucuccgggcaagugcggcugcucuuaggcgcucuccaaucacugcugggcacgcagcuacccccacaaggcaggaccacugcacacaaagaucccaacgcuaucuucuugucuuuccagcauuuguugcgagguaagguucgguucuuaaugcugguugggggaaguacucuuuguguccgacgagccccacccaccaccgccgucccgucucggaccucacugguacugacauugaaugagcugccuaaucggacuucggggcuccuugagacuaacuuuaccgccagcgcucguacuacuggaaguggacuccuaaaauggcagcagggcuuccgcgcgaagauacccggccuccuuaaucaaacuucacguucgcucgaccagauucccgguuaccuuaaccguauacaugaauugcucaacggcacaagaggucuguucccagggccgagucgccguacauugggagcucccgacaucucgagcggcacaagcgauacagggucauuaccucccaaucugcagcccggcuacucaccuucacccacucauccccccaccggccaguacacauuguucccauuaccaccuacacuuccuaccccugucguacagcuccacccccuacucccugacccauccgccccaacaccgacuccaaccucuccacugcucaauacauccuauacccacucccagaaucugucacaggagggcuag

SEQ ID NO: 5387 - RNA, 945 nt, Artificial Sequence
  Description of Artificial Sequence: Synthetic coding sequence
auggaacugaccgaacuccuguugguggucaugcugcuguugaccgcccgacugacacuuagcucucccgcuccaccagccugcgaccuucgcguacucaguaaacuccuccgagacucccacgugcuccacucaagacugagccagugucccgagguacacccgcugcccaccccaguccuccugccagcaguugauuucucucuuggagaauggaagacccagauggaagaaacaaaggcccaagacauucuaggggcuguuacccuuuuacucgagggagucauggccgccagaggccaacucggacccaccugccuuucaucucuucugggccagcuaagugggcaggugagauugcuguuaggagcgcugcaaucauuacucggaacccagcucccaccucagggacggacaacggcccacaaggaucccaacgcuauauuucuuucuuuucaacaccugcuccgagggaagacaagcggauuguuggagacuaacuucacagcuagugcuagaaccaccggaucuggacuuuuaaaauggcaacaaggauuccgcgccaaaauuccuggccugcucaaucagaccucccguaguuuggaucaaauacccggcuauuuaaacagaauccacgaguuacucaaugggacccgcggacuuuucccagggccuaguagacgcacacugggcgcaccagacauuaguucuggaaccagcgacacugggucccuaccuccaaaucugcagccaggguacuccccaucccccacccacccaccuacuggacaguacacccuuuucccacucccaccaacucugccuacuccuguugugcaacuucauccccuccugccagauccaagcgccccaacucccacaccaacaaguccccugcuaaauacaucauacacacacucucagaaucugucccaggaaggcuag

SEQ ID NO: 5388 - RNA, 861 nt, Artificial Sequence
  Description of Artificial Sequence: Synthetic coding sequence
auggaacugacagagcuacuccugguggucaugcugcuccucacagcucgcuuaacccucagcuccccagcuccacccgccugcgaccuuagaguccucuccaagcuacugcgagacucucacguguuacacucucgacugucacagugcccagaagugcacccccuuccuacucccgugcuuuugcccgcgguggauuuuagccucggcgaauggaagacccaaauggaagaaaccaaggcccaggacauucucggagccgugaccuuacuucuugagggugugauggcggcgcgugggcaacuuggaccuacgugucuguccagccuguuagggcaacugagugggcagguacggcuucugcugggugcccuccagagccugcucggaacacagcuacccccccagggacgaacaacggcacauaaggacccuaacgcuauuuuucuaaguuuccagcauuuacuccgugggaaagacuuuuggaucgugggagauaaauugcacugccugucacagaacuauugguuaugggccagcgagguggcagccggaauacagagccaggauagcuggucggccgaaccaaacuuacagguuccuggaccaaauccgagaaucccagaacaagauacuagaacccuggaguggaauucauggacccugagcuggacccuuacacaagauccacguucuccugggcacuuccugcgcaacauccgccaccgccucccugccacccaaccgccugcauggaucuuuaguuucccuaacccauccucauauuggacuguguacgcuuugccuuccuccacccaucuggcccaccccuguggacccgcuccuccaccagcaucuuag

SEQ ID NO: 5389 - RNA, 1050 nt, Artificial Sequence
  Description of Artificial Sequence: Synthetic coding sequence
auggaacugacugaacuacuccuggugguuaugcuccuacuuaccgcccgucugacacugucaucacccgcaccaccagcaugcgaucuaagagucuuaagcaaauuacuccgcgauucccacguucugcacucccgucugucgcaguguccagaggugcacccccuaccuacaccaguccuccugccagcuguggauuuuucucugggagaauggaagacccagauggaagagaccaaagcucaagauauucuaggggccgucacacuccugcuggagggagugauggccgcucguggccagcucggaccaaccugcuuauccucacuacuaggccagcugucggggcaggugaggcuguuacuuggagcccugcaaaguuugcuuggaacacagggccgcacuacugcacacaaggauccaaaugcuauuuucuuaucuuuucagcacuugcuucgugguaaaguacgcuucuugauguuaguuggcgggucaacauugugcguccggcgggcuccacccacuaccgccguucccucucggacaucccuaguacugacccuuaacgaacugccaaaucgcacaucaggccugcucgagacgaacuuuaccgccagcgcacgaacuacaggcucuggccuacugaaguggcagcaaggcuuucgggccaaaauuccaggccugcucaaccagacaucccgcucguuagaccagauaccuggcuaucucaaucggauacaugaacuccuuaacgguacgcggggcuuguuccccggaccgagccgacgcacucucggggcaccagauauuucaagcggcaccagcgacacggguucacucccaccuaaccuccaacccggcuauuccccuuccccuacgcacccucccacgggccaguacacgcuguuuccucugccuccaacacugccuaccccggucgugcaacuacacccccuucuuccagauccuagcgcucccacuccaacuccaacauccccccugcugaacacaucauauacucauucucaaaaucuaagccaagaagguuag

SEQ ID NO: 5390 - RNA, 1239 nt, Artificial Sequence
  Description of Artificial Sequence: Synthetic coding sequence
augaagaugcaucuacagagagccuuagucguacucgcgcugcugaauuuugccaccgucagccucucccuaagcaccuguacuacauuagacuucgggcauauuaaaaaaaagaggguagaagcgauuagaggccagauccugagcaaacuaagacugacuaguccuccugagccuaccgucaugacucauguacccuaucagguucuugcauuguauaauucgaccagagagcuuuuggaggaaaugcauggggagcgggaagaaggauguacgcaggaaaauacagagucagaauauuaugcuaaagagauucacaaauucgacaugauccagggauuggcggagcauaaugaacucgcugucugcccaaaaggcaucacaagcaagguguuucguuucaacgugucuucuguagagaagaauagaaccaaccucuuucgcgcugaauuuagagugcucagggugccuaacccaucuuccaaacgaaacgaacaaagaauagaguuauuucagauccucaggccggaugagcacauagcuaaacagagauauauaggcggcaagaacuuaccaacacggggaacugccgaguggcuuucauucgaugucacugauacagugcgagaauggcuguugcgcagggaaaguaacuugggacucgagaucaguauucauugucccugccacacauuucagccuaacggggauauccuggagaacauccacgaagugauggagaucaaguucaagggaguugacaaugaagaugaucauggacguggcgaccucgguagacuuaaaaagcagaaagaccaucauaacccgcauuuaauacucaugaugauccccccacaccggcuggacaauccuggacagggcggacaaagaaaaaaaagagcucuggacacaaacuacugcuucagaaaccuugaggaaaauugcugcguaaggccacuguacaucgacuuuagacaagaccucgguuggaaaugggugcaugaaccaaaaggcuacuaugcgaacuuuuguucgggaccuugccccuauuugcgcagugcagacaccacucacuccaccguguuagggcucuacaauacgcuuaaccccgaggccucugccagcccuugcugcgugccacaagaccucgagccucuaaccauucuuuacuacguaggccggacacccaaaguggagcagcucuccaauauggucgugaagucuuguaaaugcagcuag

SEQ ID NO: 5391 - RNA, 930 nt, Artificial Sequence
  Description of Artificial Sequence: Synthetic coding sequence
augaaaaugcauuuacaaagagcccucgucguccuugcucuguugaauuucgcaaccguuagucugucuuuaucaaccugcacuacuuuagauuuugggcauaucaagaagaaacguguggaagcaauccgagggcagauccugucuaaacugagacucacaagccccccugaaccuacagugaugacccacguuccauaccagguguuggcucucuacaacaguacccgggaguugcuugaggaaaugcacggugagcgggaggagggcuguacccaggagaacacugaguccgaauacuacgccaaagaaauucacaaauucgacaugauacagggucucgccgagcacaacgagcuggccgugugcccaaagggcaucacuuccaaaguuuuccguuucaaugugucaucaguggagaaaaaccguaccaaccuguucagagcugaauuccgaguacuccgcgugcccaaucccuccaguaaacggaacgaacagaggauagagcuauuccagauucuacgccccgacgagcauauagcaaaacagcgguauaucggaggaaaaaacuuaccaaccagaggaacagcugagugguugagcuuugacgugacagauacagugcgcgaauggcuucuacgcagggaaucaaauuugggacuggaaaucuccauacauugcccuugucauacauuucaacccaacggcgacauacucgaaaauauacacgaagucauggagauuaaguucaagggaguagauaacgaggaugaccauggaagaggagacuugggacgguugaagaagcaaaaggaucaccacaacccccaccugaucuugaugaugauucccccccauagacucgauaauccuggucagggcggacagaggaagaaaagagcucucgacacgaauuacugcuuuagauag

SEQ ID NO: 5392 - RNA, 996 nt, Artificial Sequence
  Description of Artificial Sequence: Synthetic coding sequence
augaacggaacucggaauugguguacccucgucgacgugcacccagaagaucaagcagcaguuuaucugaaagggcggagcggugacaagaugauacacgagaaaaauauuaaccaacuaaagagugagguccaauauauucaggaagcaaggaauugccugcagaaguugagagaagauauaucuagcaagcuggaucguaaucucggcgacucccuacaucggcaagaaauucaaguuguguuagagaagcccaauggguuuucacagucuccaacugcucuguacagcucaccaccggaaguugauacguguauaaaugaagauguggaaucacugcgcaaaacaguccaagaccugcuugcuaaguuacaggaggcuaaaagacagcaccaguccgauugcguggcauuugaaguuacuuuaucacgcuaccagagagaagcugagcagucuaaugucgcucuccagcgggaagaggaucgaguagaacagaaagaggcagaagugggcgaacuccagcggcgucugcugggcauggaaacugagcaccaggcacugcuggcuaagguucgggaaggagagguggcucuugaggaguuaagaucaaauaacgcugacugccaggcugaacgugagaaggccgcaacacuagagaaggaaguagccgguuugagggaaaagauacaccauuuagacgacaugcugaagucgcaacagagaaaagugagacagaugaucgagcaacugcagaauuccaaagccgugauccagucaaaggacgcaacuauucaagaacugaaggagaaaauugccuacuuagaagccgaaaaucuugagaugcacgaccggauggagcaucugauugaaaaacagaucagccauggcaauuuuucgacccaggccagagcuaaaaccgagaaucccgggucuaucagaauaucaaagccuccaucccccaagcccaugccagucauccgagucgucgaaaccuag

SEQ ID NO: 5393 - RNA, 1098 nt, Artificial Sequence
  Description of Artificial Sequence: Synthetic coding sequence
augaauggcacacgaaauugguguacacugguggacguucaucccgaagaccaagccgcagccggcagaaagaccuaugcaauggugagcucacauagugcuggccacagccuugcgagugaacugguugagucucaugauggacaugaggaaauuauuaagguauaucucaagggccguucaggcgauaaaaugauccacgaaaaaaacauaaaccaguugaaaucagaggugcaauacauucaagaggcccgcaacugccugcaaaaacuuagggaggacaucucaucuaaacuugaucgcaaucugggagacagcuugcaucgacaggagauccaggucguguuggagaagcccaauggauucagucagagcccuaccgccuuauacaguuccccccccgagguugacaccugcauuaaugaggauguggagucccugcgcaaaaccguccaggauuuacuggccaaacuacaagaggccaaaaggcagcaccagucagacugcgucgccuuugaagugacacugagccgcuaccagcgagaagccgagcaauccaacguugcccugcaaagagaggaggaucgcguagaacaaaaggaagcugagguuggggagcuacaaaggagguuacuggggauggagacugaacaccaagcccucuuagcuaaaguuagggaaggggaagucgcccucgaggaacucaggucgaacaacgcagacugccaggccgagagagaaaaggcugcgacgcucgaaaaggagguggccggacuccgcgaaaaaauccaccacuuggacgacaugcuaaagucacagcaacgaaaagugcgucagaugaucgaacagcugcagaauucaaaggccgugauucaaaguaaggacgccaccauacaggaguugaaggagaaaauugccuacuuggaggccgaaaacuuagagaugcacgaccgaauggaacacuugauugaaaagcaaaucucccauggaaauuucucuacacaggcccgcgcuaaaacugagaaccccggcuccauaagaaucaguaagcccccuagcccuaaaccaaugccagugauuagagugguggagacauag

SEQ ID NO: 5394 - RNA, 1173 nt, Artificial Sequence
  Description of Artificial Sequence: Synthetic coding sequence
augaacgggacccgcaauuggugcacacugguagacgugcauccugaagaucaagcagcaggcuccguagacauucuccgccucacacugcagggagaacuaaccggagacgaacucgagcacaucgcacagaaggcuggccgcaagaccuacgcuaugguuucuucacacucugccgggcauucgcuagccucugaguuaguugaaucacacgacggccacgaagagaucaucaagguauauuugaaaggucgcuccggggacaaaaugauccaugaaaagaacauuaaccagcugaagagugagguacaguacauucaagaagcacgcaacugccuacaaaagcuacgcgaggauauuagcucaaaacuggauagaaaccugggggacucgcuacauagacaagagauccaaguuguucuugaaaagcccaacggcuucucccagagcccuaccgcucuuuacaguucuccaccagagguggauaccugcaucaaugaagauguggaaucccuaaggaaaacagugcaggaucugcuagcaaagcuccaggaggcgaaaaggcaacaucaaagugauugcguggccuucgagguuaccuugagucgauaccagagagaagccgagcagaguaacgucgcacuccagcgugaagaggauaggguugaacagaaagaggcagaagugggggaacuccaaagaaggcugcuuggaauggagaccgaacaccaggcgcuuuuggcaaagguacgugaaggcgagguggcuuuggaagaacucagauccaacaaugcggacugucaagcggaaagagaaaaggccgcgacucucgaaaaggagguugcaggccuacgggagaagauccaccaccuugacgacaugcuaaaaucccagcagcgcaaagucaggcaaaugauugagcaauuacagaauuccaaggccgugauacagaguaaagaugcaacuauccaagaacuuaaggaaaagaucgccuaucuggaagccgaaaaccuagaaaugcaugacaggauggagcaccucauagaaaagcagauuagucacggaaauuuuucaacacaagcaagagccaagaccgagaaucccggaagcauccguauuagcaagcccccaagcccaaaaccaaugccugugauuaggguggucgagaccuag

SEQ ID NO: 5395 - RNA, 600 nt, Artificial Sequence
  Description of Artificial Sequence: Synthetic coding sequence
augaacggaacgaggaacugguguacucuuguggauguccaccccgaagaucaggccgcugccgggcggaaaacuuacgcgaugguuucaucccauucugcuggucauagccuggcauccgagcucguugaaucucaugacggccacgaggagauuauuaaaguguauuugaagggcagauccggugauaaaaugauacaugaaaaaaauaucaaucagcugaaaucagaagugcaguauauccaggaagcucgaaauugucugcagaaacugagagaggauauuaguagcaagcuggaccggaaccucggagacucgcugcacagacaggaaauccaggucguucuagagaagccuaauggauuuagccagagcccaacugcccuguacagcagcccccccgaaguugacaccuguauuaacgaagacgucgagagccugcggaaaaccgugcaggacuugcuggccaaacuucaagaagcuaaaagacagcaucaguccgauuguguggccuuugaggugaccuuaucaagauaucagagagaggccgagcaauccaacguugcucugcagagagaggaggaucggugcccugaguag

SEQ ID NO: 5396 - RNA, 1230 nt, Artificial Sequence
  Description of Artificial Sequence: Synthetic coding sequence
augagcucucccggaaugacuucucugcagcuggaaaaggaggaauguaugcagugcgugccauguucaccacgcaccaggguagcucuacuggaacuguacagggccaugugccaaggcucuguugauauacuucgccugacacugcagggugaacuaacaggagacgaacuagaacacaucgcacagaaagcgggucgaaaaacguacgcuauggucagcucccacagcgccggccacucccuggcaagcgaguuaguggaaucacaugauggacacgaggagauaauaaaaguguaucuaaaggggcgcuccggcgauaagaugauacaugagaagaacauuaaccagcugaaauccgagguacaauacauccaggaagcuaggaauugcuugcaaaaacugcgggaagauaucuccuccaagcuugauagaaaucugggugauucccugcauagacaagaaauacaaguuguguuggagaaaccuaacggcuucucucagucuccaaccgcccuauacucuuccccccccgagguggacacgugcauuaaugaggacgucgagaguuugagaaaaacuguccaggaucuguuggccaagcuacaggaagcaaaacgacagcaccaaucagauuguguggcauuugaagugacauuaucucguuaucagagagaggccgaacagucuaauguggcgcugcagagagaggaggauaggguggaacagaaggaggcagaggucggagaacuccagcgccgacucuugggaauggagaccgaacaucaagcacuguuggcuaaaguaagagaaggagaggucgcgcuugaagaguugcggucuaacaacgccgacugucaggccgaacgggagaaggcugccacacuggagaaggaaguagcagguuuacgcgagaagauacaccacuuagacgauauguugaaaagccagcagaggaaggucagacaaaugaucgaacaauugcagaauuccaaggccguuauccagucaaaggaugcgacaauucaggaacuaaaggagaagauagcauaccuagaggccgagaaccuggaaaugcaugacagaauggagcauuuaauugagaagcaaauuagucacggcaauuuuagcacacaggccagagcuaaaaccgaaaacccaggauccauccggauuucuaagccccccaguccaaaaccaaugccagugauacguguaguugaaaccuag

SEQ ID NO: 5397 - RNA, 543 nt, Artificial Sequence
  Description of Artificial Sequence: Synthetic coding sequence
augaacggaacccgaaacuggugcacccuaguggauguacaccccgaggaucaggccgcagcagggagaaaaaccuaugccauggucucuagucacagugccggacauucccuagcaagcgaauuaguugagucucaugacggucacgaagagaucaucaaggucuaucuaaagggcagaaguggcgacaaaaugauccacgaaaaaaacauuaaucagcugaagucggaagugcaguauauacaggaagcucggaacugccuccagaaacugcgagaagacaucucgucuaaacuggauagaaaccuuggcgacagcuugcaccgccaagagauccaagugguacuugagaaaccaaauggauuuucucaguccccuaccgcccuuaaagccggagauacggacguccaaagugacuggcgcaugucuugggggaacgaggucccuaguacgaauacagcccaguuucuggcaacuaauuguuuauucuuuuaucugcuccaccugcaaccgacccuuccauggccaccagcugaccgauag

SEQ ID NO: 5398 - RNA, 1182 nt, Artificial Sequence
  Description of Artificial Sequence: Synthetic coding sequence
auggaagagccgcagagugauccaaguguagagccuccucugucucaagaaacuuuuuccgaccuguggaagcuucugcccgaaaauaaugugcuuucuccuuugcccagccaagcuauggaugaccugaugcuuucaccugaugauaucgagcagugguuuaccgaagaccccgguccagacgaggcacccagaaugccugaagccgcuccaccagucgccccugccccugccgccccaacuccugccgcccccgcuccagcccccucguggccacugagcucuucagucccuucacagaaaacauaccagggaucauacggcuuccggcugggguuucuccacaguggcacagccaaaagcguaaccugcacauacucuccagccuuaaacaagauguucugccagcuggcuaagaccugccccgugcaacucuggguggauaguacaccgccgccuggcaccagagucagggcuauggcaauuuacaagcaaucccagcauaugaccgaaguagucagaagauguccacaucacgagcguugcuccgauagugauggacucgccccuccacagcaccuuaucagagucgaaggcaaccugagaguggaguauuuggaugauagaaacacuuuccgacacuccguggucgugccuuacgagccucccgaaguuggcagcgacugcaccacaauccauuauaacuauaugugcaacagcagcuguaugggcggaaugaaucggcgccccauccugacaauaauuacccuggaggauuccagcggaaauuugcugggacgcaauagcuucgaagugcggguaugugcuuguccuggcagagacagacgaaccgaggaagaaaaucuccguaaaaaaggcgaaccccaccaugaacuaccaccgggcaguaccaaacgggcguuacccaauaacaccuccucgucgccucaaccuaagaaaaaaccucuugauggagaguacuuuacucuacaaauucgcggcagagagcgcuuugaaauguuucgcgaacugaaugaagcacuggaauuaaaggaugcgcaagccggaaaggaacccggcgguuccagggcccacucuucccaccucaagucaaagaaaggacagagcaccucacgccacaaaaaacucauguucaagaccgaaggcccugacagugauuag

SEQ ID NO: 5399 - RNA, 1032 nt, Artificial Sequence
  Description of Artificial Sequence: Synthetic coding sequence
auggaggagccucagucugauccuucaguggaacccccccucagucaagaaaccuuuuccgaccuguggaaguuauuacccgaaaacaauguucuuuccccccuuccuucccaagccauggaugauuuaaugcugucacccgacgacauugagcagugguuuaccgaagauccugggcccgacgaggccccucggaugccugaagccgccccgccugucgcccccgccccugcggcccccacaccagccgcaccugcaccagcccccucuuggccucuauccucaagugugccaucucagaagaccuaccagggguccuauggauuucgccucggauuucugcauagugguacggcuaaaagugucaccugcacuuacucccccgcacuaaacaaaauguucugccagcuugcaaaaacuugcccuguucagcuuugggucgauuccaccccucccccuggaacaagaguacgcgcuauggcaaucuauaaacaaucacaacauaugacagaaguuguccgucggugcccacaucacgaacgguguucugacagcgaugguuuggcccccccgcagcaucucauucgaguggaaggcaaccugaggguagaguaucuagaugaucgcaacaccuuucgccacuccgucgucgugcccuaugagccaccagagguuggauccgauugcaccaccauucacuauaauuacaugugcaacucuuccuguauggguggaaugaaccggcggccuauccucacuaucaucacucucgaggacagcucuggcaaccuucuuggacggaauuccuuugaggugagagugugcgcgugcccaggcagagaucgaagaaccgaggaggagaaccuacgcaagaaaggggagccacaccacgagcuuccaccaggcuccacgaagcgcgcccugccuaauaauaccucauccucaccucagccuaagaaaaaaccuuuggauggcgaauauuucacucugcagaagacauucccggcucgacauggcgguucccauuuauag

SEQ ID NO: 5400 - RNA, 1149 nt, Artificial Sequence
  Description of Artificial Sequence: Synthetic coding sequence
auggaagaaccccaaucagacccgagcguagagccuccgcucagucaagaaacuuuuuccgaccucuggaaacuguugccagagaacaacgugcucaguccccuuccaucccaggcaauggaugaucucaugcucucuccugaugacauugaacaaugguucacugaagaucccggccccgacgaagcucccagaaugcccgaggcugcaccuccaguagcucccgcuccagcugccccaacaccugcugcuccugcacccgcccccuccuggccucuaucaucuagugugccaucccagaagacauaccagggcagcuaugguuuuagacugaccugcaccuacuccccugcccugaauaagauguucugucaguuggcuaagaccuguccaguccaguuguggguagacuccaccccccccccaggcacccgcgucagagcgauggcaaucuauaagcagucucagcacaugaccgaggugguacgaagaugcccgcaucaugagagauguagcgauuccgacggucuagcgccaccucagcacuugaucagaguggaaggcaauuuaagaguggaguacuuagaugaucgaaauacauuccgacauuccguugugguuccauacgagccgccagaggugggaucugauuguacuacgauccauuacaacuacauguguaauaguuccugcauggggggaaugaacaggcguccuauuuugacaaucauaacauuagaggauucaucuggcaaccugcucggccgcaacaguuuugagguucgggucugcgcuugcccaggaagggacagacggacagaggaggagaauuugcgcaaaaaaggcgagccccaccacgaacucccucccgguucuacaaagagggccuuacccaacaacacaucuucauccccucagccaaagaaaaaaccauuagauggggaauacuuuacgcugcagauucgggggagggaacgauuugagauguuuagggaauugaacgaggcauuggaacucaaggaugcccaagcagggaaggaaccaggcgguucaagggcucauagcucccaccuaaagucuaagaagggacaguccacuagccggcauaaaaaacugauguucaagacugagggaccagacagcgauuag

SEQ ID NO: 5401 - RNA, 858 nt, Artificial Sequence
  Description of Artificial Sequence: Synthetic coding sequence
auggaggaaccgcagucugauccuaguguggagccuccucuuucccaggaaaccuucucugaccucuggaaacugcugccugagaacaacguucuguccccucugcccagccaagccauggaugaccugaugcuaucucccgacgacauagagcaaugguucacggaagauccuggccccgaugaagcuccacguaugccugaggccgcgccacccguagcacccgcaccugccgccccgacgccugccgcgccugcuccugccccaaguuggccacugucuuccagcgugccuagucaaaaaaccuaccaggguaguuaugguuuuagacucggcuuccugcacaguggaacagccaaauccgucacuugcacauauucucccgcguuaaacaagauguuuugccagcuggccaaaacuugcccagugcaacucuggguggauuccacaccuccgccagguacccgcgugcgugcaauggcuaucuacaaacagucccagcacaugacagaggugguuaggagaugcccacaccacgaacgauguucagauucagaugggcuugcgccuccacagcaccugauucgcguggaaggcaaucugcgcguagaguaucucgacgacagaaauacuuuuaggcauuccguggucguaccauacgagccccccgaagugggauccgacuguacuacgauucauuauaacuacauguguaacuccuccugcaugggagguaugaaccggcgcccgauacugacuauaauuacacuggaagauucaagaccacgacagguugaucacuuacguuccggcgugcaggauucacuggcuaacaucgccaagagccacuuauauuag

SEQ ID NO: 5402 - RNA, 273 nt, Artificial Sequence; identical to SEQ ID NO: 5072
  Description of Artificial Sequence: Synthetic coding sequence

SEQ ID NO: 5403 - RNA, 135 nt, Artificial Sequence; identical to SEQ ID NO: 5073
  Description of Artificial Sequence: Synthetic coding sequence

SEQ ID NO: 5404 - RNA, 1026 nt, Artificial Sequence
  Description of Artificial Sequence: Synthetic coding sequence
auggaggaaccccagucugacccgagugucgaaccaccauugagccaagagacuuuuuccgaccuguggaaguugcugcccgagaauaacgugcuuagccccuugccaucacaagcaauggacgaucuuaugcuguccccagaugauauugaacagugguuuacugaagaucccgggcccgacgaggcuccaagaaugcccgaagccgccccucccguggcaccggcccccgcagcaccaacccccgccgcuccugcuccugcuccuucauggccuuuaaguagcagcgucccaucucagaaaacauaccagggcagcuauggguuccgacugggauuccuccacagcggcacugcaaagaguguaaccuguaccuacucacccgcacuuaacaaaauguucugucagcucgcuaagaccugcccaguucaauuauggguggacuccacccccccuccuggcacaagagucagagcuauggcaauauauaaacagagccaacacaugacagaggucguucgccgauguccacaccaugagcggugcucugauagugauggccuugcccccccccagcauuugauacgaguggaaggcaaccugcgcgucgaauaucuagacgacaggaacacuuuucgacacucuguuguugugcccuacgagccgccugaggucggaagcgauuguacuaccauucauuauaacuauauguguaacucgagcuguaugggcgggaugaaccggagacccauccuaacuauaauuacccuagaagacucguccggaaaccuguuggggagaaacucauucgaaguuagaguuugcgcgugcccuggccgcgaccgcaggacugaggaagagaaucuacgcaagaagggagagccccaccacgaauugccuccugggucaacuaagagagcccuuccgaacaauacauccaguagcccacagccuaaaaaaaaaccacucgacggugaauauuuuacacuccaagaccagaccucauuucagaaagagaacugcuag

SEQ ID NO: 5405 - RNA, 1182 nt, Artificial Sequence
  Description of Artificial Sequence: Synthetic coding sequence
auggaagaaccgcagucagauccuucuguggagcccccccugucgcaggaaacuuucucugacuuguggaaguuguugcccgaaaauaacgugcucagcccuuuacccucacaagcaauggacgacuugauguugucgccugaugauauagaacaaugguuuaccgaggauccugggccagacgaagcuccaagaaugccugaagcagcccccccugucgcccccgcccccgcagcuccgacucccgcagcccccgcuccagcgcccaguuggcccuuaaguaguucugugccuagccaaaagaccuaucaagguaguuauggcuucagacucggauuccugcacuccgguaccgccaaaaguguaacuugcaccuacucucccgccuugaacaaaauguuuugccagcuugcuaagacgugcccagugcaguuauggguugacuccaccccaccccccggcacacgggucagagccauggccauauacaagcaaucccaacauaugaccgaggucgugcgccggugcccucaucacgagcguuguuccgauagcgacggauuagcucccccccaacacuugauucgcguggaagggaacuugcggguggaauacuuggacgaccguaauacauucagacauagcguuguggucccuuacgaaccacccgaaguaggcuccgacuguacuacaauccauuauaacuauaugugcaauuccucuuguaugggcggaaugaacaggaggcccauucuuaccaucauuacucuggaggauagcucaggaaaucugcuggggcgcaauuccuucgaaguucgggugugugcuugcccuggacgcgacagacgaaccgaagaggaaaaucuccgcaaaaaaggagaaccacaucaugaacucccaccuggcaguacuaaaagagcccugccuaacaauacaucauccagcccccaaccgaaaaagaagccucucgacggcgaauauuuuacacugcagaucagagggcgagagagauucgagauguuuagagaacuuaaugaggcccuugaacuaaaagaugcacaggcagggaaggaacccgggggauccagggcccacagcagccaucucaaaagcaaaaagggucagagcaccucacgacacaaaaagcugauguuuaagacagaagguccugauucugacuag

SEQ ID NO: 5406 - RNA, 1041 nt, Artificial Sequence
  Description of Artificial Sequence: Synthetic coding sequence
auggaggagccucaauccgauccaucuguugagccgccucugucacaggaaaccuucucggaccucuggaagcugcucccugagaauaacgucuugagcccccugccgucacaggccauggacgacuuaaugcucucccccgacgacauugaacaaugguucaccgaagaucccggacccgaugaagcgccccgcaugccagaagccgccccaccuguggcacccgccccugccgccccuacacccgcagcccccgccccagcccccaguuggcccuuauccuccagcgugccaagccaaaagacauaccaggguucuuacggcuuccgauuaggcuuucuucauucaggcacugcaaaguccguuacuuguaccuacucaccggcacugaauaagauguucugccagcuugccaaaacaugucccguccagcuauggguugacucuacgcccccccccggaacgagagugcgcgcuauggcgauauauaagcagucucagcauaugacagaaguugugcgcagauguccccaucacgagagaugcucugacagcgauggucucgcacccccucagcaccugauccgcguggaaggcaaucugcggguggaguaucuggaugacagaaauacuuuccgacauuccguuguagucccuuacgaacccccugaaguuggaucagauuguacgacuauucauuacaacuacauguguaacagcucauguaugggaggcaugaacagacgaccaauacugaccaucauuacguuagaggauagcucuggcaaccugcugggccggaauucuuuugagguuagagugugcgcuuguccugggagagauagaagaacagaggaggagaaccugagaaagaagggagaaccucaucacgagcuaccuccuggaucaaccaagagagcccuacccaauaacaccaguagcuccccucaaccaaaaaaaaaaccccuugauggagaauauuuuaccuugcagaugcuauuagaccuuagaugguguuacuuccugaucaauucaucguag

SEQ ID NO: 5407 - RNA, 387 nt, Artificial Sequence
  Description of Artificial Sequence: Synthetic coding sequence
auggaagagccacagucugacccuucugucgaaccuccgcugucccaagaaaccuucuccgaccucuggaagcuucuuccugaaaacaacgugcucuccccacuuccaucucaagccauggaugaccuaaugcucagccccgacgacaucgagcaaugguucacugaggacccagggccugaugaggcaccucgcaugccugaagcugccccacccguggccccagcaccagcagccccaaccccugccgcccccgccccugcgccuaguuggccauugucuaguucuguacccucucagaaaaccuaucagggauccuauggauucagacuuggcuuccuucacuccgguaccgcgaaaucugucaccugcacuuauucgccuuag

SEQ ID NO: 5408 - RNA, 498 nt, Artificial Sequence
  Description of Artificial Sequence: Synthetic coding sequence
auggaggagccacagagugauccaagcguggaaccuccucuaucccaagaaaccuucuccgacuuauggaaguuguuaccagaaaauaacgugcucuccccuuugccuucucaagccauggacgaccuuauguugagccccgacgacauagagcagugguuuacagaagacccaggccccgacgaagccccucgaaugcccgaggccgcgccaccaguugcccccgcuccggcggcacccacccccgcagcaccggccccagccccaucauggccucucaguaguagugucccuagccaaaaaaccuaccaaggcaguuacggcuuccgccugggauuuuugcauucgggcacugcaaaaucuguaacuugcaccuacuccccugcucugaacaaaauguuuugucaacuugccaaaacguguccgguccaacuuuggguugauuccacaccaccccccgguaccaggguccgagccauggcaaucuauaagcaauag

SEQ ID NO: 5409 - RNA, 600 nt, Artificial Sequence
  Description of Artificial Sequence: Synthetic coding sequence
auguucugccaauuagccaaaacuugcccugugcagcugugggucgauucaacccccccuccuggaacaagggucagggcgauggcaauuuauaagcagucccaacacaugacggaagugguucgucgcuguccccaccaugagagauguucugacucagacggccucgcacccccccaacaucugaucagagucgaggggaaccucagaguggaauacuuggaugaucggaauacauuuagacacucuguuguagugccuuacgaaccccccgaagucggcagugacuguacaaccauccacuauaauuauauguguaacaguucuugcaugggcggaaugaaccgccgaccuauccuaacgaucaucacacuugaagauagcuccggcaaucucuuaggaagaaacuccuucgaaguucgaguuugugcgugcccuggacgggauagaagaacagaagaggaaaaccucagaaaaaagggcgaaccacaucaugagcuuccuccugguuccacuaaacgagcccucccgaauaacacaucuuccaguccucagccgaaaaagaaaccccuggacggagaguacuuuacacuccaguag

SEQ ID NO: 5410 - RNA, 468 nt, Artificial Sequence
  Description of Artificial Sequence: Synthetic coding sequence
auggaagagccccagagcgacccaucuguggagccaccucugucccaagaaacauuuagcgauuuauggaaacuacugccugaaaauaaugugcuguauagcccagcuuugaauaagauguucugucaacuggccaaaaccugccccgugcaacuguggguugauucaaccccccccccugguacacgggugagagcaauggcgauuuacaaacaaucccaacacaugacggaaguaguacgcaggugcccucaccaugaacgcuguucagauucugauggccuugcaccuccccagcaccugaucaggguggaggggaauuugagaguggaauaccuggaugaucgcaauacuuuucggcacucaguggucgugccauacgaaccgccugaaguaggaagugacuguaccacuauccacuauaacuacauguguaacucaucuugcaugggagguaugaaucgcuag

SEQ ID NO: 5411 - RNA, 468 nt, Artificial Sequence
  Description of Artificial Sequence: Synthetic coding sequence
auggaagaaccucaaucugacccauccgucgaaccgccucucucacaggagaccuucucggaccucuggaagcuacucccagagaauaacguccuguauucuccugcacugaacaaaauguucugccaacucgcaaagacaugucccguucaacuguggguggacuccacgccuccucccggaacaagaguucgcgcuauggccaucuauaagcaaucacagcacaugacagaagucguccgccgguguccccaucacgaaagaugcagcgauagugacggucucgccccaccucagcaccucauccgaguggaagguaaccuccggguagaauaccucgacgaccgaaacacauuuaggcauucaguaguaguuccuuacgagccucccgaagucggcucagauugcacaaccauccacuacaauuauaugugcaacuccuccugcaugggcggcaugaauagauag

SEQ ID NO: 5412 - RNA, 1470 nt, Artificial Sequence
  Description of Artificial Sequence: Synthetic coding sequence
auggcggggcagagggucuugcuucugguuggguuucuccucccuggcguacuacuuagugaagccgcaaagauccugaccauuucgaccguugauuuuaaaaaggaagaaaagucauaucaggugauuuccugguuagcaccugaagaccaccagagggaauucaaaaagucuuucgauuuuuuccuggaagagacacucggagggcgaggcaaguucgaaaaccucuuaaacguccuggaguaucuggccuuacagugcagccacuuuuugaauaggaaagauaucauggauucauugaagaacgaaaauuucgacauggugauuguugagacauuugauuacugcccuuuucucaucgcagaaaaacuuggcaagcccuucguagccauccuuucuacgagcuucggcagcuuagaguucggucugccgaucccauuauccuauguucccgucuuccgcucgcuauuaacugaucacauggauuuuuggggcagaguuaagaacuuucugauguuuuuuuccuuuugcagacggcagcaacacaugcagucaacauucgauaauacaauuaaagaacacuuuacugaggggucccgacccgugcuuucccaucuucugcugaaagcugaacuuugguucaucaauucugacuucgcuuuugacuuugcccggccccugcucccaaacaccguguacgugggcggccugauggaaaaaccuaucaaaccugucccacaggaccuggaaaacuuuaucgccaaauucggggacuccggauuugugcucguuacucucggauccaugguuaauaccugccagaacccugagaucuucaaagagaugaacaacgcguucgcacaucuuccucaaggugucauauggaaaugccaguguagucauuggccuaaggacguacaucucgcagccaacgucaagauaguggauugguugccucagucugacuugcuagcccaccccagcauaagacucuucguuacccauggaggucaaaacucuauuauggaggccauccagcacgggguacccauggucggaaucccccuuuuuggggaucaaccagagaacaugguucgagucgaagccaaaaaguuuggaguaucaauccagcugaaaaagcuuaaggcugaaacacuggcucugaagaugaaacagauaauggaagauaagagauauaaaagugcagcaguagcugccagugucauccucagaucacauccacucucaccuacucagcgucugguuggcuggauugaccauguacuccaaacagggggagccacccaccuaaaaccauacguuuuucagcagccuuggcaugagcaguaccugcuggacguauuuguguucuuacuugggcuuacuuugggaacucuuuggcuguguggcaaauuauuaggcauggccgucugguggcuuaggggagcacgcaaggugaaggaaacauag

SEQ ID NO: 5413 - RNA, 1572 nt, Artificial Sequence
  Description of Artificial Sequence: Synthetic coding sequence
auggcgggucaacgcguccuucuguuagugggguuuuuguuaccugggguccuuuuaucugaagcugccaagauccugacuaucuccacugucgguggcagucacuaccuccugauggacagagugagucaaauccugcaggaucauggacacaauguaacaaugcucaaccacaaacgagggcccuucaugccagacuucaaaaaagaggagaagaguuaucaggugaucaguugguuagccccugaagaucaucaaagagaauuuaagaagaguuuugacuuuuuccuggaagaaacuuuaggggguagggggaaauuugaaaaucuguugaaugucuuggaauaucuggccuugcaauguucucacuuccucaaucguaaggauauaauggacuccuugaaaaacgaaaauuucgacauggugauaguagaaaccuuugacuacugcccauuccugaucgcagaaaaacuaggcaaaccauuugucgcuauacuguccacuucauucgggagucuagaguucgguuugccuaucccgcugagcuacgugccugucuuucgaagccuacugacugaucacauggacuuuuggggccgugucaaaaacuuccugauguucuucucuuucugucgccgucaacagcacaugcaaucaacauucgauaacaccauuaaggagcacuuuacagaagguuccaggcccgucuugagccaccuacugcuaaaggccgagcucugguucaucaauucggacuucgcuuuugacuucgccagaccgcuacugccuaacacaguuuacgugggaggacucauggaaaaaccuaucaagcccgucccucaagaucucgaaaauuucaucgccaaguucggugauaguggcuuuguccuugugacccugggaucuauggugaacacuugucagaacccggagaucuuuaaagaaaugaauaacgcuuucgcacaccuuccucagggcguuauuuggaaaugccaauguucccacuggccuaaggacguccacuuggcagcaaaugugaaaaucguggacuggcuaccgcagucugaucugcuggcucacccuagcauaagacuguuugugacgcacggaggucagaacucuauaauggaagcuauucagcacggaguaccuauggucgggauuccuuuauuuggugaucagccugagaauauggugagaguggaagcuaaaaaauucggggucucuauucaauuaaaaaaguugaaggccgagacccucgcccuuaagaugaaacaaauuauggaagauaagagguacaaauccgcugccgucgcggcuagugucauacuccgaagccacccccugagcccaacccagcggcuggucggauggaucgaccauguucugcaaaccggaggcgcaacacaucuaaaaccauacguuuuccaacagccauggcacgagcaguacuuguuagauguauucgucuuucuccugggacucacuuugggcacucugugguuguguggcaaacuuuuaggaauggccguuugguggcugcggggggcucggaaggugaaagagacuuag

SEQ ID NO: 5414 - RNA, 417 nt, Artificial Sequence
  Description of Artificial Sequence: Synthetic coding sequence
auggcgggccaacgggugcuucuacuggugggcuucuuguuaccggggguccuguugucagaagcugcgaaaauuuuaaccaucagcacaguugggggaucucauuaccuacuuauggacagggugucccaaauccugcaagaucauggccauaaugugacaauguuaaaccauaaacgaggaccuuucaugccugauuuuaagaaagaagagaaaaguuaccaggugaucaguuggcuggcgccagaggaccaccagcgcgaguucaaaaaaagcuucgauuuuuuucucgaggaaaccuuggggggccgaggaaaauuugagaauuuacucaauguacuggaauaucuugcauugcaaugcucacacuuccuaaaucgaaaagacauaauggacucuuugaagaaugaaaauuag

SEQ ID NO: 5415 - RNA, 666 nt, Artificial Sequence
  Description of Artificial Sequence: Synthetic coding sequence
auggugaauacaugccagaacccugagauuuucaaggaaaugaauaaugccuucgcccaccuuccgcagggagucauauggaaaugucagugcucucacuggccuaaagacguccauuuagccgcuaacguaaagauaguugacuggcuaccccaaagugaccuucucgcccaucccagcauucgacucuucgugacccacggcggacagaacaguaucauggaggcuauccaacauggugugccaauggucggaaucccacuuuucggugaucagccugagaacauggugagaguggaggcgaaaaaguuuggagugucaauacaauugaagaagcucaaagcagagacacuggcucugaagaugaaacagaucauggaggacaagagauacaaaucagcugcuguagccgccucuguaauucugaggagccacccacucucucccacacagagacugguugguuggauagaucacguacuccagacgggaggcgccacccacuugaaaccuuaugucuuucagcaaccuuggcaugaacaauauuugcuggauguuuuuguguuucugcugggauuaacauugggaacccuguggcugugcgggaaguugcuggguauggcaguguggugguuacgaggcgcaagaaagguuaaggaaacauag

SEQ ID NO: 5416 - RNA, 954 nt, Artificial Sequence
  Description of Artificial Sequence: Synthetic coding sequence
uugacagaccggcagacggauacggcaccuuccccaucuuaucaucuguuaccugggcgaagaaggacuguugacgccgccgcuagccgugggcaagggccagagcccgcacccgggggaggaguugagggcgugggcgcaagaggaguggcgcugaaacucuuuguccaacucuuagggugcaguagguucggcggggccgugguaagagcaggagaagcugaaccauccggggcugcuagaagcgcuucaagcggcagagaggaaccacagcccgaagagggggaggaggaggaggagaaggaggaggaacgcgggccucaauggagacugggggccagaaaaccugguucauggaccggcgaggcugcggucugugcggacagugcaccagccgccagagccccccaagcacuggccagagcuucuggcagggguggaagaguugcaagacgcggagcugaggagaguggaccuccucauucucccucgagacgagguagcgccagucgagcgggacccgggcgugcuagcgaaacuaugaauuuccugcugucauggguacauuggagccuggcuuuacuccuguaccuucaccacgccaaguggucccaggcugccccaauggcugaagggggagggcagaaccaccacgaagucguuaaguuuauggacguguaucagcggucauacugucauccuauagaaacauuggucgacaucuuccaggaauacccugaugaaauugaguauaucuuuaaaccuagcugcguuccacugaugaggugcgguggauguuguaaugacgaggguuuggaaugugucccuaccgaggaaagcaauauaacaaugcagaucaugagaaucaaaccacaucaaggccagcauauaggcgaaauguccuuccuccagcacaauaaaugcgaauguagaugcgauaagccaagacgauag

SEQ ID NO: 5417 - RNA, 1239 nt, Artificial Sequence
  Description of Artificial Sequence: Synthetic coding sequence
cugacggacagacagacugauacagccccgucuccauccuaucacuuguuaccaggcagacgaagaaccgucgacgccgcugccucucguggucaaggaccugagccugcaccuggggggggaguggagggcgugggagcaagaggaguagcauugaagcuguuuguucagcugcucggaugcagcagauucgggggagcagugguacgcgccggcgaggccgagccgagcggagcugccaggucagcuucaucaggccgggaagagccacaacccgaagagggcgaagaggaagaggaaaaggaagaagagagaggaccccaauggagguuaggagcacggaaaccgggcagcuggaccggagaagcagcuguaugugccgacagcgcuccugcagcaagagccccccaagcauuggcucgugcaagcggacggggugguagaguagcucggcggggugcagaggaaagugguccaccccauucccccucucgcagaggcucugccucucgggcaggccccggcagagcgucggagaccaugaacuuucuucucagcuggguacauuggucucuugcccugcuuuuauaucugcaucaugcuaaguggagccaggcugccccuauggccgaaggaggagggcagaaucaucaugaagucgucaaguucauggacguuuaccaacggaguuauugucaucccauugagacccuaguugacaucuuucaggaguacccagacgagaucgaauacaucuucaagccuagcugugugccucucaugcggugugguggcuguuguaacgaugaaggccucgaguguguacccaccgaagaauccaauauuacaaugcaaauuaugaggaucaaaccucaucagggacagcauaucggcgagaugucauuccugcaacacaauaaaugcgagugccgcccaaaaaaagacagagcccggcaagaaaagaagaguguucgaggcaagggcaagggucagaaaagaaagagaaaaaaaucaagauacaaaucguggaguguguacguaggagcucgguguugcuugaugccauggagucuccccggaccccacccauguggaccguguucugaacgccgcaagcaucuguucguucaagacccccaaacauguaaguguucuugcaagaauaccgauucucgaugcaaggcacggcaacuggaguuaaacgaaagaacaugccguugcgacaaacccaggagauag

SEQ ID NO: 5418 - RNA, 984 nt, Artificial Sequence
  Description of Artificial Sequence: Synthetic coding sequence
cugacggaucggcagaccgacacagcuccaucaccuaguuaccauuuacugccagguagacggcgcacaguggacgcggcagcgucaaggggacaaggaccagaaccagcuccgggaggcgggguagaaggugugggcgcucguggcguggcucugaaacuguucgugcaacuguuagguuguucacguuuugguggcgccgucgucagagcaggcgaggccgaaccaaguggugccgcccguuccgcuucaagcggucgcgaggaaccacaaccagaagagggcgaagaggaggaggagaaagaggaggagagaggcccccaauggaggcuaggcgcccggaaaccuggaucguggaccggugaagcugcuguaugcgcagauucugcuccugcugcccgggcgccccaagcgcuugcuagagcuagcggaagaggaggcagggucgcccggagaggggccgaggaaagcgguccaccucacucacccucucgucgugggucugcaagccgugcuggaccaggucgugcgagugaaaccaugaauuuccugcugagcugggugcauuggucucucgcuuuguugcuguaucuccaucaugcgaaauggagccaagcagcccccauggccgagggcggcggccagaaucaccaugaaguuguuaaauuuauggacguauaccagcgaucuuauugucaccccauugaaacccucguggacaucuuccaagaauauccugaugaaaucgaauauauauuuaaaccaucuugugugccacuaaugagaugcgggggguguuguaaugacgagggccuggaaugcguucccacugaagaaagcaauauuaccaugcaaauaaugagaauuaaaccacaccagggucagcauaucggcgaaauguccuuccuccagcauaauaaaugcgagugccgcccaaaaaaggaccgggcccgacaagagaaaugugauaaaccaagacgauag

SEQ ID NO: 5419 - RNA, 1116 nt, Artificial Sequence
  Description of Artificial Sequence: Synthetic coding sequence
cucaccgauagacagacagacacugcgccaagcccauccuaccacuuacuuccagggaggaggaggaccguggaugcagccgcuuccagaggacaagggccggaacccgcuccaggcggcgguguugaggggguuggagcacgcggaguggcucucaagcuuuuuguacagcuguugggauguagucgauucggcggcgcggucgugagggcuggugaagcugaaccuucaggggcagcaagaagugcuuccagcggaagggaggagccacaacccgaggagggggaggaagaggaggaaaaagaagaggagcgcggaccacaguggaggcuuggcgcucggaagcccgguagcuggacaggggaagccgcuguaugcgccgauucagccccugcugcuagggcuccucaagcacuugcccgagcaagcggacggggaggaagaguggcccgcagaggagcggaagaaucaggaccaccucauagcccaagccgcagagguucugcaucaagagcuggaccgggcagagcuuccgaaacaaugaacuuucuccuguccuggguucacuggucacuagcucuccugcuguaucuacaucacgcaaaauggucacaggccgcccccauggcggaaggcggaggacagaaccaccacgaaguugucaaguucauggacgucuaucagagguccuauugucacccaauugagacucucguagauauauuucaagaauacccagaugaaaucgaauacaucuuuaagccuucuugcgucccucugaugaggugcggaggaugcuguaaugacgaggggcuggagugugugccgacugaggaaagcaauauuacgaugcaaauuaugagaauuaaaccacaccagggacagcacauuggagaaaugucuuuucugcagcauaauaaaugugaauguaggccgaagaaagaccgggcccggcaagagaacccauguggccccugcucagaaaggagaaagcaccuguucguccaagauccucagacaugcaaauguucaugcaaaaacacugacagcagaugcaaggcgagacaacuggagcugaaugaaagaacuugcaggugcgauaaacccagacgcuag

SEQ ID NO: 5420 - RNA, 444 nt, Artificial Sequence
  Description of Artificial Sequence: Synthetic coding sequence
augaacuuucuguugucuuggguccacuggucuuuagcgcugcuucuguaucuccaccaugcaaaguggucgcaggcugccccuauggccgagggugggggucagaaccaucacgagguuguuaaguucauggauguguaccagagaucguacugccauccuaucgaaacacugguggacauuuuucaggaguacccugaugagaucgaguacaucuuuaagccuaguuguguuccguugaugaggugcggaggaugcuguaacgaugagggacuggaaugcguaccuacugaagaauccaauauuacuaugcaaauaaugagaaucaaaccacaucagggccaacacauuggcgaaaugagcuuuuuacaacauaacaagugugagugcaggccuaagaaagacagggcucgccaggagaaaugugacaagccacgacgguag

SEQ ID NO: 5421 - RNA, 1170 nt, Artificial Sequence
  Description of Artificial Sequence: Synthetic coding sequence
cuaacugacagacaaaccgauaccgcuccaucaccaucuuaccaucuccugcccgggcggagacgaaccguggaugccgccgcuucuagaggacaggggccugagccugcaccaggaggcggaguagaagggguaggggcucgcggcguggcucugaaguuguuuguucagcuccugggaugcagccgguuugguggugccgucgugcgagcaggggaggccgaaccuaguggagcagcucggagcgcgaguaguggaagagaagaaccccaacccgaagagggagaagaggaggaggagaaagaggaggaacgcggcccucaguggaggcugggcgcccggaagccugggagcuggaccggcgaagcugcuguaugugccgauuccgccccagcagcuagagcuccccaggcccuggcaagggcuagcggaaggggcggcagaguagcccggagaggagcugaagaaucaggcccaccccauagcccaucacgaagaggauccgcaucacgggcaggucccggcagagcgucagagaccaugaauuuccuguuaucuuggguucacuggagcuuagccuugcuucuuuaucugcaccaugcuaaguggagccaggccgcaccaauggcugaaggcggaggccagaaucaccacgaaguagucaaauucauggacguguaucagcgcuccuacugccacccaaucgagacgcugguugacauauuucaagaguauccugaugaaaucgaguauaucuuuaaaccuuccuguguaccucugaugcgcugcggcggauguuguaaugaugaaggacuggagugcguuccuacagaggagucaaacauuacuaugcagauaaugaggauuaaaccccaccaaggacagcacauuggagaaaugucuuuuuuacaacacaauaaaugcgaauguagacccaagaaagauagagccagacaggaaaaaaaaagugucagagguaagggcaagggccaaaaaaggaagaggaaaaagucucgcccaugcggcccauguagcgagcguagaaagcacuuguucgugcaggacccacagacuuguaagugcucuugcaaaaauacagacucacguuguaaggcccgacagcuggaacuuaacgagcgcaccugucggugugacaagccccggagauag

SEQ ID NO: 5422 - RNA, 1065 nt, Artificial Sequence
  Description of Artificial Sequence: Synthetic coding sequence
cugaccgauaggcaaacagacacggccccuagcccauccuaucacuugcugccugggcgacggcgaacuguugacgcagcagccucaagaggccaaggacccgaaccugcgccuggaggaggagucgagggagugggggcccggggaguugcucugaaacuuuucgugcaguugcugggauguagccgauuuggcggagcugucgugcgcgcuggcgaggccgagccuaguggugcagcgaggucagcuaguuccgguagggaggaaccacaaccugaagagggagaagaggaagaggagaaagaagaagaacgcggcccacaguggcgccucggggcaaggaagccgggcagcuggacuggagaagcagcugugugugcagacucugccccugcugcacgggcgccacaagcucuggcccgcgcauccggacgaggcggaagaguugccaggaggggagcagaagaauccggcccuccccacaguccuucccgaagaggaagcgccagucgcgcaggaccugggcgagccuccgagacuaugaacuuccugcucagcuggguccacuggucauuagcuuugcugcuguaccugcaucacgccaaauggagccaagcagcaccuauggccgagggcggcggacaaaaucaucacgaaguuguaaaguuuauggauguauaucagagguccuauugccacccgauugaaacacuaguggauaucuuucaggaauacccugaugaaaucgaauacauauuuaaaccuuccuguguuccgcugaugcgcugcggcggauguuguaaugacgaaggauuagagugugucccuaccgaggaguccaauauaaccaugcagaucaugaggauaaagccccaccaagggcagcauaucggggaaaugagcuuccuccagcauaauaaaugugaaugcagaccaaagaaagacagggcgagacaggaaaauccaugcggccccugcagugaacgccgcaagcaucuauucgugcaggacccccagacguguaaauguagcuguaagaauaccgacucccgauguaaaauguag

SEQ ID NO: 5423 - RNA, 1188 nt, Artificial Sequence
  Description of Artificial Sequence: Synthetic coding sequence
cucaccgacagacagaccgacacagcaccgucaccaucuuaccaucugcugcccggucgcagaaggacaguggacgcagccgcaucuagagggcaagggccugaaccagcucccggaggggguguggagggcgugggcgcgcgaggcguggcucucaagcuguucguucaauuauugggauguagccgcuuugguggcgcagucguaagagcgggagaagccgagccuucgggcgccgcaagauccgccucaucagguagggaggagccgcaacccgaagagggagaagaagaggaagaaaaagaggaagaaagggggccucaauggagguugggggcccggaaacccggaucguggacuggggaggcagccgugugugcugacagugcgccugccgcuagggccccgcaagcacuagcuagagcgucaggcagaggcggccgcguagcuagacggggugccgaggagucuggaccuccccauagcccuucucgacgagguagcgccucacgagccgggcccggaagagcuucugaaacaaugaauuuucugcugucuuggguacauuggagcuuggccuugcugcuuuacuuacaccacgcuaaauggagucaggccgccccaauggcagaaggcggcggacagaaucaccaugagguaguuaaguucauggaugucuaucagaggagcuauugucaucccaucgagacccuggucgauauuuuucaagaauaccccgacgagaucgaauauauuuucaaaccuucaugcguuccccuuaugaggugcggagggugcuguaacgacgagggccucgagugcguuccgaccgaagaaagcaauaucaccaugcaaaucaugagaaucaaaccccaccaaggccaacauauaggagaaauguccuuccugcagcacaacaagugcgaauguagaccgaagaaggaccgggcgaggcaggaaaagaaauccgugagaggcaagggcaaaggacagaaaagaaagagaaaaaagagucgguauaaaucauggagcguaccgugcggaccuuguagcgagagaagaaagcaccuguucgugcaggacccacaaaccuguaaaugcuccugcaagaacacugacucccgcuguaaggcuagacagcuggaacuaaaugaaagaacaugucgcugugauaaaccaagaagauag

SEQ ID NO: 5424 - RNA, 414 nt, Artificial Sequence
  Description of Artificial Sequence: Synthetic coding sequence
augaauuuccuacuuaguuggguucauuggucccuggcguugcugcuguaucuacaucaugcuaaauggucucaggcugcacccauggccgaggguggaggacagaaccaucacgaagucgucaaguuuauggacgucuaccagaggaguuacugccaucccauugagacauuagucgauaucuuccaggaauauccugacgagaucgaauauaucuuuaaaccauccugcgucccacuuaugcgcugcggcggcuguuguaacgacgagggucucgaaugcguaccuaccgaggaaucuaauauuacuaugcagaucaugagaauuaagccucaucaaggucagcacaucggagagaugaguuuccugcagcauaacaaaugugaguguagaugcgacaagcccagaagauag

SEQ ID NO: 5425 - RNA, 1116 nt, Artificial Sequence
  Description of Artificial Sequence: Synthetic coding sequence
cucacggaccggcagaccgacacagcaccguccccgucauaccacuuacugcccggucggagaaggacaguagaugcagccgccagcagaggccaggggccagagccugcacccggaggcgguguagaaggggugggagccagaggggucgcuuugaagcucuuuguacagcuacuugguugcucgagauuuggaggcgcaguagugagagccggugaggcagaaccgucgggcgcugcaaggagcgcuuccagcggccgagaggagccccagccagaggagggugaggaagaggaagaaaaagaggaagagcgggggccacaguggcguuuaggggcucggaaacccgguucuuggaccggagaggcugcugugugugccgauuccgccccagcugcucgcgcuccacaagcccuugccagggcuuccggucgcggaggacgagucgccaggcggggagcugaagagucugggccaccccacucucccagccguagagguagcgccagucgagccggcccugggcgagccucugagacaaugaauuuucuccuuaguugggugcacuggucacuagcacuucuucuguaucugcaucacgcaaaauggagucaggcagcaccaauggccgaaggcggcggacaaaaccaccacgaaguagugaaauucauggacgucuaucagcgaucauauugccauccuauagaaacacuggucgacauuuuucaagaguauccggaugaaaucgaguauaucuucaagccauccugcgugccccugaugcggugcggcggcuguuguaacgacgaagguuuggaaugugugccuacagaagaguccaacauuaccaugcaaaucaugcgaaucaaaccucaucagggucagcauauuggagagaugagcuuccuccagcacaacaagugugaaugccgcccaaaaaaggaccgagcccgucaggaaaacccaugugggccaugcagugaacggagaaaacaccuuuuuguacaggacccucagacauguaaauguagcugcaagaacacggauucucgaugcaaagcacgccaacucgaguugaaugagagaacaugcaggucccugaccagaaaagacuag

SEQ ID NO: 5426 - RNA, 630 nt, Artificial Sequence
  Description of Artificial Sequence: Synthetic coding sequence
augaacuuucugcugagcugggugcacuggucacucgcccuucugcuguauuuacaucaugccaaauggucccaggcugccccaauggccgaagguggcgggcagaaucaccaugaaguaguuaaguuuauggacguuuaccagcgcagcuauugccacccuauugaaacucuggucgauaucuuccaggaguauccagaugagaucgaauacaucuucaagccuuccugcgucccacucaugagaugcggcggcuguugcaaugacgagggccuggagugcguaccuacugaagagucgaacauaacgaugcaaauuaugagaauaaaaccccaccagggccaacauaucggcgagaugaguuuucugcagcacaauaaaugcgagugccgaccuaagaaggaccgcgcuaggcaggaaaaaaaaucugucagaggcaaagguaaaggacaaaaacgcaagagaaagaagagcagaccgugcgggccguguagcgaaaggcgaaaacauuuguuuguucaggauccccagaccuguaaguguucuugcaaaaacacagauucacgauguaaggcucgccagcuggaacugaaugagagaacgugccguugugacaagccaagaagauag

SEQ ID NO: 5427 - RNA, 576 nt, Artificial Sequence
  Description of Artificial Sequence: Synthetic coding sequence
augaauuuuuuauuguccugggugcacuggucccuugcgcuucugcuguaucugcaucacgcaaaguggucucaggcggcaccuauggcggaggguggaggacagaaccaucaugaaguggucaaguucauggacguauaccaacgcuccuauugccauccaaucgaaacguugguugacauauuccaagaauaucccgaugagaucgaauacauauucaaaccuagcuguguuccauugaugagaugcggaggauguuguaacgaugaaggccuugaaugcgucccaaccgaagagucuaacauuaccaugcaaaucaugcgaaucaaaccacaucaaggacaacauauuggggaaaugagcuuccuucagcacaauaaaugcgaaugucgcccaaagaaggaucgggcucggcaggaaaacccuugcggaccaugcuccgaaaggcguaagcaucuuuuuguucaggauccacagacgugcaaguguuccuguaaaaacacagacagcagauguaaggcaagacaacuggagcugaacgaacgaaccugucggucucucaccagaaaggacuag

SEQ ID NO: 5428 - RNA, 972 nt, Artificial Sequence
  Description of Artificial Sequence: Synthetic coding sequence
uaacggggucagggaccggaaccugcuccuggcggaggaguugaaggagugggugcccggggaguggcuuuaaaacuguucgugcaguugcucggguguuccagauucggaggcgcgguggugagagcgggcgaagcagaaccuaguggcgcagcccggagugcuucuagcggccgugaggaaccacaaccagaggaaggcgaagaggaggaagaaaaggaggaagagagaggcccccaguggaggcuaggcgcacgcaaaccaggaaguuggaccggugaagccgccguuugcgcagacucggcuccugcugccagggcgccacaggcauuagcacgugcuucuggcagaggagggagggucgcacgcaggggcgccgaagagucuggaccaccccacucuccuucucgaagagguagugcgagccgggccggaccuggacgugccagcgaaacuaugaacuucuuacuuucuugggugcacuggagccuggcccuccugcucuaccuccaucacgcuaaguggucccaagccgcacccauggcggagggcggcggacagaaucaucacgaaguggucaaguuuauggacguguaucaacguagcuauugccacccaauagagacacuggucgauauuuuccaagaguacccugaugaaauugaauauaucuucaaaccaaguugugugccacucaugcgaugcgggggcuguuguaacgacgaggggcucgaguguguccccacagaagagucgaauaucaccaugcaaauuaugagaauuaagccucaccagggacaacacauuggugagaugucuuuucuucagcauaauaaaugugaaugucgcccuaaaaaagaccgagccaggcaggaaaagaagagcguacgaggcaagggaaaaggucaaaagaggaagcgcaaaaaaaguagguacaagaguuggagugugugugauaaaccacggcgauag

SEQ ID NO: 5429 - RNA, 648 nt, Artificial Sequence
  Description of Artificial Sequence: Synthetic coding sequence
augaacuuccugcuuagcuggguucacuggucccuugccuuauugcuuuaucugcaccaugcuaaguggucacaggcugcacccauggcugagggaggcgggcagaaucaccaugagguggugaaauuuauggacguguaucagcgauccuauugccacccuaucgaaacacuggucgauaucuuccaagaguaccccgaugaaaucgaauauauuuuuaaaccaucuugcgucccguuaaugcggugcgggggcugcugcaacgacgagggucuggaauguguuccuacagaagagaguaauaucaccaugcaaauuaugagaaucaaaccacaccaaggucagcacauuggcgagauguccuucuuacaacacaauaagugcgaaugucgccccaaaaaagaucgagcuaggcaggagaagaagagugucagagguaaaggaaagggucagaaaagaaaaagaaagaagucucgauauaaaaguuggucaguacccuguggcccauguucggagaggagaaagcaccuguucguccaggauccacagacauguaaguguagcugcaagaauacagacuccagaugcaaagcccggcagcuggaacucaaugagcgaacauguaggugcgacaaaccgcguagauag

SEQ ID NO: 5430 - RNA, 525 nt, Artificial Sequence
  Description of Artificial Sequence: Synthetic coding sequence
augaauuuucuccugaguuggguucauuggucgcucgcacugcuuuuauacuuacaucaugcaaaguggucgcaggcugcuccaauggccgagggggguggacagaaccaucaugaaguggucaaguucauggauguguaucagcgcuccuauugucauccuauugaaacucugguagacauauuccaggaauaccccgaugagaucgaguauaucuuuaaaccaagcuguguuccgcugaugagaugugguggcugcugcaacgaugaaggauuggaauguguaccuacugaagagucaaauaucacuaugcagaucaugcgaauuaaaccucaccaggggcagcacauuggcgagaugucauuucugcagcacaauaaaugcgagugucggccaaaaaaagacagagccagacaggaaaauccuugcggcccguguucugaacggcgcaaacaccucuucguccaagauccccagaccugcaaauguagcuguaaaaacacggauucacgaugcaaaauguag

SEQ ID NO: 5431 - RNA, 699 nt, Artificial Sequence
  Description of Artificial Sequence: Synthetic coding sequence
augaacuuccuguugaguugggugcauuggagccuggcucugcuuuuguaccugcaucaugcgaaauggucacaggcggcgccuauggcagaagggggagggcagaaucaccacgaaguagucaaauuuauggacguuuaucagagaucauacugucacccuauugagacacuuguggauaucuuucaggaguaucccgacgaaaucgaguacauauucaaaccuucuugugucccacugaugagaugugggggguguuguaacgaugagggccuggagugcgugccaaccgaagaguccaauauuacaaugcagauaaugagaaucaaaccccaccagggucaacauauuggcgaaaugucuuuucuccaacacaauaaaugcgaaugcaggccuaagaaagauagggcgcgccaagaaaaaaagucagucagaggaaagggaaaagggcagaagagaaagagaaagaaaagccguuacaaaucuuggagugucuacgugggggcgcggugcugccuuaugccauggagccucccuggaccucaucccugcggucccuguagcgaaagacgcaagcaccuguuuguucaggacccccaaacauguaaauguagcugcaaaaacaccgauucacgauguaaagcgagacaacuugaacugaacgagagaacguguagaugugacaaaccuaggagauag

SEQ ID NO: 5432 - RNA, 576 nt, Artificial Sequence
  Description of Artificial Sequence: Synthetic coding sequence
augaacuuucucuuaagcugggugcacuggagccuggcccuccuccuguaucuacaucacgcuaaauggagucaagcugcuccgauggccgagggcggcggacagaaucaucacgaaguggucaaguucauggacgucuaccagcgcucuuacugucacccaaucgagacacuuguugacaucuuucaggaauauccagaugaaauugaauauauauuuaagccaaguugcgugccauugaugcgguguggaggcugcuguaaugacgagggguuggaaugcgugccaacugaagaguccaauauuacaaugcagaucaugcgcauaaagccccaucagggucaacacauuggagagaugaguuuccugcagcacaacaaaugcgagugccggcccaagaaagauagagcuaggcaggagaacccaugcggcccuugcuccgaaagaaggaagcaccuguucguccaggauccacagacuugcaaaugcucuugcaaaaauacagacagucgauguaaagcgaggcaacuugaacugaacgaacggaccugucgaugcgacaaacccagaagauag

SEQ ID NO: 5433 - DNA, 1179 bp, Artificial Sequence
  Description of Artificial Sequence: Synthetic coding sequence
atgaccacgtactctgataagggggcaaaacctgagcgggggcggttcctccatttccactctgtgactttttgggttggtaacgcaaagcaggccgctagcttctattgttcaaaaatgggtttcgaacccctcgcctatcggggtctggaaacgggctcccgggaggttgtctcccacgtcataaagcaggggaagattgtctttgtgttatcaagcgccttaaatccttggaacaaggagatgggtgatcacctcgtaaagcacggggatggagttaaggatattgcgttcgaggtcgaagactgcgactacatcgtgcaaaaggcacgggagagaggggccaagatcatgagagagccgtgggtcgaacaggacaagtttggcaaggtgaaattcgctgtgttgcagacgtatggtgacactacccatacccttgtcgagaagatgaactatatcgggcagtttctcccaggatacgaagcacccgccttcatggacccgctgctgccaaaactgcccaagtgcagcttggagatgatcgatcacatcgtgggcaatcaaccagaccaggagatggtgagtgccagcgagtggtacttgaagaacctgcagttccataggttctggtccgtggatgacacccaggtgcatactgaatatagttctcttaggtcaatcgtggtggccaactatgaggagtccattaagatgcccatcaatgaacctgcccccggaaaaaagaagagccaaatacaagagtacgtcgactacaatggtggcgcaggagttcagcatatagcgcttaagaccgaggatatcattaccgccatccggcacctgagagaacgcggccttgaattcttatctgttccttctacctactacaaacagttacgcgagaagctcaagaccgctaaaataaaggtgaaggagaacatcgacgccctggaagaactcaagattctcgtcgattacgacgaaaaggggtaccttctgcagattttcactaagcccgttcaggatcgtcctactctgttcctcgaagtcatacagcggcataaccatcaggggtttggagctggaaacttcaacagtttattcaaagcgttcgaagaagagcaaaacctgaggggcaatcttactaacatggaaactaatggagtggtcccaggtatg

SEQ ID NO: 5434 - DNA, 1179 bp, Artificial Sequence
  Description of Artificial Sequence: Synthetic coding sequence
atgacgacttattccgataaaggcgccaaacctgagagaggtcggttcctgcactttcacagcgtgactttctgggtcgggaatgctaagcaggccgcaagcttctattgttctaaaatggggttcgaacccttggcatataggggtctggaaacaggttctcgcgaggtggtttcccacgtcattaagcaagggaaaatcgttttcgtcctgagtagcgcccttaacccctggaataaagagatgggcgatcacctggtcaagcacggagatggcgtcaaggacattgctttcgaagtggaagactgtgattacatagtacagaaggcccgcgaacgtggcgcaaaaatcatgagagagccgtgggtggaacaggacaagtttggaaaagtgaagttcgcggttctacagacctatggcgacaccacacatactctggtggagaagatgaactacattgggcagtttttgccgggatatgaggcaccggcttttatggatccattattgcccaagctgcctaaatgctcactggaaatgattgatcacattgtggggaatcaacccgatcaggagatggtgtcagcctctgaatggtacttgaagaatctccagttccataggttttggtccgtcgacgatacacaggttcacaccgagtactcctccctccggagtattgtggtggccaactacgaagaatcaatcaagatgcctatcaacgaaccagcgcccggaaaaaagaagagccagattcaggagtacgtggattacaatggaggtgcaggagtacagcacatagccctcaaaactgaggatattataaccgccatacggcacctgcgtgaacgcggcctagaatttctgtcggtgccgtctacttactataagcaacttagggagaaactgaaaacagcaaagattaaggtgaaagagaatatcgacgctttagaggagttgaagatcctggttgactacgatgagaagggctacctcttacagatattcactaagcccgtacaggatcgccccacactctttctggaggttattcaaagacataatcatcagggctttggcgcaggcaactttaatagtctgtttaaggccttcgaagaggaacagaatcttcggggcaacctgacaaatatggagactaacggcgtcgtgcccggaatg

SEQ ID NO: 5435 - DNA, 1179 bp, Artificial Sequence
  Description of Artificial Sequence: Synthetic coding sequence
atgaccacctactccgataagggcgcaaagccagagcgaggacgcttcttgcatttccattcagttactttttgggtggggaacgctaaacaggccgcttcgttctactgcagcaaaatgggcttcgaacctctggcatatcgcggccttgaaaccgggagcagagaagtggtgtcacacgtcatcaagcaaggaaagatcgtgttcgtcctcagctctgctcttaatccctggaataaggagatgggagatcacctggtcaagcacggcgacggagtgaaagatatcgctttcgaggtggaggactgcgactacattgtgcagaaagcgagagagcgcggtgccaagattatgagggagccatgggtcgaacaggacaaattcggaaaggtcaagttcgccgtgctgcagacttacggcgatactacccataccctcgtcgaaaagatgaactacatcggacaattcctgcctggatacgaggcccctgcctttatggaccctctgctgcctaagctgccgaagtgttcacttgaaatgattgatcatatcgtagggaatcagccggatcaggaaatggtgtccgcctcagaatggtacctgaaaaacctgcagttccaccggttttggagcgtggatgatacccaggtccacactgagtactcgtcgcttagaagcatcgtcgtggcaaattacgaagaatcaatcaagatgccaatcaacgagcctgctcccggtaaaaagaagtcgcagatccaggaatatgtcgattacaacggaggagcgggagtgcagcatatcgccctgaaaaccgaggacataatcacggccatccgccacctgcgggagcgggggttggaattcctgagcgtgccatccacttactacaagcagctgcgggaaaagctcaagactgccaagatcaaggtgaaagagaacattgatgccctggaagagttgaagatactggtcgattacgacgagaagggatacctgctgcagatcttcactaagcctgtgcaggacagaccaacccttttcctcgaagtgatccagcgccataatcaccagggatttggagcgggaaatttcaactcactgttcaaggcttttgaggaagaacagaatctccggggaaacctgaccaatatggaaaccaacggagtggtgccgggcatg

SEQ ID NO: 5436 - DNA, 1179 bp, Artificial Sequence
  Description of Artificial Sequence: Synthetic coding sequence
atgaccacctacagtgacaagggtgccaaaccggagagaggcaggttcctccactttcactctgtgaccttttgggtggggaacgccaagcaggctgctagcttttattgctccaagatgggatttgagccattagcgtatcgcggcctggaaaccgggagcagagaggtggtttcacacgtcatcaagcaaggcaaaatagtcttcgtcctctccagcgcacttaacccctggaacaaggaaatgggggatcacctggtgaagcatggcgacggagtcaaggatatagcctttgaggttgaagattgtgattacattgtgcagaaagcaagggagagaggcgcaaagatcatgcgggagccttgggtcgagcaggacaagttcggcaaagttaagtttgccgtccttcaaacatatggcgacacaactcacaccctggtggagaaaatgaactatatcggacaattcctacctggatatgaggcgccagccttcatggatccgctcttacccaaactgcctaagtgcagcttagaaatgatcgaccacattgtcggaaatcagcctgaccaggaaatggtttccgctagtgaatggtacctcaaaaacctgcagtttcatcgtttctggtctgtggacgatacccaagttcatacggagtatagctcattgaggagtattgtggtggccaactatgaggaaagcatcaaaatgccaatcaacgagcccgcacctggcaaaaaaaagagccagatccaggagtacgtggattacaacggaggcgcaggagtgcagcacattgctctcaagacagaagatatcataaccgcaataagacacctgagagaaaggggcctggagttcttgtctgtgcctagcacatactataagcaactcagggagaaactgaagaccgctaagatcaaggtgaaggaaaacatcgacgctttagaggaacttaaaattctcgttgactacgatgaaaagggctatttgctgcagatctttacaaagcctgtccaggatagacctacactgttccttgaagtgatccagaggcataaccaccagggatttggcgcgggcaacttcaatagcctgtttaaagccttcgaggaggagcaaaaccttcgcggaaacctgaccaacatggaaacaaacggcgtcgtgcccggcatg

SEQ ID NO: 5437 - DNA, 1179 bp, Artificial Sequence
  Description of Artificial Sequence: Synthetic coding sequence
atgaccacttattcagataaaggagcaaagccggagagagggagattcctgcacttccactcagtgaccttctgggtgggaaatgcgaagcaagccgcgtccttctattgctcaaagatgggatttgaaccgctggcctaccgcggactggagactggttcgagggaggtcgtgtcgcacgtcatcaagcagggtaagatcgtgttcgtcctcagctcggccctgaatccgtggaacaaagagatgggggatcatcttgtgaagcacggagacggagtcaaggacatcgcattcgaggtggaggactgtgactacatcgtgcagaaagcaagggagcggggtgcaaaaatcatgcgggaaccttgggtcgagcaagacaagttcggcaaggtcaagtttgcagtgttgcaaacctacggcgatactacccacacgcttgtggagaagatgaattacatcggacagttcctcccgggatacgaagcaccggccttcatggatcccctgctgccaaagctcccgaagtgcagccttgagatgatcgaccacatcgtgggaaaccaaccagatcaggagatggtgtctgcctcagaatggtacttgaaaaacctccagttccatcgcttctggtcggttgacgacacgcaagtgcacacggagtacagctcgctgcgcagcatcgtggtcgcgaattacgaggagtcaattaagatgcccatcaacgaaccggctccaggcaaaaagaagtcacagatccaggaatacgtcgactacaacggaggcgccggtgtccagcatatcgctctgaaaaccgaagatatcatcacggctatccggcatctgcgcgaaagaggtctggaattcctttcggtcccctcaacttactacaagcagctgcgagaaaaacttaagacggcaaagattaaggttaaggaaaacatcgacgctctcgaagaactcaaaattctggtggattacgatgaaaagggataccttctgcagattttcaccaaaccagttcaagatagacctaccctgttcttggaagtcatccaacgccataatcaccagggctttggagccggcaactttaactccctcttcaaggcgtttgaagaggagcaaaacctgcgcgggaacctcactaacatggaaacgaacggagtggtgccaggcatg

SEQ ID NO: 5438 - DNA, 1179 bp, Artificial Sequence
  Description of Artificial Sequence: Synthetic coding sequence
atgactacctattcggacaagggggcaaagccagaaagggggcgctttttgcattttcactccgtgactttttgggtcggtaatgcaaagcaagccgcatccttttactgctccaagatgggttttgagccccttgcgtacaggggtcttgaaactggaagccgtgaggtggtcagccacgtgattaagcagggtaagattgtgttcgtgctgagctccgcccttaacccttggaataaggagatgggcgatcacctggtgaagcatggagatggagtcaaggatattgcatttgaagtggaagattgtgattacattgtccagaaggcgcgtgaaagaggtgcgaagatcatgagagaaccttgggtggaacaagacaagtttggaaaggtcaaatttgcggtgctgcaaacctacggtgataccactcatacccttgtggaaaagatgaattacattggacagtttctgcctggctacgaagcacccgctttcatggatcccctgctgccaaagctcccgaagtgcagccttgaaatgatagatcatattgtgggaaatcaaccagatcaggaaatggtgtcagcttcggaatggtacctgaaaaacctgcaattccataggttctggagcgtggatgatactcaagtgcataccgaatactcgtcgcttcgttccatagtggtggcgaactatgaagaatcaatcaagatgccaatcaacgagccagcacccggaaagaagaagtcacagattcaagaatacgtcgactacaacggaggtgcaggagtgcaacatattgcactcaagactgaggatatcatcaccgccataaggcacttgagagaacgcggactggagttcctgtccgtgccctcgacttactacaagcagctgagagaaaaacttaaaaccgcaaagatcaaggtgaaggagaatatagatgcacttgaggaactgaagattctggttgattacgacgaaaaggggtatcttctgcaaatcttcactaaacccgtccaagatagacccaccctgtttcttgaagtgattcagcgacataatcatcaaggcttcggtgccggaaatttcaactccctgttcaaagcattcgaggaggagcagaacctccggggaaacttgaccaacatggaaactaacggtgtcgtccctgggatg

SEQ ID NO: 5439 - DNA, 1179 bp, Artificial Sequence
  Description of Artificial Sequence: Synthetic coding sequence
atgaccacgtactccgataagggagcaaaaccagagagggggcgcttccttcactttcattcagtgaccttctgggtgggaaacgcaaagcaagcagcatcgttctattgcagcaagatgggctttgaaccactcgcgtacaggggtttggagactggttcacgggaagtcgtgtcgcatgtgataaagcagggtaaaatcgtctttgtgctttcctcagcattgaacccttggaataaagagatgggtgaccacctcgtgaagcatggtgatggtgtgaaggatattgcatttgaagtcgaggactgtgattacatcgtgcagaaggcaagagagcgcggggcgaagattatgagagaaccatgggtcgagcaggacaagtttggaaaggtgaagtttgcagtccttcaaacttacggggatactactcataccctcgtggaaaagatgaactacattggtcaatttctgcccgggtacgaagcacctgcatttatggatccactgctcccgaagctgcctaagtgctctctggaaatgatagaccatattgttggtaaccagccagatcaagagatggtgtcggcttccgagtggtacttgaagaatttgcaattccatcgattttggagcgtggatgatactcaagtccataccgaatactcatcgctgagatccattgtggtggcaaactacgaagagagcatcaagatgcctataaacgaacccgctcctggaaagaagaagtcacaaatacaggaatacgtggactacaatggaggtgcaggcgtgcaacacattgcacttaaaacggaagatatcatcacggcaatacggcatcttagggagcggggactggagtttttgagcgtgccatcgacctactacaagcagctgcgggaaaaactgaaaaccgccaagatcaaggtgaaggaaaacatcgatgctctggaggaactgaagattcttgtcgactacgatgaaaagggatatctgctgcagatattcacgaaacccgtccaggatagaccaaccctgttccttgaggtcattcagaggcacaatcatcagggattcggagcaggtaacttcaactcgcttttcaaggctttcgaagaggaacaaaatcttagagggaatcttactaatatggaaaccaacggtgtagtgccaggaatg

SEQ ID NO: 5440 - DNA, 1179 bp, Artificial Sequence
  Description of Artificial Sequence: Synthetic coding sequence
atgacaacttattctgataaaggggcaaagcctgaacgcggacgcttcctccattttcactcagtcacattttgggtggggaacgccaaacaggccgctagtttctattgttccaaaatggggttcgaaccattagcctaccgcgggctcgaaacagggtcaagggaggtcgtctcccatgtaatcaaacaggggaaaatcgtatttgtccttagttctgcacttaatccttggaacaaagagatgggggatcatctcgtcaaacatggggacggagtgaaggacatagcatttgaggttgaagattgtgattacatcgttcagaaagctcgcgaacgaggggccaaaattatgcgagaaccctgggtggaacaggacaaatttgggaaggtcaaattcgccgtcctccagacgtatggggacacaacacatacattggtggaaaagatgaattatattggacagttccttccaggatatgaggctccagctttcatggatcccctactgccaaaactccccaaatgttctcttgaaatgatcgatcatatcgtggggaaccagccagatcaggaaatggtgtcagctagtgagtggtatctcaagaatctccagttccacagattctggtctgtggatgacacacaggtccatactgaatacagttccctgcggtctatcgtagtggcaaattatgaagaatccattaaaatgcctattaacgaaccagcacccggaaaaaaaaaatcccagatccaggagtatgtcgattataacggaggggcaggagtccagcacatagcacttaaaacagaagatatcatcactgcaataagacaccttagagaacgaggacttgaattcctctctgtaccctccacttattataaacaactcagggaaaaactcaaaacagccaagatcaaggttaaagagaatatagatgccctagaagaactcaaaattctagtcgactatgatgaaaaaggatatctgttacagatatttacaaaacctgtgcaagatcggcctacactttttttggaggtaatacagcgtcataaccaccagggatttggagcagggaattttaatagtctgtttaaggcttttgaagaagaacagaacctccgcggaaacctcacaaacatggaaactaatggagtcgtcccagggatg

SEQ ID NO: 5441 - DNA, 1179 bp, Artificial Sequence
  Description of Artificial Sequence: Synthetic coding sequence
atgactacgtattctgacaagggcgccaaacctgaaaggggaaggtttttgcacttccattccgtcactttttgggtgggtaatgctaagcaggcggcctcattctattgttcaaaaatgggctttgagcctctggcatacagaggtctggaaacgggaagtcgagaagtagtctctcacgtaatcaaacaggggaaaattgtgttcgtcctcagctctgctcttaatccttggaataaggaaatgggcgatcacctggtgaaacatggtgacggggtcaaggatatcgcttttgaggttgaggattgtgactatattgtgcagaaagcacgggaaaggggcgccaaaattatgcgtgaaccgtgggtcgagcaagataagttcggcaaggtgaagtttgcagtcctgcagacctacggtgacaccacccacactcttgttgaaaaaatgaactatatagggcaattcttacccggctacgaagcccccgcctttatggatcccctgcttccaaagctgcctaaatgctctcttgagatgattgaccacatagtgggtaaccagccagaccaggagatggtcagcgcgtccgaatggtaccttaagaacctccaatttcatcgattttggtctgtggacgatacacaggtgcacacagaatatagttccctgcgctcaatcgtagtggccaattacgaggagtcaattaagatgccaattaatgaaccagcaccaggaaagaaaaagtctcagattcaggaatacgtggactataatggcggagcaggagtgcagcatattgccctgaagacagaagacatcatcaccgcgatcaggcatctacgagagagaggtctggaattcttgtcagtgccatccacctattacaagcagttaagagaaaagttaaagaccgctaagattaaggtgaaggaaaatatcgatgcactggaagagctcaaaatcctagtggattatgacgaaaagggctacctcttgcagatcttcaccaagcccgttcaggatcgaccgactttattccttgaggttatccaacgccacaatcaccagggctttggagccggaaacttcaattctctgttcaaagcatttgaggaggagcagaatctccggggcaatctgacaaacatggagactaacggggtcgttcccgggatg

SEQ ID NO: 5442 - DNA, 1179 bp, Artificial Sequence
  Description of Artificial Sequence: Synthetic coding sequence
atgaccacttactcagataaaggagccaaacctgaaaggggaagattccttcactttcactcagttactttttgggtcggaaacgcgaagcaggccgcatccttttactgctctaaaatggggtttgaacctctcgcctatcgaggtcttgagactgggagtcgggaggtcgtctcacatgttatcaagcaaggcaaaattgtcttcgttctaagcagtgctctgaacccttggaataaagagatgggggatcatttggtgaagcacggtgacggggtgaaagatatcgcttttgaagtcgaagattgtgactacattgtgcagaaggcccgggagcgcggagctaagataatgcgagaaccatgggtggagcaggacaagtttggcaaagtcaagttcgcggtgttacagacttacggggatacgacccacacactggtagagaaaatgaactatatcggtcagttccttcctgggtacgaggccccggctttcatggatccgctactgcccaagctgccaaagtgtagtctggaaatgatcgatcatattgttggaaatcagccagatcaagagatggttagcgcaagtgagtggtacctcaagaacctgcagttccatcgcttctggtccgtggacgacacccaggtgcatacagagtactcttctctgaggtccatagtcgttgctaactacgaggagtctatcaaaatgcccattaacgaaccagcccccggcaagaaaaaaagccagatccaggagtacgtcgattacaacggaggcgcaggtgtccagcatattgctctgaagacagaggatattattaccgccatcaggcacctgcgagagcgtggcctcgagttcctatccgtgccatctacctactacaagcaactgagagagaagctgaagaccgcgaaaatcaaggtcaaggagaatattgatgcccttgaagagctcaagattcttgtggactatgatgagaagggctatctcctgcagatattcacaaagccggtccaggatcgccccaccctatttcttgaagtgattcagaggcacaatcaccagggcttcggagcaggcaactttaactctctcttcaaggcattcgaggaggaacagaacttgcggggcaatctgaccaacatggaaacaaatggggtggtgcccgggatg

SEQ ID NO: 5443 - DNA, 1179 bp, Artificial Sequence
  Description of Artificial Sequence: Synthetic coding sequence
atgactacttactccgacaagggcgccaagccggagcggggccggttccttcattttcacagcgtcaccttctgggtgggcaacgcaaaacaggccgcttccttctactgctccaagatgggattcgaaccgctggcgtatagaggacttgaaaccggatccagggaggtcgtgtcccacgtgatcaagcagggtaagatcgtctttgtcctcagttcagctctcaatccttggaacaaggagatgggtgaccacctggtcaagcacggcgatggtgtcaaagacatcgcctttgaagtggaagattgcgactacattgtgcagaaagcgcgcgagcgcggtgcaaagatcatgcgcgaaccgtgggtggaacaggacaaattcggaaaggtgaaattcgcggtcctccaaacctacggcgacactacccacaccttggtggaaaagatgaactacatcggccagttccttccggggtacgaggcgccggccttcatggatcccctcctgccaaagttgccaaaatgttcgctggaaatgatcgaccacatcgtgggaaaccagcccgaccaagagatggtttcagcctcagaatggtacctgaagaacctgcaattccatcgcttctggtctgtggacgatacccaagtgcatactgagtactcgagcttgagatcgatcgtggtggcaaattacgaggagtcaatcaagatgccaattaacgaaccagcccctggaaagaagaaatcgcagatccaggagtacgtggattacaatggaggggctggagtgcaacatattgcgctgaaaaccgaagatatcatcacggccatccggcacctccgggaacgaggactggaattcctgtcggtgcctagcacttactacaagcaactgcgcgaaaagctcaaaaccgccaagatcaaggttaaagaaaacattgatgccctggaggaactgaagatcctcgtcgactatgacgagaagggatacctgctgcagatattcactaagcccgtacaggatcggccgaccctgtttctggaagtgatccagagacataaccaccaaggattcggggcaggaaatttcaatagcctctttaaggcttttgaggaggaacagaacttgaggggaaatctcacgaacatggagactaacggcgtcgtgccggggatg

SEQ ID NO: 5444 - DNA, 1179 bp, Artificial Sequence; identical to SEQ ID NO: 5441
  Description of Artificial Sequence: Synthetic coding sequence

SEQ ID NO: 5445 - DNA, 1179 bp, Artificial Sequence
  Description of Artificial Sequence: Synthetic coding sequence
atgaccacatacagcgacaagggggctaagccggagagggggcggttccttcactttcatagcgtcacgttctgggttgggaatgccaagcaggcggcttcgttttactgcagtaagatggggtttgaacccctcgcctaccgaggcttggagacaggatcccgggaagtggtgtcacatgtgattaagcagggcaagatcgtctttgtgctttccagcgccctgaacccatggaataaagagatgggagaccacctggtgaagcacggggacggcgttaaggacatagcctttgaggttgaggactgcgactatatcgtgcaaaaggcgagggagaggggggcaaagatcatgcgggagccctgggtggagcaggacaagtttgggaaagtgaagttcgctgtgctacagacttacggcgatacaacccataccctggtagagaaaatgaactatattggacaatttttacccggatatgaagctcccgccttcatggaccccctccttcccaaacttccaaaatgctcactagagatgattgatcatattgttggtaatcagcctgaccaagagatggtatctgcaagtgaatggtatctgaaaaatctgcagttccatcggttttggtcagtcgatgacacccaggtacacaccgaatactccagtctccggagcattgtggtggccaactacgaggaatctatcaaaatgcctataaacgagccggctcctggcaaaaagaagagccaaatacaggagtacgtggactataacgggggagcgggggtacagcacattgctttaaaaaccgaggatatcatcacagccattaggcacctgcgggagagaggccttgaatttctctctgttcccagtacctactataaacaactgcgggagaaactgaaaactgccaaaattaaggtgaaggagaacatcgacgcactggaagaacttaaaatcctggttgattatgacgaaaagggctatttgcttcagatcttcactaagcccgttcaggatcgcccaacactgtttttggaggtgatccagagacataaccatcaaggctttggagctggaaattttaacagccttttcaaggcctttgaggaggagcagaacctgaggggcaacctgacgaacatggagacaaacggggtcgtgccagggatg

SEQ ID NO: 5446 - DNA, 1179 bp, Artificial Sequence
  Description of Artificial Sequence: Synthetic coding sequence
atgacaacctatagcgacaaaggcgcgaagcccgagagggggaggttcctccatttccatagcgtgacattttgggtcggtaacgcgaagcaggcggccagcttctactgttcaaagatgggtttcgagcccctggcctaccgggggctggagacaggttcaagagaagtggttagccatgtcatcaaacagggaaaaatcgtgttcgtattgagtagcgctctcaatccatggaacaaagaaatgggcgaccacctcgtcaagcacggagatggagtgaaggatatagcttttgaggttgaagattgtgattacatcgtgcagaaggcaagagaacgaggggcaaaaattatgagggaaccttgggtggagcaggataaattcggaaaggtgaagtttgcggtgctccagacatatggagatacaacccatactctggtggagaagatgaattacatcggacagtttttgcccggctacgaggcacctgccttcatggacccactgttgccaaaactgcccaaatgcagtctggagatgatcgaccatattgtgggtaaccaacctgaccaggagatggttagcgccagcgaatggtatcttaagaatctccagttccataggttttggagcgtcgacgacacacaggtgcacaccgagtattctagtctgaggtctattgttgttgccaactatgaggagagcattaaaatgcctatcaacgagccagcgcctgggaagaagaagagccaaatccaggagtacgtagactacaatggcggggccggagtccagcacatcgccctgaagaccgaagatatcatcacagcaatacgccatctgcgggagaggggtctggagtttctctccgtccccagcacatactataagcagctccgcgagaaattgaagaccgctaagatcaaagtgaaggagaacatcgacgccctggaggaattgaaaattctggtcgattacgacgaaaaggggtacttgctgcaaatatttaccaaaccagttcaggaccgcccaaccctgttcctcgaagtgattcagcggcataaccaccaagggtttggcgccggtaacttcaactcattgttcaaggccttcgaggaggagcagaatctgcgggggaatttgacgaacatggagacaaacggcgtcgtacccggtatg

SEQ ID NO: 5447 - DNA, 1179 bp, Artificial Sequence
  Description of Artificial Sequence: Synthetic coding sequence
atgaccacctactcggataagggagcaaagccagagagaggtcgctttctgcattttcactccgtcaccttttgggtcggaaatgcaaagcaggccgcatcgttctactgctcgaaaatgggctttgaacctctggcgtacaggggactggagactggcagccgggaggtcgtgtcgcacgtcattaagcaaggaaagattgtgttcgtgctttcctcggccctcaacccctggaataaggaaatgggtgaccaccttgtgaagcacggggatggggtgaaggatattgcatttgaggtggaggattgtgactacatcgtgcagaaggcgagagaacgcggggccaagattatgagagaaccttgggtggaacaagacaagtttggcaaagtgaagtttgctgtgctgcaaacttatggcgatactactcacactcttgtggagaagatgaattacatcggtcagttcctgcctggctacgaagcacccgcctttatggatccactccttcccaagctccctaaatgttccctcgaaatgatagaccatatagtgggaaaccagccagaccaggagatggtgagcgcaagcgaatggtatctgaaaaatctgcagttccaccgcttttggtccgtggacgatacccaagtgcacaccgaatactcaagcctccgatccattgtcgtggcaaactacgaagaaagcattaagatgcctatcaacgagccggccccagggaagaagaaatctcaaattcaagaatacgtggattacaacggaggcgctggggtgcaacatattgcactcaagaccgaggatatcatcaccgccattcgccacctcagggaaagaggattggaatttctgtctgtcccctcgacctactacaaacagcttagagaaaagctgaaaacggcaaagatcaaggtcaaggagaatatcgacgcactcgaagaactcaagatcctggtcgattatgatgagaagggttacctgctgcagattttcactaagcctgtccaagatcgaccaacgctgtttcttgaagtcattcagagacataaccatcaaggcttcggtgccggaaacttcaacagcctctttaaggcattcgaggaggaacagaaccttcgtggcaatctcaccaatatggaaactaacggtgtcgtgccaggaatg

SEQ ID NO: 5448 - DNA, 1179 bp, Artificial Sequence
  Description of Artificial Sequence: Synthetic coding sequence
atgactacctactcagataagggggctaagcccgaacgaggaagatttctgcattttcactccgtgaccttctgggtgggaaatgccaagcaggcagcatcgttttactgttccaagatggggtttgaacctttggcttacaggggtcttgagacgggatcgcgcgaggtggtgtcgcatgtcatcaaacaaggtaagatcgtgtttgtgttgagcagtgcacttaatccttggaacaaggaaatgggcgaccatctcgtcaaacatggcgacggtgtgaaggacattgctttcgaggtcgaagattgcgactacattgtgcagaaagcccgagaaaggggagcaaagatcatgcgcgaaccctgggtcgagcaggataagttcggtaaggtgaagtttgctgttctgcagacttacggtgacaccactcatactcttgtcgagaagatgaactacattggtcaatttcttccaggttacgaggcccctgcattcatggatcctcttcttcctaagctccctaagtgttcgcttgagatgattgaccacattgtcggcaatcagcctgatcaagaaatggtgagcgcctcggaatggtatttgaaaaatctgcagtttcatcggttttggtccgtggatgatacccaagtgcacactgaatactcatcccttagatctatcgtcgttgccaactatgaggaatccataaagatgcccattaatgaacctgcaccagggaagaagaagtcacaaatccaagaatacgttgattacaacggcggcgcaggtgtccaacacatagcgttgaaaaccgaggatatcattactgctattagacatttgcgggagagaggcctggagttcctgtcggttcccagcacttattacaagcaactccgcgaaaagctgaaaacggcgaaaatcaaggtgaaagagaacatagatgccctggaggaactgaagattctcgtcgattacgacgaaaaaggatacctcttgcaaatctttaccaagccagtgcaggatcggcccaccctcttcctcgaggtgatccagaggcacaaccaccagggttttggagcaggcaactttaactcattgtttaaggccttcgaagaagagcaaaacttgcgggggaatcttaccaacatggaaacgaatggagtggtgccagggatg

SEQ ID NO: 5449 - DNA, 1179 bp, Artificial Sequence
  Description of Artificial Sequence: Synthetic coding sequence
atgaccacctactcagacaagggcgcaaaaccagaacgcggccggttcctccacttccattcagtcaccttttgggtgggcaacgccaagcaggcggcctcgttctactgctcgaagatgggcttcgaaccactcgcctaccggggtcttgaaactggatctcgcgaagtcgtctcccatgtcatcaagcaaggaaagattgtctttgtgttgtcgagcgccctgaatccgtggaacaaagaaatgggcgatcatctggtgaagcacggcgacggagtgaaagatattgcattcgaagtggaagattgcgactatatcgtgcaaaaggcacgggagcggggtgccaagatcatgcgcgaaccctgggtcgagcaggacaaatttggaaaggtgaagttcgctgtgctgcagacttatggtgataccacccatactctggtggaaaagatgaactacattggtcagtttttgccaggatacgaagccccggccttcatggaccctctgttgccgaagctgccgaagtgctcgctggaaatgatcgaccacatcgtgggaaaccagcctgaccaggaaatggtgagcgcgtccgaatggtacctcaagaacctgcagttccaccgcttctggtcagtcgatgacacccaagtccacaccgaatacagctcgctgcggagcatcgtggtcgctaattacgaggagtcaattaagatgccgatcaacgaaccggcgccgggaaagaagaagtcccaaatccaggagtacgtcgactacaatggcggagctggcgtgcagcacatcgccctgaaaaccgaggacattatcactgcaatcaggcacctccgggagcggggactcgagttcctttcggtgccctccacctactacaaacaactcagggagaaacttaagactgctaagatcaaggtgaaggagaatatcgatgcgctggaggagctcaaaattctggtcgattacgacgaaaaaggatacctgctgcaaatctttactaagccggtgcaagatcggccaactctgttccttgaggttatccaaaggcataaccatcagggtttcggtgccggcaatttcaactcactcttcaaggcgttcgaggaagagcaaaacctgcgaggcaatcttactaatatggaaacgaacggcgtggtgccgggcatg

SEQ ID NO: 5450 - DNA, 1179 bp, Artificial Sequence
  Description of Artificial Sequence: Synthetic coding sequence
atgactacctatagcgataagggggccaagccagaacgcggccgcttcctgcacttccactctgtgacgttctgggtgggaaatgccaagcaggctgcaagtttctactgtagcaagatgggatttgaaccgctagcatatagagggttggaaaccggttcacgggaggtggtgagccatgtgatcaagcaggggaaaattgtgttcgtgcttagtagcgcattgaacccatggaataaggaaatgggcgatcaccttgtgaaacacggtgacggcgtaaaagacatcgcctttgaggtcgaggactgcgactacatagtccaaaaagcaagagagcgcggcgcaaaaatcatgcgggagccctgggtcgaacaagataagttcgggaaggtgaagttcgcagtattacagacatacggggatactacacacactctggtggagaagatgaactatatcggtcagttcctgcctggctacgaagcccctgcgtttatggatcccttgttgcctaagctgcctaagtgtagtctggagatgatagaccacatagttggaaatcagccggaccaggaaatggtttccgcgtcagagtggtacttgaaaaacctacagttccaccgcttctggtccgtggacgatacgcaagtccacacagaatactccagtctcagatctatcgtcgttgctaattacgaagagagcatcaaaatgccaatcaatgaaccagcccccggaaagaaaaagagccagatacaagaatatgttgactacaatgggggagccggagtccagcatatagctcttaagaccgaggatattatcaccgcaatcagacacctcagggaacgcggcctcgagttcttatctgtcccaagtacctactacaagcagttgcgggagaaactgaaaacagccaaaattaaggttaaagagaatatcgacgcactagaggaacttaagatcctcgttgactacgacgagaaggggtacctcctgcagatctttactaagcctgttcaagatcggccaacactctttctggaagtcatccagcgccacaatcaccagggttttggcgcaggcaacttcaattctctttttaaggctttcgaggaagagcagaatttaaggggcaatctcaccaatatggagaccaacggcgtcgtgcccgggatg

SEQ ID NO: 5451 - DNA, 1179 bp, Artificial Sequence
  Description of Artificial Sequence: Synthetic coding sequence
atgaccacttattctgataagggcgctaagccagaacgaggtcgatttcttcacttccattctgtgacgttctgggtgggcaacgccaagcaggctgcaagcttttattgcagcaaaatgggctttgaacctctggcgtatcgcggtctggaaacagggtccagggaggttgtgtcgcatgttattaagcagggcaagatcgtgttcgtgttgagtagcgccttaaacccatggaataaagagatgggcgatcacctcgtgaagcacggggacggcgtgaaagatatagcattcgaggtcgaggactgcgactatattgtgcagaaagctcgggaacgcggcgcaaaaataatgcgagagccatgggtcgaacaggacaagtttgggaaggtgaagtttgctgtcttacagacatacggtgatactactcacactctggtcgagaagatgaattacatcggtcagttcctgcccgggtacgaggctcccgcgtttatggatccgctgctgcccaagctcccgaagtgctctcttgagatgatcgaccatatagtgggaaatcagcccgaccaagagatggttagcgcgagtgaatggtatctgaagaatcttcagtttcatagattctggagcgtggatgacacgcaagtccatactgagtattcttccctgcgatccatcgtggttgcgaattatgaagaaagtattaagatgcctatcaatgagccagcgccaggcaagaaaaaatcacaaatccaagagtatgtcgactacaatgggggagcaggggtccaacatatcgcattgaagacagaggatattattaccgcgattaggcatctgcgggaaaggggactggagttcctaagcgtgcccagcacgtattacaagcaacttcgcgagaaactcaagacagctaagatcaaagtgaaggagaatatcgacgcgctggaagagctaaagatactcgtggactacgacgagaagggttatcttctccagatctttaccaaacccgtccaagataggcctacactgtttctcgaggtgatccagcgtcataaccaccagggatttggggctggaaatttcaatagcctgtttaaggcatttgaggaggagcagaatcttcgaggaaacttgaccaatatggaaacgaacggcgttgttcccggcatg

SEQ ID NO: 5452 - DNA, 1179 bp, Artificial Sequence
  Description of Artificial Sequence: Synthetic coding sequence
atgactacttattcggataagggtgcaaagcctgagagagggcgctttctgcattttcattcggtgacgttctgggtcggaaacgcgaaacaggcagcctcgttttactgtagcaaaatgggatttgaacctctcgcttaccggggacttgagacgggctcgagagaggtcgtcagccatgtgatcaagcagggaaagatagtgttcgtgctttcgagcgcgctgaacccgtggaacaaggaaatgggggatcacctcgttaagcacggcgacggagtaaaggatatcgcatttgaagttgaggactgtgactacatcgtgcagaaggcgcgtgagagaggagcaaagattatgagagagccgtgggtggagcaagataagttcggcaaggtgaaattcgcagtgctgcaaacttacggtgacaccacgcacactctggtggaaaagatgaactacattgggcaatttctccccggatacgaagcccctgcctttatggacccactgctcccaaaactcccgaagtgttcattggaaatgattgaccacattgtcggaaatcaaccagatcaagaaatggtatccgcaagcgagtggtacctgaagaacctgcagtttcatcggttttggagcgtcgatgacactcaagtgcataccgagtacagctccctgcgctcgattgttgtggcaaactacgaagaatcaataaagatgcctataaacgaaccggcgcctggaaaaaagaagtcccaaattcaagaatacgtggactacaatggaggagcaggggtgcagcatatagcacttaagaccgaggacataatcaccgcaatccgccatcttagagaacgcggtcttgaattcctgtccgtgccttctacttactacaagcaacttcgagagaaacttaagactgcaaagattaaggtcaaggagaatattgacgcgctggaagagctgaagattcttgtggattatgatgaaaaaggataccttctccaaatcttcaccaagcccgtgcaagaccgcccaactctctttcttgaagtcattcagcgccacaaccaccagggttttggtgcaggaaacttcaatagcctctttaaagcctttgaggaagagcagaatcttagaggtaacctcactaatatggaaaccaacggcgtcgtgcccggaatg

SEQ ID NO: 5453 - DNA, 1179 bp, Artificial Sequence
  Description of Artificial Sequence: Synthetic coding sequence
atgacaacctactcagataagggcgctaaacctgaacggggacgcttcctgcacttccacagtgttaccttctgggtcgggaatgccaagcaggccgcatctttctattgcagtaagatgggcttcgaaccactggcttacagaggtctagaaaccggctcaagagaagtggtgtctcacgtgatcaagcagggaaaaattgtgtttgtgcttagcagcgccttaaacccttggaataaggaaatgggcgatcacctcgtgaagcacggcgatggtgtcaaagatatcgctttcgaagtggaggattgtgactacatcgtgcagaaggcccgcgaacgcggtgcaaaaatcatgagggaaccctgggtagagcaggacaaatttggcaaagtgaaatttgccgtcctgcaaacttatggtgacaccacacacaccctggtggaaaagatgaactacatcggccagtttctccccggctacgaagcacctgccttcatggaccctctgctacctaagctccccaagtgcagcctggagatgattgatcatatagtgggaaaccaacctgaccaggaaatggtgagcgcttctgaatggtatctgaagaatctgcaattccataggttttggtctgtggacgatacccaggtgcataccgagtactcctccctgagaagtatcgtggttgctaactatgaagagtctattaagatgccgatcaatgaacccgccccgggtaaaaaaaagagccagatccaggagtacgtggattacaatgggggggctggggtgcaacacatcgcattaaagactgaagatatcattacggccatccgacatctacgcgagcgggggttggaatttcttagcgtcccatccacttactacaaacagctaagagagaaactcaagaccgctaaaatcaaggtgaaggaaaacatcgacgcactggaggaattgaagatcctggtggactatgatgaaaagggatacctgctgcagatctttaccaagcccgtgcaggatcggccaacgctcttcctcgaggtgatccaacggcacaatcaccagggattcggcgccggaaatttcaactctctgtttaaggccttcgaggaggagcagaaccttcgcgggaatctgaccaatatggaaacaaatggagtcgtgcctggtatg

SEQ ID NO: 5454 - DNA, 1179 bp, Artificial Sequence
  Description of Artificial Sequence: Synthetic coding sequence
atgaccacttacagcgataaaggagccaagcccgagagaggccgcttcttacatttccatagtgtcactttctgggtgggtaatgctaaacaggcggccagcttttactgctcgaagatgggttttgaacctctcgcctaccgtggtctagagacgggttcgcgcgaggtcgtgtcccatgtcatcaaacagggtaaaattgtgttcgtcctgagcagtgcgctgaacccatggaacaaagagatgggtgaccacctggttaaacatggtgatggtgtgaaggacatcgcgttcgaggtcgaggactgtgactatattgtccagaaggcgagggaacgcggcgcgaaaattatgcgcgaaccctgggtggaacaagacaagtttggaaaagttaagttcgctgtgctgcagacgtatggagacactacgcatactttggtcgagaagatgaactatattggacaatttctgcctggttatgaagcaccggcatttatggacccgcttctgcctaagctgccgaagtgttccttggagatgatagaccatattgtggggaatcagccagatcaagagatggttagcgcgtccgagtggtatttgaaaaacctgcagttccataggttctggagcgttgacgatacacaggtgcacacggagtattctagcctgcgctccattgtggtagccaattacgaagaaagcatcaagatgccaattaacgagcccgcaccgggtaaaaaaaaaagccagatccaggagtatgttgattacaatggtggtgccggtgtgcaacacatcgctctcaaaaccgaagatattatcacggcaatccgccatctgcgcgaacgcgggcttgagtttctgagcgtcccaagtacctattataaacagctccgcgaaaagttgaagacggcgaagattaaggtaaaggaaaatattgatgcgcttgaagagctcaaaattttagtcgactatgacgaaaaaggttacctgctgcagatctttacaaagcctgttcaggaccgcccgaccctcttcctggaggtcattcagcgccacaaccaccaagggttcggggccggaaatttcaacagtctgttcaaggctttcgaggaagaacaaaatcttcgtggcaatctgaccaacatggagaccaacggcgtggtaccaggcatg

SEQ ID NO: 5455 - DNA, 1179 bp, Artificial Sequence
  Description of Artificial Sequence: Synthetic coding sequence
atgacgacttattcagataagggagcaaagcctgaacgcggcaggttcttgcacttccatagcgtgaccttttgggtgggtaacgcgaagcaggcagcttcgttttactgctcaaaaatggggttcgagccgctcgcttaccggggcctcgagacgggatcgagagaagtcgtgagccacgtcataaagcaaggcaagattgtgttcgtcctctcgtccgccctcaacccttggaacaaagaaatgggtgatcacttggttaaacatggcgacggcgtcaaggacatagcgttcgaggtggaagattgtgattacatcgtgcagaaggcacgggaacgcggcgctaagatcatgagagaaccttgggtcgaacaggacaaattcggaaaagtgaagttcgctgtacttcagacttacggagacaccactcatactctcgtggagaaaatgaactacatcggacaattcctgccgggatacgaagccccggcgtttatggaccccctgctgccaaagctgcccaagtgttccctcgagatgatcgatcacatcgtcggaaaccagcccgatcaggagatggtgtccgcatcagaatggtacctgaagaatctgcagttccatagattttggagcgtggacgacactcaggtacacaccgagtactcctcgctgcgatcgatcgtggtggccaattacgaagagagcatcaagatgcccatcaacgagccggccccgggcaaaaagaaatcgcagatccaagaatatgtcgactacaatggtggggcgggggtgcagcacatcgcgctcaagaccgaagatatcatcaccgccatcagacacctgagagagcggggccttgaatttctgtccgtgccatcaacttactacaagcagctccgcgaaaagctgaaaaccgccaagatcaaggtgaaagagaacattgacgcccttgaggagctcaaaatcctggtggactacgatgaaaagggatacctgcttcaaatcttcacgaagcctgtgcaggaccgcccgaccctctttttggaagtgattcaaaggcataatcaccagggattcggagcgggaaacttcaactcccttttcaaggcctttgaagaggaacaaaacttgcggggcaacctcactaacatggaaactaacggggttgtgcccggcatg

SEQ ID NO: 5456 - DNA, 1179 bp, Artificial Sequence
  Description of Artificial Sequence: Synthetic coding sequence
atgaccacctactccgataagggggcgaagcctgaacgcggacggttcctccattttcattccgtcaccttttgggtggggaacgcgaagcaggcagcgtccttttactgctccaagatgggtttcgaaccacttgcatacagaggattggaaactggatcgcgcgaggtcgtgtcacatgtgatcaaacaaggaaagatagtgtttgtcctttcatcggcgcttaatccctggaacaaagaaatgggagatcacctggtcaaacacggggatggcgtgaaagacatagcttttgaagtggaggactgcgattacattgtgcaaaaagcgcgcgaacggggtgcaaagatcatgagagaaccttgggtcgaacaggataagttcggcaaggtgaaatttgccgtgctgcagacctacggcgatacgacccatacgctcgtggaaaagatgaactatattggccagtttctgcctgggtacgaagcaccagcgttcatggatcccctgcttcctaaactgcctaaatgttccctggaaatgatagatcatattgtgggaaaccaacctgatcaagaaatggtgtcggcatcggagtggtaccttaagaacctccaattccataggttttggagcgtcgacgatactcaagtgcatactgaatacagctcgctgaggagcatcgtcgtggccaactacgaggaaagcattaagatgcctattaacgagcctgcacctggaaagaaaaagtcacagatccaggaatatgtggactacaatgggggcgcaggagtgcagcatattgcgcttaagaccgaggacatcatcactgcaattagacaccttcgcgaacggggactcgagtttctttccgtgcccagcacttactacaagcagctgcgcgaaaaacttaagaccgcaaagattaaggtgaaggagaatatcgacgcacttgaagaactcaagattcttgtggactacgatgaaaagggatacctgctgcagatctttacgaaaccggtccaggacaggcctactctgtttctcgaggtgatccagcgccataaccatcaggggtttggtgcaggtaatttcaattcgctgtttaaggcctttgaagaagaacaaaacttgcgaggtaatctgactaacatggaaaccaacggagtggtgcctggcatg

SEQ ID NO: 5457 - DNA, 1179 bp, Artificial Sequence
  Description of Artificial Sequence: Synthetic coding sequence
atgactacctactctgataagggagcgaaacccgaaagagggcgctttcttcatttccattccgtgactttttgggtggggaatgccaagcaagcagcctcattctactgctcaaagatgggttttgagccgctcgcatacagaggacttgaaaccggaagccgggaggtcgtgtcgcacgtgattaagcaaggtaaaatcgtctttgtcctttcatccgcactcaatccatggaacaaagaaatgggcgatcatttggtgaagcatggggatggcgtgaaggatattgcatttgaagtggaggattgtgattacattgtgcagaaggcccgcgagcggggagcgaagatcatgagagaaccttgggtcgagcaggacaagttcggaaaggtcaaattcgcagtgctgcaaacctacggggataccactcatactctggtcgagaagatgaactacattggtcagttccttcctggatacgaagcaccagcctttatggacccacttctcccaaagttgccgaagtgctcgcttgagatgattgaccacattgtgggtaaccagccagaccaggagatggtgtccgcatcagaatggtatttgaagaatcttcaatttcatcgcttctggagcgtggatgatactcaagtgcacacggaatactcctccctccgctcaatcgtcgtggcaaactacgaggagagcattaagatgcctatcaatgagcctgcacccggtaagaagaaatcgcaaatccaggagtacgttgactacaacggtggggcaggagtccagcatatcgcacttaagaccgaagatatcataaccgcaattcggcacctgagggaacgaggtctggaatttctttcggtgccttccacttactacaagcagcttcgcgagaagctgaaaaccgccaagatcaaggtgaaggaaaacattgatgcccttgaggagcttaagattcttgtggattacgacgaaaagggctatttgctccagatctttaccaagccagtgcaggataggccaactctctttttggaagtcattcaacgtcacaaccaccaggggttcggggcgggcaactttaactcactctttaaggcgtttgaggaagaacaaaatcttagaggtaatcttaccaacatggagactaacggtgttgtgccaggtatg

SEQ ID NO: 5458 - DNA, 1179 bp, Artificial Sequence
  Description of Artificial Sequence: Synthetic coding sequence
atgaccacatatagcgataagggggctaaacccgagagaggaaggttcctacattttcattcagtgaccttctgggtcggtaacgctaagcaagccgcctccttttactgctccaagatgggtttcgaaccactggcctatagaggacttgagaccggcagtcgagaagtggtctcacacgtgatcaaacagggcaagatcgtgttcgtgctctcctcagctcttaatccatggaacaaagagatgggcgatcatctggtgaaacacggtgacggggtaaaagacattgccttcgaggtggaagattgtgactacattgtgcagaaggcccgggaaaggggcgcaaagatcatgcgggagccttgggttgagcaggataagttcgggaaggtcaagttcgccgtcctgcagacttacggtgatacaactcacactttggtcgaaaagatgaattacatcgggcagttcctgccaggctacgaagccccagccttcatggacccactcttaccaaaacttcccaagtgcagtctggaaatgattgaccacatcgtcggcaaccagcctgatcaagaaatggtttcagcctccgagtggtacctaaaaaacctgcaatttcacaggttttggtctgtggacgatacacaagtccacactgaatattcttccctgcggagcatcgtagtcgctaactatgaggagtctattaaaatgcctataaacgaaccagcaccgggcaagaagaaatcacaaattcaggaatacgtcgactataacgggggggctggcgtccaacatatagccctaaagacggaggatattatcaccgccatccggcacctgagagagagaggtttagagtttctgtctgtgcccagcacatattataagcagctaagggagaagcttaaaaccgcaaagataaaagtgaaagaaaacatagacgcactagaagagctcaagatccttgtggattacgacgaaaagggctatctgctgcagatcttcacaaagcccgtgcaagacaggccaaccctgtttcttgaggtgattcagaggcacaaccatcagggatttggggctgggaacttcaattcgcttttcaaggcattcgaggaggaacaaaatcttcgggggaatcttaccaatatggagaccaacggggtggtgcctggtatg

SEQ ID NO: 5459 - DNA, 1179 bp, Artificial Sequence
  Description of Artificial Sequence: Synthetic coding sequence
atgacaacatacagtgataaaggagctaagcccgaaagagggagattcctgcactttcattcagtgactttctgggttgggaacgcaaaacaggccgcttctttctattgtagtaagatgggattcgaacctctcgcgtacaggggacttgaaactggatcaagggaagtggtgtcacatgtgatcaagcagggaaaaatagtgttcgtgttgtcatctgctctcaacccttggaataaagaaatgggggatcatcttgtcaaacatggggatggggtgaaagacatagccttcgaagtggaagattgtgattatattgtgcagaaagccagggaaaggggggcaaaaattatgcgggaaccatgggtcgaacaagataaatttggaaaagtcaaattcgcagtgctacagacttatggagatacaactcacactctcgtggaaaaaatgaattatatagggcagttccttccagggtatgaagctccagcattcatggatcccctgctgccaaagctgcctaagtgttctttagaaatgatcgatcacatcgtggggaaccagccagatcaggagatggtgtctgcatctgaatggtatctcaagaaccttcagttccatagattctggtccgtggacgacacacaggtgcatactgagtattcatctctaaggagtatcgtcgtggccaactatgaagaatctatcaaaatgcctattaacgaacctgcgccagggaaaaaaaaatcccagattcaggaatatgtcgattacaacgggggggcaggggtccaacacatcgctcttaagacagaagatataatcacagctatccgccatttaagagagcgaggactggaatttctctctgtgccatccacatattataaacagcttagggaaaaactcaaaactgccaagatcaaagtgaaagaaaatatcgacgctctagaagaactcaaaatcctcgttgattatgatgaaaaaggatatttattgcaaatattcactaaaccagtgcaagatcggccaacactattcctggaagtgatccagcggcataatcatcaggggtttggagctggaaatttcaactccctctttaaagcctttgaagaggaacagaatctcagggggaatctgactaatatggagactaacggagttgtgcccggaatg

SEQ ID NO: 5460 - DNA, 1179 bp, Artificial Sequence
  Description of Artificial Sequence: Synthetic coding sequence
atgactacttattcggataagggagctaagcccgagcggggacgcttcctacacttccattctgtgacattctgggtgggcaacgcaaaacaggcagccagtttttattgtagcaaaatggggtttgaacccctggcataccgcggccttgagaccgggtcccgggaggtggtctctcatgttataaagcaaggcaaaatagtgtttgtgctatcctccgccctgaacccctggaataaggagatgggtgatcacttggtaaagcacggcgatggcgtgaaagatatcgcatttgaggtcgaggactgtgactacatcgtacaaaaagctcgagagaggggcgccaaaattatgagggaaccatgggtagaacaagacaagttcggcaaggtcaaattcgccgtgctgcagacttatggagacactactcacactttggtagaaaagatgaattatatcggtcagttcctgcctggctatgaggctcctgcttttatggatccgctcttgcctaagctcccgaagtgtagtcttgaaatgatcgaccatattgtcggaaaccagcctgaccaggaaatggtgtcggcatccgaatggtacctcaagaacctccagttccataggttttggtctgtggatgacacgcaggtccacacagagtactcaagtcttcgcagcatagtggtggccaactacgaagagtccatcaagatgcctataaacgagccggctccaggcaagaaaaagtctcagattcaagaatacgtggactacaacggtggggcaggtgtgcagcacattgccttgaaaaccgaggacattatcactgcaatccgacacctgagagagagggggctggagttcctcagcgtgccgtctacatactataaacagctcagggagaagctaaagacagcgaaaattaaagtgaaagaaaacattgatgcattggaagagctgaagattctcgtggactacgacgagaagggatacctgctgcagatcttcacaaagcccgtgcaggacagaccaactctattcctagaggtgatccagcgccacaatcaccagggttttggcgcgggtaactttaatagcttattcaaagcatttgaagaagaacaaaaccttaggggcaatctcaccaacatggagaccaatggtgttgtgccaggaatg

SEQ ID NO: 5461 - DNA, 1179 bp, Artificial Sequence
  Description of Artificial Sequence: Synthetic coding sequence
atgaccacctactccgataaaggcgctaagcctgagcgcggtaggtttttgcacttccacagcgttaccttctgggtgggaaacgccaagcaagcggcctccttctactgctcaaagatgggctttgagcctttggcctacagaggtctggaaaccggatcacgcgaagtcgtcagccacgttatcaagcaaggaaaaatcgtgtttgtgttgtcgtccgcactgaacccgtggaacaaggagatgggcgatcacctggtgaagcatggagatggagtcaaggacatcgcgtttgaggtcgaagattgtgattacattgtgcagaaagcccgagaaagaggagcaaagatcatgagggaaccgtgggtggaacaagacaagtttggaaaggtcaagtttgctgtgctgcagacctacggggatactactcatactttggtcgaaaagatgaattacattggccagttcctgccaggatatgaggcgcccgcttttatggacccgttgctcccaaaactgccgaagtgctcgctggaaatgatcgaccatatcgtgggaaatcagccagaccaggaaatggtgtccgcttccgaatggtatctgaaaaatctccaattccaccgattctggagcgtggacgatacccaggtgcacaccgaatactcgtcactcaggtccatcgtggtggctaactacgaagaatctatcaagatgccaattaacgagccggcgcccgggaaaaagaagtcccagatacaagaatacgtcgattacaacgggggagccggcgtgcagcacatcgcgctgaaaactgaggacatcatcaccgccatccgccacctgcgcgaaaggggactggagttcctctcagtcccatcaacttactacaaacaactgcgggagaagctcaagaccgcgaagatcaaagtgaaagagaatattgacgccctcgaggagctgaaaattctcgtggactacgacgaaaagggttaccttctccagatcttcactaaaccggtgcaagatcgtccaaccctcttcctcgaggtgatccagcgccataatcatcagggcttcggagcagggaactttaactcgttgttcaaagccttcgaagaagagcaaaatcttcgcggaaacctcactaacatggaaacgaacggagtggtcccagggatg

SEQ ID NO: 5462 - DNA, 1179 bp, Artificial Sequence
  Description of Artificial Sequence: Synthetic coding sequence
atgactacctattccgacaaaggtgcaaaacctgaacgaggaagattcttgcactttcacagcgtgactttttgggtcgggaatgctaagcaggctgcttctttctactgttctaaaatgggattcgaacccctggcatatcgcggattggaaacaggaagtagggaagtagtcagtcacgtgatcaagcaaggcaaaatcgtctttgttctttcatccgctctgaacccttggaacaaggagatgggggaccatcttgtgaagcatggagatggagtgaaggatattgcttttgaagtcgaggattgtgattatattgtgcaaaaggcacgcgaacgcggtgccaagataatgagagagccctgggtcgaacaagataagttcggcaaagttaaattcgccgtgctccagacctacggcgataccacacatacactggtagagaaaatgaattacataggacagtttctgcctggatacgaggccccggcgtttatggatcctctcctccctaagctccctaagtgttccctcgaaatgatcgatcatatagttgggaaccaacccgaccaggaaatggtgagcgcttctgaatggtacctcaaaaacctccagtttcacaggttttggtctgttgacgatacccaggttcatactgagtactcgagcctgaggtcaatcgtcgtcgctaactatgaggagtctatcaaaatgcctatcaatgagcctgctcccggcaaaaaaaagagccagattcaggaatacgtcgactacaatggaggagcaggagtgcaacacatcgcactcaaaactgaggatattatcaccgcgattcgtcatctgagagagagaggcctggagttcctgtcagtgcctagcacttactataagcagctgagagaaaagctcaagaccgctaagattaaagtcaaagagaacattgatgctctggaggagctcaagattttggtggattacgatgaaaagggatatcttctgcaaatattcaccaagcctgtgcaggataggcctactcttttcctggaggttatccagagacacaaccaccaggggtttggcgccggcaacttcaactctcttttcaaagcattcgaggaggaacaaaacctccgaggtaatctcacgaatatggagacaaatggagtggtgccaggcatg

SEQ ID NO: 5463 - DNA, 1179 bp, Artificial Sequence
  Description of Artificial Sequence: Synthetic coding sequence
atgactacttactccgacaagggtgccaaaccagaacgcggacgcttcctgcacttccattcagtgaccttctgggtcggaaacgccaagcaagcagcctccttctactgctctaagatgggtttcgagccattggcctaccgcgggttggaaactggctcgcgagaggtggtgagccacgtcatcaagcagggcaaaatagtgtttgtcctcagctccgctttgaacccgtggaacaaggagatgggcgaccatttggtgaagcatggggatggcgtgaaggacattgcattcgaagttgaggactgcgattacatagtgcaaaaggcgcgcgagaggggcgctaagattatgcgagagccttgggtggaacaagataagttcggtaaagtgaagtttgcggtcctgcagacctacggagataccacccataccctggtggaaaagatgaattacatcggacagtttcttcccggatacgaggcacctgccttcatggacccactgctgccgaagttgcctaagtgttccctggaaatgatcgaccacatcgtcggaaaccagccggaccaggaaatggtgtctgcttccgaatggtacctcaagaatctgcaatttcatcggttctggagcgtggacgatacccaggtgcacaccgagtactcatcactcagaagtatcgttgtggcaaattacgaagaatcgattaagatgccaatcaatgagccagccccgggaaagaagaagtcccaaatccaggagtacgtcgattacaatggcggagcgggtgtacaacatatcgccctgaaaaccgaggacatcatcaccgcgatccgtcatctgagggaacgggggctcgaattcctctctgtcccttcaacttactataagcagctgagggagaagttgaaaacggccaaaatcaaggtgaaagaaaacatcgatgcactggaggaattgaaaatcctggtggactacgacgaaaagggctatctcctgcagatcttcactaaaccggtgcaagatagaccgactctctttctggaagttatccaacgccacaaccaccagggcttcggtgctggcaactttaactcgctgttcaaagccttcgaagaagagcagaacctgcggggaaatctgactaacatggaaactaatggagtcgttccaggaatg

SEQ ID NO: 5464 - DNA, 1179 bp, Artificial Sequence
  Description of Artificial Sequence: Synthetic coding sequence
atgactacttactccgataagggtgctaagccagaaagaggacggtttctgcacttccactctgtgacattctgggtgggcaatgcaaaacaggccgccagtttctattgctccaaaatgggcttcgagccactcgcatatcggggcctggaaacaggctcaagagaggtggtgtctcacgtcatcaaacaagggaaaattgtttttgtgctgagctccgccctcaatccttggaacaaggagatgggtgatcacttggttaagcatggcgacggagtcaaggatatcgcttttgaggtggaagattgtgattacatcgtgcagaaagctcgcgagagaggcgccaaaataatgagagaaccatgggtggaacaggacaaattcgggaaggttaaatttgccgtgctgcagacttatggtgacactacccacacgctcgttgaaaaaatgaactacattggacagttccttcctggctacgaggcacccgcctttatggacccactgctgcccaaactgccaaagtgctccttggagatgatagaccacattgtggggaatcaacctgaccaagagatggtgagcgcctctgagtggtacctaaagaatctgcagtttcacagattctggtcagtggatgacactcaagtacatacagaatacagcagtctcagatctatcgtggtggccaactacgaggagtctatcaagatgcccattaacgaacccgcacccggaaagaagaagtctcagatacaagagtatgtcgattataatgggggggcaggcgtgcaacatatcgccctcaagaccgaggacatcatcacagccatcagacatttgcgagaacgcggactcgagttcctgtctgtgcccagtacatactataagcagctgcgcgagaagctcaaaaccgccaagattaaggttaaagagaacatcgatgctctggaggagctcaaaatcctggttgattacgacgagaaaggctatctgcttcagatctttaccaagcccgtccaagacagaccaaccttgttcctggaggtaatccaaagacacaaccaccaagggtttggagccggcaactttaattcactgtttaaagcgttcgaagaagaacagaacctccggggcaatcttactaatatggagacaaatggcgtggtccccgggatg

SEQ ID NO: 5465 - DNA, 1179 bp, Artificial Sequence
  Description of Artificial Sequence: Synthetic coding sequence
atgactacctactccgataagggagcaaaacctgaaagggggagattcctgcacttccatagtgtcactttttgggtggggaacgctaagcaggctgcctccttttactgttccaagatgggttttgaacctctggcgtacaggggtttggagacgggctctcgtgaagttgtttcacacgttattaagcagggaaaaatagtgtttgttttgagcagcgcacttaatccatggaataaggaaatgggtgatcatctagttaagcatggagatggagttaaggacatcgccttcgaagtcgaggattgtgattacattgtccagaaagcaagagaaagaggcgccaagatcatgagagagccctgggtggagcaagacaaatttgggaaagttaagttcgccgtcttgcagacatatggagatacaacccatactcttgtggaaaagatgaattatattggccaatttttgcctggttatgaagctccagcttttatggatccactattgccaaaattgcctaagtgctcgttagaaatgattgatcacattgttggtaaccagcccgaccaagagatggttagcgcctctgaatggtacttgaaaaatttgcaatttcacagattttggagtgttgacgatactcaagttcatacagaatatagttcactcagatcgatcgtggtcgctaactatgaagaatcaataaagatgcctataaacgaaccagccccggggaaaaaaaaatcacagatccaggagtatgttgattacaacggcggggcaggcgtgcaacacatcgctttgaaaaccgaggatattatcacggccattcgacacctcagagagaggggactggaattcctctcggtgccttccacatactataagcaattaagggagaagctaaagaccgctaaaatcaaagtaaaggaaaacatcgacgccttggaagaattgaagatcttagtggattatgatgaaaaagggtatttgttgcaaatcttcactaaaccagtgcaagatagaccaactttgttcttggaagtgattcagaggcacaaccaccaaggttttggtgccggtaatttcaacagtctttttaaagcatttgaagaagagcaaaatcttcgaggaaacttgactaatatggaaactaatggggtggttcctggaatg

SEQ ID NO: 5466 - DNA, 1179 bp, Artificial Sequence
  Description of Artificial Sequence: Synthetic coding sequence
atgactacttactcagataaaggagcaaagcctgaacgcggaagatttctgcattttcactcagtgaccttttgggttggaaacgcaaagcaagcagcatccttttactgctccaagatggggttcgagcctttggcttaccgcggtctggaaacgggttcgagagaagtggtgtcacacgtcataaagcagggcaagatcgtgttcgtgctgagctccgccttgaatccatggaataaggaaatgggtgatcatctggtcaaacatggagatggtgtcaaggacattgccttcgaggtggaggattgcgactacatcgtgcaaaaagcacgggagcgtggcgcaaagattatgagagagccttgggtggagcaagataagtttggtaaggtgaagttcgcagtcttgcagacgtacggagatactacccatactttggtcgagaaaatgaactatatcggccagttcctgccaggttacgaagctcctgcatttatggatccccttcttcctaaattgccaaagtgctctctggaaatgattgaccatatagtgggaaaccagccagaccaggaaatggtgagcgcgtcggaatggtacctcaagaacctccaatttcaccggttttggtccgtggacgacacccaagttcacaccgaatacagctcccttcgcagcatcgtggtcgcaaattacgaagaatctattaagatgcctatcaacgaaccagcccccggaaagaagaaatcacaaatacaggaatacgtggattacaatggaggggcgggtgtgcagcatatcgcccttaagaccgaggatatcattaccgccatacgccatcttagagagcgaggcctcgagttcctttccgtgccatccacctactacaaacagctgcgcgaaaagctcaaaaccgccaaaatcaaagtgaaagaaaacatagatgcattggaggagctgaagattctcgtggattatgatgaaaagggctatctcctgcagattttcactaagcccgtgcaagacagaccaactctttttctggaagtgattcaacgtcataaccatcaaggctttggagcaggaaacttcaactcgctctttaaggcattcgaggaagagcaaaacctgcgtggaaatttgaccaacatggagactaacggagtggtgcctggtatg

SEQ ID NO: 5467 - DNA, 1179 bp, Artificial Sequence
  Description of Artificial Sequence: Synthetic coding sequence
atgaccacctactcagacaaaggtgccaagcctgagcgagggaggtttctgcactttcattcggtgacattttgggtgggcaacgccaagcaagccgcttccttctactgttctaagatgggatttgaaccactggcctaccggggcctggagacaggctcaagagaggtagtttcccatgtcattaagcagggaaaaatagtgttcgtgttgtcaagtgcgctcaacccctggaataaggagatgggcgatcatttggttaagcatggggacggcgtgaaggatattgcgtttgaagtggaggactgcgactatattgtgcaaaaggctagagagcgaggggcgaaaatcatgcgggagccttgggtcgagcaggacaaattcggcaaagtcaagtttgcggtgttgcagacctatggtgacactacccacactcttgtcgagaagatgaattatattggacagtttcttcctggctatgaagctcctgctttcatggatcccctcctaccaaaacttccaaagtgcagcctggagatgatcgaccacatagtcgggaatcaaccggaccaggagatggtctcggccagcgaatggtacttaaagaaccttcagttccatagattttggagcgtcgacgacacacaagtgcacaccgagtactcatccctgaggtcaattgtggttgctaactacgaagagtcaataaaaatgcctattaacgagcctgctccgggcaagaagaaatcccagatccaagaatacgtggattataatggcggcgccggcgtgcagcacatagccctcaaaacagaggatatcattacagccatacggcaccttcgggaaagaggattagagtttttgtccgtcccttccacgtattataaacagctgcgcgaaaaactgaagaccgccaagatcaaggttaaagagaacattgatgctttggaggagctcaaaatcctcgtagactacgatgagaaaggatacctgctgcagatatttactaaacctgtgcaagacagaccaacgcttttcctggaggtgattcagcgccacaatcatcagggctttggcgctggaaattttaacagcctgttcaaggccttcgaggaagaacagaacttgcgcgggaatctcactaatatggagacgaacggggttgtgcccggcatg

SEQ ID NO: 5468 - DNA, 1179 bp, Artificial Sequence
  Description of Artificial Sequence: Synthetic coding sequence
atgaccacctattccgacaagggggctaagcctgaacggggtagattcctccactttcattccgttaccttttgggtggggaatgccaagcaggcggctagcttctattgttctaaaatgggattcgagcctctggcctacaggggcctcgaaacgggtagtcgcgaagtggtttcccacgtcataaagcaggggaaaatcgtgtttgttctgtctagtgccctcaatccatggaacaaggaaatgggggaccatctggtcaaacacggagatggagtaaaggatatagcctttgaagtggaagactgcgattatatcgtgcaaaaggccagagagcggggcgccaaaataatgcgggaaccctgggtggagcaagataagtttggtaaggtgaagttcgccgtcttgcagacatacggcgacacaacacacaccctcgtagagaagatgaactacattggccagttccttcctggttatgaagcccccgcattcatggaccccctcctgcctaagctccctaaatgttcactcgagatgatcgatcacatcgtaggaaatcaacctgatcaggagatggtttccgcctccgagtggtatctcaagaacctccagtttcatcggttttggagcgttgatgacacccaggtgcacactgaatactcttccctgcgctccatcgtggtggccaactatgaagagagcatcaaaatgcccatcaacgaaccagcccctggcaaaaagaaatcccagatacaggagtatgtcgactacaacggaggcgcgggggtgcagcatattgcactgaaaaccgaggacataatcaccgccatcagacatctgagggagaggggactggaattcctgtcagtcccatcaacatattacaagcagctgagagaaaaactcaagaccgcaaaaattaaggtgaaggaaaatatcgatgccctcgaagagttgaagattctggttgactatgacgagaagggataccttctgcagattttcacaaaacctgtgcaggatcgcccaaccctcttcctggaagtgatccagaggcacaatcatcaggggtttggcgctggaaactttaactctcttttcaaggcttttgaggaagaacaaaatctcagggggaacctgaccaatatggagaccaatggtgttgtgcccgggatg

SEQ ID NO: 5469 - DNA, 1179 bp, Artificial Sequence
  Description of Artificial Sequence: Synthetic coding sequence
atgaccacctactccgataagggtgccaaacccgaacgcggacggtttctgcactttcactccgtgactttctgggtcggtaacgcaaagcaggctgcctccttctactgctcgaagatgggattcgaaccgctcgcctaccggggcctggaaactggatcgcgggaagtggtcagccacgtcatcaaacaaggcaaaatcgtgtttgtcctgtcctccgcgctgaacccgtggaacaaggagatgggagatcacctcgtgaagcatggcgacggagtcaaggacatcgccttcgaagtggaggactgcgactatatcgtgcagaaggcaagagaacggggcgcaaagatcatgcgggagccgtgggtggaacaggataagtttggcaaggttaagttcgccgttctccagacttacggcgacactacccatactctggtggaaaagatgaattacattggccagttcctgcctggttacgaggcccctgcatttatggatccgctgctcccgaagctgccaaagtgctccctcgaaatgattgaccatattgtgggtaatcagccggatcaagagatggtgtcagcctctgaatggtacctcaagaacttgcagtttcatcggttctggtctgtggatgacacccaggtgcacactgagtactcttcactgaggtcgattgtggtcgccaactacgaagaatccatcaagatgcctatcaacgagcctgctcctgggaagaagaagtcgcaaattcaggaatatgtggattacaacggcggggcgggagttcaacatatcgccctgaaaaccgaggacattatcaccgcgattcgacacttgagggaaaggggcctcgaatttctctcagtgccgtcaacctactacaaacaactgcgggaaaaacttaagaccgcgaaaatcaaggtcaaagagaatattgacgctctggaagagctgaagatccttgtggactacgacgaaaagggatacttgctgcaaatcttcactaaacccgtccaagacagacccacgctcttcctggaagtgattcagcggcacaatcaccaggggtttggcgccggcaatttcaatagcctgttcaaggcattcgaggaggagcagaacttgcgcggtaacctgaccaatatggaaaccaacggtgtggtcccaggaatg

SEQ ID NO: 5470 - DNA, 1179 bp, Artificial Sequence
  Description of Artificial Sequence: Synthetic coding sequence
atgaccacctactccgacaagggtgcaaaaccagaaaggggaaggttcctgcatttccattccgtgactttttgggtcggtaatgcgaaacaagcagcctcgttctactgctcaaagatgggatttgaacccctggcatatcgaggactggaaactggcagccgcgaagtggtgtcgcacgtgataaagcaggggaagattgtgtttgtcctctcctcagcattgaacccttggaacaaggaaatgggagatcatcttgtcaagcatggagacggagtgaaggacattgcctttgaggttgaagattgtgactacatagtgcaaaaggcaagagaacggggagcaaagatcatgcgggaaccttgggtggagcaagacaagtttggtaaagtgaagttcgcagtccttcaaacttatggggacaccactcatactctcgtggaaaagatgaactacattggtcagtttcttcctgggtacgaagcacccgcgtttatggatcctttgctgccaaaacttcctaagtgttcccttgagatgatcgaccacatcgtggggaaccaaccagatcaagagatggtgagcgcgtcagaatggtacctcaagaaccttcagtttcataggttttggtcggtcgatgatacccaggtccacactgagtattcatcgctgcggtccatagtcgtggccaactacgaggaatccatcaagatgccgattaacgagccagcgccgggtaagaaaaagtcgcaaattcaggagtacgttgattacaatggtggcgcgggagtccagcatatagctctgaaaaccgaagatatcattaccgcaatcaggcacctcagagaacggggcctcgagttcctgtcagttccttcgacttactacaagcaactccgagagaagctcaagactgcaaagatcaaagtgaaagagaatattgacgcgctggaagaacttaagatccttgtggattacgatgaaaagggttaccttctccaaatcttcaccaagcccgtgcaggaccggcccaccctgttcctcgaggttattcagagacataatcaccaaggtttcggtgcaggaaactttaactcgctcttcaaagccttcgaagaagaacaaaatctgagaggcaatcttacgaacatggaaactaacggagtcgtcccaggtatg

SEQ ID NO: 5471 - DNA, 1179 bp, Artificial Sequence
  Description of Artificial Sequence: Synthetic coding sequence
atgactacctacagcgataaaggggcaaagcccgagagggggcggtttctgcatttccatagcgtaactttttgggttggcaacgctaaacaagctgcttccttttactgttccaagatgggctttgagcccctcgcgtaccgtggtttggaaacagggagccgggaggtggtctcgcacgttatcaagcaagggaaaatcgtcttcgttctaagtagtgctctgaatccgtggaacaaggaaatgggcgaccacttagtgaagcacggtgatggagttaaggatatcgcattcgaggtagaagactgtgattacatcgtccaaaaggccagggagcgcggagccaagataatgcgggaaccctgggtcgagcaggataagttcggtaaggtgaaattcgctgttctgcagacctacggcgatacaactcacaccttagtggaaaagatgaattacattgggcagtttctccccggttacgaggcccctgcttttatggatcctctgctgccgaaactgccaaagtgttctctggagatgattgaccatatcgtggggaaccaaccagatcaggagatggtgtctgcctcagagtggtacttgaagaacctacagtttcacaggttttggtcagtggacgacacccaagttcacaccgagtatagtagccttaggagtatcgttgttgcaaattatgaagaatctataaaaatgcctatcaatgagcccgctcccggtaaaaagaagagccagatccaggaatacgtagactataatggcggcgcaggggtgcagcacatcgccctgaagaccgaggacatcatcacagcaatccggcatctccgggagaggggtcttgagtttttgtctgtgccctccacttactataaacaacttagggaaaagctgaagaccgcgaagatcaaagtgaaagagaatattgacgcactggaggagcttaagatcctagttgactacgacgaaaagggctacctcctccagatcttcacgaagccagtgcaggacagacccaccttattccttgaggtgattcagaggcacaatcaccaggggtttggcgcagggaatttcaattccctgttcaaggcttttgaggaagaacaaaacctaagggggaacctcaccaacatggagaccaatggcgtcgtgcccgggatg

SEQ ID NO: 5472 - DNA, 1179 bp, Artificial Sequence
  Description of Artificial Sequence: Synthetic coding sequence
atgaccacctattccgacaaaggagccaagccagaaaggggtaggttcctacattttcattcggtgaccttctgggtcggcaatgcaaaacaggccgcttccttttactgctctaaaatgggatttgaaccacttgcctatcggggcttggaaactgggagccgggaggttgtgagtcacgtgatcaagcagggtaaaatcgtatttgtcctgagctccgcgcttaatccgtggaacaaagaaatgggcgaccacctcgtcaaacacggcgatggggtcaaagacatcgcatttgaagtggaggattgcgattacattgttcagaaggcacgagaaaggggtgctaagatcatgcgcgagccctgggtggaacaagacaagttcggcaaagtgaaattcgcggtgctacagacgtacggcgatactacccataccctcgttgaaaagatgaattacatcggacagttcctgccgggctatgaagcaccagcattcatggacccactcctccctaaactgcctaaatgtagtttagaaatgatcgaccatatcgttggcaatcaaccagaccaggaaatggtgagtgcctcggaatggtacttgaagaaccttcagttccatcggttctggtctgtggacgatacccaggtgcacacagaatattcctctctgcgatctatcgtggtcgcaaattatgaagaatctatcaagatgccgataaacgaacccgcgccagggaaaaagaagagccaaatccaggagtatgtcgattacaacggcggcgcgggagtccagcacatcgctttaaaaacagaagacatcattaccgctatacgacatctgagggagcggggcctggagttcctgtccgttccttccacttattataaacagttgagagaaaaattgaaaaccgcaaagatcaaggtcaaagagaatatagatgccctggaggaactgaagatcctggttgactacgacgaaaaaggatacttgctccagatcttcacaaagccggtacaagacagacccaccctgtttctggaggtgattcaacgacataaccaccaggggtttggcgccgggaacttcaattctctctttaaagcttttgaagaggagcagaacctccgcggtaacctgactaatatggagactaacggagtggtaccgggcatg

SEQ ID NO: 5473 - DNA, 1179 bp, Artificial Sequence
  Description of Artificial Sequence: Synthetic coding sequence
atgacgacgtattcggataaaggtgcgaaaccggaacgtggtcgttttctacattttcattcggttacgttttgggtaggtaatgcgaaacaagcggcgtcgttttattgttcgaaaatgggttttgaaccgctagcgtatcgaggtttagaaacgggttcgcgagaagttgtatcgcatgttataaaacaaggtaaaatagtatttgttctatcgtcggcgttaaatccgtggaataaagaaatgggtgatcatttagtaaaacatggtgatggtgttaaagatatagcgtttgaagtagaagattgtgattatatagttcaaaaagcgcgtgaacgaggtgcgaaaataatgcgtgaaccgtgggttgaacaagataaatttggtaaagttaaatttgcggttctacaaacgtatggtgatacgacgcatacgctagtagaaaaaatgaattatataggtcaatttttaccgggttatgaagcgccggcgtttatggatccgttattaccgaaattaccgaaatgttcgttagaaatgatagatcatatagttggtaatcaaccggatcaagaaatggtatcggcgtcggaatggtatctaaaaaatttacaatttcatcgattttggtcggttgatgatacgcaagtacatacggaatattcgtcgttacgttcgatagtagtagcgaattatgaagaatcgataaaaatgccgataaatgaaccggcgccgggtaaaaaaaaatcgcaaatacaagaatatgttgattataatggtggtgcgggtgttcaacatatagcgctaaaaacggaagatataataacggcgatacgacatctacgagaacgtggtctagaatttctatcggtaccgtcgacgtattataaacaattacgagaaaaactaaaaacggcgaaaataaaagtaaaagaaaatatagatgcgttagaagaactaaaaatattagtagattatgatgaaaaaggttatctattacaaatatttacgaaaccggttcaagatcgtccgacgttatttttagaagtaatacaacgtcataatcatcaaggttttggtgcgggtaattttaattcgctatttaaagcgtttgaagaagaacaaaatttacgaggtaatctaacgaatatggaaacgaatggtgtagtaccgggtatg

SEQ ID NO: 5474 - DNA, 1179 bp, Artificial Sequence
  Description of Artificial Sequence: Synthetic coding sequence
atgaccacatacagcgataaaggagccaagcccgagcgaggtcgtttcctacacttccacagcgttaccttctgggtcgggaacgcaaaacaggcggccagtttctactgttctaaaatgggtttcgagccactggcctaccgcgggctcgaaaccggctctcgcgaagtcgtgagccacgtgattaagcaagggaaaatagtcttcgtcttgtccagtgcactcaacccctggaacaaagaaatgggagaccatcttgtgaagcacggagacggagtgaaggacatcgcattcgaggtggaggactgtgattatatcgtacagaaagccagagagcgaggggctaagatcatgagagaaccatgggtggagcaggataagtttggaaaggttaagttcgccgtgctccagacatacggagatacgacccacacactggttgaaaagatgaactacatcggccagtttctacccggctacgaggctcctgctttcatggatcccttgttgccaaagctccccaagtgctcccttgaaatgattgaccacatcgtgggaaatcagcctgatcaggaaatggtgagcgcatctgaatggtatctcaagaacctgcagttccaccgattttggtcagtggatgatacccaagtccacactgagtactcatcgctgcgttccatcgtggtcgccaactatgaggaaagtatcaagatgcccattaacgagcccgccccaggtaagaaaaaaagccagatacaggaatatgttgattacaacggcggtgctggtgttcagcacattgcactgaagaccgaagatataatcacagcgattagacacctgcgcgaaagaggcctggaatttctgagcgtgccgagcacctactataaacagctgcgggaaaagctgaaaacagccaagattaaggtcaaggaaaatatagatgccctggaagagttgaagatcttagtagactatgatgaaaaggggtatctcttacagatctttactaagcccgtacaggaccgccccaccctgttcctggaagttattcagagacacaaccatcagggatttggtgcgggcaacttcaacagtttattcaaggcctttgaggaggagcagaacctgaggggtaatcttaccaatatggagacgaatggcgtggtaccaggcatg

SEQ ID NO: 5475 - DNA, 1179 bp, Artificial Sequence
  Description of Artificial Sequence: Synthetic coding sequence
atgactacttactcggataagggggcaaaaccggaacggggacgcttccttcacttccactccgtgaccttctgggtgggaaatgccaaacaggcagcatcattctactgctctaaaatgggattcgagccgctcgcctaccgcggtctggaaaccggctcgcgggaggtggtgtcccacgtcatcaagcaaggtaagatcgtgtttgtgctgtcctcggccctgaatccatggaataaagaaatgggagatcacctggtcaagcatggcgatggggtgaaggacatcgcattcgaagtggaagattgtgactacattgtgcagaaggccagagaaaggggcgccaaaatcatgcgcgagccatgggtcgaacaagataagtttgggaaggttaagttcgccgtcttgcagacgtatggggatactacccacactctggttgaaaagatgaattacatcggccagtttctccccggatacgaggctccagcgttcatggacccgctgctcccaaagctcccgaagtgtagccttgaaatgatcgaccatatcgtgggaaaccaacccgaccaggaaatggtgtctgcatctgagtggtacctgaaaaacctccagtttcacagattttggtcggtggacgacactcaggtccacactgaatactcaagcctgcggtccatcgtggtggcgaactacgaggagtccatcaagatgcctattaacgagccggccccaggtaaaaagaagagccagattcaggagtacgtggattacaacgggggagcgggggtgcaacacatcgctttgaaaactgaggacatcattaccgcgattcggcaccttcgcgaaaggggtcttgagtttctgtcggtgccttcgacgtactataagcagctccgcgagaaacttaagaccgccaagattaaagtcaaggaaaacatcgacgccctggaagagcttaagatcctcgtcgactacgacgagaagggatacttgctgcagatcttcaccaaacccgtgcaagaccgacctacgctcttcctggaggtgatccagagacataaccatcagggattcggagcagggaacttcaattctttgttcaaggcattcgaggaagaacagaacctgcggggtaatttgaccaacatggagactaacggagtggtgccggggatg

SEQ ID NO: 5476 - DNA, 1179 bp, Artificial Sequence
  Description of Artificial Sequence: Synthetic coding sequence
atgaccacgtactcggacaagggagcgaagccagagagaggaaggttcctgcacttccacagtgtcactttttgggtggggaacgccaagcaggcagcgtctttctactgctcgaagatgggattcgaaccactcgcctaccgcggacttgaaaccggatccagagaggtcgtttcgcatgtgatcaagcagggaaagatcgtgttcgtgctgtcatcagcgcttaacccatggaacaaagagatgggcgaccacctggtgaaacatggtgacggcgtgaaggacattgcgttcgaggtggaagattgcgactacatagtgcagaaggcccgggagcgcggagccaagattatgcgggagccgtgggtcgaacaggataagttcgggaaagtcaaatttgcggtgctgcaaacctacggagatactactcatactttggtggagaagatgaattacatcgggcagttccttccaggttacgaggctcctgccttcatggacccgcttctcccgaagttgcctaagtgctcactggagatgattgaccatatcgtgggcaaccaacccgaccaggagatggtcagcgcttccgagtggtacctcaaaaatctgcagttccaccggttttggtcggttgatgatactcaggtccacactgaatactcatccctcagaagcatcgtcgtggccaattacgaagaatcgatcaagatgcccatcaacgagccggctcctggaaagaagaagtcgcagatccaagaatacgtggactacaatggaggcgctggagtccaacatatcgcactcaagaccgaagatatcatcactgcgatccggcacctgcgcgagcgcggactggaattcctgtcagtgccaagcacttactacaagcaactccgcgagaagctcaaaaccgctaaaatcaaagtcaaggaaaacattgacgcattggaggagctgaagatactggttgattacgacgaaaagggatacctgctgcaaatcttcaccaagccggtccaagaccgtcctaccctgtttcttgaagtgatccagaggcacaaccatcagggatttggagcagggaatttcaacagcctgtttaaggctttcgaggaagagcaaaacctccgcggcaatctgactaacatggagactaacggcgtggtgccgggaatg

SEQ ID NO: 5477 - DNA, 1179 bp, Artificial Sequence
  Description of Artificial Sequence: Synthetic coding sequence
atgaccacttacagcgataagggtgcaaagcctgaacgtggcagatttcttcacttccactcggtcaccttttgggtggggaacgcaaagcaggcagcttccttctactgttcaaagatgggattcgaaccactggcctacagaggtctggaaacgggctcgagggaagtggtgtcccacgtgataaagcagggaaagatagtattcgtgcttagcagcgctctgaacccttggaataaagaaatgggtgaccatctggtcaagcatggtgacggagtgaaggatattgcctttgaagtcgaggattgcgattacatagtgcaaaaggcgcgcgaacgtggggcgaaaatcatgcgcgaaccctgggtcgaacaagataagtttgggaaagtgaagtttgcagtgcttcaaacgtacggggataccactcatactctggtggagaaaatgaactatatcggtcagtttctgcctggatatgaagcgccagcattcatggaccctcttctgcccaagttgccaaagtgttccctggaaatgattgaccatattgtgggaaatcaaccagaccaagaaatggtgtcggcatcagaatggtacctgaagaaccttcagttccacagattctggtccgtggatgatacccaggtacataccgagtactcctcgctgaggtcgatcgtcgttgcaaattacgaggaatcgattaagatgcctattaacgaaccggcgccgggaaagaaaaagtcacagattcaagaatacgtcgattacaacggtggagcaggggtccaacacatcgcactgaaaactgaggacatcatcaccgcgattcgtcatcttcgagagaggggtttggagtttctctcggtgccttcgacctactacaagcagcttcgggaaaaactcaagactgcaaagatcaaagtgaaagagaacatagacgctctggaggaactcaagatcctggtggattacgatgagaagggatatctgcttcaaatctttactaaaccggtgcaggataggccgaccctgtttctcgaggtgattcaacgtcataaccatcaaggcttcggggccggaaatttcaattcactgtttaaagcctttgaagaggaacaaaacctgagaggcaacctgaccaacatggaaactaatggtgttgtcccagggatg

SEQ ID NO: 5478 - DNA, 1179 bp, Artificial Sequence
  Description of Artificial Sequence: Synthetic coding sequence
atgaccacatatagcgataagggggccaagcccgagaggggacggtttctccactttcactccgtgaccttttgggtaggcaatgctaaacaggccgcttcgttttactgcagcaagatgggatttgagccactcgcttaccgtggtctcgagaccggatcccgagaagtagtgagtcatgtgatcaagcaggggaaaattgtctttgtgttgtctagtgctcttaacccctggaacaaggaaatgggtgatcacctggtcaagcacggggacggggtaaaggacatcgctttcgaagtcgaagattgcgattacattgttcagaaggctagggaacggggggcaaagatcatgagagaaccctgggttgaacaggataaatttgggaaagtcaagttcgccgttttgcagacttacggagacactacacacacactcgtggagaagatgaattacatcggacagtttctaccaggatacgaagccccagccttcatggatcccctgctgccaaaactgcccaaatgctctcttgagatgattgaccatatcgttggaaaccagccagatcaggaaatggtctcagcctctgagtggtacctcaagaacttgcaattccacaggttttggtctgtggatgacactcaggtgcatactgaatatagttctctgagatcaattgtggtggcaaattacgaagagtctatcaagatgcctataaacgagcccgctcctggcaagaagaagtcacaaatccaagaatatgtggattataatggaggagccggcgtgcagcatatcgccttgaagacagaagatatcataacagctattcgccatctgcgggaacgaggccttgaatttctttccgtgccctctacgtactacaagcagcttagagaaaaacttaaaactgcgaaaatcaaggttaaagagaatatcgacgcgctggaagaattgaaaattctggtagattatgacgaaaaaggctacctgctgcagatcttcacaaagccggtacaggaccgtcccactttatttctagaggtgatccagaggcacaatcatcagggtttcggcgcagggaattttaacagcctcttcaaggccttcgaagaagagcagaacctccggggcaacctaactaatatggaaaccaacggcgtcgtgccaggcatg

SEQ ID NO: 5479 - DNA, 1179 bp, Artificial Sequence
  Description of Artificial Sequence: Synthetic coding sequence
atgaccacttacagcgataagggagcgaagcccgagcggggcagattcctccatttccatagcgtcactttctgggtcggaaacgccaagcaggctgcgtccttctactgttcgaaaatgggattcgaaccgctggcgtaccgaggattggaaaccggatcaagggaagtggtgagccacgtgataaagcaggggaaaatcgtgttcgtgctgagcagcgccctcaacccgtggaacaaggagatgggagatcaccttgtgaagcacggggacggcgtcaaagacatcgccttcgaagtggaagattgcgactacatcgtccagaaggcgcgcgaaagaggcgcaaagattatgcgggaaccatgggtcgaacaggacaagtttgggaaggtgaaattcgccgtcctgcagacttacggtgacaccactcacactctggtggagaagatgaactacattggtcagttcctgcccggatatgaagcccccgcgtttatggacccgttgcttccgaagctgccaaagtgctctttggagatgattgatcatatcgtgggaaatcagccagatcaggaaatggtgtcggcgtccgaatggtacctgaagaacctgcaattccaccgcttttggtctgtcgacgatactcaggtgcacaccgagtactcctcactgcggagcattgtagttgctaattacgaagagtcaatcaagatgccgatcaacgagccagcaccgggtaagaagaaaagccaaatccaagagtacgtcgactacaatggcggagccggtgtacagcacattgccctcaagactgaagatatcataacggccatccggcacctgagagaacgcggcctcgaattcctgtcggtgccatcaacctactataaacagcttcgggaaaaactcaaaaccgccaaaatcaaggtcaaggagaatatcgacgcactggaggaactcaagatccttgttgactacgatgagaagggatacctcctgcaaatctttacgaagccagtccaggacagacctacgttgttcctcgaggtgatccaaagacataaccatcaaggatttggagctggtaactttaactcacttttcaaggctttcgaggaagagcaaaacctgcggggaaacttgactaatatggaaaccaatggagtggtcccgggcatg

SEQ ID NO: 5480 - DNA, 1179 bp, Artificial Sequence
  Description of Artificial Sequence: Synthetic coding sequence
atgactacctacagcgacaagggggctaaaccggagaggggcaggttcctgcacttccatagcgtgaccttctgggtggggaatgcgaagcaggcagcctctttctattgcagtaagatgggtttcgagcccctcgcctacagggggctggaaacgggcagccgggaagtggtcagccatgtgatcaagcaaggaaagatcgtctttgtgctctcatctgctctcaacccatggaataaggaaatgggcgaccatctggtgaagcacggggacggagtgaaggacattgcgttcgaagtcgaggactgtgattacattgtgcagaaagccagagaacgcggggccaaaatcatgcgggaaccttgggtcgagcaagataagtttggaaaggttaagttcgctgtgctgcagacctacggtgacacgactcataccctggtggagaaaatgaactacattgggcagtttctcccagggtacgaagccccagccttcatggaccctcttctgccaaagctgccgaagtgcagcctggagatgatcgaccacatcgtgggcaaccaaccggatcaggaaatggtgtccgcttctgaatggtacctgaagaatctccagttccaccgcttctggtcggtggacgatactcaggtgcacacggaatactcgagcttgcgatccatcgtggtggccaactacgaagagtccatcaagatgccgatcaatgagccggcgcccgggaagaagaagtcccagatccaggaatacgtggactacaacggcggagccggggtgcaacacatcgctctgaaaaccgaggatatcatcactgcaattcgccaccttcgggagcggggacttgaattcctctcggtgccatccacgtactacaagcaattgagagagaaacttaagactgcaaaaatcaaggttaaagaaaacattgacgcactggaagagctcaagatcctggtggattacgacgagaaaggatacttgctgcagatctttacgaagcctgtgcaagatagaccgaccctcttcctggaggttatccagcgccacaatcaccaaggcttcggagccggcaactttaactctctgtttaaagcgttcgaagaggaacagaatctccggggaaacttgaccaacatggaaactaatggagtcgtcccaggaatg

SEQ ID NO: 5481 - DNA, 1179 bp, Artificial Sequence
  Description of Artificial Sequence: Synthetic coding sequence
atgaccacttactcggacaagggtgcgaagccggaacggggtcggttcctccacttccactctgtcaccttctgggtgggtaacgccaagcaggcggcatccttttactgctctaagatgggattcgaacctctggcttaccgcggcctggagactggtagcagagaggtcgtgtcccatgtgatcaaacaagggaaaatcgtgttcgtcctgtcgtccgctttgaacccgtggaataaggagatgggggaccacctcgtgaagcatggagacggagtcaaagacatcgctttcgaagtggaggactgtgactacatcgtccagaaagctcgagagagaggtgcgaagataatgcgggaaccttgggtggaacaggataagtttggcaaggtgaaattcgctgtcctgcaaacttatggagacactactcacaccctcgtggaaaagatgaactacatcgggcagttcctgcctggatacgaggcccctgctttcatggaccccttgctccctaagctgccgaagtgctcgcttgaaatgattgaccacattgtgggaaaccaaccggatcaggaaatggtgtccgcttccgagtggtatctcaagaaccttcagttccaccgcttctggagcgttgacgacactcaagtgcataccgagtacagctcgctgaggtccatcgtggtggccaactacgaagaatcgattaagatgccgatcaacgaaccggcacccggaaaaaagaagagtcagatccaggagtacgtggattacaatggaggagcaggcgtgcaacatattgccctgaaaaccgaggatatcataactgcgatccgccaccttcgggaacgtgggctcgaattcctcagcgtgccatcaacttactacaaacaactccgggagaagctgaaaaccgccaagatcaaggtgaaagaaaacattgacgcccttgaagaacttaagattctggtggactacgatgagaagggatacctcctccaaatctttactaagccggtgcaggataggccaaccctgttcctcgaggttattcagagacataatcaccaaggattcggggcaggaaacttcaactcactgtttaaagcgttcgaggaagagcagaatttgaggggtaacctcacgaatatggaaactaatggcgtggtgccgggtatg

SEQ ID NO: 5482 - DNA, 1179 bp, Artificial Sequence
  Description of Artificial Sequence: Synthetic coding sequence
atgacaacctactctgacaagggagccaagccggaacgaggccgcttcctccactttcactctgttaccttctgggtggggaacgctaaacaggccgctagtttctattgtagcaagatgggatttgaacctctggcttatagggggctggaaaccggttctagggaggtggtctcccacgtgatcaaacaggggaagatcgtgtttgttttgagctccgccctgaacccctggaacaaggaaatgggcgaccatctagtcaaacatggagatggagtgaaggacatcgcctttgaagttgaggactgcgattacatcgtgcagaaggctagggaacgaggcgccaagattatgcgagagccctgggttgaacaggacaaattcgggaaggttaagttcgccgtgctgcagacgtacggtgacacaacccatacccttgttgaaaagatgaattacatcgggcaatttcttccaggatatgaggcaccagccttcatggacccgctgctgcctaagctgcctaaatgtagccttgaaatgatcgaccatatagtaggcaaccagccagatcaggagatggtgagcgcatctgaatggtacctgaagaacctccaattccatcggttctggtctgtggacgatacacaggtgcatactgaatactcctccctgagatccatcgtggtcgccaattatgaggagagcattaagatgccgatcaatgaaccggcccccggtaagaaaaaatcccaaatccaagaatatgtagactacaatggcggggccggagtgcagcacatcgccctcaagacagaggatataatcactgcgataaggcatctgagggaaaggggtctcgagttcctatcagtgccttccacatattacaagcagttgcgtgagaagttgaaaacggcgaagatcaaggtgaaggagaacattgatgcccttgaggagttaaagatcctcgtggactacgacgaaaagggctatttgttgcaaatctttactaaaccagttcaggaccgaccaacgctcttcctggaggtcattcagcggcacaaccatcaaggcttcggggccgggaatttcaattcgctttttaaagcatttgaagaggagcagaatcttcggggaaacttgacaaatatggaaacgaatggggtggttcccggaatg

SEQ ID NO: 5483 - DNA, 1179 bp, Artificial Sequence
  Description of Artificial Sequence: Synthetic coding sequence
atgactacatattctgataaaggggcgaaaccggaaagagggagatttttgcattttcattccgtaacattttgggttgggaatgccaagcaagcagcctcgttctattgctctaaaatgggattcgaacctttagcataccgtggccttgaaaccggaagtagagaggtggtgtctcatgttatcaaacagggtaaaattgtcttcgtactgtcctctgctttaaatccttggaacaaagagatgggagatcatctggtgaaacacggcgatggagttaaggatatcgctttcgaggtcgaggactgcgactacattgttcagaaagcacgagaacgcggggcaaaaattatgagggaaccctgggtcgaacaagataaatttggcaaggtgaagttcgcagtcctgcagacgtatggcgatacaacgcatacacttgttgaaaaaatgaattatattgggcagtttctacctggatacgaagcaccggcctttatggatccgttgcttcctaaacttccaaagtgttcattagaaatgatcgaccacatcgttggaaaccagccggaccaggaaatggtgtccgcttcggaatggtatctgaaaaatcttcagtttcaccgcttttggtcagtcgatgatacacaagtacatactgaatactctagcttaagatctatcgtggtggcaaattatgaagaaagcatcaaaatgccgattaacgaaccggcgccaggtaagaaaaaatcacagattcaggagtacgttgactataacggcggagcgggggttcagcacatcgcgttgaaaacagaagacatcataaccgcgattcgacatcttcgcgagcgtggtctcgaatttcttagcgttccatcgacatattataaacagcttcgggaaaaacttaaaacggcgaaaattaaagtcaaagaaaatatcgatgcccttgaggaattgaaaattctggtggattatgatgaaaaaggttatctgcttcaaatctttacaaaaccggtccaagataggccgactctttttcttgaggtgatccaaagacataatcatcaaggctttggcgcgggtaactttaacagcctgtttaaggcatttgaggaagaacagaatctgcggggcaatttgacaaacatggaaaccaacggtgtcgtcccgggtatg

SEQ ID NO: 5484 - DNA, 1179 bp, Artificial Sequence
  Description of Artificial Sequence: Synthetic coding sequence
atgaccacttactctgacaagggggcaaagcctgaaaggggaagatttctccattttcattccgtcaccttttgggtcggaaacgcgaagcaggctgcatccttttactgctcaaagatgggattcgaacctctggcgtacagaggacttgaaaccggatccagggaagtggtgagccacgtgatcaagcagggtaagattgtgttcgtgctgtcatcggcccttaacccatggaataaggaaatgggagatcatctggtgaagcatggtgatggagtgaaggatattgccttcgaagtggaagattgtgattacattgtgcaaaaggctcgggaacgtggcgccaagattatgcgggagccgtgggtggagcaagacaaattcggaaaggtgaagtttgcagtgctgcaaacttacggcgatactacccataccctggttgaaaagatgaactacatcggacagtttttgcctggctacgaggctcctgcatttatggatccactcctgcctaagctgcctaaatgcagccttgaaatgatcgatcacattgtgggcaaccaaccagatcaagaaatggtgtcggcatcagagtggtacctgaaaaacctccagtttcataggttctggtcagtggatgatacgcaagtgcacactgaatactcgagtttgcgttcaatcgtggtggccaattacgaggagagcatcaagatgcctataaacgaacctgcacccggcaaaaagaagtcgcaaattcaggagtacgttgattacaatggaggagctggagtccaacatatcgcccttaagactgaggacatcataactgcaattcggcacctgagggaaagaggccttgaatttctttccgtgcccagcacttactacaaacaactccgtgaaaagctgaaaactgccaagatcaaggtgaaggagaatatcgacgcacttgaagaacttaagattctggtcgattatgatgaaaagggctatctgcttcagattttcaccaaacctgtgcaggaccgtccaacccttttcctggaggtgattcaacgccataaccatcaaggttttggtgctggcaactttaacagcctctttaaagcattcgaggaggaacaaaaccttagaggaaaccttaccaatatggaaactaacggagtggtcccgggtatg

SEQ ID NO: 5485 - DNA, 1179 bp, Artificial Sequence
  Description of Artificial Sequence: Synthetic coding sequence
atgaccacttactcggacaaaggagcgaaaccagagcgtggaagattcttacatttccatagcgttaccttctgggtaggaaatgcaaaacaagccgcatcgttttattgtagcaaaatgggattcgaacctcttgcgtatcggggcttggagactggtagtcgtgaagttgtttcccatgttattaagcaagggaagattgtcttcgtcctgagttcagcactgaatccgtggaacaaagaaatgggagatcacttagtaaagcatggagacggagtaaaagacattgcattcgaagtggaagactgtgattatatcgtccaaaaagcacgagaaagaggagccaagattatgcgagaaccatgggtcgaacaggataagttcggaaaagttaagtttgcagtccttcagacttatggagatactacacacactctggtagagaagatgaattacataggacaatttctgccaggatatgaggccccagcttttatggacccattattgccaaaacttcctaagtgctcactcgagatgatcgatcacattgtcggaaaccaaccagatcaagaaatggtaagcgcttcagaatggtatcttaaaaacctccagttccaccgtttctggtctgtcgacgatacacaagttcatacggagtattcatcattgagatcaatcgtggttgcaaattatgaagaatcgattaagatgccaattaatgaaccggcaccaggaaagaaaaagagccaaatacaagaatacgtggactacaatggaggggcgggagtccaacatattgcattgaagacagaggatataatcactgcaatcagacacctacgtgagcgaggactggagttcttgtcagttccaagtacatactataaacagctacgagagaaactcaagaccgctaaaattaaagtcaaagagaatatagatgcgctggaggaattgaaaattttagttgactatgatgaaaagggatacttgttgcagatttttaccaaaccagttcaagatcgtcccacactttttctggaggtaattcaacgtcataatcaccagggttttggtgcaggtaactttaacagccttttcaaggcattcgaagaggagcagaacttgcgtggaaatctgactaacatggagaccaatggagtcgtcccgggaatg

SEQ ID NO: 5486 - DNA, 1179 bp, Artificial Sequence
  Description of Artificial Sequence: Synthetic coding sequence
atgacgacctattctgacaaaggggcaaaaccagagaggggacggttcctgcatttccattccgtgacgttctgggtcggaaacgcaaaacaagcggcatccttttactgttctaagatgggtttcgaaccactggcctaccgaggactcgagacgggctcgagagaagtggtgtcccatgtgattaagcaaggaaaaatcgtgtttgtgctgtcaagcgctctgaatccttggaacaaggaaatgggggatcatctggtgaagcacggggacggtgtcaaggatattgcctttgaggtcgaggattgcgattacattgtgcaaaaggcccgggaaagaggagccaagattatgagagaaccttgggtcgaacaagataagtttggcaaggtgaagttcgcagtgcttcaaacttacggagacactacccacactcttgtcgaaaagatgaactacattggccaatttcttcccggttacgaggcgcccgcatttatggaccctctgctgcctaaattgccgaaatgtagtcttgaaatgatagaccatattgtgggcaatcagccagaccaggaaatggtgtccgcttcggagtggtacctcaaaaacctgcagtttcaccgtttctggtccgtcgacgatacccaagtgcatactgaatactcttcccttcgctcgattgtggtcgcaaattacgaagagtcaatcaaaatgccgatcaacgaacctgcaccagggaagaagaagtcgcaaatccaggagtatgtggactacaacggtggtgctggagtccagcatatagctcttaaaactgaggatatcatcaccgcgatcagacatctgcgtgagagagggcttgaatttctttcggtaccatcaacttattacaagcagctgcgggagaaactgaaaaccgcaaagatcaaagtgaaggaaaacatcgatgcacttgaagaattgaaaatccttgtggattacgatgaaaagggatacctgctccagatattcacgaagccagtgcaggataggcctacccttttcctcgaagtcattcaacgacacaatcaccaaggtttcggagcaggtaactttaacagccttttcaaagcatttgaagaggaacagaatttgcgggggaacctcactaacatggagactaatggagtcgtaccagggatg

SEQ ID NO: 5487 - DNA, 1179 bp, Artificial Sequence
  Description of Artificial Sequence: Synthetic coding sequence
atgactacatattcagacaagggcgccaagcccgagagggggagatttctccactttcactctgtcaccttctgggtggggaacgctaagcaggccgcaagtttctactgctccaagatgggattcgagccactggcctacagggggctggaaaccggcagcagggaggtggtgagtcacgtgatcaaacagggcaaaattgttttcgtcctaagctctgccttgaatccctggaacaaggaaatgggggatcaccttgtgaaacacggcgacggggtgaaggatatcgcattcgaggtcgaggattgcgactacatcgtacagaaagctagagagcgcggggctaagattatgcgcgagccttgggtagagcaggacaagttcggcaaggttaagttcgccgtcctgcagacatatggcgacacaactcataccctggttgagaagatgaattacataggccagttcttgcccggttacgaagcccccgccttcatggaccccctgctgccaaagcttccgaaatgcagtttggagatgatcgaccacatagttggaaaccaacctgatcaggaaatggtgagcgcctctgaatggtatctgaagaatcttcaatttcaccgcttttggtccgtggatgatactcaggtgcacacagaatacagcagcctgcggtcgatagtggtggcaaactacgaggaatccatcaagatgccaattaacgaacctgctcctgggaaaaagaaaagccaaattcaggaatatgtggactacaacggcggggctggcgtgcaacacattgcccttaaaaccgaagatattattacggcgattcggcatctgcgagagcgaggactcgaattcctgtccgtgccgtccacatactataaacagctgagggagaagcttaagacagcgaaaatcaaggtaaaggagaacattgatgccctggaagaactgaagatcctcgtggattacgacgaaaagggctatctccttcagatttttactaaaccagttcaagatcgtcctacacttttcttagaagtgattcaacgccacaaccaccaggggtttggcgcaggcaatttcaatagccttttcaaagctttcgaagaagagcagaatctccgaggcaacctgactaatatggagaccaacggcgtcgtgccaggcatg

SEQ ID NO: 5488 - DNA, 1179 bp, Artificial Sequence
  Description of Artificial Sequence: Synthetic coding sequence
atgactacatattctgataagggcgccaagcctgagcgtggccgcttcctgcactttcatagtgttaccttctgggtcggaaatgctaaacaggcagccagtttctattgttctaagatgggctttgagcctcttgcctatcgggggttagaaaccggctcacgggaggtggtgtcacatgtgattaaacagggaaagatagtgttcgtcctgtcttctgcactgaacccctggaataaggaaatgggtgatcacctggtgaagcatggcgacggagtaaaagacatcgctttcgaggtagaagattgcgactacattgtgcaaaaggcacgtgaaaggggggctaagattatgcgggagccctgggtggagcaggacaaattcggcaaggtcaaatttgccgtgctacaaacctatggtgatactacccacaccctagtggaaaaaatgaactatattggacaattcctgccagggtacgaggcacctgcctttatggacccactgctgcctaaacttcccaagtgctcattggaaatgattgatcatatcgtgggcaaccagcctgaccaggagatggtgagtgcatccgaatggtacctaaagaacctacagtttcataggttttggagcgttgacgatacacaggttcacactgagtacagctctctccggtccattgtcgttgctaattatgaagaaagcatcaagatgccaataaatgagccagcacccgggaagaaaaaaagccagatacaggagtacgtggactacaatggtggcgccggagttcaacatatcgccttaaagaccgaggacattatcactgccatccggcacctgcgagaaagaggcctcgaatttctcagtgtaccaagtacatactataaacagctaagagagaaactgaaaaccgccaagattaaggtcaaggaaaatatagatgcactggaggaactgaaaatccttgtcgattatgacgagaagggctacctgttacaaattttcacaaagcccgttcaggatcggccaaccctattcctggaggttatacagcggcacaatcatcagggcttcggagctggcaacttcaatagcctatttaaagccttcgaggaggagcaaaatctgcggggaaacctcaccaatatggagacaaacggcgtggtgcctggaatg

SEQ ID NO: 5489 - DNA, 1179 bp, Artificial Sequence
  Description of Artificial Sequence: Synthetic coding sequence
atgaccacgtattctgataaaggagccaagcccgagcggggaagatttctccacttccactctgtcaccttctgggtcgggaatgcgaaacaggcagcctcattctactgctcaaaaatggggttcgagcctttagcctatcgcgggttggaaacggggtcaagggaagtggtgtcacatgtcatcaagcaagggaagatcgtgtttgtgttgtcgtcagccctgaatccctggaacaaggagatgggcgaccatctggtgaaacacggagatggtgtgaaagacatcgctttcgaagtcgaggactgcgactacatcgttcaaaaagcccgggaaaggggagccaagattatgagggagccatgggttgaacaagataaattcggtaaggtgaaattcgctgtacttcagacctatggcgacactacacatactctcgttgaaaaaatgaattatatcgggcagtttttgcctggctacgaggctcccgcgtttatggatcccttgctgccgaagctacctaagtgcagtctggagatgattgatcatatagtgggtaaccaacccgaccaggagatggtgagtgcctccgaatggtacctgaaaaatctgcagtttcatcggttctggtcagttgatgacactcaggtgcatacagagtacagctcattgcggtcaatcgtggtcgccaactacgaagagagtattaaaatgccgatcaatgaaccagcccctggcaaaaagaaatcccaaatacaggagtatgtcgactacaacggcggcgcaggagttcagcacatagccctcaagaccgaagacatcatcactgcgatccgccatttgcgcgaaaggggcctggagtttctgtcagtgccaagcacgtactataagcagctgcgcgagaaattaaagacagccaagatcaaagttaaagaaaacattgacgccctagaagagttaaaaatcctggtggactacgatgagaagggatatttactgcagatctttaccaagcccgttcaggaccgccctacactgttcctggaggttatccagaggcacaatcatcagggattcggcgcaggaaattttaacagtctgtttaaagccttcgaagaagaacaaaatttaaggggcaatcttaccaatatggagaccaatggggtggtacccggaatg

SEQ ID NO: 5490 - DNA, 1179 bp, Artificial Sequence
  Description of Artificial Sequence: Synthetic coding sequence
atgacgacttattcagataaaggcgccaagccagagcggggaagatttctgcacttccattcagtgaccttttgggtgggaaacgctaagcaggccgcgagcttctattgtagcaagatgggcttcgaaccactggcttacagaggtcttgaaaccggttcaagggaagtggtgtcacatgtgatcaagcaggggaagatcgtattcgtgctgagctctgcgctgaatccctggaacaaggaaatgggggaccatcttgtcaaacacggagatggagtgaaggacattgcatttgaggtggaagattgtgattacatagttcagaaagcccgggaaagaggggcaaagataatgagggaaccttgggtggaacaggacaagtttgggaaagtcaagtttgcagtgctgcagacttacggagataccacccatacgctggtggaaaagatgaattacataggtcaattcctccccggatacgaggcacctgcatttatggacccgctgctccctaagttgccaaaatgttcgctcgaaatgatagaccatattgtcggaaatcagcctgatcaagagatggtgtccgcctccgagtggtacctcaagaacctgcaatttcacagattttggagtgtcgatgatactcaggtgcacaccgaatactcatccctccggtcgattgtggtcgcaaactacgaggaatccattaagatgccaattaacgagccagccccaggaaagaaaaagtcgcagatccaggagtacgtggactacaacgggggcgctggagtccaacatattgctctgaaaactgaggacatcattactgcgattagacatctccgagaacggggattggaatttctttcggtcccatccacttactacaaacagctgagagaaaagctgaaaacggcaaagattaaggtgaaggaaaacatcgacgcactggaagagttgaaaatactggtggattacgacgaaaagggataccttttgcaaatctttaccaaaccagttcaagatcgccccactctgtttctggaagttatccaaagacataaccaccaaggtttcggtgcagggaactttaacagcctcttcaaggcattcgaggaggaacagaaccttcgggggaatcttacgaatatggaaactaatggtgtagtgccaggtatg

SEQ ID NO: 5491 - DNA, 1179 bp, Artificial Sequence
  Description of Artificial Sequence: Synthetic coding sequence
atgactacatactcagataagggcgccaagccggagcgcggaagattccttcatttccattctgttaccttctgggtgggaaacgctaagcaagctgcctcattctactgctcaaagatgggctttgaaccactggcctaccgcggattggaaactggctctagggaggtggtttcccatgtcattaaacagggtaagatcgtttttgtcctgagtagcgcccttaatccgtggaacaaggagatgggtgatcaccttgtgaaacatggtgatggagtcaaggatattgctttcgaggtagaagactgcgactatatcgtacagaaggccagggagaggggagccaagattatgcgcgaaccttgggtcgagcaagataagttcggaaaagtcaaatttgccgtgcttcagacctatggagacaccacccacacacttgttgagaaaatgaattatatcggtcaattcctgcctggatacgaggcaccagcctttatggatcctctcctgcccaaactgcctaagtgttctttggagatgatcgaccatatcgtcggcaatcagcccgatcaggaaatggtgtccgcatctgagtggtacctcaaaaacctgcagttccaccgcttttggtcagtggatgacactcaagtgcatacagaatacagctccttgaggagcatcgtggtggctaactatgaggagtctatcaagatgcccatcaacgaacccgctcccggaaagaaaaaaagtcagatacaagagtatgtggactataacggcggtgctggtgttcaacacattgctcttaagacagaggacataatcacagctatccgccatctcagagagcgcggtctcgaattcctctcagtgccgtctacttactataagcagcttagggagaagctgaagaccgccaagatcaaggtcaaggagaatatcgacgcgttggaagaactgaaaatcttggtggattacgacgaaaagggatacttgctccagattttcacgaaaccagtccaggacaggcccaccctttttctggaggtcatccaacgccacaatcaccagggcttcggtgccggaaacttcaattccttgttcaaggctttcgaagaggagcaaaaccttagaggaaatctcaccaacatggaaacaaacggtgtcgtaccaggtatg

SEQ ID NO: 5492 - DNA, 1179 bp, Artificial Sequence
  Description of Artificial Sequence: Synthetic coding sequence
atgactacatattcagataaaggagcaaaacctgaaagaggtagattcctacactttcattcagttacattttgggttgggaacgctaaacaagcagcatcattttattgctctaaaatgggttttgaaccattagcttatagaggattagaaactggatcaagagaagttgtaagtcatgtaattaagcaaggaaaaattgtttttgttttatcaagtgctcttaatccttggaataaagaaatgggagaccatttagttaaacatggagatggagttaaagatattgcatttgaagtagaagattgtgattatattgttcaaaaggcaagagaaagaggagccaaaattatgagagaaccttgggtagaacaagataaatttgggaaggttaagttcgcagtacttcaaacttatggtgatacaacacataccttagttgaaaaaatgaattatattggacaatttcttccaggatatgaagcaccagcttttatggatccattattgccaaaattaccaaaatgttcacttgaaatgattgatcatattgtaggaaatcagccagatcaagaaatggtttctgcatcagaatggtaccttaagaatttacagttccatagattttggtctgttgatgatacacaagtacatacagaatattcatctcttagatctattgttgttgcaaattatgaagaatctattaaaatgccaattaacgagccagctcctggaaaaaaaaaatcacaaattcaagaatatgtggattataatggaggtgcaggagttcaacacattgcacttaaaactgaagatattattactgctattagacatttaagggaaagaggattagaatttttaagtgttccatcaacttattataagcaattaagagaaaaattaaaaacagcaaaaattaaagttaaagaaaatattgatgctttagaagaattaaaaattcttgtagattatgatgaaaaaggatatcttttacaaatttttactaagccagttcaagatcgaccaactctttttcttgaagtaattcaacgacataatcatcaaggattcggtgctggaaattttaattcattgttcaaggcatttgaagaagaacaaaacttaagaggtaatttaacaaatatggaaacaaatggagttgttcctggaatg

SEQ ID NO: 5493 - DNA, 1179 bp, Artificial Sequence
  Description of Artificial Sequence: Synthetic coding sequence
atgaccacttactccgataaaggtgccaagccagagcgcggccggtttctgcatttccatagcgtaaccttttgggttggtaatgccaagcaagcagccagcttctactgctccaaaatgggttttgaaccactggcataccggggcttggaaactggttcacgcgaagtggtttcacatgtcattaaacaaggaaagattgttttcgtacttagcagcgcactgaacccttggaataaagagatgggagatcacctggtgaagcatggggatggcgtgaaggacattgcgtttgaggtggaagattgcgattacatcgtgcagaaggcaagagaaaggggtgcaaagattatgcgcgagccttgggtcgaacaagacaaatttggaaaggttaagtttgccgtgcttcagacttacggcgacaccacccatacgcttgtggaaaagatgaactacattggacagtttctccctgggtacgaggcccccgcatttatggatcccctgcttccaaaactgcctaagtgcagccttgagatgattgaccatattgtgggaaatcaacctgaccaagaaatggtgagcgcctcggaatggtaccttaagaaccttcagttccatcgattctggtctgtggacgatacccaagtgcacactgagtactcctccctgagatcgatagtggtcgcaaattacgaagaatcgattaagatgccgattaacgaacccgcgccaggtaaaaagaagtcgcagatccaggagtacgtcgactataatggtggcgcaggagtccagcatattgctctcaagacggaggacataatcaccgcgatcaggcatctccgggagaggggtctggaatttctgtcggtgccctcgacctactacaaacaattgcgggaaaaacttaagaccgcgaagatcaaagtcaaggaaaacatcgatgctctggaagaacttaagattctcgtcgattatgatgaaaaaggataccttctgcagattttcactaagccagtccaggacaggccaactctgttcctcgaagtcattcagcgccacaatcatcaaggatttggagcgggtaacttcaattcactcttcaaggcatttgaagaagaacagaacctgagaggcaatcttaccaacatggaaacgaacggtgtggtgccaggtatg

SEQ ID NO: 5494 - DNA, 1179 bp, Artificial Sequence
  Description of Artificial Sequence: Synthetic coding sequence
atgaccacgtactccgataaaggcgcgaaaccggaacgcggacgcttcttgcacttccactcggtgaccttttgggtgggcaacgcgaagcaagcggcctccttttactgctccaagatgggattcgagccgctggcatacagaggactcgaaaccggatcccgcgaagtggtcagccacgtgatcaagcaaggaaagatcgtttttgtgttgtccagcgctcttaatccttggaataaggaaatgggcgatcatctggtgaagcacggggacggagtgaaggacatcgcattcgaggtcgaggactgcgactacatcgtgcagaaggcgcgcgaacgcggtgccaaaatcatgcgcgagccttgggtcgaacaggacaagtttgggaaggtcaaatttgctgtgctgcagacctatggagatactacgcatactctcgtggagaaaatgaactacattggccagttcctgcctggatatgaagcaccggcgtttatggatccgctgctgccgaagctcccaaagtgctcgctcgaaatgatcgaccatattgtgggaaatcagccggaccaggagatggtgtccgccagcgagtggtacctgaagaatctgcagtttcatagattctggtcggtggacgacacccaagttcatactgagtactcctccctgcgctccatcgtggttgctaactacgaagagtcgatcaagatgccaatcaacgaaccggcgccaggtaaaaagaagtcacagatccaagaatacgtggactacaacgggggagctggagtccagcatattgcgttgaaaactgaggacattatcaccgctatcagacacctccgcgagaggggactggaattccttagcgtcccaagcacctactacaagcagctccgggaaaagctgaaaactgccaagattaaagtcaaggagaatatcgacgccctcgaagagctgaagatcctggtcgattacgacgaaaaggggtatctgctgcagatcttcacgaaaccagtgcaggaccgcccgactctctttctcgaggtgatacagcgccacaatcatcagggattcggagccggaaacttcaactcactgtttaaagcattcgaagaggaacagaacctgcggggaaacctgaccaatatggaaactaacggcgtggtgcctggcatg

SEQ ID NO: 5495 - DNA, 1179 bp, Artificial Sequence
  Description of Artificial Sequence: Synthetic coding sequence
atgactacctactctgataaaggcgcaaagcccgagcgcggtcgcttcctccattttcacagcgtgacattctgggtcggcaacgctaagcaggcggcgagtttctattgttctaagatgggatttgagccgctcgcttaccgcggattggagaccggttcccgagaggtcgtgtcccatgttattaaacaagggaagatcgtgttcgttctctcctccgccctaaacccatggaacaaggagatgggagatcacctggtcaagcatggcgacggtgtcaaggatatcgcattcgaagtggaagattgcgattacatcgtccaaaaggcccgagagcgcggcgccaagatcatgcgcgagccctgggtcgagcaggataagttcggtaaggtcaagttcgcagtgctccaaacgtacggtgacactactcacacactggtggagaagatgaactacatcggtcagttcctgcccggttatgaagcccccgcgtttatggatcctctacttcccaagttgcccaagtgctccctggaaatgatcgaccacatcgttggcaaccagcccgatcaggagatggtgtctgcttcggaatggtatctgaagaatttgcagttccatcgcttctggagtgtggatgatacccaagtccacaccgagtactcgagtcttcgtagcatcgtcgtggccaactacgaggagtcgatcaaaatgcccatcaacgagccggcgcccggcaagaagaaatcccagatccaggaatacgttgattacaatggaggtgccggcgtgcagcatatcgccctgaagactgaggacatcattacagccatccgacacctgcgcgagcggggtcttgagtttctgtcggtcccttccacctactacaagcagctacgcgagaagttgaaaacagctaagattaaggtgaaggaaaacattgacgcactcgaggagctgaaaatcctggtggattacgacgaaaaaggttacctgcttcaaattttcacgaaaccagtccaggaccgcccaaccctcttcctagaagtgattcagcgccacaaccatcagggattcggagccggcaacttcaactcattattcaaggcgttcgaggaggaacagaatcttcggggtaatctaactaacatggagacgaacggcgttgtcccgggcatg

SEQ ID NO: 5496 - DNA, 1179 bp, Artificial Sequence
  Description of Artificial Sequence: Synthetic coding sequence
atgaccacctactcagataagggagcaaagccagagcggggacggttcttgcatttccactcagtgaccttttgggtgggcaacgcaaagcaagcagcgagcttctattgttccaagatgggttttgaacctctggcctatagggggctggaaactgggtcgagagaggtggtatcgcacgtgattaagcagggaaagatcgtgtttgtgctttcctcggcactgaatccgtggaacaaggaaatgggagatcatcttgtgaagcatggtgatggcgtgaaagacatcgcattcgaagttgaagattgtgattacattgtgcaaaaagcccgagagcgaggagctaagattatgcgggagccttgggttgaacaagacaagtttggcaaggtcaagtttgcggtgcttcaaacctacggagacaccactcacactttggtcgagaagatgaactacattggtcagtttcttcctggttacgaggcgccagcattcatggatcccctgctgcctaagctgcccaaatgctcgctggagatgattgatcacatcgtgggcaaccagccggaccaggaaatggtgtcagcatcggaatggtatttgaaaaacctccagtttcatcggttctggagtgtcgacgatacccaggtccatactgaatactcatctcttcggtcgatagttgtggcaaactatgaagaatcgatcaaaatgccgataaatgaacctgcacctggaaaaaagaaatcacaaatccaggaatacgtggattacaacggcggtgccggagtgcaacacatcgcactcaagactgaggacattatcactgcaatacgtcatcttagggaaagaggtttggaatttctgtcggtcccttcaacctactacaagcagctccgggagaagctgaaaacggcaaagattaaagtcaaggagaacattgatgcactcgaagagcttaagattctcgtggactacgacgagaaaggataccttctgcaaatctttaccaagccagtgcaagatcgcccaaccttgttcctggaagtgatccagcggcataatcatcaaggtttcggagccggtaactttaactccttgtttaaagccttcgaggaggaacaaaatctgaggggaaacctgacgaatatggaaaccaacggagtggtgcctggaatg

SEQ ID NO: 5497 - DNA, 1179 bp, Artificial Sequence
  Description of Artificial Sequence: Synthetic coding sequence
atgaccacatactctgacaagggcgccaagcctgagcgaggcagatttctgcatttccactccgtgacattttgggtgggtaacgcgaagcaagctgcttcattctactgtagcaagatgggtttcgaaccgctggcatataggggactagagacaggcagccgggaggttgtctcacacgttatcaaacagggtaaaatcgtttttgtgctgagctcagccttgaacccgtggaataaggaaatgggggaccatctggttaagcacggtgacggagtgaaagacatcgccttcgaggtcgaagattgtgattatattgtgcaaaaggcccgagagagaggcgcaaagatcatgagggagccttgggtcgagcaagataagtttggcaaggtgaaattcgccgtactccagacctacggtgacactactcataccctggtggaaaaaatgaattatatcggacaatttctgccaggatatgaggctcctgcttttatggaccctctgttacctaagctccccaaatgcagcctggagatgatagatcatatagttggaaaccaaccggaccaggagatggtttccgcatccgagtggtatctgaaaaatctccaattccatcgcttctggtccgtggatgacacacaagtgcatacggaatattcctctctgcgctccatcgtcgtggccaactatgaggagtcaattaaaatgcccatcaatgagcctgcacccgggaagaagaaaagtcagatccaagaatatgtagactacaatggaggagctggggttcagcatattgcactcaagaccgaggacatcattaccgctatcaggcacttaagagaaagggggctcgagttcctctcggtccccagcacatactacaagcagctgagagagaagctcaagaccgcaaagatcaaggtaaaggaaaatattgatgctctggaagagttgaagatcctggttgattatgacgagaagggctacctcctccagatctttaccaagcccgtgcaggacagacccactttgtttctcgaggtgattcagcggcataaccaccaaggatttggagccgggaatttcaattctctgttcaaggcattcgaagaagagcagaatctgagaggaaatctaacgaacatggaaacgaatggggtcgtccccggcatg

SEQ ID NO: 5498 - DNA, 1179 bp, Artificial Sequence
  Description of Artificial Sequence: Synthetic coding sequence
atgacaacatacagtgacaagggagctaagcctgagagaggccggttcctgcacttccattccgtcactttttgggtaggcaatgccaagcaagcagccagcttttactgttctaaaatgggatttgaacctttagcctatcgcgggttggagacagggtcgagagaggtcgtgtcgcatgttattaaacagggtaaaattgtgttcgtgctgtcttcggcccttaacccgtggaacaaggagatgggagaccacctggtgaagcatggcgatggagtgaaagacatcgcattcgaagtggaagactgtgactatattgtccaaaaagcacgggaacgaggagccaaaataatgcgagagccttgggttgaacaggataaattcggtaaggtgaagttcgccgtacttcagacctatggcgacactacgcatacactggtggaaaagatgaactacatcggccaatttctcccaggctacgaagcccccgccttcatggatcccctgcttcccaagctacctaagtgtagcctcgaaatgattgaccacatcgttggcaaccagccagatcaggaaatggtgtccgcctcagagtggtacttgaagaatcttcagttccaccgattttggtcagtggacgacactcaggttcacaccgagtatagcagcttaaggagcatagttgtcgctaactacgaggagtcaatcaagatgccaatcaacgaaccagcaccggggaagaagaaatctcagatccaagaatacgtagactacaacggcggtgctggtgtccagcatatcgcgttgaaaaccgaggatattatcaccgctatcagacaccttagagaacggggactggagtttctgtcagtgccctctacatactacaagcaactacgcgaaaaattaaaaaccgcaaagattaaggtcaaggaaaacatcgacgcgcttgaagagctgaagatccttgtcgattacgatgagaaaggttatcttcttcagatcttcactaagcccgtgcaagacaggcctacattattcctcgaagtcatccagagacataatcaccaggggtttggcgcgggaaatttcaatagcctttttaaggccttcgaggaagaacagaacttacgaggcaatctgaccaacatggagacgaacggtgtggtgcccggaatg

SEQ ID NO: 5499 - DNA, 1179 bp, Artificial Sequence
  Description of Artificial Sequence: Synthetic coding sequence
atgactacctattccgataagggggccaagccggagagaggccgctttctccacttccattccgtgaccttctgggtcggaaacgctaagcaggcagccagcttctactgttcaaaaatgggttttgagccacttgcataccggggtctggagacgggctcgagagaggtggtgtcccacgtgattaagcagggtaagattgtgtttgtgttgagcagcgcacttaacccttggaacaaggagatgggagatcacctcgtgaagcacggggatggagtcaaggatatcgcattcgaggtggaagattgcgactacattgtccagaaagcacgagaacgcggtgcaaagatcatgagagagccctgggtggagcaagataagtttggaaaggtgaaattcgccgtgctgcaaacttacggagacaccacccacaccctggtcgaaaagatgaattacattggtcaatttctcccaggatacgaggcgccggcattcatggaccccctgcttcccaaacttccaaagtgtagcttggaaatgattgaccacatcgtgggtaatcaacccgaccaagagatggtgtcagcatccgaatggtaccttaagaaccttcaatttcatcgcttctggtccgtggacgatacccaagtgcataccgagtactcaagtctccgctcgatcgtggtcgccaactacgaggaatccattaagatgccaatcaatgaaccagctcctggcaagaagaagagccagatccaggaatacgtggattacaacgggggagcaggtgtgcaacatattgcgctcaagacggaggacatcataacggcgattcgccatctgcgcgaacggggacttgaattcctttccgtcccatccacctactacaaacaacttcgagagaaactgaaaaccgccaagattaaagtcaaagaaaacatagatgcccttgaggaactgaaaatccttgtcgattacgatgaaaagggataccttctgcagattttcaccaaacctgtccaggatcggcccaccctttttctggaggtgattcaaaggcataaccaccaaggtttcggagccggcaactttaactctctgtttaaggctttcgaggaggagcagaaccttcgaggaaatcttactaatatggaaaccaacggcgttgtgccaggaatg

SEQ ID NO: 5500 - DNA, 1179 bp, Artificial Sequence
  Description of Artificial Sequence: Synthetic coding sequence
atgacaacttattccgataaaggcgccaaaccggagcgtggccgattcttgcattttcattcggtgacgttctgggtcgggaatgcaaaacaggccgcctccttttactgcagtaaaatgggcttcgagcctttggcgtatcgagggctcgagacaggctcccgagaggtcgtgtcacatgttattaaacagggtaaaatcgtctttgtcttgtctagtgcactcaatccatggaataaagagatgggcgaccaccttgtcaagcacggtgacggtgttaaagacattgcttttgaagtcgaggactgtgactacatcgtccagaaggcacgcgaacggggtgctaagattatgagagagccctgggttgagcaagataaattcggaaaggttaagttcgccgttcttcaaacatatggtgatactacacatacactcgttgagaagatgaattatataggtcaattcttgcccggttatgaagcacccgccttcatggatccattactacccaagcttccgaagtgctcattggaaatgatcgaccatattgtgggtaatcaaccggatcaagaaatggtatccgctagcgaatggtatttgaagaacctccaattccatagattctggtctgtggatgacacccaggtccatacagaatattcttcgcttcgatctatcgtcgtggctaactatgaagagagcataaagatgccgatcaacgaacctgcccccggtaaaaagaaaagccaaatccaagagtacgtggattacaatggcggagcgggggttcaacacatcgccctgaagaccgaggacattattacagcgatccgccatctgcgtgagcgaggattggagttcttatctgttccgtcaacgtactacaagcaactccgagagaagttgaagacggctaagatcaaggtcaaggaaaatatcgacgccctggaggagttgaagatccttgtggactacgacgagaagggctaccttctacagattttcactaaaccggtccaggaccgtccaactctattccttgaagtgattcagcgccacaatcatcaagggtttggggctggaaatttcaactcattatttaaggctttcgaggaagagcaaaacctccgcggtaaccttacaaacatggagaccaacggcgtcgttccaggtatg

SEQ ID NO: 5501 - DNA, 1179 bp, Artificial Sequence
  Description of Artificial Sequence: Synthetic coding sequence
atgaccacctattccgacaaaggtgcgaagcctgagaggggtaggttcctccacttccattcggtgactttttgggttggtaatgctaagcaggcagcctctttttactgcagcaaaatgggattcgagcccctggcctatcgcgggctcgagacggggagccgcgaagtcgtaagccatgtgatcaagcagggtaagattgtgttcgtgttgagtagtgccctgaatccatggaacaaagaaatgggggaccatctcgtaaaacatggagatggcgtgaaggatatcgcttttgaagttgaggattgtgattacattgttcagaaagcaagggaacggggagctaaaataatgagggaaccctgggtcgagcaagataaattcggcaaggtgaagtttgcggttctgcaaacgtacggggacacaacccatacacttgtggagaaaatgaactacatcgggcagtttttgcctgggtatgaggctcccgcttttatggatcccttgctcccaaagcttccgaagtgctcactagagatgatcgatcacatcgtgggaaatcagcctgatcaagaaatggtgtctgcaagtgagtggtatctgaagaatctgcagtttcaccggttctggagcgtggacgacacccaagttcataccgagtatagctctctcagatctatagtggtggcaaattacgaggagtcgataaaaatgcccattaatgaacctgctcctggcaagaagaagtcccagattcaggaatacgtcgactacaacgggggcgccggggtccagcacatagccctgaagactgaagacataattaccgccattcgacacctacgtgagcgcggcttagagttcctatccgtgccgagcacctattacaagcaattgagggaaaaactgaaaaccgctaagatcaaagttaaggagaacatagacgcccttgaagagctgaagatcctggttgattatgacgagaaaggatacctcctccagatctttaccaagcccgtccaagaccgccctaccctgtttttggaggttatccagaggcataatcaccagggcttcggtgcagggaactttaacagcctattcaaagccttcgaggaggagcagaacctgcggggcaacctaaccaacatggaaactaacggcgtggtgcctgggatg

SEQ ID NO: 5502 - DNA, 1179 bp, Artificial Sequence
  Description of Artificial Sequence: Synthetic coding sequence
atgactacgtattccgacaagggagctaagcccgaaagaggacgattcttgcactttcattccgtaaccttttgggtggggaatgccaagcaggctgcctctttctactgcagcaaaatgggcttcgagcctcttgcttatagaggcctcgaaacagggtcacgagaagtggtaagccatgttatcaagcaggggaagatagtttttgtgctttcttctgcactgaacccctggaataaggaaatgggggatcatcttgtgaaacacggagacggagtgaaggatatcgccttcgaagtcgaagactgcgattacattgttcagaaggcgcgggagcgaggtgccaagattatgcgtgagccctgggtggagcaagacaagtttgggaaggtcaagttcgccgtcctgcaaacatatggcgatactactcacaccctcgtagagaagatgaattacataggccagtttctgcccggctatgaagctcctgccttcatggatccactcttacccaaactccctaaatgctcactggagatgatcgaccacatcgtgggaaaccagcccgatcaggagatggtttccgcaagtgagtggtacctgaaaaatctgcagtttcacagattttggtccgtagatgatacccaagtccataccgagtatagctcactccgatccattgtcgttgccaattatgaagaaagcatcaaaatgcccattaatgaacccgcccccggaaaaaaaaaaagtcaaatccaggaatacgtggactataacggaggcgccggggttcaacatatcgccctgaaaacggaagacatcatcacagccatccgacatttacgagaaagagggcttgagttcctgagtgtaccctcaacctattataagcagttgagggaaaagttgaaaacagctaagatcaaggtcaaggaaaacatcgatgcattggaagagctcaaaatccttgtcgactacgacgaaaaagggtatctgctccaaatttttactaagcctgttcaggataggcctaccctgtttctggaggtaattcaacggcacaatcaccagggatttggcgctggaaatttcaacagtttatttaaggcttttgaagaagaacagaatctgcgagggaatctaactaacatggagacgaacggtgtggtcccaggaatg

SEQ ID NO: 5503 - DNA, 1179 bp, Artificial Sequence
  Description of Artificial Sequence: Synthetic coding sequence
atgaccacttattcggacaaaggggccaagccggaacggggacggtttctgcactttcacagcgtgaccttctgggttggaaatgcgaaacaagcagcctccttctactgctccaagatgggctttgagccccttgcttaccgcggactggagacgggaagcagagaagtggtgtcgcacgttatcaagcaggggaagatcgtgtttgtccttagcagcgcactcaatccatggaacaaggaaatgggagatcatctggtcaagcatggggacggcgttaaagacatcgcgttcgaagtggaggactgcgattacatcgtgcagaaagctcgggagagaggcgccaaaatcatgcgagagccatgggtcgagcaagataagtttggtaaggtgaagttcgcagtgctgcagacgtacggagacacgacgcataccctcgtggagaaaatgaactacattggacagttcctcccgggatacgaagctccggccttcatggatccactgctcccgaagctgccaaagtgctcgctggaaatgattgaccatatcgtcggcaatcagccagaccaggagatggtttccgcctccgagtggtacttgaagaacctgcaatttcacagattctggtcagtggacgacacccaagtgcacaccgaatatagctcgctgcgctcgatcgtcgtggccaattacgaggaatccatcaagatgcccattaacgagccggcgccgggtaaaaagaagtcgcagatccaggaatatgtcgactacaacgggggtgcgggcgtgcagcatattgcccttaagaccgaagacatcatcactgccatccgccatcttcgcgagcggggtctggaattcctcagcgttccgtctacctactacaagcagctcagggagaagctgaagaccgcgaaaatcaaagtcaaagaaaacatcgacgctcttgaggagctgaagatcctggtggattatgatgagaagggctacctcctgcaaattttcaccaagcccgtgcaggaccgcccaaccctctttctggaagtaattcagcggcataatcatcaaggttttggagctggcaacttcaattcattgttcaaagccttcgaagaagaacaaaacctgcgtggtaatctcactaatatggaaactaatggagtggtcccagggatg

SEQ ID NO: 5504 - DNA, 1179 bp, Artificial Sequence
  Description of Artificial Sequence: Synthetic coding sequence
atgaccacgtactccgacaagggtgccaagcccgagagaggacgttttctgcatttccactcagtaactttttgggtgggcaacgccaagcaggcggccagtttttattgcagtaaaatgggctttgagccactggcttaccgggggctagaaacaggatctagagaggtggtatcacacgtgatcaaacagggtaagatcgtgttcgtgctgtccagcgccctgaatccatggaataaggaaatgggtgaccatctagtcaagcatggcgacggggtcaaggatattgccttcgaagtcgaagattgcgattacatagtacaaaaagctcgagagagaggggccaagataatgcgagagccctgggtggagcaggacaagttcggtaaggtaaagtttgcagtgctgcaaacctacggggacacaacccacacacttgttgaaaaaatgaactacattggccagttcctgccaggatacgaggctcccgcctttatggacccccttttgccaaagctacctaaatgttctctagaaatgattgatcacatcgtgggaaaccagcctgaccaggagatggtgagcgcctctgagtggtatctcaagaatctgcagtttcaccgattctggagtgtggatgatacgcaggtccatacggaatatagctctctacgctcaatcgtggtcgccaactacgaggagtcaataaagatgccaatcaacgagccagcacctggcaaaaaaaagtcacagatacaggaatatgtggattacaacggaggagcaggcgttcagcacattgctttgaaaaccgaggacattattactgcaatcagacacttgagagagcggggactcgaatttctcagcgttccctcaacttactataaacagttgcgggagaagttaaagaccgccaaaattaaggtcaaggagaatattgacgccctcgaagagctgaagatcttggttgactatgacgaaaaggggtacttgctgcaaatattcacaaagccagtgcaggaccggcccaccttgttcctagaagtgatccagcgccacaaccatcagggattcggtgccggaaactttaactccctttttaaggctttcgaggaggaacagaacctgcgaggcaatctgacgaatatggaaaccaacggggtggtgccgggaatg

SEQ ID NO: 5505 - DNA, 1179 bp, Artificial Sequence
  Description of Artificial Sequence: Synthetic coding sequence
atgacgacctacagcgataaaggtgcaaagcccgagcgggggcgcttcttgcactttcattcggtgactttttgggtcggcaacgcaaaacaagcggcctccttctactgttccaagatgggattcgagccactcgcgtaccggggcctcgaaactggatcgcgagaggtggtgtcacacgtgatcaagcaaggcaagatagtttttgtgctctcgtcggcattgaatccatggaataaggaaatgggtgatcatctcgtcaaacatggagatggcgtgaaggatattgcattcgaggtggaagattgcgactacatagtgcaaaaagcacgagagcgcggggcaaagattatgcgagaaccttgggtcgaacaagataagtttggtaaggtgaagttcgcagtgcttcaaacctacggagatactactcacaccctggtggagaagatgaactacattggacagtttttgcccggatatgaagcacctgcctttatggaccccctgcttccaaagctgcctaaatgcagcctcgagatgattgaccatatagtgggcaatcagcctgaccaagaaatggtttcggcgtcagaatggtaccttaagaatctccagtttcacagattttggtccgtcgacgatacccaggtgcacaccgaatacagctcgcttcgatcgattgtcgtcgcgaattacgaagaatccattaagatgcccattaatgagcctgccccaggtaagaagaagtcacaaatccaagaatacgtggattacaacggaggcgcaggcgtgcagcacatagcactcaagaccgaggatatcataaccgccattcgtcatctgcgcgaaagaggacttgaattcctctccgtgccttcgacctattacaagcaacttagggagaaacttaagactgcgaagatcaaagtgaaagaaaacattgatgcactcgaagagcttaagattcttgtggattacgatgagaagggttacctgctgcagatctttactaaacctgtccaggaccggcccacccttttcctggaagtcatccagagacataaccaccagggttttggagctggtaacttcaactcgttgttcaaggcatttgaggaagaacagaacctgagaggaaaccttaccaacatggaaaccaatggcgtggtgcctggaatg

SEQ ID NO: 5506 - DNA, 1179 bp, Artificial Sequence
  Description of Artificial Sequence: Synthetic coding sequence
atgacaacttacagtgataagggagctaagcctgagcgcgggcggtttcttcatttccactccgtcactttctgggtaggcaacgcaaaacaagctgcttcattttattgcagtaagatgggttttgagcctcttgcgtataggggtctggaaacgggctcaagggaggttgtttctcacgtcattaagcaaggcaagatagtttttgtactatcaagtgcactgaatccgtggaacaaagagatgggagaccatctggtgaaacatggcgatggggtgaaagatattgccttcgaggttgaagactgtgattatattgtccaaaaggcaagggagcggggggccaaaattatgagagagccatgggtcgagcaggacaagttcggcaaggtgaagtttgctgtactgcagacctacggcgacacgacccatacacttgtagagaagatgaactacatcggtcagtttctgcccgggtacgaagccccagcctttatggaccccctactgcccaaattaccaaagtgctctcttgagatgatcgaccatatagtgggtaatcaacccgaccaagaaatggtgtctgcctcagagtggtacttaaagaatcttcagttccatcggttttggagtgtggacgatacacaggtgcacacagaatacagcagccttcggagtattgtagttgctaactatgaggaatctatcaagatgcccattaacgagcctgcaccaggaaagaagaaatcccagatacaagagtacgtggactacaatggcggcgcaggggtacaacatatagcccttaaaaccgaagatatcattacggctatccggcacctgcgcgaaagaggtctggaatttttgtctgttccctccacatattataagcagcttcgggagaagctgaaaacggcaaagattaaagtgaaagagaacattgacgctctggaagagctgaagatcctggtcgactacgacgagaaagggtatctgctgcagatctttacgaagcctgtgcaggacagacccactctcttcctcgaagttattcagcggcataaccatcagggtttcggcgctggtaattttaattctctctttaaagctttcgaagaggaacaaaatctgcgagggaacctgacaaatatggagacgaatggggttgtacctggtatg

SEQ ID NO: 5507 - DNA, 1179 bp, Artificial Sequence
  Description of Artificial Sequence: Synthetic coding sequence
atgaccacatactccgacaagggggccaaaccggagcgaggacggttcctgcacttccatagcgtgactttctgggtcggcaatgcaaagcaggccgcgtccttctattgcagtaagatgggtttcgagccactggcttatcggggcctagagaccggaagcagggaggtagtctctcatgttatcaagcagggcaaaatcgtctttgtcctcagcagcgcccttaatccttggaataaggagatgggagatcacctggtaaaacatggggatggagttaaagatattgcttttgaggtagaggattgtgattatatagttcaaaaagccagggaacggggtgccaaaattatgcgagagccttgggtcgaacaagataaatttggaaaggtgaaatttgcagtgctccagacctacggcgacacgacgcacaccctggtggaaaagatgaactatatagggcagttcctgccgggatacgaagcccccgccttcatggatcccttacttccaaaacttcctaaatgctcattggaaatgattgaccacatcgtggggaatcagccagatcaggagatggtatccgcctctgagtggtacttaaaaaacttgcagttccaccggttttggagcgtggatgatacgcaagtacacacggaatattcctctctgagaagtatcgtagtcgcgaactacgaagaaagtataaagatgcctattaatgagcctgctccgggcaagaagaagagccagattcaggagtacgtggattacaatgggggagccggagtccagcatattgccctgaaaacagaagacataatcacggctatccggcatctccgtgagcgggggttggaatttctgagtgtgccctcaacctattacaagcaactccgcgaaaagctcaagacagccaagatcaaagtgaaggaaaacatcgatgccctggaagagcttaagattcttgtggactatgacgagaagggatatctgctgcagatttttacaaagcccgtgcaggatcgcccgaccctattcctggaagttatccagcgacacaatcatcaggggttcggtgcgggtaactttaacagcttatttaaagctttcgaggaggagcagaaccttcgaggtaatcttacaaacatggagacaaatggtgtggtcccggggatg

SEQ ID NO: 5508 - DNA, 1179 bp, Artificial Sequence
  Description of Artificial Sequence: Synthetic coding sequence
atgaccacatacagcgataaaggcgccaagcccgagagaggtagattcctccatttccactccgtgactttttgggtcggtaacgccaaacaggccgctagcttctactgcagcaagatgggatttgagcccttggcttataggggtctggagacaggttcccgcgaagtcgtttcccacgtgataaagcaaggtaaaatcgtgtttgttctctcctctgccctcaatccatggaacaaggagatgggcgaccatctggttaagcacggagacggtgtcaaggacatcgcattcgaagttgaagactgcgactatattgtgcagaaggctagggagcgcggtgcaaagatcatgcgtgagccatgggttgagcaggacaagttcggcaaggtcaagttcgccgtcctgcagacttatggtgatactacacatacattggtcgagaaaatgaattacatcggacagttcttgccaggttacgaagcacccgctttcatggatcccctgctgcctaagttgcctaagtgttctcttgagatgatcgaccacatcgtgggaaaccagcccgaccaagagatggtgtccgcttctgagtggtacctcaagaacctccaatttcatcgcttctggtctgtcgacgacactcaagtgcataccgagtattcctctcttaggtcaattgtagtggccaattacgaagaaagcatcaagatgcctataaacgagccagctcctggcaagaaaaaatcccagattcaggaatacgtggactacaacggcggagctggtgttcagcacattgcccttaaaaccgaggatatcatcacagcaattagacacctccgcgagcgcggactcgaatttctctcagtgcccagcacttactataagcaattgcgcgagaagttgaaaacagctaagatcaaggtgaaagagaatatcgacgccctcgaggaactgaagatcctcgtcgactacgacgaaaagggatacctgttgcagattttcaccaagcctgtgcaggacaggcccacactgtttctcgaggtgatccaacgtcacaaccaccaaggatttggcgctggtaactttaatagcctgttcaaagccttcgaggaggaacagaatctgaggggaaatctgaccaacatggagactaatggcgttgtaccaggtatg

SEQ ID NO: 5509 - DNA, 1179 bp, Artificial Sequence
  Description of Artificial Sequence: Synthetic coding sequence
atgaccacttacagtgataagggagcaaagccggaacgcggacggttcttgcacttccactcagtcacgttctgggtgggaaacgcaaaacaagcggcgagcttctactgttctaagatgggattcgagcctctggcttacagaggacttgagactggatccagagaggttgtgtcacacgtgataaagcagggaaagatcgtgttcgtgctgtcgtcggcattgaacccttggaacaaagagatgggagatcatctggtcaaacacggagatggagtgaaggacatcgcctttgaagtggaggattgtgattacatcgtgcagaaagcccgggagagaggagctaagatcatgcgagagccgtgggtggaacaagataagttcggcaaggtgaaatttgcggtcttgcagacctacggagacaccactcatacgctggttgagaaaatgaattacatcgggcaatttctgcccggatacgaggcaccagcgttcatggatccgctcctcccaaagctgccgaagtgcagcctcgagatgatcgaccacattgtgggaaaccaacctgaccaagaaatggtgtccgccagcgaatggtatttgaagaaccttcagttccatcgcttctggagcgtggacgacacccaggtgcataccgaatactcgagcctgcgctcgatcgtggtggccaactacgaggaatcgatcaagatgccgatcaatgagccggcgccgggtaagaaaaagagccagatccaggaatacgtggactataacggcggagcgggagtccaacacatcgccctcaaaaccgaggacattatcaccgcaatccggcacctccgcgaaagaggcctggagtttctctcagtcccttccacgtattacaagcaactcagagagaagctcaaaactgcaaagatcaaggtgaaggagaatatcgacgcactggaagaactgaagatcttggtggattacgacgaaaagggatacctgctgcaaatctttactaaaccagtgcaggaccgcccgactctgtttctggaagttatccaaaggcacaaccatcagggatttggggctggaaactttaactcgcttttcaaggccttcgaggaagagcaaaaccttcggggaaacctcaccaacatggagactaatggggtggtgccaggaatg

SEQ ID NO: 5510 - DNA, 1179 bp, Artificial Sequence
  Description of Artificial Sequence: Synthetic coding sequence
atgaccacatacagcgacaagggcgcaaaaccagaacggggaaggtttctgcatttccactctgtgacattttgggttggtaatgccaagcaggctgcaagcttttactgcagcaagatgggattcgagccactagcttaccgaggcttggagacgggctccagggaggttgtgagtcacgtgattaagcagggtaagattgtgttcgtcctgagctccgctctcaatccatggaacaaggaaatgggagaccacctggtcaagcatggcgacggggtcaaggacatcgcattcgaggtggaggattgcgattacattgtccaaaaagcgagagagcggggggcaaaaatcatgcgagaaccctgggtcgaacaggataagtttggcaaagttaagtttgctgttctgcagacgtacggcgacacaacgcacacactggtggagaagatgaattatattgggcagtttctgcctggatacgaagcaccggctttcatggaccctttactgcccaagctgccaaaatgctccctggaaatgatcgatcatattgttggaaaccaaccggatcaagagatggtttctgcgtccgagtggtaccttaaaaatctgcagttccaccggttttggtccgtggatgatactcaggttcacaccgaatactcctcgctaaggagcattgtagtggctaattacgaagaaagtataaagatgcctataaacgagcccgctcctgggaagaagaagtcacagatacaggaatatgtcgactacaacggcggagcgggagttcagcatattgcccttaagacagaggacatcataacagctattcggcatctgcgagaacgcggcctggagttcctctctgtcccttctacatactataagcagctcagagaaaaacttaaaaccgcaaagattaaggttaaggaaaatatcgatgcgttggaggagctcaagattctggtcgactatgacgaaaagggctacctgctccagatcttcacgaaacccgtgcaggacagacctactctttttcttgaggtgatccaacgccacaatcatcagggcttcggtgccggaaacttcaattcgttgtttaaagccttcgaagaggaacagaatctcagggggaacttgaccaatatggagaccaacggagtggtgcctggcatg

SEQ ID NO: 5511 - DNA, 1179 bp, Artificial Sequence
  Description of Artificial Sequence: Synthetic coding sequence
atgacaacttattccgacaagggcgctaagccggaacgcgggcgattcctgcacttccactccgtgacgttctgggtcggaaacgccaaacaggccgccagcttctactgctcgaaaatgggcttcgagcccctagcctaccgcgggctggaaaccggaagccgggaggtggtgtcccatgtcatcaaacaagggaagattgttttcgtgctgtcctcagccttgaacccctggaataaggagatgggagatcacctggtgaaacacggtgacggcgtgaaggacatagccttcgaagtcgaagattgtgattacatcgtccagaaagcgagagagaggggcgccaagatcatgcgcgaaccttgggtggagcaagacaagttcggtaaggtaaagttcgctgtgttgcaaacatatggcgataccacacatacgctggttgagaagatgaattatatcggccagtttctccccggctacgaagcccccgccttcatggatccacttctgccgaagctgccgaagtgcagcctggagatgatcgatcacatagtcggcaaccaaccagaccaggaaatggtctccgcatccgaatggtacctgaagaatctgcagttccaccgtttctggtccgtggatgatacgcaggtacacacggagtactccagtttgaggagtattgtggtcgccaactacgaagaaagtatcaagatgccaatcaatgagcctgcgcctggcaagaaaaagtcccagatacaagagtatgtagactacaatggaggggccggcgtgcagcacattgccctgaaaacggaggatatcatcaccgccatcaggcatcttcgagaaaggggtctagagttcctgagcgttccttcgacctattacaaacaactacgcgaaaagctgaagacagccaaaattaaggtgaaggagaacatcgatgcccttgaggaactgaaaattctggtcgactatgacgagaagggttacctactccaaattttcactaagcctgtgcaagaccgtccgacgctgttcctggaagtcatccaacggcataaccatcaaggcttcggtgctggtaatttcaatagcctgttcaaggccttcgaagaggagcaaaacctgcggggcaatttaactaatatggagacgaacggagtcgtccccggtatg

SEQ ID NO: 5512 - DNA, 1179 bp, Artificial Sequence
  Description of Artificial Sequence: Synthetic coding sequence
atgactacgtattcggacaaaggggcaaaacctgagagaggccgttttttgcactttcatagtgtgaccttctgggttgggaatgccaagcaggcagcttccttttattgctccaagatgggtttcgagcccctggcgtaccggggactcgagactggatcacgggaggtcgtgtcacacgtcattaaacaaggaaaaatcgtctttgtactgtctagcgcacttaatccatggaataaggaaatgggcgaccacctagttaaacacggggatggcgtgaaggacatcgctttcgaggtggaggattgtgactacatcgtacagaaagccagggaacgcggggcaaagattatgagggagccctgggtggagcaagataaatttggtaaggtcaaattcgccgtgctgcagacgtacggggacactacgcacacattagtggaaaagatgaactatatcggacagtttctgccaggatatgaagcacctgctttcatggatcctttactccccaaactgcctaagtgctcattggaaatgattgatcatattgtgggcaaccaacccgatcaggaaatggtgtcagctagcgaatggtatttaaagaacctccagttccatagattttggagcgtagatgacacacaggtgcatacagaatactcttcccttagatctatcgtggtggccaactacgaagagagtatcaaaatgcccattaatgaacctgctcctgggaaaaagaaaagccagattcaggagtacgtggattacaatggaggggccggcgtgcagcacatcgcccttaagaccgaggatattataactgcaatcaggcacctgcgagaaagaggactcgagttcctgtccgtgccatccacttactacaaacaactgagggagaagctgaagaccgctaaaatcaaagtcaaagaaaacattgatgcattggaggagctgaaaatcttggtggactatgatgaaaagggctacctcttacaaatcttcacaaaacccgtgcaggatcggcccactctcttcttagaggtcatccagagacataaccaccaaggcttcggggcaggtaacttcaatagccttttcaaggcattcgaggaggagcaaaatctgcggggcaaccttaccaatatggagacaaatggagtcgtgccaggcatg

SEQ ID NO: 5513 - DNA, 1179 bp, Artificial Sequence
  Description of Artificial Sequence: Synthetic coding sequence
atgactacatacagtgataagggcgctaaacccgagagagggagatttctgcactttcactctgtcacattttgggtgggtaatgcaaaacaggccgcaagcttctactgcagtaagatgggatttgagcccctggcataccgagggttggagactggtagtagggaggtggtgagtcacgtcattaagcagggaaagatcgtcttcgtcctgagcagcgcgctcaatccgtggaataaagagatgggagatcacctggtgaagcatggcgatggggtaaaggatatcgcgttcgaagtcgaggattgcgattatatcgtccagaaggctagggaaagaggcgccaagattatgcgcgagccctgggtggagcaggacaagtttgggaaggtgaagtttgccgttctgcagacctacggcgacacaactcacaccctggtcgagaaaatgaactatattggacagttcctgcccggctatgaagctcccgctttcatggaccctctgctgcctaagctgccgaaatgcagtctcgagatgatcgaccatattgtgggcaatcagcccgaccaggaaatggtcagtgccagcgaatggtatctgaagaacctgcagttccatcgcttttggagtgtagatgatacgcaagtccacacagagtattcttccctgaggtccattgtggtcgctaattacgaggaaagcatcaagatgcctatcaatgagcctgcccctggcaaaaaaaaatcacaaattcaggaatacgtagactacaatggaggcgcaggagttcaacacattgcactcaagaccgaagacattatcactgcaatccggcacctgagggagagaggtctggagtttctgtccgtgccttcaacttactataagcaactgagagagaaactcaagacggctaaaattaaagtgaaagagaatattgacgctcttgaggagctgaaaatcttggtcgactacgatgaaaaaggatacctcttgcaaattttcaccaagccagtgcaggaccgccctaccttgtttctggaagttatacagcggcacaaccaccaaggtttcggtgccggcaactttaattctctgttcaaggcattcgaggaggagcagaacctgagaggcaacctgactaacatggagacaaatggagtcgtgcctggtatg

SEQ ID NO: 5514 - DNA, 1179 bp, Artificial Sequence
  Description of Artificial Sequence: Synthetic coding sequence
atgactacctacagtgacaagggcgcgaaacccgagaggggtcgtttccttcacttccacagcgtgacattttgggttgggaatgccaaacaggctgcgagcttctactgttcaaagatgggatttgagcctttggcctatcggggacttgagaccggaagcagagaagtggtatctcacgtgatcaagcagggcaagatcgtcttcgtactgtcatctgccttgaatccttggaataaagagatgggcgaccaccttgtgaaacacggcgatggcgtgaaggatattgccttcgaggtcgaggattgcgattatatcgtacaaaaggcaagagaacgcggcgccaagataatgcgtgaaccttgggttgagcaagacaagttcggaaaagtcaaattcgcagtgcttcagacctatggagacacaactcacaccttggtggaaaagatgaattacattggccagttcctccctgggtatgaagctccagcctttatggatccattgttgccaaagctcccgaagtgcagcctggagatgatagatcatattgtgggtaaccagcctgatcaggaaatggtttcagcaagcgaatggtacctaaaaaatctgcaattccacagattttggtccgtggacgacactcaggtgcatacagagtatagctctctccgaagcattgtggtggcgaattatgaggaatctataaagatgcccataaatgagccagctcctggtaagaaaaaatctcagattcaagaatatgtggactacaatggcggggctggggttcagcacattgctctgaagaccgaggacattattacagccattcggcaccttagggaacggggtttggaattcctctctgtcccttcaacatattacaaacaactgcgcgagaaactgaagaccgcaaagattaaggttaaagaaaacatcgacgccttagaggagctgaagatacttgtcgactacgatgaaaaagggtacctgctgcagattttcacaaagcctgtccaggatcggccaactttgttcctggaagtcatccagcggcacaaccaccaaggctttggggcagggaacttcaatagcctttttaaggccttcgaggaggagcagaatcttcgggggaacctgacaaacatggagactaatggcgtcgtacctggcatg

SEQ ID NO: 5515 - DNA, 1179 bp, Artificial Sequence
  Description of Artificial Sequence: Synthetic coding sequence
atgaccacctactcagacaaaggagccaagcctgaacgcggacgcttcctgcattttcattccgtgaccttttgggtgggaaacgccaaacaagccgcttcgttctactgcagcaagatgggattcgaacccctcgcatacagagggctggaaactggatcccgggaggtcgtgtcgcacgtcattaagcaaggaaagattgtttttgtgctgtcgtcggccctcaacccttggaataaggaaatgggcgatcacctggtcaagcacggcgacggtgttaaggacatcgccttcgaggtggaggattgtgactacatcgtgcaaaaagctcgcgaacggggagccaagatcatgagggagccatgggtggagcaggataagtttggcaaggtgaagtttgcggtgttgcagacgtacggagacaccactcatacgctggtagaaaagatgaactacatcggacagttcctcccaggatacgaagcaccagcttttatggatccgctcctcccgaagctccccaaatgctcgctggagatgatcgaccacatcgtgggaaaccaacccgaccaggaaatggtcagcgcctcggaatggtacttgaaaaacctgcaattccacagattttggtccgtcgacgacacccaagtgcataccgaatactcatcgctccgctcaatcgtggtcgccaactacgaggaatcgattaagatgccaatcaacgagccggcgccgggtaaaaagaagtcacagatccaggagtatgtggactacaacggaggagcgggcgtgcagcacatcgcactgaaaactgaggatatcatcactgccatccggcacctgcgcgaaaggggccttgagttcctgtccgttccgagcacctactataagcaacttcgggaaaagctcaagaccgccaagatcaaggtcaaggagaatatcgacgcgcttgaggagctgaagatcctcgtcgactatgacgaaaagggatacttgctgcaaatcttcaccaagcctgtgcaggatcgcccgactctgtttctcgaggtcattcagaggcataaccaccaaggattcggcgcaggaaactttaacagcctgttcaaagcgttcgaggaggaacaaaatctgaggggaaacctcactaatatggagactaacggagtggtcccaggtatg

SEQ ID NO: 5516 - DNA, 1179 bp, Artificial Sequence
  Description of Artificial Sequence: Synthetic coding sequence
atgactacgtactcggacaagggagcaaagccggagcgaggaagattcctgcacttccatagcgtgactttctgggtgggaaacgctaagcaggccgcatcgttctactgctcgaagatgggctttgaacccctggcgtaccggggactggaaaccggctcgcgcgaggtggtgtcgcacgtcatcaagcagggtaaaatcgtctttgtcctgtcatcggccctgaacccttggaataaagaaatgggagatcatctggtgaaacacggagacggagtgaaagatatcgcctttgaggtcgaggattgtgactacatcgtccagaaggctagggaacgcggcgctaagatcatgcgagaaccgtgggtcgagcaagacaagttcggaaaggtgaaattcgcagtgctgcaaacttacggagacaccactcataccctggtggaaaagatgaactacatcggccaatttctgccgggatatgaggcgcctgcattcatggatccacttctgccaaagctccctaaatgttcactggaaatgatcgaccacatcgtgggaaaccagccggatcaggagatggtgtcagcgtcggaatggtacctgaaaaaccttcaatttcatagattctggtcggtggacgatactcaagtgcacactgagtattcctccctccgcagcatcgtggtggccaattatgaggagtcgatcaagatgccaatcaatgaacccgccccagggaaaaagaaatcacagattcaagaatatgtcgactacaacggaggagctggagtgcagcacatcgccctgaaaactgaggacattatcaccgcgatccggcacttgagggagcgcggactcgagttcctctcagtgcccagcacctactataaacagcttagagagaagctcaagaccgcgaagattaaggtgaaggaaaacatcgacgcactcgaggaattgaagattctcgtggattacgacgaaaagggatacttgttgcagatctttaccaaacccgtgcaagacagacctaccctgttcctggaagtgattcagcggcataatcaccaaggattcggggcgggtaacttcaacagccttttcaaagcctttgaagaagaacagaatctgagaggaaacctcactaacatggaaaccaatggagtagtgccgggcatg

SEQ ID NO: 5517 - DNA, 1179 bp, Artificial Sequence
  Description of Artificial Sequence: Synthetic coding sequence
atgactacgtactctgataagggagccaaacctgagcgcggtcgcttcctccacttccactcggtgactttctgggtcggaaacgccaagcaggccgccagcttttactgcagcaagatgggatttgaacccctcgcatacagggggctggaaactggatcaagggaggtggtgtcgcatgtcattaaacaggggaagatcgtgttcgtgctgtcctcggctttgaacccttggaacaaggagatgggcgaccatctcgtgaagcatggcgatggtgtgaaggacatcgcgttcgaggttgaagattgcgactatatcgtgcagaaagcacgggagagaggtgcgaagatcatgagggaaccttgggtcgaacaggacaagttcggcaaggtcaagtttgccgtcctgcagacctacggcgacaccactcatacgctggtcgaaaagatgaactacatcgggcagttcctgccgggatacgaagctcccgcctttatggacccgctgctgccgaagctgccaaagtgctcactggagatgatcgatcacatcgtgggcaatcagcccgaccaggaaatggtgtcggctagcgagtggtacctgaaaaacctgcagttccatagattctggagcgtggatgatactcaagtgcacaccgaatactctagcctgcgcagcatcgtggtggctaattacgaagagtccatcaagatgccaatcaacgagccggccccggggaaaaagaaatcacagatccaagaatacgtggactataatggaggtgcgggggtgcagcacatcgcgctcaaaactgaggatatcatcactgcaatcagacacctgcgtgaacggggccttgaattcttgtcggtgcccagcacctactacaagcaactccgcgagaaactgaaaactgcgaaaatcaaggtcaaggagaacatcgacgccctggaggaactgaaaatcctggtggactatgatgaaaagggttacctgttgcaaatcttcactaaaccggtccaggatcggcctactctctttctggaggtgatccaaagacacaaccaccaaggatttggcgccggtaacttcaatagcctcttcaaggctttcgaggaggaacagaatctgcggggaaacctgacgaacatggaaaccaacggtgtggtcccggggatg

SEQ ID NO: 5518 - DNA, 1179 bp, Artificial Sequence
  Description of Artificial Sequence: Synthetic coding sequence
atgactacatacagtgataaaggggctaaacccgagcggggtcggttcctgcactttcatagcgttacgttctgggtggggaacgccaagcaggcagcaagcttttattgcagcaagatgggttttgagcccctagcgtatcgtggcttagagacaggatcgagggaggtggtcagtcatgtcattaaacaaggcaagatcgtctttgtcctttcctccgccctcaatccctggaataaagaaatgggcgaccatctggtcaagcacggggacggtgtcaaggacatcgcatttgaggtcgaagactgcgattatattgtgcaaaaagctagggagaggggagctaagattatgcgtgagccatgggtggagcaggataaatttggcaaagttaagtttgcagtgctgcagacctatggagatacaacacataccctggtggagaagatgaattacattgggcagtttctccctggttacgaggcgcccgcctttatggatccacttctccctaagctgcccaaatgttccttggagatgattgaccacattgtgggaaatcagcccgatcaggagatggtcagcgcatccgaatggtacttgaagaatctgcagttccacaggttttggagcgttgacgacacacaggtgcataccgaatatagctcactgaggagcattgtggtcgcaaattacgaggagagcatcaagatgcccatcaatgaacccgcaccgggcaaaaaaaagtctcagatccaagaatacgtagactataacgggggggccggcgtccagcatattgccctcaagactgaggatattattaccgccatccggcacctacgcgagcggggccttgagttcctctccgttccgagcacatactataaacagctgagagagaagctcaagaccgccaagatcaaagttaaggagaatatcgacgctcttgaggagttgaaaattctcgtcgactacgacgagaaagggtatctgctgcagatcttcacaaaaccggtgcaggataggccaactttgtttctggaggtgatccagcgacacaaccaccaggggtttggcgcgggcaacttcaatagtcttttcaaggcgtttgaggaagagcagaatctgcggggcaacctaacaaacatggagacgaatggagttgtgcctggcatg

SEQ ID NO: 5519 - DNA, 1179 bp, Artificial Sequence
  Description of Artificial Sequence: Synthetic coding sequence
atgacaacctactccgataagggtgctaagcctgagaggggcagattcctgcacttccatagcgttactttttgggtgggcaacgccaaacaggctgcaagtttttactgctcaaagatgggcttcgaacccctggcctatcgagggctggaaaccgggagcagagaagtcgtgagccatgttatcaaacagggcaagattgtgttcgtgttgtcttccgcactgaacccatggaataaggaaatgggggatcatttggttaaacacggtgacggagtgaaggacatcgcctttgaagtggaagattgtgactatatcgtgcagaaggccagggagaggggagctaagattatgagagagccttgggttgaacaagataagttcggcaaggtcaaattcgcagtcctgcagacctacggggacacaacccacaccctcgtggagaagatgaattacattggtcagttcctccctgggtacgaagcacctgccttcatggaccccctgctgccgaaacttccgaaatgctccctcgagatgattgaccacattgtcggaaatcaaccagaccaagaaatggtgtcggctagtgagtggtacctaaaaaatctccagttccatcgattctggtctgtggacgacacacaggtccacactgaatacagttccctcaggtctatcgtggttgccaactacgaagaatccatcaagatgcctatcaacgaacctgcccccggaaagaagaagtcccagattcaggaatacgtcgactataatggcggggccggcgtgcagcatatcgctctcaagactgaagatattatcactgccataagacaccttcgagagcgtggcctggaattcctgtccgtcccctctacatattacaagcagctgcgggaaaagttgaagaccgctaagattaaagtgaaggaaaacattgatgccctagaggagctgaagattctggtggactacgatgagaaaggctatctcctccaaatatttacaaagccagtgcaagatcgtcccactttatttctggaggttatccagaggcacaatcaccagggtttcggggcaggaaacttcaactccctattcaaggcgtttgaggaagagcagaacctgcgtggcaatctcactaatatggaaactaatggggtagttcccggcatg

SEQ ID NO: 5520 - DNA, 435 bp, Artificial Sequence
  Description of Artificial Sequence: Synthetic coding sequence
atgagcactgagggaggtggacgccgctgtcaggctcaagtctcccgccgcatctccttcagtgcctcccaccggctgtacagcaagtttctgtcagatgaggagaacctaaagcttttcggtaagtgcaataaccccaacggccatggccataactacaaggtggtcgtgacggtccacggtgagattgatccagccacgggtatggtaatgaatctggcggacctcaaaaagtacatggaggaagccataatgcagccactcgatcataagaatttggatatggatgtgccgtacttcgcagatgtggtctccacgacggaaaatgtggctgtgtacatatgggacaacctacaaaaggtgctgccagtcggagtgttgtacaaagtcaaggtatatgaaacagacaataatatcgttgtgtacaagggcgag

SEQ ID NO: 5521 - DNA, 435 bp, Artificial Sequence
  Description of Artificial Sequence: Synthetic coding sequence
atgtccactgagggagggggccgccggtgccaggctcaggttagccggagaatcagcttcagtgctagtcatcgcttatacagcaagttcttatcggatgaagaaaacctaaagctcttcggaaaatgtaacaatcccaacggccacgggcacaattataaagtcgtggtgacagtgcacggggagatcgatcctgccacaggtatggtgatgaatctcgcagatctcaagaagtacatggaagaggcgataatgcagccattagaccacaaaaatcttgacatggatgtaccatactttgccgacgtggtttccaccactgagaacgtggcagtttacatctgggataacctgcagaaagtcttgcccgtcggggtcctctacaaggtcaaggtttacgaaacggataacaatatagttgtctacaaaggtgag

SEQ ID NO: 5522 - DNA, 435 bp, Artificial Sequence
  Description of Artificial Sequence: Synthetic coding sequence
atgtcaacagagggcggcggtagacggtgccaggctcaggtgtcacgacggattagcttcagcgcaagccaccggctctactccaagttcctgtccgatgaagaaaacctcaaactgttcggtaaatgcaataacccaaatggacatgggcataactataaggtcgtcgtgaccgtccacggggaaattgatccagcgacagggatggtgatgaaccttgcagaccttaagaaatacatggaggaagcaattatgcagcccttggatcacaaaaatttggatatggacgtgccctattttgcagacgtcgtgtcaaccaccgagaatgtggccgtgtacatttgggacaatctgcagaaggtgcttccggtgggagtactttacaaagtgaaggtgtacgaaacggataataacatcgtggtttacaagggagaa

SEQ ID NO: 5523 - DNA, 435 bp, Artificial Sequence
  Description of Artificial Sequence: Synthetic coding sequence
atgtctaccgagggcggcggcagaagatgtcaggctcaggtatctcggaggatttcatttagcgccagccacaggctctacagtaagttcctgagcgacgaagagaatctcaagcttttcggtaaatgtaacaacccgaatggccacgggcacaattacaaagtcgtcgtgacagtccacggtgaaattgacccagcaaccgggatggtaatgaacctggcggatctcaaaaaatacatggaagaagccatcatgcagcctctggaccacaagaatctcgatatggatgtcccttacttcgctgatgtggtctccacaactgagaatgtcgccgtgtacatttgggacaacctgcagaaggtcttgcctgtgggagtgctgtacaaggtcaaagtatacgaaacagacaacaacattgtggtgtacaagggggag

SEQ ID NO: 5524 - DNA, 435 bp, Artificial Sequence
  Description of Artificial Sequence: Synthetic coding sequence
atgtccaccgagggaggaggacgccggtgccaggcccaagtgtcccggcggatatccttcagcgcttcccatcgtctgtacagcaagttcctctcggacgaagaaaatctcaaattgttcgggaaatgtaacaatccgaatggtcatggccacaattacaaggtggtcgtcactgtgcatggtgaaattgatccagcaaccggcatggtcatgaaccttgcagatctcaaaaagtacatggaagaagccatcatgcagcctctcgatcacaagaacctggacatggacgtgccgtacttcgcagatgtggtgtcgaccactgagaatgtcgcggtgtacatttgggacaacttgcagaaggtcctgccggttggagtgctgtacaaggtgaaagtgtacgaaaccgacaataacattgtggtgtataagggcgaa

SEQ ID NO: 5525 - DNA, 435 bp, Artificial Sequence
  Description of Artificial Sequence: Synthetic coding sequence
atgtccactgaaggcggcggaaggaggtgtcaagcacaggtcagccgcaggatatccttctccgcaagccatcgtctctatagtaaattcctcagtgacgaagagaacctgaagttattcgggaagtgtaataacccaaatgggcatgggcacaattataaggtggtggtgactgtgcatggggaaatcgaccccgccaccggcatggtcatgaacctcgctgatttgaagaagtacatggaagaggccatcatgcaacctttggatcacaagaacctggacatggacgtaccttacttcgctgatgttgtgtccaccactgagaatgtagccgtgtatatttgggacaatctgcagaaggtgctacccgtcggtgtgttgtataaggtgaaagtgtacgagactgacaataacatagtggtttacaagggagaa

SEQ ID NO: 5526 - DNA, 435 bp, Artificial Sequence
  Description of Artificial Sequence: Synthetic coding sequence
atgagcactgaaggaggcggccggaggtgccaggcccaagtgtccaggcggatttcattctcggcctcgcaccggctgtactcgaagtttctgtccgacgaggagaatctgaaactgttcggtaagtgcaataaccctaacggacacgggcacaactacaaggtcgtggtcactgtccacggagagatcgacccggcaacgggaatggtgatgaacctcgcggacctcaagaagtacatggaagaggctatcatgcagccgttggatcacaagaatctggacatggatgtgccatacttcgctgacgtggtgtcgaccactgaaaacgtggccgtctacatttgggacaacctgcaaaaagtgctcccagtcggagtgttgtacaaggtgaaagtgtacgagactgataacaatatcgtcgtgtacaagggagag

SEQ ID NO: 5527 - DNA, 435 bp, Artificial Sequence
  Description of Artificial Sequence: Synthetic coding sequence
atgagcactgaggggggtggtaggcgctgccaagcacaggtctcccggcgtatctctttcagcgcctcgcacagactgtactccaaatttttgtcagatgaggaaaacttaaaactgttcggaaagtgcaacaaccccaacggtcacggccacaactacaaggtggtggtgacagtccatggtgaaatagatcccgcaaccgggatggtcatgaatctcgctgacttaaaaaaatacatggaggaagctatcatgcagcccttggaccataagaatctggacatggatgtaccctatttcgcggacgtggtctctactaccgagaatgtggcagtgtacatctgggacaacctgcagaaagtcctgccggtcggcgtcctgtacaaagtgaaagtatatgaaacagataataatatagttgtatacaaaggggag

SEQ ID NO: 5528 - DNA, 435 bp, Artificial Sequence
  Description of Artificial Sequence: Synthetic coding sequence
atgagcacggaagggggcgggcgtagatgtcaggctcaagtttcccgtaggatcagtttttcagcctcgcacagactgtacagtaagtttttatcggatgaggaaaaccttaagttgttcggaaagtgtaataacccaaatggccacggccacaactacaaagttgttgtaacagtccacggtgaaattgatccagcaacaggaatggtgatgaatctggctgatttaaagaaatacatggaagaggccatcatgcagccactcgaccacaaaaatcttgacatggatgtgccatatttcgctgacgtcgtgtctaccacggaaaacgtggctgtatacatatgggataacttacagaaggtgctgcccgtaggggtcctttacaaagtgaaggtttacgagaccgataataacatcgtcgtgtacaagggggag

SEQ ID NO: 5529 - DNA, 435 bp, Artificial Sequence
  Description of Artificial Sequence: Synthetic coding sequence
atgtccactgaaggtgggggcagaagatgccaggcacaagtgagccgacggatcagcttttccgcatcgcatcggttgtactcgaagtttctgtcggatgaggagaatctgaagctgttcggaaagtgtaacaaccccaacggtcatgggcacaactacaaggtggtggtcactgtgcatggagaaattgatccggccaccggtatggtgatgaaccttgcggacctcaagaaatacatggaggaagctattatgcaacctctggaccataagaatcttgatatggatgtcccttactttgccgacgtcgtgtccactaccgagaatgtggcagtttacatatgggataacctgcaaaaggtgctgcctgtgggagtgctgtacaaagtaaaggtctacgagactgacaacaatatcgtggtctacaagggtgag

SEQ ID NO: 5530 - DNA, 435 bp, Artificial Sequence
  Description of Artificial Sequence: Synthetic coding sequence
atgtctacagaaggaggcggacgccgatgccaggcgcaggtttcacgtcggattagttttagtgctagtcatcggttgtattcaaagtttttatcagatgaagaaaatcttaagttgttcggtaaatgcaacaatccgaatggtcatggtcacaattacaaagtcgtggttaccgtacatggggaaattgatccggcgacaggaatggttatgaacttagccgaccttaaaaaatacatggaggaagcgattatgcagcctttggatcataaaaatcttgatatggatgtgccttattttgcggatgttgtcagcacgacggaaaatgttgcggtatacatctgggataacctccagaaagtgctcccggttggagtcttatacaaagttaaagtctacgagaccgataataatatcgtagtctataaaggagag

SEQ ID NO: 5531 - DNA, 435 bp, Artificial Sequence
  Description of Artificial Sequence: Synthetic coding sequence
atgtccacagaaggcggtggaagaaggtgtcaggcgcaggtgtctagaagaataagctttagcgcatcccacagattgtactccaaattcctgtcagacgaagagaacctgaagcttttcggcaaatgtaacaatcctaacggccatggccataactataaggtggttgtgactgtgcacggtgaaatcgacccagcaacaggaatggtaatgaatttggccgacctgaagaaatacatggaggaggccattatgcagccgctggaccacaagaatctggatatggatgttccctatttcgccgatgtggtgtctactaccgagaacgtggcagtatacatatgggacaacctgcagaaagtgcttccggtcggagtactttacaaggtgaaagtgtacgagactgacaacaacatcgtggtttataagggagag

SEQ ID NO: 5532 - DNA, 435 bp, Artificial Sequence
  Description of Artificial Sequence: Synthetic coding sequence
atgagcaccgaagggggaggaaggcgctgccaagcgcaggtgtcgcgccggatatccttcagcgcctcccaccgcctgtattccaagttcctgtcagatgaggaaaatctgaaacttttcggaaaatgtaataacccgaacgggcacggacacaactacaaggtggtggtcaccgtgcatggtgagatcgacccggcgaccggtatggttatgaaccttgctgacctcaagaagtacatggaagaagccatcatgcagccactggaccataagaacctggacatggatgtgccatacttcgccgatgtggtgtccaccacggaaaatgtcgctgtgtacatttgggacaatcttcagaaagtgctccccgtgggagtcctctacaaggtgaaggtgtacgaaaccgataacaacatcgtggtgtacaaaggagaa

SEQ ID NO: 5533 - DNA, 435 bp, Artificial Sequence
  Description of Artificial Sequence: Synthetic coding sequence
atgtcaactgagggcggaggcagacggtgtcaagcccaggtgtcccgaagaataagctttagtgccagtcatcgactgtattccaaatttctttccgacgaagaaaacctgaaactgttcgggaagtgcaataaccccaatggacacgggcacaactacaaggtggtcgtgaccgtgcacggagagatcgaccctgctaccggtatggtcatgaacttggcggacttgaagaagtatatggaagaagcaatcatgcagccactcgaccataagaatttggacatggatgtgccttatttcgcagatgtcgtcagcactacagagaacgtggccgtctacatctgggacaacctgcagaaggttctgcccgtcggagtactctataaggtgaaggtgtatgagactgacaataacatagttgtttacaagggggag

SEQ ID NO: 5534 - DNA, 435 bp, Artificial Sequence
  Description of Artificial Sequence: Synthetic coding sequence
atgtccaccgagggaggaggacgccgctgtcaagcacaagtctcccggcgcatcagcttttcggcgagccatagactgtactctaagtttcttagcgacgaagaaaaccttaaactttttggtaagtgcaataacccgaatggtcacggtcataactacaaggtggtggtgactgttcacggggaaatcgacccggcaaccggcatggtgatgaatcttgctgatcttaagaagtacatggaggaagcgattatgcagccacttgaccataagaaccttgatatggatgtgccatacttcgccgatgtggtgtccaccaccgaaaacgtcgccgtgtatatctgggacaacctccaaaaggtgcttcctgtcggcgtcctctataaggtgaaggtctacgaaactgataacaatattgtggtgtacaaaggagaa

SEQ ID NO: 5535 - DNA, 435 bp, Artificial Sequence
  Description of Artificial Sequence: Synthetic coding sequence
atgtctacagaagggggcggacgcagatgccaagcccaggtgtctaggagaatcagtttctcagcatcacacagactgtactctaagtttcttagcgatgaggagaacctgaaactgtttggcaaatgtaataaccctaacggacatgggcacaactacaaagttgtcgtcacagttcacggagaaatcgacccagcaacaggcatggtcatgaatctggccgatctgaagaaatacatggaagaggccatcatgcagcccctggatcataagaacctggatatggatgtgccttatttcgccgatgtggtgtcgaccacagagaacgtcgctgtatatatttgggacaacctgcagaaggtgttgcctgtgggagttctttacaaagtgaaggtgtacgagaccgataataatattgtggtctataaaggggaa

SEQ ID NO: 5536 - DNA, 435 bp, Artificial Sequence
  Description of Artificial Sequence: Synthetic coding sequence
atgtcaaccgaaggaggtggacgcaggtgtcaggcgcaagtgtcgcggcggatctccttctcggcctcgcatcggctgtactcaaaattcctgtccgatgaggaaaatctcaagctgttcggaaagtgcaataatcccaacggccatggacataactacaaagtggtggtgaccgtccatggggagatcgatccggcgactggtatggtgatgaacctggccgacctgaagaagtacatggaggaagctatcatgcaaccgctggatcacaaaaatctcgacatggatgtgccgtacttcgccgacgtagtgtcgaccaccgaaaatgtggcagtgtacatctgggacaatctccagaaggtcctcccggtcggagtcctttacaaagtcaaggtctacgaaactgataacaatatcgtcgtgtacaagggcgag

SEQ ID NO: 5537 - DNA, 435 bp, Artificial Sequence
  Description of Artificial Sequence: Synthetic coding sequence
atgagcaccgagggaggaggacgccggtgtcaggcgcaagtctcgagacgcatctccttttccgcctcacaccgactttactcaaagttcctctctgacgaggaaaacctgaagctgtttggtaagtgcaataacccaaacggacacggccacaactataaagtggtggttacggtgcacggagagatcgatccagcgactggaatggtgatgaatctggcagacctcaagaaatacatggaggaggctattatgcaaccactggatcacaagaatcttgatatggacgtcccgtacttcgccgacgtggtgtccactactgaaaacgtggccgtgtacatttgggacaatctgcagaaggtccttcctgttggggttctttacaaggttaaggtgtacgaaaccgacaataacatcgtggtctacaagggagag

SEQ ID NO: 5538 - DNA, 435 bp, Artificial Sequence
  Description of Artificial Sequence: Synthetic coding sequence
atgtcaacggaaggtggcggaaggcgatgtcaggcacaggtctcacgcagaatttccttctctgcctcacataggttgtactctaaattcttgtcggacgaagaaaatcttaaactgttcggcaagtgtaataaccctaatggccatggacataattataaggtcgtcgttaccgttcatggtgagattgaccccgccacgggcatggtgatgaatcttgctgatttgaaaaaatatatggaggaagctatcatgcagccgctcgaccacaaaaatcttgatatggatgttccttactttgcggatgtggtaagcacaactgagaacgtcgcggtctacatttgggataaccttcaaaaggtcctacccgtcggtgtgctctacaaagttaaggtttacgaaacagacaataacattgtcgtgtataagggagag

SEQ ID NO: 5539 - DNA, 435 bp, Artificial Sequence
  Description of Artificial Sequence: Synthetic coding sequence
atgagcaccgagggtggcggcaggcgctgtcaagcccaagttagccgaaggatcagcttctccgcaagccataggctctattctaagttcctgtctgacgaggagaatctcaagctcttcggaaagtgtaataatcccaatgggcatggccacaactacaaggtggtggttactgttcatggcgaaatcgaccctgcaaccgggatggttatgaacctggccgatttaaaaaaatacatggaggaggcaattatgcaaccactggatcataagaacctggatatggatgtgccctattttgccgatgtggttagcaccaccgagaatgtggccgtgtacatctgggataatctgcagaaagtgctgcccgtgggagtgctgtataaggtgaaagtttatgaaactgacaataatatagtggtttacaaaggcgag

SEQ ID NO: 5540 - DNA, 435 bp, Artificial Sequence
  Description of Artificial Sequence: Synthetic coding sequence
atgtcaactgaaggaggaggtagacgctgtcaggctcaagtgtcgagacgaatctctttttccgcatcccatcgactctactcgaagttcctgtccgatgaggaaaaccttaaactttttgggaagtgcaataaccccaacggtcacggtcataactacaaggtggtggttaccgtgcacggagaaatcgatcctgcgacgggcatggtcatgaacctcgcagacctgaagaagtatatggaggaagcaattatgcaaccacttgatcacaagaatcttgacatggatgtgccatacttcgcagatgtcgtctcaaccaccgagaacgtggcagtttacatatgggataaccttcaaaaagtccttcccgtcggggtgctttacaaggtgaaagtttacgagactgacaacaacatcgtggtttacaagggcgaa

SEQ ID NO: 5541 - DNA, 435 bp, Artificial Sequence
  Description of Artificial Sequence: Synthetic coding sequence
atgtccaccgaaggaggaggccggcggtgtcaggctcaagtgtctagacggatttccttcagtgcctcacatcgactgtatagcaagttcttgtcagacgaggagaatctgaaactctttgggaaatgtaacaatcccaacggccatgggcataactataaagtggtggtgactgttcatggagagatcgacccagctactggcatggttatgaacctcgccgatcttaagaagtacatggaagaggctatcatgcaaccactcgatcacaagaatctcgacatggatgtcccttattttgcggatgttgtgagcacaaccgagaatgttgcagtatacatctgggacaacctgcagaaggtgcttccagtgggtgtgctctacaaggtcaaggtttatgagacggataacaatattgtagtctacaaaggcgag

SEQ ID NO: 5542 - DNA, 435 bp, Artificial Sequence
  Description of Artificial Sequence: Synthetic coding sequence
atgtcgacggaaggtggtggtcgtcgttgtcaagcgcaagtatcgcgtcgaatatcgttttcggcgtcgcatcgtttatattcgaaatttttatcggatgaagaaaatttaaaactatttggtaaatgtaataatccgaatggtcatggtcataattataaagttgttgttacggtacatggtgaaatagatccggcgacgggtatggttatgaatttagcggatttaaaaaaatatatggaagaagcgataatgcaaccgctagatcataaaaatttagatatggatgtaccgtattttgcggatgttgtatcgacgacggaaaatgttgcggtatatatatgggataatttacaaaaagtactaccggttggtgttttatataaagtaaaagtttatgaaacggataataatatagtagtttataaaggtgaa

SEQ ID NO: 5543 - DNA, 435 bp, Artificial Sequence
  Description of Artificial Sequence: Synthetic coding sequence
atgtcaaccgagggcggagggcgacggtgtcaagcgcaagtgtcaagacgaattagcttttctgcatcccacagactgtattccaagttccttagcgatgaagaaaatcttaagctgtttggaaaatgcaacaaccccaacggacacggacataactacaaggtggtggtgactgtgcatggtgaaattgacccggcaactgggatggtcatgaacctggctgacctgaagaagtacatggaagaggcaattatgcagcctctcgaccacaaaaacctcgatatggacgtgccgtactttgcggatgttgtgagcaccaccgaaaatgtggcagtgtacatatgggataatctgcaaaaggtcctgcctgtgggagtattgtacaaagtgaaggtttacgagactgacaataacatcgtcgtctacaaaggagaa

SEQ ID NO: 5544 - DNA, 435 bp, Artificial Sequence
  Description of Artificial Sequence: Synthetic coding sequence
atgtccaccgagggcggtggacggcggtgccaggcacaggtgagcagacgtatctcttttagcgcctcccacaggctatatagcaagttcctgagtgatgaagagaacctgaagttgttcgggaaatgtaacaatcccaatggacacggccataattataaagtggttgttaccgtccatggtgaaatcgaccccgcaactggtatggtgatgaatctcgccgacctcaaaaaatacatggaggaggcaattatgcaacctctggaccataaaaatctcgatatggatgtcccgtatttcgcagacgttgtttcgacgactgagaacgttgcagtgtatatatgggacaacctgcaaaaggttctccctgtgggggtgctgtacaaagtgaaagtgtatgaaacagataataatatcgttgtctacaagggagaa

SEQ ID NO: 5545 - DNA, 435 bp, Artificial Sequence
  Description of Artificial Sequence: Synthetic coding sequence
atgagcactgaaggcgggggaaggaggtgtcaagcccaggtctctcgaagaataagtttctccgcgtctcatcgcctctactccaaattcctgtccgacgaagagaatctgaagctgttcggcaagtgcaacaatcccaacggccatggacacaactataaagtcgtggtcaccgtgcatggtgaaattgatcccgccactggcatggtgatgaacctggccgatctgaaaaagtacatggaggaagccatcatgcaacccctggaccacaaaaaccttgatatggacgtgccatactttgcggatgtggttagcaccactgagaatgtcgctgtctatatctgggataaccttcagaaagtcctgcccgttggcgtgctttataaagtcaaggtgtacgagacagataacaacattgtggtctataaaggagag

SEQ ID NO: 5546 - DNA, 435 bp, Artificial Sequence
  Description of Artificial Sequence: Synthetic coding sequence
atgtcaactgaaggggggggtcgccgatgtcaggcacaggtgtcccgacgtatcagcttttcagcaagccacagactttactcaaagttcctgtcagacgaggaaaacctgaagttattcggaaagtgcaataatccaaacggacacggccacaattataaggtggtggtcacggtacacggcgaaatagatcctgcaactggcatggtgatgaaccttgctgaccttaagaagtacatggaggaagctattatgcaacccctggaccataagaacctagacatggacgtgccttacttcgctgatgtggtaagcaccactgagaacgtagccgtatatatatgggacaacctgcaaaaagtgctcccggttggtgtgttatataaggtgaaagtgtacgaaactgataataatattgtagtgtacaagggcgaa

SEQ ID NO: 5547 - DNA, 435 bp, Artificial Sequence
  Description of Artificial Sequence: Synthetic coding sequence
atgagcaccgagggcgggggtagacgatgccaagcccaagtgtcccggcgcatcagcttcagcgccagccatagactgtattcgaaattcttaagcgacgaggagaatctcaaactgttcgggaagtgcaataacccgaacggccatgggcacaattacaaggttgttgtgacagtgcacggagaaatcgacccagccacagggatggtcatgaatcttgccgatctgaagaagtacatggaggaagcaattatgcaaccattggatcacaaaaatctcgacatggacgtcccctactttgcagatgtcgtgtctacaacagagaacgtcgctgtctatatctgggacaatctgcagaaagtgctcccagtgggcgtgctgtacaaagtgaaggtttacgaaactgacaataatatcgtagtctataagggtgag

SEQ ID NO: 5548 - DNA, 435 bp, Artificial Sequence
  Description of Artificial Sequence: Synthetic coding sequence
atgtccacagaggggggtgggcgccgctgtcaggcccaggtttcacggaggatctctttcagtgcctcccaccggttgtacagcaagttcctttctgatgaggagaatctaaagctgttcggcaaatgtaacaaccccaacggccatggacacaactacaaggtggttgtcaccgtccatggcgaaatcgacccagcaaccggtatggttatgaatctcgctgacttgaaaaagtatatggaagaggcgatcatgcagcccctagaccataaaaatctggacatggatgttccttattttgccgatgtggtgagcacaacagagaatgtggcggtatacatctgggataaccttcagaaagtgttacctgtgggagtgctttacaaggtcaaagtctacgagacggacaacaacatagttgtctacaagggcgaa

SEQ ID NO: 5549 - DNA, 435 bp, Artificial Sequence
  Description of Artificial Sequence: Synthetic coding sequence
atgtccaccgaaggaggcggtaggcggtgtcaagcacaggtttcacggagaatttcgttctccgcatcgcatagactgtactcaaagttcctgagcgatgaagagaaccttaagctgttcggtaagtgtaataaccccaacggtcatgggcataactacaaagtggtggtgaccgtgcatggggagatcgatcctgcaactggtatggtcatgaacctggccgacttgaaaaagtacatggaggaggcaattatgcaaccacttgatcataagaaccttgacatggacgtgccttacttcgcggacgtggtgagcactaccgaaaatgtggccgtgtacatctgggataaccttcaaaaagtgcttcctgtcggagtgctttacaaggtgaaggtgtacgaaaccgataacaacatcgtggtgtacaagggagaa

SEQ ID NO: 5550 - DNA, 435 bp, Artificial Sequence
  Description of Artificial Sequence: Synthetic coding sequence
atgtctaccgagggcggcggacgtcgatgtcaggcccaggtatctaggcgcatctcattttccgcaagtcatagactatactcaaaatttctgtcagatgaagagaacttaaaactatttggcaaatgcaacaacccgaacgggcatggccataactacaaagttgtggtcacagtccacggcgagattgatccagccactggaatggttatgaatctcgccgacttaaagaagtacatggaggaagccatcatgcagccgctcgatcataagaacttagacatggatgtgccatacttcgccgatgttgtctccacaactgaaaacgtggctgtgtatatctgggacaacctgcaaaaagtcctcccagtgggggtcctctataaggtgaaagtatatgaaactgacaacaacatcgttgtgtataagggagag

SEQ ID NO: 5551 - DNA, 435 bp, Artificial Sequence
  Description of Artificial Sequence: Synthetic coding sequence
atgtctactgaggggggcggtcgccgttgtcaagcgcaggtgtcgcggaggatttccttctctgcatcgcaccggttgtacagcaagtttctgtccgatgaagaaaatcttaagctgtttggaaaatgcaacaatcccaatggtcatggacataactacaaggtggtggtgaccgtccatggagaaattgatccagcaactggtatggtgatgaatctcgcggatctcaaaaagtacatggaggaagccataatgcagccacttgatcacaaaaatctggacatggatgtgccttactttgccgatgtggtttcgaccactgagaacgtggcagtctacatatgggacaaccttcaaaaggtcttgccagtcggggtgctttacaaggtaaaagtgtacgaaacggacaacaacattgtcgtctacaagggagaa

SEQ ID NO: 5552 - DNA, 435 bp, Artificial Sequence
  Description of Artificial Sequence: Synthetic coding sequence
atgtcgaccgaaggtggaggaaggaggtgtcaggctcaagtatcccgccgaatttctttctctgcgagccatagattgtatagcaagttcctctccgacgaggagaatttaaagctgttcggtaagtgcaacaatcccaatggtcacggccataattacaaagtggtggttaccgttcacggcgagatcgatcctgcaaccggcatggtcatgaatctggcagatcttaagaaatatatggaggaagccattatgcaacctctggatcataagaacttggacatggatgttccatactttgccgacgtcgtatccacaacggagaatgttgccgtctatatatgggacaacctccagaaggttctgcctgtgggggtgctgtacaaagtgaaggtttacgagacagacaacaacatcgtggtctacaagggtgag

SEQ ID NO: 5553 - DNA, 435 bp, Artificial Sequence
  Description of Artificial Sequence: Synthetic coding sequence
atgagcacggagggcggggggcgcaggtgccaagcccaggtgtcgcggcgcatatctttctcagctagccatcgtttgtactcgaagttcctgtccgatgaggagaacctgaagttgtttggaaaatgtaacaatccaaacggacacggccataactataaggttgtggtgactgtgcacggcgaaattgacccggctaccggcatggtgatgaatctggccgacctcaagaagtacatggaagaagcgatcatgcagccgctcgaccacaaaaatctcgatatggacgtgccttacttcgcagacgtcgtgagcaccaccgagaacgtggccgtatacatctgggacaatcttcagaaagtcctcccggtcggagttttgtacaaggttaaggtctacgaaactgataacaacatcgtagtctacaagggtgaa

SEQ ID NO: 5554 - DNA, 435 bp, Artificial Sequence
  Description of Artificial Sequence: Synthetic coding sequence
atgtcaactgagggaggcgggcggagatgccaagcccaggtgtcccgccgcatctcctttagcgcttcgcaccggctgtactccaaattcctctccgacgaggaaaacctcaagttgttcggaaagtgtaacaacccaaacggacacggacataactataaggtggtggtgacggtgcacggggagattgacccggcgaccggaatggtgatgaacctggcggacttgaagaaatacatggaggaggccattatgcagcccctcgatcacaaaaatctcgacatggacgtgccatacttcgccgatgtggtgtcaaccaccgaaaacgtggcggtctacatctgggataatctgcagaaggtgttgccggtgggagtgctctacaaggtgaaggtgtacgagactgacaacaacatcgtggtgtacaaaggcgag

SEQ ID NO: 5555 - DNA, 435 bp, Artificial Sequence
  Description of Artificial Sequence: Synthetic coding sequence
atgtcgactgaaggaggaggaaggcggtgccaagcccaagtgtcgcggcggatctccttctccgcctcacaccgcctgtactcgaagttcctgagcgacgaagaaaacctgaagctgtttggtaaatgcaacaaccctaacggacacggacataactacaaggttgtggtgactgtccacggcgaaatcgacccggcgacgggaatggtgatgaatctggccgatttgaagaagtacatggaagaagccatcatgcaaccccttgatcacaaaaacctcgatatggacgttccgtacttcgctgacgtggtgtcgactaccgagaacgtcgcggtctacatctgggacaacctccagaaggtgctgcctgtgggcgtgctgtacaaggtgaaagtctacgagacggacaacaatatagtggtgtacaagggggaa

SEQ ID NO: 5556 - DNA, 435 bp, Artificial Sequence
  Description of Artificial Sequence: Synthetic coding sequence
atgtccaccgaaggtggaggtaggcgatgtcaagcgcaagtctcccggcgcatatctttcagtgcctcgcacagactctacagcaagtttctctcggatgaagagaaccttaaacttttcggaaaatgcaacaatccaaatggtcatggacacaattacaaggtggtcgtgactgtgcatggcgaaattgatcctgccaccggaatggtgatgaatctggcagatctgaaaaagtacatggaggaggccatcatgcagcctctggaccataagaatttggacatggatgtaccatactttgcggatgtggtgtccaccacggaaaacgtcgcagtgtacatttgggacaacctgcagaaagttctgcccgtaggggtgctctataaggtgaaggtgtacgaaactgataacaacatcgtcgtgtataagggagaa

SEQ ID NO: 5557 - DNA, 435 bp, Artificial Sequence
  Description of Artificial Sequence: Synthetic coding sequence
atgtcgactgagggaggcggacgccgttgccaagcacaggtcagcaggcgcatttccttttcggcatcccatagactgtacagcaagttcctgagcgatgaagaaaatctgaaactcttcggaaagtgtaacaacccaaacggacatggtcacaattacaaggtcgttgtgacggtgcatggggagattgaccccgccaccggtatggtgatgaacttggcagatctgaagaagtacatggaggaggcaatcatgcaaccactggatcacaagaacctcgacatggatgtgccttactttgcagatgttgtgtcgaccaccgaaaatgtcgcggtgtacatctgggataaccttcaaaaagtcctcccagtgggagtcttgtataaggtgaaggtgtatgaaaccgacaataacatcgtggtctacaagggagaa

SEQ ID NO: 5558 - DNA, 435 bp, Artificial Sequence
  Description of Artificial Sequence: Synthetic coding sequence
atgtcaactgaaggaggtggacgtcgatgtcaagcacaagtttcacgaagaatttctttctcagcatcgcaccgtttatattcaaaattcttatctgatgaagagaatttaaagttatttggtaaatgtaataatccaaatggacatggtcataattataaggtagtagtaaccgtacatggagaaattgacccagcaactggaatggttatgaatttagcagatcttaaaaaatatatggaagaagctattatgcaaccacttgatcataagaatttagatatggatgttccatattttgcagatgtagtaagcacaacagaaaatgtagctgtttatatttgggataatttacaaaaggttttaccagttggtgttttatataaagtaaaagtttatgaaacagataataatattgtagtttataaaggtgaa

SEQ ID NO: 5559 - DNA, 435 bp, Artificial Sequence
  Description of Artificial Sequence: Synthetic coding sequence
atgtccactgaagggggtggtagacggtgtcaagcacaggtgagccgccgcatttccttctccgcgtcgcatagattgtactcaaagtttctttcggatgaggagaatcttaagctgtttgggaaatgtaacaatcccaacggacacggtcataactacaaggtggtggttaccgtccacggcgagattgatcctgcaacgggtatggtgatgaatctcgcagacctgaagaaatacatggaggaagccatcatgcagccactcgatcacaagaatttggacatggacgtgccatactttgccgatgtggtgagtactactgagaacgtcgccgtgtacatctgggataacctgcagaaggtgctgcctgtgggagtcctgtacaaggtgaaggtctatgagactgataacaatattgtggtttacaagggagaa

SEQ ID NO: 5560 - DNA, 435 bp, Artificial Sequence
  Description of Artificial Sequence: Synthetic coding sequence
atgtcgaccgagggaggtgggagacggtgtcaagcccaggtcagccggcgcatatcattttccgcgtcccacaggctctacagcaaattcctgtccgatgaagaaaaccttaagttgtttggtaaatgtaacaatcccaacggccacggacacaattacaaggtagttgtgaccgtccatggcgaaatcgaccccgccactggcatggtgatgaatttggctgacctcaagaaatacatggaggaagctattatgcaacctctggatcataagaacctggacatggatgtgccatactttgccgacgtggtgtccactactgaaaacgtcgcagtctacatttgggacaacctgcagaaggtccttccagtgggggtcctgtacaaggttaaggtgtacgaaactgataacaacatagtcgtgtacaagggcgag

SEQ ID NO: 5561 - DNA, 435 bp, Artificial Sequence
  Description of Artificial Sequence: Synthetic coding sequence
atgtcgaccgaaggaggagggcggcgctgccaagcacaagtgtcacgtcggatttcgtttagcgcctcccaccgtctgtactccaagtttctttcggatgaggaaaatctcaagctgttcggtaagtgtaataaccccaacggccacggacataactacaaggtggtcgtcaccgtgcacggagaaattgatccggccactggcatggtgatgaaccttgcggaccttaagaaatacatggaagaggccatcatgcagccactcgatcacaagaacctggacatggacgtcccatactttgcagatgtcgtttcaaccaccgaaaacgtggcagtttacatctgggacaaccttcagaaggtgctgcctgtgggtgtgctttacaaggtgaaggtgtatgaaaccgacaataacattgtggtctacaaaggcgaa

SEQ ID NO: 5562 - DNA, 435 bp, Artificial Sequence
  Description of Artificial Sequence: Synthetic coding sequence
atgtcaactgagggcgggggaaggaggtgccaagcccaggtgagcagacgtatctcattctccgcaagtcaccgcctttattctaagtttctgtccgatgaggaaaatctgaagctttttggtaagtgtaacaatcccaacggacatggccataattataaagttgtcgtaacagtccatggcgagatcgatcctgctaccgggatggtgatgaatctggcggaccttaaaaagtacatggaagaagcaatcatgcagcctctggatcacaagaacttggatatggacgtgccctacttcgccgatgtagtgagcaccaccgagaacgtcgctgtttacatttgggacaacctgcaaaaggtccttccggtgggagtgttatataaagtcaaagtgtacgagaccgataataacatcgtcgtctacaagggagag

SEQ ID NO: 5563 - DNA, 435 bp, Artificial Sequence
  Description of Artificial Sequence: Synthetic coding sequence
atgtccaccgagggcggtgggaggcggtgtcaagcacaagtgtcgcgccgaatctcgttttccgcatcccatcggctttattccaagttcttgagtgatgaagaaaatctgaagctgtttggaaagtgcaacaacccgaacgggcatggacataactacaaagtagttgtgaccgttcatggagagatcgatccagcaactggtatggtcatgaacctggcggacttgaaaaagtacatggaagaagccattatgcagccactggatcacaagaacctcgatatggacgtgccttactttgcagatgtggtcagcacgactgaaaatgtcgcagtgtacatttgggataacctccagaaggtgctccctgttggcgtcctgtataaagtgaaagtgtacgagactgataacaatattgtggtgtacaagggagaa

SEQ ID NO: 5564 - DNA, 435 bp, Artificial Sequence
  Description of Artificial Sequence: Synthetic coding sequence
atgagcactgaaggcggtggacggcggtgccaggcccaagtatcaagaagaatttccttttcagcctcacaccgactttattccaagttcctgagtgacgaggaaaacttgaagttgtttggaaaatgcaacaatccgaacggccatggccataattacaaagtggtggtcacagttcacggagaaatcgacccagcgacgggcatggtcatgaacctggctgatctcaaaaagtatatggaagaagcaattatgcagcccctggatcacaaaaacttggacatggatgtgccctatttcgcggacgtggtgagtacaacagagaatgtcgcagtgtatatttgggacaacctgcagaaggtgctgcccgtgggggttctgtacaaggtcaaagtgtacgaaactgataacaacattgttgtttataagggtgaa

SEQ ID NO: 5565 - DNA, 435 bp, Artificial Sequence
  Description of Artificial Sequence: Synthetic coding sequence
atgtctaccgagggcggcggccgccgttgccaagcccaggtcagcagaagaatttcatttagtgcatcccaccgcctgtattcaaagtttctgtctgacgaggaaaacctcaagctcttcggtaaatgcaacaatcctaatggacacggccacaattacaaggtagtcgtgaccgtgcacggagagatagatcctgccaccggaatggtgatgaatctggctgatctgaaaaaatatatggaggaagcaatcatgcagcccctggatcataaaaacctggatatggatgtgccttatttcgccgatgtcgtctctaccactgaaaacgtcgccgtttacatctgggataacctgcagaaagttcttcccgtcggagtactgtataaagttaaagtgtacgagacagacaataacatcgttgtctataagggagag

SEQ ID NO: 5566 - DNA, 435 bp, Artificial Sequence
  Description of Artificial Sequence: Synthetic coding sequence
atgagcactgagggaggcggacgaagatgtcaggcccaggtaagtcgtcggatatccttttctgcgagccacaggctgtacagtaaattcctttctgatgaggagaatctgaagctgttcggcaagtgtaataatccgaatgggcacggccacaattataaggtggtcgtgacagtccacggggagatcgaccccgctaccggaatggtcatgaatctggctgacctgaaaaagtacatggaggaagccattatgcaacctctggatcataagaacctggatatggatgtcccatactttgccgacgtggtgagtacgaccgagaacgtggctgtgtacatctgggacaacctgcagaaagtgttgcctgttggcgtgctttacaaagtgaaggtgtatgagacagacaacaatattgtggtgtataagggcgaa

SEQ ID NO: 5567 - DNA, 435 bp, Artificial Sequence
  Description of Artificial Sequence: Synthetic coding sequence
atgtctacagaagggggagggaggcgttgtcaggctcaggtttcccgaagaataagtttcagtgcctcccatcggctctattctaaattcctctcagatgaagaaaatctgaaacttttcggaaaatgcaacaaccctaatgggcacggacataactataaggtggttgtgacggtccatggggaaatagatcccgccactgggatggtcatgaacctagccgatcttaagaaatatatggaagaggccataatgcagcccttagatcacaaaaatctcgatatggatgtgccatattttgcagatgtggtgagtactacagaaaatgtggctgtgtatatatgggataatcttcagaaagtgctccctgtgggggtcttatataaagtgaaagtttacgaaactgacaataatatcgtggtatacaagggggaa

SEQ ID NO: 5568 - DNA, 435 bp, Artificial Sequence
  Description of Artificial Sequence: Synthetic coding sequence
atgagtaccgaaggtggcggtcgaaggtgccaggcacaggtctccagacggatctccttctcggcgtcgcaccgtctttatagcaagttcctgtctgacgaggagaacctgaagctcttcggtaaatgcaacaaccccaacggtcacgggcataactacaaagtcgtggttacagttcatggagaaatcgacccagctactggtatggtcatgaatcttgccgatctcaagaagtacatggaagaggccataatgcagcccctggatcacaaaaatctcgacatggacgtgccttacttcgcagatgtcgtttctaccacagagaatgtcgccgtctatatctgggataacctgcagaaggtcttgcccgtgggtgtcctctacaaggtgaaggtgtacgagaccgataacaacatcgtagtctacaaaggcgag

SEQ ID NO: 5569 - DNA, 435 bp, Artificial Sequence
  Description of Artificial Sequence: Synthetic coding sequence
atgtcaacagagggcggggggagacgatgtcaggcccaggtctcacggcggatcagttttagtgcgtctcatcggctgtactctaaattcttgtccgacgaggagaacctcaaactctttggaaagtgcaacaacccgaacggccacggtcacaactacaaagtcgtggtgacagtgcatggcgaaattgatcctgctactgggatggtaatgaacttggccgatctaaagaaatacatggaagaagctattatgcagccactggatcacaaaaatctggatatggatgtaccgtattttgccgatgtggtgagtacaactgagaacgttgccgtgtatatctgggataaccttcaaaaggtcctgcccgtcggtgtgctatacaaagtgaaggtgtatgagaccgataacaacattgtggtgtataagggcgag

SEQ ID NO: 5570 - DNA, 435 bp, Artificial Sequence
  Description of Artificial Sequence: Synthetic coding sequence
atgtctaccgagggagggggccgtaggtgccaggcacaggtttcgcgtcgtatttccttttcagctagccatagattgtactcgaaatttctttctgacgaagaaaatctcaagcttttcggaaagtgcaacaaccccaacggtcatggtcataactataaagtcgtagtcaccgtgcacggggagattgaccccgcaacgggaatggttatgaatctggccgacctcaagaagtacatggaggaggctatcatgcagccacttgaccacaagaacctggacatggacgtgccgtatttcgccgatgtcgtttccacgaccgagaatgtggcagtatacatatgggacaacctacaaaaggtgctgcctgttggcgtgttatacaaagtcaaagtctacgaaacagataataatattgtagtgtacaaaggagaa

SEQ ID NO: 5571 - DNA, 435 bp, Artificial Sequence
  Description of Artificial Sequence: Synthetic coding sequence
atgtcgaccgaaggaggaggacgcagatgtcaggcgcaggtgtccagacgtatctctttttcggcctcgcatagattgtactccaagttcctgagcgatgaagagaacctgaagctgttcggaaagtgcaataatcctaacggccacggccacaattacaaggtggtggtgaccgtgcatggcgaaatcgaccctgccaccggaatggtcatgaatctggctgacctcaaaaagtacatggaagaggccatcatgcagccattggaccacaagaacctggatatggacgtgccctacttcgcagatgtcgtgagcactaccgaaaatgtggccgtctacatctgggataacctgcagaaagtgcttccggtgggagtgctctacaaggtgaaggtctacgaaaccgacaacaacatcgtggtctacaagggggaa

SEQ ID NO: 5572 - DNA, 435 bp, Artificial Sequence
  Description of Artificial Sequence: Synthetic coding sequence
atgtccaccgaaggtggaggccgtcgctgtcaggcacaggtgtcacgcaggattagcttttcagccagccaccgactgtattccaagtttctgtccgatgaagaaaatctgaagctctttggcaagtgcaacaaccccaacggacacggtcataactataaagtggtggtgaccgtgcacggagaaattgacccagcaacggggatggtgatgaatctggcagatctgaaaaagtacatggaggaagccatcatgcaaccacttgatcataagaacctcgacatggatgtgccctacttcgcagatgtcgtctccactaccgaaaacgtggctgtctacatttgggacaacttgcaaaaagttcttccagtcggagtgctgtacaaggtgaaggtctacgagactgataacaatatcgttgtctacaagggggag

SEQ ID NO: 5573 - DNA, 435 bp, Artificial Sequence
  Description of Artificial Sequence: Synthetic coding sequence
atgagcaccgagggtgggggccggcgatgccaggcacaagtaagtagacgaatctcgttctctgccagtcatcgattgtacagtaaattcctgtctgacgaggaaaacctgaaactctttggaaagtgcaataatccaaatgggcacgggcataactataaagtggtcgtgaccgttcatggtgagatagatcctgccacgggaatggtgatgaacttggcagatttgaaaaagtacatggaggaggctattatgcagccactcgatcataaaaatttggacatggatgtaccgtactttgccgatgtggtctcgactaccgaaaatgtggcagtgtatatttgggacaacctgcagaaggtattaccggtcggggtgctttacaaggttaaggtatacgaaaccgacaacaatatagttgtgtataagggagaa

SEQ ID NO: 5574 - DNA, 435 bp, Artificial Sequence; identical to SEQ ID NO: 5570
  Description of Artificial Sequence: Synthetic coding sequence

SEQ ID NO: 5575 - DNA, 435 bp, Artificial Sequence
  Description of Artificial Sequence: Synthetic coding sequence
atgtcaactgagggaggagggcgccgctgtcaggcccaggtgtcaaggagaatctcgttctccgctagccatagactctactccaaatttctgtccgacgaggagaatctgaagctgttcggaaagtgcaataatccaaacggtcacggacacaactataaggtcgtggtcaccgtccacggtgaaattgatccggctaccgggatggtgatgaatctggccgacctgaaaaagtacatggaagaggcaatcatgcaaccgcttgatcataagaatttggacatggatgtgccttactttgcggatgtagtctctaccactgaaaacgtcgctgtgtacatttgggacaacctccagaaagtcctcccagtcggagtgctgtacaaagtcaaagtctacgaaaccgacaacaatatcgtggtctataagggtgag

SEQ ID NO: 5576 - DNA, 435 bp, Artificial Sequence
  Description of Artificial Sequence: Synthetic coding sequence
atgagtacagaaggtggaggcagacgctgccaggcccaagtttccaggagaatctcattttctgctagtcatcggctctattctaagtttctcagcgacgaggagaatttgaagcttttcggaaagtgtaacaacccaaatggacacggtcataactacaaggtcgttgtcaccgtgcatggagaaatcgaccctgctaccggtatggtgatgaacctggcggacttgaaaaaatatatggaagaagccatcatgcagccactggaccacaagaatctcgatatggacgttccttactttgccgacgtcgtgagcactacagaaaacgtcgccgtctacatttgggacaatttgcagaaagtcctccctgtgggggtgctgtataaggtgaaggtgtacgaaacagacaacaatatcgtagtgtacaaaggggaa

SEQ ID NO: 5577 - DNA, 435 bp, Artificial Sequence
  Description of Artificial Sequence: Synthetic coding sequence
atgagcactgagggaggcggtagacgatgtcaagcacaagtctcacgccgcatatctttttcggcctcgcacaggctgtattccaagtttctgagcgacgaagaaaacctgaaactttttgggaaatgtaacaatcctaacgggcacggtcacaattacaaggtggtcgtgaccgtccacggtgaaattgatccagcaaccgggatggtcatgaacttggcagatcttaagaaatacatggaggaagcaatcatgcaacctcttgaccataagaaccttgacatggacgtgccatactttgccgatgtcgtgtcaaccaccgaaaatgtggccgtgtacatttgggataatcttcagaaggtgctccccgtcggcgtgttgtacaaggtgaaagtgtacgaaaccgacaataacattgtggtctacaaaggcgaa

SEQ ID NO: 5578 - DNA, 435 bp, Artificial Sequence
  Description of Artificial Sequence: Synthetic coding sequence
atgagcactgagggcggaggtcgccgctgccaggctcaggtctcacgccgaatcagcttttctgcatctcatcgcctgtactcgaagttcctgtcagacgaggagaacttgaaactctttggtaagtgtaacaatccaaacggtcatggtcataattataaggttgtggtgacggtacatggagagatcgatccagccacggggatggtgatgaacttggctgatctaaagaagtatatggaggaggcaattatgcaaccgttagatcataaaaacttggatatggacgtcccctatttcgcggacgttgtcagtaccacggagaacgtggcggtttatatctgggacaatctccaaaaagttctgcctgttggggtgctatacaaggttaaagtgtacgaaactgacaataacatagtcgtttacaagggggaa

SEQ ID NO: 5579 - DNA, 435 bp, Artificial Sequence
  Description of Artificial Sequence: Synthetic coding sequence
atgagtacggagggcggtggtcgcagatgtcaggcccaggtatcccgacggatctctttttctgcctcccacagactgtactcgaagtttctgagtgatgaagagaacctgaagctcttcggtaaatgcaataaccccaacggtcatggacataattataaggtggtcgtcacggtccacggggagattgatccagctacaggtatggtgatgaatctcgctgacctcaagaaatacatggaagaggccattatgcagcccctggatcacaagaatctagacatggatgtgccttactttgccgatgtggtgtctaccacagagaacgtggcagtatatatctgggacaatcttcaaaaggtgctccccgtgggcgtcctgtacaaagtcaaggtctatgaaacggataataacatcgtggtgtacaagggagag

SEQ ID NO: 5580 - DNA, 435 bp, Artificial Sequence
  Description of Artificial Sequence: Synthetic coding sequence
atgtccacagaaggtggcggccgccgctgccaggctcaggtatctcgacgaataagctttagtgcaagccacagactgtatagcaagttcctgtcagacgaagaaaacctgaagctgtttggcaagtgtaataatcccaacggtcacgggcacaactataaggtggtggtaacggtgcacggggagattgatcctgcgaccggaatggtgatgaatctggccgatcttaagaaatatatggaggaggcgataatgcagccgttggatcataagaatctcgacatggatgtgccatacttcgcagatgtagtgtccacaaccgagaacgtcgctgtttacatttgggataacttgcagaaagtcctcccagtcggagtgttgtataaagtcaaagtctacgaaaccgacaataacatagtggtctacaaaggggaa

SEQ ID NO: 5581 - DNA, 435 bp, Artificial Sequence
  Description of Artificial Sequence: Synthetic coding sequence
atgtctaccgagggagggggcagacggtgtcaagctcaggtctctcgtaggatatcattcagcgcttctcacagattgtactcaaaattccttagtgatgaagagaacttaaagttgttcgggaagtgtaataaccctaatggacacggccataattacaaggttgtggtaactgtccacggcgaaattgatcctgcaaccggcatggtcatgaatctagcagatcttaagaagtacatggaagaggcaataatgcaacccttggatcacaaaaacctcgatatggatgtgccctatttcgctgatgttgtatccaccactgagaacgttgctgtatatatatgggataatctccaaaaggtgcttcccgtaggtgtactctataaagtgaaggtttatgagacggataacaatattgttgtttacaagggagaa

SEQ ID NO: 5582 - DNA, 435 bp, Artificial Sequence
  Description of Artificial Sequence: Synthetic coding sequence
atgtctaccgaagggggcggtaggcgatgccaggcccaagtttctcggcgaatctcattctccgcctcccaccgcttgtacagcaaatttcttagcgatgaagaaaacctgaagttattcgggaaatgcaacaatcctaatggacacggccacaattacaaagtggtggttaccgtgcacggggagattgatcccgcaaccggtatggtcatgaatttggctgacctgaagaaatacatggaggaggccatcatgcagccactggaccacaaaaatttagatatggacgtgccctacttcgccgacgtggtgagcacaactgaaaatgtagcagtgtacatctgggataatttgcagaaagtgctgccggttggggtgctgtacaaagtcaaagtttacgagaccgataacaacatcgtcgtttataaaggagaa

SEQ ID NO: 5583 - DNA, 435 bp, Artificial Sequence
  Description of Artificial Sequence: Synthetic coding sequence
atgtccactgaaggtggtggaaggagatgtcaggcccaggttagccggcgcatatctttttcggcgtcgcatcggctctacagcaagttcctgtcagacgaggagaatcttaaacttttcggtaagtgcaataatcctaacggacacggtcacaactacaaggtcgtcgtgaccgtgcacggagagatcgatccggccaccggaatggttatgaatctggctgacctgaagaaatacatggaagaagctatcatgcaaccactcgaccataaaaaccttgatatggacgtcccgtacttcgccgatgtggtgtccactacggagaacgtagcagtgtacatttgggataacctgcagaaggtgctgcctgtcggggtgctctacaaggtgaaagtgtatgaaaccgacaataacattgtggtgtacaagggggaa

SEQ ID NO: 5584 - DNA, 435 bp, Artificial Sequence
  Description of Artificial Sequence: Synthetic coding sequence
atgagcacagagggaggaggaagaagatgccaggcccaggtgtctagacgcatatcttttagtgcttctcaccggctgtacagcaaatttctgtcagacgaagagaatcttaagctgttcgggaagtgcaataatcctaatggacatgggcacaattacaaggtggtcgtgaccgttcatggggaaattgaccctgcgacagggatggtgatgaatctggcggacttaaagaaatacatggaggaagctataatgcagcctcttgaccacaagaatcttgacatggacgtaccatactttgcggatgttgtctcgaccactgaaaacgtagcagtgtatatctgggacaacctgcagaaagtgctacctgtcggagtgttgtataaggtgaaggtctatgaaactgataacaatatcgtcgtatataagggcgag

SEQ ID NO: 5585 - DNA, 435 bp, Artificial Sequence
  Description of Artificial Sequence: Synthetic coding sequence
atgtcaaccgaaggagggggaaggaggtgtcaggcccaggtgagtcggcggataagtttttctgcttcccaccgactttattcgaaatttctaagcgacgaggagaatctgaagctattcggaaaatgcaacaaccccaatggccacggacacaattataaggtggtggtcactgtgcatggcgaaattgacccagccacaggcatggtaatgaacttggccgatctgaaaaagtacatggaggaggcaattatgcagccattggaccacaagaacctggacatggatgtcccatattttgcagacgtggtgagtaccaccgagaatgttgcagtttacatctgggacaacctgcagaaggtgctcccagtgggagtgctctacaaagtgaaggtctatgagactgataataacatcgtagtgtacaagggcgag

SEQ ID NO: 5586 - DNA, 435 bp, Artificial Sequence
  Description of Artificial Sequence: Synthetic coding sequence
atgagcactgagggcgggggtaggcgctgccaggcccaggtgagccgcaggatctcgttttccgcttcgcacagattgtactcaaagttcctgtcggatgaagaaaacctgaagctgttcggtaagtgtaacaacccaaatgggcacggacataactacaaagtggtcgtgaccgtgcacggcgaaatcgaccccgcgaccggaatggtgatgaacctggccgaccttaagaagtacatggaggaagccatcatgcagccgctcgaccataagaacctggatatggatgtcccttactttgcggacgtcgtatccactaccgaaaatgtggcagtctacatttgggacaatctgcaaaaagtccttcccgtcggcgtcctctacaaagtcaaagtctacgaaactgataacaacatcgtggtctacaaaggggaa

SEQ ID NO: 5587 - DNA, 435 bp, Artificial Sequence
  Description of Artificial Sequence: Synthetic coding sequence
atgagtaccgaggggggcggccggaggtgtcaagctcaggtgtcacgccgcatcagcttcagcgcgagtcaccgcctctattctaaattcctgagcgatgaggagaacctcaaactctttgggaagtgtaataaccccaatggtcacggacataattacaaagtcgtggtaaccgttcatggcgagatagatccagctacaggcatggttatgaatcttgcagatctaaagaaatacatggaagaggcaatcatgcaacctctagatcataagaatctggatatggacgtgccgtatttcgccgatgtagtcagtactaccgaaaatgtggcagtgtacatctgggacaacctgcagaaggtattgccagtcggcgtcctttataaggtcaaagtgtacgaaaccgataataatatcgtcgtctataagggtgaa

SEQ ID NO: 5588 - DNA, 435 bp, Artificial Sequence
  Description of Artificial Sequence: Synthetic coding sequence
atgtcgactgagggaggcggccgacgttgtcaggcccaggtgtcgaggcggatcagcttctccgcttcgcatcgcctctactcaaagtttctctcagatgaagagaatctgaagctgttcggaaagtgcaacaacccaaatgggcatggacacaattacaaggtggtggtgaccgtccacggagagatcgatccggccaccggtatggtgatgaatttggcggacttgaagaaatacatggaggaagcgataatgcagcctctcgatcacaaaaatctggacatggatgttccatacttcgccgatgtagtctccacgaccgaaaacgtcgcagtgtacatttgggacaaccttcaaaaagtgctcccggttggggtcctgtacaaggtgaaagtctacgaaactgacaacaacatcgtggtgtataagggtgaa

SEQ ID NO: 5589 - DNA, 435 bp, Artificial Sequence
  Description of Artificial Sequence: Synthetic coding sequence
atgtctaccgaaggcggtgggagacgatgtcaggctcaagtgtccagacgcattagcttttcagcatctcacaggctgtactcaaaattcctcagcgatgaagaaaacctcaagctgtttgggaagtgcaacaacccgaatggacatggacataactacaaggtggtcgtgaccgtgcacggagaaatagatcctgccactggtatggtcatgaatctggcggacttgaaaaagtacatggaagaagccatcatgcaacccctcgaccataagaacttggacatggacgtcccatactttgctgacgtggtgagcactactgagaacgtggccgtgtacatttgggacaaccttcaaaaggtgctgcccgtgggagtcctttacaaagtgaaggtctacgagactgataacaacatcgtggtgtataagggcgaa

SEQ ID NO: 5590 - DNA, 435 bp, Artificial Sequence
  Description of Artificial Sequence: Synthetic coding sequence
atgtcaacggagggcgggggccggagatgtcaagcccaagtgtcccgccgcatttcatttagcgcgagccaccgactatactctaaattcctctcggacgaggagaatctgaagctctttgggaagtgcaataacccaaacggacacggtcacaactataaagttgttgtcacagttcatggcgaaatagatcctgctacaggcatggttatgaatttggccgatctaaagaagtatatggaggaggctataatgcagccactcgaccacaagaatcttgatatggatgtgccatacttcgccgacgtcgtgtccaccactgagaatgtcgcggtctacatctgggacaacctgcaaaaggtgttgcctgtgggagtactatataaagtcaaagtgtatgagaccgacaataacatcgtagtctacaagggggaa

SEQ ID NO: 5591 - DNA, 435 bp, Artificial Sequence
  Description of Artificial Sequence: Synthetic coding sequence
atgtcaactgaaggcggaggacgcagatgtcaggcacaggtgtcacgccggatctcgttcagcgcctcccacaggctgtactcgaagttcctgtccgatgaagagaatctgaaactgtttggtaagtgcaacaatccgaacggacacggacataactacaaagtcgtcgtgactgtgcacggggaaattgaccctgcgaccggcatggtcatgaacctcgcggacctcaagaagtacatggaggaggctatcatgcagccgctggatcataagaatcttgatatggacgtgccctacttcgccgatgtggtgagcacgaccgagaacgtcgccgtttacatctgggacaacctccaaaaggtgttgccagtgggagtgctgtacaaggtcaaagtgtatgaaaccgacaataacatcgtcgtgtacaagggcgaa

SEQ ID NO: 5592 - DNA, 435 bp, Artificial Sequence
  Description of Artificial Sequence: Synthetic coding sequence
atgagtacagaggggggagggcggagatgtcaggcacaggtatctagacgcatatcattctccgcctcccatcgactctatagtaaatttctctctgacgaagagaacctcaagctctttgggaaatgcaacaatcctaatggacatgggcataactacaaggtggttgtgacagtgcatggggagattgatcctgcaacaggaatggtaatgaatcttgcagatctaaaaaagtatatggaagaggcaataatgcagccacttgaccataagaaccttgatatggatgtgccatactttgctgacgtggtgagtactacagaaaatgtcgctgtgtatatatgggataatctgcagaaagtgcttcctgtgggagtgctgtataaagttaaagtttatgagactgataacaacatcgtagtctataagggggaa

SEQ ID NO: 5593 - DNA, 435 bp, Artificial Sequence
  Description of Artificial Sequence: Synthetic coding sequence
atgagcacggaaggtgggggcaggcgttgtcaagctcaggtctctaggagaattagtttcagcgcatctcaccggctgtattccaagttcttatccgatgaggaaaatctgaaactctttgggaagtgcaacaaccctaacgggcacgggcataactacaaggtggtcgtgaccgttcacggggagattgatcctgctaccgggatggttatgaacctggcagatttgaagaagtacatggaagaagccataatgcagccactagaccacaagaatctggacatggacgtcccatatttcgccgatgtcgtgagcacgaccgaaaacgtggccgtgtacatctgggacaatctgcaaaaagtgctccctgtgggagtgctctataaggtcaaagtgtacgaaaccgataacaacatcgtagtttacaaaggcgag

SEQ ID NO: 5594 - DNA, 435 bp, Artificial Sequence
  Description of Artificial Sequence: Synthetic coding sequence
atgagcactgaaggcggtgggcgccggtgtcaagcccaagtctctaggaggatctcattctcggcatcgcatcgcctctattccaagttcctgtcagatgaggaaaacctgaaactctttgggaagtgcaataacccaaacggtcatgggcataactacaaagtcgttgtaacggtccacggggaaatcgatccggctactggcatggtgatgaatctggcagacctgaagaaatacatggaggaagccattatgcagccgctggaccacaaaaatctcgacatggacgtcccatacttcgcggatgtcgtcagcaccaccgagaatgtggcggtgtacatctgggataatcttcagaaagtcctcccggtcggagtactctacaaggtgaaggtgtatgagactgacaacaatatcgtggtgtacaagggagag

SEQ ID NO: 5595 - DNA, 435 bp, Artificial Sequence
  Description of Artificial Sequence: Synthetic coding sequence
atgagcacggagggcggcggccggaggtgtcaggcccaggtgagcaggagaatttcctttagcgcttcgcaccgtctgtactcaaaattcctctctgacgaggagaatcttaagctgttcggaaaatgcaacaaccccaacggtcatggacacaattacaaggtcgtggtgacagtacacggcgaaatcgaccctgctaccggcatggtcatgaatctcgccgatttaaaaaagtacatggaggaagctataatgcaacctctggatcacaagaacctcgatatggacgttccgtacttcgcagatgttgtgtcgactaccgaaaacgtggccgtctatatttgggacaatctgcagaaggttctcccagtcggtgtcctgtataaggtcaaggtgtacgaaaccgataataacattgtggtgtataaaggtgaa

SEQ ID NO: 5596 - DNA, 435 bp, Artificial Sequence
  Description of Artificial Sequence: Synthetic coding sequence
atgtcgactgagggaggaggacgcaggtgccaggctcaagtcagcaggcggatctcattcagcgcaagccaccgcctgtacagcaaattcctgagcgacgaagagaacttgaagctgttcggaaagtgcaataacccaaacggccatggccacaactacaaagtcgttgtgaccgtgcacggagaaatcgatccagccactggaatggtgatgaacctcgcggacctgaagaaatacatggaggaagcgattatgcagccgctcgatcataagaatctggacatggacgtgccctactttgccgatgtcgtgtcgacgacggaaaatgtggcagtctacatctgggacaacctccagaaagtgctgccggttggggtgctgtacaaagtgaaagtgtatgaaaccgacaataacatagtcgtgtacaagggagag

SEQ ID NO: 5597 - DNA, 435 bp, Artificial Sequence
  Description of Artificial Sequence: Synthetic coding sequence
atgtcaaccgaaggaggcggaaggagatgtcaagcccaagtctcgcggagaatcagcttctcagcatcccaccggctctacagcaaatttctctcagacgaagaaaacctgaagctcttcggtaagtgtaacaacccaaatggacacggacataactacaaggtcgtggtgactgtgcacggtgaaatcgacccggccacggggatggtcatgaacctggccgacctgaagaaatacatggaggaagccattatgcaacctctggatcacaagaacctggacatggacgtgccatacttcgcagatgtagtgtccaccaccgagaatgtggcggtgtacatctgggacaacctgcagaaggtgctgccagtgggagtgctctataaggtgaaagtgtacgagactgataacaatatcgttgtgtacaaaggagaa

SEQ ID NO: 5598 - DNA, 435 bp, Artificial Sequence
  Description of Artificial Sequence: Synthetic coding sequence
atgtccacggaaggcggaggtcgccggtgccaggcgcaggttagccgccgcatcagcttctctgcctcacaccgcttgtactccaagtttttgtccgacgaggagaacctcaagctgttcggcaagtgtaataacccaaacggacatggtcacaactacaaggtcgtagtcaccgtccatggtgagatcgacccggccaccggcatggtcatgaatctggctgatctgaagaagtatatggaggaggctataatgcaacctctggatcacaagaacttagatatggacgtaccctactttgcggacgtcgtcagcacaaccgagaacgtcgccgtgtacatctgggataacctgcaaaaggtcctgcccgtcggagtgttatataaggtcaaggtttatgagacggataacaacatcgtcgtttataagggcgag

SEQ ID NO: 5599 - DNA, 435 bp, Artificial Sequence
  Description of Artificial Sequence: Synthetic coding sequence
atgtcgacggaaggtggtggacggcggtgccaggctcaagtcagcagacggatatcgttctcggcatcccacagactctattcaaagttcctctccgatgaagagaacctgaagttgtttggcaagtgcaataatccaaacggtcatggacacaactacaaggtggtcgtgaccgtgcacggggagattgatcccgcaactggaatggtcatgaacctcgcagatctgaagaagtacatggaagaagcaattatgcagcccctcgatcataagaatcttgatatggatgttccatactttgcagatgtggtgtcgaccactgagaatgttgcggtctatatctgggacaacctgcagaaagtcctgccggtgggagtgctctacaaagtcaaggtgtacgaaaccgacaacaatattgtcgtgtacaagggagag

SEQ ID NO: 5600 - DNA, 435 bp, Artificial Sequence
  Description of Artificial Sequence: Synthetic coding sequence
atgtcaactgagggcggcgggcgacgctgccaagctcaggtatcacggcgtatatcttttagcgccagccacaggctgtattccaagttcctttctgacgaagaaaatttgaagctttttgggaaatgtaacaaccccaatgggcacggacataattacaaggtagtcgtgacagtgcatggagagatcgaccccgcgacgggaatggtgatgaacctagccgatctgaaaaagtacatggaggaggcaataatgcagccactggaccataagaatctggacatggacgtgccctacttcgctgacgtggtgtcaacaacggagaatgtggcggtttatatctgggacaacctgcagaaagtgctacctgttggagtgctctacaaggtcaaggtttacgaaaccgataataatattgttgtgtataagggggag

SEQ ID NO: 5601 - DNA, 435 bp, Artificial Sequence
  Description of Artificial Sequence: Synthetic coding sequence
atgtcgactgagggaggaggaaggcgttgtcaggctcaagttagccgacgaatttctttcagcgcgtcgcatagattatactccaagttcctttctgatgaagagaatctaaaactctttggaaaatgtaataacccaaatggtcacggacacaattacaaggtcgtcgtgacagttcacggagaaatagatccagcgactggaatggtcatgaatctcgcagatctgaagaaatacatggaggaggctatcatgcaacctcttgatcacaaaaacctggatatggatgtgccgtactttgctgatgtagttagcacaacagaaaacgttgcagtgtatatttgggataacctacaaaaagttcttccagttggggttctctataaagtcaaagtttatgagacggacaataacattgttgtctataaaggtgag

SEQ ID NO: 5602 - DNA, 435 bp, Artificial Sequence
  Description of Artificial Sequence: Synthetic coding sequence
atgtccactgagggaggggggaggagatgtcaagcgcaggtttcgcggcgcatctccttcagcgcatcccatcgtctgtactcaaagttcctgtcggatgaggagaacttgaaactttttgggaagtgcaacaatccaaacggacatggccacaactataaggtggtggtgaccgtccacggagagatcgaccccgccactggaatggtgatgaatttggccgatctgaagaagtacatggaagaagccatcatgcagccgcttgaccacaaaaacctggacatggacgtcccgtacttcgctgacgtcgtgtcaactaccgaaaatgtggcggtctacatttgggataatctgcagaaggtgctcccggtgggtgtgctctacaaagtcaaggtgtacgaaaccgataacaacatagttgtgtacaagggagaa

SEQ ID NO: 5603 - DNA, 435 bp, Artificial Sequence
  Description of Artificial Sequence: Synthetic coding sequence
atgtcgaccgaaggaggaggccggcgatgccaggcacaagtcagtagaagaatctcgtttagcgcatcacaccgcttgtactccaagtttctgtccgatgaggaaaatctgaaactcttcgggaagtgtaataaccccaatggtcacggacataactataaagtcgtcgtgaccgtgcatggtgaaatcgaccctgccaccggcatggtgatgaacctggccgatcttaagaagtacatggaagaagctattatgcagccactggatcataagaacctggatatggacgtgccttacttcgcagatgtcgtgagcactacggaaaacgtggcagtctacatctgggataacctccaaaaggtcctccctgtgggcgtattgtacaaggttaaggtatatgagactgacaataacatagttgtgtacaaaggagag

SEQ ID NO: 5604 - DNA, 435 bp, Artificial Sequence
  Description of Artificial Sequence: Synthetic coding sequence
atgtccaccgaggggggaggacgaagatgccaggcgcaggttagcaggagaatcagtttctccgcatcccatcgcctctactctaagttcctgtctgatgaggagaatctcaaactcttcggcaagtgcaataaccccaatgggcacggacacaactacaaggtggtggtgacagtccatggagaaatcgatcctgctactggcatggtgatgaatttggctgacctgaagaagtacatggaggaagcaataatgcaacccttagaccataagaatctggacatggacgtaccttacttcgcagacgttgtgagtaccacagagaatgtcgctgtttacatttgggataacttacaaaaggtccttcctgtaggcgttctctataaggtgaaggtgtatgagacagataacaatatcgtggtgtataagggggag

SEQ ID NO: 5605 - DNA, 435 bp, Artificial Sequence
  Description of Artificial Sequence: Synthetic coding sequence
atgtcaactgagggtggaggtcgcagatgccaagcgcaggtgtctcgaagaatatctttcagcgccagtcatcgtctgtatagcaaatttctgagcgatgaagaaaatctgaagcttttcggaaagtgcaacaatccgaacggacatgggcacaactacaaggtagtggtgacagtgcacggtgaaatcgacccggcgacgggcatggtcatgaatctcgcagatcttaagaagtacatggaggaggctatcatgcagccgcttgaccataagaatctggacatggatgtgccgtattttgctgatgtagtgagcaccaccgagaatgtagccgtttatatatgggataacctacagaaagtcctccccgttggggttctgtataaggtcaaagtctatgagacagacaataatatcgttgtgtacaaaggggag

SEQ ID NO: 5606 - DNA, 435 bp, Artificial Sequence
  Description of Artificial Sequence: Synthetic coding sequence
atgagcactgaaggcggaggcaggcgctgtcaggcccaagtctcccggaggatctcgttctccgcctctcaccggctgtactcaaagttcctgtccgatgaggagaacctcaaattgtttggtaaatgcaataaccccaatggtcatggacacaactacaaggtggtcgttaccgtgcatggggaaattgacccagcgactggaatggtgatgaacttggccgatctgaagaagtacatggaggaggcgatcatgcagccgctggaccataagaatctggatatggatgtgccgtacttcgctgacgtcgtttccacgaccgaaaacgtggcagtgtacatctgggacaacctccagaaagtcctcccggttggtgtgctttacaaagtgaaggtctacgaaactgacaataacattgtggtgtacaagggcgaa

SEQ ID NO: 5607 - DNA, 4281 bp, Artificial Sequence
  Description of Artificial Sequence: Synthetic coding sequence
atgcaccagcggcatccgcgggcacggtgtccaccgctctgcgtggcaggaatccttgcttgcgggtttctcctcggatgctgggggccgtcgcatttccaacaatcatgcctgcaggcgctggaaccacaggctgtatcttcctacttgagccctggagccccgctgaaaggacggccaccctcgccaggattccaacgccagcgccagaggcagcgccgcgccgcgggcggaatcctgcacctggagctgctggttgcagtcggacctgacgttttccaggcccatcaggaggacactgaacgctacgtgcttacgaacctgaatatcggggcggagctcctgcgcgacccgtcgctgggtgcgcagtttcgcgtccatctggtgaagatggttatcctcactgaaccagaaggagcaccaaacatcactgctaatctgacctcaagcctcctgagcgtgtgcgggtggagccaaactatcaacccggaggatgataccgaccctggccacgcagacctggtgctgtacatcacccggttcgacctggagctcccagatggaaaccgccaggtacgcggagtgacccagctgggaggggcatgctctccgacctggtcgtgtctgatcacggaagataccggtttcgacctgggcgtcactatcgcacatgagatcggacactccttcggactggaacatgacggagcccccggatcaggatgtgggccttccggacacgtcatggcctccgatggcgcggcaccccgggcaggactcgcatggtcgccttgctcgcgacgccagctcctgagcttgctgtcggccgggcgggcacgctgtgtgtgggacccaccgcggccacaacccggctcggcaggccaccccccagatgcgcagcccggactctattacagcgccaacgaacaatgtcgcgtggccttcggaccgaaagcagtggcttgtaccttcgctagggagcaccttgatatgtgccaagccctgagctgccacaccgatcctctggaccagtcatcctgctcgcggcttctggtgccgctgctggacggcaccgagtgtggtgtggaaaagtggtgctccaagggacgctgccggagcctggtcgaactcaccccgatagctgccgtgcacgggaggtggagttcctggggccctcgctcaccgtgcagccgctcctgcggaggcggcgtcgtaacccggcgtcgccagtgcaacaatcctcgcccagctttcggaggacgggcctgcgtgggagcagacctgcaggccgaaatgtgcaatactcaagcctgtgaaaagactcagctggaattcatgtcacaacaatgtgcaagaactgatggtcaacctttgagatcgtcccccggcggcgcatcattctaccactggggtgccgcggtgccacatagccagggagacgcgctctgcaggcacatgtgtagggcgattggagaatcgttcatcatgaaaagaggggactcgtttctggacggcactcgctgcatgccttccgggccacgagaggacggaactctgtccctgtgcgtcagcggctcctgcagaaccttcggatgcgacggacgcatggactcccagcaagtgtgggatcggtgccaggtgtgcggaggggataatagtacctgctcgccgaggaaggggtctttcactgcaggtagagccagggagtacgtcacgtttctgaccgttacgccaaacctgacttcagtgtacatcgccaaccacaggccgttgtttactcatctggccgtgagaatcggtgggcgctacgtggtggcgggcaagatgtctatttccccgaacactacctacccctccctgctcgaggacggcagagtcgaataccgcgtggcacttacggaggaccgtttgcccagactcgaagagatccggatttggggaccgctgcaggaggacgcggatatccaggtgtaccgcaggtacggagaagagtacggaaatcttacccggcctgacattacgttcacttacttccagcccaagccgcgccaggcctgggtgtgggcggctgtgcggggcccgtgttccgtgtcatgtggagccgggctccgctgggtgaactattcctgcctggaccaggcccgcaaggagttggtcgagacggtgcaatgccaggggtcccagcagccaccggcgtggccggaagcgtgcgtccttgaaccttgcccaccatactgggctgttggagacttcggcccgtgctcggccagctgcggtgggggactgcgcgaacggccagttagatgcgtggaggcgcaaggctcccttctcaaaaccctgccgccggcccggtgtcgggcgggtgctcagcagccggccgtggcacttgaaacttgcaacccgcagccgtgcccggccaggtgggaagtgtccgagccatcatcgtgcacttccgcaggaggggctggattggcgctggaaaacgaaacctgcgtgccaggagcggatggactcgaagcgccggttaccgaaggcccaggcagcgtcgatgagaagctcccagccccagaaccttgcgtgggaatgtcatgtccacccggctggggacacctggatgcgacttcagcgggagagaaggccccatcaccatggggaagcatcagaacgggtgcacaggccgcacacgtctggaccccagccgccgggtcctgttccgtgtcgtgcggcaggggattgatggagctcaggttcctgtgcatggattcagccctgagagtgccagtgcaagaagaactgtgtgggcttgccagcaagccggggtcccggagggaagtctgccaagccgtcccgtgccctgcccgttggcagtataagttggcggcatgttcggtgtcctgtggacgaggagtggtccggagaatcctctactgcgcacgggcccatggagaggatgatggtgaggagattttgctggacacccagtgccagggactcccgcggcctgagccgcaagaagcctgctcactcgagccttgtccgcctcgatggaaggtgatgtcactcggtccgtgttcggcttcatgcggactcggcaccgccagacggagcgtcgcatgtgtgcagctcgaccagggccaggatgtagaagtcgacgaagctgcgtgcgccgccctggtgcgcccggaagcctccgtgccatgccttatcgcggattgcacctaccggtggcacgttggaacctggatggaatgctccgtgagctgcggcgacggtatccaacggcgaagagatacctgcctgggccctcaggcgcaggctccggtccctgcagacttttgccaacacctcccgaagccggtgaccgtgcgcggatgctgggcgggcccgtgtgtaggacaagggaccccctctctggtgccgcatgaggaggctgcagcaccggggagaactactgcgactcctgcgggggcatcgctcgaatggagccaggcgagagggctgctgttttccccggctccgcaacctcggcgcttgctccctggtccccaggaaaattctgtgcaatcatcggcgtgtgggagacagcaccttgagcccaccggcactattgatatgaggggaccgggccaagccgactgcgcggtggctatcgggcggccactgggagaagtggtgactctcagagtgctggaatcatccttgaactgttcggccggcgacatgctgctgttgtggggacggttgacctggagaaagatgtgcagaaaacttctggatatgaccttttcgtcgaaaacgaatactcttgtcgtccgccagcgctgcggacgccccggtggtggcgtcctgcttcgctacggatcgcagttggccccggaaactttttacagggagtgcgacatgcaattgttcggtccctggggggaaatcgtgtcgccctccctttccccggcgacgagcaacgccggcggatgccgcctgttcatcaacgttgcaccgcatgcccgcatcgcgatccacgccctcgcaaccaatatgggagccggaacggaaggagccaacgcctcatacatcctgatacgagacacccacagtctccgcactactgcgttccatggtcaacaagtgctgtactgggaatcggaaagctcgcaagcagaaatggagttttccgagggcttcctgaaagcacaagcctctctccggggccagtactggaccctgcagagctgggtgccagagatgcaagatccccagtcctggaagggaaaggaaggcacc

SEQ ID NO: 5608 - DNA, 4281 bp, Artificial Sequence
  Description of Artificial Sequence: Synthetic coding sequence
atgcaccagcgacacccacgggcccgctgtcctcctctgtgtgtggctggtatactggcatgcggctttctcctgggatgttggggaccaagccacttccaacaatcctgcctgcaagcgctggagcctcaggcggtatcctcttacctttccccgggagcccccctcaagggccggccaccttcacctggatttcaaagacaaagacagcggcagcggcgcgcggcaggcggaatcctccatctcgagctgttggtggcagtgggtcccgacgtgtttcaagcccaccaagaagataccgaacgatatgtccttactaacttgaatatcggcgcggagcttctccgagatccgtcccttggagcacaatttagagtgcatctcgtgaagatggttattctgaccgaaccagagggggcacccaacatcaccgcaaaccttacctcgtcacttcttagtgtgtgcggatggtcccaaactatcaatccagaggatgacaccgaccccggacacgcagatctggttctgtacattaccaggtttgatctggaactgccagatggaaacagacaggtccgcggggtgacccagcttgggggagcctgttcgcccacttggagctgtcttatcactgaagataccggttttgatcttggagtgacgatcgcacacgaaataggccatagctttgggcttgagcacgacggcgcacctggcagcggttgtggtcctagcggtcatgtcatggcgtcggacggggcagcacctagagcaggtcttgcatggtccccatgttccagacgtcaactgctgtccctgctgtccgctggtcgagcacggtgtgtctgggatccaccaaggcctcagcctggaagcgcaggtcacccacccgatgcccaacctgggctgtactacagcgcaaatgaacagtgtagagtggctttcggacctaaggctgtcgcttgtaccttcgcccgagaacatcttgatatgtgccaagcactgagctgtcatacggatcccttggatcaatcatcctgttccagactcctggtgcctctgctggatggcacggaatgtggagtggagaaatggtgttcaaaaggaagatgcagatcccttgtcgagctgacccctatcgcagccgtgcatggcagatggtcatcctggggacccaggagcccttgctcgcgctcatgtggtgggggcgtggtcacccggcggagacaatgcaataatcctcggcctgcctttggaggaagggcgtgtgtgggcgcagatcttcaagcagaaatgtgtaacactcaagcatgtgaaaaaactcaacttgaattcatgagccaacagtgcgctcggaccgatggacaacctcttagatcctccccaggtggagcctcattttaccattggggtgcagcagtccctcattcgcagggagacgccctgtgtagacatatgtgtagagcaataggtgagtctttcataatgaagagaggtgattcctttctggatggcacccgttgcatgccatcggggccgagagaagatggaaccctttcgctgtgcgtcagcggaagctgcaggacttttggctgcgatggtagaatggattcacagcaggtgtgggatcgttgccaggtgtgtgggggtgataacagcacttgtagcccacggaagggatcattcaccgccggccgagcacgagaatacgtgactttcctcaccgtgaccccgaacctgacttccgtgtacatcgccaaccacagacctctctttactcacttggcagtgagaattggaggtaggtacgtggtcgcaggtaagatgtcgatttcccctaacactacttacccatcacttctcgaagatggaagggtcgaataccgcgtcgctctgacggaggaccggcttcccagactggaggaaatcaggatctggggtccactccaagaagatgcggatatccaagtctacagacggtacggtgaggaatacggaaacctgacccggcctgacattaccttcacttacttccaacccaaacctaggcaagcatgggtgtgggcagcggtgcggggaccatgtagtgtgtcctgtggtgctggcctgagatgggtcaattactcatgcctggatcaagcgcgcaaggaactggtcgaaaccgtgcaatgtcaaggttctcaacaaccgcccgcttggccggaagcgtgtgtgctcgaaccttgtcccccctactgggcagtgggtgattttggaccctgttccgctagctgtggcggtggtctgagggaacgccctgtccggtgtgtggaggcacaagggtcacttctgaaaacgctcccccctgcacgatgtcgtgcaggggcgcagcaaccagcagttgcacttgagacttgtaatccacagccatgtcctgcaagatgggaggtgtcagagccatcgtcgtgtacttccgcaggtggtgcaggtctggctctggaaaacgagacgtgtgtccccggtgcggacggtctggaggcaccggttactgaagggccgggatcggtggatgaaaaactgccagcgccagagccttgcgttggaatgtcctgtcctcccggatggggacatcttgatgccacgtcggcaggtgaaaaagccccctctccctggggctccatccgaaccggtgcacaggcagcgcatgtgtggacccctgcagctgggtcatgttccgtctcatgtggacgaggactgatggaactgcgttttctttgtatggattctgctcttcgggtcccagtgcaagaagaactgtgtgggctggcatcgaagccaggttcacggagggaggtgtgtcaagcagtcccctgccctgcacggtggcagtacaagttggcagcctgtagcgtctcgtgtgggagaggagtggtgaggcggattctttactgtgcaagggcgcatggagaggatgatggagaagagatccttttggatacccagtgccagggtctgccgcggcctgaacctcaagaagcgtgctcgctggaaccatgccctcccagatggaaggtgatgtcgctgggtccctgttcagcgagctgcggtctgggaacggcacgcagatcggtggcatgtgttcagctggatcaaggacaagatgtcgaggtggatgaagcggcatgcgccgccctcgtcagaccggaggcgtcagtgccatgcctgatcgccgattgcacctaccgctggcacgtgggaacttggatggaatgttcggtgtcatgtggagatggcatccaacgccgtcgggacacttgcctcgggccacaggcacaagcgcctgtgcctgcagacttctgtcaacatctccctaagccagtgactgtccggggctgctgggcgggcccttgtgtgggacagggtactccgagcttggtgcctcacgaagaagcagcagcgcctggtcgtactacggcaaccccagcgggagcgagcctggaatggtcacaggcacgaggcctgctgtttagcccagcacctcaaccacgtaggctgctccctgggccacaagaaaatagcgtgcaatcgtcagcgtgtgggaggcagcatcttgaacctaccgggactattgacatgcgcggaccaggtcaagcagattgtgctgtcgcgattgggaggccactgggtgaagtggtgacgctccgcgtgcttgaatcgtcacttaactgttccgcgggcgacatgctgctgctctggggacgcctgacctggaggaaaatgtgtagaaaacttttggatatgaccttttcaagcaagactaacaccctcgtggtgagacaacgatgcgggcgcccagggggtggagtgctgttgcgttacggcagccaactggccccggagactttttaccgcgagtgcgatatgcagctttttggaccttggggcgaaattgtttctccctcactgagtcctgcaacttcgaatgcaggcgggtgcagattgttcatcaacgtcgcaccacatgcccgtatcgcaattcatgcactggctaccaacatgggcgcgggcactgaaggggccaacgcatcgtacatacttatacgcgacacccacagcctccggactactgcatttcatggacagcaggtgctgtactgggaatcggaatcaagccaggcggaaatggaattttcggagggcttcctcaaggcacaggcctccctgcgcggtcagtactggaccctgcagtcatgggtgccagagatgcaggaccctcaatcgtggaaggggaaggaagggacc

SEQ ID NO: 5609 - DNA, 4281 bp, Artificial Sequence
  Description of Artificial Sequence: Synthetic coding sequence
atgcaccaacgccacccacgcgcacggtgtccgccactgtgtgttgcaggaatcctcgcctgtggctttctgctgggttgttgggggccatcgcacttccagcagtcctgccttcaagcattggaaccccaggccgtgtcgagctacctgagccccggtgcgccgctgaagggtcgcccgccgtcaccgggtttccagcgtcaacgacagcggcagaggagggccgctggggggatactacatctggaactgctggtcgctgttggacccgatgtgttccaggcccaccaggaggacaccgagcgctacgtcctcaccaatctgaatattggggccgaactgctgcgggacccttcccttggggcacagttccgggtgcacctggtgaagatggttatactcacggagccggagggggctccaaacatcaccgccaacctgacatctagccttctatcagtgtgtggatggagccagacgattaaccctgaagacgatacagatccgggacacgccgatctcgtcctgtacattacccgcttcgatctagaactgccagatgggaatagacaggttagaggggtgacccagctaggaggtgcctgcagtcctacctggagctgtctcatcaccgaggatactggctttgacctaggagttaccatcgctcatgaaattggacatagctttggccttgagcacgacggagcaccgggatcaggctgtggaccctccggtcatgtgatggccagcgacggtgcggccccacgagccgggctcgcctggagtccatgctctcgtcgccagctcctatcactgttgagcgcgggtagggcccggtgcgtttgggacccacccagaccacagcccggatctgccgggcaccctccggacgcacagcccgggctctactactctgctaatgaacagtgcagggtggcatttgggcctaaggccgttgcctgtacattcgccagggagcatctcgatatgtgccaggcactctcctgccacacagatccattggaccagtcctcctgcagcagactcctggtacccctgcttgatggaacagaatgcggcgtggagaagtggtgctccaaaggcaggtgtaggtcactggtggagctcactcctatcgcggcagtgcacgggagatggagctcatggggcccgcggtccccatgctctcgctcttgcggaggaggggtcgtgacacgtcgacgtcagtgcaataacccccgtcctgcctttggggggcgagcttgcgttggggctgacctccaggccgagatgtgcaacacgcaggcctgcgagaagactcagctggagtttatgtcgcaacaatgtgcaagaacagacggtcagccgttgagatcctcgccaggaggggcgtcgttttatcattggggggccgccgtgccacattctcagggagacgccttatgtaggcatatgtgtcgggccataggggagtcattcataatgaagcggggagatagtttcctagacggcactcggtgcatgccgtccggcccaagggaggacggcacgctaagtctgtgcgtgtcaggctcttgccgaaccttcgggtgcgatgggcgcatggatagccaacaagtgtgggatcgctgccaggtgtgcggtggcgacaactccacctgtagtcctcgtaagggctcgtttacagccggacgagcccgggagtatgttaccttcttgaccgttactcccaatttgacttctgtgtacattgctaatcaccgtcctctgttcacccacctggcagtgcggatcggtgggcggtacgtcgtggcaggaaagatgtctatcagccctaacactacatatccgtccctcctcgaagacgggcgcgtagagtaccgggtagctctgacagaagatcgtctgccaagactggaagagatacgcatatgggggcctttacaggaggatgctgacatacaggtgtatcgaagatatggggaggaatacggcaacttgacacgccctgacatcaccttcacttattttcagccgaagcctcggcaggcttgggtctgggctgccgtgagggggccatgctccgttagctgcggcgctgggctgagatgggtcaattacagttgtttggaccaagccagaaaggagctggtcgagaccgttcagtgccagggcagccagcaacctcctgcctggcccgaggcgtgtgttctggagccatgccccccttattgggccgtaggggacttcggaccctgcagcgccagctgtggaggtggacttcgcgagagacccgtgcggtgtgttgaagcccaggggtcactgttaaagacactacctccagctagatgccgcgctggagcccagcagcccgctgtcgccctcgagacctgtaatccccagccttgcccagctcggtgggaagtgtcagagccctcatcttgcacttctgccggcggggcaggtctcgctctggagaacgaaacttgcgtccctggggcggatggtctggaggctcctgtaactgaggggccaggctcagtggatgagaaactccccgcacccgagccatgcgttgggatgtcatgtccaccggggtgggggcaccttgacgccactagtgcaggggagaaggccccctccccctggggaagcatacgcaccggggctcaggctgcgcatgtgtggactcccgccgctggcagttgctccgtttcatgcggccgaggtcttatggagctccggttcctgtgcatggactccgcactcagagtcccggtacaggaagaactgtgcgggctagccagtaagcctgggagcagaagagaagtgtgtcaagccgttccatgcccagccaggtggcagtacaaactggctgcatgctcagtgtcttgtgggcgcggcgtagtccggcgcattctctactgtgctcgagcccatggggaggacgacggcgaggaaatactgctggacacacagtgccagggactgccgcgccctgaaccccaggaagcgtgttcgctagaaccttgtcctccaagatggaaggtcatgagcttgggaccatgttccgctagctgcgggctaggtaccgcacgaagatcagtcgcatgcgtgcagctggatcaaggacaggacgttgaggtcgatgaggctgcctgcgcggccctagtccgccctgaagctagcgtcccctgtctgattgccgattgcacctacaggtggcacgtggggacatggatggagtgctcagtgtcatgcggtgatggtatacaaagaagacgcgatacctgtttggggccacaggcgcaggctccagtgcccgcggacttttgccagcatttgcccaaacctgtgacagttcgcggatgttgggccggtccatgtgtaggacaagggactccttcgctcgtgccccacgaggaggcggctgctccggggcggaccaccgccacccctgccggggcgtctctggaatggtcccaggcacgcggtctgctgttctctccagctccccagcccaggcgactgctccccggccctcaagagaactctgtacagtcctcagcttgtggaagacagcacctcgagcctaccgggacaatagacatgcgagggcccggtcaagctgattgtgccgtcgcaatcgggcgaccccttggggaggtggtgactctgcgcgtgctggaatcctcactgaattgcagcgcgggcgacatgctgctgctgtggggcaggctgacatggcgcaaaatgtgtcgcaagttgcttgatatgacgttttccagcaaaactaacacactggtggtgaggcagaggtgcggaaggcctggaggaggggtgctcctgagatacggcagccagcttgccccagagactttctatagagagtgtgatatgcagctgtttggaccttggggtgaaatcgtgtctccatcgttgtctcctgccacatctaatgctggcggctgtcgcctgtttatcaatgttgcgccgcacgctcggatcgcaatccacgcccttgctacaaacatgggcgcagggacagagggtgctaacgcctcctacattctcatccgggatacgcattcgttaagaacgaccgcttttcacggccagcaggtcctctattgggaatccgaatcaagccaagccgagatggagttcagtgagggctttctgaaggcccaagcaagtctccggggccagtattggacactacagtcttgggtccctgagatgcaggacccgcagtcgtggaagggcaaggaagggacg

SEQ ID NO: 5610 - DNA, 4281 bp, Artificial Sequence
  Description of Artificial Sequence: Synthetic coding sequence
atgcatcagcgtcacccacgcgcccgttgccctccgctctgtgttgcgggtatcctggcctgcggattcctcctgggctgttggggcccgagccacttccagcaaagctgcctccaggccttagaacctcaggctgtctcttcgtacctctcaccgggcgcccctctcaagggccgacccccctctccgggcttccaacgtcagcgtcaacgtcaacgccgtgccgccggcggaatcctgcatctagaactgctggtcgccgtgggccccgacgtttttcaagcccaccaggaggatactgagcgctacgtgctcaccaacctcaacatcggcgctgagctccttcgcgaccccagcctgggcgcgcagtttcgcgttcatcttgtaaaaatggttatcctgactgaacccgagggagctccaaacattactgccaacctgacttcgtcccttttgtcagtttgcggttggtctcagactatcaaccccgaggatgataccgacccgggtcacgcagacctggtcctctacatcacccggttcgacctggaacttcccgacggaaatcgccaggtgcgcggagtgacccagttgggcggtgcatgctcaccgacatggtcgtgtctcattaccgaggacaccggcttcgatttgggagtgaccattgctcacgagatcggacactccttcggtctcgagcatgatggtgctcctggttctggatgcgggccttccggacacgtgatggcgagcgatggagccgcccctcgcgccgggctggcgtggtcgccttgcagcaggcgccagttactgagtcttctcagcgccggcagagcccgttgtgtctgggatcctccccgcccccagccgggttccgccggacacccccccgatgcccagcccggtctctactatagtgccaacgagcagtgtcgcgtcgccttcggccctaaggctgtcgcttgcaccttcgcccgcgagcatctcgacatgtgccaggccctcagctgccacacagaccccctcgatcagtcatcttgttcgcggctacttgtcccactgctcgacggtacagaatgcggtgtcgagaagtggtgctctaagggccgttgccgatccctagtcgaactcactcctattgctgccgtccacggacgctggtcgtcgtggggacctcgttccccgtgttcccgctcgtgcggtggcggcgtggtcaccaggcgccggcaatgtaataatccacgccccgcattcggtggccgtgcctgcgtcggcgccgatctgcaggccgagatgtgcaatacacaggcgtgcgagaagacccagttggaattcatgagccagcagtgcgcccggaccgatggccagccccttcgctcttcccctggcggcgcgtccttctaccactggggggccgcggtgccacacagccaaggtgatgctctgtgccggcacatgtgccgcgcaattggtgaaagcttcattatgaagcgtggcgacagcttcctcgacggcacgcgttgcatgccgagcggcccccgcgaggatggcactttatctctatgcgtttcgggatcctgccgcaccttcggctgtgacggccgtatggattctcagcaggtctgggatagatgccaggtttgtggaggtgataacagtacctgctcgccccgtaagggaagtttcaccgcaggcagagcacgggagtacgtgaccttcctgaccgttacgccgaacctcacctcggtttacattgcaaaccaccgtccgctcttcactcacctggccgttcgtataggtgggcgctacgttgtagcggggaagatgtccatcagcccaaacaccacctacccgtcgctgttggaggacggtcgcgtcgagtaccgcgtcgctttgactgaggaccgtctccccaggctcgaagagatccgcatctggggcccgttgcaggaggatgccgatatccaagtgtaccggcggtacggcgaggaatacggcaacctaacccgtcctgacattaccttcacctactttcagcccaagcctcgccaggcctgggtctgggccgcggtgcgcggcccctgttctgtttcttgcggagccgggcttcgttgggtcaactactcctgtctggaccaggcgcgaaaagaacttgtcgagactgttcagtgtcagggctctcagcagccgcccgcctggcctgaggcctgtgtcctcgaaccttgtccaccctactgggcagtcggcgactttggcccctgttctgccagttgtggcggaggtcttcgtgagcgtcccgtccgctgtgttgaagctcagggttccctcctcaagacgctcccgccggcacgttgcagagctggtgcccagcagcctgcggttgctctggagacttgcaatccacagccgtgccccgcccgctgggaggtgtcagagccttcctcctgtacctccgcaggcggcgcgggtctggctctcgaaaacgagacatgcgttcccggtgccgacggcctagaggctcccgtcactgagggtcctggctcggtcgacgaaaagttgccagctcccgaaccctgcgtcggaatgagctgccccccaggctgggggcacctggacgccacctctgccggtgagaaggccccatctccatggggctccattcgtactggagctcaagctgctcatgtctggacgcccgctgctggctcctgttctgtgagctgcggccggggtctgatggagcttcgtttcctgtgcatggactccgccctgcgtgtcccggtgcaggaggagctctgtggtctcgcctccaagccgggctcacgtcgtgaggtttgccaagcagtcccctgtcccgctcgttggcagtacaagctcgctgcgtgctccgtctcctgcggccgcggagtcgtccgccgtatcctgtactgtgcccgggcccacggcgaagatgacggtgaggagatattgttggatactcagtgccagggacttcccagaccggagccgcaagaggcgtgttctctggagccttgccctcctcggtggaaggtgatgagcctgggcccgtgtagcgcttcatgcggcctcggcactgcccgccgctccgttgcttgcgtccagctcgatcagggccaggacgtcgaggtcgatgaggccgcctgtgcagccctcgttagaccggaggcctccgttccctgcctcattgccgattgcacctataggtggcacgtgggcacgtggatggagtgctccgttagttgtggcgatggaattcaacgccgccgcgacacctgtctgggcccccaggctcaggctcccgtaccggctgatttctgccagcaccttcctaagcctgtgaccgtcaggggatgttgggcggggccgtgcgttggacagggcacgccgtcactggtgccccatgaagaggccgcggctccagggcgcaccactgccacccctgctggtgctagcctcgagtggtcccaggccaggggcctccttttctcgccggcccctcagccgcggcggcttttgcccggcccccaggagaactcggttcaatcttccgcctgcggccgtcagcacctggagcccaccgggaccatcgacatgcgcggtccaggccaggccgactgcgctgtcgctatcggtcggcctctgggcgaggttgtgaccctcagggtcctggagagctcactgaactgctctgccggcgacatgcttctgttgtggggtcgcctgacttggcgtaagatgtgtcggaagctcttggacatgactttctcctccaagactaacactttggtagtccgccagcgttgcggccgtccgggcggtggtgtcttgctgcgttatggctcgcaacttgctcctgaaactttttaccgggagtgcgacatgcaactcttcggtccatggggggagatagtctcgccttcgctctcccctgccacatctaacgccggcggttgccgcctgttcatcaacgtggccccacatgcccgaatcgctatccacgctctagccaccaacatgggtgccggcaccgagggtgcaaacgcctcctatatcttgatcagggacactcactctcttcgcactaccgcgtttcacggccaacaggttttatactgggagagcgagagctcgcaggcggagatggagttctcggagggtttcttaaaggctcaggccagcctccggggccagtactggacccttcaaagttgggtccctgagatgcaggatccgcagtcttggaaggggaaggagggcaca

SEQ ID NO: 5611 - DNA, 4281 bp, Artificial Sequence
  Description of Artificial Sequence: Synthetic coding sequence
atgcatcaacggcaccctcgcgccagatgtccccccctgtgcgtggccgggatattggcatgcggatttctgctgggctgctgggggccaagccactttcagcagtcatgtctgcaggccctagagccccaggctgtctctagttacctgagccccggagcaccactgaaagggcggccaccatcccctggcttccagcgccagcggcagcgacagcgacgcgccgccggcggtatccttcatcttgaactgctggtggcagtcggtcccgatgtgtttcaagcccatcaagaggatactgagcggtacgtgttaaccaatctgaatattggagctgagctgctacgagaccctagtcttggtgctcaattccgtgtgcacctggttaaaatggtgattctgacagaaccagaaggggcccccaatattaccgcaaacctgaccagctctctgctgtcagtctgtggctggtcacagaccatcaaccctgaggacgatacagatccaggccatgccgacctagttctgtatataactcgctttgacctagagctgcccgacggaaatagacaggtgcgcggagtgacccagctgggaggagcctgcagcccaacttggagttgtctcatcactgaggatacaggtttcgacctgggtgtgaccatagcccacgaaattggtcattcctttggtctggagcacgatggggccccagggtctggctgcggcccaagtggccacgttatggccagcgatggggccgccccacgcgctggcttagcttggtccccctgctctcggcggcagctattgagcctgttatctgctgggagagccagatgcgtgtgggatcccccgcgcccacagcctggctctgccgggcaccctcccgacgctcaaccaggcctatactattccgccaacgagcagtgcagggtggctttcggaccaaaggctgttgcctgtacctttgcccgggagcacctagacatgtgtcaggccctgtcttgtcacacagatcccctggaccagagcagctgttctagacttctcgtccccctactcgacggcacagagtgcggggtggagaaatggtgttctaagggcaggtgcagatcactggttgagttaacaccaattgctgcagtgcacggcagatggtcttcttgggggccacggagcccttgctcaagaagctgcgggggcggagtcgtcacccgtcgccggcagtgtaataacccccgacccgccttcgggggcagggcctgtgtcggtgccgacctgcaggctgaaatgtgcaacacccaagcatgtgaaaagactcagcttgagtttatgtctcagcagtgcgcacgtaccgatggccagccattgagatcttctccggggggtgccagtttttatcactggggcgccgccgtgccgcattctcagggtgatgctctatgcagacatatgtgccgggctattggcgagtccttcatcatgaagcggggcgacagctttttagacggcacaagatgcatgccctccgggccccgtgaagacgggactttgtctctgtgcgttagcggcagctgtagaacctttgggtgtgacggacggatggatagccagcaggtgtgggaccgttgtcaggtgtgtgggggtgataacagcacatgttctcctcggaaaggctcctttaccgccgggagagcccgcgaatatgtgactttcctgactgtgacacccaacctgacaagtgtgtacattgccaaccaccggcctctatttacccacttagccgtgcgaattggagggaggtacgtggtggctggtaagatgagcatttctccaaacaccacctatccctccctgctggaagatggcagggtggagtatagagtggccctgactgaggataggctgcccagactggaggaaatccgtatatggggccccctgcaggaagacgccgatatacaggtgtataggagatacggggaggaatacggcaatctgacccgccctgacatcacatttacttatttccagccaaaaccccggcaggcctgggtctgggctgctgtccgcgggccttgttccgttagttgtggggccggcctgcggtgggtgaattatagctgtctggaccaagcacgaaaagagctggtcgaaaccgtgcagtgccagggcagccagcagccaccagcttggcccgaggcatgtgtcttagaaccatgtcctccctattgggccgtgggcgatttcggaccatgcagcgcctcttgtggcggcggccttagggagagaccagtgaggtgtgtggaagcccagggaagcctgctgaaaaccttgcctccagcacgctgccgtgctggggcccaacagcccgcagtagctttagagacctgcaacccacaaccatgccccgcccgatgggaagttagtgagcctagttcttgcactagcgcaggcggcgctggcctagcactagaaaacgaaacttgcgtacctggcgcagatggtctggaagcaccagtgaccgaaggaccagggtctgttgatgagaaactcccagctccagaaccttgcgtgggcatgagctgcccgcccggatgggggcacctagatgctaccagtgccggcgaaaaggctccaagtccctggggtagtatacgcaccggcgcccaggctgctcacgtatggactccagcagccggctcctgctctgtctcttgcgggcggggcctcatggagctgagattcctgtgtatggatagtgcacttcgggtgcctgttcaagaggagctatgcggcttagcctccaagcctggatcacgacgcgaggtttgccaagcagtcccttgccctgccagatggcagtacaagctggccgcctgcagtgttagttgtggccgcggcgtcgtgcgtcgcatcctgtactgcgcacgtgcacacggcgaagacgacggcgaggagatactgctggacactcaatgtcagggcctacctcgccccgagccccaggaagcttgtagccttgaaccatgtccccctcggtggaaggtgatgagcctcggaccctgttctgcttcatgtggcctgggcactgcccgccggagcgtggcctgcgttcagctagatcagggccaagatgttgaggtggatgaggcagcctgcgcagccctggttcgccccgaggcctcagtgccctgcctaatagccgattgcacataccgatggcacgttgggacatggatggagtgttctgtgtcctgtggagacggaatccagaggcggagggacacctgcctggggccacaggcacaggcacccgtgcccgccgacttctgccaacacctgcctaaaccggtgaccgtgcgcgggtgctgggctggcccctgcgtgggccaaggcaccccgagtctggttccacacgaagaagcagctgcccccggccgtacaactgccacacctgctggcgcctccctggagtggagtcaggctagagggctcctgttctcaccagctcctcagcctcgtcgcctgttgcctggcccacaggaaaacagtgtgcagagctccgcttgtggccgacagcacctagagcccacaggcaccattgatatgagaggaccaggacaagccgactgcgcagtggcaataggccgccctcttggtgaggtggtgacactaagagtgctggaaagtagtctgaactgttccgctggcgatatgctgctgctttggggccggctaacatggaggaagatgtgtaggaagctcctcgatatgacattcagcagtaagacaaatacactcgtagtgcgtcagcgctgcggtcgaccaggcggaggcgttctactgcggtacggctctcagctggccccagaaaccttctatcgagagtgcgatatgcagctattcggcccatggggcgaaatagtgagcccatctctcagccccgccaccagcaatgctgggggctgcagactgtttataaatgtcgccccacatgcccgcatcgctatccacgccctggcaacaaatatgggagccggcacagaaggggccaatgcttcatatatccttatacgcgatacccattcattacgcacaacagcctttcatggtcaacaagtgctgtactgggaatccgagtccagtcaggccgagatggaattctctgaaggcttcttaaaggcacaagcatcccttcgcggccagtattggaccctgcaaagctgggttcccgaaatgcaggacccccagagctggaaaggcaaggaggggact

SEQ ID NO: 5612 - DNA, 4281 bp, Artificial Sequence
  Description of Artificial Sequence: Synthetic coding sequence
atgcaccagcgccatcccagagcacggtgcccccctctgtgcgtggctgggattcttgcttgtggcttccttctgggatgctggggaccatctcatttccaacagagctgtttgcaggcactggagcctcaggccgtcagtagttacctctcccctggcgcccccctcaagggaagaccaccttctcctggtttccagcggcagcgacagcgccaacggcgcgccgcaggtgggatactgcacttggaactgttggtggctgtcgggccagatgtgttccaggcgcatcaggaggatacggaaaggtatgttcttactaatttgaatatcggggccgaacttctgagggatccctcccttggagctcagttccgggtgcatctggtcaaaatggtgatcctgaccgagccagagggtgcgccgaacataacggcaaacctgacatcctctcttttgtcagtgtgcgggtggtcccaaacaattaacccagaggatgacacggatcccgggcatgccgatctggttctctatatcacacgcttcgatctggagctcccagacggtaataggcaggtgcgcggcgtcacgcaactcggcggtgcctgctcccccacttggtcatgcctgatcactgaagataccggatttgacctcggagttacaattgcccacgagatcggccattccttcgggcttgagcatgatggtgcgcctggcagcgggtgcggtccaagcgggcacgttatggcaagcgacggtgccgccccacgggcagggctggcatggtccccttgtagtcgcaggcagctcctgtccctgctgtctgctggcagagcaagatgcgtctgggatccaccgaggcctcagccagggagtgcgggccacccacccgacgcccaaccagggctgtactatagcgccaacgagcagtgtcgggtcgcgtttggacctaaagccgttgcttgcacattcgctcgagaacatctcgacatgtgccaagctctgagctgccatacagatccactcgatcagagcagttgttcacgcctgcttgtacctttgctggatggaactgaatgcggtgtggagaaatggtgttcaaaaggacgatgcagatctctcgtcgagctgacccccatcgctgccgttcacggaaggtggtccagttggggaccccggtccccctgcagccgcagttgcggaggcggagtcgtgacacggaggagacagtgcaacaatcctcgacctgcattcggtggccgggcttgcgtaggcgctgacctgcaggctgagatgtgcaatactcaggcatgtgagaagactcaactggaattcatgtcccagcagtgcgcgagaactgacgggcagccactcaggtcctccccgggcggtgcctctttctaccattggggagcagccgtgccacattcccagggcgatgctttgtgccggcacatgtgtcgcgcaattggtgagtcatttatcatgaagagaggggattcttttctggatggcaccagatgtatgccatctggaccccgcgaagacgggaccttgtcattgtgcgtgtctgggtcctgtcgaacatttggctgtgacggacggatggactcccagcaggtctgggacaggtgccaagtgtgtggaggagacaattcaacatgtagccctcggaagggatcatttaccgccgggagggccagagaatacgtgaccttcttgaccgtgacgccgaacctgacctctgtttacatcgcgaaccacagacccctgtttacccacctcgccgttagaatcggaggtcgctatgtggtggctggcaaaatgtcaatatcccctaataccacatacccgagcctgcttgaagacggacgagtcgaataccgggtggcgctcacagaagacaggctgccccggttggaggaaatacgcatatggggtccactccaagaggacgccgacatccaggtctatcgccgatatggtgaggagtatggtaatctgacccggcccgacatcacgttcacttactttcagccgaagccccggcaggcgtgggtttgggctgcggtcagagggccatgctcagtgtcctgcggagccgggcttcgatgggtaaactactcttgcctggatcaagcacggaaggaactcgtcgagactgtgcagtgtcaggggagccagcagccccctgcatggcccgaggcctgcgtgttggaaccatgtcccccatattgggccgtaggggactttggaccctgttccgcctcctgtggcggaggtctccgggaacgacccgttcgatgtgtggaagcgcagggctctctgctcaaaactctcccccctgcgaggtgtcgcgccggggcgcagcagccggccgtggccctcgaaacatgcaacccccagccatgcccagctcgctgggaggtctctgaaccatccagttgtacgtccgcagggggtgcaggactggcgctcgagaacgaaacctgtgtgcccggggctgatggactggaggcccccgttaccgagggaccaggttctgtcgacgaaaagctgccagcccccgaaccctgtgtgggcatgtcctgtccaccaggctgggggcacctggatgcaacgagtgcaggcgagaaggcccctagtccctgggggagtattcgcacgggggcgcaggccgcccacgtgtggaccccagcagcgggtagctgtagcgtgtcctgcggacggggactcatggagctcagattcctttgcatggactcagctttgagggtacccgtgcaggaggaattgtgtggcttggcttccaaacctgggtcaagaagggaggtgtgccaggctgttccatgtcctgccaggtggcaatataagctggcggcatgttcagtttcttgcgggaggggggtcgtgaggagaattctgtactgcgccagggcccacggcgaggatgacggcgaggaaatcttgctggatacccagtgccaggggctcccacggcctgagcctcaggaagcctgcagcctggagccgtgcccgcccaggtggaaggttatgagtttggggccctgctccgccagctgcggactgggaacagcacggcgctcagtggcctgcgtgcagctggatcagggccaggacgttgaggtggatgaggcggcctgtgccgcccttgtgcgaccagaagcttccgtgccctgtctgatcgcggactgcacctatagatggcatgtggggacgtggatggaatgttccgtgagctgtggcgatggcatccagagaaggagagatacctgcctgggcccccaggcccaggccccggttcccgcagatttttgccagcacctgccaaaacccgtgaccgtgcggggttgctgggccgggccatgcgtgggccagggaacgccctccctggtaccacacgaagaggctgccgctcctgggagaaccaccgccacccctgccggggcctcacttgaatggagccaggcccggggcctgctgttttcccctgcgccccaaccacgcagactcctgcccggaccccaggaaaatagcgtgcaatcctcagcttgcgggaggcagcacctggagcccaccggtaccatcgatatgagaggcccaggacaggcggattgtgccgtcgctatagggagacctctgggggaggtggtgactctccgcgtgttggaaagttccctcaattgttctgctggagatatgctgctgctgtgggggagactgacctggagaaaaatgtgtcggaagctcctggacatgacctttagtagcaaaacaaacaccctcgtcgtcagacagaggtgtgggagaccggggggcggagtcctcctccggtacggttctcagctggctcctgagactttctatagagaatgcgatatgcagctctttggaccttggggcgagattgttagtccatccttgtcacctgccacctctaacgccgggggatgtagactgtttattaacgtagcaccacacgctcgcatcgctattcacgccctggccaccaacatgggcgctgggacagagggcgcgaatgcgagctatatccttatccgcgatacccattctctgcgaacgacggcttttcacggacaacaggtactgtactgggaaagcgaaagttcccaggccgagatggagtttagcgagggatttctgaaagcacaggccagtctgcgcggccagtattggacgctgcagagctgggttcctgagatgcaagatccgcagtcctggaagggcaaagagggaaca

SEQ ID NO: 5613 - DNA, 4281 bp, Artificial Sequence
  Description of Artificial Sequence: Synthetic coding sequence
atgcaccagagacacccgcgcgcacgctgcccgccactctgtgtggcaggaattctggcctgcggcttccttttgggctgttggggaccctcccactttcagcaatcctgtctgcaggctctggagcctcaggccgtgtcttcttatctgagccctggcgccccactgaaaggacgcccgccgtctcccggctttcagaggcagagacaacgccaacgccgcgctgccggcggcatcctgcacctggaactcttggtagcggtgggcccggatgtcttccaagcccatcaagaggatacagagcgctacgtgctcacaaatttgaacattggtgctgaattgctgagggatccctccttgggagctcaattccgcgtccatttggttaaaatggtgatcctgaccgagcccgagggagccccaaatattactgctaatctgacaagttcccttttgtcagtttgcggttggagccagaccatcaacccggaagacgatactgaccctggtcacgccgacctggtgctgtacattacccgcttcgacttggaactgcccgatggtaatagacaagtgagaggagtaacccagttgggcggagcatgcagtcctacgtggtcatgcttgattaccgaagatacaggtttcgaccttggcgtgacaatcgcgcacgagatcggtcactcttttggcctcgaacacgatggtgcccccggcagcggttgcggaccatcaggccatgtgatggcatcagatggcgcggctccgagggccggactggcgtggagtccttgtagcaggcgccagctcttgtctctgcttagtgccggccgcgctaggtgtgtttgggatcccccaaggccccaacccggatctgcaggacatcctccagacgcacagccaggtctctactactctgcaaacgagcaatgtcgcgtcgcctttggccctaaggccgtcgcctgcactttcgccagagaacacctggatatgtgtcaggccttgagctgtcacactgacccactggaccaaagctcctgttctaggctgctggtgcccctgctggatggcaccgagtgcggcgtggaaaagtggtgtagcaagggcaggtgcaggagtctggttgagttgactccaatagctgctgtacacggaaggtggtcatcttggggacctaggtctccctgctcaagaagctgtggcggcggagtggtcaccagaaggaggcagtgcaacaaccccaggcccgccttcggtggtagggcttgcgtgggagcggatcttcaggctgaaatgtgtaacacccaagcttgtgagaagacgcagctggaatttatgtcccagcagtgcgcaaggactgacggccagccgctgaggtcatctcccggcggcgcatccttctaccactggggcgcagccgttccccattctcagggcgatgctctgtgcagacatatgtgcagggcgatcggtgaatcctttattatgaagcgcggcgatagtttcctggatggtactcgctgcatgccttcaggtcccagagaggacggaacactgtccctttgcgtcagcggcagctgtagaacattcggctgcgacggaaggatggacagccagcaggtctgggaccgctgccaggtatgtggcggcgataattctacttgctctcctcgcaagggatcattcactgccggacgcgcacgcgagtacgtcaccttccttaccgtgactcctaaccttacttctgtgtatattgctaaccatagacccttgttcacccatttggccgttaggatcggcggtaggtatgtggttgctggcaaaatgagtatttctcctaatacgacatacccgagcctgttggaggacggacgcgttgaataccgcgttgcgcttaccgaggacaggttgcctaggttggaagagatcaggatctggggtcctcttcaggaggacgctgacatccaagtgtacagaagatacggcgaagaatacggcaatttgactcgccctgacatcacatttacttactttcaacccaaacccagacaagcatgggtgtgggcagcggtcagaggaccgtgctccgtgtcctgtggtgctggcctgagatgggtcaactactcctgtctcgaccaggccaggaaggaactcgtggaaaccgtccagtgccagggatctcaacaaccaccggcctggcctgaagcatgcgttctggagccctgccccccctattgggctgtaggcgatttcggtccctgcagcgccagttgcggcggcggcctgcgcgagaggcctgtgaggtgcgtagaagctcagggctctctcttgaagaccttgccccctgcacgctgcagggctggtgctcaacagcccgcagtggctctggagacctgcaatccacagccctgcccagctaggtgggaagtgtccgagccgagtagttgtacgagtgctggtggagccggactcgcactggagaacgagacgtgtgtaccgggagctgatggccttgaagcacccgtgaccgaaggacccggttcagtggacgaaaagttgcctgcacccgagccatgtgtgggtatgtcttgcccacccggctggggtcatctggacgctacctccgccggagaaaaggcaccgtccccatggggcagcatcaggaccggtgcgcaggctgctcacgtttggacccccgcggccggatcctgctctgtcagctgtggaaggggtctcatggagctgagattcctgtgcatggactcagccctgagggtacctgtgcaggaagagctttgcggcttggctagcaagcccggatctcgcagagaggtgtgtcaagccgtgccgtgcccggccagatggcaatataaacttgccgcctgttccgtctcatgcggccgcggagtggtcagaagaattttgtattgtgctcgcgctcacggcgaggatgacggcgaggagatactgctggacacccagtgccagggtcttccacgcccagagccccaagaggcatgctcccttgaaccctgtccaccccgctggaaggtaatgtcactgggaccttgttctgcttcttgcggactgggtaccgccaggagatccgttgcttgtgtgcagctggaccagggacaggatgtcgaggttgatgaggctgcatgcgctgctctggtgagacccgaagctagtgtcccctgcttgattgccgattgcacctaccgctggcacgtcggcacctggatggagtgtagtgtgagttgcggtgatggaattcaacgcaggagagacacatgtctgggtccccaggctcaagcacccgtgcccgcagacttttgtcagcatttgcccaagcctgttaccgttcgcggctgctgggctggcccgtgtgtgggacagggcacaccaagtctcgtgccccatgaagaagctgcagcgcctggtcgcaccacagctactccagctggagcgtccctggagtggagccaggcgagaggactgctgttttcaccagctccacagccccgcaggctgctgccgggaccacaagagaactcagtgcagagtagcgcatgtggaaggcagcacctcgaacccaccggcaccatcgacatgcgcggccctggtcaggccgattgcgcagtcgcgataggtagacctctgggcgaagttgtgaccctgagggttctggagtcaagtctgaattgttctgcaggcgacatgttgctcctgtggggccgcttgacctggagaaaaatgtgccgcaagctgttggatatgactttttcctcaaagaccaacacactggtagtgaggcaacgctgcggcagacccggaggaggtgtgctgctgagatacggtagccagcttgcgcctgagactttctacagagagtgtgacatgcagcttttcggcccttggggagaaatcgtgagcccttctctttctccggctacttctaacgccggtggatgtagacttttcataaacgtcgctccgcatgcccgcatcgccatccatgctttggctaccaacatgggagccggaaccgagggcgctaatgcttcatatatcctcattagagacacacattcactgaggactactgcctttcacggccagcaagtcctctattgggagagtgagagttcccaggccgaaatggagttttcagaaggtttcctcaaggcccaggcctccctgagaggacagtactggaccttgcagtcatgggtaccagaaatgcaggacccccaaagctggaagggtaaggagggcact

SEQ ID NO: 5614 - DNA, 4281 bp, Artificial Sequence
  Description of Artificial Sequence: Synthetic coding sequence
atgcaccagcggcatccgagggctcgttgtcccccactttgcgtcgctggaatcctcgcatgtgggtttttgcttggatgttgggggccatcgcattttcagcaaagctgccttcaggcgcttgaaccacaggcggtgtcttcatacttgtcaccaggagccccattgaagggaagaccgccgtcgccaggatttcaaagacaaagacagcgccaacgtcgcgcggcgggagggattttacacctggaattacttgtagctgtaggaccagatgtattccaggcacatcaagaggacacagaaaggtatgtgctaacaaatctcaacattggagctgaactcttgcgcgacccatccttgggagcccaattccgcgtccaccttgttaagatggtcattcttactgaaccagagggagcacctaatatcaccgcgaatttgacgtcttcattgctatcagtctgcgggtggagccaaactattaatccagaagatgataccgatcctggtcatgctgatttagtcttgtacataacgcgttttgatttggaactgcctgatggaaatcgacaagtcagaggagtgacccaattgggcggtgcatgctccccaacttggtcatgccttattaccgaggacacgggattcgatctgggagtaaccattgcccatgaaatcggtcattccttcggattggaacatgacggagccccaggaagtggatgtggtcctagtgggcatgtcatggcaagtgacggtgccgcgccaagagcaggattggcgtggagcccgtgctcgaggagacagttgctatcacttctctcagctgggcgagctcgatgcgtttgggacccacccagacctcagccgggatctgcgggtcatcctccagatgctcagccgggattgtattactctgcaaacgaacagtgtagagttgcatttggaccaaaagcagttgcttgtacgtttgcacgggaacacttagatatgtgccaagccctgtcatgccacactgacccgctcgatcaatcaagttgttccaggctgctcgtgccactgctggatggtacagaatgtggtgtggagaaatggtgttctaaggggagatgtcgatctctggttgagctgacaccaattgcagccgtccatggacgatggtcctcctggggacctcgctcaccgtgctccagatcatgcggagggggagttgtcaccaggcggcgccaatgcaataatccaagaccggcctttggtggcagggcatgtgttggcgcagatcttcaagcagaaatgtgcaatacacaagcatgcgaaaaaactcaactcgaatttatgtcccagcaatgtgcccgaactgatggacaaccattgcgttctagccccggaggtgcctctttctatcattggggagcagcagtcccgcattcccaaggcgatgctctatgtcgccatatgtgcagagctataggagagagtttcatcatgaaaagaggagattcattcttggatggcacacgatgtatgccctccggacctcgagaggatggtacattgtctctatgcgtttccggatcttgtagaacctttggttgtgatggaagaatggacagccaacaggtctgggatagatgccaggtctgcggaggagataattctacatgtagtccacggaaaggaagttttaccgcaggaagagcccgcgaatatgtgactttcctcacagttacaccaaacctaacctccgtctatattgcgaaccaccgaccgctgtttactcacttagctgttcgtataggaggacgctatgtcgttgccggaaagatgtccatcagtccaaacaccacatatccgtcgctactagaagatggacgagttgagtatcgagttgctttaaccgaggatagattgcctagactcgaggaaattcgcatctggggcccattgcaggaggatgcagacatccaagtttatcgacggtatggagaagagtacgggaacttgactagaccagatattacctttacttattttcaacctaaaccgcgacaagcttgggtctgggcagcagttcgtgggccatgttcggtttcgtgtggagcaggtctgcgatgggtcaattattcttgcttggatcaagcccgtaaggaactcgtggagacagtacagtgtcaaggatcccagcaacctcccgcctggccagaggcatgtgtccttgagccgtgtccaccttattgggcagtgggtgattttggcccttgcagcgcatcatgtggtggaggtttgcgagaacgaccagttcgttgtgtcgaggcgcaagggtccctgctgaagactctacctccggcccgttgccgagctggagcacaacaaccagcagttgctttggaaacatgcaacccacagccttgtccggctagatgggaagtttcagaaccgtcatcctgcacatcagcaggtggagctggacttgcacttgagaacgaaacgtgtgtgccgggagctgacggattggaagctccggtcactgaggggccagggtcggtcgacgaaaaattaccagcacctgaaccttgtgttggaatgtcttgtccaccaggatggggacatttggatgcaaccagtgctggcgaaaaagcaccgtcaccgtggggatcaatacgaactggagctcaggctgctcacgtgtggactccagcggctggctcctgttctgtttcgtgcggacggggacttatggaattacgttttctttgcatggatagcgcattacgtgtgccagttcaagaagaactttgcggtcttgcttctaagcctggaagccgcagagaagtgtgtcaagccgttccatgcccggctcggtggcaatacaaacttgctgcttgttcggtctcatgtggacgaggagttgttcgacgaattttgtattgtgccagagcccatggagaggatgacggagaggagatcctccttgatacccaatgccagggactcccgcgtcctgagccacaggaggcatgctctctcgaaccatgtcccccacgatggaaagtcatgagtctcggaccatgtagtgcctcatgtggacttggaactgccagaaggtcggttgcttgcgtccaactggatcaaggtcaggacgtcgaggtcgatgaagcggcttgtgctgctcttgttagaccggaagcatcggtaccttgtctgattgcagattgcacatatcgctggcatgttggaacatggatggaatgcagcgttagttgcggagacggaattcaacgtcgtagagacacttgtcttggtcctcaggctcaggctcctgttccagcagatttctgtcaacatcttccgaagccggtgacagttcgaggatgctgggccggcccctgtgtgggacaaggaacaccttcactcgtaccccacgaagaggcggcagcgcccggtagaacaactgcgacgccggctggggcaagcttggaatggagtcaggctagaggtcttttgtttagtccagctccacaaccacgtagactgttgccaggacctcaagagaattctgtgcaatcctcagcttgtggaagacagcacctcgaaccaacgggaacgatcgatatgcgagggcctggtcaggctgactgcgctgttgccattggtcggcctcttggtgaggtagtgacattacgtgttcttgaaagttccttgaattgttctgctggagatatgttgcttctgtggggaaggttgacctggcgtaaaatgtgcagaaaactactcgatatgactttttcttctaagacgaacactctcgtagttagacagagatgtggaaggcctggaggtggagttttgctacgatatggttcgcaacttgcaccggaaactttttatcgtgagtgtgacatgcagctgttcggtccatggggagaaattgtttccccgagcctgtcaccagcgacttctaatgctggaggttgtcgcctttttattaacgttgcgccacacgcccgtattgctattcatgccctcgctaccaatatgggcgccggtactgaaggcgccaacgcttcgtatattctcattagagatacccactcgctcaggacaacggcctttcatggccagcaggttctttattgggagtctgagagttcacaagcagaaatggaattttcagaaggattcctcaaagcacaagcaagcttgcggggacagtattggacgctccaatcttgggtcccagagatgcaggacccacaatcgtggaaaggaaaggagggaacg

SEQ ID NO: 5615 - DNA, 4281 bp, Artificial Sequence
  Description of Artificial Sequence: Synthetic coding sequence
atgcaccaaaggcaccctagagctagatgtcctcccctgtgcgttgctggaatactcgcttgcgggttcctgctgggatgttggggtccatcccactttcagcagagctgcttgcaagctcttgagccacaggccgtatccagctacctgtctcccggcgcaccactgaaaggccggccaccctcaccaggattccaacgccagaggcagcggcagcgaagggccgccggaggcatcctccacctcgagctgctggtggcggtaggtccagatgtctttcaggcccaccaggaagatactgaaaggtacgtgctgacaaacctcaacataggggccgagctgttgagagacccgtcactgggagctcaatttagagtgcatctcgtgaagatggtgatcctgacagagccggaaggcgctcctaatatcacagcaaacctcacttcttccctgcttagtgtgtgcgggtggagtcaaacaataaacccagaggacgacaccgatcccggacacgcggatctggtcttgtacatcacccggtttgaccttgagctgcctgatggcaataggcaagtgcggggcgtaacccagctcgggggggcctgctctcccacatggagctgtttgatcaccgaagatacgggattcgatttgggggttaccatcgcccatgagatcgggcactcttttggcttggagcacgacggcgcaccagggtctgggtgcggaccttcaggtcatgtgatggcctctgacggggccgctccccgcgctggcctggcgtggtctccatgtagccgcaggcaactgctgagcctgcttagcgccggtcgcgccagatgcgtttgggaccccccacgccctcagcccggaagcgcaggtcaccctccggacgctcagccaggcttgtattattctgccaacgaacagtgtagggtcgcctttggcccaaaagctgtcgcatgtaccttcgcccgggagcacctggacatgtgccaggcactgagttgccacacggaccccctcgaccagagttcttgctctcgacttctggtgccgttgctggatggcaccgaatgcggcgttgagaagtggtgttccaaaggtaggtgtcggagtttggtggaactgacacccattgcagctgtccatgggaggtggtcaagctgggggcctcggtcaccttgctctagaagctgcgggggtggggttgtcactagaagacgccagtgcaataatccaaggcccgctttcgggggacgcgcttgcgttggcgccgatctgcaggcagaaatgtgtaatacacaggcgtgtgagaagacccagctcgagtttatgagtcagcagtgtgccaggacagacggtcagccgctgaggagctctccagggggagctagcttttatcactggggagcggctgtccctcattctcaaggggatgcattgtgtaggcatatgtgccgggcaatcggcgaatcattcattatgaagcgcggggactccttcctggatgggacacgctgcatgccgtctggcccgagagaagatggtacgttgagcctgtgcgtgtccggcagttgtagaacatttggctgcgatggccgcatggattctcagcaagtgtgggacaggtgtcaagtgtgtgggggggacaacagtacatgttcacctcggaaggggagcttcacagctggccgagcgcgagaatacgtcacgtttctgaccgtgacaccgaatcttacctctgtgtacatcgccaatcaccggccccttttcactcacctcgccgtacggattggtgggcggtacgtagtggccggaaaaatgtccattagtcccaataccacctacccttccttgctggaagatggcagagtagagtaccgagtcgctctgactgaggatcgcttgcctcgcctggaggaaatcagaatatgggggcctttgcaggaggatgccgacatacaggtttatcgaagatatggcgaagagtatggcaatctgaccaggccggatatcacattcacatattttcagcccaagcctaggcaggcttgggtgtgggccgctgtgagggggccttgcagcgtctcttgtggggccggattgagatgggtcaactattcctgccttgaccaggccaggaaagagctggtagagactgtccagtgccaggggagtcaacaaccacctgcctggcccgaggcatgtgtcctcgaaccctgcccaccttactgggccgtaggggatttcgggccatgtagcgcttcttgcgggggggggctgcgcgagcgaccagtcagatgtgtggaggcccagggttctcttctgaaaacactgccgccggctagatgccgcgccggcgctcaacaaccggcagttgctcttgagacttgtaatcctcagccatgtccagcccgctgggaggtctcagaaccatcaagctgcacaagcgctggaggggcaggcttggccctggaaaacgagacttgcgtgcctggtgccgatgggctggaggcaccagtgacagaaggcccaggctccgtggacgagaagctgcccgccccagaaccatgtgtgggcatgtcttgcccaccagggtggggccatctggacgcaacaagcgctggcgagaaggcccccagcccctggggaagcattagaaccggagctcaggccgcccatgtgtggactccagcagctgggagctgctcagtcagctgcggtaggggcttgatggaactgaggttcctttgtatggactcagccctgagggttccagtacaggaggaactctgtgggcttgcctccaagcccggatcccgacgcgaagtgtgtcaggcagttccgtgccccgcaaggtggcagtataagctcgctgcgtgtagcgtaagctgcggccgcggtgtggtgcgccgcatactttattgcgccagagcccatggagaggacgacggcgaagaaattctgctggacacacagtgtcagggcctcccccgcccagagcctcaggaagcctgctctctggagccctgcccccccagatggaaagtgatgtctctcggtccttgtagcgcctcctgcggactcggtaccgctagacggtcagtcgcatgcgtgcagcttgaccagggccaggatgtggaggtggacgaggctgcatgtgccgcactcgtccggcccgaggcatcagttccttgtcttatcgctgattgcacatacaggtggcacgtgggcacgtggatggagtgctcagttagctgtggagacggcatacagcgccgcagagatacatgccttggtccccaggcgcaagcccccgtccctgccgacttctgccagcatctccccaagcccgtgaccgtaaggggttgttgggctggcccttgtgtgggacaaggtaccccctccttggtgcctcacgaagaggctgcggcccccggcagaacaacagccacccccgctggagcctctcttgagtggtcacaggccaggggcttgctgtttagtcccgcgcctcagcctcgccgattgctgcccggaccgcaggaaaacagtgtgcagtctagcgcgtgcggaagacagcatctggaacccactggaactatagacatgcgcgggccaggtcaagctgattgcgccgtcgcaattgggagaccacttggagaggtggtgaccttgcgggtgctggaatccagcttgaactgttccgctggcgatatgttgctgttgtgggggagactgacttggaggaagatgtgtagaaagctgcttgacatgacattttctagcaagaccaacacactcgtggtaaggcagaggtgtggccgccctggtggaggggttctgctgagatatgggagtcaactcgcacccgagacattctatcgagaatgcgatatgcagctgttcggcccctggggcgagatagttagcccttctctgtctccagccacatctaatgcaggtgggtgtcgacttttcatcaatgttgcaccgcatgctagaatcgccatccacgctctggcaacaaacatgggcgccggaacggagggggcgaatgccagttatatcctgatccgggatacccattcactgagaactactgccttccatggccagcaggtcttgtattgggaatcagaatcatcccaagcagagatggagttcagcgaggggtttctgaaggcccaggcatcactgaggggccagtactggactctccagagctgggtccctgaaatgcaggatccccagtcttggaaggggaaagagggaaca

SEQ ID NO: 5616 - DNA, 4281 bp, Artificial Sequence
  Description of Artificial Sequence: Synthetic coding sequence
atgcaccaaaggcatcctagggcaaggtgccccccactgtgcgtagccggcatcctggcgtgcggtttcctgctgggttgctggggtccttcacacttccagcagtcctgtctgcaagcactcgagccccaggctgtgtctagctatctgtctccgggtgcaccgcttaaagggagaccaccctccccagggtttcagaggcagaggcagcgacaacgcagagccgcaggtgggatactacatctggagcttttagtggcggtcggtcctgacgttttccaggcccaccaggaggatacagaaagatatgtactgaccaacttgaacattggtgccgagctccttcgggatccttccctgggtgcccagttcagagttcacctggttaagatggttattctgaccgagcccgagggcgcaccgaacattacagccaacctaactagtagtctgctgagtgtttgtgggtggagccagacaattaatcctgaggatgacaccgatcccggtcatgcagacttggtcttatacatcacacggttcgacctggagctacccgacggtaaccggcaggttcgcggagtgacccagctgggcggtgcatgttccccgacatggagttgcctgatcaccgaggatacgggcttcgaccttggcgtgactatcgcacacgagatcggacattcttttggcctggagcatgatggcgctcccggatcagggtgcggaccgtcagggcatgtgatggcctccgacggggctgcgccccgcgccggactggcttggtccccgtgctcccggagacagctgctctccctccttagcgccggaagagcccggtgcgtttgggaccccccccgccctcagccaggttccgccggacaccctcccgacgcgcagccgggcctatactattccgccaatgagcagtgcagggtcgcattcggccctaaggccgtggcatgcacctttgccagggagcatctggacatgtgccaagctctctcctgtcacaccgaccctctagatcagtccagctgtagccgactgcttgtacctctgctcgatggcacagagtgcggcgtcgaaaaatggtgctctaagggaagatgcaggagcttggtggagctgacccctattgccgcagtacatgggcggtggagctcttgggggcctcgcagtccttgttcccggtcatgcgggggtggcgtggttacacgacgcagacagtgtaataatcctcgaccagccttcggcggacgggcttgcgttggagcagatctgcaggccgagatgtgcaatactcaggcatgcgagaaaactcaactggaatttatgtcccagcaatgcgccagaactgacggccagcccttgagatcctcacctggaggtgcatctttctatcattggggggcagccgtcccccactctcagggggatgccttgtgtcgtcatatgtgccgagcaattggtgaaagcttcatcatgaaaagaggggatagcttcttggacggtaccaggtgtatgccgtccggaccccgcgaggatgggacattgagcctgtgcgtttcaggcagctgtaggactttcgggtgcgacggaaggatggactcgcagcaggtatgggatcgttgtcaagtctgcggcggcgataattccacctgctccccaagaaagggctcattcacagctggaagagccagggaatacgtgacatttttgacggtgacacccaatttgacaagtgtgtacattgctaatcatcgccccctattcacccatttggctgtcagaattggcgggcggtatgtggtcgctggtaaaatgtctatatcgcctaacacaacttacccaagccttctcgaggacgggcgagtcgagtaccgtgtggcattgacagaggacaggctgccaaggttagaggaaatcagaatttggggccctctccaggaggatgcagacatccaagtctatcgaaggtatggagaggagtacgggaatttgacacgacctgatatcacattcacatactttcagccgaagcctaggcaggcgtgggtctgggccgctgttagggggccctgtagcgtttcttgcggcgcaggtcttcggtgggtgaactactcctgtctcgaccaggccaggaaggagcttgtggaaaccgtgcagtgtcagggatcacagcagccaccggcgtggccagaagcgtgcgtgctggaaccatgtcctccttactgggccgtgggtgattttggaccctgctctgcatcctgcggaggcgggctcagagagcgcccagtgagatgcgtggaggcgcaggggagcctgctcaaaaccctacccccggccaggtgccgggccggggcacagcaaccagccgtggctctggaaacttgcaaccctcagccatgtcctgcccgctgggaagtgtccgagccaagtagctgtacgtccgccggaggggctggtctcgctctggagaacgagacatgcgttcctggcgcggacggactggaagcgcccgtgacggaagggcccggaagcgtggacgagaagcttccagcccctgagccatgcgttggcatgtcctgccctcctggctggggacacctggacgctacctcggccggcgagaaggccccttctccttggggctcgatcagaaccggcgcgcaggcggcccatgtatggacacccgccgcaggctcatgttcagtcagttgtggcaggggccttatggagctgcgctttctctgtatggattccgctctacgggtgcctgtgcaggaggaactttgcggcctggcgtcaaaacctggctctcgccgggaagtctgtcaggccgtgccatgcccggccaggtggcagtacaagctagcagcttgctctgtgtcttgcggccgaggagtggtgcggagaattctgtactgtgctagggctcacggagaggacgatggggaggagattctgctcgatacacagtgccaggggctgccaaggcctgagccccaggaagcttgctctttagaaccgtgtcctccacgctggaaggtcatgtccctaggaccgtgtagtgcctcctgcggactgggcaccgcaaggaggagtgtcgcctgcgttcagctggatcaagggcaagatgttgaagtcgatgaggccgcctgtgccgcattggtcaggcccgaagctagtgtcccctgtctgatcgctgattgcacttataggtggcatgtcggcacatggatggagtgttccgtgagctgcggagacgggatccagcgtcggcgggatacctgcctaggcccgcaggctcaggccccggtgcctgccgacttctgccaacaccttcccaagcctgtcacggtccgagggtgttgggccggcccttgcgtggggcagggcacaccctcattggttcctcatgaggaagcagcagcccccggacggacgaccgcaacccctgccggggctagcctagagtggagtcaggcacgtggacttctattttcgcccgcgcctcagccacgaagattgctacctgggccacaggaaaatagtgtgcagtcgtccgcctgtggaagacagcatctggaacctaccggaactatcgatatgaggggacctggtcaagcggattgtgccgttgctattgggagaccactcggcgaagtggtgaccttgagggtgctggaatcctccctgaactgcagcgcaggcgacatgctgcttttatggggacgcctgacctggcgaaaaatgtgtcgcaaacttctcgacatgactttcagtagtaaaacaaatactctggtggtgcgacaacggtgtggaaggcctggtggaggagtgctgttgcggtacggaagccagctagctcccgagacattctaccgcgagtgcgacatgcagctgttcggaccctggggcgagatagtgagtccaagtctgtctccagcaacctctaacgccggaggttgtcggcttttcatcaacgtggcaccgcacgcccgtatagccattcatgctctggccactaatatgggagcaggcaccgaaggcgcaaacgcttcgtacatcttgatcagggacacacactccctgagaacaacagcctttcatggacaacaggtcctgtattgggagagcgaatcttcccaggctgagatggaattttccgaaggatttctgaaggcccaggctagcctcagaggacagtactggacactgcagtcatgggtgcccgaaatgcaggatcctcagtcctggaagggcaaagaaggtacc

SEQ ID NO: 5617 - DNA, 4281 bp, Artificial Sequence
  Description of Artificial Sequence: Synthetic coding sequence
atgcatcagcgccaccctcgggcccggtgccctccactgtgcgtggctggaatcctcgcctgcggattcctgctgggatgctggggcccatcgcactttcaacaatcgtgtctgcaggctctcgagccgcaagcagtgtccagctacctctcccctggcgccccgctcaaaggacgccccccaagccctggattccaacggcaacgccagcggcagcggcgagcagcagggggaatcctgcatctcgagctgctcgtggcagtgggacctgacgtgtttcaggcccaccaggaagatactgaaagatacgtcctcactaacttgaacattggggccgaactgctccgtgacccatccttgggagctcagttcagagtgcaccttgtgaaaatggtgattctcactgaaccggagggcgccccaaatatcacggccaacctcacttcctcgctgctctccgtctgcggctggtcacagaccatcaacccggaagatgatactgaccctgggcacgcggacctcgtcctgtatatcactagattcgacttggaacttcctgatggaaatcggcaggtccgcggggtgacccagctgggcggagcgtgtagcccgacttggtcgtgtctcatcactgaagatactggcttcgacctgggagtcaccattgctcatgagattggccacagcttcggcctggaacacgatggagcgccgggctccggctgtggcccaagcggacatgtgatggcctcggatggtgccgcccctcgcgcgggtttggcctggtcaccgtgttcccgccgacagcttctgtcgctcctgagcgcggggcgcgctcggtgcgtgtgggacccacctaggcctcagccgggctccgcggggcacccgcccgatgcccaacccggactgtactactccgcaaatgaacaatgccgggtggcctttggacccaaggcggtggcctgtacgttcgccagggagcatctcgacatgtgccaagctctgtcgtgccacaccgaccccctcgaccagtcctcctgctcccggctgctggtgcccctcttggacgggactgagtgcggcgttgagaaatggtgctccaagggcaggtgtcgctccctcgtggaactgacgccgatcgccgccgtccatggaagatggtccagctggggacctcggtccccgtgcagtcgatcgtgcggaggaggtgtggtgaccaggaggcgccagtgcaataatccgaggccggcgttcggaggcagagcctgcgtcggagcagatctgcaggcagagatgtgcaatacgcaagcgtgcgagaaaacccagctcgaattcatgtcccaacagtgcgccagaactgatggacagccgctgcgctcgagccccggaggagcctccttttaccattggggagcggccgtgccccactcgcagggtgacgcactctgtagacatatgtgtcgcgctatcggggaatcatttatcatgaagcggggagactctttcctcgacggcaccagatgcatgccgagcggaccacgagaggacggcactctgtcactgtgcgtctctggaagctgcagaaccttcggctgcgacggaagaatggatagccagcaggtctgggaccggtgtcaggtgtgtggcggtgacaactcgacctgttcgccgcgcaaaggctcctttactgccggacgcgccagggaatacgtgacctttttgactgtgaccccaaacctgacttccgtgtatatcgccaatcatcggccgctgtttacgcatctggccgtcagaatcgggggacgatacgtcgtggcagggaagatgtcaatctcgccaaatactacttatccgtcgctgctggaggatggcagggtggagtaccgggtcgctctgaccgaggaccgattgccaaggcttgaggagatcaggatttggggaccgcttcaggaggatgccgatatccaagtctaccgtcgctacggagaggagtacggaaacctgacccggcctgacatcactttcacttacttccaacctaagccccgccaggcgtgggtgtgggccgccgttagggggccgtgctcggtgagctgtggcgcaggactccgctgggtgaactactcttgcctcgaccaggctcgcaaggagctggtggagactgtgcagtgccaaggtagccaacagcccccggcttggccggaggcatgcgtcctggaaccgtgcccaccgtactgggctgtgggagacttcgggccgtgttctgcgtcctgcggaggaggacttagagaaaggcccgtccggtgcgtggaagcccaaggttccctgttgaaaacccttccacctgcaaggtgccgtgcaggcgcccagcagccagcggtggcgttggaaacgtgcaacccccagccatgcccggcccgatgggaggtgtctgaaccctcttcctgtactagcgccggaggagcaggactggcccttgaaaacgaaacctgcgtcccgggcgccgatggcctcgaggcaccggtcaccgagggaccgggatcggtggatgagaagttgccggcacctgagccgtgcgtcggcatgtcgtgccctccaggttggggtcatctcgacgcgacttccgccggcgaaaaggcgccgtctccgtggggcagcattcgcacgggagcccaagcggcgcacgtgtggactccggctgcgggttcatgctccgtaagctgcgggcgcggactgatggagcttaggttcttgtgtatggactctgcccttagagtgccagtgcaagaagagctctgcgggctcgcgtcgaaacctggatcaagacgggaagtatgccaagccgtgccctgtccggcgcggtggcaatacaagctggctgcctgctcagtgagttgcggccgaggagttgtgcgccggatcctgtactgcgcccgcgcgcacggagaggatgatggagaagagatcctgctggatacgcagtgtcagggtctgccgcgcccggaaccgcaagaggcgtgcagccttgaaccatgccctcctagatggaaggtgatgagccttggaccgtgctccgcgtcctgtggtctgggaaccgcgcggagatctgtggcttgtgtccaactcgaccagggacaagacgtggaagtcgatgaggcggcttgcgcagcgctggtgaggccggaagcgtccgtgccatgtctgatcgccgattgcacttaccgatggcacgtgggcacctggatggaatgttcagtctcgtgcggcgatggaatccagcggcgcagggatacttgtctgggacctcaggcccaggcccctgtgcctgcggacttctgccagcatctgccaaagcccgtgaccgttcgcgggtgctgggctgggccatgcgtggggcaggggacgccctcgctggtcccacacgaggaggccgcagcaccagggcgcactaccgcaactccagcaggggcctcacttgaatggagccaagcgcggggcctgttgttctcgcctgcccctcaacctcgccggctcctgcctggaccgcaagaaaactccgtccaatcgagcgcgtgtggacggcagcatctggagccgacgggaaccatcgacatgcggggtccgggtcaggcggactgtgctgttgccatcggccgcccactgggagaggtggtgacccttagagttttggaatcgtcccttaactgcagcgcaggggacatgctgctcctctggggtcggttgacgtggcgcaagatgtgccgcaagctgctggatatgaccttctcgtccaagaccaacactttggtcgtgcggcagcggtgcggacgcccggggggaggggtgctgttgcgctacggatcccagctggcaccagaaactttctacagagaatgcgacatgcagctgttcggaccgtggggagagatcgtctccccaagcctgtcgccagctactagcaacgccggagggtgtcggctcttcatcaatgtggcgccgcatgcccggatagccatacacgcactcgcgactaacatgggagccggaaccgaaggagcgaatgcgtcatacatcctgatccgggacactcatagccttcgcactactgcctttcacggacagcaagtactctactgggagtcagagagctcccaggcagaaatggagttttcggaaggcttcctgaaggcccaagcatctctgcggggccagtactggacgctccaatcctgggtgccggaaatgcaagacccacaatcgtggaaaggaaaggaaggaacc

SEQ ID NO: 5618 - DNA, 4281 bp, Artificial Sequence
  Description of Artificial Sequence: Synthetic coding sequence
atgcatcaacggcatccaagggctcgctgcccgccattgtgtgttgccggaattttagcttgtggattccttttaggctgttggggtccaagccactttcaacagtcatgccttcaagcactagaaccgcaagcggtttcctcatatctttccccaggagcgcctctgaagggacgacccccttcacccggctttcagagacagcgccagcgccagcgtcgtgcggccggaggcattttacacttggaattactggtggcagtcggaccggatgtcttccaggcgcaccaagaagacacggagagatacgttttaacaaatctaaatattggagctgagcttctgcgtgatccgtcactgggtgcccagtttcgtgtacacttggttaaaatggtgattctcaccgaacctgaaggggcacccaatataacagcaaatctgactagttccctactttctgtctgcggttggtctcagacaattaatccggaagacgacaccgacccgggacatgcagatttagtgctttatattacacgtttcgacttagaactgccggacggcaacaggcaggtgcgtggtgttacacaattaggcggtgcgtgcagcccaacatggtcttgtctgattaccgaagatacggggttcgacctgggggtaacgattgctcatgagatcggccattcttttggccttgagcatgatggcgccccaggtagtgggtgcgggccttccggccatgttatggcctcagacggtgctgcaccgcgggcgggcttagcttggtcaccgtgtagtcgaagacaactgttaagtcttctttccgcagggcgagccagatgtgtatgggacccgccaagaccccaacccggatcggccggccatcctccggatgcccaaccgggactctactattctgctaatgaacaatgtcgcgtggcgttcggtccgaaggcggtagcatgcacatttgcgcgtgaacacttggacatgtgtcaagctttgtcttgtcatactgatccattagatcagtcttcatgcagccgcttgcttgtgcctcttctggatggcactgagtgcggcgttgaaaaatggtgttcaaaaggccgttgtcgttctctggtggaacttactccaattgcggcggtgcatggcagatggtcctcttggggaccgcgctcaccttgtagccggtcttgtggcggaggtgtcgtaacccgcaggcgccagtgtaacaatcctagacctgcctttggcgggcgtgcctgcgtcggggccgatctgcaggctgagatgtgtaatacccaggcatgcgaaaaaacacaattagagtttatgtcacagcagtgcgcgcgtacagatggccagcctttgagatcttccccgggcggcgccagtttctaccattggggcgcggccgtcccgcattcccagggagacgcgttatgcagacatatgtgtagagcgattggcgaatcgtttatcatgaaaagaggcgactctttcttggacggaacgcgctgtatgccgtcaggacctcgtgaagatggcactttaagcttgtgcgtgtcaggctcgtgcagaacatttggctgcgatggtcgaatggacagtcaacaggtatgggatagatgtcaggtctgtggtggcgataattcaacttgctcacctagaaaagggtcttttactgccggacgagcccgtgaatatgtgacgtttctgaccgtaacgccgaatttaacctccgtatatattgccaaccaccgccctttatttactcaccttgccgttcggattggcgggaggtatgtcgttgcgggcaaaatgtctatcagccctaatacaacgtacccgagcttattagaagatggacgagtcgagtatcgcgtagcgctgactgaggataggctcccgcgtctggaagagataaggatctggggacccctacaggaagatgccgacattcaggtttaccgcaggtatggtgaggagtatggtaacctaacacgtccggatataacatttacctactttcagccgaaaccgcgacaagcgtgggtttgggcagcagtacgtgggccatgttctgttagctgtggtgcaggtttacgatgggtcaactattcttgtctggaccaggcaagaaaagaattagtggaaactgttcagtgccaaggcagccaacagcctccggcgtggcctgaagcttgcgtgttagaaccgtgccctccgtactgggctgtcggcgattttggcccgtgcagtgcaagctgcggaggcggacttcgcgagcgcccagtgagatgcgtggaagcacaaggaagcttactgaaaaccttgccaccggcacgatgcagagcgggtgcccaacagccggccgtagctctggaaacttgtaatccgcagccatgccctgcacggtgggaagtttctgagccatcgagctgtactagcgctggtggagcgggcttggccttggaaaatgagacctgcgtaccgggcgccgatgggctagaggcgccagtcacagagggcccgggatcagtggacgaaaagctcccggctccggaaccgtgcgtaggaatgagctgtcctccgggatggggtcatttagatgctacatctgcgggggaaaaagctccttctccttggggctcaattcgtacaggagcgcaagctgctcatgtttggactccggctgcgggcagttgttccgtttcctgtggtagaggcttgatggaactcagatttctttgtatggattcagcccttcgagtgccggtgcaggaagaactgtgtggattggcaagcaaaccggggagccgaagagaagtgtgtcaagcagtgccgtgtccggctcgttggcagtacaaacttgcagcttgcagtgtcagttgcggtagaggcgtggtgcgtcgtattttgtactgcgcacgtgcccatggcgaagatgatggagaagaaattttattagatacccaatgccagggacttccgcgtccggaacctcaggaagcctgctcattggagccatgtccgccgagatggaaagttatgtctcttggaccatgcagcgcttcctgcgggttgggaactgcacgtcgctctgtcgcatgtgttcagctcgatcagggccaggacgtcgaagtggacgaagctgcttgcgcagcgctggttcggccagaggcgagtgtgccgtgtcttattgcggattgcacgtaccgctggcatgttggcacatggatggaatgctcagtcagctgcggcgacgggatacaaagaagaagggatacatgcttagggccgcaagctcaagcgccagtcccggctgatttttgccaacatttgccgaaaccggtgaccgtccgcggctgctgggctggaccgtgcgtcggacaaggcacgccgtcgttagtaccacatgaagaagctgccgccccgggcagaacgacagcaactcccgctggcgcgtccttggaatggagccaagcgcggggccttcttttttcaccggcaccgcaaccacgacgtcttctgccaggaccgcaagagaactcggttcaatcctctgcctgtggaagacaacatctggaacctaccggaacgatcgatatgagagggccaggacaagccgactgtgccgtagctattgggcgccccctgggcgaagtggtaaccttacgcgttctggaaagttctcttaactgctctgccggagatatgctattactttggggtaggctaacctggcggaaaatgtgccgtaaattattagacatgactttcagttcaaaaacgaacacactggttgtgcggcagcgatgtggacgccctgggggcggtgtcttgttaagatatggcagccaactcgcaccagaaacgttctatcgcgaatgtgacatgcaactttttggaccgtggggcgaaatcgtttctccgagcctgtcccctgctaccagcaacgcgggaggttgccgcttgtttatcaatgtggcaccgcatgctaggattgcaatccacgcgttagctacaaatatgggagcaggaacagaaggagcgaacgcctcctatatcttgatccgtgatacacatagcttgcgcaccacagcgtttcacgggcagcaggttttatattgggaaagtgaatcaagccaagctgaaatggagttctcagagggctttttgaaagcgcaagcatctttacgtggtcaatactggacccttcagtcgtgggtacctgagatgcaggatccgcaaagctggaagggaaaagaggggact

SEQ ID NO: 5619 - DNA, 4281 bp, Artificial Sequence
  Description of Artificial Sequence: Synthetic coding sequence
atgcaccagcgacatcccagagccaggtgtccgcctctgtgcgtggctggtattctggcgtgtgggtttcttctcggctgttggggcccctcacactttcagcagtcttgtttgcaggctctggagccacaggcggtctcctcatacctatcccctggggcacctctcaaagggcgtcctcccagccctggttttcagagacagagacagcggcaacgcagagccgccggcggaattctacacctggagctgcttgtagctgtaggtcccgacgtcttccaggctcaccaagaagatacggaaaggtatgtgctgaccaatctcaatattggggcggagctgctgcgcgatccttcattgggcgcacagtttcgggtacatctcgtcaagatggtgatcttaaccgagccagaaggcgcaccaaacattaccgccaatctcactagcagcctactgagcgtgtgcggctggtctcagacaatcaacccggaggatgacactgaccctggacacgccgacttagtgctctacattacaagattcgatttggagctcccggatggcaacagacaagtgcgaggtgtgacccaactgggcggtgcgtgcagtcccacttggtcatgtctcatcaccgaagatacgggatttgaccttggtgtaaccatcgcacacgagattggacactcatttggactggaacacgatggtgcaccaggttctggctgtggtccttcagggcacgtgatggctagtgatggcgccgcacctcgggctggtctcgcttggtcaccctgttcccgccgacagctgctgagcctgctgagtgcaggccgtgcaagatgcgtatgggacccccctcgaccccagccaggcagtgccggacacccccctgacgcgcaacctggcctgtattatagcgccaatgaacagtgccgcgtggcattcggaccaaaagcagtcgcatgtaccttcgctcgcgaacacctcgacatgtgtcaggccctttcctgtcataccgaccccttggatcagagttcttgtagtcgcctcttggtccccctcctggatggcacagagtgtggtgtggaaaagtggtgctccaaaggtcggtgccgcagtctggttgagttgactccaattgcagccgtccacgggcgctggtcatcctggggccccaggtctccgtgctcaaggtcttgcggtggtggagttgtcacacgccgcagacagtgtaacaatcctcggcccgccttcggcggccgggcctgtgtgggggcagatcttcaggcggagatgtgtaacacacaggcttgtgagaagacccaactagagttcatgtcgcagcagtgtgcacgaactgatggccagcctttgcgatcgagcccaggtggagccagcttttatcactggggtgctgctgtgccccactctcagggcgatgccctctgccgtcatatgtgccgagccattggggagtcgttcatcatgaaacggggggactcattcctggacggcaccagatgcatgccttctgggcctcgggaggacggcaccctcagcctttgcgtgagcggaagctgtagaacgttcggatgcgacggacgtatggatagtcagcaggtgtgggacagatgccaggtttgtggtggggacaactcgacctgttcaccacgcaagggttcttttaccgccggtcgcgcccgtgagtacgtgacatttttgaccgttactcccaacttgacatccgtttacattgctaatcaccgcccgctgttcacacacttggcggtgaggattggcggcaggtacgttgttgccggaaagatgtcaattagcccgaatacgacttatccaagtttgttagaagacggcagggtggagtacagagtggccctgactgaggacagactgccacgactggaggaaatccggatatgggggcccctgcaagaggatgctgacatccaggtttaccggcggtacggcgaggaatatggaaacctgactcggccagatattaccttcacatacttccagcctaagccccgccaggcctgggtgtgggccgcagtgcgcggtccctgtagcgttagctgtggcgcgggactccggtgggtgaactactcctgtctcgatcaggctaggaaggagctggtggagaccgtgcagtgccaaggatctcagcagcccccagcgtggcccgaagcttgtgtgctcgagccctgccccccttattgggctgttggcgacttcggcccctgtagcgcctcttgtggaggtgggcttcgcgagcgacccgtgcggtgtgtcgaagcgcaaggatctctcttgaaaacactgccccccgcccgttgcagggccggcgcccagcagccggctgtcgccttggagacatgtaatcctcagccttgtcctgcacgatgggaggtttccgagccaagttcatgtaccagcgctgggggggccggattagcccttgagaacgaaacttgtgttcccggagcagacggactggaagcgccagtcactgaaggtcctggctccgttgacgagaagctcccggcacctgaaccctgtgttgggatgagctgtccgccaggatgggggcacctggatgctacctccgccggggagaaggcaccttcaccttggggatctatccgcacaggagcacaggcggcccacgtatggactccggccgcgggatcctgttccgttagttgcgggcgcgggttaatggagctgcggttcctatgcatggattctgctctgagggtcccggtgcaggaagagctgtgtggcctggctagtaagcccgggtcccgccgcgaagtgtgtcaggccgtcccttgtcccgctagatggcaatataagctggctgcctgctctgtcagctgcggcagaggggtagttagacgcatcttatactgtgctcgggctcatggggaggatgatggagaggagatcctgctggatacccagtgtcaaggccttccccgcccagagccccaagaagcatgctcgctggagccttgcccaccgaggtggaaggtgatgagtttgggtccttgcagcgcttcttgcggcctgggtactgccaggcggtctgttgcctgcgtgcaactggaccaggggcaggatgtagaggtggatgaggctgcatgcgccgctctagtgagacctgaagcctcagtcccctgcctgatagccgattgtacctacagatggcatgtggggacctggatggagtgtagcgtcagttgtggtgacggtatacaacgcagaagggacacctgtttaggaccgcaagcacaggcacctgtgcccgctgacttttgtcagcacctgcctaagcctgtcactgtccgaggatgctgggccggtccatgcgttggacaggggactccgagtctcgtgccccacgaagaggctgccgcaccaggccgcaccacagcgacaccagctggcgcgtccctcgagtggagtcaggcccgaggactgcttttctctccagcgccacaacctaggagactgctgcctggaccgcaggagaactccgtgcagtctagcgcctgtggtagacagcacctcgaacctactggaactatcgacatgcgggggcctggccaggcggactgcgcagtggcaatagggcgcccgctgggggaggtggtgaccctgagggtgctggagtcctcactcaattgttccgcaggcgacatgctgttgttgtggggaagactaacttggcgaaagatgtgtaggaagcttctggatatgaccttttccagcaaaactaatactctcgtagtccgccagcggtgcggccgccccggaggaggagtcctgttgcgatatggtagtcagctggccccagagacattttatcgtgagtgcgatatgcagctgtttgggccatggggcgagattgtcagcccgagtctgagcccagccacttcgaatgcaggtggctgtagacttttcattaatgtggccccgcatgctcggatcgccattcatgctctggccacgaacatgggtgctggcacagagggcgcaaacgccagctatattctgattcgggacacccactctcttaggaccaccgcatttcatggtcagcaggtgctttactgggagtccgaaagcagtcaggcagagatggagttctcagagggatttctgaaagctcaagcctccttgcgtggacaatattggactctgcagagttgggtgccggagatgcaggaccctcagtcatggaagggtaaggaagggaca

SEQ ID NO: 5620 - DNA, 4281 bp, Artificial Sequence
  Description of Artificial Sequence: Synthetic coding sequence
atgcatcagcggcatccccgcgcgagatgtccaccgctttgtgtcgccggtattcttgcatgcggcttcttgcttggatgttggggtccgtcacactttcagcaatcttgcctgcaagccttggagccccaggctgtgtcgtcctacctctccccaggcgctcctcttaagggtcggccacccagcccaggcttccaacgtcaacgacaaagacaacggcgagcagcaggtgggattctgcacctggaacttcttgtggcggtggggccagacgtgttccaggcacaccaggaagatactgaaaggtacgtactcactaaccttaacatcggagcggagcttcttagggatccctcgcttggcgcgcaatttagggtccatctcgtcaagatggtgatccttaccgaacctgaaggtgcaccaaatatcactgcgaacctgacctcgtccctcctgtcagtgtgtggatggtcgcaaactataaaccctgaggacgatactgacccagggcatgctgatcttgtcttgtacatcacgaggtttgatctcgaactccccgatgggaacaggcaagtgcgcggggtgacgcaactgggtggagcatgttcgcccacctggtcctgtctcattactgaggatactggctttgacttgggtgtcaccattgcccatgagataggacactcattcggactcgaacacgacggagcacctggcagcgggtgcgggcctagcggtcacgtcatggcctccgatggggcagctccgcgcgcaggactcgcctggtcaccgtgctcccgtagacaactgttgtcgctgctgtccgcaggtcgcgcgcgatgtgtctgggaccccccacgccctcaacctggttcggccgggcatccccctgacgcccaacctggattgtattactcggctaatgaacagtgccgggttgcattcgggccaaaggcagtggcctgtacctttgcgcgcgaacatctggacatgtgccaagcactgtcctgccataccgacccgctcgaccagtcgtcgtgtagcaggctgttggtgcccctgctggatgggactgagtgtggtgtggaaaagtggtgctcgaagggaagatgccggagcctggttgaattgaccccaattgcagccgtccatggtagatggtcgagctgggggcccaggagcccatgcagcagatcctgtggcggaggcgtggtgacgcgtcgtcgacaatgcaataaccctaggcctgctttcggaggaagagcctgtgtgggcgcggatcttcaggccgagatgtgtaatactcaggcctgcgaaaagactcagcttgagtttatgtcccagcaatgcgcacggacggacggacagcctcttagatcctcacccggaggagcgtcattttaccactggggcgccgcagtgccacacagtcagggtgatgcgctgtgtcgtcacatgtgtcgagcaattggagagtcatttatcatgaagcgaggtgattcgtttctggacgggacccgctgtatgccctccggtccacgggaggatggcaccctttctctttgcgtttcagggtcctgtcggacctttggatgtgacggtcgtatggactcacaacaggtgtgggataggtgtcaagtttgcggaggagacaatagcacctgttcccccagaaagggttcgttcactgcaggaagagctcgggaatacgtgaccttccttaccgtgacgcctaaccttactagcgtgtacattgccaatcaccgaccccttttcacgcacttggcggtgcgtatcggtggccggtacgtggtggcaggtaagatgtcaatctcccctaacacgacttacccatccctgcttgaagatggaagagtcgaatacagagtggccctgaccgaggaccggctccctcgcctggaagagattcgaatttggggcccactccaggaggatgccgacattcaagtttaccggcgctatggagaagagtacggaaatttgacccgccctgatatcaccttcacctacttccaaccaaagcctagacaagcatgggtgtgggccgcagtgagggggccctgtagcgtgtcctgtggggcgggactcagatgggttaactactcctgcttggatcaagcgcgaaaagaattggtcgagacggtgcagtgtcaaggctctcagcagccacctgcctggccagaggcttgcgtgctggaaccatgcccgccatactgggccgtgggtgattttggaccctgttccgcgagctgtggaggaggacttcgagaacgaccggtgcgctgtgttgaagcacaggggtccttgcttaagactcttccgccggcacgttgcagggctggagcccagcagcctgcagtcgcacttgaaacttgtaacccgcagccttgtcctgcacgctgggaagtctcggaaccctcgtcatgtacctcggccggcggagcaggtctggcgctcgagaatgaaacctgtgtgcctggagcagatggcctcgaagcgccagtcaccgaagggccaggttcagtggacgagaagctgcctgcaccagaaccgtgcgtcgggatgtcatgtcctcccggttgggggcatctggatgcaacctcggcaggcgagaaggcaccgtcgccttggggttccatccgaacgggcgcgcaggccgcacatgtgtggactccagcggcaggttcatgttctgtgtcttgtggaagaggtcttatggaacttagattcctgtgcatggattcagcacttcgagttccagtgcaggaagaactctgtgggctggcatccaagcccggatcgagacgagaagtgtgccaagcagtcccttgtccggctcgctggcaatacaagctcgccgcatgttcggtgtcctgtggccgtggagtcgtgcgccggattctgtactgtgcccgcgcgcatggagaggatgatggagaggaaatcctgcttgatacccaatgtcaaggtttgcctcgacctgaaccacaagaggcgtgctcgcttgagccttgtcctccccggtggaaggtcatgtcactgggaccgtgcagcgcttcctgcgggctgggaactgcgagacgctccgtggcctgtgtgcaactcgaccaaggacaagatgtggaggtggatgaagcagcgtgcgcagcactggttagaccagaagcatcagtgccttgcctgatagccgattgtacctaccggtggcatgtgggaacctggatggaatgttcagtgagctgtggggatggaatccagagacgtagggatacctgtctcggccctcaggcacaggcacccgtacctgccgacttctgccagcatctgcctaagccagtgactgtgcggggatgttgggccggaccttgtgtcggccaaggcactccatcgcttgtcccacacgaagaagcggctgcacctggccgtactactgccaccccggccggagcttcgctcgagtggtcgcaagccaggggactgctgttctcccctgcacctcagcctcgacggctgctccctggaccacaagaaaattcggtgcaatcctcagcatgtgggcgtcaacatttggaaccgaccggcaccattgatatgagaggaccgggtcaggcagattgtgctgtcgcaatcggaaggcctcttggcgaagtcgtgaccctcagagtgctggaatcaagccttaactgctccgcaggagatatgctgcttttgtggggtaggcttacttggcggaaaatgtgtcggaagctgttggatatgaccttttcgtcgaaaactaacaccttggtggtcaggcagcgatgcggacgtcccggaggaggagtgcttctgcgttacggatcgcagcttgcacccgaaactttttaccgggaatgtgatatgcaactgtttggaccgtggggcgaaattgtctccccctccctgtctcccgcaacgagcaacgctggaggctgtcggctgtttatcaacgtggccccccatgcgaggattgctatccatgccctggcgactaacatgggggcagggactgagggagctaacgcaagctacattcttattagagacactcattccctgcgcaccactgcatttcatggtcagcaggtcctttattgggagtcagagtcctcgcaagcagaaatggaattctcggagggctttcttaaggcacaagctagcctgagaggacagtactggaccctccaaagctgggtccccgagatgcaagacccacagtcttggaaaggaaaggaaggtacc

SEQ ID NO: 5621 - DNA, 4281 bp, Artificial Sequence
  Description of Artificial Sequence: Synthetic coding sequence
atgcatcagaggcatccaagagccaggtgtccaccgctgtgtgtggctggcattctggcttgtggttttctcctgggctgctgggggccaagtcacttccagcaatcctgcctccaagccttggagccgcaggctgtatcttcatacctgtcccctggggctccactgaaaggcaggccgccttcccctggattccagcgccagcgacaacggcaacgaagagccgcaggtggcatcctccacctggagctgcttgttgccgtaggccctgatgtgtttcaagcccaccaggaagatacggagcgatacgtactgacaaacttgaacattggtgctgagctgctgcgcgacccaagcctgggcgcccagttcagagtgcacctggtcaagatggtcatcctgaccgaaccagagggcgccccaaacataactgcgaacttgacgtcttcattgctgtcagtctgtggatggtctcagaccatcaatccagaggatgacaccgacccagggcacgctgacttggtactctacataacacggtttgatctggaactccccgatggcaataggcaggtcagaggggtgacccaactcggaggtgcttgcagccctacctggtcatgcttgataacagaagatactggctttgacctgggtgtcacaatcgctcacgaaattggccactcattcggcttggagcacgacggcgcgccgggcagtggatgcgggccaagtggacacgttatggcctccgacggcgcggccccaagggcagggctcgcctggtccccatgcagtcggaggcagctgctcagcctgctgtcagcaggcagggcccggtgcgtgtgggatccccccaggcctcagccaggctcagcgggtcacccccccgatgcccagcccggcctgtactactccgctaacgaacaatgccgggtggcgtttgggccgaaggctgtggcctgcacattcgcccgcgaacacctggacatgtgtcaggccttgagttgccataccgatccacttgaccagtcttcctgtagcagactgctcgtcccactgctcgatggaactgagtgtggggtagagaagtggtgcagtaagggacggtgtcggtctcttgttgagcttacaccaattgctgctgtgcacggacggtggtcatcctggggcccgcggtcaccttgctctaggtcttgcggaggaggagtcgtaactcgcagaagacagtgcaacaatcctaggcccgcattcggcggtcgggcatgtgtgggtgcagatctccaggcagagatgtgcaatactcaagcatgtgaaaagacgcagctggagttcatgagccagcagtgtgctagaaccgatgggcagcctctcaggagcagtcctgggggcgcttccttctatcactggggagccgcagtgccacatagccagggggatgcactctgcagacacatgtgtcgagccatcggagagtctttcattatgaaaaggggcgattcttttctggatggtactaggtgtatgccttctggaccacgggaggacggaacactcagcctctgcgtgtcaggatcatgtcgaacattcgggtgtgacgggcgcatggacagccagcaggtttgggaccggtgccaagtgtgtggcggcgacaacagtacctgtagtccaaggaagggatcttttacggccggtagggctcgggaatatgtaaccttccttacagtgacccctaatttgaccagcgtgtacatcgccaaccatcggccgctgttcacccatctggcggtgcgcataggtggcaggtacgttgtggccggtaaaatgtctattagcccaaataccacctacccaagcctccttgaagacggccgagtggaatacagagtggctttgactgaagatcgcctgccccgacttgaggagattaggatctggggtccactccaggaagacgcagacatccaagtgtatcgcagatacggcgaggagtacggaaatctgacaagacccgatatcacattcacatatttccagccaaagccccgacaggcctgggtctgggctgctgtacggggaccttgctccgtgtcctgcggcgcagggttgcgctgggtgaattattcttgcctggatcaggcacgcaaggagctggtggagaccgtccagtgtcaggggtctcagcagccacctgcctggcccgaagcctgtgtgcttgaaccttgtcccccgtattgggctgtaggcgattttggcccatgctcagcttcatgtggcggaggcttgagggaacgcccggtgagatgcgtggaggcacaaggttcattgctgaagacccttccccccgctcggtgcagagcgggagctcagcagccagctgtcgcgctggagacctgcaacccccaaccctgtccggcacggtgggaggtgtctgagcctagttcttgtaccagcgctggcggcgcaggtttggccctggaaaatgagacctgtgtgcccggtgctgatgggctggaggctcccgtcaccgagggaccagggtctgtcgacgagaagctgccagcaccagagccctgtgtcggtatgtcctgtcctccgggttggggacacctggatgccacctctgccggcgaaaaggctccttccccgtggggtagcattagaacaggtgcccaagcagcgcatgtttggacacccgctgccgggtcttgtagtgttagttgtgggcgcggcctgatggaattgcggtttttgtgtatggattccgcattgcgcgttcctgtgcaggaggagttgtgcggactcgcctctaaacccggctcaagacgggaggtatgtcaggccgtcccgtgtccggccagatggcaatacaagctcgctgcatgttctgtttcctgcggccggggagtggtccggcgaatcctgtactgtgcccgggcccacggcgaagacgacggcgaggaaatcctgctcgacactcagtgccaggggttgccccggccagaaccccaggaggcctgtagcctcgagccttgcccccctagatggaaggttatgagcctgggtccttgtagtgctagctgtgggctggggaccgctaggaggagcgtggcatgtgttcagctggaccagggtcaggacgtcgaagtggatgaggcagcatgcgccgcgctggtgcgaccagaagcgagcgtgccgtgcttgatcgcagactgcacttaccgctggcacgtcggcacctggatggagtgttctgtctcatgcggggacggaattcaaaggagacgggatacatgcttgggtccccaggctcaggcgcccgtccccgcagatttctgtcagcatctccctaaacccgtcacagtgaggggatgctgggcggggccttgcgtgggtcagggcacgccttcacttgtgccccacgaggaagctgccgccccaggcaggaccacagctaccccagctggcgcctctttggaatggtctcaggctagaggcttgctcttttcccctgccccacaaccccggcggttgctccctggtccgcaggaaaatagcgtgcaatctagtgcttgcgggagacagcacctcgagccaactgggacgattgacatgagaggtccagggcaggctgattgcgccgtggctattggaagacctctcggggaagtcgtaacccttcgcgtgctcgagtcctccttgaattgttctgccggtgatatgctcctgctgtggggccgccttacctggagaaagatgtgcaggaagctcttggacatgaccttctcttccaaaaccaacaccctcgtggtgagacaacgatgcggacggccaggcggcggcgtactgctcaggtacggctctcagctggcgccagaaaccttctacagggaatgcgacatgcagctcttcggaccttggggcgagattgtctccccctctcttagccccgcaacctccaatgctgggggatgcagactgttcataaacgtggccccccacgcccgcatagccatccacgctctggccaccaacatgggagctgggactgagggagcaaacgccagctacatactcatcagagatacccactccctgagaacgacagcattccatggacagcaggtgctgtattgggagagcgagtcctcccaagctgagatggagtttagtgagggtttcctgaaggcacaggcgagcctgcgggggcagtattggacccttcagtcttgggtgccagagatgcaggaccctcagtcttggaaaggaaaagaaggtacc

SEQ ID NO: 5622 - DNA, 4281 bp, Artificial Sequence
  Description of Artificial Sequence: Synthetic coding sequence
atgcaccaaagacacccccgggcgaggtgcccaccgctgtgcgtggcagggatcctggcctgcggattcctgctgggttgttggggaccgagccattttcaacagagctgtctgcaagcgctggaaccccaggccgtgagctcctacctgtcacctggtgcgccgcttaaaggtcgcccgccctccccaggcttccagaggcaacgccaacgtcaacgccgagctgcaggaggcattctccacctggagcttctcgtcgccgtgggaccggacgtgttccaagcccaccaagaggataccgaaagatatgtgctcacgaatctgaacattggcgcggagctgctgcgcgacccttcgcttggcgcccagttccgggtccatctggtgaaaatggtcatcctgactgaacctgagggcgctccgaacatcaccgcgaatttgacctcttctctgctgtccgtgtgcggatggagccaaaccatcaaccctgaggacgacaccgatccgggccacgcagatctggtgctgtatatcactcgatttgaccttgagcttccagacgggaacagacaagtgcggggcgtgactcaactgggaggtgcctgctcgcccacttggtcgtgcctgatcactgaggacaccggattcgacttgggagtgactatcgcccatgagatcggtcacagcttcggccttgaacacgacggtgctccgggttcgggctgtgggccatcgggacacgttatggcctcggacggagcagcccctcgggccggccttgcctggtcgccgtgctcgagacgacaacttctgtccctcttgtcggccggcagagcccggtgcgtgtgggatccgccgcggcctcagcctggatccgccgggcatccacctgatgctcaaccgggtctgtactactcggcaaacgaacagtgccgggtggctttcggtcctaaggcagtcgcctgcacctttgcccgggagcatctggatatgtgccaggctctgtcatgccacactgacccactcgatcagtcgagctgttctcgcctgttggtgccgctgctggacggcactgaatgcggagtggagaagtggtgtagcaagggacgctgccgcagcctcgtcgagctcaccccgatcgcggcagttcatgggcgctggtcgtcgtggggacctcggtcgccttgttcacgctcatgcggaggcggtgtggtgacccgccgccgccagtgtaataacccacgcccggcattcgggggacgggcatgcgtgggagccgacctccaggcagagatgtgcaacacccaggcctgcgaaaaaactcaactggagttcatgtcccagcaatgcgcccgcacggacggacagccactgcggtccagcccaggtggcgcctcgttctaccactggggcgccgccgtgccgcactcccaaggtgacgccttgtgtcgccacatgtgccgggcgatcggagaatctttcatcatgaagaggggggatagctttctggacggaaccagatgcatgccgtcgggtccgcgggaagatgggacgctctccctctgtgtgtctggatcctgccgcaccttcggatgtgatggacgcatggattcgcagcaagtctgggaccgctgtcaggtctgcggcggtgataactcgacttgttcaccacggaagggttcgtttaccgccggacgcgccagagaatatgtgactttcctgactgtgactccaaacttgaccagcgtgtacatcgctaaccatagaccgctgtttacccacttggctgtgcgcattggcggacggtacgtcgtggcgggaaagatgagcatctcgcccaacaccacttacccgagcctcctggaagatggccgggtggaataccgggtggccctgactgaggatcgcctgccacgcctggaagaaatccgcatctggggtcctctgcaagaagatgcagacatccaggtgtaccggcggtacggcgaggaatacggaaacctgacgcgacctgatatcacgttcacgtacttccagccgaagccacggcaggcgtgggtatgggcagcagtgcgcgggccgtgcagcgtctcgtgcggagctggattgcgctgggtgaactactcttgccttgaccaggcacgcaaggaactggtcgagactgttcagtgccagggttcccagcaaccgcccgcgtggcctgaggcctgcgttcttgagccgtgcccgccctactgggccgtgggcgatttcggcccgtgttcggcttcatgcggagggggactgagagaaagacccgtgcggtgtgtggaggcgcaaggaagcctgctcaaaactcttccgccggcaagatgccgagccggagcgcaacagccggcagtcgcactggagacgtgtaatcctcaaccatgtccggccagatgggaggtgtccgagccgtcgagctgcacttccgctggaggtgccgggctcgccctggaaaatgagacttgcgtgccgggagccgacgggcttgaggccccggtcaccgagggcccgggaagcgtggatgaaaaactccctgcccccgagccgtgcgtgggcatgagctgcccaccaggctggggacaccttgatgcaacttcagcaggggaaaaggcacctagcccttggggttcaattcggaccggagcgcaggctgcacacgtgtggaccccggcagccgggtcgtgctcggtgtcatgtgggaggggccttatggaactgcggttcctgtgcatggactcggcgctgcgcgtgccggtccaggaagagctgtgcggtctggcctcaaagcccgggtcacggcgggaagtctgccaggctgtgccctgtccggctagatggcagtataagctcgcagcctgttcggtgagctgcggcagaggcgtggtccggcggatcctgtattgcgcccgagcccacggagaagatgatggtgaagaaatcctcctcgatactcagtgccaaggactgccacggccggagcctcaagaagcctgctcccttgaaccgtgtccgccacgctggaaggtgatgtccctcggaccgtgctcggcttcctgcggactgggcaccgcgaggcgctcggtggcctgcgtgcaactggatcagggccaggacgtcgaagtggacgaagcggcctgtgccgccctggttagaccggaggcgagcgttccatgtctgatcgcggactgcacctacagatggcatgtgggaacctggatggagtgcagcgtgtcctgcggagatggaattcagagacgccgggatacctgcctgggtccacaggcccaagcccctgtccccgctgacttttgtcagcatctccctaagccggtcaccgtccgcggctgttgggcggggccgtgcgtcggacaaggcaccccttcactggtgcctcatgaggaggcggcagcccccggacggaccaccgccaccccggcgggcgcctccctcgagtggtcccaagcgcgggggctcttgttcagcccagcaccacagcctcgtagacttttgccaggacctcaggagaacagcgtccagtcgtctgcatgcggacgccagcatctcgaaccaactggcaccatcgacatgcgcggaccaggtcaagcggactgcgcggtggccatcggacgcccgctgggggaggtggtgactctgagggtgctggaatcgtcgctgaattgctcggctggagacatgctcctgctttggggtcgcctgacctggagaaaaatgtgccggaagttgctcgacatgactttctcgtccaagaccaacaccctggtcgtcaggcaaaggtgcggtcgtccgggcggtggagtgcttctccggtacggctcccagcttgcaccggaaacgttctatcgggaatgtgatatgcagctctttggcccgtggggcgaaatcgtgtcaccgtccctgagccctgccacctccaatgctgggggatgtaggctcttcatcaatgtggccccgcatgcccggatcgcaattcacgcacttgcaactaatatgggagcggggactgaaggagctaacgcgtcatacatcctgattagagacacccattctctgcgcacgaccgctttccacggccagcaggtcctttactgggagagcgagagctcgcaggccgagatggagttcagcgaaggattcctgaaagcccaggcgtcactccgcggccagtactggaccctgcaaagctgggtgccggaaatgcaggatccccagtcatggaagggcaaggagggcact

SEQ ID NO: 5623 - DNA, 4281 bp, Artificial Sequence
  Description of Artificial Sequence: Synthetic coding sequence
atgcaccagagacacccccgtgcaaggtgcccccccctttgcgtcgccggcatcttggcctgcggatttcttcttggttgttggggcccctctcacttccagcagtcctgccttcaagctcttgaaccccaagccgtgtcatcttacctgagcccaggggcacctctgaaaggacgaccaccatctccaggcttccaaagacagaggcaacggcaacgccgcgcggccggagggattcttcatcttgagcttctggtcgccgtggggccagatgtcttccaggcgcaccaggaagatactgagagatacgtcctcactaatctcaatatcggcgcagaacttttgcgcgacccgtcattgggagcacagtttagggtccatctggttaagatggtcatcctcaccgagcctgagggagcgccaaacatcaccgccaacttgacctctagcttgctgagcgtctgcggttggtcccaaacaatcaacccggaggatgacacagaccctggccatgccgatcttgtgctgtacattaccagattcgatttggagctccctgatggaaacaggcaggtgcggggggtaacacagctgggcggagcgtgttccccaacttggtcttgcctcatcaccgaagacacagggttcgacctgggagttacaatcgcacacgaaatcggccactctttcggcctggagcatgatggagcaccagggtctggttgcgggccttcaggtcacgtgatggcatccgacggcgccgcaccgagggccggactggcttggagcccctgctctcgccgacagttgctgagcctcttgtctgctggacgcgccagatgtgtctgggatccaccgcggccacagccaggcagtgctggccacccacctgatgctcaaccgggtctgtattactcagctaatgagcagtgccgcgtggcattcggcccaaaggccgtggcttgtacctttgctcgcgaacatctggatatgtgccaagcactgagttgccacacagatccactcgatcaatcctcttgtagtaggcttctcgtccccttactcgatggaaccgagtgcggagtggagaagtggtgtagcaaaggacgttgcagaagcctggttgaattgactcccattgccgctgtgcatgggaggtggtcttcctggggccccaggagcccttgttcgcggtcctgcgggggaggcgtggttacacgcaggcgccaatgcaacaaccccaggcctgcttttggtggacgggcatgtgttggagcagacctccaggcggagatgtgcaacactcaggcttgcgagaaaacccagctggaatttatgagtcagcagtgtgccagaactgatggacaaccacttcggagcagccctgggggagcgtccttctatcactggggggctgccgtgccccattcacaaggcgatgccttgtgtcggcacatgtgtagagcaattggagaatctttcataatgaagagaggagattctttcctggacggtacacgctgtatgccgtcaggaccacgcgaggacggtacactcagcctttgcgtcagtggttcatgccgcaccttcggctgcgacggacgcatggacagccaacaagtatgggacagatgtcaggtttgtggtggagataattctacctgtagtccaaggaagggctctttcacagctgggagagcccgcgaatacgtcaccttcctgaccgtgaccccgaacctcacttccgtgtacatagccaaccacaggccgctcttcactcatctcgctgttcgcattggaggaaggtacgttgtcgcaggtaagatgtcgatctctccaaacactacgtatccatctctgcttgaggacggacgagtggagtacagagttgcactcacagaagataggttgccccgcctggaggaaatccgcatttggggccctcttcaagaagacgccgatatccaggtttacaggagatacggagaagagtacgggaacttgacacgccccgatattacctttacatacttccaacccaaacctcgtcaggcttgggtgtgggcagccgtgcgtggaccctgtagcgtgagttgcggggccgggctgaggtgggtgaattatagctgcctcgatcaggctaggaaggagcttgtggaaactgttcaatgccaaggtagccaacagccccctgcctggcctgaagcctgtgtcctcgagccatgtccaccttactgggctgtgggtgattttggaccttgctccgccagttgcggagggggcctgagggagcgtccagtcagatgtgttgaagcccaaggtagcctgttgaagaccctgcccccggctcggtgtcgcgccggcgcacaacagcctgccgtagctctcgaaacctgtaacccacagccatgtcccgctaggtgggaagtgagcgaaccatcatcttgtacgtccgcaggcggcgctggactcgctctggagaacgaaacgtgtgttcctggcgctgatggactggaagccccggtgaccgagggtcctgggtctgttgatgagaaactgcctgcccccgagccttgtgtcggcatgtcatgccccccaggatggggccatctggatgctacttcagccggggagaaagccccaagcccatggggctctattagaaccggggcccaggccgctcacgtgtggaccccggctgcgggctcctgctcagtgagctgcggccgtgggttgatggaacttaggttcctgtgcatggacagcgcacttcgggtgcctgtccaggaggagttgtgtggcctcgcaagcaagccaggatcccgtagggaggtgtgccaagctgtgccttgccctgctagatggcagtataaactcgcagcatgctcagtttcttgtggaagaggtgtcgtcagaagaatattgtattgtgctagggcccatggagaggatgatggagaggagatcttgctggacacccagtgccaggggctcccccgacccgagcctcaagaagcctgctctctagaaccctgcccccctcggtggaaagtcatgtccctcggaccttgcagcgcaagctgtggtctcggcaccgccagaagaagcgtggcctgtgtccagctcgatcaaggccaggacgttgaagtggatgaggcagcatgcgctgctctggttcgcccggaggcttcagtgccttgcctcatcgccgattgcacatataggtggcatgtgggcacctggatggaatgctctgtgagttgcggagatggaattcaacgtaggagagatacctgcctgggcccccaggctcaggctccagtacccgcagatttttgtcagcacctgccgaaacccgtgaccgtgaggggctgttgggcaggaccatgtgtgggccagggaacgccctcacttgtaccacacgaagaagctgcggcccccggcaggacaacagctacaccagcaggagctagcttggaatggtctcaagctagaggcttgttatttagtcctgccccacaacctcggcgtctattgcctggacctcaggagaactcggtgcaaagtagcgcctgtggtcgccagcatctggaacctactgggaccattgatatgaggggacctggccaggccgactgcgctgttgcaatcgggaggccgctcggtgaagtcgttacgcttagggtcctcgaaagctcattgaactgcagcgccggtgacatgctgttgctttggggacgccttacatggagaaagatgtgtaggaaactgctcgacatgaccttttccagcaagacaaacacattggtagttagacagcgctgcggaaggccaggaggcggcgttctcctccgatacggctcccagctagctccagagactttctaccgcgaatgcgatatgcaactgtttggaccctggggcgagattgtgtccccgagcctgagccccgcaaccagcaacgctggaggctgtcgactctttatcaatgtggcacctcacgctaggatcgctatccacgctcttgccactaacatgggcgcaggaaccgaaggcgctaacgccagttatatattgataagggacacccacagtttgcggacaaccgcattccatgggcaacaagttctctattgggagtctgagagttcacaagccgaaatggaattcagcgagggctttcttaaggcacaagccagtctgaggggccaatattggacactgcaatcatgggttcctgagatgcaggacccgcagtcttggaagggaaaggaggggacc

SEQ ID NO: 5624 - DNA, 4281 bp, Artificial Sequence
  Description of Artificial Sequence: Synthetic coding sequence
atgcaccagcgccaccccagagcaagatgccctcccctatgtgttgctggtatccttgcctgtggattcctgcttggatgctgggggcctagtcactttcagcagtcttgtctgcaggctctagaaccccaggcagttagcagctacctcagccctggcgctcccctgaaagggaggccaccttcacctgggtttcaacggcagaggcagagacaaagaagagctgccggcgggatcttgcacctggaattattagtggctgtcggaccagacgtgtttcaagctcatcaggaagacacagagaggtacgttttgaccaatctgaacattggggcagagctgctcagagatcctagcctgggcgctcaatttagggtgcacctggtaaaaatggtgattctgacagagcctgagggcgcccccaacataaccgctaacctgacctcctctttgctgtctgtgtgtgggtggagccagactataaatcctgaagacgacacagaccccggccacgcggaccttgttctgtatatcactcgattcgatcttgagctccctgacggcaaccgccaggtgcgcggtgtaacacagctgggcggggcctgctcccctacatggtcgtgcctgattacagaggatactggcttcgacttgggagtcacaatcgcacatgaaatcggtcacagcttcgggttagaacacgatggggcccctggatcagggtgtgggcctagtggccatgtcatggcatcagatggagccgcccctcgtgcagggttggcctggtcaccctgcagcagacggcagttgctatcactcttgagtgccggcagggccaggtgtgtctgggatcctccgcggccgcagcccgggagcgctggacatcccccagatgcccagcccggcttgtattacagcgctaacgagcagtgtagggtggctttcggacctaaagccgtggcatgtacctttgcccgggaacacctggatatgtgccaagccctttcctgtcatactgaccctctcgatcagagtagttgttcccggctgctggtgccgcttctggatggaactgaatgcggggtggagaagtggtgctctaagggccggtgccggtctctagttgagctgaccccaatcgcggccgtgcatggacgatggtccagctgggggccaagatctccatgttcacgctcatgtggcgggggcgtggtcacaagacggaggcagtgtaataatccgaggccagcttttggcggccgcgcctgtgtgggcgcagatctacaggctgaaatgtgcaatacacaggcatgcgaaaaaacccagctcgagtttatgtcgcagcagtgcgctcggacagacgggcagcctctgaggtcttcccccggcggcgccagtttttaccattggggggcagcagtgccacacagccagggggatgctctatgcagacatatgtgtcgtgctataggagaatcgtttatcatgaaaagaggagattcattcctagatggtacccgctgtatgccgtctggaccgagagaggacggcacactgtccctctgcgttagcggtagctgtcgcacctttggatgcgatggcagaatggactcacaacaggtgtgggaccggtgccaggtgtgtggaggggataatagcacatgctcaccaagaaaagggtcctttactgctggtagagccagggagtatgttacattcctgactgtgacacctaatctgacgtccgtctacattgcaaatcatcggcctttgttcacccaccttgctgtcaggatcggcggccgatacgtggtggctgggaagatgtccattagccccaacaccacttatcccagcttgctcgaagatggcagagtcgagtatcgcgttgccttaaccgaggacaggttacctaggttggaggagatacgtatctggggcccactgcaggaggatgcagacattcaagtttacaggcgttatggggaggagtacggaaaccttactcgccccgatattacattcacatatttccaacctaaacctcggcaggcctgggtttgggccgccgtgaggggcccttgcagcgtctcctgcggagctgggcttcgctgggtcaattactcatgtctggatcaggctcgcaaagaactcgtggaaaccgtgcagtgtcaaggctcccagcaacccccagcctggccagaggcctgtgtcctcgagccatgccccccttactgggctgtgggagattttggaccctgcagtgcctcttgtgggggcggcctccgagaaagacctgtgaggtgcgtggaggcccagggatccctgctgaagacactgccccctgcacggtgccgggccggggcccagcagccagccgtcgcccttgagacatgtaacccccagccctgtccggcgagatgggaggtgtctgagccatcttcttgtacttctgctggcggcgccggactggcactggaaaacgagacatgcgtcccaggagcagatggtcttgaggccccagtcactgagggtccaggcagcgtggatgagaagcttccagcacccgagccttgcgtcggcatgtcttgcccccccggatggggacatctggacgccacttcagccggggagaaagcaccctcaccatggggcagtatcagaacaggcgcgcaagctgctcatgtgtggacgccggccgcgggttcttgctctgtaagttgcgggcgtggcctaatggagctacggtttttatgtatggatagtgccttgagggttcccgtacaagaggagctatgcggccttgcctcaaagccaggtagcaggagggaggtgtgccaggccgtcccctgccccgctaggtggcagtacaagcttgcagcttgttctgtctcttgcggacgcggggttgtccgaagaatcctgtattgcgcacgagcacacggggaggacgatggagaggagatactgctggatacacagtgccaggggctcccaagacccgagcctcaggaagcctgcagtctagaaccctgtcctccgcgttggaaggtgatgagcctggggccatgttccgctagctgcggactgggtaccgctcgtcggtccgtggcctgtgtccagctggatcaaggccaggacgtggaagtggatgaggcggcctgcgccgcactggtgcgcccagaagcttctgttccttgtttaattgccgattgcacctacagatggcacgtagggacatggatggagtgttcggtgtcgtgtggcgatgggatccagaggcgacgagacacttgtttgggcccccaggcgcaggcccctgtacccgctgacttttgccagcaccttcccaagccagtgaccgtgaggggttgctgggccggaccatgcgtgggacagggcactcctagcctggtccctcatgaagaggccgcagcccccggccgaactaccgcgactccagccggcgcctcgctggagtggtcacaggctcgtggactcctgttttcaccagccccacagcctcggagactgctacccggaccacaggaaaactcagttcagagtagcgcatgtggcaggcagcatcttgaacccaccggcacaatagatatgaggggacctgggcaggctgactgcgccgtcgccataggtcggcccctgggagaggtagtaacactgagggtgctggaaagcagcctcaactgttccgccggggatatgctgctactgtggggacgactgacatggagaaagatgtgtcgcaagcttctagatatgacattcagcagtaagactaacactctggtcgtgcggcagagatgcggacgacccggcggtggagtgctgcttagatatggcagtcagctagcacctgaaaccttctatcgtgagtgtgatatgcagctattcggaccctggggcgaaatcgtgagtccgtccctgagccccgctacctccaacgctggtgggtgccgactgtttattaacgtggctcctcatgccaggatcgcaatacacgccctagccacaaacatgggcgccggaactgagggggccaacgccagttacattcttatccgagatactcattctctccgtactacggcctttcacggtcagcaagtgctgtactgggagtcagaatccagccaggccgagatggaattctcagaagggttcttgaaggcgcaggcttcgttgagaggacagtattggaccctgcagtcatgggtccctgaaatgcaggatcctcaaagttggaaaggcaaggagggcacg

SEQ ID NO: 5625 - DNA, 4281 bp, Artificial Sequence
  Description of Artificial Sequence: Synthetic coding sequence
atgcatcagcgccaccccagagctaggtgccctcccctgtgcgtggcaggtatactggcctgtggtttccttctgggctgctggggccctagtcactttcaacaatcatgtcttcaggccttggagccacaggccgtaagttcctatctgtctcccggcgctccactgaagggtaggcccccctcccctggattccagagacagaggcagcgtcagcgccgtgctgccggaggcatcctgcacctcgagctcctggtcgcagtgggacctgacgtcttccaggctcaccaggaggacacagagcgctacgtgctgaccaacttgaatatcggcgccgagttgctgagggacccaagtctgggagcacagttccgcgtccatctggtgaagatggtgatcctgaccgaacccgagggtgcccccaatatcactgcaaacctgacctcctctcttctgagcgtatgcggctggtcccagacaattaaccctgaagacgataccgatccaggacatgctgacctggtactctatattaccagattcgacctggagctcccagacggaaacaggcaggttaggggcgtcacccagcttggtggtgcatgttcaccaacttggtcttgccttatcactgaggacaccggtttcgacctcggcgttactatcgcccatgagatcggccattcttttggtctcgagcatgacggtgctccaggtagtggatgcggcccctccggacacgtaatggcttcagatggtgccgctcctcgtgccggactcgcctggtctccttgcagtcgtcgtcaactgctgtcactgttgtcagctggccgtgctcgctgtgtgtgggaccctcctcgcccacagccaggtagcgctggacatccccctgacgctcaacctggtctgtattatagcgctaacgagcaatgccgtgtcgccttcggtcctaaagccgtcgcctgcactttcgctcgcgaacatctcgacatgtgtcaggctctgtcttgtcatacagacccactggatcaatcttcttgttcacgcctcttggtgcccctcctggatggaaccgagtgcggagtagaaaagtggtgtagcaagggtcgttgccgctctttggtggaattgacccctatcgccgcagtccacggtcgctggtcaagttggggaccacgttcaccctgttctcgcagttgcggtggcggcgtggtaacccgtagaaggcaatgcaacaacccacgtccagctttcggcggaagagcctgtgtgggtgccgacctgcaggcagagatgtgtaatactcaagcttgcgagaagacacagctggagttcatgtcccagcagtgtgctcgtaccgatggacagcctttgaggtcttccccaggaggcgcctccttctaccactggggtgctgcagtgccacactcacagggcgatgccctgtgtcgccacatgtgcagggccattggtgaatccttcattatgaaacgtggagattccttccttgacggaactagatgcatgcctagtggtcctagagaggacggtacactttctttgtgcgtgagtggaagctgccgcacttttggatgcgacggtaggatggacagccaacaggtgtgggaccgctgtcaagtttgtggcggcgataacagcacatgttcccctcgcaaaggaagtttcacagctggtcgtgctagagagtatgtgaccttcctgacagtgacacctaatctgacctccgtgtacattgctaaccaccgtcctttgtttacacatctcgctgtgaggataggtggccgttatgtggtagcaggcaagatgtccatttccccaaacaccacctacccctccctcctggaagatggtcgcgtggagtacagagtggctctcaccgaggaccgcctcccaagattggaggagatccgcatttggggcccactccaggaagacgccgacattcaggtctaccgcagatacggtgaggaatatggtaatctgactcgtcctgatatcactttcacttatttccaacctaaacctaggcaagcttgggtttgggctgctgtgaggggtccctgttcagtctcctgcggtgctggattgcgctgggtaaactactcatgtctcgaccaagcccgtaaggagttggtcgagaccgtgcagtgtcaaggctctcagcagccccccgcttggcctgaggcctgcgtgcttgagccctgccctccttattgggccgttggtgattttggaccttgttctgcaagctgcggcggcggtctgcgtgagcgccccgtaagatgtgtggaggcacagggaagcttgcttaaaactctcccccccgctagatgccgtgctggtgctcaacagccagccgtggcacttgaaacctgcaacccacagccttgccccgctagatgggaagtctctgagccctccagttgcacttccgccggaggagccggattggcactggaaaacgaaacctgtgtgcctggcgctgacggactggaggcccccgtgactgagggtcctggatctgtggatgaaaaattgcccgctccagaaccttgcgtaggcatgtcttgcccacctggatggggccaccttgacgccactagcgccggagagaaggcaccatcaccctggggtagtataaggacaggcgcccaggctgcccacgtctggactccagccgcaggcagttgttcagtgtcctgcggtcgtggtttgatggagctgcgcttcctgtgtatggacagcgcattgcgcgttccagtgcaggaggaactgtgtggccttgctagtaagcccggctcacgccgcgaagtttgccaggctgtgccttgcccagcccgttggcagtacaagctggctgcatgtagcgtcagttgtggccgtggtgttgtgagacgtattctgtactgcgctagggcacacggcgaggatgacggagaagagattttgctggatacacaatgtcagggtctgccccgccctgagcctcaagaagcttgcagtttggagccttgtcctcctagatggaaggtcatgtctctgggcccttgctctgcctcctgtggcctgggtaccgcccgtaggtcagtcgcttgtgtgcagctcgaccagggacaggacgtcgaggtggatgaggctgcctgcgccgccttggttagacctgaagcctctgtgccttgcctcatcgccgactgcacttaccgctggcatgttggaacctggatggagtgttccgtatcctgtggagacggtatacagaggagacgcgacacatgtctgggccctcaggctcaggctcccgtgcctgcagatttctgtcaacacctgcctaaacccgtcaccgtgcgtggctgctgggcaggaccatgtgtcggacagggaactcctagtttggtaccccacgaagaggctgccgctcctggtaggacaaccgcaacacccgccggcgcttccctggaatggtctcaagcacgtggactcttgtttagccccgccccacagcccagacgtttgctgcccggtccacaagaaaactcagtgcagtccagcgcctgcggaaggcagcatcttgagcccacaggtacaatagacatgagaggcccaggtcaagccgattgtgccgttgcaattggaaggcctctgggtgaagtggtcaccctgcgtgtcctggagtcatccctcaattgttccgctggtgatatgctcctgttgtggggccgcctgacatggcgcaaaatgtgccgtaaactgctggatatgacatttagctctaaaaccaataccctggtggtcagacagcgttgtggaagaccaggaggcggtgttctgcttaggtacggaagccagcttgcacccgagactttctaccgcgagtgcgatatgcagctgtttggaccatggggagaaatcgtgtcccccagcctgtcaccagcaacctctaatgctggtggctgccgcctttttatcaatgtcgctcctcatgctcgcatcgcaatccatgctctcgctaccaatatgggcgctggtaccgaaggcgctaatgccagctacattctgatcagggacactcactctctgagaacaacagcatttcatggacagcaggtgctgtactgggagagtgagtcttcacaggctgagatggaatttagtgaaggcttcctcaaggctcaggcctctctgaggggccaatactggactctgcagtcatgggtgcccgagatgcaagacccccagagttggaagggaaaagagggcact

SEQ ID NO: 5626 - DNA, 4281 bp, Artificial Sequence
  Description of Artificial Sequence: Synthetic coding sequence
atgcaccagagacatccacgggctagatgtccccccctttgcgtggcaggaatcttggcctgcggcttcctcctcggatgttggggtccttcccattttcagcagtcttgtctgcaggccctcgagccccaggcagtctcgtcctacctctcgccgggagcacccctgaagggcaggcctcctagtccggggttccaacgacagcgtcaaagacagcggcgggcagccggggggatcctacatcttgagttgctggtggccgttggccccgatgtgtttcaggcgcaccaagaggacacagagcgatacgtgctgacaaacttgaatatcggtgctgaactgctcagggatccgagcctgggtgcccagtttcgagtgcatctcgttaaaatggtgattctgactgagccagagggcgctcccaatataaccgcaaatcttacatctagcttgctaagtgtatgcggatggagccagactattaaccccgaggatgacacagaccccggacacgcggacctggtcttatatataacacggtttgatctcgaattgccagacgggaatcgtcaggttagaggcgtgacccaactgggtggcgcttgttcacctacctggagttgcctgattacagaagacacgggatttgacctcggtgtgactatcgcacacgagatcggccactcgtttggtctggagcacgatggagcacctgggtcaggctgtggccctagcgggcacgtcatggcaagcgacggcgccgccccaagggctggcctggcctggtccccctgcagtagacggcagctgttgtctctgctgtctgccggcagggcaaggtgcgtttgggacccaccaaggccacagccaggctctgcggggcacccccccgacgcgcagcccggcctgtattacagcgcaaatgagcaatgccgcgtagcgttcggtccaaaggctgtagcctgtacattcgcaagggagcacctcgatatgtgtcaggccctgtcatgtcacacagaccctctcgaccaaagcagctgctcgcgacttttagtcccccttttagacggtaccgagtgtggggtcgagaagtggtgctccaagggacggtgtcgctctttggtggaacttacccccattgccgctgtgcacggtcgttggagctcatggggcccacgcagcccatgcagtcgaagctgcgggggtggtgttgtgacacgcagacgccagtgtaataacccacggcctgctttcggggggagggcatgtgtcggggccgatttacaggcggagatgtgtaatacacaggcatgcgagaaaacgcagctagagttcatgtcacagcagtgtgcccggaccgatggccagccgctaagatcaagtcccggcggtgccagtttttatcattggggggcagcagtgccccacagtcaaggtgacgctctgtgcagacatatgtgcagagcgatcggagaaagtttcattatgaagcggggcgatagcttcctcgatgggaccaggtgcatgccctctggtccaagggaagatggtaccctgtcactctgtgtgtctggctcgtgtaggactttcgggtgcgacggcagaatggactctcaacaggtgtgggatcgctgtcaggtatgtggcggcgataattccacatgcagcccaaggaaaggctccttcaccgcaggtagggcaagagagtacgtcacctttctgactgtgacccccaacctgacctcggtgtacatcgctaatcataggcctctcttcacacatcttgccgttcgaatcggcggtcggtatgtggtagctgggaaaatgagcatatctcccaacacgacgtatccctctttgttggaggacggacgagttgagtaccgtgttgcccttaccgaagaccgcttgccacgtctggaagagattcggatctggggccccctgcaggaggatgcagacatccaagtctatcggcgatatggggaagagtacgggaacttgactaggcctgacatcacatttacctattttcaacccaagccacgtcaggcctgggtgtgggcagcagttagaggcccatgctctgtctcatgtggagctggcctgaggtgggtgaattactcgtgcctcgatcaagcccgaaaagagctggtcgagaccgtgcaatgtcaagggtcacagcagcctcccgcttggcccgaagcctgcgttttggaaccatgcccaccctattgggctgtcggagattttggcccatgctcggccagctgtgggggcggactgcgcgagagacctgtcagatgcgtcgaggcacagggatctcttctcaaaaccctacctcccgcccgctgccgcgcaggtgcacagcaaccagctgttgccctggagacttgcaacccgcagccatgtcctgctcggtgggaggtcagcgaaccatcatcctgtacaagcgccggtggcgccggcttggctctggagaacgagacctgtgttccaggagcagatggtctggaagctccagtgacggagggacctgggagtgtcgatgagaagcttcccgcgcccgagccctgtgttggtatgtcctgcccacccggctggggccacctcgatgctaccagtgccggtgagaaagcaccatcaccatggggatctatcaggaccggtgcccaggccgcacacgtgtggacacctgcggctggctcgtgcagcgtgtcttgcggccgtggtttgatggagctccgatttctctgtatggatagcgccctcagagtgcctgtccaagaagaactttgcgggctggccagtaaacccggatctcgcagagaggtttgccaggctgttccgtgccctgcacggtggcagtacaagttggctgcatgttccgttagttgtgggcgcggagttgtgcgcagaatactctattgtgccagggcccacggcgaagatgatggcgaggagatactgctggatactcagtgccaggggttgcctcgcccagagcctcaggaagcttgcagcctggagccttgccctcctagatggaaggtcatgagtctggggccatgtagtgccagctgcggcctcgggacggccaggcggtctgtcgcatgtgtccaactagatcagggacaagacgttgaagtggatgaggccgcatgtgccgctctggttaggcctgaagcttcagttccttgtctgattgctgactgcacataccgctggcacgtaggtacctggatggagtgctcagtgtcctgcggtgacggtatccagagacggcgagatacatgtttggggccacaggcacaggccccggtgcctgccgatttttgccaacatctgcctaagcctgtcaccgtgcgaggttgctgggccgggccttgcgtgggccagggcacaccatctttggtccctcatgaagaggcggcggctcctgggcgaactacagccactccagcaggcgcttccctagagtggagtcaggctcgcggcctcctctttagtccagcccctcaaccgcggcgactcttaccagggccccaagaaaacagcgtgcagtcaagtgcatgtggccgacagcacttggagccaaccggtactatcgatatgcgcggtcccggccaagccgattgtgctgtagccatcggcagacctctgggcgaagtggttacactgcgggttcttgagagctccctcaattgtagcgctggagatatgctgcttctttggggaaggctcacctggaggaagatgtgcaggaagctgctcgacatgaccttttcaagcaaaacaaatacactggtggtaaggcagagatgtgggcgtcctggcggaggcgtactgctgcgatatggatcccaactggcccctgagacgttctatagggagtgtgatatgcagctgtttgggccatggggagagatcgtgtcaccgtcactgtctcctgccacatctaatgccggaggttgtagactcttcatcaacgtagcaccccacgcccgaatcgccatccacgccctagccaccaacatgggggccggcactgaaggcgctaacgctagctacatactgattagggacacccatagtctgaggacaacagcctttcacggtcaacaggtattgtattgggagtccgagtcttctcaagccgaaatggagttctctgaagggttcctgaaagctcaggcttctctgcgcggccagtattggactctgcagtcctgggtgcccgagatgcaggatccccagagttggaaggggaaggaaggcact

SEQ ID NO: 5627 - DNA, 4281 bp, Artificial Sequence
  Description of Artificial Sequence: Synthetic coding sequence
atgcaccaaaggcaccccagggcacgatgcccccccttgtgcgtggcagggattctggcctgtgggtttctactgggatgctggggaccatcccactttcagcagagctgtttacaggcactcgagccacaggctgtctcctcgtacttgtctccaggcgcccctctcaaggggcggcctccaagcccaggtttccagcgtcagaggcagaggcaacggcgggcggctgggggcatcctccacctggaattgttagttgcggtgggtcccgacgtgttccaagcgcatcaggaggacacagagcggtacgtgctgactaacttgaatattggtgccgagctgctgagggatcctagcctgggagcccaattcagagttcatctagtgaagatggtgatcctaacggaaccagagggcgcaccgaacatcaccgctaacctcaccagtagcctgctgtccgtttgcggatggtctcagaccatcaatcctgaggatgatactgaccctggccatgcagatctggtcttgtacattacgagattcgacctggagcttcccgatggaaaccggcaagtcagaggagtaacacagctcggcggtgcctgtagtccaacttggagctgtcttatcaccgaggataccggcttcgatctgggggtgacaatagcacatgaaatcggacatagctttggactggagcacgacggagcccccggctctggctgcgggccaagcggccacgtgatggcttccgacggcgctgcacccagggccggtctggcctggtctccttgctccaggaggcagcttctgagcctgctttcagcaggtcgcgctcgctgtgtctgggacccaccacggccccagccagggtcggctggccatcctcccgatgcccaaccaggactgtactattccgcaaacgagcagtgtcgcgtagctttcggtccgaaagcagtggcatgcaccttcgcccgcgagcaccttgatatgtgccaggccttgtcatgccacaccgatccccttgatcagagcagctgttcccggctgctggtgccgctgctggatgggaccgaatgcggggtggaaaaatggtgctccaaaggccgctgtcgatccttggtggagctgactcccattgctgccgttcacggtcggtggagctcctggggccccaggtccccttgctcacggagttgcggaggaggcgttgttactcgtcgtcggcagtgtaacaacccgcggcctgcttttggaggaagggcttgcgtcggagctgacctgcaggctgagatgtgtaacacccaagcgtgtgagaagacccagctggagtttatgtcccagcagtgcgcacgtactgacggccaaccattacgatcctcccccgggggggctagcttctaccactggggagccgccgtgccccactctcagggcgatgccctgtgcagacacatgtgccgcgctatcggagaaagtttcattatgaaaagaggtgactcgtttctggacggcaccagatgtatgcccagtgggcctcgggaggatggtaccttgtcactctgtgtgagtgggagttgtcggaccttcggatgtgacggcaggatggactctcaacaggtgtgggatagatgccaggtctgtggtggggataacagtacctgcagtccgcgaaaggggtcatttactgccggccgggctagagagtatgtaacctttctgacagtgacccctaatctgactagcgtatacatagccaaccatcggccgctgtttacacacctggcagtcagaataggcggtcgctatgttgtggccggcaagatgtcgattagtccgaatactacttacccatcgttgctggaggacgggagggtggaatatagggtcgccttgacagaggaccgcctaccaaggctcgaggagatcaggatatggggccccctgcaagaagacgccgatatacaggtgtacaggcggtatggagaagagtatgggaatctgacccggccagacataacgtttacatattttcaaccaaagccgagacaggcctgggtttgggccgccgtacgggggccctgctctgtgagctgtggggccggcttaaggtgggtgaattactcatgtctagatcaggcaagaaaggagttggtggaaaccgtgcagtgccagggcagccaacaaccccctgcctggccggaagcatgtgtgttggaaccttgcccaccttactgggccgtaggggacttcggaccttgcagcgctagctgtgggggaggattacgggagcggcccgtgcggtgtgtggaagcacaggggtctttattgaaaaccttacccccagccaggtgcagggccggagcacagcagcctgctgtggctctggaaacttgtaacccccagccctgtcctgctcggtgggaggttagtgaaccctcttcctgcacttctgctggcggcgccgggctggcgctcgagaacgagacctgtgtgccaggagctgacggcctggaggcccccgtgacggaagggccagggtccgtagatgaaaagcttcctgctcctgagccatgcgtggggatgtcctgccctcccggctggggccatctcgacgctactagcgccggagagaaagccccctccccctggggatccatccgtacaggcgctcaggctgcccatgtctggacccctgccgctggtagctgttccgtcagctgcggcagaggactgatggaactgcggtttctgtgcatggattctgcacttcgagtgcctgtgcaggaagaactgtgcggcctggcttcaaagccaggctcccggcgggaggtatgtcaagcagtgccctgtcccgccagatggcagtataagctggccgcctgttcggtgtcctgtgggagaggcgtagtgagacgcatcctgtattgcgcacgtgcccatggagaagacgacggcgaagagattctgctagatacccagtgtcagggactgcccagacccgagccccaagaggcatgctcccttgagccatgccctcccaggtggaaggtaatgagcctcggtccttgttcagcctcctgtgggctgggaacagcacgccgttctgttgcctgcgtccaattagatcagggtcaagatgtcgaggtggacgaggccgcctgcgcggccttagtcagacccgaagcgtctgttccgtgtctgatagcagattgtacttatagatggcacgtgggcacctggatggagtgctccgtgagttgcggcgacggaattcagagaagacgcgatacgtgcctgggccctcaggcccaggctcccgtgcccgcagatttttgccaacatctgcctaaacccgtgaccgttaggggatgctgggctggcccatgcgtcggccagggaaccccctccctggtccctcatgaggaggctgctgcccccggaaggaccaccgctaccccagcaggggcaagcctggagtggtctcaggccagagggctgcttttctcacccgcccctcagccaagaaggctgttaccaggcccacaggaaaattccgtgcagagctccgcctgtggcaggcagcatctcgagcccacaggcactatcgatatgcggggaccgggtcaggccgactgtgcagtcgctatcggccggccgctaggagaagtggtgactcttcgcgtgcttgagagcagtctgaactgctcggcaggggacatgctattgctgtgggggaggcttacatggaggaaaatgtgtaggaaactgttggatatgacttttagctcaaagaccaataccttggtggtccgacagagatgcggtcggcccggtggcggtgtcttattacgctatggaagtcagctcgctcccgagacattctatcgcgagtgtgacatgcagctatttggtccttggggcgagattgtgtccccttcacttagcccggccacatccaacgccggggggtgcaggttgtttattaacgtagcaccccacgcaagaatagccatccacgccctggccactaacatgggggcaggaaccgagggggccaacgcttcatacatcctgattcgtgatacccactcactccggacaaccgctttccacgggcagcaggtgctgtattgggagtctgagtctagccaggccgaaatggagttcagtgaggggttcctgaaagcccaggcgtccttgaggggacagtactggacattgcaatcatgggtcccagaaatgcaggacccacagtcatggaagggaaaagaaggcacg

SEQ ID NO: 5628 - DNA, 4281 bp, Artificial Sequence
  Description of Artificial Sequence: Synthetic coding sequence
atgcaccagcgacatccacgggcccgttgccctcccctgtgcgttgccggtattctggcctgtggcttcttgctggggtgttggggaccctcgcatttccaacagagctgtctgcaggcacttgaaccccaagctgtaagctcctacctctcgccaggagcccctctgaagggtaggccaccctctccgggcttccagcgtcagcgccagcgccagcggagggctgccggcggaatcctgcacctggaactgctggtggcagtcggtccagatgtattccaggcccatcaagaggacaccgagagatatgtcctcaccaacctgaatatcggagccgagctgctgcgtgatcccagtctaggagcccaatttagagttcacttggttaagatggtgatcctcaccgagccggaaggggctcccaacatcaccgccaatttgacttcaagtctattatctgtgtgcgggtggagtcaaacgattaaccccgaggacgataccgaccccggtcacgcggatcttgtcctttatataactcgatttgatctcgagctccccgacggcaaccggcaggttagaggcgttacacagttagggggcgcgtgctcacccacctggtcatgccttataactgaggacacgggctttgatctcggtgtgaccatcgctcacgaaattggccatagtttcgggctagaacacgacggtgcccctggatccggatgcggtccctctggccacgtcatggctagcgatggcgcagctcccagggcaggactggcctggagtccttgcagtcgccgacagctgctctctctgctatccgcgggccgggctcggtgtgtctgggacccacctagaccgcagccaggttctgcgggacacccccctgacgctcaaccaggactgtattatagtgcgaatgagcagtgccgagttgcctttgggcccaaagctgtagcctgtaccttcgcccgtgagcatctggatatgtgccaggccctgagctgtcataccgacccacttgaccagtcttcctgcagtagactcttagtacccctgctggatggaactgaatgcggcgtggagaaatggtgctctaaggggagatgccgatctctggtcgaactaaccccaattgcggccgtccatggccgctggagttcatggggcccccgatctccctgctctcgcagctgcggaggcggcgtggtgacacgtcgccggcagtgcaacaaccctaggcccgcttttggcggccgcgcatgcgtaggggcggacctgcaggctgaaatgtgcaatacacaggcctgcgagaagactcaactcgaattcatgtctcagcagtgcgccaggacagatgggcagcccttgagatcaagcccaggaggggcctctttttatcattggggggctgccgtcccacatagtcagggagacgctttatgtcgacacatgtgtcgcgcaatcggcgagtcattcatcatgaaacgaggggattcattcctggatggtacgcgatgcatgccctctggcccgagagaggatggcactctgtccctgtgcgtttccgggagctgtaggacattcggatgcgacggccggatggacagccagcaagtgtgggatagatgccaggtgtgtggtggagacaattccacatgttcaccacggaagggctcttttaccgccggaagagctagagagtatgttacgtttcttaccgtgacccctaacttaaccagcgtctatatcgccaatcatcgtcctctgtttacccacctggcggtgcgcatcggaggcagatatgtagtcgctggcaaaatgtctatctccccaaatacaacatatccttcccttctggaggacgggagagtggagtatagggtggctctgacagaggaccggctaccaagactggaggaaatccggatctggggaccactccaggaagacgctgacatccaggtctacagaagatatggggaagaatatggcaatctcaccaggccagacatcactttcacatattttcagccgaaaccaaggcaggcttgggtctgggctgctgttagggggccatgctcagtgagctgtggcgcaggcctgcggtgggtgaactatagctgcctcgaccaggcccgaaaagaacttgtcgagactgtacagtgtcagggctcccaacaacctcctgcgtggccggaggcatgtgtgcttgagccgtgtcctccctactgggcggtgggagacttcgggccatgttcagcgtcttgcggcggaggcttacgcgaacggcccgttagatgcgtggaggcgcaaggaagccttctgaaaacccttcctccagctaggtgtcgcgcaggggcacagcaacctgcagtggcattagaaacctgcaacccacagccatgccctgccagatgggaggtgagcgagccctcatcatgcactagtgctgggggcgctgggctggccctagagaatgaaacctgtgtcccaggtgcagacgggctcgaagcccccgttactgagggccctgggtctgtggacgaaaaattgcccgccccagagccctgtgtgggaatgtcctgcccacccgggtgggggcatcttgatgccacttccgcgggggagaaagcccccagtccctggggttctatccggaccggcgctcaggccgcccatgtatggactccagcagcaggttcctgctcagtgagctgcgggcggggtctgatggagttgagattcttgtgcatggactccgctctcagagtgccagttcaggaggagctctgcggcctagcctctaaacccggcagcaggcgggaagtctgccaagccgtgccctgtccggccaggtggcagtataagttagccgcctgttccgtttcctgtgggcggggcgttgtgcgccgaattctgtattgcgcccgggcacacggagaggatgacggcgaggaaatccttctcgatacacagtgccaaggccttccacggccagagccccaggaggcctgctccctcgaaccatgtcccccccgttggaaggtgatgagtctcgggccttgttcagccagttgcggcctgggcacggctcgcaggagtgttgcctgcgttcaactcgatcaggggcaggatgtggaggtggacgaagccgcctgcgccgccctagtgcggccagaggcctctgtgccatgcctcatcgctgattgtacttacagatggcatgttggcacctggatggagtgctccgtttcctgtggagatgggattcaacgaagacgggacacatgtctcgggccccaggctcaggccccagtgcccgctgatttttgtcaacatctcccaaaaccggttacagtgaggggctgctgggcaggaccatgcgtaggacaagggaccccatctctggttccacatgaggaggctgccgctcccggccgcacaaccgctacgcccgcgggtgcaagcctcgaatggagccaggctcgaggcctattgttcagccccgccccacaaccacgccgattactgcccggtccgcaagaaaatagcgtgcagtcatccgcatgcggccggcagcaccttgagcctacaggaactattgacatgagaggacccggacaggcagactgcgcagtggcgatcggaagaccacttggtgaggttgtgaccctccgtgtgttggagagttccctcaactgctccgcgggagatatgttattactgtggggtcggctgacctggcgcaagatgtgccgcaagttactggatatgaccttttcttctaaaaccaacaccctggtcgttcggcagaggtgcggccggcctggcggaggagtgctgctcaggtatggaagtcagcttgcccccgagacattctatcgtgagtgcgacatgcaactgttcggtccctggggtgagatcgtgtcgccatctctttcccctgcgacctctaacgccggagggtgtcgtttgtttatcaatgtggcaccacacgctcggatcgcaatacacgctcttgcaacgaacatgggcgctggcactgagggagcaaacgcttcctatatcctgattcgagacacccattcattacggaccaccgcatttcatggccaacaggtgctgtattgggagtctgaatcaagtcaggcagaaatggagttcagcgagggctttctgaaggcgcaggcttcacttcgaggccagtattggaccttgcagagttgggtgcccgaaatgcaggatccccagtcatggaagggtaaagaggggact

SEQ ID NO: 5629 - DNA, 4281 bp, Artificial Sequence
  Description of Artificial Sequence: Synthetic coding sequence
atgcatcaacggcaccctcgagcacgttgtcctccactgtgtgttgccggaatattggcgtgcgggttcctgcttggatgttggggaccatcgcatttccagcagtcctgccttcaagcactcgagccccaggctgtgtcgtcgtacctgtcgcctggtgcaccccttaaaggtcgccctccatcccctggatttcaacgtcagcgccagagacaacggcgggcagcaggaggaattctccatcttgagctgcttgtcgccgtgggacccgacgtgtttcaggcacatcaagaagataccgaaagatacgtgttgacgaacttgaatataggagccgaacttctccgcgacccatcattgggagcccaattccgggtgcatctcgtgaagatggtgattctgaccgaacctgaaggcgcacctaacatcactgcgaacctcacctcgagcctgctctcggtctgcggctggtcccagaccataaatcctgaagatgataccgacccaggacacgcagatctggtgctgtacattactagatttgatctggagttgccagacggtaatcgacaagtgcggggtgtgacccaacttggtggggcatgctcacctacgtggtcgtgcctgattactgaagataccggttttgatcttggagtgactatcgctcatgaaataggacattctttcggccttgaacacgatggtgcacctggcagcggttgtggacctagcggacatgtcatggcttcggatggggcagcaccacgggcaggacttgcatggtcgccttgttccagaaggcagctgctgtcattgctctcggcaggaagggctagatgtgtgtgggatccacctcggcctcaaccgggttcggcaggccaccctccagacgcgcagcctggcctttactatagcgcaaacgaacaatgccgggtcgctttcggcccaaaagcagtggcgtgcacgtttgcaagggaacatctggacatgtgtcaagcactcagctgccacaccgatcctctggatcagtcaagctgttctcgacttctggttcctttgctggacggaaccgagtgtggcgtcgaaaagtggtgttcgaagggacggtgtagatcgctggtcgagctcactccgatcgccgcggtgcatgggcggtggagctcctggggacctcgatctccatgttccagatcgtgcgggggtggagtggtgacccgacgcaggcaatgtaacaatccccgcccagcatttggtgggagagcctgcgtgggggcagatcttcaggcagaaatgtgcaacactcaggcttgtgaaaagacgcaactcgagtttatgtcccagcaatgcgcccgcacggatggtcagcctttgcgctcaagtcctgggggcgccagcttttaccattggggtgctgcagtgccacattcacagggagatgcactgtgtcggcatatgtgcagggctatcggagaatcgtttatcatgaaaagaggcgattccttcttggatggaaccagatgcatgcccagtggacctcgggaggacggaactctttcgctgtgcgtgtcaggatcgtgcaggactttcggttgcgacggccgcatggactcccaacaggtgtgggacagatgccaagtctgtggcggagataactcaacctgttcccctcgcaaggggtcgtttactgctggacgggcgagagaatacgtgactttcctgactgtcacccctaacctgacttcggtgtacattgcgaaccacagacctctttttacccatctggccgtccgtattggaggccggtacgtcgtggcaggaaaaatgtccatttcccctaacaccacctacccttcactgctggaggacggacgcgtcgaatacagagtggcgctgactgaagatcgtctcccgcgacttgaagaaatccgcatttgggggcctttgcaggaggacgccgatatccaggtgtacagaagatatggggaggaatacggaaatcttacgcggcctgatatcacttttacttacttccaacccaagccacgccaagcatgggtgtgggcagcagtgcgtggcccctgctcagtgtcctgcggtgcgggactgcgctgggtgaattactcctgtctggatcaggcgcgaaaggagctggtggagactgtgcagtgtcagggatcccagcagccaccagcttggcccgaagcgtgtgtccttgaaccttgccccccgtactgggcagtgggtgactttgggccgtgttcggcaagctgtggtgggggactccgggaacgccctgtgagatgtgtggaagcccagggctcgctgctcaaaaccctcccacccgcaagatgcagagcgggagcacaacagcccgcggtcgctctggaaacctgtaatccacagccctgccctgcacggtgggaagtgtccgagccatcgagctgtactagcgccggaggtgcaggattggcactggagaacgagacttgcgtccctggtgcagacggtcttgaggcacctgtgactgagggtccaggatccgtggacgaaaagctgccagctccagaaccttgtgtcggaatgtcctgtccgccagggtgggggcatctggatgctacttcggcaggtgaaaaggcaccatccccgtggggtagcattagaactggagcacaagccgcccacgtgtggacccctgcagcaggatcgtgttcggtgagctgtggacgcggtctgatggaacttagatttctgtgtatggattcggcactcagggttcctgtgcaagaagaactttgtggcttggcatccaaacctggctcccgacgcgaagtgtgtcaggcagtgccctgtcctgccagatggcagtacaagctggctgcctgctctgtgtcctgtggtaggggagtcgtgcggagaatcctctactgcgcaagggcccacggggaagatgacggagaagaaattctgctggatacccaatgtcaaggccttcctcggcccgaaccccaagaggcctgctccctcgagccttgtcctcctaggtggaaagtgatgtccctcggcccttgttctgcatcctgtggacttggaacggcaaggagatccgtggcgtgtgtgcagctcgaccagggtcaggatgtcgaagtggatgaagctgcatgtgcggcacttgtgcggccagaagcctcagtgccttgtcttattgccgactgcacttaccggtggcatgtgggaacttggatggaatgctcggtcagctgcggagacggcatccaacgtcggcgggatacttgcctgggcccacaagcgcaagcacccgtgcctgccgatttttgtcagcatctgccaaagcctgtgactgtcaggggttgctgggcaggaccttgtgtaggccagggaaccccttctctcgtccctcatgaagaagcggcagcaccaggaaggaccaccgccactccagctggtgcttcgctggaatggtcccaagcgcggggacttctgttttcccccgccccacaaccgagacggcttctccctggcccccaagagaacagcgtgcagagctcggcatgcggccggcaacatctcgagccaaccggtactatcgatatgagggggcctggccaagccgattgtgcggtggccatcggtagaccactgggtgaagtcgtcacgcttagagtgcttgagagctcccttaattgttccgcaggagatatgcttttgctttggggtcgactgacttggagaaaaatgtgcaggaagctgttggacatgactttctcctcaaagactaataccctggtggtgcgacaaagatgtgggaggccgggtggtggtgtgctgttgcgttacggtagccagcttgcacctgaaaccttttacagggaatgcgatatgcagctgtttggaccctggggagaaatcgtgagcccttcactctcacccgcaacttcgaacgccgggggttgtcgcctcttcattaatgtcgctcctcacgcaaggatcgcgatacacgcacttgctaccaatatgggggctggaaccgagggagcaaacgcatcgtacattctgattcgggatactcattcacttaggacgactgcatttcacgggcaacaggtgctttactgggaatcggaaagcagccaagctgagatggaattttccgaaggttttcttaaggcccaggcatcccttcgaggacaatactggaccctccagtcgtgggtgcctgagatgcaggatccccagtcctggaagggtaaggaaggtacc

SEQ ID NO: 5630 - DNA, 4281 bp, Artificial Sequence
  Description of Artificial Sequence: Synthetic coding sequence
atgcaccagaggcatccaagagcccggtgtccacccttgtgcgtggctggaatcctcgcctgcgggtttctcctggggtgttggggaccctctcatttccagcagtcatgtttacaggccctcgaaccacaggcagtatcatcttacctctctcccggggcacccctgaaagggagacccccctctccaggattccagagacagcgccagcgccagcggagggctgctggagggatcctgcacctggaactgctggtcgctgtcggacctgatgtgtttcaggctcaccaggaggatacagaacggtatgtactcactaacctcaatataggagccgaactgctcagggatccctctcttggagcacagtttcgagtccatctcgtaaaaatggtcatcctcactgaacctgaaggagcccctaatatcacagctaacctgacatcttctctcctcagtgtatgtggatggtctcaaacgataaacccagaagatgatacagatcccgggcacgcagatcttgtgctatatataactcgattcgatctggaactccctgatgggaatcggcaggtcagaggggtgacacagctaggaggagcatgttctcccacatggtcttgtctcataactgaagatactgggttcgatctgggagtgactatcgcccacgaaatcggacactcattcgggctcgaacatgatggagcccctggatccggatgcggaccatcaggacacgtgatggcttccgatggagctgcaccccgggcagggctggcctggtcaccttgttcacgacggcagctactctctttgctctcagccggaagagccaggtgtgtgtgggatccccctagaccccagcccggatctgcaggacacccccctgatgcccagccagggttatattattccgcaaatgaacagtgccgagtagcgtttggacccaaggccgtcgcatgtacattcgcaagggaacatctggatatgtgccaggctctgtcatgtcatacagacccactagaccaatctagttgttctcgtctgctagtccctctgctcgatgggactgaatgtggagttgagaaatggtgttccaaggggcggtgccgatcattagttgaactcacaccaatcgcagctgtgcacgggcgctggtcttcttggggaccccggtctccctgttcccgcagttgcgggggaggggtggtaactagacggcgacaatgcaacaatcctcggcccgcttttggaggaagagcttgtgtgggagcagatctccaggccgaaatgtgtaacacacaggcttgcgaaaagacacaactagaattcatgtcgcaacagtgtgctagaactgatgggcagcctctgcggtcttctccaggaggagctagtttctatcactggggagcagccgtcccacactctcagggagatgctctctgccgtcacatgtgtagggcaataggggaatcctttataatgaaacgtggggattcattcctcgatggaacacggtgcatgccatctggacctcgcgaagatgggactctatccctctgtgtctccgggtcttgtagaacttttggatgtgatggaagaatggattctcagcaagtctgggataggtgtcaggtgtgtggaggagataactctacttgctctccgcgcaaagggtccttcacagcaggacgcgcacgggagtatgttacatttctcactgtgacacctaacctcacttctgtttatattgctaaccataggcccttattcacacatctagccgttcggatcggagggcgttatgtcgtagcagggaaaatgagtatctcccccaatacaacttatccatcgcttctagaggatggacgggtggagtacagggtggctctcactgaagaccgcctcccacgactagaagaaattagaatttgggggcctcttcaggaagatgccgatatccaggtgtatcggcgatacggggaagagtatggaaatctgacacggcccgatattacatttacttacttccagccaaagccccggcaggcctgggtgtgggctgcagtcagagggccctgttccgtctcatgtggggcaggactgaggtgggtaaactactcctgtctcgatcaggccagaaaagaacttgtcgaaacagtacagtgccagggatctcagcagccacccgcatggcctgaagcttgcgtgcttgaaccatgcccaccttattgggcagtaggagattttggaccttgttcagcctcctgcggaggggggctgagggaacggcctgttcgctgcgtcgaagcgcagggatccctactgaaaacgctcccccccgcaaggtgccgggcaggggcacaacagcccgccgtagcccttgaaacttgcaacccccagccctgtcccgctcggtgggaagtttcagaaccctcatcatgcacaagtgcagggggggctgggctggctttagaaaacgaaacatgtgttccgggagctgatgggctcgaagctcccgtcactgaaggacccgggtctgtcgatgaaaaacttccagctcccgaaccttgtgtagggatgagttgcccacctggatgggggcacttggatgcaacatctgccggagagaaagcaccctctccctgggggtctataagaactggggctcaggctgcacacgtatggactcccgcagcagggtcatgctccgtatcatgtgggaggggactcatggaattacgctttctatgtatggatagtgctttaagggtccctgtacaggaagaactttgtggactcgcctcaaaaccaggatcaaggcgggaagtctgtcaggcagttccatgccccgctaggtggcagtataaattagcagcctgttctgtgtcatgcgggcgaggggtcgttcgccgaatcctctactgtgctagagctcatggagaggatgatggggaagaaatccttctcgatacacagtgtcagggactgcctcgaccagaaccccaggaagcctgttctcttgaaccctgtccccctcgctggaaagtcatgtcactcggaccatgctccgcctcttgtggactggggactgcgagaagatccgtggcctgtgtgcagctcgatcaggggcaggatgttgaggtagacgaggctgcctgtgccgcactggtgagaccagaagccagtgtgccatgtctcatagctgattgcacatatcggtggcatgtaggaacatggatggagtgcagtgtttcctgcggggatgggatacaacggcgcagggacacttgtctaggaccacaggcccaggcacccgttcctgcggatttctgccagcacctaccaaagccagttacagtgagggggtgctgggcaggaccttgcgtagggcagggaacaccaagtctcgtacctcacgaagaagccgccgctcccggacggactactgccactccggctggagcatctctcgaatggtctcaggcgagaggactgcttttttctccagcaccccagccacgaaggctcctgccaggacctcaagaaaattccgtccagtcttcagcttgcggaaggcagcatctcgaacccacagggacaatagatatgagggggccaggacaggctgattgtgccgtggcaatcgggcgcccactgggagaagtcgtgacactgcgggtactggaatcttctcttaattgttccgccggagatatgctgcttctatggggaagactaacatggcgcaagatgtgtagaaagctacttgatatgacgttttcctcaaaaactaacacattagtagttaggcaacgctgcgggagaccagggggaggagtcctgctgaggtatgggagtcagctcgcacccgaaacattctacagggaatgcgatatgcaactttttggaccatggggggaaatcgtttccccatcgcttagtcctgccacatccaacgcgggaggatgtcgcctgttcataaacgtcgctccacatgcaaggatcgccatccacgctttggctacaaacatgggagccgggacagagggggcaaacgcctcctatatattgatacgagacacacactctctgcggacaacagcctttcatgggcagcaggtactctattgggaatctgaatcttctcaggccgaaatggaattttccgaggggtttctgaaagctcaggcttctctccgggggcagtattggacactccagtcctgggtccccgaaatgcaggatcctcagagttggaagggaaaagaaggaact

SEQ ID NO: 5631 - DNA, 4281 bp, Artificial Sequence
  Description of Artificial Sequence: Synthetic coding sequence
atgcatcaacgccacccccgggcgcgatgcccacctctgtgcgttgcgggtatcctggcgtgcgggttcctgttgggttgttggggcccgagccattttcaacaatcctgtctgcaggccctcgagccgcaggcagtgagcagctacttgtcacctggcgcaccactgaaaggtcgccctccgagcccaggctttcagaggcagcgccagcggcagcgtcgcgccgccggcggcattctgcatctggaattgctggtcgctgtgggtccggacgtgttccaagcacaccaagaggataccgaaagatacgtcctgaccaatttaaacataggtgccgagttattgcgggaccctagccttggcgcgcaattccgtgtccacctggttaaaatggtcattctgactgagcctgagggcgcgcctaatatcacggccaatctcactagcagtctgctctctgtctgcggttggagccagacaatcaatccagaagacgacacagatccgggccacgccgatctcgttctgtacattacgcgcttcgacctggaattgccagatgggaatcgccaggtgcgcggtgtaacgcagctgggtggagcctgcagccctacgtggagctgcctcattaccgaggatactggttttgatctcggagttaccatcgcgcacgaaatcggacacagcttcggcttagaacatgatggcgcaccggggtccgggtgtggtccatccggtcacgttatggcgtccgatggtgccgctccaagagctggtctggcttggagcccgtgttcccgtcgacagctgctgtcattattgagtgcaggccgcgcgcgatgcgtgtgggacccgccacgcccacaacctggctccgcgggccaccctccggacgcgcagcctggcctgtactactccgcgaacgaacagtgtcgagtggcattcggcccgaaggcagtagcgtgcaccttcgctcgcgaacacttggacatgtgccaagcattgagctgccatactgacccgttggatcagagctcatgctcccgcctgctcgtgccgctgctcgatggtacggagtgtggggtcgaaaaatggtgtagcaagggtagatgccggagcctggtggagctgacaccgatcgcagcagtgcacggtaggtggtcctcctggggtccacgcagtccgtgctctaggagctgcggtggtggagtcgtgacccgccgacgccagtgtaacaacccgcggccagcatttggtggtagggcgtgcgtcggagcagacctgcaggcagagatgtgcaatacgcaggcgtgcgaaaagacccagctggaattcatgagccagcagtgtgcccgaactgacggccagccgctacgcagctcgccgggaggcgcgtccttttatcactggggtgcggcagtgcctcatagccagggagacgccctgtgtcgccacatgtgccgcgccattggtgaatcttttataatgaaacgcggcgactcatttctggacggtacccggtgcatgccatccggtccacgtgaagacggtacgttgagcctgtgtgtgagcggttcctgccgtacgttcggctgcgacggtcgcatggattctcagcaagtgtgggacagatgccaagtttgcggtggtgacaatagcacttgtagtcctcgcaaaggctcattcaccgcgggccgcgcccgcgagtacgtgacctttttgactgtgactccaaatttgacctctgtgtacatcgcaaaccataggccgctgttcacccacctcgcagttcgcataggtggtcgttacgtggtcgctggtaagatgtcgatctcccccaacaccacgtatccttcgctgcttgaagatggacgtgtcgaataccgcgtggcgctgactgaggatcggctacctcgtcttgaggaaattcgcatctggggaccccttcaggaagatgcggacattcaggtttatcgccgctacggcgaagagtatggcaacctgacccgcccagacattacttttacatactttcagcctaagccgcgacaggcctgggtttgggccgcagtgcgcgggccgtgcagcgtgtcctgtggagcgggtctcagatgggttaattacagctgcctggatcaagcgcgcaaagagctggtagagacggttcaatgccagggttctcaacagcctcctgcttggccggaggcttgcgttttggagccgtgccctccgtattgggctgttggtgacttcggcccgtgtagcgctagctgtggcgggggcctccgagagcgccctgttcggtgtgtcgaggcccagggaagccttctgaagacgctcccgccggcacgttgcagagcgggtgcccagcagcctgcagttgcactggagacatgtaatccacaaccttgcccagcacggtgggaggtctcggaaccatcttcctgtactagcgcaggtggtgcggggttggcgctggagaacgaaacttgtgtgccaggagcagatggcctggaggctccggtgaccgagggccccggtagcgttgacgagaaactgccagcgcccgaaccgtgtgtcggtatgagctgccccccggggtggggacacctggatgccaccagcgcgggcgagaaagctccgtcgccttggggcagcatccgaacgggcgcgcaagcagcccacgtgtggacgccggctgcgggttcctgcagcgtgagctgtggacgcggtctgatggagcttcgctttctctgtatggattcggctctgcgagtccccgttcaggaagagctgtgcggtctggcctccaagccaggctcgcgtcgggaggtgtgtcaagcggtgccgtgcccggcccgttggcagtacaaactggcagcgtgctctgtgagctgcggccgcggggtggttaggcgcatcctgtattgtgccagggctcatggggaagatgacggagaagaaatcttactcgatacccagtgccagggtttgccgcgcccagaaccgcaggaggcgtgttcactggagccatgcccgccgcgatggaaggtgatgagcctgggtccctgcagcgcctcgtgtggactcggtacggcgcgcagatctgttgcctgcgtgcagctggaccaaggtcaagatgttgaggtcgatgaggccgcctgtgctgccttggtgaggcctgaggcctctgtgccgtgtttgatcgcagactgcacctatcgctggcacgtcgggacctggatggaatgctctgtgagctgcggtgatggaattcaacgccgccgtgatacctgcctgggaccgcaagcacaagcaccagtgccggccgacttttgtcaacacttgcctaagcccgttaccgttaggggctgctgggccggtccttgcgtgggccaaggtaccccatctctggtgccacatgaagaggcggcagcacctgggcgcacgactgccaccccggctggcgcgtctctggaatggagccaagcacgtggactgctgtttagcccagctccccaacctcgtcgtctgctgccaggccctcaagaaaatagcgtgcagagctcagcgtgtggccgccagcacctggagccgaccggtacaatcgatatgagaggtccaggtcaagcggactgtgcagttgcgattggtcgtccgttaggggaagttgttaccctcagagtcctggaatcaagcctgaactgcagcgctggtgacatgctcctgctatggggccgcctgacctggcggaagatgtgccgtaaactgctggatatgacctttagtagcaaaacaaacaccttagtggttcgccagcgttgtgggcggccaggaggcggggttttgctccgctatggttcgcagttggcaccggagactttctatcgtgagtgtgacatgcaactgtttggcccatggggcgagatagtcagcccgtctctcagccctgcaacctccaacgcgggcgggtgccgcctgttcattaatgtggccccgcacgccaggattgcgattcatgcactggcaacaaatatgggcgcaggtactgaaggtgcgaatgcttcatatatccttatccgcgacacccacagcctgcgtacaacggcgttccacggtcagcaggtgctgtactgggaaagtgagagctcacaggcagaaatggagtttagcgagggatttttgaaggcgcaggcgagcctgcgtggccagtactggacgctgcagtcctgggttccagagatgcaggaccctcaaagctggaaaggcaaagagggtacg

SEQ ID NO: 5632 - DNA, 4281 bp, Artificial Sequence
  Description of Artificial Sequence: Synthetic coding sequence
atgcatcaacgccacccgagggcgagatgccctccgctgtgcgtcgctggcattctggcatgtggcttcttgctcgggtgttggggcccgtcgcattttcagcaatcatgtctccaggcactggagccacaagcagtgagcagctacttgagcccaggagcgcctctgaagggtcgcccgccgtcccctggctttcagcgacagcgccagaggcaaagacgcgccgccggcggtatcctccatttggagcttctggtggctgtgggacctgatgtctttcaggcccaccaagaggacaccgagaggtacgtgctgaccaacctgaatatcggtgcggagctcctccgggacccgtccctcggtgcgcaatttagagttcacctggtgaagatggtgatcctgaccgaaccggaaggagcaccaaacataaccgccaacctgacctcttcgctgctctcggtgtgcggatggtcccagaccatcaacccggaggacgacactgacccgggacatgcggacctggtgctgtacattacccggttcgacctcgagctcccggacggaaatagacaggtgagaggagttacgcaactgggaggagcctgctccccgacctggagctgcctgatcaccgaggacaccggattcgacctgggagtgaccatcgcccatgagattggtcattcgtttggactcgaacacgatggagccccgggatcgggctgtggaccctcaggacatgtgatggcttcagacggagccgccccaagagcgggacttgcctggtccccgtgttcacggagacagctgctcagcctcctctcagcaggacgggcgcgctgcgtgtgggacccacctcgcccgcagccagggtccgccggacatccgcctgacgctcaaccgggactctactactccgcaaacgaacaatgtcgcgtggctttcggaccgaaggctgtggcgtgtactttcgcacgcgaacaccttgatatgtgccaagccctctcgtgccacactgacccgctggaccaaagctcatgctcccggttgctggtgcccctgctggatggaactgaatgtggagttgaaaagtggtgctccaaaggacgctgccgcagcctggtggagctgaccccgattgccgccgtgcacggacgctggtcatcctggggaccacgctcaccgtgctctcgcagctgtggcggaggagtggtgactcgcagacgccaatgcaacaatccccgcccggcctttggcggtcgcgcctgcgtgggcgccgatctgcaagctgaaatgtgcaacacgcaggcatgcgaaaagacgcagttggagttcatgtcgcagcaatgcgcccgcaccgacggacagccgctcagatcctccccgggaggagcgtccttctaccactggggggccgccgtgccgcactcccagggagatgcgctttgtcgccatatgtgccgggctatcggcgagtccttcatcatgaagcggggagattcgttcctggacggtaccagatgcatgccgagcggaccacgggaagatggcactctgagcctgtgcgtgtcgggctcttgccgcacgttcggatgcgacggaagaatggactcccagcaagtgtgggacagatgtcaggtctgtggaggtgacaattccacttgctccccgcgcaagggctccttcaccgctggacgcgctcgcgagtacgtcaccttcttgaccgtgaccccgaaccttacctcagtctacatcgccaatcacaggcctctgttcacgcatctggccgtccgaatcggaggtaggtacgtggtggcaggcaagatgtccatctcaccgaacacgacctacccatcgctcctggaagacggccgcgtggagtaccgtgtggcattgactgaggatagactgccgcggctggaagaaattcggatctgggggccgctgcaagaagacgcagacatccaggtgtaccgccggtacggagaagaatacggcaatctgactcggcccgacatcacgttcacctactttcaaccgaaacctcgacaagcatgggtttgggccgcggtgcgcggaccgtgctcggtgagctgcggggccgggctgcgctgggtgaactattcctgccttgaccaagctcgaaaggaactcgtggagactgtgcagtgccaaggatctcagcaaccaccggcctggcccgaggcgtgtgtcctggagccgtgcccgccgtactgggccgtgggggacttcggaccatgctcagcgagttgcggcgggggcttgcgggaacggcccgtgcggtgcgtagaagctcagggttccctcctgaagacccttcctccggcgaggtgcagagccggagcccagcaacctgctgtggctctggagacttgcaacccacagccgtgtcctgctagatgggaagtctcagaaccgtcgtcctgcaccagcgcaggaggggccggcctcgctctggagaatgagacttgcgtcccgggagcagacggactggaggccccggtcacggaaggcccggggtcggtggatgaaaagctgccggcacctgagccatgcgtgggcatgtcatgtcctccaggatggggacatctggatgcgacctcagcaggtgagaaagcgccatcgccatggggtagtatcagaactggagctcaagccgctcacgtctggaccccagccgccggtagctgctcagtctcgtgcggccggggactgatggaactgcggttcctgtgtatggattcggcactcagagtgcccgttcaggaagaactttgcggactcgcctcgaagcccgggtcacgcagagaagtctgccaggcagtgccatgccccgcgcgctggcaatacaagctggctgcctgttcagtgtcgtgcggacgcggtgttgtccgacggatcctgtactgcgcaagagcccacggagaagacgacggagaagaaatcctgttggacacccagtgtcagggactgcccaggcctgagccgcaggaagcatgctccctcgagccgtgccctccgaggtggaaggtgatgagcctgggcccgtgtagcgccagctgtggccttggaactgctcggcggtccgtcgcatgcgtccagcttgaccaggggcaagacgtcgaagtggacgaagccgcgtgtgcagcacttgtgcggcctgaggctagcgtcccttgcctgatcgctgactgcacgtaccgctggcacgtgggaacctggatggagtgctcggtgtcctgcggagacggaatccagcggaggagagatacctgcctcggaccgcaagcacaagccccggtcccggccgacttctgccagcaccttccgaagcccgtgactgtgcgcggatgctgggcgggcccgtgcgttggacagggaacgccatcactggtgccccacgaggaagcagcggcaccaggaaggaccactgcaactccagctggcgcgagcctggaatggtcccaggcccgggggctgctgttctcgcctgccccccaaccgcgccgattgctgccgggtccgcaagagaactcagtccagagctcggcttgcggtcggcagcatctggaaccgaccggcacgatcgatatgcgcgggccagggcaagcggactgtgcggtggccattggtcggcctcttggagaagtggtcactctccgcgtgctggagtcctccctcaactgctcagcaggagacatgctgctgctctggggtcggttgacctggaggaagatgtgccgcaaattgctggacatgaccttctcctcaaaaaccaacactctggtcgtcagacaacggtgcggacgcccgggaggaggagtgctcctgcggtatgggtcgcagctggcaccggaaaccttctatcgcgaatgcgacatgcagctgtttggcccttggggagagatcgtgagcccgagcctgtcacctgcaacctccaacgccggcggttgcagactgttcatcaacgttgctccgcatgcccgcatcgctattcacgcactcgctactaacatgggagctggcaccgaaggagcgaacgcgtcatacatcctcatcagagatactcacagtcttcggaccaccgcgttccacggccagcaggtgctgtactgggaatctgagtcctcacaagcggagatggaattctcggaaggattccttaaggcacaggcttccttgcggggccagtactggaccctgcaatcctgggtgccggaaatgcaagacccgcaatcgtggaagggaaaagagggaacc

SEQ ID NO: 5633 - DNA, 4281 bp, Artificial Sequence
  Description of Artificial Sequence: Synthetic coding sequence
atgcaccagaggcacccgcgggctcgctgcccgcctctgtgtgtggcaggaatcctcgcctgcggatttctgctgggatgttggggtccgtctcatttccagcaatcatgcctccaggcattggagcctcaggcagtgtccagctatctctcaccgggagctcctctgaaggggcggccaccgtcaccgggttttcaacgccagagacagaggcaacggcgggccgctggaggaatacttcatctggaactgctggtggctgtcgggcctgacgtgttccaggcgcatcaggaagatactgagcgatacgtgctgaccaacctcaacataggagcagagctcttgagggaccctagcctgggagcacaatttcgggtccacctggtcaagatggtcatcctgactgagcccgagggagccccgaacatcaccgccaacctgacttcatcgctgctgtcggtttgtggttggtcccagacgatcaaccctgaggacgataccgaccctggtcatgctgacctggtcctctacattactcggttcgaccttgagctgccggacggcaatcgccaagtgaggggtgtgacccagctgggaggagcgtgctctccgacttggtcgtgtttgatcaccgaagatactgggttcgacctcggagtgactatcgcgcatgagatcggacactccttcggcttggagcacgacggcgctcccggctccggatgcggaccttcgggtcacgtgatggcaagcgacggagcggcgccgcgcgctggcctcgcctggtcgccctgctcgagacgtcagctcctttcactcctgtccgcaggaagagcccgttgcgtgtgggacccgccgaggccacaaccggggtcagctggacacccaccagatgcgcaacctggactgtactattcagcgaacgaacagtgccgggtggccttcggaccaaaggcagtggcttgcacctttgcccgcgagcatctcgatatgtgccaagccctctcttgtcataccgatccgctggaccagtctagctgttcgcgcctgctcgtgccgctgctggatggaactgaatgtggggtggaaaagtggtgctccaaagggcgctgcaggtccctggtggaactgaccccaattgccgccgtgcacgggagatggtcaagctggggcccgagatcaccatgttccaggtcctgcggtggaggcgtggttacccgccggcgacagtgcaacaaccccagaccggcgtttggagggcgcgcttgtgtcggagccgacctgcaagctgaaatgtgtaacacccaggcgtgcgaaaagactcagctggagttcatgagccaacagtgtgcccggaccgacggacagccgctccgatcctcaccggggggtgcctccttctatcactggggagcggcagtgccacactcccaaggcgatgccctctgtagacatatgtgccgcgccatcggagaatcgtttatcatgaaaagaggggactccttcctggacggcacgcgctgcatgccgtccggaccgcgcgaggacggcaccctctcgctgtgcgtgtccggttcctgtagaaccttcggatgtgatgggcggatggactcccaacaggtgtgggaccggtgccaagtctgcggtggggataactcgacctgcagcccccgcaaaggatcattcaccgccgggagagctagggaatacgtcactttcctcaccgtgacccctaacctgacctcggtgtacatcgcgaaccacagaccgctgttcactcacctcgcagtccgcattggtggacggtatgtggtcgccggaaaaatgtcgatttccccgaacactacttatccttcgctgctcgaggacggaagagtggaataccgggtcgcgctgaccgaagatcggctccctagactggaagaaatccgcatctggggaccactccaagaggatgccgatatccaggtgtaccggaggtacggagaggaatacgggaacctgactagacctgacattaccttcacttactttcaacccaaacctagacaggcttgggtctgggccgccgtgcgcgggccctgctcagtgtcttgcggagctggactgagatgggtgaactattcctgcctggatcaagcccgaaaggaactggtggaaactgtgcagtgccagggatcgcaacagccgccggcgtggcctgaggcatgcgtgctggagccgtgtcctccttactgggccgtcggggactttgggccgtgttcggcttcgtgtggtggagggctgcgggaacgcccggtcagatgtgtcgaggcccagggcagcctgctgaaaaccctgccgcccgcgcggtgccgggccggagcacagcaaccagccgtcgccctggagacttgcaacccgcaaccttgtccggcaagatgggaagtctccgagccttcgtcctgcacgtccgcgggtggcgccggcttggctctggaaaatgaaacttgcgtgccgggagccgacgggctggaggccccagtgaccgaaggtcctggctccgtggacgaaaaactgcccgcgcctgaaccttgcgtcggaatgtcatgtccgccggggtggggacatcttgatgctacctcggccggcgagaaagcaccgtcgccatggggaagcattcggaccggcgctcaggcagcccacgtgtggactccggcagcggggagctgctcggtgtcatgtggacggggactcatggaacttcgcttcctctgcatggactcggcgctccgggtgccagttcaggaggaactttgcggactggcctcaaagccgggctctcgccgggaagtgtgtcaggccgtgccttgcccggcacggtggcagtacaaactggccgcttgcagcgtctcgtgcggaaggggagtggttcggaggatcctgtactgtgcacgcgcccatggggaggatgatggcgaagaaatcctgttggacacccagtgtcagggtttgccgcgccctgaaccccaggaagcatgctccctcgagccgtgcccgcctcgctggaaagtgatgtctctgggaccatgctcggcaagttgtggtctgggtactgcgaggcggtcggtggcatgcgtccaactggatcagggacaggatgtggaagtggacgaagccgcctgtgctgctctggtcaggcctgaggcttccgtcccatgcttgatcgccgactgcacctaccgctggcatgtgggaacttggatggaatgctccgtgagctgtggtgatgggatccaacgccggcgcgacacctgtctggggccgcaggcgcaggccccagtgccggcagatttctgtcagcacctgcctaaaccggtgactgtccggggatgctgggccggaccgtgcgtgggccagggcacgccaagcctggtcccgcacgaagaggccgcagcgccagggcgcactactgccactcccgcaggagcctcactcgaatggagccaggcgcggggactcctcttctcaccagcgcctcagccccgcagacttcttccgggtccgcaagagaactcagtgcagagcagcgcatgcgggcgtcagcacctggaaccgactggaaccattgacatgagaggaccgggacaggcggactgcgctgtcgccattggccgcccattgggggaggttgtcactctcagggtccttgaaagctcgctcaactgttcggctggggacatgcttctcctgtggggtcgcctgacttggcgtaagatgtgccgaaagctcctcgacatgacttttagtagcaagaccaacacccttgtggtccgccagagatgcggaaggcccggcggaggcgtgctgctgcggtacggatcacagcttgctccagagactttttaccgcgagtgcgacatgcagctcttcggaccgtggggtgaaatcgtgtcgccgtccttgtccccggccacttcgaatgccggaggttgccgcctgttcattaatgtggcaccacatgcgcgcatcgccatccacgctcttgcaacgaatatgggagcaggaactgaaggagcgaacgcgtcatacatcctgatccgggatacgcattcccttcgcaccaccgctttccatggacagcaagtgctgtactgggaatcggagtcgtcccaagccgaaatggaattcagcgagggattcctcaaggcgcaggccagcctccggggacaatactggaccctgcagagctgggtccctgagatgcaagatccacaatcgtggaagggaaaggagggcact

SEQ ID NO: 5634 - DNA, 4281 bp, Artificial Sequence
  Description of Artificial Sequence: Synthetic coding sequence
atgcatcagaggcatcccagagctaggtgcccacccctgtgtgtcgctgggatcctggcatgcgggtttttacttgggtgctggggaccctctcactttcagcagagttgtctgcaggcactggagccccaagccgttagtagctacctgtcaccgggagcgcccctgaagggtcgacctccaagccccggttttcaacgtcagagacagaggcagagaagagctgctggtgggatcttgcacctggagttgctagtggccgtgggtccagacgtgtttcaggcccaccaggaggatactgagagatatgtcttgactaacctgaacattggcgccgaactgctccgagatccctccctgggggcccaattcagagtacacttggtaaagatggtaatacttactgagcctgagggggcgcccaacatcacagccaacctgacttccagcctgctgagtgtttgcgggtggtcccagaccattaaccctgaggatgacaccgatcctggtcacgcggacctggtcctgtacatcacccgatttgacttggagttaccagatgggaatcggcaagtccgaggggtgacacagttgggtggggcctgctcccccacctggtcctgcctgatcaccgaggacacgggctttgacctgggcgtgaccattgctcatgaaattggacactcttttgggctcgaacatgatggggctcctgggtcaggctgcgggccgtctggacatgtgatggcgtctgatggcgctgccccccgtgcaggcctcgcttggagcccgtgcagcagaaggcagcttctgtcactgctgagcgccggacgtgctcggtgtgtgtgggacccccctaggcctcagcccggctctgccggccatccacccgacgctcaacccggactgtactatagcgcaaacgagcagtgtcgtgtggccttcggaccaaaggctgttgcctgtactttcgcaagagaacatctggacatgtgccaggccctcagctgtcataccgaccctttggatcagtctagctgtagcaggcttcttgttccccttttagatggcaccgaatgtggcgtggaaaaatggtgcagcaaaggccggtgccgctccctggtcgagctgacaccaatcgctgccgtgcacggtagatggtcttcctggggtccccgctccccttgctccaggtcctgcggagggggcgtggttacgcgcagacgtcagtgtaacaatccgcgacccgcctttggcggaagggcctgcgtgggggccgacctccaagcagaaatgtgcaacacccaggcttgtgagaagacacagctggagtttatgtcccagcaatgtgctagaactgacggacagcccctacgttcctcacctgggggcgcgtctttttaccactggggcgccgcagtccctcactcccaaggcgatgctctgtgtaggcatatgtgtagagcgatcggggaaagttttattatgaagcgaggggactcattcctggatggcacccgttgtatgccgtccggacctcgcgaggacgggaccctgtctctttgcgtgtccggatcttgccgaacgtttggttgcgatggaagaatggacagccagcaggtgtgggaccggtgccaggtctgcgggggcgataactccacatgctctcctagaaaagggtcttttaccgcgggtcgcgcgcgggagtacgttacgtttctaactgtcactcctaaccttacatccgtctacattgccaatcatcggcccctgttcacacacctcgctgtccgcataggtggacgctacgtggtggccggcaagatgagcatctctccaaatacaacctaccccagccttttagaggacggaagggtagaatacagagtggcccttaccgaggatagacttccaagactcgaggaaataaggatttggggccctttgcaggaagatgctgacattcaagtgtatagaagatacggagaggaatacgggaacttaacccgacccgacatcacattcacatactttcaacccaaaccccgacaagcttgggtgtgggcagccgtgagaggaccttgctcggtctcatgcggcgcaggcctccgctgggttaactacagctgtctggatcaggcgaggaaggagttagtagagacagtgcagtgccagggtagccaacaacctcccgcatggcctgaggcatgcgtcttagaaccatgtccaccttattgggccgtgggggattttggcccgtgcagcgcctcttgcggcggcggactcagggaaagacccgtgcgatgtgtagaagcccaaggctctcttcttaaaacactgcccccagctagatgccgtgcaggcgcacagcagccggccgttgccctggagacatgtaacccacagccctgccccgctcgctgggaggtgagcgagccttctagttgtacctccgccggcggcgccgggctcgccctggagaacgagacttgcgtacctggagctgacggcctggaggctccggtaactgaggggcctggctctgtggacgagaaactgcctgcccccgaaccctgcgtgggcatgtcttgtcccccgggctggggccacctggacgcaacttccgcgggcgagaaagcacctagcccttgggggagcattcggaccggcgcgcaagcagctcatgtatggacccctgccgcaggctcctgcagcgtctcatgcggacgaggtctaatggaattgagattcctatgcatggacagcgcactgcgggtgcctgtgcaggaagaactgtgtggcctcgcttcaaaacccgggtcgcgccgggaggtctgtcaggcagtcccatgccctgccagatggcagtacaagctggcagcatgctcagtgagttgtggacgcggtgtggtgcggcggatactgtactgtgccagggcccatggagaggatgatggagaagagatcctgctggatacccaatgtcaggggttaccaagaccggaaccgcaggaggcttgctctctcgagccatgtcccccaagatggaaagtcatgagtctcggaccctgttccgcctcttgtggactgggaaccgcacggcgcagtgtggcctgcgtgcaacttgatcagggtcaggacgtggaagtcgacgaggctgcttgcgcagccctcgttcggcctgaagctagcgtgccctgtctgatcgcagattgcacttaccggtggcacgttggcacgtggatggagtgttccgtatcttgcggggacgggatacagcgtcgcagggacacgtgtctcggcccacaagctcaggcaccggtgccggccgacttctgtcagcatcttcctaagccagtgaccgttcgagggtgttgggctggcccatgcgtcggacaggggacccccagcctggttccccacgaagaagctgccgcccctggacgcacaacagcgactccggccggcgcgagcctggagtggtcccaggcacgtggattgctttttagccctgcgccccagccgcgccggctgctccccggtccccaggagaattctgtgcagtctagcgcctgcgggcgtcagcatcttgagcctaccggcactatagacatgagaggccctggacaggcagactgcgccgtcgcaatcgggagaccgcttggtgaggtagtcacgctcagagtgctggagagctctcttaactgttccgcaggcgacatgctgctgctttggggtcgcctcacctggagaaagatgtgtcgaaagctgttagatatgaccttcagcagtaagaccaatactttagtggtccgacagcggtgtggccggccagggggaggtgtgctgcttagatatggatcccagctagcccctgaaacattttatagggagtgcgacatgcagctgtttggcccatggggagagatagtcagcccctccctgagtccagcaacgtcaaacgcgggaggatgtcgactctttatcaacgtggccccccacgcccgcatagcaatccatgcgctggcaactaatatgggtgccggaacggagggggccaacgccagctacatcctcatacgggacacacacagcctccgtacaactgctttccacggacagcaagtcttatattgggagtctgagtcatcccaggcggaaatggagttttccgagggtttccttaaagcacaggcaagcctgcggggtcagtattggacacttcagtcttgggtgcctgaaatgcaagacccacagtcttggaaagggaaagaagggacg

SEQ ID NO: 5635 - DNA, 4281 bp, Artificial Sequence
  Description of Artificial Sequence: Synthetic coding sequence
atgcaccaacggcatccaagagcgcggtgtcctccgctttgcgtggccggaatactcgcctgtggctttcttcttggttgttggggtccatcccatttccagcaatcatgtctgcaggcactggagccacaagcagtgtcatcctatctttcaccgggggcacctcttaaaggtagaccaccctcgcccgggtttcagcgtcagagacagcgacagagaagggcggccggagggatcctgcatctggaacttttggtggcggtcggacctgacgtgttccaagcgcaccaggaggatactgaacgctacgtgctgaccaacctgaacatcggagcagagcttcttagggatcccagcttgggcgcacaatttcgggtgcatctggtgaagatggtgatccttaccgaaccagaaggtgcacccaacattacggcaaaccttaccagctcacttctctccgtctgtggttggtcccagactattaaccctgaagatgatactgatccgggtcatgccgacctcgtcctgtacatcactcgcttcgatctggagcttcctgatggaaacagacaagtgcgcggtgtgacccagcttggtggcgcttgctccccaacctggtcgtgccttataaccgaggacactgggttcgatctcggagtgacgattgcgcatgagattggtcactcctttgggcttgagcatgatggcgctccaggaagcggatgtggaccttcaggacacgtgatggcatcagacggtgcagcgccgagagcaggcttggcatggtccccgtgttcccgtagacagttgctgagccttctttccgcaggtcgagctaggtgcgtgtgggaccctccaagaccgcaacccggatctgcaggacatccccctgatgcacagccaggactgtactactcggcaaatgagcagtgccgcgtggccttcggaccaaaagcagtcgcatgtacttttgcaagagaacatcttgatatgtgtcaggcattgagctgtcatactgaccccttggaccaaagctcatgttcaagactcctcgtccccctgcttgacggaaccgaatgcggagtggaaaaatggtgctccaaaggtcgctgccgctcgctggtcgaactcacccctatcgcagcagtccacgggcgttggtcgtcctggggacctcgcagcccctgttcaagatcctgtggcggaggagtggtcactcgcagacggcaatgcaataaccctcggcctgcgtttggaggtcgcgcatgcgtcggagcggatttgcaagcagaaatgtgtaatacccaagcgtgtgagaaaacccaacttgaattcatgagccagcagtgtgcccgcactgatggacaaccactcaggtcgtcgcccggcggtgcgtcgttttaccactggggagcagcagtgcctcattcccaaggcgacgccctctgccgccatatgtgtcgcgcgataggagagagcttcatcatgaaaagaggtgactcgtttcttgacggtacccgttgcatgccatccggacccagagaagatggaactctgtccctctgtgttagcggatcgtgtagaacctttgggtgtgatggacggatggactcgcagcaagtgtgggacagatgtcaagtgtgtggtggtgataactcaacgtgttcacctaggaagggatcatttaccgcaggccgcgctagagagtacgtcacgtttctgactgtgactcctaaccttacgtccgtgtatatcgccaaccataggcctctctttacccaccttgcagtgagaatcggtggacggtacgtggtggcaggaaagatgagcatttccccaaacaccacttacccatcgctgcttgaagatggacgcgtggagtacagagtggctcttacggaagatcggctcccccgcctggaggaaataaggatttggggaccacttcaagaagatgcagatattcaagtctaccgtaggtatggcgaggaatacggaaatcttacccgacctgatattaccttcacctactttcaaccaaaaccacgccaagcatgggtttgggccgcagtccggggtccctgctccgtctcgtgtggagccggactgcgatgggtgaattactcgtgtctggatcaagccaggaaggaactggtcgagactgtccagtgtcaaggatcccaacagcccccagcatggccggaagcgtgtgtactggagccctgtccaccttactgggcggtgggagattttggcccttgtagcgcaagctgcggcggaggtctgagagagcgacctgtgcgttgcgtggaagcccaaggttcactgcttaagaccctcccccctgctcgatgcagggcaggtgcccagcagccagccgtggcacttgaaacgtgcaacccgcagccatgtccagcgagatgggaagtctctgaaccttcaagctgtaccagcgcggggggagcaggacttgcacttgaaaatgagacttgcgtgccaggtgccgacgggctggaagcacctgtcactgagggacctggatctgtcgacgagaaactgcccgcaccagagccatgtgtgggaatgtcctgtccacccggatggggacacctcgatgcaacctcagctggagagaaagccccaagcccttggggatcgatccgtactggagcacaggcagctcatgtgtggacccccgcagcaggcagctgttcggtcagttgtggtcgcggactgatggaacttcggttcctgtgcatggactccgcccttagagtgccagtccaagaagaactctgcggtctggcctccaagcctggatctaggagagaagtctgtcaagccgttccctgtcctgcaaggtggcagtacaagctggcagcttgttccgtgagttgcgggcgaggtgtcgtgcgcagaattctgtactgtgcaagagcacatggagaggacgatggagaagaaattcttctcgatactcaatgtcagggacttccaagacctgaaccccaagaggcctgtagcctcgaaccctgtcctccccggtggaaggtgatgagcttgggtccttgctccgcctcatgcggactgggaaccgcaagacgctcggtggcatgtgtgcaacttgatcaaggtcaggacgtggaagtggatgaggcagcatgtgcggcacttgtccgccccgaagccagcgtgccttgtcttattgctgactgtacctaccgctggcatgtgggaacttggatggaatgctctgtgtcctgtggagatggaattcagagacgacgtgatacctgtcttggtccacaggcacaagcgcccgtcccggccgacttttgtcagcatcttccaaaacctgtgaccgtgcgtggatgttgggcgggtccttgcgtcggacaaggcaccccttcccttgtgcctcacgaagaagcggcagcacctggtagaactactgcaacgccagcgggcgcaagccttgaatggtcacaggccagagggctgctgttttccccggcacctcaaccaaggagactcctgccgggaccacaagaaaactcggtgcagtcgtcggcgtgtggacgacagcatcttgaacccacggggactattgacatgagaggtcctggacaggcggattgcgccgtggcaattgggcgaccactcggggaagtggtgactcttcgcgtgctggaatcgtccctgaattgttcggccggagatatgctgcttttgtggggaaggcttacctggcggaaaatgtgtagaaagttgctcgatatgaccttcagcagcaagaccaataccctggtcgtgagacaaaggtgtggtaggcctgggggaggcgtgctcctcagatacggttcccagctcgctccagaaaccttttaccgtgaatgtgacatgcaactctttggcccatggggggagatcgtgtcaccttccctgagccctgccacctcaaacgccggagggtgtaggctgttcattaacgttgctccacatgcaaggattgcgattcacgcactcgccaccaacatgggtgccggaactgaaggtgccaacgcgtcttacatcctgatcagggatactcattcgcttcgtaccactgcatttcatggacaacaggtgctgtattgggaatcggaaagttcgcaagcagagatggaattttcagagggatttcttaaagcacaggcttccctgcgcggacagtactggacgctgcaatcgtgggtgcctgaaatgcaggatccacaaagctggaagggaaaagaaggtacc

SEQ ID NO: 5636 - DNA, 4281 bp, Artificial Sequence
  Description of Artificial Sequence: Synthetic coding sequence
atgcatcagcggcatccacgcgcgcggtgtcctcccctctgtgtcgcgggcatccttgcgtgcgggtttttgctggggtgttgggggccctcccattttcagcagagctgcctgcaagcgcttgagccgcaggccgtgtcatcatacctttcaccgggagcccctctgaaaggtcgcccgccatcccctggcttccaaaggcaacggcaacgccagcggcgggctgctggcggcatccttcacctggagctgcttgttgcagtggggccggacgtgtttcaagcccaccaggaagatacggaaagatatgtgctgaccaacctcaacatcggggccgaactgcttcgggaccctagcctcggagcccaattcagagtgcatcttgtgaagatggtgatcctgaccgaacccgagggagcgccaaatatcaccgccaacttgacctcatcccttctgtccgtctgcggatggtcccaaaccatcaacccggaagatgatactgatccaggtcatgctgacctcgtcctctacatcacccgatttgatttggaactgcccgacggaaacagacaggtccgcggcgtcacccaactgggcggagcctgtagtccgacgtggagctgcctgattacggaggacaccgggttcgatctcggagtgaccatcgcgcatgagattggacactcgtttggtctggaacatgacggtgcaccgggatcggggtgcgggccatcagggcacgtgatggcgtcggatggcgcagcccctcgcgccggactcgcctggagtccgtgctcgcggcgacagctcctctccctgctcagcgccggtcgggcccgctgcgtgtgggaccctcctcgaccacagccgggttcggcaggacacccgcctgacgcccaaccgggactgtactactccgcgaatgaacagtgccgtgtggcattcggtccaaaggccgtcgcctgcactttcgcccgtgagcacctcgacatgtgccaggcgctttcctgccacaccgacccactggatcaaagctcgtgctcgaggctgctggtacccctgctggacggaaccgaatgtggagtggagaagtggtgctccaagggtcgatgccggagcttggtcgagctgactcccatcgcggcagtgcacggacggtggtcatcctggggaccaagatccccatgctcgaggtcttgtggcgggggagtggtcactcggcgacggcaatgcaacaacccaagaccggccttcggaggacgggcatgcgtgggagcagatctgcaagccgaaatgtgtaatactcaggcctgcgagaaaactcagctggagtttatgagccagcagtgtgcgcggaccgacggacagcccctgagatcatccccgggaggcgcctcattctaccactggggtgcggccgtgccgcactcgcaaggcgacgcactgtgccggcatatgtgccgagcgatcggagaatctttcatcatgaagcggggtgatagcttcctggatggaaccagatgtatgccgtcggggccgagagaggacggtaccctgtcgctttgtgtgagcggctcatgcagaaccttcggatgcgacggtcgcatggactcacagcaggtgtgggacagatgccaagtgtgcggaggtgacaattcaacctgctcgcctcgcaaggggtcgtttaccgccggccgcgcgcgggaatatgtcactttcctgacggtgacccccaaccttactagcgtctacatcgcaaaccaccgcccacttttcacccacctggccgtccggattggtggacgttacgtggtggcagggaagatgtctatcagcccaaatactacctacccatccctgctggaggatggtcgggtcgaataccgagtggcactgacggaggaccgcctcccccgcttggaggaaatcaggatctggggtccccttcaagaagatgcagatattcaggtgtacagacgctacggagaggagtacggaaatctcacgcgcccggacatcaccttcacctacttccagcctaaaccacggcaggcttgggtgtgggcagccgtccgaggcccgtgcagcgtgtcctgcggagcaggtttgcgctgggtgaactactcgtgccttgaccaagcacgcaaggaactggtggaaactgtccagtgccagggctcgcagcagccacccgcctggccggaagcctgtgtccttgagccctgcccaccttactgggctgtgggcgattttggaccttgctccgcctcctgtggaggaggtctgcgcgaacgcccagtacgctgtgtcgaggctcagggatccctcttgaaaactttgccgccagctaggtgcagggcgggagcccagcaaccagccgtcgcgctggagacttgcaatccccagccttgccctgcccggtgggaagtctcggaaccaagctcttgcacctcagccggcggagcgggcctggcgttggaaaacgagacgtgcgtgccgggcgcggacggactcgaggccccggtcacggaggggcccggttcggtcgacgaaaagctgccggcccctgaaccatgtgtgggcatgtcgtgtccgcctgggtggggccatctggatgccacttcggcgggcgaaaaagcgccgtctccgtgggggtcgatacgcactggagcgcaggccgcccacgtctggactccggctgcgggctcttgctcggtgagctgtggtaggggtctgatggaactccgctttctgtgcatggactcagctctcagagtgcccgtgcaggaggaactctgcggactcgcgtccaaacctggttcccgccgggaagtctgccaggcagtgccttgtcccgcgcggtggcagtacaaactcgcagcttgttccgtgtcatgcgggcggggcgtggtccgtagaatcctctactgcgcacgcgcacacggagaggacgacggcgaagagatcctgctggacacccagtgtcaaggactcccacggccggaaccgcaagaggcatgttccctggaaccgtgtccgccaaggtggaaagtcatgtcgctcggaccgtgcagcgcttcctgcggccttggcactgctcgccgcagcgtcgcgtgcgtgcaactggaccagggtcaagacgtcgaagtggacgaggccgcgtgtgcagccctggtcagaccggaagcgtccgtcccgtgtctgattgcagactgcacttaccgctggcacgtgggaacctggatggagtgctccgtgagctgcggagacggaatccagaggcgccgcgatacttgtctgggccctcaggcgcaagcccctgtccctgccgacttctgtcagcacctcccaaagcctgtcaccgtgcgcggatgctgggccggaccgtgcgtcggccaagggaccccttctctcgtgccgcatgaggaagccgcagcgcccggacggacgaccgccaccccggcgggcgcgtcgctggagtggagccaggcccggggactcctcttctcaccggctccgcaaccaaggcggctgctgcccgggccacaggagaatagcgtgcagagctccgcgtgcgggcggcaacacctcgagcccaccggtactatcgacatgaggggcccaggccaagcggactgcgcagtggctatcggtcgcccactgggggaagtggtcactctcagagtcttggagtcctccctgaattgtagcgccggagatatgttgctcctttgggggagactgacgtggagaaaaatgtgcagaaagttgctggatatgaccttctcgagcaagactaatactctcgtcgtcaggcagcgctgcggacggcccggtggaggagtgctgttgcgctacggatcccaacttgccccggagactttctatagagagtgtgatatgcaactgtttggcccgtggggagagatcgtttccccgtcgctgtccccagcgacttcgaacgcgggcggatgccggctgttcattaacgtggcgccgcatgccaggatcgccatccacgcccttgcgaccaacatgggtgctggcactgaaggcgctaacgcatcgtacatcctcattagagatacccactcgctgcgaaccaccgctttccatggacagcaggtcctttactgggaaagcgagtcgtcgcaggctgagatggagttttcagaggggtttctgaaggctcaagcctccctgagaggtcaatactggactctgcagtcatgggtgccagaaatgcaggacccccaatcctggaagggcaaggaaggaacc

SEQ ID NO: 5637 - DNA, 4281 bp, Artificial Sequence
  Description of Artificial Sequence: Synthetic coding sequence
atgcaccagcgccacccgcgggctcgctgcccgccactgtgtgtcgcgggaatcctggcctgcggcttcctgctcggatgctggggaccaagccatttccagcaatcatgtctgcaagctctggaaccacaagctgtgtcgtcgtacctgtcaccgggggccccgctgaagggacgaccaccgagccctgggtttcagagacagcggcagcgccagcgccgcgccgccggtgggattctccacctcgagctcctggtcgccgtgggccccgacgtctttcaagcgcaccaagaggataccgagagatacgtcttgaccaatctcaacatcggagcggagctgctgcgagatccatctttgggtgcccagttcagagtgcatctggtcaagatggtcattctgacggagcccgagggggcaccgaatatcaccgcgaaccttacctccagcctgctctcagtctgcggctggtcgcagactattaacccggaggacgacaccgacccaggccacgccgatctcgtgctttacatcacgaggttcgatctcgagcttccggacgggaatagacaggtgcgcggcgtgacgcagcttgggggcgcctgctctccgacctggtcttgcctgatcaccgaagatacgggattcgaccttggagtgaccatcgcgcatgagatcggccactccttcgggcttgaacacgacggagcacctgggtcaggatgtggcccgtcaggacatgtcatggcatccgatggagccgcaccaagggccggcctggcctggagcccatgctccagacggcagctgctctcccttctctcagcaggtagagcacgctgcgtgtgggacccgccaagaccgcagccgggaagcgccgggcacccaccagacgcacagcctggactgtactactctgccaacgagcagtgccgggtcgccttcggacctaaggccgtggcgtgcacgttcgcccgcgagcatctggacatgtgtcaagccctgtcctgccacactgacccacttgaccagagctcgtgctcccgccttctggtgccactgctcgacggcaccgagtgcggagtggaaaagtggtgcagcaaaggacgctgcagatcgctggtcgaactgaccccgatcgctgcagttcatggaaggtggagctcatggggaccgcggtcgccttgttcaagatcttgtggaggcggcgtcgttactagacgacggcagtgtaataacccacgacccgcctttggaggacgcgcttgtgttggagcggaccttcaagctgaaatgtgtaatacccaggcttgtgagaaaacgcagctggaattcatgtcacagcagtgtgctcgcaccgatggccagcctctgagatcctccccgggaggcgcttctttttaccactggggagccgcagtgcctcattcccaaggtgacgcgctctgtaggcacatgtgcagagcgatcggtgaatcgttcatcatgaagcgcggggactcgttcctggacgggacccgctgcatgccttcgggaccgcgcgaggacggaactctctccttgtgcgtgtccggatcctgccgcaccttcggatgcgatggacggatggattcccagcaagtgtgggatcggtgccaggtgtgcggcggagataactccacgtgctcccctcgcaaaggatccttcaccgcgggacgcgcgcgggaatacgtgaccttcctgactgtgactccgaatctgacttcggtctacattgctaatcatcgccctctcttcactcatctcgctgtcaggatcggaggccgttacgtggtcgctgggaaaatgtccatctcgcctaacactacctacccaagcctccttgaagatggacgggtcgagtaccgggtcgctctgaccgaggacaggctcccgcgcttggaagagattagaatatggggaccgctgcaggaagatgcggatatccaggtctaccggcgctacggcgaagagtatggaaacctgactcgcccggatatcactttcacgtacttccagcctaagccacgccaggcatgggtgtgggccgcggtccgggggccttgctccgtgagctgcggggcaggactgcggtgggtgaactacagctgtttggaccaggcgcggaaagaacttgtcgaaaccgtgcaatgccaaggatcgcaacaaccgcccgcgtggccggaggcatgcgtccttgaaccttgtcccccttactgggcagtgggagatttcggtccctgttcggcttcctgcggcggaggactgcgcgagcgcccagtgcggtgtgtggaggcccaaggatcgttgctgaaaacgctgccaccggccagatgccgcgcaggggcccagcaaccggccgtggcccttgaaacctgcaatccccagccgtgcccagcgagatgggaagtgagcgaaccctcatcgtgcactagcgcaggaggagcaggcctggctctggagaacgaaacttgtgtgccaggtgcggatggtctggaggcccccgtcaccgaaggacctggctcagtggatgaaaagctgcccgccccggagccctgcgtcggaatgagctgcccgccgggatggggacacctggatgcaaccagcgcgggtgagaaggccccgtccccgtggggctccatccgcactggtgcccaagcggcccacgtgtggaccccagcggcgggaagctgttcggtttcttgcggaagaggcctcatggagctcagattcctgtgcatggactcagccctgcgcgtgcctgtgcaagaagaactgtgcggactggcaagcaaacctggatcgcgccgggaggtgtgccaagccgtcccctgccccgcccgctggcaatacaaactggcggcctgcagcgtgtcctgtggccggggagtggtgcgcaggattctctactgcgcacgcgcccacggtgaggatgatggggaggagatattgcttgacacccaatgccagggactcccccgcccggaaccacaagaagcctgctcgctggagccatgcccgccacggtggaaggtgatgtcgctcggtccatgcagcgcttcatgcggactgggaaccgccaggcgctccgtggcctgcgtgcagctggatcagggacaggacgtggaagtggacgaagccgcttgcgctgccctcgtcaggcccgaagcctccgtgccgtgcctgatcgccgattgtacctaccgctggcacgtgggaacttggatggaatgcagcgtctcatgcggagacggaatccaaaggagacgcgacacctgcctcggcccccaagcacaagcgccagtgccggcggatttctgccaacatttgcctaagccggtgaccgtgaggggttgctgggcgggaccatgcgttggacagggaaccccatcactggtgccgcacgaggaagcagccgcccctggtcggactactgcaactccagcaggcgccagcctggaatggtcgcaggcaagaggcctcctgttctccccggccccgcagccgaggagattgctgcccgggccacaggaaaactccgtgcagtcgtccgcctgcggccggcagcacctggaaccgaccgggactatcgacatgaggggcccaggtcaggcagactgtgccgttgcgatcggacgtccgctgggagaagtcgtgactctgcgcgtgctcgaatcgagcctgaattgctctgctggagacatgctgctgctttggggccgcctcacctggcggaagatgtgccgcaaactccttgacatgacgttttcatcaaaaaccaatactctggtggtgagacagaggtgcggccgaccaggtggaggcgtgctcctgcggtatggcagccagctcgctcctgaaaccttttaccgagaatgtgatatgcaactcttcgggccgtggggggaaatcgtctccccttccctgtcgccggctacctcaaatgccggaggatgccgccttttcatcaacgtggcaccgcacgccaggatcgcaatccatgctctggccaccaatatgggagcggggaccgaaggagccaacgcctcctacatcctcattagggatactcattcgctgagaaccactgctttccacggacaacaggtcctgtactgggagagcgagtcctcgcaagccgaaatggagttctcggaagggtttctcaaggcacaggcctctttgcggggacagtactggaccttgcagagctgggtgccggagatgcaggacccgcaatcgtggaagggaaaggaaggaact

SEQ ID NO: 5638 - DNA, 4281 bp, Artificial Sequence
  Description of Artificial Sequence: Synthetic coding sequence
atgcatcagaggcacccacgcgcacgttgtcctccactgtgtgtggcagggattttggcgtgtggcttcttgctaggctgttggggaccatctcactttcagcagtcctgcctccaggccctagagccccaggcggtttcatcgtacttgtctcccggtgcgccactgaaaggcagaccgccttctccaggattccaacgccagaggcagaggcagcggcgggcagccgggggcattctccaccttgagttactggtcgccgtaggtccggacgtattccaggctcatcaggaggacacagaaaggtacgtcctcacaaatctaaacattggcgctgagttgctgagggacccttcacttggcgcacagtttagagtccacctcgtgaaaatggtcatcctcaccgaacccgagggggcgcctaacattacagccaatctcaccagtagcctgctcagcgtgtgcggatggtctcagaccataaaccctgaggatgatacagacccggggcacgcagatctggttttatacattactcgctttgatctagaactgccggacggaaatcgccaggtgcggggcgtcacacagctcgggggagcctgctctcccacatggtcctgcttgatcaccgaggatacaggcttcgatctgggcgtaacaatagcacacgaaatcggacattcctttggtctggagcatgacggagcacccggctccggatgtggacctagcggccacgtgatggcatcagatggggcagcaccccgggccggcttagcttggagcccatgttcaaggcgtcagctcctaagccttctctccgccgggcgggcacgctgcgtgtgggaccctcctcggcctcagccgggctccgccggacaccctccggacgcgcaaccaggcctgtactatagcgccaatgaacagtgccgggtcgcatttggccccaaggctgtggcatgtactttcgcgagagagcacttggatatgtgtcaggcgctctcctgtcacactgacccacttgaccagagctcctgttccagactgctggtgcccctgcttgatggaacagagtgtggggtcgagaaatggtgctctaagggacgttgtcgaagcctggtagagttaacccctatcgcagccgttcatggccggtggagttcatggggacctagaagtccctgctcgcgatcatgtggagggggcgtcgtgacacgcagacgccagtgcaacaacccgaggcccgcgtttggagggcgggcctgtgtgggagcagacctgcaggcagagatgtgcaacacacaggcatgcgaaaaaactcagcttgagtttatgagtcagcagtgcgcgaggaccgacgggcagcctctgcgctcttcaccaggcggggcaagtttctatcactggggcgcagcagtcccacatagccagggcgatgccctgtgccggcacatgtgccgcgccatcggcgagtctttcatcatgaagcggggggacagcttcctagacgggactagatgcatgccaagcggcccacgggaagacggtacattaagtctgtgcgtgagtggtagttgtaggaccttcgggtgtgacgggcgtatggactcccaacaggtgtgggatcgttgccaggtttgtgggggggataacagtacctgttctcccagaaagggttcctttaccgctggtcgagcaagagaatatgtgaccttcctaaccgtgactccgaacctgactagcgtgtatatagccaaccacaggcctcttttcacacatctggcagtgcggatcggaggtaggtacgtcgtagctgggaaaatgtccatcagtcctaacaccacctacccatcacttttggaggacggacgggtcgagtatcgggttgcactcactgaggataggctgcccaggctggaggaaatcagaatctgggggcccctgcaggaggacgcagacatacaggtgtatcgccgctacggggaagagtacggcaacctgactcgccctgacataacttttacatacttccagcctaagcctcggcaggcctgggtatgggctgctgtgagggggccctgcagtgtctcttgcggagccggcttaaggtgggtgaactactcgtgcttggaccaggcccgaaaggagcttgtcgagactgttcagtgccaggggagccagcagcctcccgcctggccggaagcttgcgttctggagccctgtcctccatattgggccgtgggggactttggaccttgttctgcatcttgcggtggcggattgagggaaagaccagttcgttgcgtggaagcacagggttctctgctgaaaaccctgcccccagctaggtgtcgtgcaggagctcagcaaccagccgtcgcactagagacctgcaacccacagccttgccctgcacgatgggaggtttcagagccctcctcttgtacttccgccgggggtgctggcctggcactcgaaaatgagacttgcgttcccggcgctgacgggttagaggcacccgttactgaaggcccgggcagcgtcgacgagaagttgccggcgcctgagccctgcgtgggtatgtcttgtcctcccggctggggccacttagatgccaccagtgcaggggaaaaggcaccgagtccctggggaagtattagaactggcgcccaggcagcccatgtttggactccggccgccgggtcctgctccgttagctgtggacgtggcctgatggaattacgattcctgtgtatggatagtgcactccgagtccctgtgcaggaggagctgtgtggtctggccagtaagcctggcagtcgacgcgaggtgtgccaggcagtcccatgccccgccaggtggcagtacaaacttgccgcctgctccgttagttgtgggagaggtgtcgtacgccgaatcctgtactgtgcccgagcgcatggtgaagatgacggcgaagaaatactccttgacacccaatgccaggggttaccccgaccagagccgcaagaggcctgtagcctcgagccctgccctccacgctggaaagtcatgtccctgggcccttgcagcgctagctgcggcctcggaaccgccagacgatctgtggcttgtgtccagctggaccaaggccaggacgttgaggtggatgaggccgcatgcgccgccctcgtccgacctgaggcatctgttccttgcttaattgcagactgtacctatcggtggcacgtcggcacctggatggagtgtagtgtgtcatgcggagacggtatccagcggaggcgggacacctgcctaggtccgcaagcgcaagcaccagtgcccgcagatttctgtcagcacctgcccaagccagtgacagtgcgcggctgttgggccggaccgtgtgtgggccaggggacccctagtttagtaccacacgaggaggccgccgctcccggccgtacaacagctactccggcaggagccagcctggaatggtcacaggcccgcgggcttttattcagtccagcccctcaacctcgtcgtcttctgccagggcctcaagagaactccgtacagtcaagtgcgtgcggccgtcaacacttggaacctactggaaccatcgatatgcgggggcccggacaggccgattgcgcagtagcaattggacgccccctcggtgaggttgtaacactccgggtactggagtccagtctgaattgttcggctggtgacatgctgctcctgtgggggcggttaacctggcggaagatgtgtcggaaactcttagatatgactttttcatctaagacaaacacactcgtcgtaagacaaagatgcgggcggcccggtgggggggtcctgctgcgctacggaagtcagctcgcccccgagactttttatagagaatgcgatatgcaactcttcgggccatggggcgagatcgtctccccatccctgtccccggctacgagcaacgccggaggctgccgcctcttcattaacgtagccccacatgcacgcatcgccattcacgccctggctactaatatgggagccggaaccgagggcgccaacgcttcgtacatcttgataagggacacccatagcctgagaacgaccgcatttcacgggcagcaggtcctgtattgggaaagcgagtcatcgcaggctgaaatggagttctccgaagggtttcttaaggcccaggcctcccttaggggtcagtattggactctgcagagttgggtgcccgaaatgcaagaccctcaatcttggaaggggaaagagggtaca

SEQ ID NO: 5639 - DNA, 4281 bp, Artificial Sequence
  Description of Artificial Sequence: Synthetic coding sequence
atgcaccaacgtcatcctagagcaagatgtccaccactttgtgtagctggaattttagcatgtggatttcttcttggttgttggggaccatcacattttcaacaatcatgtcttcaagctttagaaccacaagctgtatcatcttatttgtctccaggagcacctttaaaaggtagaccaccatctcctggatttcaacgacaaagacaaagacaaagaagagctgctggaggaatattacatttagaacttttagttgcagttggacctgatgtttttcaggctcatcaagaagatactgaaagatatgtattgactaatttaaacataggggctgaattacttcgagatccaagtttaggagctcaatttcgtgttcatttggttaagatggtcattcttacagaacctgaaggagcacctaatataactgcaaatttaacttcatcacttctatcagtttgtggatggagtcaaactattaatccagaagatgatacagatccaggacatgctgatttggttctttatattacaagatttgatcttgaacttccagatggtaatagacaagttagaggagtaactcaattaggaggagcatgttcacctacttggtcatgtcttattactgaagatacaggattcgatttaggagtaacaatagctcatgagattggacatagttttggtcttgaacatgatggagcaccaggttcaggatgtggaccatctggacatgtcatggcaagtgatggggctgcaccacgtgctggtctagcatggtcaccatgttcaagaagacaacttttgtcattattaagtgcaggtcgagctagatgtgtttgggatcctccaagaccacaaccagggtcagctggacatcctcctgatgcacaaccaggactttattatagtgctaatgaacaatgtcgagttgcctttggtccaaaagcagttgcttgtacatttgctagagaacatttagatatgtgtcaagcattatcatgccataccgatccattagatcaatctagttgttctcgtttacttgttccattattggatggaactgaatgtggagttgaaaaatggtgttctaaaggaagatgcagatcattagttgaattaacaccaatcgctgcagtccatggaagatggagtagttggggacctcgtagtccatgtagtagatcatgtggtggtggagtagttacacgtagaagacaatgtaataatccaagaccagcttttgggggaagagcttgcgtaggtgctgatttacaagctgaaatgtgtaatacccaagcttgtgaaaaaacacaacttgaattcatgtctcaacaatgtgcaagaactgacggacaacctcttagatcatcccctggtggagcatcattttatcattggggtgctgctgttccacattcacaaggagatgctctttgtagacatatgtgtagagctattggtgaaagttttattatgaaaagaggagattcatttttagatggaactagatgtatgccttctggaccaagagaagatggaactttaagtttatgtgtttcaggatcctgtagaacttttggatgtgacggacgaatggattctcaacaagtttgggatagatgtcaggtatgtggtggggataatagtacatgtagtccacgtaaaggttcatttactgcaggaagagctagagaatatgttacatttcttactgttacacctaatcttacttcagtatatattgctaatcatagaccattattcacacatttagctgtcagaattggtggtagatatgttgttgctgggaaaatgagtattagtccaaatacaacatatcctagcttattagaagatggaagagttgaatatagagtggcacttactgaagatagattaccaagattagaagaaataagaatttggggacctcttcaagaagatgcagatattcaagtttataggagatatggagaggaatatggaaatttaactagaccagacataacttttacttattttcaaccaaagccaagacaagcatgggtttgggcagctgtacgaggtccatgtagtgtttcatgtggagctggattaagatgggttaattacagttgtttagatcaagctagaaaagaacttgtagaaacagttcaatgtcaaggatctcaacaaccaccagcttggccagaagcttgtgttctcgaaccttgtccaccatattgggctgttggtgatttcggaccatgtagtgcatcttgtggaggaggactaagagagagaccagttagatgtgttgaagcacaaggatctttacttaaaaccttaccaccagcaagatgtagagctggtgctcaacaaccagctgtagctttagaaacatgtaatccacaaccatgtcctgcacgatgggaagtatctgaaccatcttcatgtacatcagctggaggagctggacttgccttagaaaatgaaacatgtgttccaggggcagatggacttgaagcaccagttactgaaggaccaggttctgtggatgaaaaattacctgctcctgaaccatgtgttggaatgtcatgtcctccaggatggggtcatttagatgctacaagtgcaggtgaaaaagctccttcaccatggggttcaatacgtacaggagctcaggcagctcatgtatggactccagctgcaggatcttgtagtgttagttgcggtagaggacttatggaacttagatttttgtgcatggatagtgctttaagggttcctgttcaagaggaactttgtggtttagcatctaaaccaggttctagaagagaagtttgtcaagcagttccatgtccagctagatggcagtataaacttgcagcttgttctgttagttgtggacgtggagttgttcgtcgtattttatattgtgctagagctcatggtgaagatgacggagaggaaattcttttagatactcaatgtcaaggacttccaagacctgaaccacaagaagcttgttcacttgaaccatgtccaccaagatggaaagtcatgtctcttggaccatgttcagcttcttgcggacttggtacagcaagacgttcagtagcttgtgttcaacttgatcaaggacaagatgtagaagttgatgaagctgcttgtgctgctttagtccgtcctgaagcttctgttccatgtttaattgcagattgtacttatagatggcatgtaggtacttggatggaatgtagtgttagttgtggtgatggaattcaaagaagaagagatacttgtcttggacctcaagcacaagcaccagtacctgcagatttctgtcaacatttaccaaaaccagttacagtcagaggatgttgggctggaccatgcgttggtcaaggtactcctagtttagtaccacatgaagaagcagctgctccaggaagaacaacagcaacaccagcaggagcatctttagaatggtcacaagctagagggcttttatttagcccagcaccacaaccaaggcgtttgttaccaggaccacaagaaaattctgttcaaagttctgcatgtggacgacaacatttagaaccaacaggtacaattgatatgagaggaccaggacaagcagattgcgctgttgctattggaagaccattaggtgaggttgttacacttagagttttggaatcatctttaaattgttcagcaggagatatgttacttctttggggaagattaacttggagaaaaatgtgtagaaagcttttggatatgacattttcatcaaagactaatactcttgttgttagacagagatgtggtagaccaggggggggagtgttattacgatacggatcacaattggcaccagagactttttatagagaatgtgacatgcaactttttggaccatggggagaaattgttagtccaagtttgtcaccagctacttcaaatgctggtggatgtaggttatttattaatgtagcaccacatgcaagaatagctattcatgccttagcaactaatatgggtgcaggaacagaaggtgcaaatgcaagttatattcttattagagatacacattctttacgaactacagctttccatggtcaacaagttttatattgggaatcagagagttctcaagctgaaatggaattttcagaaggatttttaaaagctcaagcttctttaagaggacaatattggactttacaatcttgggttcctgaaatgcaagatccacaatcatggaaaggtaaagaagggaca

SEQ ID NO: 5640 - DNA, 4281 bp, Artificial Sequence
  Description of Artificial Sequence: Synthetic coding sequence
atgcatcaaagacatcctcgtgctagatgtcctccgctgtgcgtggccggaattctcgcgtgtgggttcctgctgggctgttgggggccatctcacttccaacagagttgtcttcaggcactagaaccccaagcagtgtcttcctacctttcacccggagctcccctaaaaggccgaccgccctcgcctggtttccagcgtcaaagacagcgacagaggcgcgcggctggcggcattctgcacctggagttgctcgtcgccgtgggcccggatgtgtttcaagcacatcaggaggacaccgagcgatatgttctgacaaatctgaacatcggggctgagctactccgggaccccagcctcggcgcacaattccgggtgcatctggtgaagatggtaatcctaaccgagccagagggcgctcctaacattactgccaatttgacgagcagtttattgagcgtgtgtggttggtcacagaccatcaatcccgaagacgacactgaccccgggcacgctgatctggtgttgtatatcacccggtttgatctcgagctgccagacggaaaccgtcaggttaggggcgtgactcagctcgggggtgcctgctctccgacctggtcttgcctcatcaccgaggacaccggcttcgatctgggcgtgaccatcgcacacgagatcgggcactccttcgggttagagcacgacggagcaccgggaagcggatgcggacctagcggccacgtgatggcatccgatggggcggctccgcgtgcgggcctggcgtggagcccctgctcaagacggcagttgctgagtttgctgagcgccggtcgtgcgaggtgcgtgtgggacccaccccgccctcagccagggtctgctgggcacccccccgacgcccagcccgggctttactactcagcgaacgagcagtgccgtgttgccttcgggcctaaagccgtggcttgcacctttgccagagaacacttggatatgtgccaggcactgtcgtgccacaccgatcccctggatcagagctcatgcagtaggctgctggtgcctctcctggacggtaccgaatgtggggtcgaaaagtggtgctctaaaggacgatgtcggagtctcgtggaactgactccaattgcagctgtccatgggaggtggagtagctggggacctcggagcccatgtagtcgctcctgcgggggaggagtggtaacgaggcgcaggcagtgcaacaaccccagaccggctttcggtggacgcgcttgcgtgggagccgatcttcaagcagagatgtgtaatactcaggcctgcgaaaaaacacagttagaattcatgtcacagcagtgcgcaaggaccgatggccagcctttgaggtcttcacccgggggcgccagcttttaccactggggagctgccgttccccattctcagggggacgccctgtgtcgacacatgtgtagggcaatcggcgaaagctttattatgaaacgtggcgattcgttcctggatggcacgcggtgtatgccatcagggccccgcgaggacgggactctgagtctgtgcgtgagtgggtcttgcagaaccttcggatgtgatggccgcatggattctcagcaggtgtgggatcgctgccaggtgtgtggcggagacaattccacctgcagcccacgcaagggctcctttacagcaggcagggctcgggagtatgtcactttcctgaccgtgactccgaatctgacgtctgtctatatcgccaaccataggcccctcttcactcatctagctgttagaattggcgggcgatacgtggtggccgggaagatgagtatttctcccaatacaacataccccagcctgctggaagacggccgggttgagtaccgcgtagccctcactgaggatcgactcccccggttggaagaaatccggatctggggaccattgcaggaggacgccgacatccaggtgtaccggcgctacggtgaggagtacggcaatctgactagaccggacataaccttcacgtacttccagccgaagccacggcaggcatgggtgtgggctgcagttcgcggaccctgtagtgttagctgcggagccggcttacgctgggtgaattactcctgccttgaccaagccaggaaagagctggtggagaccgttcagtgccagggctctcagcagccacctgcttggccggaagcgtgcgtcttggagccatgtcccccatactgggcagtgggcgattttggaccatgcagcgccagctgcggcggcggtctgagagaaaggcccgtacgttgtgtggaggcccagggatccctgctcaaaaccctcccacctgcgaggtgccgagcaggagcccaacaacctgccgtggccctcgagacctgtaacccacagccctgtccagccagatgggaggtttcggagcccagttcatgtacctcagctggcggcgctggcctagctctggagaatgaaacctgtgtgcccggagcagatggcctggaagccccagttaccgaaggaccaggctccgtggatgaaaagttacctgccccagaaccatgcgtggggatgagctgcccacctggttggggccatctcgacgctacttccgctggggaaaaggctccctccccctggggctctatcaggaccggggctcaggccgcgcacgtgtggacaccggctgctggctcttgctccgtgtcctgtggcaggggcctgatggagctaaggtttctgtgcatggatagtgctttacgtgtcccagtgcaggaggagctgtgtgggctcgcctccaaacccgggtctcgtagagaggtatgtcaggctgtgccctgtccggccaggtggcagtacaagctggccgcctgcagcgtgtcttgcggccgcggcgtagtcagaaggatcttatactgcgcccgtgcgcacggggaagatgatggggaagagatactgctggatacacaatgtcagggcctaccaagacctgagcctcaggaagcttgctctctcgaaccgtgtccaccaaggtggaaggtgatgagcctgggaccatgctctgcaagctgcggcttaggaactgctcgcaggagtgtcgcctgcgtccagctggatcagggccaggacgtggaggttgatgaggcagcttgcgctgccctagtcagaccagaggcttccgtgccgtgcctcatcgctgactgtacctacaggtggcacgtaggaacgtggatggaatgtagcgtatcttgtggggacggcatccagcgacgacgagacacctgtctcgggccccaggctcaagcacccgtcccggccgacttctgtcagcacctcccgaagccagtgacagtacgcgggtgctgggctggcccctgcgtgggccaggggaccccttcgctggttccccatgaggaggccgccgcacctggccgtacaactgctacaccagcaggagctagtctggaatggagtcaagctagaggcctgctctttagtccagcccctcagcctcggcggctcctgcccggtccacaggagaattccgttcaatccagcgcctgtggtcgccagcacctcgaacccacgggaactattgatatgcgagggccgggtcaggcagattgtgcagtggcaattggtcggcccctgggcgaggtggtcacccttcgtgttttggaatccagcttgaactgttcggcgggcgacatgcttttactgtggggtaggcttacatggcgtaagatgtgcagaaagctgctcgacatgacatttagttctaagaccaacacgttagtggtccgacagagatgcggcagaccagggggcggggtcctgctgagatatggatcacaattggccccagagacgttctaccgggagtgtgatatgcagctgttcggcccttggggcgagatagttagcccctccctaagccccgctacgtccaacgctggcggatgtcgcttatttataaacgtggcgcctcacgcacgcatagccatccatgctctggcgactaatatgggagccggaacagagggagcaaatgcttcctatatcctcatcagagatacccattcactccgtaccacggccttccatggacagcaagtgttatactgggagagcgagagcagtcaagctgagatggagtttagcgaaggcttcctgaaggcacaggccagcctccgaggccagtactggactctccagtcatgggtgccagagatgcaggacccccagtcttggaaggggaaggaaggcacc

SEQ ID NO: 5641 - DNA, 4281 bp, Artificial Sequence
  Description of Artificial Sequence: Synthetic coding sequence
atgcaccaacgccatccgagagcaagatgcccaccactctgcgtcgcaggaatactggcatgtggttttctgctggggtgttggggtccctcgcacttccagcagagctgcctccaagcactggaaccacaggccgtgtcatcgtacctttcccctggtgcccctctcaaaggcaggccgccatcaccaggcttccagcggcaaaggcagaggcaaaggcgtgccgcaggggggattcttcaccttgaacttctggtggcagtgggacctgacgtgttccaggctcaccaggaggacactgaacgttatgtcctcactaacctcaacatcggggcagagctgctcagagatccgagcctgggtgcccaatttcgagtgcatctggtgaagatggtgattctgaccgaaccggagggcgcacctaatatcactgcaaaccttacttcatctctgctcagcgtgtgtggatggtcgcagaccataaaccccgaggacgatacggacccaggccacgccgatctcgtcctgtacattacccgcttcgacttggagctgcctgatggcaatcggcaagttcgaggggtgacccaacttggaggggcatgttctcctacttggagctgtcttatcaccgaggacactggctttgacctcggggtgaccatcgcacatgagattggacactcatttggtctggaacatgatggggcccccgggtcgggatgtggaccttctggtcacgttatggcatcagacggagccgcgcctcgggcgggactcgcatggtccccttgctccagacgacagcttctctctctgctttccgcgggccgagcacgttgtgtgtgggatccaccaaggccacagcctggttcggcaggacatccacccgatgcacaaccaggactctactactccgcgaatgagcaatgtcgcgtggcgtttggtcctaaggcagttgcatgcactttcgcccgggagcatcttgatatgtgtcaagcgctgagctgccatactgaccctctggatcaatcgagctgctcgcgcctgcttgtcccacttctggatggtaccgaatgcggagtcgaaaaatggtgttccaagggtaggtgtcgatcactggtggagctcacccctatagctgctgtgcatggccggtggtcgtcgtggggaccccgtagcccatgttcgagatcatgcggtggaggagtcgtgaccagacgacgacagtgtaacaacccaagacctgcattcggaggacgggcctgtgtgggtgcggaccttcaagcagagatgtgcaacactcaggcatgcgaaaaaactcagcttgaattcatgagccaacagtgcgcaagaaccgacggtcaacctttgcgctcctcgccaggcggtgcatcattttaccattggggtgcggcagtccctcattcgcaaggagacgccctttgtagacatatgtgtagagcgattggcgagtcattcatcatgaagcgtggagatagctttcttgatggaactcgatgtatgccttccggacccagagaggacggaaccttgtccctttgcgtctccgggtcctgtcggacgtttggatgtgacggtcgaatggattcgcagcaggtgtgggatcgttgtcaggtctgtggaggagacaactcgacctgtagcccaagaaagggctcgttcactgcagggcgggcaagggagtacgtcacttttcttaccgtgaccccaaacctcacgagcgtgtacattgccaaccacaggcccctttttactcatctggctgtgcggattggcggccgatacgtcgtggccggaaagatgagcatctcgcctaatactacctacccttccctgctggaagatggacgggtggaataccgggtcgcacttactgaagatcggcttccacgtctggaagaaattagaatttggggaccactgcaggaagatgcagatatacaggtctaccgccggtacggagaggaatacggaaaccttactcggccagatattaccttcacttactttcagcctaagcctcgacaggcctgggtgtgggcagccgtgcgcggaccttgctcagtgtcgtgcggtgctggtttgcgatgggttaactacagctgtctggatcaagcacgaaaggaactggtggaaacggttcaatgtcagggctcgcaacaacctccggcctggccagaggcttgtgtccttgaaccatgccccccttactgggcagttggggacttcggcccttgttccgcctcatgtggtggtggtctgcgcgagcgtcccgtgcgctgtgtcgaagcccaaggatcgctgcttaagactctgccccctgcacgttgtagggcgggagcacaacaacctgcggtggcgctggaaacgtgtaatcctcagccctgccccgcccgttgggaagtttcagaaccttcgtcgtgtacttcagcaggaggcgcaggtcttgcccttgaaaacgaaacctgtgtgcctggggcagatggactggaagcacctgtgactgaggggccgggatcagttgatgagaaacttcccgcacctgaaccttgtgtcggcatgtcctgccctcctggatggggccacctggatgcaacctcagctggtgagaaagcaccatcaccgtgggggtcaatacggaccggagcacaagctgcgcacgtgtggactcctgccgccggatcgtgttcggtgtcctgtggtaggggtctgatggaactgcgcttcctgtgtatggattcggctctgcgggttccagtgcaagaagaattgtgcggactggcaagcaaaccgggctcgagacgcgaggtgtgtcaagcagtcccatgtcctgccagatggcaatacaaattggcagcctgttcggtgtcgtgtggaagaggagtggtgcgccggattctttactgcgcgcgggcacatggggaagatgatggtgaagaaatccttcttgatactcagtgtcaaggccttccccggcctgaaccgcaggaagcatgtagcctggaaccctgtcctccccggtggaaagtgatgtcgctcgggccttgctccgcgtcatgcggtctgggcaccgctagaagatcggtggcgtgtgtccaactcgaccagggacaagatgtggaggtggacgaggccgcttgtgcagcgctggtgcgacccgaggcttcagtcccatgccttattgcagattgcacctatagatggcatgtgggaacctggatggaatgctccgtcagctgcggagacgggatccagcgacggcgggatacctgcttgggacctcaggcccaagcaccagtgcctgccgacttttgtcagcaccttccaaaacctgtgaccgttcgtggatgttgggcaggaccctgcgtggggcaaggaaccccttccctcgtcccccacgaggaagcagcggcaccgggccggaccacggcaacgccggcaggtgcctcgcttgagtggtcccaagcaaggggactgctctttagccccgctccacagccaagacgcctcctgccaggaccgcaagagaatagcgtgcagtctagcgcctgtggtcgccagcatcttgagccaaccggaactattgatatgcggggacctgggcaggcggactgtgcagtggctattgggaggccactcggagaagtcgtgactcttcgtgtgttggaatcatcgctcaactgctcagccggtgatatgctcctgctttggggtagacttacttggcgaaagatgtgtaggaaattgctcgatatgactttctcttcaaagacgaatactctcgtggtgagacaaagatgtggaaggcctggtggcggtgtgcttcttagatatggaagccagcttgctcctgaaaccttttaccgagaatgcgatatgcagctctttggcccttggggtgagatcgtgagcccttcactttccccagcaacttcaaacgcagggggatgccgtctgttcataaatgtggcacctcatgcaagaattgcgatccatgccctcgctactaacatgggtgcaggtaccgagggtgcaaatgcgtcctacatccttattagagacacccattcccttcggactacggcctttcatggtcaacaagtgctgtactgggagtctgaatcatcccaagctgaaatggaattttccgaaggctttctcaaggctcaagcatcgctgagaggacaatactggacgcttcaatcctgggtcccggagatgcaggacccccagtcatggaagggaaaggagggaacc

SEQ ID NO: 5642 - DNA, 4281 bp, Artificial Sequence
  Description of Artificial Sequence: Synthetic coding sequence
atgcaccagcgacatcccagagcccgctgcccccctctttgtgtagccggtattctggcttgcggttttctgctgggctgttggggcccatctcattttcagcaaagttgccttcaagcccttgaacctcaagctgtgagttcttacctgagtcccggggccccactgaaaggaagacccccttcacccggcttccagagacagcgccaacgccaaaggagggcggctggagggatcctccatctggaactcctggttgccgtcggccctgatgtttttcaggctcatcaggaggacacagaacggtacgttttgaccaacttgaatattggcgccgaactgctgcgcgacccctccttgggggcacagtttcgcgtgcacttggtgaagatggtgatcctgacggaaccagagggagcgccaaacattaccgctaacctgacttcttccttgctgtcagtatgcggttggtctcagactatcaaccccgaagatgatactgaccccgggcatgcggaccttgtgctgtatatcacgagatttgatctggagctgcctgacggtaacagacaagttaggggggtcactcagcttggaggagcatgtagtccaacttggtcttgcctcatcacagaagacaccggattcgacctgggggtaaccattgcgcacgagatcggccatagtttcggactggaacacgacggagcacctggctccgggtgcggaccaagcggccacgtaatggcctccgatggggcagctcctcgggctggcctggcatggagcccttgttccaggcggcagcttctctcactgctcagcgctggcagagcccggtgcgtttgggatcctccaagaccacagcccggctcagcaggccaccctccagatgctcagcctggactgtactattctgcaaacgaacaatgtcgagtggccttcgggcccaaggcagtagcgtgtactttcgccagggagcacttggatatgtgccaagctctgagctgccatactgatccgttagatcaaagttcctgttctcgcctcttagtgccactcttggacggcaccgaatgtggcgtggagaaatggtgcagcaaaggcaggtgcagatctttggtggaactgactccaatcgctgccgttcacggaaggtggagctcttggggacctcgtagcccatgtagtagatcttgtggcgggggggtcgtaacccgcagaagacaatgcaacaacccaaggcctgcttttggcggacgcgcttgcgtaggcgctgacctgcaagctgagatgtgcaacacccaagcttgcgaaaaaacacagcttgagtttatgtcacagcaatgcgctcggaccgacggccagccacttaggagtagccccggtggagccagcttttaccactggggcgctgccgtgcctcatagccagggagacgctctctgcaggcacatgtgcagagctatcggggagagttttatcatgaagaggggagacagcttcttggatgggaccaggtgtatgccgtccggccctagagaagatggaactctgagcctgtgcgtcagcggctcctgcagaacatttggttgcgatggaagaatggatagtcaacaggtgtgggaccgctgccaggtttgtggaggggataatagcacctgtagcccaagaaagggctctttcaccgcagggagggcccgggagtacgtgactttcttgaccgtgacccccaaccttacttctgtgtatattgctaaccatcggcctctctttacccatctggccgtccgaatcggaggacgatacgtagtagctggcaaaatgtccattagtcctaacactacatacccctctctgctggaggatggcagggttgagtaccgcgtggccctcactgaggatagactgcccagacttgaggaaatccggatctggggacctcttcaggaggatgcggacatccaggtttataggagatatggagaagaatacgggaacctaacaaggcccgacattacgttcacctacttccagccaaagcccagacaggcttgggtctgggcagccgtcagagggccctgtagcgtcagctgtggagcgggattgagatgggtgaattactcttgtctggaccaggctagaaaagaattggtggagactgtacagtgccagggaagtcagcaaccacccgcttggcccgaagcttgcgtcctcgagccgtgtccgccttactgggccgtgggagatttcggtccctgcagcgcttcttgtggcggaggcctgcgggaacgaccagtgagatgtgtggaagcccagggaagcttgctgaagaccctccctcccgcaaggtgccgtgctggtgctcagcagccagccgttgccctggagacctgcaaccctcaaccttgccccgctaggtgggaggtttcagagccttcctcttgtacatctgcaggtggggcgggtttagctctcgagaacgaaacctgcgtccccggcgctgacggattggaggctccagtcaccgaaggcccaggctctgtcgacgagaagttgcccgcacccgaaccctgcgtgggaatgagctgtccacccggctggggtcatctggacgctacaagtgctggcgagaaggctccgtccccgtggggcagcattaggacaggagcacaggccgcacacgtgtggactcccgcagctggcagctgctctgttagctgcgggcgagggctaatggagctccgtttcctgtgcatggactctgcacttagggtcccggtgcaagaggaactttgcggtctggcgagcaaacccggctcacggagagaagtctgtcaagctgttccttgccctgcaaggtggcaatataaactggcagcatgcagcgtgagctgcggaagaggagttgtgaggcgcatcctctactgtgcacgggctcatggggaggacgatggagaggagatacttctggatacacaatgccaagggttgcctagacccgagcctcaggaagcctgtagtttggaaccctgccctccacgatggaaagtcatgtctttgggtccttgttctgcctcttgtgggctgggtactgcaagacggagtgtagcttgcgtgcaactcgaccaagggcaggatgtggaagtggatgaggcagcttgtgcggctcttgtacgtccagaggcgagtgtgccctgcctgatcgctgattgcacctaccgttggcatgtgggaacttggatggagtgtagcgtgtcttgtggggacggcatccaacggagacgtgatacatgcttaggtccacaagctcaggcgccagtccctgcagacttttgtcagcatcttccgaaacccgtgactgtcaggggatgctgggcaggaccatgtgttggccagggaacaccttcactcgtcccccatgaggaagcagctgcccccggcagaaccactgctacacccgccggagcttcactcgagtggagccaggcgcgcggcttgctgtttagtcccgcgccccaaccacgcagactgcttccaggcccacaagagaatagcgtccaatccagcgcttgtggccgccagcacctggaacccaccggaaccatagatatgaggggtccaggacaggccgattgtgctgtcgcaatcggcaggcctctcggggaagtagttactttgcgcgttcttgagtcttccctgaactgctccgccggtgatatgctcctgctgtggggaaggctgacttggaggaaaatgtgcaggaagcttctggatatgaccttctcgagcaaaactaacaccctggtcgtgcggcagcgttgcggacgtcccggggggggagtacttttgcgctacggaagccaacttgcacctgaaacattttacagggaatgcgatatgcaactgtttggcccatggggcgagatcgtgagccccagccttagtccagccacatcgaacgcaggaggttgccggctttttattaatgttgctcctcacgctagaatcgcaatccacgccttggctaccaacatgggagcaggcaccgaaggcgctaacgcgtcatatattctaatcagagatacacatagcctcagaactaccgcctttcacggccaacaagtgctttactgggagtccgagtcttcacaagcagaaatggagttcagcgaaggattcttgaaagcacaggcatctctgaggggacagtactggaccctgcaaagttgggtaccagaaatgcaagatccacaatcatggaagggcaaggagggaacc

SEQ ID NO: 5643 - DNA, 4281 bp, Artificial Sequence
  Description of Artificial Sequence: Synthetic coding sequence
atgcaccagcgccaccccagagcccggtgtccccccctctgcgtagccggcattttggcatgtggtttcctgttgggctgctggggaccctcccattttcagcaatcctgcctgcaagctctagagccccaggcagtctccagctacttaagccccggcgctcctctaaaggggcggcccccctcacccggattccagcgccagagacagaggcagcgccgagctgccggcggcatacttcacctggagctgcttgtggcggtgggccccgatgtgtttcaagcccaccaagaggatacagaacgttatgtgttgaccaacctaaacattggagccgaactgctaagagacccctccctgggggcccagttccgggtacatcttgtgaagatggtcatcctgactgagccagaaggggctcctaatattacagccaatctcactagctctttactatcagtgtgtgggtggagtcaaacaataaacccagaggacgacacagatcccggccacgcggacttggtgctgtacatcacccggtttgatctggaactcccagacggcaatagacaagtcaggggagtgactcagttgggaggggcatgctccccaacgtggagctgcctcatcaccgaagatacaggtttcgacctgggcgtaaccatcgcccatgagatcggtcatagcttcggactggagcacgacggggcccccgggtctggatgtggaccaagtggacacgtaatggctagcgacggggccgcacctcgtgccggacttgcttggtccccctgttctcggcgtcagctgctaagcctgctgtcagccggacgtgcacgttgcgtgtgggatccgccacgaccccagcccggatctgccgggcatcctcccgatgcacagcccggactgtattactcagccaatgagcagtgtcgggttgcctttggtcctaaggcagtggcttgcacctttgcgagggagcacctcgatatgtgccaggctctgtcttgtcatacggatcccctggatcagagcagctgctcaaggcttctggtgcctttgctggacggaactgagtgtggtgtcgagaagtggtgctccaaggggcggtgtcggagtttggtcgaactcaccccaattgccgctgtccatggtcggtggtccagctggggccctcgctcgccttgcagccgcagttgcggcggcggcgtggtgacaagaagaaggcagtgcaacaacccgcggccggcattcggcggcagggcgtgcgtcggagctgatttgcaggcagaaatgtgcaatacgcaggcttgcgagaagactcagctcgagtttatgagtcagcaatgcgcacgcacagatggccaaccgctccgatcttcacctggaggcgcatcattttaccattggggcgctgcggtccctcattctcaaggtgatgcactgtgtcgccacatgtgtcgcgcaattggagagagcttcataatgaaaagaggtgacagttttctggatggcacaagatgtatgccttccggaccaagggaggacggtactctctctttatgcgtgtcagggagctgcagaacctttggttgtgatggccgaatggacagccaacaggtctgggaccggtgccaggtatgtggaggggacaattcaacctgttcacctaggaaagggtcattcaccgctggcagagcgagggagtacgtgacattcctgacagtaacacccaacctgacttccgtgtacatcgcaaaccacagacccctgtttacacacttggccgtgcgcatcggcggtcgttatgtggtcgcaggcaaaatgtccatctctcccaacacaacttacccgagcctccttgaagacggccgggtcgaatatcgcgtcgcactaactgaggataggttgcccaggctggaggagatacgtatctggggacctctccaagaggacgctgatattcaggtctaccggcgatatggggaagaatacgggaatctgactcgcccagatataacgttcacttactttcagcccaagcctagacaggcctgggtatgggcagcggtccgaggaccatgttccgtgagctgcggggccggtcttaggtgggtaaactactcatgcctggaccaggcccggaaagagttggtggagaccgtacagtgtcagggtagtcaacaacctccagcttggcccgaggcctgtgttctagaaccttgtcctccctactgggccgtaggcgattttggtccctgtagcgcatcatgcgggggtgggctcagggagaggccagtacgttgcgtagaggcccaagggtccctgctgaaaaccctgcctcccgccaggtgccgcgccggcgcgcaacagccagccgtggcactcgaaacatgcaacccccaaccatgccccgctcggtgggaagtgtctgagccttcttcttgcaccagtgctggtggggctggtctggcactggagaatgaaacatgcgtgcccggtgctgatggtttagaagctcctgtcaccgaaggtcccggcagcgtcgacgaaaaactccctgcccccgagccctgcgtgggcatgtcctgcccgcctggttgggggcacttagacgctacctctgcaggggagaaagcccccagcccatgggggtccatacgcactggtgcccaggccgcccacgtgtggaccccagcggctggttcgtgctccgtgagttgtgggaggggcttgatggaactgcgttttctgtgtatggactctgcgttacgtgtacctgtgcaggaggagctgtgcgggctggcctcaaagcccggatcacgacgtgaggtctgccaggcagtgccttgtcctgcccgatggcagtataagctggcagcttgctcagtaagctgcggccgcggagtggtccggagaattttatactgtgcgcgcgcccacggagaggatgacggggaggagattctcctggacactcagtgccagggcctgcctcgccccgaaccccaggaggcctgctcactggagccttgtccaccaaggtggaaagtcatgtctctgggtccttgctcggcatcgtgtgggctcggtaccgcccgaaggagtgttgcctgcgttcaactggatcagggacaggatgtggaggtggacgaagccgcatgcgctgctttggtgcggcccgaggcttccgtcccttgccttatcgctgattgtacataccgatggcacgtaggaacttggatggaatgctcagtgtcctgtggggatgggatccagagacgccgtgacacttgtcttggtccacaggcgcaagctcccgtgcccgcagatttttgtcagcatctgcctaagcccgtcacggtgaggggctgttgggccgggccatgcgttggccaggggaccccttctctcgtgccccacgaggaggcagcagcacccggcaggacgacggcaacaccagcaggagcttcacttgaatggtctcaagcccgggggttacttttttcccccgctccacagcctcgaaggttgctgccgggacctcaggaaaactccgtgcagtcgtccgcatgcgggcgccaacatctcgaacccaccggcacaattgatatgcggggaccaggacaagccgattgtgctgtggctattggccgcccacttggagaggtggtgaccctgagagttctcgagtccagtttgaactgctcggcgggagacatgctcctactctggggcaggttgacctggcgtaagatgtgtaggaaactcctggatatgaccttctcctcaaagactaacacccttgtggtgagacagcgatgcggacggcccggtggtggcgtcctcctgagatatggctctcagctggctcccgagactttttacagggagtgcgatatgcagctttttggcccctggggagaaattgtttcgcctagcctgtcaccggcgacttcaaatgctggcggttgtcggctctttataaatgtggcaccgcacgcccggatcgcaatccatgcacttgcaacaaacatgggggctggtaccgagggagccaacgccagttacattcttattagagacactcacagcctccgaaccaccgctttccacggacagcaggtcctgtactgggagtcggaatcgtctcaagcagaaatggaattctcagagggatttttgaaagcccaggcatcacttcgtggtcaatactggacgctccagtcctgggtgcccgagatgcaggatccacagtcttggaaaggtaaggagggcact

SEQ ID NO: 5644 - DNA, 4281 bp, Artificial Sequence
  Description of Artificial Sequence: Synthetic coding sequence
atgcaccagcggcacccccgcgcccggtgtccccccctgtgcgttgcggggattctcgcctgtggatttttgctgggatgctggggcccatcacattttcagcagagttgcctacaggctcttgagccccaggcggtgtctagctacctctcacctggggcacctcttaaaggccgaccaccttcccctggctttcaaagacagaggcagcgtcagaggagggccgcggggggtattttacatctggagttgcttgtggccgtaggacccgacgtctttcaagcccatcaggaggatacagagcgctatgtgctgaccaacctgaacatcggggccgaactgctcagggatccaagtctgggagcccaattcagagttcacctcgttaaaatggtgattctgactgagcccgaaggcgccccaaacattaccgccaatctgacttcgagtcttctgtccgtgtgcggctggtcacagactataaatcctgaggatgatacagaccctggccacgctgatctggtgctttatataactcgcttcgacttggaactccccgatggcaatagacaggtgcggggtgttactcagttagggggcgcttgtagcccgacgtggagttgtctcattaccgaagatactggtttcgatcttggagtgaccatagcgcacgaaattggtcactcctttggcctcgaacacgacggagctccagggtcaggctgtggaccctctggacacgttatggcgtctgacggcgcggccccgagggccggactggcttggagcccctgcagcagacgtcagctcctctcactcctatccgccggcagagcaagatgtgtctgggatccaccccgaccccaaccaggatctgcaggacacccccctgacgcgcagccagggctctactactccgccaatgaacagtgtcgcgtggcattcggacccaaagctgttgcatgtacattcgctcgcgagcatctggacatgtgtcaggctttgagctgccatacggaccccctcgatcaatcttcatgctcgagactcctggtgcccctgctagacgggacagaatgcggcgtggagaaatggtgctccaagggccgttgccggtctctcgtggaactgacaccaattgcagcggtgcacggcagatggagcagttggggacctcgaagtccctgcagcagatcctgtgggggaggcgtggtcacaaggcgcaggcagtgcaacaatcctcgtcctgccttcggtggaagagcctgtgtgggggcagacttgcaggcggaaatgtgtaacacacaagcttgtgagaaaacccaactggagttcatgtctcagcagtgtgcaagaaccgacggtcaaccactccggagcagccccggcggggcgtctttctaccactggggggctgccgtgcctcactctcaaggagacgcattatgccggcacatgtgtcgcgcaattggcgagtccttcataatgaagagaggggactccttccttgacgggacgcgctgcatgccatccggcccaagggaggacgggactctcagtctgtgcgtcagcggctcatgtagaacctttggttgtgacggaagaatggactctcaacaggtgtgggaccggtgccaagtctgcgggggcgataacagcacctgctcacccaggaaggggtcgtttaccgctggacgagcgcgggagtacgttaccttcctgacagtgaccccaaatctcacgtctgtgtacattgccaaccataggcctctttttacgcaccttgccgtgaggatcggggggagatacgtggtcgcgggtaagatgagtatcagcccaaatacaacatacccgagcctccttgaggatggcagagtggagtacagggtcgcattaactgaggacaggctgccccgacttgaggagatacgcatttggggccccctccaggaggatgcggacatccaggtgtatcggcgctacggcgaggaatacgggaatctgactcgtcccgacatcacctttacgtacttccaaccaaagcctcgacaggcgtgggtgtgggccgcagttagggggccttgtagcgtttcttgtggggcaggattaaggtgggtcaactacagttgtctggaccaggccaggaaagagctcgtggagactgtccagtgccagggatcccagcagccaccagcttggccagaggcatgcgttcttgaaccatgtcctccttattgggccgtaggggatttcggcccgtgctcggcctcctgcgggggggggctgagagaacgacccgtcagatgtgtggaagctcaaggctctcttttaaagacacttccacctgctaggtgccgagctggagcccagcaaccagcagtagctttagaaacgtgcaacccccagccctgtcctgcccgctgggaagttagcgagccctcttcttgcacaagcgcaggtggcgcaggcctcgccttggaaaatgagacctgtgtgccaggcgcggacggcctggaggcaccagtgaccgagggccctgggtccgtggacgagaagctaccagcccctgaaccatgcgtggggatgtcctgcccgccaggttggggacacctcgacgcaacgtctgcaggcgaaaaggccccctccccctggggctccatacgtacaggagcacaggccgctcacgtgtggacacctgccgcagggtcctgtagcgtcagctgcggccgcggcctcatggagcttcgcttcctgtgcatggatagtgccctgagagtgccagtgcaggaagaactgtgtggccttgcatcaaagccgggctcacgacgggaagtctgtcaggccgtgccatgccctgcccgatggcagtataagctggctgcctgcagcgtttcgtgtggtcgaggggtggtgcgacggatcctgtactgtgcacgtgcacatggagaggacgacggggaggagatcctgctggacacccagtgtcaaggcttacccagaccagagccacaggaagcatgctcactggaaccttgtccccctcgctggaaggtgatgagcctgggaccttgttctgcgagctgtgggctcggaacagctcggcggtccgtcgcctgtgtgcagttggaccaaggacaggacgtagaggtggatgaggccgcttgtgccgctttggtcaggccagaagcctcagtcccatgtctgattgcagactgcacatacagatggcatgtcggcacttggatggagtgttccgtctcctgcggcgatggaatccagcgcagaagagacacctgcctcggcccccaagcccaagcccccgtgccagcagacttctgccagcacctgccgaagcccgtcacagttcggggttgctgggctggaccctgtgttggacaagggactccttcgttggtcccccatgaagaggccgctgcacccgggcgcacaactgctacgccggcgggtgcctccttagagtggtctcaagcgagaggactcctgttttctccagcaccgcagcctcgcagattgctacccggcccacaggagaacagtgttcaatcctctgcctgtggacgccagcatctagagccaacgggtaccattgacatgagaggccctggccaggctgattgtgcagtcgcaattggaagacccctcggggaagtggtaacgctgcgcgtgctcgagtcttctctcaactgctcggcgggcgacatgctcctgctgtggggtagactgacgtggcgaaagatgtgtaggaaactgcttgacatgaccttctcctcaaagacaaacaccctcgtcgtcaggcagcgctgcggccgtccaggtggcggggtgctgcttagatacggctcccagcttgcacctgagaccttctatcgcgagtgtgacatgcagttgtttgggccctggggagagatcgttagcccatcattgtcacctgctacttccaacgccgggggctgtcggctgttcattaatgtggcccctcacgcacgaatcgccattcacgctttagccactaacatgggcgccgggactgagggagccaacgccagttacattctgatcagggacacccattccctgcggaccacagcttttcatggccagcaggttctctactgggagtctgagtcttctcaggcagagatggagttctctgaggggttccttaaggcccaggcatcactcagaggccagtattggacactgcagagctgggttccagagatgcaggatcctcaatcttggaaggggaaggaagggacc

SEQ ID NO: 5645 - DNA, 4281 bp, Artificial Sequence
  Description of Artificial Sequence: Synthetic coding sequence
atgcatcagagacacccacgggctagatgcccccccctgtgtgtggctgggatcctggcctgtgggtttttactcggatgttgggggccctctcatttccagcaatcttgcctccaggccttagagccacaggccgtctcctcttatctgtctccaggggcccctcttaaaggaaggcccccctctcccggattccagcggcagcgacagagacagagacgggccgctggggggatcctgcatcttgagctgctcgtggcagtgggacctgatgtgttccaggctcaccaggaagatactgaaaggtatgttctgactaacttaaacatcggggcggagctgttacgggatcccagtctaggggcgcagtttcgggttcatctggtgaaaatggtgatactcacagaacccgaaggagctccaaatatcactgcaaacctaacatctagtctcctgtccgtgtgtgggtggagtcagactatcaatcccgaagatgatacagatcctgggcatgctgatctagttctctatataacacggttcgatctggaattacccgacggaaaccgacaggttagaggggttactcagctcggaggggcatgttctccaacttggtcatgtctcatcactgaagatactggatttgatctgggggttactatagcccatgaaataggacactcttttgggctcgaacatgatggagctcctgggagtggatgtgggccctccggacacgtcatggcctctgatggagccgcacctagggctgggcttgcatggtcaccctgttctcgacggcagctgctgtctctattgtctgctggaagggcgaggtgtgtgtgggaccctcctcgacctcagccaggatctgcggggcacccacctgatgcccagcctgggctctattattctgccaacgaacagtgtcgggtggcctttggacctaaagctgtagcttgcactttcgctagagaacacctcgacatgtgtcaggctctgtcttgccatacagatcctctggaccagagttcatgctctcgcctacttgtgccactgctcgatggaactgagtgcggggtggagaaatggtgttctaaagggcgttgcagatctctggtggagctcactcctatagccgctgtccacgggcgatggtccagttggggacctaggtctccctgctcgcgaagttgcggaggaggagtcgtcacacggcggcgacagtgtaataaccctcggcctgcatttggagggagggcatgtgtcggggctgatttgcaggctgaaatgtgtaacacacaggcatgtgagaaaacacagcttgaatttatgtctcagcagtgtgcccgaacagatgggcagcccctgaggtcttcccctgggggagcatctttctatcactggggagccgccgtgccacacagtcagggagatgctctatgtagacatatgtgccgcgcaatcggggagtccttcatcatgaaacgaggggacagttttctggatggaacgcgctgtatgccctcagggcccagagaggatggaacactgagtctttgtgtctccgggagttgtaggactttcggatgcgacggacgcatggattctcagcaggtgtgggatcgttgccaggtatgcgggggagataactcaacatgttctccccgaaaaggatctttcacagccggacgggctagagagtatgtgacattcttgactgtgactcctaatctgacatccgtatatatagctaaccatcgacctctgttcacacatttagccgtaagaataggagggagatacgtggtggccgggaaaatgtccatatcaccaaacacaacgtatccctcactcctcgaggatgggagggtagaataccgtgttgccctaactgaagataggctacccagactagaggaaataagaatctggggaccccttcaggaagatgcggatatccaggtctataggaggtatggggaagaatatgggaatctaactagacccgacattacttttacttatttccagcccaagcccagacaggcttgggtctgggccgctgttcgaggaccctgttccgtaagttgtggagctggactccgctgggtgaactatagttgtctggatcaggcccggaaagaattagttgaaactgtgcagtgccaggggtcccagcagccccccgcctggcccgaagcgtgtgttctcgaaccatgccccccctattgggccgtcggagattttggaccctgctccgcatcttgcggaggaggacttcgggaacgacctgtgaggtgtgtcgaagcacaggggagtctgttgaaaacactcccacccgccagatgtcgagctggagcacagcagcctgctgtagcactcgaaacgtgcaacccacagccctgcccagctcggtgggaagtgtccgaaccttcttcatgcacttccgctgggggagctgggctcgccctcgaaaacgaaacatgcgtaccaggggccgatggattggaagctcccgttacagaagggcccgggtccgtggatgaaaagctccccgctcctgaaccttgtgtggggatgtcttgccccccgggatgggggcatctggatgctactagtgccggagaaaaagctcccagtccttggggatccatacggactggggcacaggccgcacacgtctggacaccagccgcagggtcttgttctgtgtcatgcgggcggggacttatggaactgaggttcctttgtatggactctgccctcagagttccagtccaggaagagctctgtgggttagcctctaaacctggatcaaggagagaagtgtgccaggccgtcccttgtcctgctagatggcagtataaactggcagcttgttccgtgagttgtggaagaggggtggttcggcgtatcctttactgtgcaagagcccatggagaagatgatggagaagaaattcttcttgatactcaatgccagggactacccaggcctgagccccaggaagcctgctcattagagccttgtcccccccggtggaaagtgatgtcactcgggccctgttccgctagttgcggacttgggacagctcgtagatcagttgcttgtgtacagcttgatcaggggcaagacgttgaagtagatgaagccgcctgtgctgccttggtgcgcccagaagcctcagtaccttgtctgatcgccgattgcacatataggtggcatgtggggacttggatggagtgctcggtgtcatgcggggacgggatccagcgcaggagagatacatgcctggggccccaggctcaggctcccgtgcctgcagatttctgtcagcacctaccaaaacccgtcacagtccgcggatgctgggctggaccatgtgtggggcaaggaacaccttctctcgtacctcacgaagaagcggctgccccaggacggactacagcaactccagcaggggcctctttggagtggtcacaggccagggggctgttattcagtcccgcaccacagcctaggcggctcctgcctggaccacaggagaactccgtgcagagttcggcctgtgggcggcagcatctggaacccactgggacaatagatatgagggggcctggacaggcagattgcgccgtggctatcgggcggcctctcggagaagtggtgactctcagggtgcttgaatcttcccttaattgtagtgccggggacatgcttttactctggggacgccttacatggaggaaaatgtgtagaaaattgctcgatatgactttttcatccaaaactaatacactcgtggtgaggcagaggtgcggacgccccggaggaggggtgctgctgcgatatggatctcagctcgcccccgaaacattctatcgcgaatgtgacatgcagctgttcgggccttggggggaaattgtgtcgccttcattatcccccgctacttcaaatgccgggggatgtcgactcttcatcaacgtggcccctcatgctcggatagctatccacgcccttgctactaacatgggggctggaacagaaggagctaatgcctcttatatactcatccgcgatactcactccctgcgaacaacagcttttcatgggcagcaggtgctatattgggaatcagaatcctcacaggccgaaatggagttttcagaagggtttcttaaagctcaggcttcactccgagggcagtactggacactccagtcttgggtgcctgagatgcaggatccacagagttggaagggaaaagaagggaca

SEQ ID NO: 5646 - DNA, 4281 bp, Artificial Sequence
  Description of Artificial Sequence: Synthetic coding sequence
atgcatcaaagacacccgcgggcgaggtgccctccattgtgtgtcgctggaattctggcatgcggattcctgctgggatgttgggggccgtcacactttcagcagtcatgcctgcaggctctggagccgcaggccgtgtcgtcctacctgagccctggcgcccccctgaagggccggcctcctagcccagggttccaacgccaacgccaaaggcaaagacgtgctgcaggaggaatcctgcacctggagctgctggtcgccgtcggtccagatgtattccaggctcaccaggaggacaccgaacgctacgttctcactaacctgaatattggagcggagctcctgcgggatccttccctcggagcccagttccgggtgcaccttgtcaaaatggtgatcctcaccgaaccggagggagcgccaaatatcacggccaacttgacgagctcgctcctgtcagtctgcggatggtcccaaacgatcaacccagaggacgataccgatccagggcacgccgaccttgttctctacatcactcggttcgacctggaactgcccgatggcaatcgccaggtccgtggagtgacccagctcgggggagcctgtagcccgacctggtcctgtctgataacggaggacaccggttttgacctcggcgtgactatcgcccacgaaattggacattcattcggcttggagcacgacggagctcctggaagcggttgcggaccgtcgggacacgtgatggcttccgatggagcggcaccgcgcgcaggactggcctggtcgccctgcagtcggcgccaactgctgtcactcctttcggccggtcgggcccggtgcgtctgggacccgccgcgcccccaaccaggcagtgcgggacatccgcctgatgcccaacccggcttgtactactcggctaatgagcagtgtcgagtggctttcggaccgaaggcggtggcctgcaccttcgcgcgcgagcacctggatatgtgtcaggcgctgagctgccacacggatccgctggaccagtcgtcctgttcccggctcctggtcccgctgctggacggtactgaatgcggcgtcgagaagtggtgctctaagggaagatgccgctcgttggtggaactgactcctatcgccgccgtgcatggtcgctggagctcttggggacctcggtcgccttgcagtaggagctgcgggggaggcgtggtgactcgccggcgacagtgcaataacccaaggccggcattcggaggacgcgcctgcgttggtgcggatttgcaggcggaaatgtgcaacactcaagcatgcgaaaagacccagcttgagtttatgtcgcagcaatgcgcacgcactgacggccaaccccttcgctccagccccggcggcgcatcgttctaccattggggcgctgcggtgccgcactcccagggggacgccttgtgccggcatatgtgccgcgcgatcggagaatccttcatcatgaaacgcggagattcgttcctggacggaacccgctgcatgccgtcaggcccaagggaagatggaaccctgtcattgtgcgtgtccggctcatgtcggacttttggatgcgacggaagaatggactcacagcaggtctgggaccgctgccaggtctgtggaggagacaattcgacgtgttccccgcggaagggatcgttcaccgccggcagagcaagagaatacgtcacctttctgaccgtgactccgaaccttactagcgtctacattgcgaatcaccgccccctcttcactcacctcgctgtgcggatcggaggaaggtacgtggtggcggggaagatgtctatcagcccaaacaccacttacccgtcccttctcgaagatgggcgggtggaataccgagtcgcactgactgaggaccgcctcccgagactggaggagattcggatctggggtccactccaggaggatgcggacatccaggtttatcgtcggtatggcgaggagtacggaaatctgaccagaccagatatcacttttacctacttccagccgaagcctcgacaggcttgggtgtgggcggcggtgagaggcccatgctctgtaagctgtggggctggtctgcggtgggtgaactactcctgcctcgaccaagcccgtaaggagctggtggaaacggtgcagtgtcaaggatcgcagcagccgccggcctggccagaggcctgtgtcttggaaccatgtccaccgtactgggcggtgggcgacttcggcccttgttccgccagctgcggcgggggacttagagaacgcccagtgaggtgcgtggaggcgcaggggtcactcctcaaaaccctgccgcctgcgcggtgccgggcgggtgcacagcagccagcagtcgctctggaaacctgtaacccgcaaccatgccctgcacggtgggaggtcagcgagccgtcgtcatgcacttcagcaggcggagctggactggcactcgagaacgagacttgcgtcccgggagcagacggactggaagcgccggttactgaaggaccgggctccgtggatgaaaaacttcctgctccggaaccgtgcgtgggtatgtcctgccctcctggatggggccacctcgacgccacctcggcaggagaaaaggccccaagcccgtggggttcgataagaaccggagctcaagctgcccacgtgtggaccccggctgccggatcgtgctccgtgagctgcgggcgcgggctgatggaactccgcttcttgtgcatggacagtgccttgcgcgtgccggtccaagaagaactgtgcggccttgcctctaagccaggctctcggagagaagtgtgccaggcagttccatgtcctgcacgctggcagtacaaactggccgcctgctctgtgtcctgcggcagaggcgtggtgcggcggatcctttactgcgcacgggcacatggcgaggatgacggcgaagaaatcctccttgacactcaatgtcaagggctgccaaggcccgaacctcaggaggcttgctccctcgagccctgccctccaagatggaaggtgatgtctctgggcccatgctcagcttcatgtgggctgggtactgccagacggtcagtggcctgcgtgcagctggatcagggacaagacgtagaagtggatgaggcggcgtgcgctgctctcgtcagaccggaggcttccgtcccgtgcctgatcgccgactgcacgtacaggtggcatgtcggaacctggatggaatgttcagtgtcgtgtggggacggaatccagagacgtcgggatacctgtctgggaccacaggcccaggcgcctgtcccggccgacttctgccaacatctgccaaaaccggtgaccgtgagaggctgctgggccggtccttgcgtaggacagggaactcctagtctggtgccgcatgaggaggccgccgcccccggacgcaccaccgccactccagctggcgcgtcactcgaatggtcgcaggccagggggctcttgttttcgccggccccacaaccacgccggctcctgccgggaccccaggagaattccgtgcaaagcagcgcctgcggaaggcagcatctggaacctaccggcacgatcgacatgagagggcctggacaagcggattgcgcagtggccattggtcgcccgcttggtgaagtggttactctgcgcgttttggagtcgtcactcaactgctcggcgggtgacatgctgctgctctgggggcgccttacctggcgcaagatgtgtcgtaagctcctggatatgacttttagctccaagaccaacaccctggtggtgagacaacgctgcgggaggccgggtggcggagtgctcctgcggtacggatcgcagctcgccccggagactttctatcgggaatgtgacatgcaactgttcggaccatggggggaaatcgtgtcaccgtcgctgtccccagccacctcgaacgccggaggatgccgacttttcatcaatgtcgccccccatgcccgcatagcgatccacgccctcgcgactaacatgggagcagggaccgaaggtgctaacgcctcgtacatcctgattcgcgacacccactcgctgcgcaccactgcatttcacggacagcaagtcctgtactgggaatcggaatcctcccaggccgaaatggagttctccgaaggtttcctcaaagcccaggcgtcgctccgcggccagtattggacccttcaatcgtgggtgccggaaatgcaagacccgcagtcgtggaagggaaaagaaggcact

SEQ ID NO: 5647 - DNA, 4281 bp, Artificial Sequence
  Description of Artificial Sequence: Synthetic coding sequence
atgcatcagcggcatcctcgcgcgcggtgccccccgctttgcgttgccggaatcctcgcttgcggcttcttgctcggctgttgggggccttcccatttccagcaaagttgcctgcaagcactggagccgcaagccgtgtcttcctatctatcgccaggcgccccgcttaaaggccgacctccctccccgggatttcaacggcagcgacaacgccagcgccgtgcagcgggagggatcctgcatttagagcttctcgtcgctgtaggcccagacgtcttccaggcccaccaagaagataccgagcggtatgttctcactaacctcaatataggtgctgagctcctgcgggacccctccctcggagctcagttccgcgtccacctcgtcaaaatggttatactcaccgagcccgagggtgcgcctaatattacggctaacttgaccagcagcctgctctccgtgtgcggatggtcccaaaccattaaccccgaggatgatacagaccccggccatgctgacttggtcttgtacattacacggtttgacctggagttgccggatggcaatagacaagttcggggagtgactcaactaggaggcgcttgctccccaacttggtcgtgcctcattacagaagatactggcttcgaccttggggtcactattgcccacgaaattggacactcgtttggactggaacatgatggagccccaggctccggttgcggccccagcggccatgtgatggcatcggatggggcagctccgagggctggactcgcgtggtcgccatgcagcagaagacaattacttagtctgcttagtgcaggacgcgcgcggtgtgtgtgggacccccctcgtcctcagcccgggtcagccggacacccgccggacgctcagccgggtctctattactcggctaacgagcagtgccgtgtggcgttcggccccaaagcggttgcctgtacttttgcacgagagcatctggatatgtgccaagccttatcgtgtcacactgacccgctcgatcaaagctcatgcagtcggctcctggtgccccttcttgacggtacggaatgtggagtggaaaagtggtgctctaagggacgctgcagatcgctagtagaacttactccgattgcggcggtgcacggacgatggtcctcttgggggccccgttcgccttgctctcggtcatgcggaggcggggtggtaacgcgcagacgccaatgcaataaccctcgaccggccttcgggggtcgggcgtgtgtgggcgcagatttgcaggcagagatgtgcaatacgcaagcatgcgagaagactcaactggagtttatgtctcaacaatgcgctcggacggatggtcaacctctgcgaagctcccctgggggtgctagcttctatcattggggtgccgctgttccacacagtcaaggggatgcgttgtgtcgtcatatgtgtcgtgccatcggtgagtcattcatcatgaagcgaggagactcatttcttgacggaactcggtgcatgccctccggcccccgtgaagatggcacactttcgttgtgcgtcagtggtagctgtcgcacattcggctgcgacgggcgcatggatagtcagcaggtctgggacagatgccaggtatgtgggggcgataacagtacatgttcgcctcgaaaaggtagttttacggctggccgggcccgggaatacgttacgtttctgactgtaactccaaacctgacgtccgtctatattgccaatcaccggccactatttacccatcttgctgtgcgcatcggtggccggtacgtggtagccggcaaaatgtccatcagtcctaatactacctacccttccctgttggaggatggacgagttgagtatagagttgccctcaccgaagatcgtttacctcgactagaagagatccgcatctgggggcctctgcaagaggatgcggacatccaagtttatcgtcgctacggtgaggagtatggcaacctaacgcgtcctgatatcacttttacgtattttcagcccaaaccgcgacaagcctgggtctgggcggctgttcgcgggccgtgctcggtcagctgtggcgctggacttcggtgggtgaactattcatgcctcgatcaagctcggaaggagctagtcgagacagtgcaatgtcagggctctcaacaacctcctgcatggccggaggcttgtgtcctagagccatgtccgccgtattgggcggttggagatttcggaccttgcagtgccagttgtggagggggactaagggaacgtcctgtgcgatgcgtagaggcccaggggtcactgctaaaaacgctccctccagcacgatgccgagcgggggcacagcagcctgcggtagcgctcgagacttgtaatcctcaaccctgcccggcccggtgggaggttagcgaacctagttcttgtacgtcggcaggtggggccggcctagcactcgaaaatgagacctgtgttccgggtgcagatggtctggaggcccccgtcactgaaggccccggctcagtcgatgaaaagcttcccgcacccgagccatgtgtgggtatgtcttgccccccgggatggggacacctggacgcaacatccgctggcgaaaaagccccttcgccgtggggatccattcgtactggtgctcaggcggcgcacgtctggacaccagcagctggttcctgttctgtttcatgtggaagaggtctcatggaacttcgcttcctctgtatggacagtgctctccgcgtgccagtccaagaagagctttgcggcctagcgagcaagcccggatcgaggcgagaagtttgtcaggcggttccttgtcccgctcggtggcaatataaattagcagcttgtagcgtgtcctgcggcaggggagtagtccggcgtattctttactgcgctagggcacatggcgaggatgatggagaggaaatactacttgatacccagtgccagggactgcctcgtccggaaccgcaggaagcatgcagcctcgaaccttgtcctcccagatggaaagtgatgtctctgggcccttgttcggcttcttgcggacttggcaccgcaaggcgctcggtcgcatgcgtccagctcgaccagggccaggacgttgaggtggacgaggccgcctgcgccgccctcgttcgccctgaggcatccgtcccatgtctaatcgccgattgtacgtatagatggcacgttggtacgtggatggagtgtagtgtctcctgtggtgatgggattcagcgtcgccgcgatacgtgcttgggccctcaagcacaggctccagtccccgccgacttctgccaacatctaccaaaaccagtcaccgtgcgcggttgctgggcaggtccatgcgttgggcaaggaacgccctcacttgtgccgcacgaggaggcagctgctccaggaaggacgactgccacaccggcaggcgcttctctggagtggtcccaggcccgtggtttgctgttctcgccagcgccccagccacgcaggctgttacctggcccgcaggagaatagtgtccaatcgtctgcatgcgggcgccaacaccttgagcccacggggacgatagatatgcgagggccgggccaagctgattgcgcggtggctataggtcggcctctcggtgaggtagtcaccttacgcgttttagagtcttctctaaattgtagtgccggagatatgttgctcttatggggtcgcctaacctggcgaaagatgtgtagaaagcttttggatatgacattcagttcgaaaaccaatacattggttgtccgccagcggtgtggtcgacccggtgggggagtgctattacgctacggttcccagttggcgccggagacattttatcgtgaatgtgacatgcagttgtttggcccttggggtgaaatcgtcagtccgtctctttcacccgcgactagcaacgctggcggatgtaggttgtttatcaatgtggcaccgcatgcccggattgcgatccacgctctcgcgacaaatatgggtgctgggactgaaggcgcaaatgcgtcctatattctgattcgcgatacccactctcttcgtaccaccgcctttcacggtcagcaggtgttgtattgggagtccgagtcgagccaggcagagatggaattcagcgagggttttctaaaagcgcaggctagccttcgaggacaatactggaccctccagagctgggttcctgagatgcaggatccccaaagctggaaagggaaagaaggtacg

SEQ ID NO: 5648 - DNA, 4281 bp, Artificial Sequence
  Description of Artificial Sequence: Synthetic coding sequence
atgcaccagcgccatccaagagcccgatgcccacctctgtgcgtggctggaatcctggcttgcggtttccttctcggatgttggggaccatcgcatttccagcaatcctgcctgcaagccctggagccgcaggcagtgtcatcttacctgagcccgggggctccgttgaagggacgcccaccatcacccggattccagagacagagacagaggcaaaggcgcgcagcgggcggaatcctgcacctggaacttcttgtggcagtgggacctgacgtatttcaggcacaccaagaggacactgaacgctacgtcctcactaaccttaacattggcgcagaactcctccgcgatccatccttgggtgcccaattccgtgtgcatcttgtcaaaatggtcatcctgacggaaccagaaggcgcccccaacataaccgccaacctgacctcgtcgctgctgagcgtgtgcgggtggtcacagactattaacccggaggatgatactgaccctggacacgccgacctcgtcctctacattacccgattcgacctcgagctgccggacggtaaccgccaagtccggggagtcactcaactcgggggtgcctgttcgccgacttggagttgcctgatcactgaggacaccgggtttgaccttggagtcaccatcgcccacgaaatcggccatagcttcggccttgagcacgatggagcccctggttcaggctgcgggccgtcagggcacgtgatggcatcagacggtgcagccccgagggctgggcttgcttggtcgccctgttccagaaggcagctgctgtctctcctgtcagccgggagggctcggtgcgtgtgggatccgcctcggccacaacctggatcggccgggcatccacccgacgcccagccgggactttactactcggcgaatgaacaatgccgcgtggcattcggacctaaggccgtggcttgcaccttcgcccgggaacatctcgatatgtgccaggctctgtcgtgccacaccgacccgctggatcaatcctcgtgctcgcgcttgctggtgcctttgctggacgggaccgagtgcggtgtggagaagtggtgctccaagggccgttgccgctcgctcgtcgaattgactcctatcgctgcggtgcatggccggtggtcctcatggggaccacggtcaccatgctcccggtcgtgtggagggggcgtggtgacccgccgacggcagtgcaacaacccgaggccggccttcggcggacgcgcctgcgttggcgctgacctgcaggcggagatgtgcaatactcaagcgtgtgaaaagacccaattggaattcatgtcgcagcaatgcgctaggaccgatggtcagcctctcaggagctcgccagggggagcctcattctaccactggggagcggccgtgccacatagccagggcgacgccctctgcagacatatgtgccgtgctatcggggaatcattcatcatgaagagaggagattcgttcctcgatggcacgaggtgcatgccatcgggcccgagggaggacggtaccttgtccctctgcgtgtccggatcgtgtcgcactttcggatgcgacggacgcatggattcgcaacaggtctgggataggtgccaagtgtgtggcggtgataattccacctgctcaccccgcaagggatcgttcaccgccggacgggctcgggaatacgtcactttcttgaccgtgactcctaatcttacttccgtgtacatagcgaaccacaggcccctgttcactcacctcgccgtccggatcggtggacggtacgtggtggcgggcaaaatgtcgatttccccgaataccacctacccgtcgctgctggaagatggccgcgtcgaataccgagtggcgctgactgaggaccggttgccacggctggaagagatcaggatctggggaccgctccaggaggatgcagatatccaggtctatcggcggtacggggaagaatacgggaatcttacgcgcccagacattactttcacctactttcaacctaagcctcgccaggcgtgggtgtgggctgccgtgagggggccatgctcagtgagctgcggagccgggcttcgatgggtgaactactcgtgcctggatcaggcccgcaaggagctcgtggaaaccgtccagtgccagggatcacagcagccacctgcctggccagaggcctgtgtcctggaaccatgtccgccatattgggcagtgggtgatttcggaccgtgctcagcgtcgtgcggaggcggattgcgcgaaaggccggtgagatgtgtggaggcccagggctcgcttcttaagacgctccctccggctcggtgccgggccggggcccaacagccggcggtggccttggaaacctgtaacccacagccatgcccggcgcgctgggaagtgtcggaaccttcgtcctgcacctcagccggaggcgcaggcctggcactcgaaaacgaaacctgtgtgcccggagcagacggactggaggccccagtcaccgagggtcccggctcggtggacgagaaactgccagcaccggagccgtgcgtgggtatgagctgccccccggggtggggacacctggatgccaccagcgcgggcgaaaaggctccatcaccgtggggcagcatccggaccggagcccaggccgcacatgtgtggactcctgcagccggttcgtgttcagtcagctgtgggaggggactcatggagctgagatttctctgcatggactccgccctcagagtgccggtgcaggaggaattgtgcgggctcgcatccaagcccggctcgcgcagagaagtctgccaggctgtgccttgccccgcgcggtggcagtacaagctcgccgcctgttcggtgtcctgcggccgcggggtcgtgcgccgcatcctctattgtgcgcgggcgcacggggaggatgatggagaagagatcctgttggacacgcaatgccagggactccctaggccggaaccgcaggaagcctgctcactcgaaccctgcccacctcggtggaaagtgatgtcgctgggtccgtgctcggcgtcgtgcggtctgggtacggcacgtcgcagcgtggcctgtgtccagctcgaccagggacaggatgtcgaggtggacgaagcggcttgcgcagccctcgtacgcccggaagcgtcggtcccatgcctcatcgcagattgcacctacagatggcatgttggaacctggatggagtgctccgtgtcatgcggagacggaatccaacgcaggagggacacctgtctgggaccacaggcacaagcccccgtccctgctgacttttgccaacacctgcctaagcctgtgaccgtccgcggatgttgggcgggaccatgcgttggccaaggaactccgtcattggtgccccacgaggaagcggcggcccctggaagaaccactgcaacccccgcgggagcatcgcttgaatggtcacaggctagaggcctgcttttctcgcccgcaccacaaccaagacggctgctcccgggaccgcaggagaacagcgtgcagagcagcgcctgcgggagacagcacctggagccgactggaactatcgacatgcgcggcccagggcaggcggactgcgcggtggcaatcggacgcccgctcggagaggtggtgactctccgcgtccttgagagctcactgaactgtagcgccggagacatgttgcttctgtggggacggctgacctggaggaagatgtgcaggaagctgcttgatatgaccttctcctcgaaaactaatactctggtggttcggcagagatgcggccgcccaggaggtggggtgctgctgaggtacggatcccaactggccccggagactttttaccgcgagtgcgatatgcagctgtttggaccttggggagagatcgtgagtccgtcactcagcccagcgacctcaaatgccggagggtgtagactgttcattaacgtggccccacatgcacgtatcgcaatccacgcccttgcaacgaacatgggagctggaaccgagggcgctaatgcgagctacattctgatccgggacactcattccctccgcaccactgcatttcacggacagcaagtcctgtactgggagagcgaatcgtcccaagcagagatggaattctccgagggatttctgaaagcccaggcgtccctgagaggccagtactggactctgcagagctgggtgccggaaatgcaggatccacagtcgtggaaaggaaaagagggaacg

SEQ ID NO: 5649 - DNA, 4281 bp, Artificial Sequence
  Description of Artificial Sequence: Synthetic coding sequence
atgcatcagagacacccaagagcgagatgtcctccgctttgcgtggcgggtatcctggcgtgcggtttccttttggggtgctggggaccttcgcactttcagcaatcatgcctgcaagcactggaaccgcaggcagtgtcgtcgtacctttcgccaggtgcacctctgaaggggcgtcctcctagccctggatttcagcgtcagaggcagcgacaaagaagggcagctggaggaattcttcacctggaactgctggtcgcagtgggaccggacgtgtttcaagcacatcaggaagataccgagagatacgtgctgacgaaccttaacattggggccgaactccttcgtgatcccagcctgggagctcagttcagagtgcatcttgtgaagatggtgatactgaccgaaccagagggagcgcctaacatcaccgcaaacttgacctcatcactcctttccgtctgtggctggtcgcagactatcaaccctgaagatgacactgatcctggacatgcggatctcgtgctgtacattacccggtttgacctggaactccctgatgggaatagacaggtgagaggtgtcacccaacttggtggtgcgtgttccccaacttggagctgcctgatcactgaagatacgggctttgacctcggagtcactattgcccacgaaattggccactcgtttggtcttgagcacgatggagcgcctggttcaggttgtgggccttcggggcatgtgatggctagcgatggggcagccccaagagccggactggcctggagcccatgttcccgtaggcaacttctttcactgctgtccgctgggcgcgcaagatgtgtgtgggaccctccaagaccccaaccaggtagcgcaggacatccccccgatgcacaacctggtctttactacagcgcaaacgaacaatgccgcgtggcatttggaccgaaggcagtggcgtgtacctttgcgcgcgaacatctggatatgtgccaagcattgtcctgccacactgacccgcttgaccagtccagttgtagccgacttcttgtccctcttcttgacggcactgaatgtggtgtcgaaaagtggtgtagcaagggaaggtgccggagccttgtggaattgactcccatagctgcagtccatggaagatggtcctcgtggggaccacgcagcccttgcagtcggtcgtgtggaggaggtgtggtcacccgccgtaggcagtgtaataacccacggcctgcattcggtggtcgggcatgcgtgggtgcagacctgcaggcagagatgtgtaatactcaggcatgtgaaaaaactcaactggagtttatgagccaacaatgtgctaggacggatggacagccacttagatcctcaccaggtggcgcatccttctaccattggggggcggcagtcccacatagccaaggggacgcactgtgccgccatatgtgccgcgcgatcggagaatcgttcataatgaaacggggtgattcctttctggacggaacccggtgcatgccgagcggtcctcgagaggacggaaccctgtctttgtgtgtgagcggatcctgtagaacttttgggtgtgatggtcggatggatagccaacaagtgtgggacaggtgccaagtctgcggaggcgataattcaacctgttcgcccagaaagggatccttcaccgcaggccgggcccgcgaatacgtaacgtttcttaccgtgacgcctaacctgacctccgtgtacatcgccaatcacaggccgctgttcactcatcttgcagtgagaataggaggacgttacgtggtggcaggcaagatgtcgatctcaccaaatactacctacccttcgctgctcgaagatgggcgtgtggagtaccgcgttgctctgactgaggatcgactgcctcggcttgaagagattcgaatttggggacctcttcaggaagatgctgatatccaggtctatagaagatacggtgaagagtacgggaacttgacccggcctgatattaccttcacctacttccaacctaagcctagacaggcttgggtgtgggcagccgttcgcggaccatgttccgtgtcctgtggagcaggtctgagatgggtcaactactcatgcctggaccaagccaggaaagaactcgtggaaactgtgcagtgccaaggttcccagcaacctcccgcatggccagaagcctgcgtgctcgagccttgcccaccctactgggcagtgggagattttggaccttgctcggcatcctgtggcggaggcttgagagagcgccctgtgcggtgtgtggaggcacaaggttcgctgctcaagaccctcccccctgccagatgccgggccggtgcacaacagccagcagtggcgctcgaaacctgcaatccacagccatgtcccgcgcgctgggaagtctccgaacctagctcgtgcacgtccgccggtggcgcagggctggcactggagaatgaaacctgtgtgcctggagctgacggactcgaggcgccagtgacggaagggcctggtagcgtggatgaaaagctgcctgcacctgaaccctgcgtcgggatgtcgtgcccacccggatggggtcaccttgacgcgacctccgcaggtgagaaggcaccatccccctgggggtctatcagaaccggggcgcaggcagcccacgtgtggacccctgcagcgggttcctgctccgtctcctgtggccgtggacttatggaacttcggtttctttgtatggacagcgctcttcgtgtgccagtgcaagaggagctctgcggactggcaagcaaacctggcagccgccgcgaggtgtgtcaagcagtgccgtgtccagcgcggtggcaatacaagctggcagcctgcagcgtgagctgcggccgcggggtcgtcagaaggatcctctactgcgcgcgcgcccatggcgaggacgatggggaagagattttgctggatacccagtgtcaaggactcccgcgccccgagcctcaagaagcatgctccctcgagccttgtcccccacggtggaaggtgatgtctctcggaccttgttcagctagctgcggtctggggaccgcccgtcggagcgttgcatgtgtgcagctggaccaaggacaagacgtcgaagtcgacgaagccgcatgtgcggcgctcgtgcgccctgaagcgtcggtaccatgtctcatcgcagattgtacctaccgttggcatgtgggaacgtggatggagtgttcggtgagctgtggcgatggtattcagcgtcggagggacacctgtctggggccccaagcccaagcaccagtgcctgctgatttctgtcaacatctgccgaaacctgtcactgtccggggttgctgggcaggtccctgtgtggggcaaggtacgccttcccttgtgcctcatgaagaggccgcagccccaggaagaaccactgcaacgccagcaggggcgtcactggaatggtcacaggcaagaggactgctttttagtcctgcacctcaacccagacgcctgctgcccgggccgcaggaaaactccgtgcaatcctccgcatgtggtaggcagcaccttgaacctacgggtactattgatatgcgcggtccagggcaggcagactgtgcggtggcaattggtaggcccctgggcgaagttgtcaccctgagggtgctggaaagctcgttgaactgttcagcaggcgatatgcttctgctttgggggagattgacctggcgtaaaatgtgtagaaagctgttggacatgacgttttccagcaagactaacaccctggtggtccgccagaggtgtggcagacccggaggtggcgtgctgctcagatatggctcccaactcgcaccagaaaccttttacagagagtgcgatatgcagctgttcggtccgtggggagagatcgtctcaccctcgctgtcccccgccaccagcaatgcaggaggatgtcggctcttcataaatgtcgcacctcacgcccgaattgccatccatgctctggccaccaatatgggtgcgggaaccgagggagcgaacgcgagctacatacttattcgggatacccattcccttcgtaccactgcattccatggacagcaggtgctttactgggaatcagaatcctcccaagcagagatggaattttccgaaggtttcctgaaagcccaagcaagcctcagaggccaatactggacccttcagtcctgggtgcctgaaatgcaagacccccaaagctggaagggaaaagaaggtact

SEQ ID NO: 5650 - DNA, 4281 bp, Artificial Sequence
  Description of Artificial Sequence: Synthetic coding sequence
atgcatcaaagacacccgcgcgcgcgctgtccgccgttgtgcgtggccgggatcctggcctgcgggttcctgctgggatgttggggaccatcacacttccagcaatcgtgtctccaggccctggagccccaggcggtgtcgtcctacctgtctcctggtgcgccgctgaaggggaggcccccgtcacctggattccagagacagcggcagagacagagacgcgctgcgggagggatccttcatctggaacttctggtggccgtcggtccagacgtgttccaggcccatcaggaggacactgagagatacgtgctcaccaacctgaatatcggagccgaacttctgagggacccatccctgggagcccagttcagagtgcacctcgtgaagatggttatcttgactgaacctgaaggtgctcccaacatcactgctaacctgacttcctccctcctgtcggtgtgtggctggagccagacgatcaatccggaagatgacaccgacccgggacacgcggatctcgtgttgtacatcacccggttcgacctggagttgcccgacggaaacagacaggtgcggggcgtgacccagctcggaggcgcttgctcccctacttggtcctgtttgatcaccgaggatactggattcgatctgggagtcaccatcgcccacgaaatcggccactcattcggtctggaacacgacggagccccagggtcgggatgcggaccgtccggtcacgtgatggcatctgatggagccgcaccgagggcgggcctcgcttggtcgccgtgcagccggaggcaattgctctcactcctgtcggctggacgcgcgcggtgcgtgtgggacccaccccgaccccaaccgggatccgcaggacacccaccagatgcccaacctggcctttactactccgccaatgaacagtgccgggtggcgttcggcccgaaggcagtggcttgcaccttcgcaagagaacatctggatatgtgccaagccctgtcatgccatactgacccccttgatcagtcatcctgctcgcggctgcttgtgccgctgctcgatggaactgagtgcggagtggagaaatggtgcagcaagggtagatgccgcagcctcgtggaactgactccgatcgccgccgtccacgggagatggtcatcctggggaccccgatcaccatgttcaagatcgtgcggcggaggtgtggttacgaggaggaggcagtgcaataacccccgacccgcgtttgggggccgggcttgcgtcggagcagatcttcaggccgagatgtgcaacacccaagcctgtgagaaaacccagctcgaattcatgtcccagcagtgcgccaggactgacggacagcctctcaggagctcgcctggaggagcctcattttaccattggggggccgccgtgccccactcgcagggagacgccctgtgtaggcatatgtgccgcgccatcggagaaagtttcatcatgaaaaggggagactcattcctcgacggaactcggtgcatgccatcaggtccccgcgaagatggcactctcagcctgtgcgtctcaggcagctgtcggacgttcgggtgtgacggacgcatggacagccagcaggtgtgggatcgctgccaagtttgtggcggggacaactcaacttgctcaccgagaaaggggagcttcactgcaggacgtgcacgggaatacgtgactttcttgactgtgactccaaaccttactagcgtgtacattgcgaaccaccgccctctttttacgcacctggcagtccggatcggaggacgctatgtggtggccggaaagatgtcgatttcgcccaacaccacctacccgtcgctgctggaggacggacgggtggagtaccgggtcgccctcaccgaggaccgcctgccaagactcgaagaaatccgcatttggggccctctccaagaggatgcggatatccaggtgtaccgccggtacggtgaagaatacggcaatctcaccagacctgacatcactttcacttacttccagccgaagccgcggcaggcctgggtctgggccgccgtccggggaccatgctcagtgtcgtgcggagcaggacttcggtgggtcaattacagctgtctggaccaggcccgcaaggaactcgtggagactgtgcagtgccagggttcccagcagccgcctgcgtggccggaggcgtgcgtgctggaaccgtgccccccgtactgggccgtgggtgacttcgggccgtgctccgcctcatgcggaggaggactgagagaaaggcccgtgcgctgtgtcgaagcgcagggatcgctcctgaaaaccctgccgccggcacggtgcagggccggcgcgcagcagccagccgtcgctctcgaaacttgcaatccacaaccgtgcccggcgcgctgggaagtgtccgaacctagcagctgtaccagcgcgggaggcgcgggccttgcgttggaaaacgaaacttgcgtgcctggagctgatggactggaggccccagtcaccgaaggccctggatcggtggacgagaagctcccggctccggaaccttgcgtgggcatgtcgtgcccgccaggatggggacacctcgatgccacttccgcaggagagaaggctccgtcaccgtggggctccatccgaaccggtgcccaagcggcgcatgtctggactcccgcagcaggatcgtgctcagtgtcctgcgggaggggacttatggaattgagattcttgtgcatggactcggctctcagagtgcctgtccaggaagagctgtgcggactggcatctaagcctggatcgcgccgcgaggtctgccaagccgtcccctgcccggccagatggcagtataagctggctgcctgtagcgtgagctgcgggcgcggcgttgtgagacgcattctgtattgtgcccgagcgcacggagaagatgatggcgaagagatccttttggacacccagtgccaaggcctgcccagacctgaaccgcaggaggcatgctccctggaaccatgcccgcccagatggaaagtgatgagcctgggaccgtgcagcgctagctgtggcctcggaactgcacggaggtcagtggcgtgtgttcagctggatcaaggacaggatgtcgaggtggacgaagcagcctgcgccgcgctggtgaggcctgaggcatcagtgccgtgtctgatcgctgactgcacctaccggtggcacgtgggtacctggatggaatgcagcgtgtcatgcggggatggaatccagaggcggcgggacacttgtctcggaccacaggctcaggccccggttccggcagacttctgccagcatcttcccaaaccggtgactgtgcggggatgctgggcagggccgtgcgtggggcagggaactccgtcacttgtgccacatgaagaagccgcagcgcctggacggacgaccgcaaccccggctggcgcctcgctggaatggagccaagcccgcggtctgctcttctcgccggcacctcagccgagacgtctccttccgggaccgcaagagaattccgtgcagtccagcgcctgcggccgtcaacacctcgaaccgaccggtacgatcgacatgagaggtccgggccaggcagattgcgctgttgctatcgggcgcccgctcggagaggtagtgactctgagagtgcttgagagctccctgaactgctcagcgggcgatatgctcctgctttggggacgtctcacctggcgcaagatgtgccggaaactgctggacatgaccttcagctctaagactaatacgctggtcgtccgccagcgctgcgggcgacctgggggcggagtgctgctgcggtacggctcccagctggcgccagaaaccttttatcgcgagtgcgacatgcagctgttcggaccatggggagagatagtttcaccttcgctgagcccagccacgtccaacgcgggcgggtgtcggttgttcatcaacgtggccccgcatgctcgcattgcgatccatgccctcgcgactaacatgggggcaggaaccgaaggcgcgaacgcttcgtacatcctcatccgggatactcactccctgcgaactactgcatttcatggacagcaggtgctgtactgggagagcgaatcaagtcaggcggaaatggaattctcggaaggattcctgaaagcccaagcatccttgcggggccaatactggaccttgcagtcctgggtgcctgagatgcaagacccacaatcatggaagggtaaagaaggaacc

SEQ ID NO: 5651 - DNA, 4281 bp, Artificial Sequence
  Description of Artificial Sequence: Synthetic coding sequence
atgcatcaaaggcaccctcgagcaaggtgtccaccactctgcgtagccgggatcctggcgtgcggatttctcttagggtgttggggaccatcacattttcaacagagctgcttacaggccctcgagccgcaggccgtttccagctacttgagtcccggagctccgttgaaaggtcgaccacccagccctggtttccagagacagagacagcgacagaggcgagccgcaggcggcatcctacatcttgagctcttggttgctgtggggccagatgtattccaggcacatcaagaggacacagagcgctacgtgcttacgaacctcaacattggcgcagaactgctcagggatccgagcctcggcgctcagtttagggtgcatctggttaagatggtgatcctcacagagcctgaaggagcaccaaatatcactgctaacctcacctcatcgctgctgtcagtgtgtggctggagccaaaccattaatcctgaagatgacaccgatccaggccacgccgacttggtgctctacataacacgcttcgatttggaactgcccgacgggaatcgccaagttagaggcgtgactcagctggggggtgcctgtagtcccacgtggagttgcctgattaccgaagatacagggttcgatcttggggttacaatcgcccacgagattggccactccttcggtctcgaacatgatggcgctcctggatcaggatgtggaccttccggccatgtcatggcttcagatggtgctgcgccacgcgccggtctggcttggtcgccctgttcacggcgccagctcctgagcttgctgagcgccggcagggccaggtgtgtgtgggacccacccagaccccagcctgggtcagcaggccacccccccgacgcccagccaggcctgtattatagcgcgaatgagcaatgtcgcgtcgcgttcgggccaaaagccgtggcatgcactttcgcacgcgaacacctggatatgtgccaagcattgtcgtgtcatacagacccactggatcagtcctcttgtagtcgcctcctcgttccattgctagatggaactgagtgcggcgtagaaaaatggtgctctaagggacgatgtaggtcattagtggaactgacacctatagcagctgttcacggcagatggtcctcgtggggtcccaggtccccctgctctcgaagctgtggcggtggagtagtgactcgtagacgacagtgcaataatccaaggcccgcctttggtggccgggcttgcgtgggcgccgatttgcaggctgaaatgtgcaacacccaggcctgtgagaagacccagttggagttcatgtcacaacagtgcgctcgcactgatggtcagcctttaagatcttcgcccggcggtgcctccttttaccattggggagcggcggtgccacattcccagggggacgcgctctgccgtcatatgtgcagagccatcggcgaaagttttattatgaagagaggcgatagtttcttagacggcacgaggtgcatgccatctggccccagggaggatggaaccttgtcgttgtgtgtttcaggatcctgccggactttcgggtgtgacggacgaatggactcccagcaagtgtgggaccgctgccaggtttgcggtggggataattcaacctgttcccctcggaaaggtagcttcactgcaggtcgagcccgagagtatgtgaccttcctgactgtcacccctaatctgacatctgtctatatcgcaaaccaccgtcctctgttcacacacctcgccgtgaggataggcggtaggtatgtcgtcgccggcaagatgagtatttcccccaataccacctatccctcacttcttgaggatggcagggtcgagtaccgggtagcccttactgaggataggcttccccggctggaggaaatacgtatatggggccctctgcaggaggacgccgatattcaagtttatcgtagatacggcgaagagtatggaaatctcacaagaccggacattacctttacctatttccaaccaaagccacgtcaagcgtgggtctgggcagccgtgaggggcccgtgctcagtcagctgcggagcagggttacgatgggtcaactactcctgtttagaccaagctcgcaaggagctcgttgaaaccgtacagtgccagggctcccagcaaccccccgcgtggccggaggcctgtgtgcttgaaccatgccctccatattgggcggtgggtgattttggaccttgttcagcatcttgtggtgggggactgagagagcggcccgttaggtgtgtggaggctcaggggtctctcttgaaaacactcccacctgctagatgtcgggctggagctcagcagccagccgttgccctggagacttgtaatcctcagccgtgtcccgccagatgggaggtttcggagccatcctcatgcacatctgctggtggagctggcctggcgcttgaaaatgagacctgcgtgcctggagccgatggactggaggcccctgtgacagaagggcccggatctgtggacgaaaaacttcccgctccagaaccatgcgttgggatgtcctgcccccctggctggggacatctggatgccacctcagctggagagaaggcaccaagcccatgggggagcatcagaactggagcccaagctgcacacgtgtggactccagccgctggaagctgcagtgtgagctgtgggagaggtctgatggagctgagatttctttgcatggactcggcactgagagtacccgtgcaggaggagctgtgcgggctggcctcaaagcctggctctaggagagaggtctgtcaggccgtcccgtgccccgcccggtggcagtataagctggctgcctgctcggtttcctgtggtcggggggttgtcagaagaatcctatactgcgccagagcccatggagaagacgatggagaggaaatactcctcgacactcagtgccagggcctcccacggcctgaacctcaggaggcgtgttccctggagccctgtcccccaagatggaaggtaatgagtctgggtccatgttctgcgtcctgcggtttgggcaccgcacgaagaagtgtcgcttgcgtgcagctggaccagggccaagatgtggaggttgatgaggcggcatgtgcggcactcgtgaggccagaagcttctgtcccctgtctgatcgctgactgtacttatcggtggcacgttggtacttggatggagtgcagtgtcagctgcggtgacggcattcagagacgccgggacacttgccttggcccacaagctcaggcacccgttcctgctgatttctgtcagcatttgcccaaacctgtgacagtgagaggatgttgggcgggcccttgtgtcggccaggggaccccctcacttgtgccgcatgaggaggccgccgctcctggtcgcactactgctacacccgccggtgcaagcctggaatggagtcaagccaggggcttgctgttttctcctgctccccagcctcgccgactgttgcctggcccgcaggaaaatagcgttcagtcctctgcatgcgggcggcaacaccttgagcccacggggaccattgacatgagggggccggggcaggccgattgcgccgtggccattggaaggcctctcggagaagtagtcactctgcgcgtgctggaaagttccctgaattgctctgctggggacatgcttctgctctgggggaggctgacctggagaaagatgtgcagaaagctcctggacatgacattttcgtctaaaaccaatactctggtcgtacggcagaggtgtggaagacccgggggaggtgtcctgctccggtatggctcacaattagcgcccgagaccttctacagagaatgcgatatgcagctttttggtccctggggggagattgtgtcaccatcccttagccccgctactagcaacgccggcggctgccgccttttcatcaatgtggccccccacgcacgcatcgcgattcatgccttggccaccaatatgggcgccgggaccgaaggtgccaatgcatcttacattctaatacgtgacacccatagcctgcgaacgacggcttttcacggccaacaggtgctgtattgggagagcgagtcatcacaggctgaaatggaattcagcgaaggttttttaaaagctcaggcttctttacggggccaatactggacacttcagtcttgggtgcctgaaatgcaagatccccagagttggaagggaaaggaggggacc

SEQ ID NO: 5652 - DNA, 4281 bp, Artificial Sequence
  Description of Artificial Sequence: Synthetic coding sequence
atgcaccaacgccatcctagggctagatgtccgccactgtgtgtggccggcattctggcctgtgggttcctgcttggatgctggggaccctcccatttccagcagagctgcttgcaagcactggagccacaggcggtcagctcatacctcagccctggcgcccccctgaaaggaagacctccctcacccgggtttcagcgacagcgacagcgccagaggagagccgccggcggaattctgcacctcgagttacttgtcgctgtgggccccgacgtcttccaggcccaccaggaggacacggaacgatatgttttaaccaacctgaacataggggctgaactgctccgagacccgtccctcggcgcccagttcagagtccacctagtgaagatggtgatcctcacggaacccgagggagctcctaacataacggcgaacctgacttcctctttgctgtcggtatgtggctggagccaaaccataaaccccgaagatgatactgatcctgggcacgctgacctagtgctttatattacaaggttcgacctcgaactccccgatgggaacaggcaggtgcgtggtgtgactcagctggggggagcctgtagtcccacctggtcctgcctcattaccgaggataccggatttgatctgggggtgaccattgctcacgagataggccatagcttcgggctcgagcatgacggagcaccagggtcaggctgcggtcccagcggccacgtcatggcctcagacggggcggccccaagggccggcttggcgtggtccccctgcagtcgacgacagcttctgagcctcctatccgccggcagggcacggtgcgtatgggatcctcccagaccacagcctggttccgctggccatcctcctgatgcgcagcccgggctttactattccgctaatgaacagtgtagagtagccttcgggccgaaggccgtggcttgcactttcgccagagagcacctggacatgtgtcaggccctcagttgccacactgaccccctggaccaaagctcttgctcacgattgctcgtccctctactggacggtaccgagtgtggggtcgaaaagtggtgtagcaaaggccgctgccgatctctggtggagctgacacctatcgcagccgtgcatggaaggtggtcaagctggggaccgaggtctccttgttccagatcatgcggcggaggtgtcgttacacgacgacgccagtgcaataacccgagacccgcgttcggggggcgcgcctgcgtcggtgcggacctccaggcagaaatgtgcaatactcaagcatgcgagaaaacccaacttgagttcatgagtcagcagtgcgctcggactgatggtcagccgctgcgcagctcgcctggcggggcatcgttctatcattggggggctgccgtgcctcatagccaaggcgatgccctctgtcgacacatgtgccgagcaatcggagagagttttattatgaaaaggggagactccttcctggatggtaccaggtgtatgccatccggacctagagaggacggcaccctttcattgtgcgtgagtggtagttgcaggacatttgggtgtgatgggaggatggattcccaacaggtctgggaccgatgtcaagtgtgtggcggggacaactccacctgttcacccaggaaaggaagttttacggcaggtcgtgcacgagagtacgtgaccttcctgacagtcactcccaatctgacctcggtctatattgccaaccatcgaccactgtttactcacttggcagttcgaatcggcggccgttacgtagtggctggcaaaatgtcaatatcccctaacacaacctatccctcattgcttgaggatggtagggtggaatatagagtagctctcactgaggatcgcctcccacggctggaggaaatccgtatttggggaccactgcaagaggatgcagatattcaggtgtacagacgatacggcgaggaatatgggaacctcactagaccggatataacctttacttacttccagcccaaaccaagacaggcatgggtatgggccgctgtgagaggtccttgcagtgtaagctgtggcgcgggacttagatgggtaaactattcttgcctggatcaagccaggaaggagctcgtggaaacagtgcaatgccagggtagccaacagcctccggcttggcctgaagcttgtgttctggaaccttgtcctccatattgggccgtgggtgacttcggtccttgttctgcctcttgtgggggtggactccgagagcgcccagtgcgatgtgtggaagcccagggcagcctcctgaagaccctgcctccggcgcggtgtcgggctggcgcacaacagccagccgtagctttagagacttgcaatccccagccctgccccgctaggtgggaagtgtccgagccatcttcctgtacttccgccggcggggcaggcctggctctggaaaatgagacatgcgtgccaggggccgatggcttggaggcccccgtgacagaaggaccagggagtgtcgacgaaaaactgccagccccagaaccttgtgtcgggatgtcttgccccccaggatggggacacttggatgctacttcagccggcgagaaggccccctctccatggggcagtattagaaccggcgcgcaggcagctcatgtttggacacctgctgctggatcctgtagtgtgtcctgcgggcgaggcctaatggaactgagattcctgtgtatggattccgccctaagggtgcctgtgcaggaggagctctgcgggctagctagtaagccaggatcgcggcgagaagtctgccaagctgtgccctgcccagcaagatggcaatacaaacttgccgcatgctcagtaagttgtggaaggggagtagtgagacggattttgtactgtgctcgagcccatggcgaagacgacggtgaagaaatcctcctcgatacacagtgtcaaggactgccaaggccagaaccacaagaagcatgctctctggaaccatgcccaccaagatggaaagttatgtcactcggaccgtgcagcgcctcatgcggactaggcacagcccgacgcagtgtagcatgtgtccagttggaccaaggccaggatgtcgaggttgatgaggcagcgtgcgccgcactggtgcgaccggaggctagtgtcccctgcttgatcgccgactgcacatatcgctggcatgtcgggacgtggatggagtgttctgttagctgcggagacggaatacaacgtcggcgagatacatgtctgggacctcaagcgcaggcaccggtacctgccgacttctgccagcatttgcccaaaccggttacagttagaggctgttgggcaggcccatgcgttgggcaaggcaccccttccctagtgccccacgaagaagccgccgcgcctggacgaacgacagcgacacctgctggggccagcttagaatggagtcaagcaagaggtctgttgttctcccccgccccacagccacgtcgattattaccaggacctcaggagaactcggtccagtccagcgcttgcgggcgacagcacttggaacctacaggaacaattgacatgcggggcccaggccaagccgactgcgctgtcgctattggccgacccttgggtgaggtggtcacacttcgcgttttagagagctcactgaattgctctgctggcgacatgctgctgctctggggccgactaacgtggcgtaagatgtgtaggaaactgctcgatatgactttttcatctaagacaaatactctcgtggttaggcagcggtgcgggaggcctggtggtggagtactgctgcgatacggcagccaactggcccccgaaacattttatcgggaatgtgacatgcagttgtttggtccctggggagaaattgtgtccccgtcactgtctccagccactagcaacgccggcggatgtagactcttcataaacgtggctccccacgcccggatcgccatccacgccctggcgaccaatatgggcgcaggcaccgagggagctaacgcatcctacatactcatcagggatactcatagcctgagaactactgcatttcatggccagcaggttctttattgggaaagcgagtcttctcaggccgagatggaatttagcgaaggatttctcaaggcacaagcctccctcagggggcagtattggacattgcagtcctgggtgccagagatgcaggaccctcagtcttggaagggaaaagaagggact

SEQ ID NO: 5653 - DNA, 4281 bp, Artificial Sequence
  Description of Artificial Sequence: Synthetic coding sequence
atgcaccagagacacccgcgcgcccgctgcccgccactgtgtgtggcaggcatcctcgcgtgcggcttcctgctcggctgctggggaccatcgcatttccaacagagctgcttgcaagcgttggaaccgcaggcggtgtcctcctacctttcgcctggtgctcccttgaaaggacggccgccctccccggggttccagaggcagagacagcggcagcgccgagcagcggggggaatccttcacctcgagctcctggtggcagtgggcccggacgtgtttcaggcgcatcaagaagataccgagcgctatgtgctgactaatttgaatatcggagctgaactcctgcgcgacccttcgctgggggcacagtttcgcgtgcacctcgtgaagatggtgatcttgactgaaccggagggagccccaaacattaccgctaacctgacgtcctcgctcctgtcagtctgtgggtggtcacaaaccatcaatccagaggacgacacggacccgggacacgcggacctcgtgctttacattaccagatttgatctggaacttccagatgggaaccgacaagtgcgcggggtgacccaactgggaggcgcctgctcgcctacttggtcgtgcctgatcactgaggacactggattcgacctcggcgtgaccatcgcccatgagatcggtcactcattcggactggaacatgacggagcacctggttctggatgtggcccttcggggcacgtgatggcatcggacggagccgcaccgagagcaggcttggcctggtcaccttgctcgaggcgccagcttcttagcctgctcagcgcggggcgcgcgcgttgtgtctgggacccaccccgccctcaaccgggttccgccggacacccaccggatgcacaaccaggcctctactactcggcgaacgaacagtgccgggtggcgttcggtccgaaagcagtggcctgcaccttcgcacgggagcacctggacatgtgccaagccctgtcgtgccataccgaccctctggaccagagctcgtgctcccggcttctggtccctctgctcgatggcaccgagtgtggtgtggaaaagtggtgcagcaaaggtagatgccggagcttggtggaactcactccgatcgccgccgtgcatggaaggtggtcatcgtggggcccgagaagcccctgttcgcgctcctgcggcggaggcgtcgtgaccagaaggcgccagtgcaacaacccgcgcccggccttcggcggacgggcctgcgttggagccgatctgcaagcggaaatgtgcaatacccaggcgtgtgagaaaactcagctcgaattcatgagccagcaatgcgcacgtactgatggccaaccgttgcgctcgtcaccgggaggcgcctcattctaccactggggagcggctgtgccgcacagccagggcgacgcgctgtgccgacatatgtgccgggccattggagaatcgtttatcatgaaacggggcgactcctttttggatggcacgaggtgcatgccatccggcccacgggaggacggtaccctcagcctctgtgtgtcggggagctgtcggacctttgggtgcgacggacggatggattcgcaacaggtgtgggataggtgccaagtctgcggcggagacaattcaacgtgctcgccacgcaaaggttccttcactgcaggacgggcacgcgagtacgttactttcctcactgttaccccaaacctgactagcgtttacatcgccaaccaccgcccgctcttcacccacctggcggtgcgcatcggcggtcgctatgtggtggcaggcaaaatgtcgatcagcccgaacactacctacccgtcactcctcgaggacggccgcgtggaataccgggtcgcactgaccgaggaccgcctgccacgactggaggagatcagaatctggggaccgctgcaggaagatgcggatatccaggtgtaccgaaggtacggtgaagagtacggaaatctcaccagacctgatattaccttcacttacttccagccgaagcctcggcaggcatgggtctgggcggcggtccgggggccctgctcagtgtcgtgcggagccggactgagatgggtgaattactcctgtctggaccaagcgcgcaaggaactggtggaaaccgtgcagtgccaaggttcacagcaacctccggcgtggccggaagcatgcgtgctggagccgtgcccgccgtactgggctgtgggagactttggaccatgtagcgcttcgtgcggaggtggccttagagagcgcccggtgcgctgtgtggaagcacaaggttcgttgctgaaaactctgccaccggcccgctgccgcgccggtgcccaacagccagcggtcgcacttgaaacctgtaatcctcaaccgtgtcccgctagatgggaagtctcggagccttcatcgtgcacctccgcgggtggtgccggacttgctctggaaaacgaaacctgcgtgcccggcgcggatggactggaggccccagtgaccgaaggaccggggtcggtggatgagaagctcccagctccagagccgtgtgtcggaatgagctgtcctcccggatgggggcacctggatgcgacctcagcgggagaaaaggctccgtcaccttggggaagcatccgcaccggagctcaggcagcacatgtctggaccccggccgccggatcctgctcggtgtcgtgcggcagaggcctcatggaactgcggtttctgtgtatggattcagccttgagagtgccagtgcaggaagaactctgcgggctggcctccaagcccggctccaggcgcgaggtttgccaagcggtgccttgtccggcccgctggcagtataagctggccgcatgctccgtctcctgcggtcggggagtcgttagacggatcctttactgcgcccgcgcacatggagaggacgacggcgaggaaattctgctggacactcaatgccagggattgcccaggcccgaaccacaagaggcttgctcgctcgaaccgtgtcccccaaggtggaaggttatgtcgctcggaccatgctcggcgagctgcgggctgggaacggcccgccggagcgtggcgtgtgtccagcttgaccagggacaggacgtggaagtggacgaagcggcgtgcgccgccctggtcaggccagaagcgtccgtcccgtgcctcatagcagactgcacctacagatggcacgtgggaacttggatggaatgctccgtcagctgcggagacggtatccagcggcgccgggacacttgcctcggaccgcaggcacaggctccggtgccagccgacttctgtcaacacctgccaaaaccggtgaccgtgcggggctgttgggcgggaccttgcgtcggacaaggaaccccgagccttgtgccacacgaggaagcggccgcaccagggcgcacgactgccactccggctggcgcctcactggagtggtcccaggccagaggccttctgttttccccagctccccagcccaggcggctgctccccggccctcaagaaaacagcgtgcaaagcagcgcctgcggtcggcagcacctggaacctactgggactatcgatatgcgcggaccaggacaggcggattgcgcggtggccatcggccggccgcttggggaagtggtgacccttcgcgtcctcgaaagctcactgaactgctccgctggagacatgctcttgctttggggaaggctgacgtggcgcaagatgtgccgcaaattgcttgacatgacgttcagctcaaagaccaatacgctggtcgtcagacagagatgcggaaggccggggggcggggtccttctccggtatggatcgcagctggccccggagactttctaccgggagtgcgacatgcaactgttcgggccttggggtgagatcgtctcaccttccctctcccctgctaccagcaatgcgggtggatgccggctgttcatcaacgtcgcgcctcatgcacgaatcgccatccatgcactcgccactaacatgggagccgggaccgaaggcgcaaatgccagctacatcctgatccgagacacccattcccttagaaccaccgcctttcatggacaacaggtgctttactgggaatcggagtcgtcacaagctgagatggagttctctgagggcttcttgaaggcccaggctagccttagaggccagtactggaccctccaaagctgggtcccggagatgcaggacccacagtcgtggaaagggaaggaaggaacc

SEQ ID NO: 5654 - DNA, 4281 bp, Artificial Sequence
  Description of Artificial Sequence: Synthetic coding sequence
atgcatcaacgccacccacgcgcaagatgcccacctctgtgcgtagctggtatcctggcgtgtggctttcttctgggatgctggggaccatcccattttcaacagtcgtgtctgcaggcgttggagcctcaggcagtgtcgtcctacctttccccaggagcaccccttaagggcagacctccatcacctggtttccaacgccaacgtcaaagacaacggagggccgcaggaggaattcttcacctggagctgcttgttgccgtgggcccagatgtgtttcaagcacatcaggaagatactgaaagatacgtgttgactaatcttaacattggagcggaactgcttagggacccatcgcttggagcccagtttcgggtccatttggtcaagatggtgatcctgaccgaaccagaaggagctcctaatatcactgcaaatttgacttcctcccttctttcagtgtgtggatggagccaaactataaaccctgaggacgatactgatccaggtcacgcagatctggtcttgtacataactagattcgaccttgagctgcctgatggtaaccggcaagtgaggggagtgacccaactgggtggtgcgtgtagccctacttggtcctgtcttattaccgaggatacgggatttgatctgggggtgaccattgcacatgagatcggacattcgtttggactggaacacgacggagcgcccgggtcaggttgtgggccatcgggtcatgtcatggcatccgatggagccgcgccacgggctggtctggcatggtcgccatgctccagacgtcaacttttgagcctcctgtccgcaggtagggcacgatgcgtctgggatccacctaggcctcagccaggttcggcagggcatcctcccgacgcacagccaggcctgtattactccgcaaacgaacaatgtcgcgtcgctttcggccctaaagcagttgcttgcactttcgcacgcgagcatctggatatgtgccaagcactctcctgtcataccgatccccttgatcagtcctcatgttcccgtctgctggtgcctctgctggatggaaccgaatgcggagtcgaaaaatggtgtagcaagggtaggtgccgaagtcttgtcgaactgactcctatagcagcagtgcacggcaggtggtcctcgtggggaccacggagcccatgtagcagatcctgtggcggaggcgtcgtgacccgaaggcgtcagtgtaataaccctcgacctgcatttggaggacgtgcctgcgtaggagccgatcttcaagcagagatgtgcaacacccaagcctgtgagaaaactcaactcgagtttatgtcgcagcaatgtgcaaggactgacggccagcctcttagaagctcccctggaggggcctccttttatcattggggcgccgcagtgccacacagccaaggggatgcactttgtagacatatgtgtagagcaattggagaatccttcattatgaaacgtggcgatagtttccttgatggcacgcggtgcatgccgtccggtccgagggaagatgggactctgtcgctgtgcgtgagcggttcgtgtagaacttttggttgtgatggtcgcatggattcccagcaagtgtgggaccgatgtcaagtgtgcgggggtgataattccacttgttcgccccgcaaagggtcatttactgccggacgtgcaagggaatacgtcaccttccttaccgtgactcctaatctgacctcagtgtacattgctaatcaccgcccactttttacccatctggcagtgagaattggtggaagatatgtggtggcaggcaagatgtcgatatcacctaatacgacctacccatcgctgttggaagatggcagagtcgaatacagggtggcattgacggaagatcgccttccaagactggaagagatccgcatttggggtcccctgcaggaagatgcggacattcaggtctacagacgctacggagaagaatacggaaatcttaccagacctgatatcacttttacgtactttcagcctaagccacggcaagcctgggtgtgggccgcagtccgcgggccctgtagcgtctcgtgtggtgcaggactgagatgggtcaactacagctgccttgaccaggcccgtaaagagctggtcgagactgtgcagtgtcagggttcacagcagcctcccgcatggcccgaggcttgtgtcctggagccgtgtcctccttactgggcagtgggagacttcggtccttgtagcgcatcctgcggaggaggactgagagaaaggccagttagatgtgtggaagcccagggaagcctgcttaagacccttcctcctgcaagatgccgcgcaggagctcaacaaccggcagtggcgctggagacttgtaacccacaaccctgccccgcacgttgggaagtttccgagccctcgtcgtgtacttcagccggcggcgcaggactcgcccttgagaacgaaacttgtgtccctggtgcagacgggctcgaggcaccagtgaccgaaggtccaggttcagtggatgagaagttgcctgctcccgaaccgtgcgtgggtatgtcatgcccccctggatggggtcatctggacgcaactagcgcaggagaaaaggcaccgtcgccttggggttccattcggaccggagcccaagcagcacatgtgtggactcctgccgctgggtcgtgttccgtgtcatgcggaaggggcctgatggaacttcgctttctttgtatggatagcgccctgagggtgccggtgcaagaagaactgtgtggtctggcgagtaagcccggatcccgccgggaggtctgtcaggctgtcccctgcccagcaagatggcagtacaaacttgcagcctgctcagtgagctgtggtcggggagtggtgagacgtattctttactgcgcacgtgctcatggtgaggacgatggcgaggagatactgctggacacccagtgtcaaggtctgcccaggccggaacctcaagaggcatgtagccttgaaccatgtcctccaaggtggaaggtcatgtcactgggtccatgcagcgcatcctgtggacttgggaccgctcgacgaagtgtggcctgtgtgcaactggaccaaggtcaggacgtggaagtcgatgaagcagcgtgcgcggctttggttagaccagaggcaagcgtcccctgtttgattgcggattgcacctacagatggcacgtggggacgtggatggaatgtagcgtgtcgtgtggtgacggtattcaaaggcgacgcgacacttgtctcggaccacaagcccaagcacccgtcccagcagacttctgtcaacatttgccgaagcccgtcactgtcaggggctgctgggccggtccatgtgtgggtcaaggaacccctagcttggtcccacacgaagaagccgcggcgccaggacgtaccacggctactcctgcaggcgcatcactggaatggtcacaggcacgtggcctgctgttttcacctgcaccacagccacggcgacttctgccgggaccgcaagaaaactcggtgcaatcatccgcttgcggacgacagcacctggagcctaccgggaccattgacatgcgaggcccaggacaagccgattgtgccgttgccatcggtagaccgctcggagaagtggtgaccctccgggtgcttgagtctagcttgaactgttctgctggtgacatgctcctgctgtgggggcgcctcacgtggagaaagatgtgtcgcaaacttctggacatgactttctcgtcgaaaactaacaccttggttgtccggcaacggtgcggtcggcccggaggaggcgtgctgcttcgctacggctcacaattggcacctgaaaccttttaccgagaatgtgatatgcaactgtttggcccctggggggaaatcgtgagcccaagcctttcacctgctacctcgaatgccggtggatgccggttgtttatcaatgttgcacctcacgcgagaattgccattcacgcgctggcaaccaatatgggtgctggtaccgaaggagcaaacgcctcgtacattctgattagagatacccactcgcttcgcaccaccgcgtttcacggccagcaggtgctttactgggaatcagagtcctcacaggcagaaatggagttctcggagggattcctcaaggcgcaagcgtcgcttagaggccaatactggaccttgcagagctgggtgccggaaatgcaggatccacaatcgtggaaggggaaggaaggaact

SEQ ID NO: 5655 - DNA, 4281 bp, Artificial Sequence
  Description of Artificial Sequence: Synthetic coding sequence
atgcaccagcgccaccctcgagctaggtgtcctccactctgtgtggccggcatcctggcatgcgggtttctccttggatgttggggtccttcccactttcaacagtcctgccttcaagcacttgaaccccaagcagtgagctcctaccttagcccaggcgcacctctgaagggtcgccctccttctcccggatttcagagacaacggcagcggcaaagacgggctgcaggcggaattctccatctggaactgctcgtggccgttggacctgatgtgttccaggcgcatcaggaagataccgagaggtacgtgcttaccaacttgaatattggcgcagaacttctccgcgaccctagcctgggggctcagttccgagtgcaccttgtcaaaatggtcattcttacggagcctgaaggcgcacctaacataaccgccaacctgacttcgtccctgctttcggtgtgcggatggtcacagactataaacccagaagatgataccgatcctgggcatgccgacctggtgctctacataactagatttgaccttgagctgccagatggaaacagacaggttcgcggggtgacgcaactgggtggagcatgtagcccaacctggagctgcctgatcactgaagatactgggtttgacctgggcgtgaccatagcccatgaaatcggtcattcttttggtctggagcatgatggggcacctggttccggctgcggtccatccgggcatgtcatggcctctgacggtgcggcgcccagagcaggattggcgtggtccccctgctcgcgccggcaactcctttcattgctgtcggccgggcgggcaaggtgtgtgtgggatcctccccgtccacaacctggatcggccggacatccaccagatgcacaacccggtctttactactcggctaacgagcaatgcagagtggcctttggaccaaaggctgtcgcatgtaccttcgcccgggagcacctggacatgtgtcaagctctgtcctgccacactgatcctctggatcagtcgagctgttcgaggctgcttgtgcccctgctcgatgggactgagtgcggagtggagaaatggtgctcaaaaggacgttgtaggtcactggtggagcttactcccattgccgcagtgcatgggaggtggtcctcttggggaccccggtcaccttgttctcgatcctgtggaggcggtgttgtcacccggagacgccaatgcaacaatccccgcccagcgtttggtggacgggcctgtgtgggggcagatcttcaagccgaaatgtgtaatacgcaagcgtgcgaaaagactcagttggagtttatgtcgcaacagtgtgccaggactgacggtcaaccgctgcgctcgtcccctggtggggcgagcttctaccactggggtgcagcagtccctcattcgcaaggtgatgcactctgtaggcatatgtgtcgcgcaatcggcgaatcgtttatcatgaagagaggagatagcttcctggatggaacccggtgcatgccttcagggcctagagaagatggaactctgtccttgtgtgtgtcgggatcgtgtagaacctttggttgtgatggaaggatggattcgcagcaagtgtgggatcgttgccaagtgtgtgggggcgacaactccacgtgtagccctcgtaagggttcgttcaccgccggaagagcacgcgaatacgtcacttttctcaccgtgacccccaacctgacctcagtgtacatcgcgaatcaccgtccgttgtttacccatctggcagtacggattggtggacggtatgtggtggcgggcaaaatgagcatttcccccaatactacctaccctagcctgctggaagatggtagagtcgagtaccgggtggcactcactgaggatcgcttgcctcgcctcgaggaaattagaatctggggaccattgcaagaagatgcagatatccaggtctatagaagatacggagaggagtacggcaacctcactaggcctgacattaccttcacctattttcagccaaagccacgccaagcctgggtttgggcggcagtgagaggaccctgttcggtgtcttgtggagcaggtctgaggtgggtcaactactcgtgccttgatcaggcgagaaaggaactcgtggaaaccgtgcagtgccaaggatcgcagcaacctcccgcatggcctgaagcgtgcgtgctcgaaccatgtcccccttactgggcggtcggagacttcggcccttgttctgcaagctgtggaggaggcctgagagaacgtcccgtgaggtgtgtggaggcacaaggctccctgcttaagacgctgccacccgccagatgcagagcaggagcacaacaaccagcagtggcactcgaaacctgcaacccacagccttgtccagcacgatgggaagtgtcagagccgtcctcttgtacttcagcaggaggtgcaggacttgcactcgaaaatgagacttgtgtgcctggtgctgacggcctcgaagcacctgtcactgaaggacctggatccgtggatgaaaaactccccgcacctgaaccgtgcgtggggatgtcctgccctccaggatggggacacctggacgcaacttctgctggagaaaaggccccatccccttgggggtcaattcgaactggagcacaggccgcacatgtgtggactcctgctgccggatcatgtagcgtcagctgcgggcgagggctcatggagctcagatttctctgtatggattctgcgctccgggtgcctgtgcaggaggaactttgtggccttgcatcaaagccgggatccagaagggaagtgtgtcaggccgtcccttgcccggcgaggtggcagtacaagctggctgcttgttcagtctcatgtggcagaggggtggtgcgtagaattctctactgcgcgcgggcacatggcgaggatgacggagaagaaattctgcttgatactcagtgccaaggcctgccccgacccgagccccaggaagcgtgttctttggagccctgtccaccacggtggaaagtgatgtcactgggtccatgcagcgcatcatgcggcctcggaactgcccgacgttcggtggcctgcgttcagctggaccagggccaggatgtcgaagtggacgaagcagcatgtgcagctctggtccgcccggaggcatcggtgccatgcctgattgcagactgcacttacagatggcacgtagggacctggatggaatgttctgtctcatgcggagacggaattcagcggcgccgcgatacttgtcttggcccgcaagcacaagcacctgtccctgcggatttttgccaacatctgcctaagccagtgaccgtcaggggctgctgggctggcccttgtgtgggccagggaacgccttccttggtgcctcacgaagaagcagcggcaccaggcagaacgacggcaacccctgcaggagcaagccttgaatggtcccaagcgcgcggactcctcttctcccctgctcctcagcctcggaggctgcttcctggtccgcaagaaaatagcgtgcaatcgtcggcctgcggacgccaacatctggagccgactgggactatagatatgagaggcccaggccaggcagattgtgccgtggcaattggacgaccgctcggcgaagttgtgacccttcgtgtccttgagtcctcgctcaattgttcggcaggcgatatgcttctcctttggggtagactgacctggcgcaagatgtgccggaagctcctcgatatgaccttcagctctaagaccaataccctggtggtgcgccaaaggtgcggacgcccaggtggaggcgtgctgctgcgctacggttcacaattggcacccgaaacgttttaccgtgagtgtgatatgcaacttttcgggccgtggggagaaatcgtttcgccttccctttcgcctgcaacctcgaacgcaggagggtgtaggctcttcatcaatgtcgcacctcatgccagaatcgcaattcatgcgcttgcaactaacatgggtgcaggtactgagggtgccaatgcatcgtacatcttgattagagacactcactcacttagaaccaccgcatttcatggtcaacaagttctttattgggaatccgaaagctcccaggccgaaatggagttcagcgaggggttcctgaaagcgcaagcaagcctgcgcgggcaatactggaccttgcagtcgtgggtcccagaaatgcaagaccctcaaagctggaagggcaaggagggaact

SEQ ID NO: 5656 - DNA, 4281 bp, Artificial Sequence
  Description of Artificial Sequence: Synthetic coding sequence
atgcatcaacggcatcctcgagcgcgctgtcccccactttgcgtggctgggatcctggcatgcggctttctgctgggttgttggggcccttcacatttccagcagagctgcctccaagccctggaaccacaggcagtctcgtcctacttgagccccggagcaccactgaagggacgccccccttcgccaggatttcaacggcaacgccagcgccaaagacgtgccgcaggagggattcttcatctggagctcctggtggcggtgggacctgatgtctttcaagcacaccaagaggacaccgaacggtatgttttgactaacttgaacattggcgcagagctgctcagggatccttcccttggagcacaatttcgggtccacctcgtgaagatggtgatcctgaccgaaccggagggtgcccctaacattactgccaaccttacgtcatctctgctttcagtgtgtggatggtcccaaactatcaatccggaagatgatactgatcctggccatgcagacctggtgctgtacataacgagatttgatctcgaactccccgacggaaacagacaagtcaggggtgtgacccaactgggtggcgcatgttcgcctacctggagctgtctgattaccgaagataccgggtttgatctcggcgtgacgatagcacatgaaatcggacactcgttcgggctggaacatgatggtgcaccagggtcgggttgtggacctagcggtcatgtgatggcatccgacggtgcagcaccaagggcggggctcgcgtggtcgccatgttcgcgcagacaactgttgtccctccttagcgctggacgcgcgagatgtgtctgggatccaccgcgacctcagccaggatccgctggacatcctcccgacgcacagcctggtctgtactactcagcaaacgagcagtgtagggtggcatttggtccgaaggcggttgcttgtaccttcgctagagaacacctcgatatgtgtcaggcactgagctgccacacggatcccctggatcagtcctcgtgttcgcgcctgctggttccccttttggacggaactgagtgtggggtcgagaagtggtgttcgaagggccgttgtaggtcactggtcgagctgactcccatagcagcagtgcacggaagatggagctcatgggggccacggtccccatgctcacgttcgtgcggtggcggagtcgtgactaggcgccgccaatgcaataatcctaggccagcattcgggggaagagcatgtgtgggagccgatctccaagcagagatgtgtaacacccaggcatgtgagaaaactcagctggagtttatgtcccagcaatgtgccagaactgatggccagcctttgcgatcctcacccggaggagcctcgttttaccattggggcgcagctgtccctcactcacaaggagatgcactgtgtaggcatatgtgtagggcaattggggagtcattcatcatgaaaagaggcgactcatttcttgacgggactagatgtatgccgagcggaccccgtgaagatggaactctgagcctgtgtgtgagcgggtcgtgtagaacctttggatgtgacggacgtatggactcacagcaagtgtgggatcgctgtcaagtttgcggtggtgataacagcacttgctcaccacggaagggctcctttactgcaggtagggcacgtgaatacgtgacgtttctgactgtgactccaaacctgactagcgtgtacatcgccaaccacagacctctgttcacccacctggccgtgcgcataggagggagatacgtcgtcgcaggaaagatgtcgatctcccccaatactacgtatcccagcctgctcgaagatgggcgggtggaataccgtgtggctcttaccgaggatcgcctccctcggctggaagaaataagaatttggggtccactgcaggaagatgcagacatacaggtgtacaggagatacggagaagaatacgggaacctgaccagacctgacattaccttcacctactttcagcctaagccacggcaggcctgggtctgggcggcggtgcgcggaccgtgctcggtgtcgtgcggtgcgggtctgcgctgggttaactactcctgccttgatcaagcacgtaaggaacttgtggaaactgtgcagtgccaaggttcccaacagcctcctgcctggcctgaagcatgcgtgctcgaaccgtgcccgccttactgggcagtcggagactttggtccctgttcggcctcgtgtggcggggggctgcgagaacgccctgtgcgatgtgtcgaagcacaaggtagcttgctcaaaaccctgccccccgccagatgtagagcaggtgcgcaacaacctgctgttgccttggaaacctgcaatccgcaaccctgtcctgcgcgctgggaagtgtcggaaccaagctcctgtactagcgcaggaggtgcggggcttgcactggaaaacgaaacctgtgtgcccggcgctgatggacttgaggcccctgtgactgaaggacctggatcagtggatgagaagttgccagcacccgaaccttgtgtcggaatgagctgtccacctggttggggacaccttgatgcaactagcgcgggcgagaaggcaccatcgccgtggggttccattagaactggcgcacaggcagcgcatgtctggactccagcagcaggaagctgttccgtgtcgtgcggcagaggactcatggagctcagatttctttgtatggattcggcactgagggtccctgtccaagaggaactttgtggactcgcctcaaaacctggatcgaggcgtgaggtgtgtcaggcggtgccatgtccagcaagatggcaatacaagttggcggcctgtagcgtcagctgtggtagaggtgtcgttcgtcggattctttactgtgcaagagcacatggcgaggacgatggagaggaaatcctgcttgatacccagtgccaggggcttccaagacctgaaccccaggaggcatgttccctggagccgtgcccaccccggtggaaggtgatgagcttgggtccctgttcagcatcgtgtggacttggaaccgcacgaagatcagtcgcttgcgtccagcttgatcagggtcaggatgttgaggtggatgaagccgcctgtgctgcactggtgcgccctgaagcaagcgtcccttgcctgatcgcggactgcacttacagatggcacgtgggaacctggatggaatgttcggtgtcatgcggagacggtatccaacggagacgggacacctgtctgggaccacaagcccaagccccagtgccagcagatttttgccaacatcttcctaaacctgttactgtgcgaggatgctgggcgggtccatgcgtcggacaaggcaccccctcacttgtgccccatgaagaagccgcagcaccaggacgaactactgccacccctgccggcgcctcccttgaatggtcgcaggcacgtggactgctgttctcccctgcacctcagccaagacggctgctgcctggtccccaagaaaactcagtgcagagctcagcctgtggtagacaacatcttgaacccactggaaccattgatatgagaggaccagggcaagccgattgtgcagtggccattggtagaccactcggcgaagtcgtgactcttcgtgtgcttgaatcatcccttaattgctcagcaggggatatgctgctgctgtggggacgcctgacttggagaaagatgtgccgtaaactgctcgatatgacctttagctcaaagacgaacactctcgtggtgcgccagaggtgtggccggccgggcggcggagttctgctgaggtacggttcgcaacttgcccctgaaaccttttacagagaatgcgacatgcaattgttcgggccttggggagagattgtgagcccatccctctccccggcaacttcgaatgccgggggatgcagactgtttatcaatgtggcaccgcatgctagaattgccattcatgccctggccaccaacatgggcgcaggcaccgagggagctaatgcatcgtacatcctgattagagatacccattctctgaggactactgcgtttcatggacaacaagtcctttactgggaatcggaatcctcgcaagccgagatggaatttagcgagggctttcttaaagcccaggcgagccttaggggacagtattggaccctgcagtcatgggtgccagagatgcaagacccccagtcgtggaaggggaaggaaggaact

SEQ ID NO: 5657 - DNA, 4281 bp, Artificial Sequence
  Description of Artificial Sequence: Synthetic coding sequence
atgcatcaaaggcacccaagggcacggtgtcctccgctatgtgtagcagggatcttggcctgcggcttcctcctcggatgttggggaccaagccattttcagcagtcttgtctgcaggccctggaaccacaagcagtgtcctcatacctctccccgggcgctcctctcaaagggaggcccccttctcctggtttccagcggcagcggcagcggcaaaggagagccgcagggggtatcctgcatctggagctgcttgtcgccgtaggaccagacgtctttcaggcccaccaagaagacacagaaagatacgtgctgacgaacctcaatatcggagctgagctgctgagagatccaagtttaggagctcagtttcgcgttcatctggtgaaaatggtcattttaaccgagcccgagggggccccgaacataactgcgaacctaacaagcagcttgttgtcggtctgcggctggtcacaaactataaatcccgaagatgataccgaccccggacacgctgatctggtgctctacattacccgctttgaccttgagctaccggacggcaatcggcaggtgaggggcgtgacacagctgggaggagcatgctccccaacctggtcctgcctgattaccgaagacaccggatttgacttgggagtgaccatagcacacgagataggacactcgtttgggcttgagcatgacggcgcacccggttcaggctgtggtccctctggtcatgtgatggcatcagacggcgctgcaccccgggctggcttagcgtggtccccatgcagcaggagacaactgctctccctgcttagcgcgggacgggcaaggtgcgtctgggacccaccaagacctcagcctgggtccgctgggcacccccccgatgcccagcccggcctatactatagcgcaaatgaacagtgtagagtggcgtttggcccaaaggcagtggcctgcaccttcgctagggagcacctcgacatgtgccaagctctgtcttgtcataccgacccacttgatcagtcaagttgctcccgcctacttgtgccgctgctggacgggaccgagtgtggcgttgagaaatggtgctctaagggccgctgtaggtctcttgtcgagctgaccccaattgctgcagttcatggacgttggtcttcatggggcccacgctcaccctgcagtagatcatgtgggggcggggtggtgactaggagacgccagtgtaacaaccctcgcccggcgttcggcgggagggcttgcgtcggggcggacctacaggcggaaatgtgtaacacacaggcctgcgaaaaaacacaactggagttcatgagccaacagtgcgcacgcaccgacggtcagccgctccggtctagtcctggaggagcctcattctaccactggggggctgctgtgccccacagccaaggggatgccctctgccgacacatgtgtagagccatcggggagagcttcattatgaaacgcggagatagcttcttagacggcactcgctgtatgccttccgggcctcgcgaggatgggacactctccctctgcgtatctggcagctgtagaacattcgggtgcgacgggagaatggacagccagcaggtgtgggatcgatgccaagtctgcggaggcgacaatagtacctgttcaccacggaagggatcctttactgccgggagagcaagagagtacgtaacattcttgaccgtgaccccgaatctaacatcagtgtacattgccaatcacagacctctgttcacacacctggccgtccgcataggcggcagatatgtggttgcagggaagatgagtataagcccgaacactacttacccaagcctgctcgaggatgggagagtcgagtacagagtggccttgacggaagaccgcctaccaaggctggaggagattcggatctggggtccactccaggaagacgccgatatccaggtctaccggcgatacggcgaggagtatggtaaccttacgcggcccgacatcaccttcacctatttccagccaaaacctcgtcaggcctgggtgtgggcagccgtgaggggcccttgctcagtcagttgcggtgcagggctccgttgggtcaattattcctgtctggaccaagcacgcaaagaactggtggagactgtacagtgtcagggaagccagcagcctcccgcttggcccgaagcatgcgtattagagccctgcccaccatattgggcggtgggtgactttggaccttgcagtgcttcctgtggcggcggcctgagagaacggccggtccggtgtgtcgaggcacagggaagtctcctcaagactctaccacctgccaggtgtagggcaggggctcagcaacctgcagtagcgctggaaacttgtaatccacagccttgcccggctagatgggaggtgtcggagccttcttcctgcacgagcgcagggggagcgggtcttgctcttgaaaacgagacttgcgtccccggagccgatgggctcgaagctccagtcaccgaagggcccgggagcgtcgatgaaaaactgccagcccccgagccctgcgtgggtatgtcatgtccgccgggctggggacacttggatgcaacctcagcgggggagaaagcgccatcaccatgggggagtattcggacaggcgcacaggctgcccacgtatggacaccagccgccggctcctgcagcgtctcttgcgggaggggcttaatggagttgcggtttctatgtatggacagcgctcttcgcgttcccgtccaggaggaactgtgtggcttggcttccaaacccggcagcaggcgcgaggtttgccaggcagttccttgtccagcccgatggcagtataagctggccgcatgcagcgtatcttgtggccggggtgtggtcaggcgcatactttattgtgccagggcccacggggaagacgatggagaagaaattctgcttgacacccagtgccagggactgcctcgcccagaaccccaggaagcctgctctttggagccgtgcccacccagatggaaggttatgtccttagggccatgttctgccagctgtggcctcggtaccgcgagaaggtctgtggcttgcgtccaattggatcagggacaagacgtggaggtggatgaggctgcgtgtgccgccctggtgcggccagaagcctcggtgccatgtctgatcgctgactgcacctatcggtggcacgtcggcacttggatggagtgtagtgtgtcatgtggggacggtatccagagacggagggacacatgtttggggccgcaagctcaagcacctgtgcccgcggacttctgccagcacctgcccaagccggttaccgtgcggggatgttgggcaggcccttgtgtcggccaaggtacacccagtttggttccgcacgaggaggcggccgcacctggacggacaactgctacccctgccggagcgagcttagagtggagtcaagcacgaggactactgttttctccagccccacagcctcggcgcttgctgccgggtccccaggaaaactccgttcagtctagtgcgtgtgggagacagcatcttgaacccacaggtaccattgatatgcgaggtcctggacaggcggactgcgcagtggccattggaaggccactaggtgaggttgtgacgctcagagtcctcgaatcttctctgaattgcagtgccggggacatgcttctactgtggggcaggttgacttggcgcaaaatgtgtagaaagctcctggatatgaccttttccagtaagacaaataccctggtcgtgcgccaacgctgcggtcgacccggaggcggagtactgctgcggtacgggtcccagctggcgccagaaaccttctatagagagtgcgatatgcagttgtttggcccatggggcgagatcgtatccccttccctctctcctgcaacgtcaaatgctggcggctgccgtcttttcatcaacgttgcccctcacgctagaatcgccatccacgccctggcaacaaatatgggcgctgggacagagggtgctaacgcttcctacattctcatcagagacacccatagccttcgcacaactgctttccacggccagcaagtgctgtactgggagtcggagtcttcacaggcagagatggagtttagcgaaggcttcctcaaagcacaggccagcttacggggccagtactggacgttgcaatcctgggtacctgagatgcaggacccacagagctggaagggaaaagagggtacc

SEQ ID NO: 5658 - DNA, 4281 bp, Artificial Sequence
  Description of Artificial Sequence: Synthetic coding sequence
atgcaccagcgccatccccgcgcaagatgcccccccttgtgcgtcgctgggattctggcatgcggtttcctccttggttgttgggggccctcgcactttcagcagtcttgtctgcaagctctagaaccccaagctgtgtcctcatacctatcacctggagcacctctgaagggacgacctccgagccctggattccagcggcaacgacagagacagcggagggcagcaggaggcatcttgcacctggaactgctggtggccgtcgggcccgacgttttccaggcacaccaggaagataccgagaggtacgtgctcactaacttgaatatcggagcagaacttctccgcgatcctagtctgggtgcccagtttagggtgcatctggtcaagatggtgattctgacagaaccagagggagcacccaacataaccgccaacttgaccagctccctgctctcagtgtgtggatggtctcagacgatcaatccagaggatgacacagacccggggcacgcagacctggtgttatacatcaccaggttcgatttagaactgcccgacggcaatcgacaggtgaggggggttacccaactaggtggcgcttgcagcccaacatggagctgcctgattaccgaggacacaggatttgatctgggtgtgacaatagcccatgagatcggccactctttcggactagagcatgatggcgctcccgggagtggctgcggtccatccgggcacgtcatggcgagcgatggagcagctccgagggcaggactcgcctggtcaccgtgctctaggagacagctgctatccttgctgagcgccgggcgggccaggtgtgtttgggacccgcccagacctcaaccagggtcagccgggcatccgcctgatgctcagcctggcctgtactattccgcgaacgagcagtgccgagtcgcattcgggcccaaggccgtcgcctgtacatttgctcgagaacatctggacatgtgccaagccctcagctgccacaccgacccgctggatcagtcttcatgctcacggttgcttgttccactcttggacggtaccgaatgcggggttgaaaaatggtgctccaaaggacggtgcagaagcttggtggagcttacgcctatcgcggccgttcacggtagatggagttcttgggggccacggagtccctgctcccgttcatgcggcgggggcgtggtcacgcgacgcagacaatgcaacaatccccggcccgcctttggcggtagagcttgcgtcggagcagatctgcaggcagagatgtgtaatacccaagcgtgtgaaaagacgcagctcgaattcatgtcccaacagtgcgcccggacagacggtcagcccctgaggtcctcacccgggggggcaagcttctatcactggggcgctgccgtcccacactcacaaggcgatgctttgtgcaggcatatgtgtagggcaatcggcgagtcattcataatgaagaggggcgactcatttctggacggaaccagatgcatgccatcaggcccacgcgaggacgggacactgtcattgtgtgtctcgggatcctgcaggaccttcggttgtgatggacgtatggactcgcaacaggtgtgggaccgctgccaggtttgcggcggtgataattcaacttgtagtccccgtaaaggcagttttactgcaggccgcgcgcgcgaatatgtgacattcctgacagtaacaccaaatctgacaagcgtttatatagcgaatcaccggcctctgttcacacatcttgccgtccgaattggcgggcgatacgtcgtggcagggaagatgagtatctccccaaacacgacttacccatcgttgctggaagacggtagagtggaataccgtgttgcactcaccgaggatcggcttcctaggctggaagaaattagaatctggggtcctctccaggaagatgctgatattcaggtctacaggcggtatggcgaagagtacggcaatctgaccagacctgacataacgttcacttacttccagcccaaaccacgacaagcatgggtgtgggccgccgttcgggggccttgttctgtgtcctgcggcgccggtctccgatgggtaaactattcctgtctggaccaggccagaaaggagctggtggaaaccgtgcagtgccagggttctcagcagccccccgcctggcccgaggcctgtgtcttggagccctgtccgccttattgggcagtgggggacttcggtccttgttctgcttcctgcgggggcgggcttagagagagacccgttcggtgcgtcgaggctcagggaagtctgctgaagacgctgcccccggcacgttgcagggccggcgcacagcagccagctgtagcactggaaacctgcaatccacaaccatgcccagctcggtgggaggtatctgaaccatcatcatgcactagcgccgggggtgctggtttggccctcgaaaacgagacctgtgttccaggagctgacggtctcgaggcgcctgttacggagggtcctggatccgttgacgaaaaacttcccgctcccgaaccttgtgtaggcatgagctgtcccccaggctggggccatcttgacgcaaccagcgccggggaaaaagctccctccccttgggggtctattagaacaggggcacaggctgcccacgtctggacacccgcagccggatcctgcagcgtgtcatgtggcagaggactgatggagctgaggtttttgtgcatggattccgccctgagggtgcccgtgcaagaggagttatgtggcctggcttcaaagcccgggagtcgaagagaggtttgtcaggcggtgccgtgtccagcgcggtggcaatacaaattagcggcctgcagtgtgagctgtggccggggcgtagtgcgccggatcctatattgtgccagagcccatggagaggacgacggcgaagaaatcctattagacacacagtgccagggcctgccgaggccagagccccaggaggcctgctctcttgagccgtgccctcccagatggaaggtgatgtcgcttggaccatgtagtgcctcgtgcgggctaggtacggcccgacggagtgtagcatgtgtccagctggaccaggggcaggacgtggaggtcgacgaggccgcgtgtgccgcgctggtccgacccgaggctagcgtcccttgcttaatcgccgactgtacctatcgctggcatgtgggcacatggatggagtgttcggtcagctgcggcgatgggatccagcgcaggagggatacctgtctgggcccacaggctcaggcccccgtccccgctgacttctgccagcacctgcctaagcccgtgaccgtcagagggtgctgggccggtccctgtgttggacaaggaaccccttctcttgtgcctcatgaggaggccgccgctcccggacgcacaaccgcaacaccggctggcgccagcctggaatggtctcaggctaggggtctattattttcacccgccccacagccacgacggcttctgcctggcccgcaagaaaatagcgtgcaatcttctgcctgtggtaggcagcacctggagcctaccggtactatcgacatgcgagggcctggacaggctgattgtgccgtggccatcgggagaccccttggcgaagttgttacccttcgagtcctggagtcgagtctgaactgtagtgccggggacatgctgttactctggggtaggctcacttggcgcaaaatgtgccggaagttgttggatatgactttcagttcaaaaactaacacccttgttgtgagacagcgatgtggccgccctggaggaggtgtccttctccgctacggatcacagctcgcacccgaaaccttctacagagagtgcgatatgcaactttttgggccatggggcgaaatcgtgagcccctctctgtcccccgctacgtccaacgcggggggctgccggttgttcatcaatgtcgctccccacgcgcgaatcgcgatccatgcgctggctactaacatgggagcaggtaccgaaggtgcaaacgcctcttatattcttatacgagacacccacagtctaagaactactgcctttcatggccagcaggtgctatactgggaatccgagtccagccaggcagagatggagttcagcgagggatttttgaaggcccaggcatcattgaggggtcagtactggactttgcagtcgtgggttccggaaatgcaggaccctcagtcatggaaaggaaaggaggggaca

SEQ ID NO: 5659 - DNA, 4281 bp, Artificial Sequence
  Description of Artificial Sequence: Synthetic coding sequence
atgcatcagcgccacccccgcgcaagatgtcccccgctatgtgtcgccgggatcctggcctgcggcttccttctggggtgctgggggccgtcccacttccagcagagttgcctccaagcgctggagccgcaagctgtcagcagctacctgtcgccgggggcccccctaaagggtcggcctccctctccgggctttcaacgtcagagacagagacagagaagggctgccggtgggatcttgcatttggaactgctggtggccgtggggcctgatgtctttcaggctcaccaggaagacacggagagatatgttctgacaaacctcaacattggggcggagctcctgcgtgatccatctctgggggcgcagttcagggtccacctggtgaagatggtgatcctcacggaacctgagggcgctccaaacatcaccgccaatctgacctccagtcttctgtctgtttgcggatggagtcagaccataaaccctgaggacgacacggatccagggcacgcagatttggtactgtacattacacgtttcgatctggaacttcccgatggcaacagacaggttaggggagtgacacagcttggcggggcttgtagtcccacctggagttgcctcatcacagaggacacaggattcgaccttggcgtgacaatagcccatgagataggtcactccttcggactggagcacgacggtgctcctggaagtggctgcgggccgagcggccacgtgatggccagcgacggggcggctcccagagcgggcctggcctggtcaccgtgctctcggaggcagctgctttccctgctgtctgccggtcgggcgcggtgtgtgtgggatccccctcggccgcagcctggatcagctggacacccccctgatgcacagcccggactgtattattccgctaatgagcagtgtcgggtggccttcggacctaaagcagtggcctgtacgttcgccagagaacacctggacatgtgccaagcgctgtcctgtcacacagacccccttgaccagagctcctgcagtagacttcttgtcccgcttctcgacgggactgagtgcggcgtcgaaaaatggtgttccaagggaagatgcaggtcactggtggaactgaccccaatcgcagcagtgcacgggaggtggagctcctggggaccccgttcaccttgctcccggtcttgcggagggggcgtcgtgacgaggcgccggcagtgtaataatcctcggccggcgtttgggggcagggcctgtgttggcgctgacctccaggcggagatgtgcaatacccaggcttgtgaaaaaactcagcttgaattcatgtctcagcaatgtgcacggacagatggacagcccttaagaagttcccccgggggggctagcttctatcactggggtgcagccgtgccccatagccaaggggacgcactttgcagacatatgtgcagggccatcggcgagagctttattatgaaacgcggggacagcttcctggacggaacgcgctgcatgccatccgggccacgagaggatggaacgctgtccttatgcgtcagcggctcttgtcggacattcggatgtgacgggagaatggattctcaacaggtctgggacaggtgccaggtgtgtggtggggataacagcacctgttccccacgcaaaggaagctttacagccgggagggcgcgagagtacgtgacgttcctcactgtaacacccaatcttacctctgtgtatatcgcgaatcacaggcctctcttcactcacctggctgtccgcatcggaggaaggtacgtggtggcagggaaaatgagtatctccccaaacactacctatccctcgctgttggaggatggaagggtggaatatcgcgtcgccctgaccgaagaccggctgccccggctagaagaaattcgaatctgggggcccctgcaagaggacgccgacatccaagtgtatagaaggtacggggaggagtacgggaaccttacccggccagacattaccttcacctatttccagccaaagcccaggcaagcctgggtctgggctgcagtgaggggcccttgttctgtcagctgcggggccggcctccggtgggtaaattattcctgtttggaccaggcgcggaaggaacttgttgagaccgtccagtgtcagggatctcagcaaccccccgcctggcctgaggcttgcgtgctggagccttgcccgccatactgggccgtgggggatttcgggccgtgttccgcgtcttgcggcggcggcctgagggagcggccggtgcgctgcgtcgaggcacagggctccctcctgaagaccctccctcccgcccgatgcagggccggagcgcagcagcccgcagtggcccttgaaacatgcaatccccagccttgtcccgccagatgggaagtgtctgaaccctcctcctgcacgagcgcgggcggggcaggacttgctttggagaatgagacctgtgtccccggcgccgacgggctagaagcccctgtgactgaaggccccgggtccgtggatgaaaagctaccggcccctgagccctgcgtcggaatgtcgtgcccccccggatggggccatctagatgccacctcagctggagagaaggcaccgagtccctgggggagtatcagaacgggggctcaggctgctcacgtgtggacccccgccgccgggtcctgtagcgtgtcctgtggcaggggtctgatggagctcaggttcctgtgtatggacagcgcactccgggttccggtgcaagaggaactttgcggactggcttccaagcctgggtcacgccgcgaagtctgccaggctgtgccctgccccgcaagatggcaatataagctcgccgcctgttccgtaagctgcggccggggggtcgtgaggaggattctgtattgcgcccgcgcccacggggaggatgacggggaggagatcctcctcgatacccagtgtcaaggcctgccaaggccggagccacaggaggcctgcagcctggaaccttgtcctccacggtggaaagtgatgtccctaggaccgtgcagcgccagctgcggcttaggcacagcaaggcgctcggtggcctgcgtgcagttggatcagggacaggatgttgaggtggatgaagctgcatgtgctgccttagtccggcctgaggcctcagtcccttgcttaatcgccgactgtacctacagatggcatgttggcacatggatggagtgttccgtgtcgtgtggcgatggtatccagcgtcgacgcgacacctgcctgggtccccaggcccaagctccagtcccagcggacttttgccagcacttacccaagcccgtcaccgtgcggggatgctgggctggaccatgtgtcggacaaggtacccctagtctggtgcctcatgaagaggccgccgcacccggcagaactacggccacacccgctggggcatctctcgaatggtctcaggcccggggactcctgttcagcccggcccctcagcctcgtaggctgctgcccggcccccaggaaaattcagtgcagtccagcgcctgcgggagacagcacctggagcctaccggcactattgacatgcgtggtcctgggcaggccgactgtgctgtggctatcggtagaccccttggcgaggtggttaccctcagagtcctggaatccagcctcaactgtagcgcaggagacatgcttctgttgtgggggcggttaacctggaggaaaatgtgtcgcaagctgttggatatgacattttcaagcaagactaacacgctggtcgtcagacagcgctgcggccgccccggcggcggagtactgctacgttacggtagccagcttgcccctgaaactttctaccgcgagtgcgacatgcaactgttcggcccttggggggagatagtgtctccatccctgtctccagctacctctaatgcaggcggttgcagactgttcatcaatgtcgctccccatgcccgcatagccatccatgcgctcgctacaaatatgggcgccggcaccgaaggcgccaatgcttcctacatccttattcgagacacacacagtttacgcactacagcattccacggacagcaggtgctgtattgggagtctgagagctctcaggccgagatggagtttagcgaagggtttctgaaggcccaggcgtcgctaagaggtcagtattggaccctccagagctgggtgcccgagatgcaggacccacagagctggaagggcaaagagggaacc

SEQ ID NO: 5660 - DNA, 4281 bp, Artificial Sequence
  Description of Artificial Sequence: Synthetic coding sequence
atgcatcaacgccatcccagggcaagatgccccccactttgtgtagcaggaattcttgcatgtggattcttgctgggttgctggggacctagtcactttcagcaatcctgcctgcaagctcttgagccgcaagccgtatcatcctacctgtcgcccggggccccgttgaagggacgtcctccgtcgccgggattccagaggcaaaggcaaaggcaacggcgtgccgctggaggtattctgcatcttgaacttctcgtggccgtgggaccagatgtatttcaagctcatcaggaggacactgagcgttatgtactgactaaccttaatataggtgccgaacttctacgagatccatccttgggcgctcagtttagagttcatcttgtgaaaatggtgatcctaacggagcccgaaggggcaccgaacattaccgcaaatctgacttcaagtttgttgtcagtgtgtggatggtcgcagacaattaatcctgaagatgatacagatcctggacacgctgatttggttctttatattacacgtttcgatttggaacttccagacggaaaccgccaagtgagaggagtgacgcagcttggaggcgcttgttctccaacgtggtcttgtttaattaccgaggataccggttttgatcttggagtgacaatcgcacatgaaattggtcattcttttggattggaacatgacggggcaccaggaagtggatgcggaccatctggacatgtcatggcttcagatggggcagcaccacgggcaggtctcgcttggtcaccatgcagtcgaagacagttgctctctcttcttagtgctgggcgcgcacgttgcgtctgggacccaccaaggccacagcctggatcagctggccatccccctgacgcccagcctggtctctactatagtgctaatgaacagtgcagggttgcctttgggcctaaggctgtggcatgcactttcgcccgtgagcaccttgatatgtgtcaggcactgtcttgccacacagatcctttagatcagtcatcgtgcagccggttactcgtgcctcttctggacggtactgaatgcggtgtagagaagtggtgtagcaaggggaggtgtagatctctcgttgaattgacacctatcgcagctgttcatggacggtggtcttcatggggcccgcgtagtccatgttctcgttcttgtggggggggtgttgtgacgagaaggaggcaatgcaacaatccaagaccagcatttggtggcagagcttgcgtgggtgcagatttacaggcggaaatgtgcaatactcaagcctgtgagaaaactcaactggagtttatgtcgcaacaatgtgctcggaccgacggtcagccactaaggtcttcccccgggggagcctccttctatcactggggagccgcagttccacattctcagggggatgcactctgccgacacatgtgtagagcaataggtgagagtttcatcatgaaaagaggtgactccttcttagacgggactagatgtatgcctagcggtccaagggaagacgggactttgagtctttgcgtgtctggttcctgtaggacatttggttgcgatggtagaatggattcgcaacaagtatgggaccgttgccaagtttgtggtggcgataatagcacgtgctccccccggaagggttccttcaccgctgggagggcccgcgaatatgtcacattcttgactgttactccaaatctaacatcggtgtatatagccaaccatagacctctattcacacatcttgctgttagaattggaggtcgctatgttgttgcaggaaaaatgtccatttctcctaatactacctatccatccctcttggaggacggacgggtggagtatcgggttgcattaaccgaagatcgtcttcccaggcttgaagagattagaatatgggggccattacaagaagatgctgatatccaggtctatcgtcgttacggggaggagtatgggaacttaactaggcctgatattacctttacttacttccagcccaagcctaggcaggcctgggtatgggccgctgtacgtggaccatgctctgtgtcgtgcggtgcaggacttcggtgggtaaactactcatgcctcgaccaagcccgaaaggagttggtggagactgttcagtgtcaaggctcgcaacaacctccagcatggcctgaggcttgcgtgttagaaccttgtccgccatattgggcggttggcgattttggaccttgctccgcatcctgtggcggtgggttaagagagcgacccgtgagatgcgtagaagcacaaggttcactgctaaaaactttgccacctgctcgatgtagagctggggcacagcagcctgctgttgctcttgagacttgtaatcctcagccatgcccagcccgctgggaggtttccgagccaagcagttgcacaagtgccgggggagctggacttgccttagaaaatgaaacttgtgtccctggtgctgacggtcttgaggctccagtgaccgaaggccctggatctgttgatgaaaaacttccagcacctgaaccttgcgtggggatgtcctgtcctcctggttggggtcatttagacgcaaccagtgcaggggagaaagcaccatctccctggggttcgatcaggaccggggctcaggctgctcatgtttggactcccgctgctggatcctgctcagtgtcttgcggaagggggctgatggagcttcgattcctttgcatggattctgcgcttagagtcccagttcaggaagaactgtgcgggcttgctagcaagccgggttcacgtcgagaggtttgccaggctgtcccttgtccggctagatggcagtataagttggctgcctgtagcgtgagctgtgggaggggggttgtgcgtcgtattctctattgtgcgagggctcacggtgaagatgatggtgaagagattttgctcgatactcaatgccaaggattgcctcgccccgagcctcaggaggcctgttctttggaaccatgcccgccccgatggaaggtaatgtcactcgggccatgttctgcaagttgcggtttgggtactgctaggcgtagcgtggcctgtgtacaactggatcagggacaagacgtcgaggttgatgaggctgcatgtgctgcactcgttcgacccgaggcaagcgtgccgtgtttgatagctgactgtacttatcgctggcatgttggtacctggatggaatgcagcgtttcttgcggtgatgggattcaaagaagaagagatacatgcttgggtccacaggcccaagctcctgttccagcagatttttgccagcatttgccaaaacctgtaacagtcagggggtgctgggccggcccttgtgtcggtcagggtactccgtcgttggtgccacacgaggaagccgctgctcctggccgaactacagcaacccctgctggagctagtctggagtggtctcaggctagaggccttcttttctccccagccccccagcccagacggctcttgccaggtcctcaggagaacagcgtgcaaagtagtgcctgtggaaggcagcatttagaacccaccggtactatcgacatgcgcggaccaggtcaggctgactgcgctgtcgctattggaagacctctcggtgaagttgttaccctgcgagttcttgaaagcagcctaaattgtagtgcaggagatatgttgcttctgtggggtaggctgacatggaggaaaatgtgtcgtaagctactggatatgacgtttagttctaaaacgaatacgctcgtggtccgtcagaggtgcggtagacctggaggtggagttcttttgaggtatgggtcccaactcgctccggaaacgttttatagagaatgtgatatgcaactttttggcccatggggtgaaatcgtttcaccctctttatctccagctacatccaatgcaggaggttgcaggctctttatcaacgttgcccctcatgcgcgcattgcaatacatgcacttgccacaaacatgggcgcgggcacagaaggagccaacgcctcttatatactaatacgtgatacccattcccttcggactaccgcctttcacggacagcaagtactctactgggaatcagaatcctctcaggctgagatggagttcagcgaaggatttctgaaggcccaggctagcctgaggggtcagtattggacattacagtcctgggttcccgaaatgcaggaccctcagtcctggaaggggaaggagggtaca

SEQ ID NO: 5661 - DNA, 4281 bp, Artificial Sequence
  Description of Artificial Sequence: Synthetic coding sequence
atgcaccaacgtcatccgcgggcgcggtgtccccccttgtgcgtagcaggcatcttagcttgcggtttcctgctgggatgctggggaccctcgcatttccaacagtcttgcctccaggccctggagcctcaggccgtttcaagctacttatccccaggcgccccactgaaaggcagaccccccagcccaggctttcaacgtcagcggcagagacagcggagagctgctggagggatcctccacctggaactcctggtggcagtcggtcctgatgtttttcaggcccatcaggaggatacggagcggtacgtcctcaccaacctgaacattggggccgagctgctcagggatccgagcttaggagctcagttcagggtccacctggtcaaaatggtaatactgacggaaccagagggggccccaaatatcacagcaaatctgacatcttccttgttatccgtatgcggttggagccagaccatcaaccctgaagacgacaccgatccgggacacgctgaccttgtcctgtatatcactaggtttgacctggagctccccgatggaaatcgacaggtgagaggcgtgacacagctgggcggggcttgttcgcccacatggagctgcttaataaccgaagataccggatttgatcttggggtgacgatcgctcacgaaataggacattccttcggtctggagcatgacggcgcccctggttcaggctgcggccccagcgggcatgtcatggcaagtgatggagctgccccccgagcaggtttggcctggtctccctgttcaaggcggcagcttctaagtctgttgtccgccgggagagcacgctgcgtgtgggaccctccacggccacaacccggctcggccgggcatccaccggatgcacaaccaggattatactacagtgcgaatgagcagtgccgggtcgcgttcggtcccaaggccgtggcatgtacctttgctcgggaacacctggacatgtgccaggccctgtcgtgtcacacagaccctttggaccagtccagctgcagccggctgctggtacccttgctggatggaacggagtgcggagttgagaaatggtgtagtaagggacggtgccggagcctggtggagctgactcccattgccgcggtgcacgggcggtggagttcctggggccccaggtcaccgtgctctaggtcatgtggcgggggagttgtgacaagacgaagacaatgtaacaatccaaggcctgcgttcggcggaagggcgtgtgtgggcgcagatctgcaggctgagatgtgcaatacccaggcctgtgaaaagactcaactggaattcatgagtcaacagtgtgccagaacggacggccaacctctgcgctcctctccgggcggtgccagcttttatcactggggggctgctgtaccacattcacaaggtgatgccctgtgtaggcacatgtgtagagctatcggggagagctttattatgaaaagaggagattcgttcttggacggcaccagatgcatgccaagtggtccaagagaggatggaactctgagcctatgcgtaagcggttcttgtcggaccttcggatgcgacggccggatggattctcagcaggtttgggaccgctgccaggtgtgcggcggcgacaactctacgtgttcaccaaggaagggaagcttcacggcgggacgtgcacgcgagtacgtcacttttctcacggtgactcccaacctgacctcagtgtatattgccaaccataggcctctgtttacccatctcgccgtccgaattggggggaggtacgtggtggcaggaaagatgtcaatttcccctaatactacatatccctccctgctggaggacggcagggtagagtaccgggtggcactcaccgaagatcgattgcctcgtctggaggagattagaatctggggtcctctgcaggaggatgccgacatccaggtctataggcgctatggggaggagtacggcaatctcaccaggcctgacataacttttacttactttcagcccaaaccacggcaggcttgggtgtgggcagccgtgcgcggaccctgttcagtctcgtgtggggccgggcttcggtgggtaaactattcttgtttagatcaagcccgcaaggaattggtggaaacagtgcagtgccagggaagtcaacagccccccgcctggccagaggcttgcgtcttggagccatgtcccccctattgggccgtgggagacttcggcccatgttccgcgtcatgtggtgggggtttgcgcgaacgacccgttaggtgtgtggaagcccaggggtctcttctcaaaaccctgcccccagctcgctgtcgcgcgggcgcgcagcagcccgcggtggcactcgagacctgcaaccctcagccctgccccgctagatgggaagtttcagagccgtcatcatgtacctccgccggaggtgctggtttagcactagagaatgaaacatgtgtgccgggggccgacgggcttgaggctcctgtgaccgaagggcctggctccgtcgatgagaaacttcctgctcccgaaccatgtgtaggtatgagctgcccgccagggtggggtcacctagacgcaacttcggcaggtgagaaagctcccagcccctggggctccattaggaccggggcacaagccgcccacgtatggacccccgccgccgggtcctgttctgttagttgtgggcgcgggctgatggagttacgcttcttgtgcatggactctgctctgcgagtcccagtgcaggaagaactatgtggactggcctccaaacccggttctagacgcgaagtatgtcaggctgttccatgtccagcaagatggcagtacaaactggctgcatgtagcgtgagctgtggccgtggcgtagtgaggaggatactgtattgcgctcgtgctcacggagaagatgacggggaagagattctgctagatacgcagtgtcagggactgccccgccctgaaccacaggaggcctgttccctcgagccatgcccccctcggtggaaggtcatgtcattgggaccttgcagtgccagctgcgggttgggaactgctaggcgctccgtggcttgcgttcaactagaccaggggcaagacgtagaggttgacgaagccgcttgcgcagccctcgtccggcccgaggctagtgtcccatgcttgattgctgattgtacataccggtggcacgttgggacttggatggaatgttcagtgagttgcggcgatggcattcaacgtcgccgggacacctgccttgggccacaagcccaagcaccagtccctgcggacttctgtcagcacctgccaaagcctgtcaccgtgcgagggtgttgggccggaccctgtgtgggccagggaaccccgagtctcgtgccacacgaggaagctgcagcacccggcagaaccactgctaccccggccggcgcctcactggagtggtcacaagccagaggtctcctcttctcccctgcccctcagccccgacgcctgcttccaggacctcaggagaattctgttcaaagctcagcctgcggccggcagcacttggagcctacaggcactatcgacatgcgcggccctggccaggccgactgcgccgtagcgattggacgacccttgggcgaggtcgttaccctgcgagtgttggagagttctctgaactgctctgcgggggatatgctgctgctatggggacgacttacatggcggaagatgtgtcgtaaactgctggacatgacatttagctctaagaccaataccctagtggttagacagcgctgtggtcgccccggggggggcgtcttactgagatacggcagtcagctcgctcctgagacattctatcgggaatgcgacatgcagctgtttggaccatggggagaaatagtgagcccgagcttgtcacccgctacttccaatgccggtgggtgtcggctgtttatcaacgtggcacctcacgcaagaatcgcaatacacgccctggccacaaacatgggtgcggggaccgaaggggcaaacgctagctacattctgatcagagacacacattctctgcgaaccactgcgttccatggccagcaagtcctgtactgggaatccgaatcgtcgcaagccgaaatggaattctccgaaggcttcctgaaggcccaagctagcctgaggggacagtattggacacttcagagttgggttccggagatgcaggacccccaatcttggaaaggcaaggagggaaca

SEQ ID NO: 5662 - DNA, 4281 bp, Artificial Sequence
  Description of Artificial Sequence: Synthetic coding sequence
atgcaccaaagacacccccgggcaagatgccccccactgtgtgtcgcaggaattcttgcatgcgggtttctcctgggatgttgggggccaagtcactttcaacagtcgtgtctccaggcactggagcctcaagcagtgtcgtcctacctctcacctggagcccctcttaagggccgcccaccaagccctggatttcaaagacagagacaacggcaaagaagagcagcaggaggtattcttcacctggagctgcttgtggcagtgggtccggatgtgttccaggcacaccaagaagataccgaacgctacgtactgactaacctcaatataggagcagaattgcttcgggatccttcgctgggtgcacagtttagagtgcaccttgtcaagatggtcattcttacggaaccagagggcgccccaaacattaccgcgaatttgacctcatcccttctttcggtgtgtggatggagccaaactattaaccctgaggatgataccgatccaggtcatgcggatcttgtgctttacattaccagatttgatcttgaactgcctgatggcaaccggcaagtgcggggcgtgactcagctggggggcgcatgttcgcccacctggtcatgcctgatcacggaagataccgggtttgacttgggtgtgaccatcgcccatgaaatcggccattccttcggcttggagcatgatggagcgcctggatccgggtgtggaccttcgggacatgtgatggcatccgatggggcagcacctcgtgccgggctggcatggtccccatgttccaggcggcagctgctttctcttctgtccgcaggcagggcaaggtgcgtgtgggatccgccccgtcctcaacctggaagcgccggacatcctcctgatgcccaacctggactctactactcggcaaacgaacagtgcagagtcgcgttcggcccgaaggcagtggcatgtacctttgcacgggagcatctggatatgtgccaagccctgtcctgtcatactgaccctctggaccagtcatcatgctcgcgcctgctcgtcccgttgctggacgggactgaatgcggagtcgaaaaatggtgttcaaagggccgatgtaggtccctggttgaactcacgccaatcgcagcggtgcatgggcgttggtccagttggggtccaagatcaccctgttcgagatcctgcggtggtggtgttgtgactcgtagacgtcagtgcaacaaccctcgaccagcattcggcgggagggcatgcgtcggagcagatcttcaggcagaaatgtgcaacacgcaagcatgtgaaaagacccagctcgagtttatgtcacagcagtgcgctagaactgacgggcagccattgagatcgagtcccggtggagcatccttttatcattggggggcagcagtgccccattcgcagggagatgcactttgcagacatatgtgtcgggctatcggagagtcgttcattatgaagcggggtgacagctttctggacggtactagatgtatgccgtcaggaccaagagaagatggtactctctcactttgtgtgtcggggtcgtgcaggacttttggttgcgacggtagaatggatagccaacaggtttgggaccggtgccaagtgtgtggaggtgataactccacctgttcgccacggaagggttcattcaccgcagggagggcacgtgagtacgtcacttttctcaccgtgacccctaatcttaccagcgtgtacatcgcgaatcacagaccgctttttacccacctggcagtccggatcggaggtcgctatgtggtcgctggcaaaatgtccatatcacctaacaccacgtacccttcactgctcgaagatggacgagtcgagtacagagtggcccttacggaagataggctgccccggctggaagaaataagaatctggggtccacttcaagaggatgcggacattcaggtgtacaggagatacggagaagagtacggaaacctgacccgacccgatatcaccttcacctacttccaaccaaagcccaggcaagcatgggtctgggcagccgtgagaggtccctgctcagtctcctgcggtgccgggcttcggtgggtgaactacagctgcctcgaccaggcccgcaaggaacttgtggaaaccgtccaatgtcaaggctcgcagcagccgcccgcatggccggaagcatgcgtcttggaaccgtgtcctccttactgggcagtgggcgatttcggaccatgtagcgcctcgtgtggcggcggactgagagagcgccctgtgcgctgtgtggaggcacaggggtcgcttttgaaaacgctgcccccagcacgatgtcgcgctggtgctcaacagccagcagtcgctctcgaaacttgcaatccccaaccatgcccggcccggtgggaagtgtcggagccatcctcgtgcacctccgcagggggcgcaggtctggcacttgagaacgaaacgtgtgtgcctggtgctgatggtcttgaagcaccagtcaccgaaggcccaggatccgtcgatgaaaaactccctgcacctgagccttgtgtcgggatgtcatgcccaccgggatggggacatctcgacgcgacttcggccggagagaaggcaccaagcccttggggatcgattcgtaccggagctcaagcagcacatgtctggaccccagcagcaggatcatgttcagtctcctgtggaagagggctcatggaacttcgtttcctgtgcatggactccgcactccgcgttcctgtgcaggaagaattgtgcggcctggcctcaaagcctgggtcacggagagaggtgtgtcaggccgtgccttgccctgctcgatggcaatacaagctggcggcgtgctccgtgtcatgtggacgcggcgtggtccggagaatcctctactgcgccagagcacacggagaagatgatggagaagaaatactgcttgacacccaatgtcagggacttccccgtccggaaccacaagaggcctgttccctggaaccttgtccaccacggtggaaagtgatgtcgcttgggccatgttcggcaagctgcggtttggggaccgcccgacggtcggtcgcctgcgtgcagcttgatcagggccaggacgtggaagtggatgaagcggcgtgtgcagcccttgttaggcccgaagcatccgtgccatgtctcatcgcagattgtacttacagatggcacgtcggcacttggatggaatgctctgtgtcatgtggcgatggaatccagcgtagacgggatacttgcctcggaccacaggcccaagcaccggtgcctgccgatttttgccaacacctgccgaagccagtcactgtgcgtggttgctgggcaggaccatgtgtcggtcagggtactccgtcccttgtgccacatgaggaagctgcagcacctggcagaaccactgcgaccccagccggggccagccttgaatggtcacaagcaagaggtctgctgttttccccagccccacagccaagacgcctgctgcccggacctcaagaaaactcggtgcagtcctccgcatgtgggagacaacacctcgagccaaccgggaccatcgatatgcgcggcccaggacaagcagactgcgcagtggcaattggacgaccactgggagaagtggtgacgcttcgggtgcttgaatcgtcgctcaattgctccgcaggcgatatgcttcttctttggggacggcttacttggcgcaagatgtgccgtaagctgcttgacatgaccttcagcagcaagactaataccctcgtcgtcagacaaagatgcggacgcccaggtggaggcgtcttgcttaggtatgggtcgcaactcgcccctgagacgttttacagagagtgtgatatgcaacttttcggaccttggggtgaaatcgtttccccatcgctcagcccagccacttccaacgcgggaggatgtcgcttgttcatcaatgtcgcccctcacgcgcgcattgcaattcacgcacttgcaaccaatatgggagcaggcactgaaggtgcaaacgcaagctacattctgatacgtgatacgcatagcctccgaactactgcattccacggccaacaagtgctttactgggagtcggaatcgtcccaggcggagatggaattctccgagggcttccttaaggcgcaagccagccttcgcggccagtactggaccctgcagagctgggtgcctgaaatgcaagatccgcaatcgtggaagggtaaggaaggaacc

SEQ ID NO: 5663 - DNA, 4281 bp, Artificial Sequence
  Description of Artificial Sequence: Synthetic coding sequence
atgcatcaacggcatccacgggctcgttgtcctcctctttgcgtggccggaatcctcgcatgtggttttctcctgggatgttggggtccctcgcattttcaacagtcctgcctgcaagcacttgaacctcaggcagtctcttcatacctttcgcctggagcgccacttaagggacgaccgcctagcccgggttttcaacgtcaacggcaaaggcagagacgagcagctggtggtattcttcatttggaactgcttgtggcagtcggacctgatgtgtttcaggcacaccaagaagatacggaacgttacgtgttgaccaaccttaacataggcgcagagcttctgcgtgacccgtcacttggtgcccaattccgagtgcaccttgtcaagatggtgatcctgactgagcctgaaggcgcacccaacatcactgcgaacctgacgtcatccctcctttcggtgtgtggatggtcacaaactattaacccggaagatgatactgatcctggtcatgcagatcttgtgttgtacattaccagattcgacctggagctccctgacggaaaccggcaagttcggggtgtcactcaactggggggtgcctgctcaccaacctggtcatgtctgattacggaggacaccggatttgatctgggggtgaccatcgcacatgagattggccacagctttggtcttgaacatgacggagcaccagggtccggatgtggaccttcaggccacgtgatggcaagcgacggggcggccccacgcgcaggcctggcatggtcgccatgttccagacggcaactgttgtcgctgctgagcgccggtcgggcacgctgtgtttgggatccacccagacctcaacctggatcggcgggacatccaccagatgcccaaccaggactttactactctgccaatgaacagtgtagagtggctttcggcccaaaggcagtggcctgtactttcgcaagggagcatctggatatgtgtcaagccctgtcgtgccatactgatccacttgatcaatcctcttgttcacgtcttttggtgcctcttctcgacggtaccgaatgcggtgtggagaaatggtgttccaagggacggtgccgctcgctggtggaactgaccccaatagcagcggtccatggaagatggtcgtcgtggggtcctcgctcgccctgtagccgatcgtgtggtggtggcgtagtgaccagacgcaggcagtgcaataacccacgtcccgcttttggtggacgagcgtgcgtgggggctgacttgcaggcagagatgtgtaacactcaggcttgcgaaaaaacccaacttgagtttatgtcccaacaatgtgcacgtaccgatggccaaccccttcggtcatcccctggtggcgcatctttttaccactggggtgcagccgtcccacactcgcaaggggatgctctgtgtcgccatatgtgccgtgcaattggtgaaagtttcataatgaaacggggcgattcattcctggatggaactcgctgtatgcctagcggaccaagagaggacggaaccctttcgctttgtgtgtccgggtcctgtcggactttcggatgcgacggacggatggattcgcagcaagtctgggaccgctgtcaggtgtgtggaggcgataacagcacttgtagccctcggaaaggatccttcacggctgggcgcgcgagagaatacgtcaccttccttaccgtgacgccgaacctgacctcggtctacatagcaaatcacagacccctgttcacccatttggctgtaagaatcgggggaaggtacgtcgtggcgggaaagatgagcattagcccaaatactacctacccatcgcttcttgaagatggtagagtggaataccgagtcgcgcttaccgaggacagactgcctagacttgaagagattaggatttggggtcctctccaggaggacgcggatattcaagtgtaccgaaggtacggagaagaatacggtaacttgaccagaccggatattacctttacctactttcaaccaaagccaagacaggcttgggtctgggcagccgtgcgcggtccatgctcggtgtcctgtggtgccggtctgagatgggtgaactattcctgtctggatcaggcgcgcaaggaactggtcgaaaccgtgcagtgtcaaggatcccagcaaccacctgcatggcccgaggcgtgcgttctggaaccgtgccctccatattgggccgtgggagactttggtccctgtagcgcatcatgtggcggaggacttagagagaggcctgtgaggtgcgtggaagcacagggttcacttcttaagactcttccacccgcaaggtgcagagcaggggcccagcagccagcagtggccttggaaacttgtaatccccagccttgtccggctcggtgggaagtctccgaaccttcatcctgtacgtccgcagggggagcgggccttgcgctggagaacgaaacctgtgtcccaggggcagatggtctggaggcaccagtgaccgaaggacctggttccgtggatgaaaagctgccagcaccagagccatgtgtgggaatgtcatgtcctcctggttggggccatctggatgcaacctcagcgggtgaaaaggcaccttcgccttgggggtccatcagaactggtgcccaagccgcacatgtctggacccccgcagcgggttcatgttcagtgtcctgcggccgaggactcatggaattgagattcctttgtatggactcagcactgagggtgccggtgcaagaggagctgtgcggactcgcgagcaaaccaggatcgaggcgggaagtgtgtcaggcggtgccctgtccggctcgatggcaatacaagctggcagcatgtagtgtgtcgtgtgggagaggggtcgttaggagaatcctgtattgtgcccgcgcacacggggaagatgacggagaagagatactgttggatactcaatgccaaggtctgcctcgcccggaacctcaggaggcttgttcattggaaccttgtccgccccgatggaaagtgatgtccctcggaccatgctccgcgtcatgcggactcggtactgccaggcggtcggtggcatgcgtgcaactcgaccagggtcaggacgtcgaagtggatgaagcagcgtgcgccgcacttgtgaggcctgaggcctcggtgccttgcctcatagcagattgtacttatagatggcatgtcggcacttggatggaatgttccgtgtcctgtggagacggcattcagaggcggcgggatacttgtttgggccctcaagcccaagcaccagtgcctgcagatttctgtcagcatcttcctaaacctgtcacggtcagaggatgttgggcaggaccatgcgtcggtcaaggaaccccatcgcttgtcccgcatgaagaggcggcagcacccggacgtaccactgcaacccctgcaggagcttcccttgaatggtcccaagcaagaggcctgcttttttctcccgcaccacagcctcgcagacttctgcctggtcctcaagagaattcggtgcaatcctccgcatgtggacggcagcatcttgaaccaactggaacgatagatatgagagggcctggacaggccgactgtgcagtggcaattggacgcccacttggggaagtcgtgacgctgcgggtgctggaatcatcactgaattgttctgcaggagatatgctcctgctttggggccggctcacttggcgaaaaatgtgtagaaagctgctggatatgactttctccagcaaaaccaatacccttgttgtgagacagcgatgtgggcgaccaggcggaggagtgcttttgaggtacgggtcccaactggcacccgaaaccttttaccgggaatgcgatatgcagctgttcgggccttggggagaaatcgtctcgccctccctgtcacccgctactagcaacgcgggaggttgtagactgttcattaacgttgcccctcatgcacgtatagctatccacgccttggctactaatatgggagcaggcactgaaggtgcaaacgcatcttacatcttgattagagacacccattcactgaggactaccgcctttcacggtcaacaggtcctttactgggagagcgagagctcacaggcggaaatggaattctccgagggatttcttaaagcccaggcctcgctccgaggtcagtactggactttgcagtcgtgggtgcctgagatgcaagacccccaaagctggaaaggcaaagagggcact

SEQ ID NO: 5664 - DNA, 4281 bp, Artificial Sequence
  Description of Artificial Sequence: Synthetic coding sequence
atgcatcaacggcacccacgggccaggtgtccaccgctgtgtgtggccgggatcctcgcctgtgggttcctcctggggtgctggggtcctagtcattttcaacaatcctgcctgcaagccctcgagccacaagccgtgtcaagttacctctctcctggtgcacctctaaagggtcggcctccgtctcccggtttccagcgccaaaggcagcggcagcgccgagctgcgggagggatcttgcatctggagctgcttgtcgccgttggacccgacgtctttcaggcacaccaggaagacaccgagcggtacgtcttaaccaacctgaatatcggggctgagctgttgcgagacccttcactcggggctcaatttagagtccatttggtaaaaatggttatcttgacggagcctgaaggcgcacccaacataactgccaacctgaccagctcactgcttagcgtgtgtggatggtcccagacaataaacccagaggacgatactgatcccggtcatgcggatttggtgctgtacattacccggttcgatttggaattgcccgatggtaatcggcaggttcggggcgttacccagctgggaggcgcttgttcacctacctggtcctgcttgataactgaagacacgggtttcgacttaggcgttaccatcgcgcacgagattggacactcctttgggctcgagcacgatggcgcacccggtagcggctgcggaccctctggccacgtgatggccagcgacggggccgctccccgggccggactcgcgtggagcccatgttctcgacgacaactactttccctgttgtcggccgggagggccagatgcgtctgggatccgccccgccctcagcccggaagtgccgggcatccaccagacgctcagcctggtttgtactatagcgccaatgaacagtgcagggtcgcctttgggcctaaggctgtggcatgtaccttcgccagagaacacctggacatgtgtcaggccctctcatgccataccgaccccttagaccaaagctcctgcagccgacttctcgtgccgctgctagacggaaccgagtgcggcgtggaaaaatggtgctccaagggaagatgccgcagcctcgttgagctaactcctattgcggcagtccatggcaggtggtcttcctggggtcctcggagcccctgttctagatcgtgcggaggcggagtggtgacacggagacgacagtgcaacaatcccagacccgctttcgggggcagggcctgcgttggggctgacctgcaggccgaaatgtgtaacacccaggcatgcgagaaaactcagttagagtttatgtctcagcaatgtgccagaaccgacgggcagccactgcgaagctcaccaggcggcgcttctttttaccactggggcgctgcagttcctcattcccagggggacgcattgtgtaggcacatgtgcagagcaatcggagaaagcttcattatgaagaggggtgatagtttcctggacggcactcgctgcatgcctagcggtccgcgcgaagacggcacgctgagtttgtgcgtttcagggagctgccgtactttcggctgcgatgggcgaatggactcacagcaggtgtgggaccggtgccaggtgtgtggaggagataactctacatgttcacccaggaaaggatcatttacggcagggcgggcccgagagtatgtgacatttttaaccgtgacgccaaacttaacttcagtgtacatcgctaaccatcggccgctgttcacacaccttgccgttcgaatcggaggcagatacgtggtggcaggaaaaatgagtatctctcccaatacaacataccccagccttctcgaagatgggagggtcgaataccgggtggctcttactgaagaccgtctcccccgcctcgaagaaatcagaatttggggcccccttcaagaggacgccgacatccaggtctacaggcggtacggcgaggaatatggcaacctgacaagaccagacatcaccttcacctacttccagcccaagccacgccaggcctgggtgtgggcagccgtgcgcggcccctgtagtgtctcttgcggagcgggccttaggtgggtgaattactcttgcctggatcaggcgagaaaggagctggtggagacggttcagtgccagggatcacagcagcccccagcgtggccggaggcctgtgtgctggaaccttgcccgccgtactgggctgtcggcgattttgggccctgcagcgcaagctgcggcggcggcctaagggaacgtcctgtccgctgcgtggaggctcagggatctttgcttaagacactgcctccagcaagatgccgcgctggagctcagcagcccgcagtggcactagagacgtgcaatcctcaaccatgccctgcacggtgggaggtgtctgagcctagcagttgcacatctgcaggaggcgccggcctcgcactggagaacgagacttgcgtccctggtgcagacggcctggaggcccccgtaaccgagggccctggaagtgtcgatgagaagctcccagctcctgagccatgcgtcggaatgtcgtgcccacccggctggggacacctggatgccacttccgcgggagaaaaagccccgtctccctggggctccataaggacaggcgcacaggccgcacacgtgtggacccctgccgcaggatcttgttctgtgtcttgcggccggggcctgatggagctccgcttcctgtgtatggattctgcactcagagtccccgtccaggaagagctctgcgggctggcttcaaagcccgggagtagacgggaagtctgccaagctgtgccgtgccccgctcgatggcagtacaaactggccgcctgttctgtgagttgcggtcgtggcgtggtacggcgcattctgtactgcgctagagctcacggcgaagacgacggggaagaaatcctacttgacacccagtgccagggactgcccagaccagaaccccaagaggcatgttcactcgaaccttgcccgccgagatggaaagtgatgtccttgggcccctgttccgcttcttgtgggctaggaaccgctagacgctctgttgcctgcgtgcagctcgaccagggacaggacgtagaggttgatgaagcggcatgtgcagccctggtcaggcctgaggcctcagttccttgcctcatcgccgactgtacatatcggtggcacgtgggcacctggatggagtgcagcgtttcctgcggagacggtatccagaggcgccgagacacgtgcctggggccccaagctcaagctccagtgccagccgacttttgtcagcacctgcccaagcccgttaccgtcagaggatgttgggcagggccttgcgtcggacagggtacgccctccctggtccctcacgaagaggctgccgcgcctggcaggaccactgcaacccctgccggcgcctcactggagtggtcccaggcccgcggactacttttcagcccagccccacagccccggcgcctgctgccagggccccaggagaattctgtgcagagctcagcatgtggccggcagcatctcgagccaactggcaccatcgacatgcggggacctggccaggccgactgcgccgtagccattgggcgaccattgggggaggtagtaactctcagagttctggagagctcccttaactgctccgccggcgatatgctgctactgtgggggaggctcacctggagaaagatgtgtcggaagctgctggatatgactttttcctctaagacaaacaccttagtggtgagacagaggtgcggtaggcctggcggaggagttcttctgaggtatggctcccagctggcccccgaaactttctacagagagtgtgacatgcagcttttcggaccatggggtgagatagtcagcccttcactgagcccagccacaagtaatgccgggggatgtcgcctattcattaacgtcgccccccatgcgcgcatcgccatacacgcactggctacaaacatgggggctgggactgaaggcgctaatgcctcatacatccttatccgggatacacattcgctgagaacaaccgcctttcacggccagcaagtcctgtattgggagtccgagagctcacaagccgagatggaatttagcgagggctttttgaaggcacaggcatccttaagagggcaatactggacattacagagttgggtgcccgaaatgcaggatccacagagctggaaaggaaaggaaggtact

SEQ ID NO: 5665 - DNA, 4281 bp, Artificial Sequence
  Description of Artificial Sequence: Synthetic coding sequence
atgcatcaaaggcacccccgcgcacgctgccctccgctttgtgttgcaggcatcctggcgtgtggtttcctgcttggatgctggggcccgtcccattttcagcaaagttgtttgcaagcacttgaaccacaggctgtgtctagctacctttcccctggggcacccctgaagggccggcctccatcgccaggttttcagagacaacgccagagacagcgtagggcggcagggggaatacttcatcttgaacttctggtggctgtgggtcccgatgtgttccaagcccatcaagaggataccgaacgctacgttctcactaacctgaacataggagcggaacttctgcgggatccatcactcggtgcacaattccgagtgcatctcgtgaaaatggtcattctgaccgaaccagaaggagctccgaacataactgcaaaccttacctcatcgctgcttagcgtctgcggttggtcgcaaactataaacccggaagatgataccgaccccggccacgctgatttggtgctctacatcactcgcttcgacctggagttgcccgatggaaaccgtcaggtgcgcggcgtgacccaattgggaggggcctgttcgcctacctggtcatgtcttattacggaagataccggatttgatctgggagtgaccatagcacacgagatcggacattcgtttgggctcgagcatgatggtgcaccaggttcgggatgtggacctagcggacatgtgatggcctcagatggagcagcacccagagcagggctggcctggagtccctgtagccgtaggcaactcttgtccctccttagcgcaggccgagcccggtgtgtgtgggaccctccaaggccgcaacccggaagcgcagggcacccaccagacgcacaaccaggcctttactattcagcgaacgagcagtgtcgagtggcctttggccccaaggcagtggcatgtacgtttgcaagggaacatcttgacatgtgtcaagcgctcagctgccataccgaccctctggaccagtcctcatgttcgcgacttcttgtgcctcttctggatggcaccgagtgtggtgtcgagaaatggtgttcaaagggacggtgccgatcgctcgtggagctcactcccattgccgcagtgcacggccgatggtcatcgtgggggcccagatcgccgtgttccaggtcctgtggaggtggcgtggtgacccggcggcgccaatgcaataatcctcggccagcatttggaggccgcgcctgtgtgggagccgacctgcaagccgagatgtgtaacactcaggcatgtgaaaagactcagttggagtttatgagccaacagtgtgcgagaacggacggacagcccctgcgttcgtccccaggtggagcatccttttaccattggggagcagccgtgccccattcacagggtgatgcactttgtcgtcatatgtgtcgcgcgattggggagagcttcattatgaagcgcggcgattcgttccttgacggcacccggtgtatgccatcaggacctcgagaagatggcactctctcgctgtgcgtgtcgggctcatgtcgtacgtttggatgtgatggccggatggacagccaacaggtgtgggatcgttgccaagtctgtggcggggataactccacgtgttctcctcgaaagggttcatttactgccggacgggcacgagaatacgtcacctttcttaccgtgacgcccaatcttactagcgtgtatatcgcaaatcaccgtcccctgtttactcatctggcggtgagaattggcggaagatacgtggtggcgggtaagatgtccatttcgccgaatactacctacccatcgcttcttgaggatggaagggtggaatacagagtggcgttgactgaggatagactgcctcgcctcgaagagatacgaatctggggtcctcttcaagaagatgcggatatccaggtgtacagaagatacggtgaggagtacggtaacctcactagacccgacattaccttcacgtacttccagcctaagcctaggcaggcatgggtctgggcagcagtgagaggaccatgttcagtgtcttgtggtgccggtttgagatgggtgaattactcatgtcttgatcaggcacggaaggaactggtggaaactgtgcaatgtcaggggagtcaacagcctcctgcgtggccagaagcctgcgtgctcgaaccatgccctccgtactgggcggtgggtgactttggaccttgctccgcctcgtgtggagggggtctgcgcgaaagacccgtgcgctgtgtggaagcacagggcagcctgcttaagacgctcccccctgctcgatgtcgagcgggcgcgcagcagccggcagtggcactggaaacctgtaacccgcaaccgtgtccggcacgttgggaagtttcggaaccatcgtcgtgcacttctgcagggggagcaggactggctctggaaaatgagacttgcgtgccaggtgcagacggacttgaagcaccagtcacggaaggacctggatctgtcgacgagaagttgcccgcacccgaaccttgcgtcggaatgtcctgccctcccgggtggggccatttggatgctacgtccgcgggagagaaggcacctagcccctggggttcgatacgcaccggtgcacaagcggcacacgtgtggactcccgcagcgggatcctgctccgtgtcgtgtggccgtggtctgatggaacttagatttctgtgtatggactcggcgctgcgggtcccagtccaagaagagctgtgtgggctcgcatcaaagccaggtagccgtcgggaggtgtgtcaggcagtgccatgtccagcgaggtggcagtacaagctggccgcatgtagcgtttcatgtggtcggggtgtggtgagaaggatcctgtactgcgcgagagcccatggggaagatgatggggaggaaatccttctggatacccaatgccagggacttcctagaccagagcctcaggaagcatgctctcttgagccatgtcctccaagatggaaggtgatgtcgctgggaccatgttcggcaagctgtggattgggtacggcgcggcggtcggtcgcgtgcgtgcagctggatcagggtcaggatgtggaggtggatgaagcggcatgtgcggctctggtaagacctgaagcatctgtgccttgtctgattgcagactgtacttaccgatggcacgtcgggacgtggatggaatgttcggtgtcctgcggggatggaatccagaggcggcgagacacctgccttggcccgcaggcacaagcaccagtcccagcagatttttgccaacatctgcccaagcctgtgacggtgagaggttgttgggcggggccatgtgtcggacaagggactccatcccttgtgcctcacgaagaggctgccgcacccggtaggactactgcaacccctgctggggcctcgctggagtggtcccaagctcgcgggcttctcttttctccagcccctcagcctcgccgcctgctgccgggcccacaagaaaactcagtccaatcaagcgcatgcggacgccagcacctcgagcccactgggaccatcgacatgagaggcccaggacaagcagactgtgcagtggcgattggacggccccttggggaggtcgtcactctccgggtgcttgaaagctcgcttaactgtagcgccggggatatgctgctgctctggggaaggctcacctggagaaagatgtgccgcaaactgctggacatgacgtttagctcaaagaccaacactctcgtcgtgcggcagcgatgcggacgacctggtggaggtgtgctccttagatacgggagccaactggcacctgaaaccttttacagggaatgcgatatgcagctcttcggtccatggggagaaattgtctccccttcgctctcaccggccacctcgaatgccgggggatgcaggctcttcataaacgtggcacctcacgcaaggattgcaattcatgccctcgccactaatatgggcgcaggtaccgaaggagcaaacgcatcgtacatcctgattagggacacccattcccttagaaccaccgcatttcacggacagcaagtgctttactgggaatcggaatcctcgcaggcagaaatggaattttcagagggatttcttaaagcacaggcctcgcttcggggacaatactggaccctgcaatcatgggtccctgaaatgcaagatccacagtcctggaagggtaaggaagggacc

SEQ ID NO: 5666 - DNA, 4281 bp, Artificial Sequence
  Description of Artificial Sequence: Synthetic coding sequence
atgcaccagcgtcacccaagagcacgctgtccacccctgtgcgtggcaggtatacttgcgtgcggattcctgctgggatgctggggcccttcacatttccaacagagctgcctgcaggcgcttgaaccgcaggcagtgtcgagctatctgagccctggtgctccccttaagggacgaccacctagcccaggcttccagcggcaaagacaacgccaacgaagggcagctggaggaatccttcaccttgaactgctggtggcagtgggaccagacgtgtttcaggcgcatcaagaagataccgagagatacgtgttgactaatctgaatatcggagcggaactgctccgcgaccctagcctcggagcacaatttagggtgcatctcgtcaaaatggtcattttgacggagccggaaggggcgccgaacattactgccaacttgacgtcctctctgctttcggtctgcggttggagccagacgattaacccggaggatgataccgaccccggacatgccgatctggtgctgtacatcacccgtttcgatctggaactgccagatggaaatcggcaggtcaggggcgtgacccaattgggcggcgcctgttcgcccacttggtcgtgtctgattacggaagataccggatttgatttgggagtaacgatcgcccatgagattggtcattcgtttggactggaacacgacggggcacctggttcgggctgtgggccatcaggacacgtgatggcaagtgacggggcggccccgcgagcgggtcttgcctggtccccatgtagccgacgtcagctgttgtccctgctctccgcaggaagagctaggtgcgtgtgggacccaccgcggcctcaaccaggttccgcgggacatcctcctgacgcccagcctggactgtactactcggccaacgaacaatgtagagttgcctttggacctaaggctgtcgcatgtacgtttgcacgagagcacctcgacatgtgtcaagctctgtcgtgtcacaccgatcccctggaccaaagctcatgctcgcgtttgctggtgccactgctcgacggaactgagtgtggagtggaaaagtggtgttctaagggcagatgcaggtcattggtggagctcacgcccatcgctgcagtgcatggccgctggtcctcgtggggacctcgcagcccgtgctccagatcgtgtgggggtggtgtggtgaccaggcggcggcagtgcaacaatccaaggcctgcattcggaggacgcgcctgcgtcggggctgatctgcaagcggagatgtgtaacacccaggcgtgtgaaaaaactcagcttgaattcatgtcgcagcagtgcgcacgaaccgacgggcaacccctccgatcgtcgccaggaggagcgtcgttttaccactggggagcagccgtgcctcatagccaaggagatgcgctgtgtagacacatgtgcagagcaataggagagtcgttcataatgaagaggggagatagcttcctggacggtactagatgtatgccttcgggcccacgcgaggatggtactctctcgctctgcgtctcgggatcatgccggacttttggatgtgacggccgcatggactcgcaacaggtgtgggatagatgccaggtctgcggtggagacaactcgacctgttcacctcggaagggtagctttacggcaggtcgtgcccgcgagtacgtcacctttcttacggtgacccctaatcttacttcagtgtacattgctaaccatcggccacttttcactcatcttgcagtgagaattggtggaaggtacgtggtggcaggaaaaatgtcgatttcgcctaacaccacttacccttccctccttgaggacggacgagtggagtacagggtcgcgctgacggaagatcgcctgccaaggcttgaagaaatcaggatttggggaccacttcaagaagatgcagacatccaagtgtaccggcgctacggtgaagaatacggaaaccttactcgccctgatataacgttcacctactttcaacctaagccacggcaggcgtgggtgtgggcagccgtgcgtggaccgtgtagcgtgtcatgcggcgcaggacttcgctgggtcaactacagctgtctcgatcaggccaggaaggagctggtggaaaccgtgcaatgtcaggggtcccagcaacctccagcatggccggaagcctgtgtgctggaaccttgtcctccttactgggcagtgggagattttggtccttgctccgcatcgtgtggtggcggtcttagggaaagacctgtcagatgtgtggaagcacaaggttcgctgcttaagaccctcccccctgctcgctgccgggcaggagcccagcagccggccgtcgcccttgagacttgtaaccctcaaccatgtccggcccgatgggaagtctccgagccatcgtcctgtacctcggccggaggtgcagggctggccctcgaaaacgagacttgtgtcccaggtgccgatggcctggaagcgccagtgactgaagggccaggctcggtggatgaaaagttgccagcacccgaaccatgtgttggtatgtcttgtcctcccgggtggggtcatcttgatgctacttcggccggggagaaggcaccttccccctggggatcaatccggactggtgcacaagctgcccatgtttggactccggcagccggttcatgttccgtctcgtgcgggagaggactgatggaacttagattcctttgtatggactccgccctgcgggtgccagtccaggaagaactttgtggtcttgcctcgaaaccagggtcgagacgggaagtctgtcaagcagtgccctgcccagcacgctggcagtacaaacttgcagcttgttccgtgtcctgcggaaggggtgtcgtgagacggattctttactgtgcacgggctcatggtgaagatgatggcgaagaaatactgctggacactcaatgccagggacttcctagaccagagcctcaagaagcatgttccctggagccctgccctcctagatggaaggttatgagcctcggcccttgcagcgcatcctgtggcctcggaaccgcaagaagatccgtggcatgcgtgcagttggaccagggccaagacgtcgaagttgatgaggcagcatgtgcagcgcttgtcagaccagaggcatctgtgccatgtctgattgcagattgcacctatcgctggcatgtgggcacctggatggaatgctccgtcagctgcggagatggaatacagcggagacgagacacttgccttggtccacaggcccaggcccccgtgccagccgatttttgtcagcacctgcccaagccggtgaccgtgcggggttgctgggcaggtccttgtgtcggtcaaggaaccccatcactggtcccgcacgaagaggcagcggcaccaggtcggaccaccgccaccccagcaggagcatcactggaatggtcccaagcccgaggcctgttgttctcacccgcaccccaaccaagacgactcctccctggaccacaagagaactcggtgcagtccagcgcatgtggacggcagcatttggaacctacgggaacgattgacatgaggggtccaggacaagccgattgtgctgtggcaatcggtcgtccacttggtgaagtggtgactctccgggtgctggaatcatcactcaactgcagcgcgggtgatatgctgcttctgtggggcaggttgacttggagaaagatgtgtagaaagctgctggatatgaccttttcatccaaaactaatactctggttgtgcggcaaaggtgtggaaggccgggaggcggagtcctcctgagatacggaagccaactcgcacctgagactttttacagggaatgtgatatgcaactgttcggtccctggggagaaatcgtgtcaccatccctgtcgcctgccacttcgaatgccggcggttgcaggctctttatcaacgtggcaccacatgctagaattgctattcatgcactggcaactaacatgggcgcagggactgagggagcgaacgcgtcatacattctgatacgggacactcattccctccgcactactgcatttcatgggcaacaagtgctttactgggaaagcgaatcgtcgcaggcagaaatggagttttccgaaggattccttaaggcacaggcctccctgcgcggtcagtactggaccctgcaaagctgggtgccagaaatgcaagatcctcagtcatggaaaggtaaggagggcact

SEQ ID NO: 5667 - DNA, 4281 bp, Artificial Sequence
  Description of Artificial Sequence: Synthetic coding sequence
atgcaccaaagacatccgagggctcggtgtccgccgctctgcgtggccgggatcctggcctgcggattcctgctgggatgctggggaccctcgcatttccaacaaagctgcttgcaggccctggagccacaggccgtgtcgtcgtaccttagcccgggggccccactcaagggtcggccgccctcgcccggatttcagcgccagcggcagaggcagcgccgggcggcgggcggaatcttgcaccttgagctgctggtggccgtcggtcctgacgtgttccaggcgcaccaagaagatactgaaagatatgtcctgaccaacctgaacatcggagcggaactgctcagagatccgtccctgggggcgcagtttagagtccacctcgtgaagatggtgatcctgactgaaccggaaggagccccgaacatcactgcgaatctgacctcatcattgctttccgtctgtggatggagccaaaccatcaacccggaagatgacactgacccgggccacgccgacctggtgctgtatatcacccgatttgacctggagctccctgatgggaatagacaggtgagaggggtcactcagctcggaggggcctgttcaccaacctggtcctgtctcatcacggaggacacgggtttcgacctcggcgtgactatcgcccacgagatcggacactccttcggactggagcacgacggagcgccgggaagcggctgcggcccgtctggccacgtgatggcgtccgacggcgcagcacctagagccggactcgcatggagcccgtgcagccgacgccagctgctgtcactcctcagcgctgggagagcgaggtgcgtgtgggaccctccgaggccacagccgggttcggctggacatccccccgatgctcagccgggactgtactactcggcaaacgagcagtgccgcgtggccttcggcccgaaggcggttgcatgcactttcgcccgggaacacctcgacatgtgccaggccctctcctgccacacggatccgctcgaccagtcgtcctgttcgcgcttgctcgtgccgctgttggacggtaccgaatgcggcgtggagaaatggtgcagcaagggacgctgccgttcactcgtcgagcttaccccgattgccgcggtccacggcaggtggagctcgtggggaccacggtcgccatgctcccgctcatgtggcggaggagtcgtcacccggaggcggcaatgtaacaaccctcgaccggcgttcggtggccgcgcgtgtgtgggagctgatctgcaggctgaaatgtgcaacactcaggcttgcgagaaaacccaactggaattcatgtcacaacagtgcgcacgcaccgatggtcaaccgctgcggtctagccctggtggagcctctttctaccattggggcgccgccgtgccacactcccagggagacgccctgtgtcgccatatgtgccgcgcgattggagaatcctttatcatgaagcggggtgacagcttcctcgatggaacccggtgcatgccgtcggggccacgcgaggacggaaccctgagcctctgcgtgtccggaagctgccggaccttcgggtgcgatggcagaatggattcgcaacaggtctgggaccgctgtcaggtgtgtggaggcgataactctacttgctcaccacgcaagggatcatttactgccggtcgcgcccgcgagtacgtgacttttctgaccgtcactcctaacctgacctccgtctacattgcgaaccaccggccacttttcactcatctcgcagtgcggataggtggtcgctatgtggtggctggaaaaatgtcgatcagcccgaatactacttacccgtcgcttctggaagatggccgcgtcgaatacagagtcgccctcactgaagatagactcccgcggctcgaggagatccgcatctggggacctctccaggaggacgcagatatccaagtgtaccggagatacggagaagagtacggaaatctgaccagaccagatatcaccttcacttacttccaaccaaaacccagacaagcatgggtatgggccgctgtgcgcgggccttgctccgtgtcgtgcggcgccggcctcagatgggtgaattactcctgcctggatcaagcgagaaaggaactggttgaaacggtgcagtgccaaggatcgcagcaaccgccggcatggccggaggcctgcgtgctggaaccatgcccgccgtactgggcggtcggagacttcggaccgtgctccgcgtcatgtggaggggggctgcgggaacgcccagtgcgctgcgtggaagcccaggggagtctcctcaagactctgcctccagctagatgtagggccggggcccaacaaccggctgtagccctcgaaacttgcaacccccagccttgcccggctcggtgggaggttagcgagccctccagctgcacctccgccggtggcgccggactggctctggagaacgaaacttgtgtgcccggcgcggacgggctggaagcacctgtgacggaaggccccggatcggtggatgagaaactgccggccccagagccgtgcgtcggtatgtcatgccctccagggtgggggcaccttgacgcaacctcagcgggcgaaaaagcgccgtcgccgtggggttcgatcagaaccggcgcccaagccgcgcatgtgtggacccccgccgcgggctcctgcagcgtgtcctgcggaaggggacttatggagttgagattcttgtgcatggactcggccctgcgggtgccggtccaggaagaattgtgtggactggcatcgaagcccggatcgcggagagaagtctgccaggcagtgccgtgccctgcccgctggcaatacaagctcgcagcctgctcggtgagctgcggcaggggagttgtgcgtaggattctttactgcgcgagagcacatggcgaggacgatggagaagagatcctgctcgatacccagtgtcaggggttgcctaggcctgaaccccaggaggcgtgttcactggagccttgtccgcctcggtggaaggtgatgtccctcggaccatgctccgcatcgtgcggactgggaactgccagacggtccgtggcttgtgtccaacttgaccaaggacaggatgtggaagtcgatgaggcggcttgcgcagccctggtccgccccgaggcgagcgtcccgtgtctcatcgctgactgcacctaccgctggcacgtgggcacttggatggaatgttcagtttcctgcggggacggcatccagcgccgccgagacacctgccttggaccacaggctcaagcgccagtgccagcagacttttgccagcacctgcctaagccggtgaccgtgagggggtgctgggcaggcccgtgcgtgggacagggcaccccatccctggtgccccacgaggaggccgccgccccaggccgcactaccgccactcctgctggagcctccctggaatggtcccaggcacgcggactgctcttctcgccggcacctcaaccgcggaggttgctgccaggtccccaagaaaattcagtccagtcgtctgcttgtggacggcagcatctggaaccgactggcactattgacatgcgggggccaggacaagccgactgcgcggtggctattggacggccattgggagaagtcgtgaccctgcgcgtcttggagtccagcctgaactgtagcgccggagacatgctccttctgtggggacgactgacctggcggaagatgtgccgaaagctcctggacatgaccttctcatcaaagacgaacacgctggtggtgcggcagcggtgcggccgcccaggaggtggagtgctcctgcgctacggctcacagctggcgcctgaaaccttctaccgtgaatgcgatatgcagttgtttgggccttggggcgaaattgtgtccccgtcgctgagcccagccacctcgaatgcaggaggatgccggcttttcatcaatgtcgccccacatgcacgcatcgcaatccacgccctggcgactaacatgggtgcaggaaccgaaggtgctaatgcctcgtacatcctgatccgcgacacgcatagcttgcggactactgcatttcatggacaacaggttctctactgggagtcagagtcctcgcaggctgagatggaattcagcgagggcttcctgaaggcccaagctagtctgcgcggacagtactggaccctgcagtcatgggtgccggaaatgcaggacccacagtcctggaagggaaaagaaggaacg

SEQ ID NO: 5668 - DNA, 4281 bp, Artificial Sequence
  Description of Artificial Sequence: Synthetic coding sequence
atgcaccagcgccacccccgggcccgctgcccaccgctgtgcgtggccgggattctcgcctgcggatttctgcttggctgttggggcccgtcacacttccagcagtcgtgcctccaagcactcgaaccccaagcagtgagctcctacctttctccaggcgcccctctgaaaggaaggccgccaagccccggtttccagcggcagagacagagacaacgacgcgccgctggcgggatcctgcaccttgaactgctggttgcagtgggccctgacgttttccaagcgcaccaagaagatactgagcggtacgtcctgaccaatctgaatattggcgcagaactgttgcgcgacccgtccctgggtgcgcagttccgggtccatcttgtcaagatggtcatcctgaccgaacctgagggagcccctaatatcacggcaaacctcaccagctcgttgctgtccgtgtgcggttggagccagactatcaacccggaggatgataccgatccgggccacgcagatctggtgctgtacatcacccgcttcgatctcgagctccctgacggaaaccgccaggtgcgcggggtgacccagttgggtggcgcctgctcgccgacttggtcgtgtctgattaccgaagatactggcttcgacctcggagtgaccatcgcgcatgagatcgggcactcgttcggactcgagcacgatggagctccgggaagcggatgcggtccgtcgggacacgtgatggctagcgatggagcagctccacgtgctggactggcttggtccccgtgttcaagacggcaactgctgagcctgctctcggccggaagagctaggtgcgtgtgggacccgccgcggcctcagcctggttcggcgggacatccgccggacgcccagcccgggttgtactactccgctaacgagcagtgcagggtggcattcggtccgaaggcggtcgcctgcaccttcgccagggagcatctggacatgtgtcaggcgttgtcctgccacacggatccactcgaccagagctcatgttcaaggttgctcgtccctcttctggatgggactgaatgcggcgtggaaaaatggtgtagcaagggccgctgccggtcgctggtggaactgactcccatcgccgcagttcatggacgttggtcatcgtggggaccaagatcgccttgctcaaggtcatgcggaggcggggtcgtgactcgcaggcgacagtgcaacaatccgcgtccggctttcggaggacgcgcctgcgtgggggcagatctgcaggcagaaatgtgcaacactcaagcctgcgaaaaaactcaactcgagtttatgtcccagcagtgcgcccggactgacggccaacccctgaggtccagcccaggcggagcatcattctaccactggggtgccgcggtcccgcatagccagggagatgcgctttgtcgccatatgtgcagagcgatcggtgagagctttatcatgaaacgcggtgactccttcctcgatggaacccgctgtatgccgtccggcccacgcgaggacgggaccctgtcgctctgcgtgtccggttcctgcagaactttcggctgcgacggacgcatggatagccaacaagtgtgggacaggtgtcaggtgtgtggtggagataatagcacgtgctcaccgagaaaggggtcgttcactgctgggagagcccgggaatacgtgaccttcctcactgtcactccaaacctcacttcggtgtacattgcgaaccaccgcccacttttcactcatcttgcagtcaggattggaggaaggtacgtcgtcgccggcaaaatgtccatctcccccaatacgacctacccgagcctgctggaagatggacgggtggaatatagggtggcccttaccgaggacaggctcccaagactggaggagatcaggatctggggaccactccaggaggacgcagacatccaggtgtaccggcggtatggggaggagtacggtaacctcacccggcctgacattacctttacctactttcaaccaaagccgcgccaggcctgggtgtgggccgccgttcgtggaccatgcagcgtctcgtgcggcgccggtctgcggtgggttaactacagctgcctggaccaggcgcgcaaagagctggtcgagactgtccaatgccaaggctcgcaacaacctccggcctggcccgaggcctgcgtgctcgagccttgtcctccttattgggctgtaggggatttcggcccttgtagcgcaagctgcggtggaggactgcgggaacgcccagtaagatgcgtggaggcgcaaggatcactgctcaaaactctgccgccggcacggtgccgggcaggggcacaacagccggccgtggccctggaaacctgcaatccgcaaccttgtcctgcacgctgggaagtgtcagagccgtcatcctgcacctcagctggaggggcgggcctcgcactcgaaaacgaaacctgcgttccgggagccgacggactggaagccccagtgactgaagggcctgggtcggtggatgaaaagctgccagccccagagccgtgcgttggaatgtcatgtccgcccgggtggggacatctggatgcgaccagtgcgggcgagaaagccccttccccttggggatccatccgaaccggagcacaagccgctcatgtgtggacgcctgccgcgggctcttgctcagtgtcgtgcggacgcggtcttatggaactccggtttctctgcatggactcggcacttcgcgtcccggtgcaggaggagctctgtggattggcaagcaagccaggatcacgacgtgaggtgtgccaggcggtgccttgtccggcccgctggcaatacaaactggcagcgtgctcggtgagctgcggtcgcggggtggtccggaggatcttgtactgcgcaagagcacatggagaagatgatggagaagaaatcttgctggacacccagtgtcaaggtctgccacggccagagccacaagaagcctgctcattggagccgtgcccgccacggtggaaagtgatgagtctcggcccgtgctcagcttcatgtggactgggcactgcgcgccgctccgtggcgtgcgtgcagctggaccagggccaggatgtggaagtggacgaagccgcatgcgccgccctggtccgcccagaggcatctgtcccgtgcctgatcgctgattgtacttacagatggcacgtcggcacctggatggagtgctcggtgtcctgcggcgacgggatccagcgccgtcgcgatacttgtttgggaccgcaggcacaggctccggtcccagccgacttttgccagcatttgcccaaaccagtgaccgttagaggctgctgggcgggaccgtgtgtcggccagggaaccccgagcctggtcccgcacgaggaagcagccgcgccgggaagaaccactgccactcccgcaggagccagccttgagtggtcgcaggctagaggacttctgttctccccagcacctcagccgcgcagactgcttcctggaccgcaggaaaatagcgtgcagtcgtccgcctgcggccgccagcatctggaaccgactggtactatcgatatgagagggcccggacaagcggattgtgcggtggctatcggacgccctctcggggaggtggtgactttgagagtgctcgagagctccctgaactgctcggccggagacatgcttctcttgtggggtaggcttacttggaggaagatgtgccgcaagctcttggacatgaccttctcgtcgaaaaccaatactctggtggtgaggcaaaggtgcgggcgccccggcggaggagtcctgctgcgctacggatcccaactggctccggaaactttttacagggaatgcgatatgcagctgttcggaccttggggagaaattgtgtcgccaagtctgtcgcctgccacctcaaacgcggggggatgtcggctcttcattaacgttgctccacatgccagaatcgctatccacgccctggcgactaatatgggggctggaaccgaaggagccaacgcctcatacatcctgatcagagacacgcatagcctcagaaccactgcatttcatggacagcaggtcctgtactgggagtccgaatcgagccaggctgagatggagttctcggaaggatttctgaaggcgcaagcatctctccgcggccagtattggaccctgcaatcatgggtcccagagatgcaggacccacaatcctggaagggtaaggagggtacc

SEQ ID NO: 5669 - DNA, 4281 bp, Artificial Sequence; identical to SEQ ID NO: 5644
  Description of Artificial Sequence: Synthetic coding sequence

SEQ ID NO: 5670 - DNA, 4281 bp, Artificial Sequence
  Description of Artificial Sequence: Synthetic coding sequence
atgcaccagaggcatcccagggcccgctgccctccactctgcgtcgccgggattctggcgtgcgggttcctcctgggctgttgggggccgagtcacttccagcagtcttgcctccaggctctggagccacaggccgtctcatcatacctgtctccaggcgctccattgaagggacggcctccaagtcctggctttcagcgccagcggcagcgccagagacgggccgctggggggatactccacctggagctgctggttgccgttggtcctgatgtgtttcaggctcatcaggaggacacagaacgatatgttctcacaaatctgaatattggggcagagcttctgcgggacccttccctcggcgcacagtttcgggtccacctagttaaaatggttatattgaccgaacctgagggcgcgccgaatatcacggctaatctaacgtcttcgctactgtctgtgtgcggatggtcccaaacgataaaccccgaggacgatactgacccaggtcacgctgacttagtgctgtacatcactcgctttgatctcgagctcccagacggcaataggcaggtacggggtgtcactcagctgggcggggcctgctcacccacttggagctgtttgataactgaggacaccggatttgacctaggggtgacgatcgcacatgagatcggtcactcctttgggctagaacatgacggcgcccccgggtctgggtgcggtcctagtgggcatgtcatggcttccgacggagccgcccctagagccggactggcatggtcaccttgttcccgtcgacagctcctgagtcttctgtccgccggccgggcgcgctgcgtgtgggacccccccaggccacagcccggctccgccggtcacccccctgatgcccagccaggcctatactactccgctaacgaacagtgtcgagtcgccttcggtccaaaagcggtggcctgtaccttcgcaagagagcatctggacatgtgccaggcattgtcttgtcataccgatcccttggaccagtccagttgctcgcgacttttggtgccacttctggacggcacagaatgcggcgttgagaagtggtgctccaagggtcgctgccgctcacttgtggagttgacaccaatcgcggctgtgcacggccggtggagctcctggggaccacgctctccatgctctagatcttgtggggggggtgtggtgacacgccggaggcagtgtaacaaccccagaccagccttcggagggagggcttgtgtgggagctgacctgcaggctgaaatgtgtaacacgcaagcgtgtgagaaaacccagctggagtttatgagtcagcagtgcgcccgcactgatgggcaaccattgaggtcttcgccgggcggcgcctctttctaccactggggcgctgcagtgccccactctcagggcgacgctctatgcagacacatgtgccgtgctattggggagagttttatcatgaagcgaggtgattcctttctcgacggaacaaggtgcatgccctctgggccgcgcgaagacgggactctctccctgtgtgtgagtgggagctgtagaaccttcggttgcgatggtcggatggacagccagcaagtatgggaccgatgtcaggtctgcggcggggataactcaacctgttcccccagaaagggcagttttactgccggtcgggccagagagtatgttactttcttgactgtcacaccaaatctcacgtccgtgtacatcgcaaatcatcgccctctattcacacacctggccgtacggatcggtggccggtatgttgtggccggcaagatgtccatctctccgaataccacctatccttcactgctggaggatgggcgggtggaatatcgtgtggcgttgacagaagaccggctccctcgtctggaggaaatccgcatttggggaccactgcaggaagatgctgacatacaggtgtacaggaggtacggggaggaatacggtaacttgaccagacctgacataaccttcacctattttcagccgaagccgcggcaggcctgggtctgggccgccgtgagggggccctgcagtgtgtcctgtggggcaggtttacgttgggtgaattactcctgcctcgatcaggcccggaaagaactggtggagactgtccaatgccagggctcccagcagcctcctgcatggccagaggcatgtgtcctggaaccatgccctccttattgggcagttggcgactttgggccctgttccgctagttgtggaggagggctaagagaaagacctgtcaggtgcgtggaggcccagggatctctgcttaagaccttgcccccagctcgatgccgggcaggggcccagcagcctgcagtcgcattggagacgtgcaacccacagccttgtcctgctaggtgggaagtcagtgaaccatcatcctgcacctcagccgggggcgccggtttggctctggagaatgagacttgtgttcctggcgctgatggactggaagccccagttacagaggggcccgggtcagtggatgaaaaactgcctgcacccgagccatgcgtggggatgagctgcccccccggatggggacacctggacgcaacgagcgcgggagaaaaagctccaagtccctggggatctatcaggacaggtgcccaggcagcccatgtctggacccctgctgccggttcatgtagcgtaagttgtggtaggggcctgatggagctgcgattcctgtgcatggattcagcgctgcgtgtgccagtgcaggaagaactgtgcgggctcgcctccaagccaggttcccgccgcgaggtgtgtcaggctgtgccatgtcccgcccgctggcagtacaagctggccgcttgctccgtctcctgcggcagaggagtggtgcgccgcatcctgtattgcgcgcgcgcccatggtgaggacgacggggaggagatcctgctggacactcagtgccagggtctgcctagacctgaaccccaggaagcatgcagcctggagccttgcccacctagatggaaggtcatgtctctcggcccatgttccgcaagctgtggtcttggaaccgccaggaggagcgtggcctgtgtgcagctcgaccagggacaagatgtggaggtcgacgaggctgcctgtgccgccctcgttcgacctgaggcctccgtcccatgcctgatagcagactgtacatacaggtggcacgtggggacttggatggagtgttcagtgtcttgcggcgatggtatccaaagaaggcgcgatacctgcctgggacctcaggcacaggctcccgtgcctgctgatttctgtcagcatctgccaaaacctgtaacagttcgaggatgctgggccggcccatgtgtgggccagggcacaccgagtctggtcccacatgaagaggctgccgcacccggtagaaccactgccactcccgctggggccagcctcgagtggtctcaagcccggggactgctatttagtcccgccccccagccgcggcggcttcttccaggacctcaggaaaactcagtgcagagtagtgcctgcggccgccagcaccttgaaccaactggcacgatagacatgcgtggtcctgggcaggcagattgcgcagtggccatcggtcggccactgggtgaggtggttacactccgggtcctcgaatccagccttaactgctctgcaggcgacatgctgctcttgtggggcagactcacctggcgtaagatgtgtcgcaaactgttggacatgacctttagttccaagaccaacacgctagtggtgcggcagcgctgcggccgccccggcggcggagtgctgctgcggtatgggagccagctggctccggagaccttttacagagaatgtgatatgcagttatttggcccatggggggaaatagtgtccccttccctgtcaccagccacatccaacgcaggaggctgtaggctcttcattaatgtggccccccatgcccggattgccatccacgctctcgcaacaaacatgggggcggggacagaaggcgcaaacgcttcctatattctgattcgcgatacacattctctgcgtacaacggccttccacggccagcaagtactttactgggagtccgaaagtagccaggccgaaatggaattcagcgagggttttcttaaggcccaggcatccttgagagggcagtactggacactccaatcatgggtgcctgaaatgcaggatcctcagtcttggaaaggtaaggaggggact

SEQ ID NO: 5671 - DNA, 4281 bp, Artificial Sequence
  Description of Artificial Sequence: Synthetic coding sequence
atgcaccagcgccaccctcgggcacgatgccccccgctgtgtgtggctggaatcttggcttgcggcttcctcctgggctgttggggtccttcccattttcagcagtcttgcctccaggccctggaacctcaggctgtgagctcctatctgtcgcctggagctccacttaaagggcggcccccttcaccaggcttccaacgccaacggcaacgccagcgcagggctgcgggcgggatcttgcacttggaactgcttgtggctgtcggccccgacgtattccaagcacaccaagaggacacggagaggtatgtcctcactaatctgaatatcggggctgaactgctgagagatccatctctcggtgctcagttccgtgtgcacctggtcaagatggttattctgaccgagcccgaaggtgcaccgaacattacggccaatctcactagctcactcctcagcgtctgcgggtggtctcagactataaaccctgaggatgacaccgatcccgggcatgcagacttggtgctatacataacacggttcgacttagagctacccgacgggaaccgacaggtgcggggtgtgacacagttgggtggcgcctgttccccaacttggagttgcctcatcaccgaagacacaggattcgaccttggggtgacaatcgcccacgagatcggtcacagcttcgggctggaacacgacggagcaccaggaagtgggtgcggaccaagcgggcatgtaatggcctcagacggtgccgcgcctagagccggcctggcgtggtccccctgtagccgaagacagctcctctccctcctgagtgctggaagggcccggtgtgtgtgggatccaccgcgaccacaaccagggtccgccggtcacccacccgacgctcagcccggactgtattacagtgccaacgagcagtgcagggtggccttcggtccaaaagccgtggcctgcacatttgctcgagagcacttagatatgtgtcaagccctctcttgccatacagaccccctcgatcagtcctcctgctcgaggttgttggtacccctcctcgatggcaccgaatgcggggtggagaagtggtgctctaaaggccgttgccgatccctggtggaattaacacccattgctgccgtccacggccggtggagttcgtggggaccgaggtcgccgtgttcccgctcttgcggtggaggagttgttacaagacggcgccaatgcaataaccctaggccagccttcggaggaagagcctgcgtgggcgcagatctacaagcagagatgtgtaatacccaggcctgcgagaaaacccagttggaatttatgtctcagcagtgtgcacggactgacggtcagcccctgcggagctcgccgggaggtgcttccttctaccattggggcgccgcggttcctcacagtcagggcgacgcgctctgtcggcacatgtgtagagctatcggggagtctttcattatgaagcgcggcgatagctttctcgatggaacccgctgtatgccgtctggccctagggaagacggaactttgtcgctctgcgtgtctggatcctgccggacctttggatgcgacggaaggatggactcccaacaggtctgggatcgttgtcaggtatgcggaggcgacaatagtacttgctcgccgcgcaagggttcgttcacagccggtagggcaagggagtacgttaccttccttactgtaactccaaatctgactagtgtgtacatcgcgaaccaccgccccctgttcacccatctcgctgttaggatcgggggccggtacgttgtggcagggaaaatgagtatctcgcctaacactacttacccgtcgcttctggaggatgggagggtggagtacagggtggccctgacggaagaccgtctcccccgcctggaggagattcgcatttggggtccactccaggaagatgctgatatccaggtctaccgccgctacggggaggagtatgggaatcttacacgtcctgatattactttcacatattttcaaccaaagccacgacaggcgtgggtttgggccgccgtgcgcggaccctgctcagtctcatgcggagccgggctccgatgggtgaactattcgtgcctggatcaggcccgcaaggagctcgttgagaccgtacagtgccaaggcagtcagcagccccctgcctggccagaggcttgcgtgctggaaccatgtccgccatactgggccgtgggggactttgggccttgtagcgcctcttgtggtggaggactgcgcgaaaggcccgtgaggtgtgtcgaggcccaggggtctctccttaagaccttgccccccgcacgctgcagagctggcgcccagcaacctgccgtcgccctggagacttgtaacccccaaccctgtcccgccagatgggaagtgtccgagccctcctcttgtactagcgccggcggggcgggcttggcattggaaaacgagacctgtgtacctggagccgacggccttgaggctccagtgaccgagggacctggctccgtcgacgagaagctccctgcacccgaaccttgtgttggaatgtcttgtccccccgggtggggtcacctggatgctaccagcgcaggtgaaaaagcaccaagcccctgggggtctataagaaccggtgcccaggcggctcacgtctggacacccgccgcagggagctgctccgtcagttgtgggcggggactgatggagctgaggtttttatgtatggactccgccctgcgggtaccggtgcaggaggaactctgcgggctggcatctaagccaggatccagaagagaggtctgtcaggcagtcccatgcccagcaaggtggcaatacaaactggctgcctgctctgtgtcctgcgggagaggcgttgtccggagaatattgtactgtgcaagggcccatggggaggacgatggagaagagatcttgctggacactcagtgccagggccttcctcgcccagagccacaggaagcctgctctcttgaaccttgccctccgagatggaaggttatgagtttgggaccatgctcagcctcgtgcgggcttggcacagcccgcaggtccgtggcatgtgttcaattggaccagggccaggacgtcgaagtggatgaagccgcttgcgctgctcttgtgcgccccgaagccagtgtcccatgtctgatcgcggattgcacatatcgatggcacgtaggaacctggatggagtgcagtgtgagttgcggcgatggcattcaacgccggagagatacctgtttgggcccacaggcacaggctcccgtccctgctgacttttgccagcatctgcctaagcccgtgacagtgaggggatgttgggctggaccttgcgtgggtcagggcactccctctctggtgccacacgaagaggcggccgcacctggcaggacaactgccacacccgcaggggccagtctggagtggagtcaagcccggggcctcctcttttccccagcaccacaacctcggaggttactgccagggccccaggaaaactctgtacagtcatccgcttgcggccggcagcacctcgagccaacaggaactatcgacatgcgaggccccggccaagcagactgtgccgtcgccattggaagacctttgggcgaggttgtcaccctcagagtcctagaaagctccctcaactgttcggctggtgatatgctgctgttatggggccggctgacctggagaaaaatgtgccgtaaactgcttgatatgacatttagtagtaagactaacactcttgttgtccggcagcggtgcggacgacctggagggggcgtgctgctccgctacggctcccagctagcccctgagacgttctaccgtgagtgcgacatgcagctgttcgggccctggggagagatcgttagcccttccttgagccctgctactagcaatgccgggggttgccggctgtttattaatgttgcacctcacgcccgtatcgccatccatgctttggccactaacatgggcgctggtacagagggtgctaacgcatcttacattctgattcgcgacacccactctttacgaacaaccgccttccacggccaacaggtcctgtattgggaatctgaaagctctcaggccgagatggaattctccgaggggttcctcaaggcccaggcttcactgcgcggtcaatattggaccctccaatcatgggtgcctgagatgcaagacccccaatcgtggaaaggcaaagagggcacc

SEQ ID NO: 5672 - DNA, 4281 bp, Artificial Sequence
  Description of Artificial Sequence: Synthetic coding sequence
atgcaccagcgacacccgcgcgcccggtgtccccctttgtgcgtggccggaatcctggcttgcggattcctgctcgggtgctggggcccgtcgcactttcagcagtcctgcctgcaggccctggagccacaggccgtgtcgtcctacctttccccgggagcccccctgaagggacggccgccatcaccaggttttcagcggcagcgccagcggcaaagacgcgcagcgggtggaatcctgcacctcgaattgctcgtggccgtcggaccggatgtgttccaagcccaccaggaggacactgagaggtacgtcctgactaacctgaatatcggcgccgagctcctgcgcgacccgtccctgggggcacagttcagggttcacttggtgaagatggtgatccttaccgagccagaaggagccccgaatatcactgctaacctgacctcgtcactcctctcggtttgcggttggtcccaaaccatcaacccggaggacgataccgatccggggcacgcggatcttgttctgtacattacccggtttgacctggaactccccgacggcaacagacaggtgagaggggtgactcaactcggtggggcctgttccccgacctggtcgtgtcttatcaccgaggataccggctttgacctcggagtgacgatcgctcacgaaatcggacacagctttggactggaacatgacggagctcctggatcggggtgcggaccgtcgggtcacgtgatggcctcagacggcgccgccccgagagcagggctggcttggtccccctgctcccggaggcagctcctcagcttgctttccgcaggacgcgcgcgatgtgtctgggacccgccacgccctcagccgggatcggccggccaccctccagatgcacaacctggactctactactcggccaacgaacagtgccgcgtcgctttcggtccgaaggcggtggcgtgtacttttgcccgcgaacacttggacatgtgccaagctctttcgtgtcatactgatcccctggaccagtcgagctgtagtcgcctcctggtgccgctgctggatggcaccgaatgtggggtggaaaagtggtgctctaagggccggtgtcgctccctcgtggagctcactccgatagccgcagtgcatggtaggtggtcatcctggggtcctaggagcccgtgcagccggtcatgtggtggcggcgtggtcactaggcgccggcaatgtaataacccgcgcccggcgttcggagggcgcgcctgcgtgggagcagacttgcaagctgagatgtgcaatactcaggcatgcgaaaagactcagctcgagtttatgagccaacagtgcgcacggacggacgggcaaccgctgcggtcgagccccggtggcgcatcgttctatcattggggagcggcggtcccgcatagccagggcgatgctctctgcagacatatgtgcagagcgatcggcgaatcatttatcatgaagagaggcgactcgttcctggacggaacgcgatgcatgccctcagggccccgggaagatggaaccctcagcctctgcgtgtcagggtcctgcagaaccttcggatgcgacggacgcatggattctcaacaagtgtgggacagatgccaggtgtgcggaggtgacaattcgacctgcagccctcgcaagggctcgtttaccgcaggacgtgcccgcgaatacgtcactttcctgactgtcacgccaaacctgacgagcgtctatatcgcaaatcatcggcccctgttcacccacctggcagtgagaatcggtgggagatacgtcgtcgctggcaaaatgtcaatcagcccaaacaccacttacccatccctgcttgaagatggtcgggtggagtacagggtcgcgcttaccgaggacaggctgccaaggctcgaagaaattcgcatctggggccccttgcaagaggatgccgatatccaggtttaccggcgctatggagaagagtacgggaacctcacccgcccggacatcacctttacttactttcagccaaaaccgagacaggcctgggtgtgggcggcggtgcgcggtccctgttcagtgtcatgcggcgctggactccggtgggtgaattactcgtgtctggaccaagctagaaaggaattggtggagacggtgcaatgccagggaagccagcaaccccccgcatggcctgaggcttgcgtgctggaaccgtgtccgccatactgggctgtcggagacttcggaccgtgctcggcatcttgtggaggaggactgagagaacgccccgttcgctgtgtggaagcgcagggatcgctcctcaagaccctgccgcctgctcgctgtagagctggggcccagcaaccagccgtggcgctggaaacctgcaacccgcagccttgccccgcccggtgggaagtgtcggagccttcgtcgtgcacgtcggctggaggtgccggcctggccctggagaacgaaacttgcgtgccaggagccgatggactcgaagcgcccgtgaccgaggggccagggtccgtggacgagaaactgccagcgcccgaaccatgtgtgggaatgtcgtgcccaccaggatggggccacctggacgccacgagcgcgggcgagaaggccccgtcaccatgggggtccatcaggaccggagcgcaggccgcacatgtttggacccctgcagccggatcgtgctcagtcagctgcggacggggccttatggaactccgctttctttgcatggatagcgcgctgcgcgtgccagtgcaagaagagttgtgtggcctggcatccaaaccaggttcgcggcgcgaggtctgtcaagcagtcccgtgtccagccagatggcaatacaagctggcagcttgctccgtgtcctgcggaagaggagtagttagacggatcctctactgtgcgcgggctcatggtgaggacgacggagaagaaatcctcctcgacactcagtgccagggactgccacgcccggagccacaggaggcatgttcgctggaaccatgtcctccgcgctggaaggtcatgagccttggtccgtgctcggcctcttgtggactgggaaccgcacggaggtcggtagcctgcgtgcagctggatcaaggacaggatgtcgaggtggacgaagccgcgtgcgctgccctcgtccgcccggaggcctcggtcccgtgcctcatcgccgactgcacctaccggtggcacgtcggcacctggatggaatgctcagtttcgtgtggcgacggaattcaacgccgcagggatacctgcctgggcccgcaggcgcaggccccagtcccagcagatttctgccagcacctcccaaagccggtgaccgtgcggggctgctgggccggaccgtgcgtaggccagggaactcccagcttggtgccgcacgaagaggcagccgccccgggtcggactactgcaactccggctggcgcatcccttgaatggtcccaggcacggggcctcctgttcagcccggctcctcagccacgccgccttcttccgggacctcaggagaacagcgtgcagtcgtcggcctgcggacgtcagcatttggagccgactggtactatcgacatgcgcggtccggggcaagctgattgcgctgtggcgattggaaggccactgggggaagtggtgaccctgagagtgttggagtcctcccttaattgcagcgctggggatatgctcctcctgtggggtcgactgacctggcgcaagatgtgtcgcaaactcctggacatgactttctcctccaagaccaacacgctggtggtgcggcagcgctgcggacggccaggaggaggagtccttttgcgctatgggtcgcaactggcgcccgagactttctatagggaatgcgacatgcaactgttcggcccatggggggaaatcgtgtccccttcgctttctcctgcgacttcaaacgcgggaggttgtcggctgtttatcaacgtcgctccacatgcaaggattgcaatacacgcactggccactaacatgggagctggaactgaaggggccaatgcgtcatatatcctgatccgggatacccattcgctgcggaccactgccttccacgggcaacaagtcttgtactgggagtcagaatcctcgcaggcagaaatggaattttcggagggttttctgaaagcgcaggcttcgctgcgcggacaatactggacgctgcagtcctgggtgcctgaaatgcaggacccgcaaagctggaaggggaaagaaggaacg

SEQ ID NO: 5673 - DNA, 4281 bp, Artificial Sequence
  Description of Artificial Sequence: Synthetic coding sequence
atgcaccagagacacccccgggccaggtgtccacctctttgtgtggccgggatcctcgcgtgtgggttccttctgggttgctgggggccgagtcactttcagcagagctgtttgcaggccctggaaccacaggccgttagctcctacctcagcccaggcgcgccgctcaagggccgaccccccagccctgggttccagaggcaacgacagcgccagaggcgagccgcaggcggaatcttgcacttagagctcctggtcgccgtgggacctgatgtcttccaagcccatcaggaagatacggaaagatacgtactcacgaacctgaatatcggcgccgagttgctgagagacccgtcattaggggcccagttcagagttcacctggtgaagatggtgatcttgaccgagcctgagggggcccccaacattacagccaatctgacctccagcctgctgtctgtgtgcgggtggtctcagacaatcaatccagaagatgataccgacccaggacacgccgacctggtgctgtatatcactcggttcgacctcgaattacctgatgggaataggcaagtgagaggggtcacccagctcggaggagcttgtagcccaacttggtcttgtttaatcacggaggatactggatttgaccttggtgtgaccatcgcgcacgagatcgggcattccttcggactggagcatgacggagcaccgggctctggatgcggacccagtggacatgtgatggcctccgacggagccgctccacgggcagggttggcctggtcaccctgctcacgaagacagttgctctccctgctgtctgctggaagagccagatgcgtgtgggaccctccccgcccacagcctggctcagctggacacccccctgatgctcagcccggcctgtattacagtgcaaacgaacagtgtagggtggccttcggaccgaaagccgtcgcatgcacattcgcacgggagcatctggacatgtgccaggccttgagttgccacaccgacccgctggatcagagcagttgttctcgccttctcgtccctcttttggacggtacagagtgtggcgtggaaaagtggtgctctaaaggcaggtgccgcagtttggtggaactgacacctatcgccgcagtccatgggcggtggtcctcatggggcccccggtccccctgttctcggtcttgcggaggcggggttgtcacacgccgtcggcagtgtaacaatccacggccagccttcggcggccgcgcatgcgtgggagccgacctgcaggccgaaatgtgtaacacccaggcctgtgagaagacacaactagagtttatgtcccagcagtgcgcccggaccgatggccagcccttgaggtcatcccctggaggggcctctttttaccactggggggccgccgtccctcacagtcagggcgacgccctttgccgacacatgtgtagagccataggtgaaagctttatcatgaaacgaggggactcgttcctggatggcacacgctgcatgccctctggccctagggaggacggcaccctctcattatgtgtatccgggtcctgcagaacatttggctgcgatggaagaatggatagtcaacaagtctgggatcggtgccaagtgtgtggaggagacaattctacttgcagtcctcgcaaagggtcgttcaccgccgggcgcgccagagagtatgtgacatttctcaccgtgacgcccaatcttacctctgtgtatatcgcaaaccaccgccctctgttcactcacttggctgtgcggataggcggaagatacgtggtagcgggcaagatgagcatttccccgaatacaacttacccctctctgctggaggacggccgagtagagtacagagtagccctgaccgaagataggctgcctcggctggaggagatccggatatgggggccgcttcaggaggacgcggatatacaggtctaccggagatacggtgaagaatacggaaacctgacccgtcccgacatcactttcacgtatttccagcctaagcctagacaggcctgggtctgggccgccgtgcgggggccatgctcggtctcctgtggggccggcctgcgttgggtcaattactcttgcctggatcaggcaaggaaggagctggtcgaaaccgtccagtgccagggatctcaacaacctcctgcatggccagaggcttgcgttcttgagccttgccctccctactgggctgtaggagattttggtccatgttcagcctcttgcggtggcgggttgcgagagaggcccgtgcgctgtgtcgaggcacaagggtcgctgctcaaaaccctgccacccgcaagatgtagagcaggggcccagcagccggccgtggcgctagaaacctgtaatcctcagccttgtcccgcgcgctgggaagtgagtgaaccgagcagctgcaccagcgcgggcggggccggcctcgccctggagaatgaaacctgcgttcctggtgccgacggcctcgaggccccggtgactgagggtcccggctccgttgacgagaaattgccagcacccgaaccctgcgtgggaatgagttgccccccaggctggggacacctcgacgccacttccgccggggagaaggcaccttccccgtggggatcaatcaggactggagcacaggccgctcatgtgtggacaccggccgcgggaagttgctccgtctcctgcggccgtggtctgatggaattgcggtttttgtgcatggattctgcccttcgggttcctgtgcaggaggagctctgcggactggcctctaaacctggttctcgccgggaggtttgtcaagcagtgccttgtcccgcccgttggcaatacaaacttgccgcttgctctgtcagctgcggcaggggagtggtccgacggatcctatactgcgctcgggctcatggcgaggacgatggggaagagattctgctcgacacgcaatgtcaggggctgccccggcctgagccacaagaggcatgttctctggagccatgccccccccggtggaaagtgatgtctcttgggccatgctctgcaagttgtggactgggaactgcccgcaggagcgttgcatgtgtgcagctggaccagggacaggacgtggaggttgatgaggccgcctgcgctgccctcgtcaggcccgaggccagcgtgccttgtctgatcgccgactgtacataccggtggcatgtaggaacctggatggagtgcagcgtttcctgcggtgacggaatccagcggcggagggacacctgcttaggacctcaggctcaagcacctgtcccagcagacttctgtcagcacctcccgaagccagttacagtaaggggatgctgggcgggaccctgcgtgggacagggtacacccagtctggtaccgcatgaagaggccgcagcacccggtcggacaacggcgacacccgctggcgcatctctcgaatggagtcaggcccgcggtttactcttctcaccggccccacagcccaggagactgcttccgggcccgcaggagaacagcgttcagagttcagcttgtggtcggcagcacttagagcctaccggcaccatcgacatgagagggcctgggcaggctgattgtgcagttgctattggcaggcctctgggcgaagtggtgactctccgcgtgctggaatcgtcgctgaactgcagcgccggtgatatgctgctgctgtggggcaggctgacgtggcgaaaaatgtgtagaaagctgcttgacatgacttttagtagcaaaacaaatacactcgtggtgagacagcgctgtggccggcccggcgggggggtgctgcttcgctatggctcccaactggcgccagagactttctaccgcgaatgcgatatgcagctgttcggtccctggggggagatagtaagcccgagtttatctcctgccaccagcaacgcgggagggtgcagacttttcatcaatgtagcccctcacgcacgcatcgccattcacgcactcgctaccaatatgggggccggcacggaaggtgcaaacgccagctacattctgattcgagacacccactctctcaggacaaccgccttccacggccagcaagtgctctattgggaatccgagagcagccaggccgaaatggaattctctgagggctttctcaaggcccaggcttcccttcggggccagtattggacgctccaatcttgggttccggagatgcaagatccccagtcctggaaaggcaaggagggcacc

SEQ ID NO: 5674 - DNA, 4281 bp, Artificial Sequence
  Description of Artificial Sequence: Synthetic coding sequence
atgcatcagcggcatccgcgcgcccgttgccctcctctctgcgtggctgggatcctcgcgtgtgggttcctgcttggatgctggggaccgtcacacttccagcagtcctgcctccaggccctcgaaccgcaggctgtctcgagctacctgtccccaggtgccccactgaagggacgcccgccttccccgggttttcagcgccaacgccaaagacagcggcgagccgcgggaggaattctgcatctcgaactcctggtggccgtcgggccggacgtgttccaagcgcaccaagaagatactgagaggtacgtcctcactaatttgaatatcggagcggaactgctgcgggacccatcgcttggtgcccagttccgagtgcacctggtcaagatggtgatcctcaccgagcctgaaggagcgccaaatatcactgccaacctcactagctccctcctgtccgtctgtggatggtcgcaaaccatcaatccggaagatgacacggacccggggcatgctgatctggtgctgtatatcaccaggttcgatctggagctccccgatggcaacagacaggtccgtggcgtgactcagctcggcggggcctgcagtccgacttggtcatgcctgatcactgaggataccggcttcgatctgggcgtgactatcgcacatgaaatcggccattcgtttgggttggaacatgacggggcacccggatctgggtgtgggccgtccggacacgtgatggcctccgacggcgccgcaccgagggccggactcgcctggagcccgtgcagccgccggcagcttctgtcgctcctctcagcgggaagagcgagatgtgtctgggatccgccgcggcctcagccaggatcggcaggacacccccctgacgcacagccgggactgtactactccgccaacgaacaatgtagagtggcctttgggcccaaggcggttgcgtgtacgtttgcccgcgaacatctggatatgtgccaggcgctctcgtgtcacacggatccgcttgaccagtcgtcgtgctctaggctgttggtgccgctcctggatggcactgagtgcggcgtggagaaatggtgcagcaaaggacggtgccgctcgcttgttgagctgaccccaatcgccgcagtccacggccgttggagcagctggggccctcggtccccgtgctcaaggtcgtgcggcggaggcgtggtcacccggcgcagacagtgcaacaatccacggccagccttcgggggcagagcctgcgtgggagccgaccttcaagcggagatgtgcaatactcaagcctgcgaaaagactcagctggagtttatgtcgcagcagtgcgctcgcaccgacggacagcctctgagatcgtccccgggcggagcctcattctaccactggggagcggcagtgccgcattcgcagggcgacgcgctgtgcaggcatatgtgccgggcaatcggagaatcgttcatcatgaagcgcggcgactcgttcctggacggaactaggtgtatgccatcagggcctagggaagatggaactctgagcctttgtgtgagcggatcgtgtagaaccttcggctgcgacggaagaatggattcgcagcaggtctgggatagatgccaggtgtgcgggggtgacaactccacttgttcgccgaggaagggatcgttcactgccggccgcgcacgggagtacgtgactttcctcactgtgactccgaatctgacctcggtctacattgccaaccaccggcccctcttcacccatctggccgtgcggatcggcggccggtacgtggtcgctggaaaaatgtcgatttcgccgaacacgacctacccatcactgctcgaagatggccgggtcgaatacagggttgccctgactgaagatcgcctgccccgcctggaggaaattcgcatctggggacctctccaggaggacgccgatattcaggtgtaccgccgctacggcgaggaatacggcaacctcacccgcccggatatcaccttcacctacttccaacctaagccgaggcaggcgtgggtttgggccgcagtgcggggaccgtgttccgtcagttgtggtgcgggtctgagatgggtgaactactcctgcctcgaccaggccaggaaggagctggtggaaactgtccagtgccagggaagccagcagcccccggcctggcccgaggcctgtgtgctggagccatgcccgccctactgggccgtcggagactttggaccatgctcagcatcgtgtggcggaggccttagggagcgcccggtgcgctgcgtcgaggcccaaggatccctcctcaagactttgccgcctgcaaggtgtagagccggagcacagcagccagcggtggctctcgagacttgtaatccgcaaccgtgccccgcgcgctgggaggtgagcgagccgtcctcctgtacttctgccggaggagcgggattggctctggaaaacgaaacctgcgtgccaggagcggacggactggaggcacctgtgacggaggggccgggatcagtcgatgaaaagctgccggctcccgaaccctgcgtcggaatgtcgtgcccaccgggatggggtcacctcgatgcaaccagcgccggtgagaaggccccatcgccatggggatcaatcagaactggagcccaggcggcccacgtgtggacgccggcagctggatcctgttcggtgtcgtgtggacggggactcatggagctgcgcttcctgtgcatggactcggcactgcgggtgccggttcaagaggaactctgtggcctcgcgtcgaagccgggctcccgccgcgaggtgtgccaagccgtgccctgtccagcccggtggcaatacaagttggcggcctgcagcgtgtcctgtggacgcggagtcgtccggcggattctctattgcgcgcgcgctcacggtgaggacgacggagaagaaatcctgctggatacccaatgtcagggcctgccacgaccggaaccgcaggaagcgtgttccctcgagccgtgtcctccgcgctggaaggtgatgtcgcttggcccatgctccgcgtcatgcgggttgggtactgctcgcagatccgtggcctgcgtccagctcgatcaaggacaggacgttgaggtcgatgaggctgcgtgcgcggccctggtgaggcctgaggcttcggtcccctgtctgatcgctgattgcacgtatcggtggcacgtgggaacctggatggagtgctccgtctcctgcggagacggaatacaaagacggcgcgatacctgcctgggaccacaggcacaggcgccggtccccgctgatttttgccagcacctgccgaaaccagtgacggtgagaggctgctgggcgggaccgtgcgtggggcaggggaccccatccctggtccctcatgaggaagcggctgcaccagggcggactactgccactcctgccggagcttcactggagtggtcgcaggcgcgaggactgctgttctcgccagctcctcagcccagacggctgcttcctggaccgcaagagaacagcgtgcagagctcagcttgtggtcggcagcaccttgaaccaaccgggaccattgacatgcggggtccgggccaggctgactgcgcggttgccatcggtcgcccactgggcgaggtggtgactctgcgcgtgctggagtcgtcactcaactgcagtgctggtgacatgctgctcctctggggacggcttacttggaggaagatgtgcaggaagctcctcgatatgaccttctcttcaaagaccaatacgctcgtggtgcggcaacggtgcggccggccgggaggtggcgtgttgctcaggtatggatcacagctggctccggaaaccttctatagagaatgcgacatgcaactcttcggaccatggggggaaattgtttccccatccctgtccccagcaacctcaaacgcaggcggttgtcgactcttcatcaacgtggccccgcacgctagaatcgcgatccacgcgctcgccactaacatgggggcaggcactgaaggtgcgaacgcatcctacattctgatcagggacacgcattcgctccggactaccgcttttcatggacaacaagtcctttactgggaatcggaatcatctcaagcggaaatggaattcagcgaagggtttctcaaggcgcaggcatccctccgcggacagtactggactctccaaagctgggtgccggaaatgcaggacccacagtcctggaaaggtaaggagggaacc

SEQ ID NO: 5675 - DNA, 4281 bp, Artificial Sequence
  Description of Artificial Sequence: Synthetic coding sequence
atgcaccagcgacatccgcgagctcgatgcccccccttgtgcgtggcaggtattctcgcttgtggcttcctgctgggttgctggggcccctcccactttcagcagtcgtgtctccaggctttggagccacaggcagtgtcctcctatctctcgcctggcgcccccctgaaaggccgccccccctcacccggcttccagaggcagcgccaaaggcagcggagggctgcaggggggatactgcacttggagctcttggtggctgtggggcccgatgtgtttcaggctcaccaggaggataccgagcggtatgttttaactaacctgaacatcggtgctgaattgctgcgggatccgagtctgggggcacagttcagggtgcacttagtgaagatggtaatcctgactgaaccggagggagctcccaacattacagctaacttgacatccagtctgttgtctgtatgtggttggagccagacaataaaccctgaggacgataccgatccaggccatgccgatttggttctatacatcacccggtttgacctcgaactgcccgacgggaacagacaggttagaggagtgacacagctcggaggcgcatgctctcccacttggagctgcctcatcactgaggacacaggcttcgatctgggagtgaccattgcacacgaaatcggccactcctttggcctggaacacgatggagctcctggcagcgggtgtgggccatctggccacgtcatggcgtctgacggggcagcaccaagagcgggtttggcgtggtctccttgttctcgccggcagttgctttccctgttgtcagccgggcgggcacgttgcgtgtgggatccacccagaccccagcccgggtctgctgggcacccccccgacgcgcaacccggactctactactctgccaatgaacagtgcagggtcgctttcgggcccaaggctgttgcctgcaccttcgctcgagagcacctagatatgtgtcaggctctgtcgtgccacacggatcccctggaccagtcctcctgttcccgattactcgtccctctgctcgacggcactgagtgcggcgtggaaaagtggtgcagcaaggggcgatgtcgctctcttgtcgagctgacgccaattgccgcagtgcacggacgttggtcgagctgggggccaagatccccttgtagcagatcctgtggtggtggagtcgtaacacggcgacggcagtgcaacaatccccggcccgccttcggcgggagagcgtgcgtcggtgccgacttgcaggcagagatgtgcaacacgcaggcctgcgagaagacacagctggagtttatgtcccaacagtgtgctcgcactgacggacagcctctccgctcctccccaggcggcgctagtttctaccactggggggcagctgtgccacactctcagggtgacgctctgtgcaggcacatgtgccgtgccattggggaatcttttatcatgaaacgaggggactctttcctggacggaacccgctgtatgccttcgggccctcgggaggacggaaccttgtccttatgtgtaagtgggtcatgcaggaccttcggttgcgacggaagaatggactcgcagcaggtgtgggaccgttgtcaggtttgcggcggcgataactcgacctgctcacctcggaaggggagctttactgcaggtagggcccgggagtacgttacctttctgaccgttacgcctaacttgacctctgtgtacattgctaaccaccggccactcttcacgcacctggctgtccggattggaggcagatacgtggtggccggaaagatgtccatttcaccaaatacaacttatccttcacttctagaggatggtcgggtcgaataccgggtggctctgacggaagatcgtctccctcgcttggaagagattcggatctgggggcctttacaagaggatgcagacattcaggtataccggcgctacggggaggagtacgggaacctgacccgcccagacattacttttacctacttccagcccaagcctcggcaagcatgggtgtgggccgccgtgcgcggcccttgttcagtgtcgtgtggtgccggcctgaggtgggttaactattcttgtttggaccaggcacgtaaagagctcgtggaaacggttcagtgtcagggcagtcagcagccacccgcatggccggaagcttgtgtgctggagccttgtcctccctactgggccgtgggcgatttcggtccttgcagcgcatcttgcggcggtggactgagagaaagacccgtgcgttgcgtcgaggctcagggcagcctcctgaaaaccctcccaccggctaggtgccgggccggagcacagcagcccgcggtggccttggagacttgtaatccccagccatgccctgctcgttgggaggtgtctgaaccttcatcctgtacatctgccggaggagccggattggccttggaaaacgagacctgtgtaccaggagcagatgggctggaagcccctgtaacagaaggaccgggcagcgtggatgaaaaactgccagcacccgagccctgcgttggaatgtcctgccctccaggatggggccatctggacgcgacctcggctggcgagaaagcgcctagcccctggggatcaattcgaacaggcgctcaggctgcgcatgtttggacgcctgccgctggatcttgcagcgtgagctgcggccgaggcctgatggagctgagatttttgtgcatggactccgccttgcgcgtgccagtccaagaagagctctgcgggctcgcttcaaagccaggatctcggagagaggtttgccaggctgttccttgcccggctcgatggcagtataagctcgcagcatgctccgtttcatgcggtagaggggtggtgaggagaattttgtactgcgcacgcgctcatggggaagacgacggggaagagatccttctcgacacccagtgtcaaggactaccccgtcccgagccacaggaggcctgcagcttggagccatgcccccctaggtggaaagtgatgtccctgggcccttgctctgcgtcttgcggcttggggacagcccgccgttcagtggcatgcgtgcagctcgaccagggacaggatgttgaggttgatgaagccgcttgcgccgccctagtcagacctgaggcatccgttccttgcttaattgccgattgtacataccgctggcacgtaggcacctggatggagtgttctgtttcgtgcggggatggcattcagagaaggcgcgatacgtgcttggggccccaggcgcaggcacctgtcccggctgatttttgccaacatctgcctaagccagtgacagtaaggggctgttgggccgggccgtgcgtcggccagggcacaccctcgttagttcctcacgaggaggccgcagccccgggacgtaccacagcaacacccgcaggggcctccctggagtggagccaggccaggggccttttattctcacctgctccgcaacctaggaggcttctccccggtccacaggagaactctgtccagtcttccgcctgtggccggcagcatcttgaacccacagggaccatcgacatgagaggccctggccaggctgattgcgcagtggctatcgggagacccttgggcgaagtggtgaccctccgggtactcgaatccagcctaaattgtagtgcaggcgatatgctgctgctgtgggggcggttgacctggaggaagatgtgcagaaagctcctcgatatgacattctcctctaagactaacacgttagtcgtgaggcagagatgtggacgaccgggtgggggtgtacttctgagatacggatcccagttagccccggagactttctaccgggagtgcgacatgcagctatttgggccttggggggaaatcgtgagcccttccctctcacctgccaccagtaacgcaggcggctgtcgcctgttcataaatgttgctcctcacgcgcgtattgccattcatgccctagctacgaacatgggagccggaacagagggggccaatgcgtcatacattctgattcgtgacacccactctcttcgcaccacagccttccacgggcagcaggttctctactgggaatctgagagctcccaagccgaaatggaattttcagaaggctttctgaaggcgcaagcatccctgcggggtcagtactggactttgcagtcttgggtgcctgagatgcaggatcctcaatcctggaagggcaaagaagggact

SEQ ID NO: 5676 - DNA, 4281 bp, Artificial Sequence
  Description of Artificial Sequence: Synthetic coding sequence
atgcatcagcggcatccccgcgcgcggtgtccgccgctttgcgtggctggcattttagcgtgcggttttctcttgggatgctggggcccttcgcacttccaacaatcctgccttcaggctcttgaaccacaggcagtgtcctcttacctcagtcccggcgccccactaaagggccgccccccgtctccgggtttccaacgccagaggcagcggcagcggcgtgcggctggagggatcctgcacctggagctcctcgttgccgtgggcccggacgtattccaggcccaccaggaggataccgagaggtacgttctgaccaatctgaatattggagccgagctactgcgcgaccccagcttgggagctcagttccgcgtgcacctggtgaagatggttatcttaacagagccggagggggctccgaatatcacggccaacctgacaagcagcctgttgtctgtgtgtggttggtcgcagaccatcaaccctgaggatgacactgatccggggcacgcagatctggtcttgtatattacaaggttcgacctggaactgcccgatggtaaccgtcaagtcaggggtgtgacgcaactggggggtgcctgctcaccaacatggtcctgccttataacagaggacacgggattcgacctaggcgtgacgattgcccacgagattggacactcctttggactggaacacgacggggcacccggcagtgggtgtggaccaagcggccatgttatggccagtgatggagccgcgccccgtgcaggcctggcctggtccccgtgcagtaggcggcaactcctttcattgctgagtgcgggtcgcgcgcgctgcgtgtgggatccaccgcggccccagccgggttcggcaggtcacccgccggacgcgcagccagggttgtattactccgcgaatgagcagtgcagagtggcttttggaccaaaggcagtggcctgcacattcgctcgcgagcatctggatatgtgccaagccctctcctgccacacagatccattggatcagtcgagttgttcacgcctcctggtgcccctgctggacggcactgagtgcggcgtcgaaaaatggtgctccaaggggcgctgccgctccttggtggagctcacacccatcgccgccgtccacggacggtggtccagttggggaccccgtagcccatgtagtaggtcttgcggcggaggcgtcgttaccagacgccgccagtgcaataacccgcgcccagcgttcggaggacgcgcgtgtgtgggcgccgacctgcaggccgagatgtgtaatacccaggcctgcgagaagacacagctggaatttatgagtcagcaatgcgcgcgtacagatggacagcccttgaggagttcacccggaggcgcgtcgttctaccactggggagctgccgtgccacattcgcagggagatgccttgtgcaggcatatgtgccgcgccatcggggagagcttcattatgaaacgtggcgatagcttcctggatggaactcgttgcatgcccagcgggccccgcgaagatggcaccctgagtttgtgtgtgagcggttcatgccgtactttcggctgcgacggccgcatggactcccagcaggtctgggaccgctgccaggtgtgcggcggtgacaatagtacctgttccccccgaaagggttcctttaccgcaggccgcgcgcgggagtacgtgactttccttactgtaaccccaaacctgacgtcagtgtatatcgctaaccaccgcccactattcacccatctggcggtacgaatcggcggacgctatgtggttgcgggcaagatgtccatcagccccaatacaacgtatccgtccctgcttgaggacggtcgggtggagtatcgtgttgctctgaccgaggataggctgccgcgcctggaggaaattagaatctgggggcctctccaagaggacgccgacatccaggtgtatcgccgctatggcgaagaatatggaaacctgacccggccggacatcacgttcacatatttccaaccgaagccacgccaggcctgggtctgggccgccgtccggggcccatgctcagtgagctgcggcgccggactccggtgggtaaattattcctgcctagaccaagcccggaaagagctagttgaaacggtacagtgccagggctcacaacagcctcccgcatggccggaggcatgtgttcttgagccctgcccaccatactgggccgtgggtgacttcggaccttgcagtgcctcttgcggaggaggtttgagggagagaccagtgcgatgcgttgaagcccagggaagcctattgaagacactgcccccagctcgctgccgcgccggtgcccaacagcctgctgtcgcgctagaaacgtgtaatccccagccgtgtccggcccgctgggaggtatcggaaccaagctcttgcacctccgctggcggggccggcctggcgcttgagaatgagacctgcgttcccggagctgatggactcgaggccccggttaccgaaggcccaggttctgttgatgagaagctgcccgcgccggagccctgcgtcggcatgagctgccctcccggttggggccacctggatgctacatctgcaggcgagaaggcgccgagcccatggggcagtatccggacgggcgcccaggctgcccatgtctggactcctgcagcgggcagttgctcagtgagctgcgggcggggactgatggagctacgcttcctatgcatggactcggcgttgcgcgtgccagtgcaggaagaactgtgcggcctggcttcgaagccaggtagtcgtcgcgaagtttgccaggctgtgccctgcccggcgcggtggcagtacaagttggctgcctgcagtgtgtcctgtggtcgcggggtggtgcgacgaatcctgtactgtgcgagagcccacggagaggatgacggagaggagattcttctggatacccaatgccaaggcctgccacgccctgagccgcaggaagcctgtagcctggaaccgtgcccgccacggtggaaggttatgtccctcggaccgtgctcagcgagctgtggcctcggcacggcgcgacgctccgttgcttgcgtacaactagaccaagggcaggacgttgaggtggatgaagcggcctgcgccgccctggttagacccgaggcgagcgttccctgcctcatcgcagattgtacttacaggtggcacgtcggaacatggatggaatgtagtgtatcgtgcggagacggcatccaacgtcgacgcgacacctgcctgggtccgcaggcgcaggctccagtccccgctgatttttgccaacatctaccaaaaccggtgacagtacgaggatgctgggccggcccctgcgttgggcagggaacgccgtcgctggtgccgcatgaagaggccgctgcccccgggcgtacgacagcaacaccggctggtgcctccctagagtggtcccaagctcgtggcctgctgttttcgccggctccacagccgcgaaggttgctgccaggccctcaagaaaactcggtccagtcctccgcctgtggacggcagcacctcgaacctaccggcacgatagatatgaggggaccgggtcaggctgactgtgctgtggccattggccgacccctgggtgaagtggtcaccctaagggtattggaatcctccttaaactgctccgccggcgatatgcttctgctgtggggacgccttacctggcgaaagatgtgtcgcaagttactggacatgacgttctcctcaaaaacaaacacgctggtggttaggcagcggtgcggaaggcccggaggcggggtcctactgaggtatggctcccagcttgctcccgagacgttctaccgcgagtgcgatatgcagctgttcggcccatggggggagatagtgtccccgtcgttgagccccgctacgagcaatgccggaggctgtcgtctgttcataaacgtagccccccacgcgcgtattgcaatacacgccctggctacaaatatgggcgcaggcactgagggcgccaacgcttcctatatcctgatccgggacacacatagtctccgcaccacggcgttccatggccagcaggtgttatactgggaatccgagtcaagccaggccgaaatggaatttagcgagggatttctgaaggcccaggcctcactgcgcggccagtactggaccctgcagtcgtgggtacctgagatgcaggatccgcaatcctggaagggaaaggagggtact

SEQ ID NO: 5677 - DNA, 4281 bp, Artificial Sequence
  Description of Artificial Sequence: Synthetic coding sequence
atgcatcagaggcacccgcgggctaggtgcccgccgttgtgcgtcgcgggaatcctcgcttgtggatttttgctcgggtgttggggaccgagccatttccagcagtcctgcctgcaggctcttgaaccacaggccgtctcgtcatacctcagtccgggggccccgctgaaaggccgccctccatcgccgggatttcagcgccagcgccaacgacagagaagggcagccggaggcatcctccatcttgagctgctcgtggctgtgggtcctgacgtgttccaggcccaccaagaggacaccgagcgctacgtgctgactaatctgaacatcggcgcggaactcctccgtgatccaagcctgggagctcagttccgcgtgcaccttgttaagatggtgatcctgaccgagccagaaggcgctccaaacattaccgccaacctgaccagctccttgctgtcggtgtgtggttggtcgcagaccattaatccagaggatgacaccgatcctggccacgctgatcttgtgctctacatcactcgtttcgacctggaattgccggacgggaaccgccaggtgcgcggagtgacccaactgggtggcgcctgcagcccaacgtggtcgtgtctgattactgaagatacggggtttgatctgggagtgactatcgcgcacgaaatcggacactcgttcggtctggaacacgacggcgcaccggggtcaggatgcggcccgtcgggacatgtcatggcatcggacggagccgcgccaagagccggccttgcttggtcgccttgctcacgccgccaactgctgagcctgctgtcggctggaagggcacgctgcgtgtgggacccgccgcggccgcaaccgggatccgcagggcacccaccggatgcccaacctggactgtactatagcgccaacgaacaatgccgggtggctttcggacctaaagccgtggcgtgcaccttcgcgagagaacacctggacatgtgtcaggccctgagctgtcatacggacccgctggatcaatcgtcttgcagtcgactgttggtgccgctgctggacggaactgagtgcggcgtggagaagtggtgttcaaagggccgctgccggtcactggtggaactcacccctatcgcagcagtgcacggccggtggtcgtcctggggtcctaggagcccttgttcacggtcctgcgggggaggagtggtgactcgccggagacagtgcaacaatccgcggccagcgttcggcggacgggcctgtgttggcgctgacctccaagccgaaatgtgcaatacccaggcttgcgaaaagactcagctggaattcatgtcacaacagtgcgctcggaccgacggacaaccgctgaggtcgtccccgggaggtgcctccttctaccactggggagctgcagtgcctcattcacagggggatgctctttgtagacatatgtgtcgggcaattggggagtccttcatcatgaagcgcggagactcgtttcttgacggcacgcggtgcatgccgagcggtccgagagaggatggtaccctgtcgctgtgtgtgtcgggttcctgtcggacctttggatgcgacggacggatggactcccagcaggtgtgggaccggtgccaagtgtgtggaggggacaactccacttgttccccgcggaagggatcctttactgccggaagagctcgggagtacgtgaccttcctcaccgtgactcctaacttgacctcagtgtacatcgcgaaccaccggcccctcttcactcatctggcggtgcgcatcggtggacggtacgtcgtggccggtaagatgtcaatctccccaaataccacctacccgtctctgcttgaagatggacgggtggaataccgcgtggctctgaccgaagatagactgccacggctcgaggagatcagaatctggggtcctctgcaggaagatgccgacattcaagtctatcggcggtacggcgaagagtacggcaacctgactagaccagacatcacgtttacctacttccagcctaagccccggcaggcttgggtgtgggcggccgtgcggggcccgtgctcagtttcctgcggggcgggccttagatgggtgaattactcctgcctggaccaggcgagaaaagaacttgtggaaacggtacagtgccaaggatcacagcagccgcctgcctggcctgaagcctgcgtcttggaaccatgtccgccttactgggcggtgggagacttcggaccatgctcggcttcatgcggaggtgggctcagggaacggccggtccgctgcgtcgaagcgcaaggctctttgcttaagactcttccgccggcgcggtgcagagctggagcccagcagcccgcggtggcactggaaacctgcaaccctcagccttgcccggctcggtgggaagtgtcagaaccttcctcttgcactagcgccggcggcgccggactcgccctggagaacgaaacctgcgtgccaggcgccgacggtctggaagcgcctgtgaccgaaggtcctggaagcgtggatgagaagctgccagcaccagagccgtgcgtgggtatgtcctgccccccgggatggggtcatctggacgctactagcgcgggggaaaaggccccgtcgccttgggggtccatccgaaccggggcccaggccgcacacgtgtggaccccggccgccggctcgtgctccgtgtcgtgtgggcgaggactgatggagctgcgctttctgtgtatggattccgccctgcgggtgcccgtgcaggaagagctctgcgggttggcctccaagccaggatcacgccgggaagtctgtcaagccgttccatgtccagcccgctggcagtacaaattggctgcttgcagtgtgtcctgcggcaggggggtcgtcaggcggatcctgtactgtgctcgggcgcatggagaggacgacggagaggaaatcctgctcgacactcaatgccagggactgccgcgcccggagccgcaggaggcatgctcgctggaaccgtgcccaccgcgctggaaggtaatgagccttggcccctgctcggcgtcgtgcggccttggaactgccagacgatcggtcgcctgtgtgcaactcgatcaaggccaggacgtcgaggtggacgaagcggcatgcgccgccctggtgcgaccggaggccagcgtgccatgcctgattgcagactgtacttacaggtggcatgtcgggacctggatggaatgttccgtctcatgcggggacggaatccaacggcgcagagacacttgtctcggcccacaggcccaggctccggtgccagccgacttctgccaacatctgcctaaacctgtgaccgtgcgcggctgctgggcgggcccctgcgtgggacaaggtacccccagcctggtgccgcatgaagaagcggcggcgcccgggaggactactgcgactccagccggtgcctccctggagtggtcacaggccagaggactgcttttctcgccggcaccacaaccacggcggctgctcccagggccgcaagaaaacagcgtccagtcaagcgcatgtggtaggcagcacctggagccgactggaaccatcgacatgcgcggaccgggtcaggccgattgcgcggtggcaatcggtaggccactgggagaagtcgtgaccctccgcgtcctcgaaagctctctgaactgcagcgcaggagacatgctgctgctgtggggtcgcctgacctggcgaaaaatgtgccggaagctgcttgatatgaccttttcgtccaagactaatactctggttgtgcgacaaagatgtggacggcccggagggggcgtgctgctccgttatggctcgcagttggcacctgaaactttctaccgcgaatgcgatatgcagctgttcggaccttggggtgagatcgtctcgccgtcactgagcccggctacttccaatgcaggaggatgcaggctctttatcaacgtggcaccgcatgctcgcatcgctatccatgcattggccactaacatgggagcaggaactgaaggcgcaaatgcgtcgtacattttgatccgcgatacccactcgcttaggaccactgctttccatggacaacaggtgctttactgggaatcggaatcgtcccaggcggagatggagtttagcgagggcttcctgaaggcgcaggctagtctgcggggccagtactggacgctccaatcttgggttccagaaatgcaggatccccagtcatggaaaggaaaggaagggacc

SEQ ID NO: 5678 - DNA, 4281 bp, Artificial Sequence
  Description of Artificial Sequence: Synthetic coding sequence
atgcatcaacgccacccaagggccagatgtccgccgctctgcgtggcgggaatcctcgcttgtggattcctcctggggtgttggggtccgagccactttcagcagtcctgcctgcaggccctcgagccgcaggccgtgtcgtcctacctgagccctggcgccccgctgaaggggaggccgccgtcccctggattccagcggcaacgccaaagacagcgacgggccgcgggcggaatcctccatcttgaactgctcgtggcagtcgggccggacgtctttcaggcgcaccaggaagatactgaaagatacgttttgaccaaccttaacatcggtgccgaactgcttcgcgacccatctctgggagcccaattccgggttcatctggtgaagatggtgatcctgactgaaccagaaggagcccctaacattactgcgaacctgacgtcgtcgctgcttagcgtgtgcggttggagccaaactatcaaccccgaggacgacactgaccctggacatgccgatctggtcctgtacatcactcggttcgacctggaactcccagacgggaacaggcaggtgagaggcgtcactcagttgggaggagcttgcagccccacctggtcctgcctcatcaccgaggacaccggcttcgacctgggagttactatcgcccatgaaatcggccactcattcggcctcgaacacgacggggcccctggctcgggatgcggaccctcggggcatgtgatggcttcggatggtgcagccccacgggctggacttgcatggtcgccgtgcagcaggcgccagcttctgtcccttctctccgcggggagagcgaggtgtgtgtgggatcctccgcggccgcagcctggctcggctggacacccgccggatgcgcaaccgggcctgtactactcggccaacgaacaatgtcgggtggcgtttggacccaaagcggtggcgtgcaccttcgctcgagaacatctcgacatgtgccaggcactgtcctgccataccgatccactcgaccagtccagctgctcgagactgctggtcccactgctggacggaactgaatgcggcgtcgaaaagtggtgctcgaagggacggtgcagatcgctggtggaactgacccctatcgccgccgtgcacggaaggtggtcctcatggggtccacggtcaccttgctcccggagctgcggcggcggggtggttactagacgcaggcaatgcaataatccgcgcccggccttcggaggacgggcgtgcgtcggagctgacttgcaagccgagatgtgcaatacgcaggcttgtgaaaagacccaacttgagttcatgagccagcagtgcgcccggaccgacggacaaccgctgagaagttcgccggggggtgccagcttttaccactggggcgccgcggtccctcattcgcaaggcgatgcactgtgccgacacatgtgccgcgctatcggggagtcgtttatcatgaaacgcggcgactctttcttggacggtacgagatgtatgccttcaggtccgagagaggacggaactctgtctttgtgcgtttcgggttcctgtcggaccttcggatgtgatggccggatggactcacagcaggtgtgggatcgctgccaggtgtgtggaggggacaatagcacctgttcgccacggaagggatcctttaccgccgggcgcgccagagaatatgtgactttcctgaccgtgactccaaacctcaccagcgtctacatcgctaatcaccgccccctgtttactcatttggcggtgcgcatcggaggccggtacgttgtcgctggaaagatgagcatctcaccgaacacgacttacccgtcccttctcgaggacggacgggtggaatacagagtggctctcactgaagatcgactgccaaggctggaagaaatcagaatctgggggcccctgcaggaagatgcagacattcaggtgtatcggcggtacggagaagagtatggaaacctgacgcggccagatatcaccttcacgtacttccagccgaagccccggcaggcgtgggtgtgggcagcggtgcggggaccgtgctcagtgtcgtgcggcgccggcctgagatgggtgaactactcgtgtctggaccaggctaggaaagaacttgtcgagactgtgcaatgccagggatctcagcaaccccctgcgtggccggaggcgtgcgtgctcgagccctgtccgccttactgggcagtgggagatttcggaccatgttcggcgtcatgtggcggaggacttagagagaggccagtcagatgtgtggaagcccagggaagcctgctgaaaaccctcccgccagcacgctgccgggcaggagcacaacagcctgcggttgcgcttgagacttgtaatccacagccatgcccggcccgctgggaagtaagcgagccgtccagctgcacgtcggcaggaggcgcgggactcgccctggagaatgagacgtgcgtgccaggagccgacggtcttgaagcaccggtcacggagggccccggatccgtggatgagaagctgccagcccctgagccatgcgtgggaatgtcctgccctcctggatggggacacctggacgccacctccgcaggtgaaaaggcgccgtcgccttggggctctataagaactggtgcccaggccgcacacgtgtggacccctgccgccggaagctgttcggtgagctgcgggcgcggactgatggaactgaggttcttgtgtatggactccgccctgagagtgccagtccaggaagagctctgcggattggcctccaagccgggaagcaggcgcgaggtctgccaggctgtcccctgcccggcccggtggcagtacaagctggcagcttgctcagtgtcatgcggcagaggagtcgtccggcgcatcctgtactgtgcccgggcccacggcgaggacgacggagaagaaatcctgctggacactcagtgccagggcctcccgcggccggagccgcaagaggcctgctcacttgagccttgccctccacgctggaaggtgatgtcgttgggaccttgttcagcgtcgtgtgggttggggactgcccgccgctcagtggcctgcgttcagctcgaccaaggacaagatgtggaggtggatgaagccgcatgcgctgcactggtaagaccagaggcgtccgtcccgtgcctcattgctgattgcacctaccgctggcatgtgggcacctggatggaatgctctgtgagctgcggtgacgggatccaaagaagaagagacacctgcctcggaccgcaggcgcaggcccccgtgccggccgacttctgccagcacctgccgaagccggtcaccgtgcgcggctgctgggccggcccgtgcgtcgggcaaggcactcctagcctcgtgccccacgaagaggccgccgccccgggcagaactactgctactccggcgggcgcttcgctggaatggagccaggcgcgaggactcctgttctccccggcgccccaaccccggagacttctgcctggaccccaagagaactctgtgcaatcaagcgcgtgcggaaggcagcacctggaaccgactggaacgatcgacatgcgaggcccgggccaggcagactgtgcggtggctatcggacggccgctgggagaggtcgtgactctccgcgtcctggagtcctcattgaattgcagcgcgggagatatgctcttgctctgggggaggctcacctggaggaaaatgtgccggaagctcctggatatgactttctcgagcaaaactaataccctggtggtgagacagcggtgtggacgcccggggggaggcgtcctgctcaggtacggatctcagctggcgccggaaaccttttatcgcgaatgtgacatgcagctctttggcccgtggggcgagatcgtctccccatcactcagcccggccaccagcaacgccggtggctgccggctgttcatcaatgtggccccgcatgcgagaatcgccatccacgcgcttgccactaatatgggagcagggactgaaggagcaaacgcttcatacattcttatcagagacacccatagcctgcgaaccactgcattccacggtcagcaggtgctgtactgggaaagcgaatcgtcgcaagcagaaatggagttttccgaaggattccttaaggcccaggccagcctgcgggggcagtactggactctgcaatcctgggtgcccgaaatgcaggacccacagtcgtggaagggaaaggaaggcacc

SEQ ID NO: 5679 - DNA, 4281 bp, Artificial Sequence
  Description of Artificial Sequence: Synthetic coding sequence
atgcaccaacgccaccctcgcgcccggtgtccccccctgtgcgtggcggggatactcgcttgcggttttttgcttgggtgttggggaccttcgcatttccagcagtcgtgcctgcaggccctggaacctcaggcagtgagttcatatttgtcgcctggcgcacccttgaaaggcaggccaccatcacctggcttccagaggcagaggcagcggcagcgtcgggcagccgggggtatcctgcatctggaactgctggtggcagtgggacctgatgtgttccaggctcatcaggaggacactgagcggtacgtgcttaccaaccttaatatcggagctgagcttcttcgtgatccctcgctgggagcccagttcagagtccacctcgtgaaaatggtcattcttaccgagcctgagggcgcacctaatatcaccgccaatctgactagttctttgctgagcgtctgtgggtggagccagactatcaaccccgaagacgataccgaccctggccatgccgatctagtcctgtacattacacggttcgacctcgagctccccgatggcaacaggcaagtgaggggtgtaacccaactcggtggagcttgctccccaacatggtcctgcctcattaccgaggataccggatttgacctgggggtcaccattgcgcatgaaataggacacagcttcggccttgagcacgatggcgctcctggtagcggctgcggaccgtcaggacacgtcatggcatctgacggtgctgctccccgggccggcttggcgtggtctccttgttctagaaggcaactgctgagcctgctaagcgctggccgtgcccggtgcgtgtgggatcctcccagacctcagccaggtagtgccgggcatcctcccgacgcccagccagggttatattattcagcgaacgagcaatgccgcgtcgcattcggaccaaaagctgtagcctgcaccttcgcgagagagcacctcgacatgtgccaggccctctcctgtcataccgacccactggatcagtcgtcctgtagtaggctgttggtcccccttcttgacggcacggaatgtggggtggaaaagtggtgtagcaaaggtcggtgccgttccctggttgagttgacacccattgcagccgttcacggaaggtggagctcctggggaccccgcagcccatgctcaagatcatgcgggggaggtgtggtgacccgccgccggcaatgtaacaatccgcgaccggccttcggcgggcgcgcctgcgtgggggctgacttacaggccgaaatgtgcaatacccaggcctgcgagaagacccagttagaattcatgagtcagcaatgtgcacgaaccgatggccagccattgcgaagctcaccaggcggcgctagtttttatcattggggagcagctgtgccgcatagtcagggcgacgctctctgccggcatatgtgccgggctattggggagtcatttatcatgaagagaggggatagctttctggacgggacacgctgcatgcccagtggaccaagggaggacggaactctctccctgtgtgtttctggctcttgtcgcaccttcgggtgtgacggcagaatggatagtcaacaggtttgggataggtgccaggtgtgcggcggggataatagtacctgtagtccaagaaagggtagctttaccgccggaagggcacgcgaatacgtgaccttcctgacggtaacccctaatttaactagcgtatatatcgcaaaccaccgccctctctttacacacctggccgtgagaatcggtggacggtacgttgtggccggcaagatgtctatctctccgaacactacatatccgtcattacttgaggacggccgggtcgaatacagggtagcgctaaccgaggaccggcttcccaggctggaagagatacggatatgggggccattgcaagaggacgccgatattcaagtataccggcggtatggcgaggagtacggtaatctgactcggcccgatataacgttcacgtactttcagcctaagcctagacaggcttgggtttgggccgccgtgagagggccatgctcagtctcttgcggagccggcttgcggtgggttaattactcatgtcttgatcaggctcgcaaggagcttgtcgagacagtgcagtgtcaaggaagtcagcagccccccgcttggccggaagcgtgcgtgctggagccatgccccccatactgggcggtaggcgattttggaccctgctccgcaagctgtgggggtggactgcgcgagcgtcctgttaggtgtgttgaggcacagggctctctgttgaagaccttgccgccagctaggtgtcgtgcaggtgctcaacagccggcagtggcattggagacgtgtaacccccagccttgtcccgccaggtgggaggtatctgagccttcgtcttgcacctcggcagggggggccggcctagcactggagaacgagacctgcgttcccggagctgacgggctagaggcgcctgtgacggagggtcctgggtccgtggatgagaagctccctgcacccgagccttgcgtgggaatgtcctgtccgccaggctggggccacctggacgctacttcggcgggggagaaggccccgagtccatggggatcaattaggacaggggctcaagccgcgcacgtctggacacccgctgcaggttcgtgttcggtgtcctgtgggcgcgggttaatggagcttaggtttttgtgtatggactccgctttgcgagtgccagttcaggaggagctgtgcggactcgcttccaagcctggctcccgccgggaggtgtgccaggctgtcccgtgccccgccagatggcagtacaagctggcagcatgctcagtctcttgtgggcggggtgtggtgaggagaattctgtactgcgcccgggcacatggagaagacgacggtgaggagattctcctggatacacagtgtcagggcttgcctcgcccagaaccccaagaagcctgttcactagagccttgtcccccccgctggaaggtcatgtctctcgggccctgttcagctagttgtggcctgggtacagccagaagatctgtggcctgcgtccaactcgaccagggccaggacgttgaagtcgatgaggccgcctgtgcagctcttgtgcgacctgaggcttcggtgccctgcctgatcgctgactgcacgtacagatggcacgttggtacttggatggagtgtagtgtcagctgtggggatgggattcagcgccggcgtgacacctgtctgggacctcaggctcaggcaccggtgcctgcagacttttgtcagcacttgcccaaacctgtgactgtccgaggatgctgggctggcccatgtgttgggcaaggcacacccagtcttgtgccgcatgaggaagcagctgccccaggccggaccacagcgacccccgccggagctagcctggaatggagccaagctcgaggccttttgttcagccctgctccccagccccgccgcctgctgccagggccacaggaaaactcagtgcagagctccgcatgtggacgccaacacctggagcccactgggacgatcgatatgagaggtcctggacaggctgactgtgccgtggcaattggacgaccattgggtgaggtagtgactctccgggtgttggaaagttctctgaactgtagcgccggagacatgctgctcctgtggggacgcctcacttggcgcaaaatgtgtcggaaactcctggacatgacatttagcagcaagacaaacacgctcgtcgtgagacagaggtgtgggcggccaggaggcggagtccttctccgttacgggtcccagctggccccagaaacattttacagggaatgtgatatgcaactgtttggcccatggggggagattgtctcaccttcccttagccccgccacgtctaacgccgggggatgccgacttttcatcaacgtggcaccacacgcccgcatcgcaatccatgcgttggcgacaaacatgggagcaggtacagagggggccaacgccagttacatcctcatcagagacacacattctttacggaccacggcctttcatggacagcaggtgttgtactgggagagtgaatcctctcaggcagaaatggagttttctgagggttttctgaaggctcaagcttcattacgtgggcagtattggactctccagtcttgggttcccgaaatgcaggacccccagtcctggaagggaaaggagggaact

SEQ ID NO: 5680 - DNA, 4281 bp, Artificial Sequence
  Description of Artificial Sequence: Synthetic coding sequence
atgcatcaacgacatccgcgtgcgcgatgtccgccgttatgtgttgcgggtatattagcgtgtggttttttactaggttgttggggtccgtcgcattttcaacaatcgtgtttacaagcgttagaaccgcaagcggtatcgtcgtatctatcgccgggtgcgccgttaaaaggtcgaccgccgtcgccgggttttcaacgacaacgtcaacgtcaacgtcgagcggcgggtggtatattacatctagaattattagtagcggttggtccggatgtttttcaagcgcatcaagaagatacggaacgttatgtattaacgaatctaaatataggtgcggaattactacgagatccgtcgctaggtgcgcaatttcgtgtacatttagtaaaaatggtaatactaacggaaccggaaggtgcgccgaatataacggcgaatctaacgtcgtcgttattatcggtatgtggttggtcgcaaacgataaatccggaagatgatacggatccgggtcatgcggatttagtattatatataacgcgttttgatttagaactaccggatggtaatcgacaagtacgtggtgtaacgcaactaggtggtgcgtgttcgccgacgtggtcgtgtctaataacggaagatacgggttttgatttaggtgtaacgatagcgcatgaaataggtcattcgtttggtctagaacatgatggtgcgccgggttcgggttgtggtccgtcgggtcatgttatggcgtcggatggtgcggcgccgcgtgcgggtttagcgtggtcgccgtgttcgcgtcgtcaattattatcgctattatcggcgggtcgagcgcgttgtgtatgggatccgccgcgtccgcaaccgggttcggcgggtcatccgccggatgcgcaaccgggtctatattattcggcgaatgaacaatgtcgagttgcgtttggtccgaaagcggttgcgtgtacgtttgcgcgagaacatttagatatgtgtcaagcgttatcgtgtcatacggatccgttagatcaatcgtcgtgttcgcgattattagtaccgctactagatggtacggaatgtggtgttgaaaaatggtgttcgaaaggtcgatgtcgttcgctagttgaattaacgccgatagcggcggtacatggtcgatggtcgtcgtggggtccgcgatcgccgtgttcgcgttcgtgtggtggtggtgtagtaacgcgacgtcgacaatgtaataatccgcgtccggcgtttggtggtcgagcgtgtgtaggtgcggatctacaagcggaaatgtgtaatacgcaagcgtgtgaaaaaacgcaattagaatttatgtcgcaacaatgtgcgcgaacggatggtcaaccgttacgatcgtcgccgggtggtgcgtcgttttatcattggggtgcggcggtaccgcattcgcaaggtgatgcgctatgtcgtcatatgtgtcgtgcgataggtgaatcgtttataatgaaacgaggtgattcgtttctagatggtacgcgttgtatgccgtcgggtccgcgagaagatggtacgttatcgttatgtgtatcgggttcgtgtcgtacgtttggttgtgatggtcgaatggattcgcaacaagtttgggatcgatgtcaagtatgtggtggtgataattcgacgtgttcgccgcgtaaaggttcgtttacggcgggtcgtgcgcgtgaatatgttacgtttttaacggtaacgccgaatttaacgtcggtttatatagcgaatcatcgaccgctatttacgcatttagcggttcgtataggtggtcgttatgtagtagcgggtaaaatgtcgatatcgccgaatacgacgtatccgtcgttattagaagatggtcgagttgaatatcgtgtagcgctaacggaagatcgtctaccgcgactagaagaaatacgtatatggggtccgttacaagaagatgcggatatacaagtatatcgacgatatggtgaagaatatggtaatctaacgcgaccggatataacgtttacgtattttcaaccgaaaccgcgtcaagcgtgggtatgggcggcggttcgtggtccgtgttcggtttcgtgtggtgcgggtctacgatgggtaaattattcgtgtctagatcaagcgcgtaaagaattagttgaaacggtacaatgtcaaggttcgcaacaaccgccggcgtggccggaagcgtgtgttttagaaccgtgtccgccgtattgggcggttggtgattttggtccgtgttcggcgtcgtgtggtggtggtttacgtgaacgtccggttcgatgtgttgaagcgcaaggttcgctattaaaaacgttaccgccggcgcgttgtcgtgcgggtgcgcaacaaccggcggttgcgttagaaacgtgtaatccgcaaccgtgtccggcgcgatgggaagtttcggaaccgtcgtcgtgtacgtcggcgggtggtgcgggtttagcgttagaaaatgaaacgtgtgttccgggtgcggatggtttagaagcgccggttacggaaggtccgggttcggtagatgaaaaattaccggcgccggaaccgtgtgtaggtatgtcgtgtccgccgggttggggtcatctagatgcgacgtcggcgggtgaaaaagcgccgtcgccgtggggttcgatacgaacgggtgcgcaagcggcgcatgtatggacgccggcggcgggttcgtgttcggtatcgtgtggtcgaggtttaatggaattacgttttttatgtatggattcggcgctacgtgtaccggttcaagaagaattatgtggtctagcgtcgaaaccgggttcgcgacgtgaagtatgtcaagcggtaccgtgtccggcgcgttggcaatataaattagcggcgtgttcggtttcgtgtggtcgaggtgtagtacgtcgtatattatattgtgcgcgagcgcatggtgaagatgatggtgaagaaatattattagatacgcaatgtcaaggtttaccgcgtccggaaccgcaagaagcgtgttcgctagaaccgtgtccgccgcgttggaaagttatgtcgttaggtccgtgttcggcgtcgtgtggtctaggtacggcgcgtcgatcggtagcgtgtgtacaactagatcaaggtcaagatgttgaagtagatgaagcggcgtgtgcggcgctagtacgaccggaagcgtcggttccgtgtctaatagcggattgtacgtatcgatggcatgtaggtacgtggatggaatgttcggtatcgtgtggtgatggtatacaacgacgtcgtgatacgtgtctaggtccgcaagcgcaagcgccggtaccggcggatttttgtcaacatctaccgaaaccggttacggtacgaggttgttgggcgggtccgtgtgtaggtcaaggtacgccgtcgttagtaccgcatgaagaagcggcggcgccgggtcgtacgacggcgacgccggcgggtgcgtcgctagaatggtcgcaagcgcgaggtttattattttcgccggcgccgcaaccgcgtcgtctattaccgggtccgcaagaaaattcggttcaatcgtcggcgtgtggtcgacaacatttagaaccgacgggtacgatagatatgcgaggtccgggtcaagcggattgtgcggttgcgataggtcgtccgctaggtgaagttgtaacgttacgtgtactagaatcgtcgctaaattgttcggcgggtgatatgttattattatggggtcgactaacgtggcgaaaaatgtgtcgaaaattactagatatgacgttttcgtcgaaaacgaatacgctagtagtacgtcaacgatgtggtcgaccgggtggtggtgttctattacgttatggttcgcaattagcgccggaaacgttttatcgagaatgtgatatgcaattatttggtccgtggggtgaaatagtatcgccgtcgctatcgccggcgacgtcgaatgcgggtggttgtcgattatttataaatgtagcgccgcatgcgcgaatagcgatacatgcgctagcgacgaatatgggtgcgggtacggaaggtgcgaatgcgtcgtatatattaatacgagatacgcattcgctacgtacgacggcgtttcatggtcaacaagtattatattgggaatcggaatcgtcgcaagcggaaatggaattttcggaaggttttttaaaagcgcaagcgtcgctacgaggtcaatattggacgttacaatcgtgggttccggaaatgcaagatccgcaatcgtggaaaggtaaagaaggtacg

SEQ ID NO: 5681 - DNA, 4281 bp, Artificial Sequence
  Description of Artificial Sequence: Synthetic coding sequence
atgcatcagaggcaccctagagcgaggtgccctcctctgtgtgtggctggaatcctcgcctgtggcttccttctcggctgctggggaccgtcgcacttccaacagtcctgcttgcaggcactggaaccccaggcggtgagttcatatctgtcaccaggggctccacttaaaggcagacctccatccccaggctttcaaagacaaaggcagaggcagcgaagagccgcaggcggaattctgcatttggagctgcttgtggccgtggggcccgatgtgtttcaggcccaccaggaagacacggagaggtacgtgctcacaaatctcaacataggggccgaactactcagggatccgtcgctcggggctcagtttagggtccatttggtcaaaatggttatcctgacagagccagagggggcgccaaacattactgccaacctcactagctcgctgcttagtgtgtgcggatggagtcagacgatcaacccggaggacgacacggacccaggacatgccgatcttgtcctctacattacacggttcgacttggaattgcctgatggcaaccgccaagtcaggggtgtgacccagctgggcggcgcgtgctctccaacctggagttgcttgattactgaggatacagggttcgatttgggggtcaccattgctcacgaaatcgggcactctttcggcttggagcacgatggagctccaggttccggatgtgggccttcaggacacgtgatggcaagtgatggtgccgctcctcgtgccggcctcgcgtggtctccgtgcagcaggcgccagctcctatcgctcctgtcagcggggcgggccaggtgtgtctgggatcctccgcggccacagcctgggtcagctggacaccccccggatgcccagcctgggctctattactccgccaacgagcagtgtcgagtcgcctttggcccaaaggcggtggcctgcacattcgcgcgagagcatctggacatgtgccaggccttgagttgccatactgatcccctcgaccagtcaagttgctcccgattactggttccgctcctcgacgggactgaatgtggtgttgagaaatggtgttcaaaaggtcgatgtcgaagtctggtggaactcacccctattgccgcagttcacggtagatggtcctcttgggggccgagatcgccctgcagcagatcatgcgggggcggagtcgtgactcgaaggcgacagtgtaacaaccctcgcccggcctttggggggagagcctgcgtgggtgctgaccttcaagctgaaatgtgcaacactcaggcgtgtgaaaagacccaactcgaatttatgtctcagcaatgcgcccgcaccgatggccagcctcttaggagctcccccgggggagcgtccttctatcattggggcgccgctgtgccccacagccagggagatgccctgtgccggcatatgtgcagggcgataggcgagagttttatcatgaagcgtggcgactcttttctggacggcacacgatgcatgccgtctggcccccgtgaggacggaacactgtccctgtgcgtgtctggaagctgtaggacctttggatgtgatggccgaatggattcacagcaggtctgggatcgatgtcaggtgtgcggtggcgataactcgacatgttctccaaggaaggggtctttcacagccggacgtgcgagggaatatgtaacctttctgaccgttaccccaaacttgacttcagtttatatagccaaccataggcctctctttacgcatctcgcagtacgcattggtgggagatatgttgtcgcaggtaagatgagcatcagcccgaacactacctaccccagcctcctggaggacggcagagtggagtatagagtcgctttaaccgaggatcgcctgcccagattagaagaaatcagaatatggggtcctctgcaggaggatgctgatattcaggtttatcgaagatatggcgaggaatatggaaacttaacaaggcccgatatcacattcacgtattttcaacctaagccccgtcaggcttgggtgtgggctgctgtgcgagggccctgtagcgtgagttgtggagccggactaagatgggtgaactacagttgtcttgatcaagcccgtaaggaactagtggaaacggtgcagtgccaagggtcccagcagccgcccgcatggccagaggcctgtgtgcttgagccttgtcccccatactgggccgttggtgactttggaccgtgctcggcctcatgcggcggagggttgcgagagagacctgtgcgatgcgtggaagctcaggggagcctgctcaagacacttccccccgcccgctgcagggccggggcacagcagcccgctgtggcactggaaacgtgcaaccctcagccctgtcctgcaagatgggaggtttctgagcccagcagctgcacctctgcaggtggcgcgggcctagccctggaaaatgaaacatgtgtgcctggagctgacgggctcgaggccccagtgacggaggggccgggcagcgtggacgaaaaactgccggcaccggaaccctgcgtaggtatgtcttgtcccccgggctgggggcatttagacgcgacttccgcaggagagaaggcaccttccccttggggttcaatccgaactggcgctcaggcggcacatgtgtggacccccgcggcggggtcatgcagtgtaagctgcggtaggggtctaatggaactgaggttcttatgcatggactctgccttgcgagtaccagtccaggaagaactctgcggtctcgcctctaagcctgggtcaagacgagaagtgtgtcaggcggtgccttgccctgcaagatggcagtacaagctggcggcatgttcagttagctgtggaaggggcgttgtccgaaggattctgtactgcgcacgtgcccacggcgaagatgacggtgaagagatacttctcgatactcaatgtcaggggttgccaagacctgagcctcaggaagcctgcagcctcgaaccttgcccacctagatggaaagtgatgtccctggggccttgttcagcctcatgcgggctggggactgctcgaaggagcgtggcttgtgtacagctggaccagggccaagatgtggaagtcgacgaggccgcatgcgctgccctcgttcgtccagaggcatccgtgccctgcttaattgcggactgtacatacaggtggcacgtgggtacatggatggaatgcagtgtgtcctgtggagacggcatccagcggaggagggatacctgcctgggaccacaggcccaggcgcccgtgcccgcagatttttgtcagcacctgccaaaaccggtgaccgtgcgaggatgctgggctggaccctgcgtgggccagggcactccaagtctagtcccacacgaagaggccgcagcaccagggcgaaccactgctactccagcaggagcttccctggagtggtctcaggcccgtgggcttctgtttagcccggccccacaaccgaggcgtttactgcccgggccccaggaaaactcagtccagtcttctgcatgcggcagacagcacttggaacctacaggcacaattgatatgcgaggcccaggtcaggccgattgtgccgttgcaattggacggcccctcggggaagtggtgactctgagggtcttggagtcatcactcaattgctcggcaggagacatgctcctgctctggggaagacttacttggcgcaagatgtgtagaaaactgttggacatgacctttagtagcaaaacaaatacccttgtcgttaggcagcgctgcggaaggccagggggaggcgtgttgctccgatacgggtcacagctcgcccctgaaacattttacagggaatgtgacatgcagctgttcgggccttggggggaaattgtatctccatccttgtctcccgctacatcaaacgccggcgggtgtaggctgttcataaatgtggcaccacatgccagaatagcaattcacgctctcgctactaatatgggagccggtacagagggcgccaatgcctcctacattctgattcgagacacacactctcttcgaacgaccgcctttcatgggcagcaagtgctgtactgggagtctgaatccagccaagccgagatggaattttctgagggatttctgaaagcacaggcatcactgagagggcagtactggactcttcaatcatgggtgccagagatgcaggatccccagtcatggaaagggaaggagggaaca

SEQ ID NO: 5682 - DNA, 4281 bp, Artificial Sequence
  Description of Artificial Sequence: Synthetic coding sequence
atgcaccagcgccacccgagggcgcgctgtccgcctctttgcgtggccgggattctggcttgcggcttcctgttggggtgctggggaccttcgcacttccagcagtcatgcctgcaggctctagagccccaagctgtctctagctacctttccccaggagcaccgctgaaaggtaggccccctagtccaggctttcagcggcagcgccaacgacaacggcgcgccgctggagggatcctgcacttagaactgttagtggcagtaggtcctgatgtatttcaggcccatcaagaggataccgagaggtacgtgcttacaaatctcaatataggagcagagcttttgcgggacccctcccttggggcccagtttagagtgcacctcgtaaagatggtcattctgacagaacccgagggcgccccaaacatcacagcgaacctgacctcatcacttctgtctgtgtgtgggtggagtcagaccatcaatcctgaagatgataccgatcctggccacgcggacctcgtgttgtatataactcgtttcgacctcgagttacccgacggaaataggcaggttaggggtgtgacacagctgggcggggcatgctcccctacatggtcctgcctcatcaccgaagacaccggattcgacctgggtgttacaatcgcgcatgagattgggcactcttttgggcttgagcacgacggggcaccagggtccggttgtggcccctctggtcatgtgatggcctcagacggcgccgcgcctagagcagggttggcgtggtcaccgtgctccagacgccagctcctctccctgctgagcgccggtagggcccggtgcgtgtgggaccctcctcgtcctcagccaggatcagccggccacccacccgacgctcaacccgggctgtattattccgctaatgaacaatgtcgtgtggcgttcggacctaaggctgtcgcctgcacttttgctcgtgagcacctagacatgtgtcaagcactcagctgccacaccgatcctcttgatcaatctagttgcagccgtcttcttgttccactgctcgatggaaccgagtgcggggtagaaaagtggtgctctaaaggcagatgcagaagtctcgtcgaactgactcctatagccgccgttcatggccgatggagttcctggggaccacggagtccatgtagtcgttcttgtggcgggggcgtggtgacaaggcgtaggcaatgtaataatcccagacccgcgtttgggggtcgggcctgcgttggagccgatcttcaggctgaaatgtgcaacacgcaggcctgtgagaaaacacagctggagttcatgtcccagcaatgtgccaggactgacgggcagccactccgctctagccctgggggagcgtctttctatcactggggagccgccgtgccacatagtcagggagatgccttgtgtcgccacatgtgccgtgcgattggtgaatcctttatcatgaaaagaggagattcgttcctcgacgggacccgttgcatgccctctggcccacgtgaagatggaactctcagcctttgcgtgagcgggtcttgtcggacattcggatgtgacggcagaatggactcccagcaggtgtgggaccgttgccaggtctgcggtggtgacaactctacatgtagtccccggaaggggtcattcactgctggtcgcgctagggaatacgtaacattcctcactgtgacgcccaatctcacatctgtctatatagccaatcaccgacccctttttactcacctcgctgttagaatcgggggcagatatgtggtggcagggaagatgtccatctctccaaacaccacctacccctccctgctggaggatgggcgggtggagtaccgagtggcacttacagaagacagattgccaagactggaagagatccggatatggggaccattgcaggaagatgcagacatacaagtgtatcgtaggtacggagaagaatacggtaatctgacacgacctgacatcacttttacatatttccagcccaaaccacgtcaggcatgggtgtgggctgccgtgcgggggccctgtagcgtttcttgcggcgctggcctgaggtgggtgaactactcctgtctcgaccaagcacgcaaggagctggttgagaccgtccagtgtcaggggagccagcagcccccagcctggcccgaggcttgcgtcctggaaccatgtcctccatactgggctgtgggagattttggaccatgcagtgcgtcttgcggaggagggctaagagagcggccagtgcgctgcgtggaggcgcaagggtcgctgctgaagacactgccaccagcccggtgtagagctggtgcacagcaacctgctgttgctctggagacttgtaaccctcagccctgtccagcgcggtgggaggtgagcgagccctcgtcttgcaccagcgccggcggcgcgggacttgccctggagaacgagacctgcgttcctggggccgacgggctggaagcccctgtgacagaaggccctggatccgtcgacgaaaaactgcctgccccagaaccctgcgtcgggatgagctgtccaccgggctggggccacttggatgctacgtcagctggagagaaggcacccagcccttggggctccattaggactggtgcccaagctgcacacgtgtggactccagccgcaggcagctgttccgtgtcttgcgggcggggcctcatggagctgaggtttctgtgtatggactcagctctgcgtgtgcccgttcaggaagagctgtgcggcctagcatcaaagcctggcagtaggcgagaggtgtgccaagccgtgccctgccccgcccggtggcagtacaaactggccgcctgtagcgttagttgtggaaggggtgtcgtccggagaatcctgtactgcgcaagagctcatggagaggatgacggtgaggaaatacttctggacactcaatgccaggggctgcctagaccagagcctcaggaagcgtgtagccttgaaccttgcccgccgcggtggaaggtcatgtcactgggcccttgctctgcaagctgtggcctgggcactgcgaggaggtcagtggcctgcgtgcagctagaccagggtcaggacgtggaggtggatgaagctgcatgcgccgctctggtgcggcccgaagcttctgtgccttgtttgattgccgactgtacataccggtggcatgtaggaacttggatggagtgtagcgtttcttgtggtgatggaatccagcggcgccgagatacctgtctaggaccacaggcccaggctcctgtccctgcagatttctgccaacatctgcccaaacccgtgaccgtgagaggatgctgggcgggtccctgcgtaggtcagggaaccccatccctggttccacatgaagaagctgcggcaccgggtaggacaacagcgacccccgccggtgcatctcttgaatggtcccaggctaggggactgctgttctctcccgcgcctcaaccacgccggttgctccccggtcctcaggagaactcggtgcagtctagtgcctgtggccgacagcacctggaacctacgggcactattgatatgagaggtcctggccaggccgattgtgccgtggccatcgggaggcccctgggagaagttgtgacactaagggtcctggaatccagcctgaactgttccgcgggagatatgctgctcttgtggggcaggcttacatggagaaaaatgtgccggaagctgctcgacatgaccttcagttctaaaactaatacactggtcgtgcgccagcgttgtggcagaccgggcggaggtgtcctgctgcggtatggcagtcagctcgcgccggagactttctatagagagtgtgacatgcagctgtttgggccttggggggagatagtgtcaccctccctgagtccagccaccagtaacgccgggggatgcagactgtttatcaacgtcgcccctcacgcaaggattgctatccacgctcttgctacgaatatgggcgccggtactgaaggggcgaacgccagttatattttgattagagacacccattctctgagaactactgcgtttcacgggcagcaagtgttatactgggaatccgagtctagccaagccgaaatggagttcagtgagggtttcctcaaggcccaggcctcactccgaggtcaatattggactttacaatcatgggtgcctgagatgcaggatcctcagtcctggaagggtaaagaaggcaca

SEQ ID NO: 5683 - DNA, 4281 bp, Artificial Sequence
  Description of Artificial Sequence: Synthetic coding sequence
atgcaccagagacatccacgtgcaagatgtcctcccctttgtgtcgcaggaatacttgcatgcggatttctgcttggatgctggggtccctcccatttccaacaatcatgtttgcaagcgcttgagccacaagcagtttcgagctacctttcgccgggggcgccccttaaaggccgaccgccatcccccggcttccagagacaacgacagcgacaacgtagagcagcagggggtattctccatctggaacttctggtggcagtgggccctgatgtgttccaagcacaccaggaagatactgagagatatgtgctcactaatctgaacattggtgcagagctcctcagagatccatcgctgggggcacaatttcgggtgcatctggtgaagatggtgatcttgactgaacccgaaggagcccccaacattaccgcaaacttgacgtcctcgctgcttagcgtctgtggttggagccagaccataaaccctgaagatgataccgatccgggtcacgctgatctcgtgctttacattactcgattcgatcttgaactgcctgatggtaaccgtcaagttcgcggagtgacccagctcggaggtgcgtgctcgcctacctggtcctgcctgattacggaggatactggcttcgacctgggagttactattgcacacgaaatcggtcactcttttggccttgaacacgatggagcaccgggttcaggatgtggcccatccggccatgtgatggcaagcgatggagcagccccaagagcgggacttgcctggagcccatgttcacggaggcagctcctttcactcctttccgcaggtcgcgcgaggtgcgtctgggatcctcctaggccacaaccaggatcagcagggcatccgcctgatgcacaaccaggtctttactactcggcaaacgagcaatgtcgtgtggcattcgggccaaaagcggttgcatgtaccttcgcaagggagcatcttgacatgtgtcaagccctgtcttgtcatactgatcctctggaccagtccagctgttccagactgctggtcccgctgctcgacggtactgaatgtggagtcgaaaaatggtgctctaaaggccgctgccgttcgcttgtcgaattgacccccattgcagccgttcacggccgttggtccagttggggacctagatcaccgtgctcccggagctgtggagggggagtcgtgactagacgccgacaatgcaataatccgcgcccagcattcggaggacgggcatgcgtgggtgcagaccttcaagcagagatgtgcaatacccaagcctgcgaaaagactcaactggagtttatgagccagcagtgtgcgaggactgatggacaacctctccggtcgagcccaggaggggcatccttctaccattggggagcagcagtgcctcattcgcaaggggacgccctgtgtcgtcatatgtgtcgtgcaattggtgagtcgttcatcatgaagcggggagattcctttctggatggtacgcgctgtatgccctcaggaccacgcgaagatgggactctctccctttgtgtgtcggggagttgtagaacctttggatgtgatggaagaatggactcgcaacaagtgtgggatagatgccaggtgtgtggcggcgataactcgacctgctctccacgaaagggatcattcactgccggcagagcccgggaatatgtgacctttcttactgtgacgccaaatcttacctccgtgtacattgcgaaccacaggcctctttttactcatcttgcagtccggataggtggccggtacgtcgtggcagggaaaatgtcaatttcaccaaacaccacttacccgagcctccttgaggatggtagagtggagtaccgtgtggctctgactgaggaccgcctgcctcggttggaagagattcgtatctggggtccactgcaagaagatgcagacattcaggtgtaccgtcgctatggggaggaatacggtaatctcactcgtccagacatcacttttacctactttcaacctaagccccggcaagcgtgggtctgggcagcagtgcggggtccatgctcagtgtcctgcggtgcaggactcaggtgggtcaattactcatgtttggatcaggcccgcaaggagctggtggaaactgtgcaatgtcaaggaagtcaacagcctcccgcatggcccgaggcatgtgtgctcgaaccatgccctccttactgggcagtgggggacttcgggccgtgcagcgcttcgtgtggaggaggtcttagagagcgcccggtgagatgtgtggaggcacagggatcgctgctcaagactctccctcctgcgagatgtcgagcaggtgcgcagcaacctgccgtggccctggagacgtgtaaccctcagccttgtcccgccagatgggaagtgtccgaaccctcctcatgtactagcgccggtggtgcaggcctggccctcgaaaacgaaacctgcgtcccaggagccgatggcctggaggcacccgtgaccgaaggacccggatccgtggatgaaaagctgccagcacccgaaccttgtgtgggaatgtcatgcccccctggatggggacatctggatgccacctcagcaggtgagaaggcacctagcccatgggggtcgatccgcacgggcgcacaggcggcacatgtgtggaccccagccgcaggttcatgttcagtctcatgcgggcgcggactgatggaactgcgatttctgtgcatggattcagctctgcgggtccctgtccaggaagagctttgcggacttgcatcaaagcctggatcaagaagggaagtttgtcaagccgtcccttgtccggccagatggcaatacaagctggctgcctgttcggtttcgtgtggaagaggagtggtgcggcggattttgtattgcgcgagagcacatggagaggacgatggagaggaaatcctcctcgatactcaatgtcaaggcctcccaaggcccgaacctcaggaagcctgctcgcttgagccatgtcctcctcggtggaaggtgatgagtcttggaccttgttcggctagctgtggattggggaccgcacgccggtcggtcgcctgtgtgcaattggatcaaggccaggacgtggaagtcgatgaggctgcatgtgcggcacttgtgaggcctgaagcgagcgtgccatgtctcatcgcagactgtacgtaccgttggcatgtgggaacgtggatggaatgttcggtatcgtgcggggacgggatccagcggcgcagagacacctgtctcggaccgcaggctcaagcaccagtgcccgccgatttttgccagcacctgcctaaaccggtgactgtccggggatgttgggccggaccatgcgtgggacaaggtaccccttccctggtgcctcatgaggaagcggccgcccctggacggaccaccgcaacccccgcaggggcctcccttgaatggtcgcaggcgagaggactcctgttttcgcctgcaccccagccaagaaggctcctgcctggaccgcaggaaaactcggtgcaaagctccgcatgtggcaggcagcatcttgaacccactggtactatcgacatgcgcgggcccggtcaggcagattgcgccgtggccatcggacgtcctctgggcgaggtggtgactctcagagtgctcgaatcatcgctcaattgtagcgcgggggatatgctgttgctttggggtcgactgacttggagaaagatgtgccgtaagctgctcgatatgacttttagttcaaaaaccaacaccctggtggtgaggcaacgttgcggaaggccgggaggcggagtgcttcttagatacggttcgcaacttgccccagaaaccttttaccgggaatgcgacatgcaactgtttggcccatggggcgaaattgtgtcgccttccctgtctccggctacttcgaatgctgggggctgcagactcttcatcaacgtggccccccacgccagaattgccattcacgcgctggcaaccaatatgggtgcgggaaccgagggagcaaacgcatcctacatattgatccgggacacccacagcctcagaactaccgcctttcatggtcagcaggtgctttactgggagtctgaaagcagccaggcggaaatggaattctcggaaggatttctcaaggcacaggcgagtctcaggggacaatattggacccttcaatcttgggtcccagaaatgcaggatcctcagagctggaaggggaaggagggcacc

SEQ ID NO: 5684 - DNA, 4281 bp, Artificial Sequence
  Description of Artificial Sequence: Synthetic coding sequence
atgcaccagcggcatccccgggcaaggtgtcccccactgtgtgttgcaggtattcttgcctgcggtttcctgctgggatgttggggaccatcacattttcaacagtcatgtttgcaggcgctggaacctcaggccgttagctcctacctttcaccgggcgcccccctcaagggaaggccaccatccccagggtttcaacggcaaagacaacgacagaggagagcagcaggtggaatcctgcatctggaattgctcgtggctgtgggacctgacgtgtttcaagcacatcaggaagatactgagaggtacgtgctgaccaaccttaacattggcgcagaacttcttcgtgatccttcacttggcgcgcagttcagggtccatttggtgaagatggtcatactgaccgaaccggaaggggcacccaacattaccgctaatcttacttcatcacttcttagcgtgtgtggatggagtcagaccattaatcctgaagatgatactgaccctggtcatgccgacctggtcctttacattactcgttttgaccttgagttgccagacggtaataggcaggtgcggggagtgactcaacttggaggagcatgcagcccgacttggtcatgcctgattacggaggacaccggatttgatctgggagtcaccatagcacacgagattggacactcatttggccttgagcatgatggagcgccaggatccggatgtgggccatcgggccatgtgatggcgtccgatggagcggcacctagagccggtcttgcctggtcgccgtgcagcagacgtcagcttctctcgctgctttccgcaggtagagcacgttgtgtgtgggacccgcccaggccacaacccggaagcgcaggtcatccacccgacgcgcaaccaggtttgtactatagcgcgaacgagcagtgtcgggtcgcatttggaccgaaggcagtcgcctgtacttttgcgagggagcacctggatatgtgccaggcactgtcgtgtcacaccgatcctcttgatcagagctcgtgttctcgactgcttgtgccactgctggatggtaccgagtgcggagtggagaaatggtgttccaaggggagatgccggtcgctggtggagctgactcccatagcagccgtccatggaaggtggtcgtcctggggcccccgctcgccctgctcgcgctcgtgtggcggaggagtggtgacgcggaggcgtcaatgtaacaacccacggcctgccttcggaggtagagcgtgtgtcggcgcagatctgcaagccgaaatgtgtaatactcaagcatgtgaaaaaactcagctcgagttcatgtcccagcaatgtgcacggaccgatggtcagcctctgcggtcgtcccctggaggcgcatcgttctaccattggggagcagccgtgccacattcgcaaggagacgcattgtgcaggcatatgtgtagagcaattggagaaagtttcattatgaagcggggagactcattcctggacggaactagatgtatgccttcgggtccacgcgaggatggcaccctgagcctttgcgtgtccggatcttgtcggacttttgggtgtgatggtagaatggattcgcaacaagtctgggatcggtgccaggtgtgtggtggggacaactccacttgtagcccaagaaagggatcgttcacggcagggagagcaagagagtatgtaacctttctgactgtgactccaaatctcactagcgtgtacattgccaaccatagaccactctttacccatctggcagtgcggatcggtggccgatacgtggtggcagggaagatgtcaattagtccgaacactacctatccaagcctgctggaagatggccgagtggaatacagagtcgctctcactgaggaccgtctgcctcgacttgaagaaatcagaatctggggacccttgcaggaagatgcagacattcaagtgtaccggaggtacggggaggaatacggtaatttgacccgccctgatataacttttacttactttcagcctaagcctagacaggcttgggtgtgggcagccgtccggggaccttgctcggtgagctgcggtgcaggactgagatgggtgaattacagctgtcttgatcaggcccgaaaagagctggtggaaacggttcaatgccaaggatcacagcagccccctgcatggccggaagcatgtgtgctcgagccatgcccaccttactgggccgtcggtgactttgggccctgctccgcatcctgtggaggaggtctgcgagagcgccctgtgcgctgtgtggaggcgcagggttctcttctcaagacccttccgcctgcgagatgtagagcaggagcacagcaacccgcagtggcattggaaacttgtaaccctcaaccctgccctgcacgttgggaagtgtccgaaccttcgagctgtaccagcgcaggcggcgcgggacttgcgctggaaaacgaaacctgcgtgccaggcgccgatggcctggaagcacctgttactgagggtccaggatcagtagatgaaaagctccctgcgcccgaaccgtgtgtggggatgtcgtgcccaccaggttgggggcatctcgatgcaacctcagcaggagaaaaggcaccatcaccatggggctccatcaggactggtgcccaagccgcccacgtgtggactcctgccgccggctcctgcagcgtgtcgtgcgggaggggactcatggaacttaggtttttgtgtatggattcggcactcagggtcccggtgcaagaagaactgtgtggactggcgtcaaagcctggttcgagaagagaagtgtgtcaggcggtcccatgcccggctcgatggcagtacaagctggccgcttgttcggtttcgtgtggaagaggagtggtccggcggattctttactgtgcaagagcgcatggggaagatgacggcgaggaaattctgcttgatacccaatgtcaaggtttgccacgtcccgagccccaagaagcatgctcgcttgaaccatgtcccccacggtggaaggtgatgtctttgggcccatgctcagcatcatgtggtcttggaacggcccggcggtcggtggcctgcgttcagctggatcagggccaggatgtggaagttgatgaagcggcatgtgctgccctggtccggcctgaggcatccgtgccatgtcttatcgcagactgtacttaccggtggcacgtcggtacctggatggaatgctcagtgtcgtgtggagatggaattcagcggcgcagagatacctgcctgggaccccaagcacaagcccccgtccctgctgatttttgtcaacatctccctaagcctgtcaccgtgcgcggatgctgggcaggaccttgcgtcggtcagggcaccccttcgttggtgccccatgaagaggcagcagcgccaggccgcaccacggcgacgcctgccggagcttcacttgagtggtcgcaggcacgggggctcctgttttccccagcaccccaacccagacggcttctccccggacctcaagaaaattcggtgcagtcgagtgcatgtggccgacaacaccttgagcctactggtacgatcgatatgcgtggacctggccaagccgattgcgccgtcgcaatcggccggccactgggagaagtggtgaccttgcgagtgcttgaatcgtcgcttaactgctcagcgggggatatgctgcttctctggggacggctgacttggcgcaaaatgtgcagaaagctgctcgatatgaccttttccagcaaaactaataccctcgtcgtgagacaacgctgcggtaggcctggaggtggagtgctgctcaggtacggaagccaactggcaccggaaactttctacagagaatgtgacatgcaattgtttggaccttggggagaaatagtgtcgccatcattgtccccagcgacttcaaacgccggcggttgtagattgttcataaacgtcgctcctcacgcacggatcgctatccacgcgctcgccaccaacatgggtgcgggtacggaaggtgcgaacgccagctacattctcatccgagatacccactctctgcgcaccaccgcattccacggtcagcaagtgctctactgggagtcggagagctcccaggccgaaatggagttctcggaaggctttctgaaggcgcaagcatctcttcgtggtcaatactggactctccaatcgtgggtgcccgagatgcaagatccccaatcgtggaagggtaaggagggaacc

SEQ ID NO: 5685 - DNA, 4281 bp, Artificial Sequence
  Description of Artificial Sequence: Synthetic coding sequence
atgcaccagcggcatccacgtgctcggtgcccccccctgtgtgtggcaggcatcctggcctgcggcttcctgctggggtgttgggggccctcacattttcagcagagctgtctgcaggcgttagagccgcaggcagtgtcctcatatctatcacctggggcgcccctgaagggtagacctccatctccggggttccagcggcaacggcagcgccaacgccgcgccgcagggggaattctccacttggagctgctggtggctgtggggcctgacgtcttccaggctcaccaggaggacacagagcgatacgtgctcacaaaccttaatattggagcggagctgctgcgcgatccttccctgggcgctcaattccgggtgcatctggtgaagatggttattctcacagagcctgaaggggcgccaaacattacggccaacctaactagctcactgctgagtgtgtgcggatggtcccaaacaattaacccagaggacgacacggaccccggccatgcggatctggtactgtatattacccgattcgacctggagttgcccgatggaaatcgacaggtgcgtggcgttacccaacttgggggcgcctgcagtccaacctggtcctgtctgataaccgaggacactggcttcgacctgggggtaaccatagcccatgagataggacacagcttcggactggagcacgacggggcgcctgggtcaggatgtggcccgagtgggcacgtgatggcatccgacggtgcagccccacgcgctggattagcatggtctccctgttcccgccgccagctgctgtcactcctctcagctggcagggccagatgtgtctgggacccaccccggcctcagcccggctcagctggccacccgcctgacgcccagcctgggctctattatagtgccaatgagcagtgtagggtggcgttcggtcctaaagcagtggcctgtacctttgcccgcgagcacctggacatgtgccaggctctctcctgccacactgatccgctggaccagagctcttgttccagacttctggttcccttgctggatggcactgaatgcggagtggagaagtggtgctccaagggacgctgccgttccctggtagagttgactcctattgccgccgttcatggccggtggagcagttggggtccccgttctccttgcagtcgtagctgtggcggaggtgtggtcaccaggcggagacaatgcaataatccccgaccagcattcggcggccgcgcgtgtgtgggtgcggatctccaggccgaaatgtgcaacacccaagcctgtgagaaaactcaactcgagtttatgagccagcaatgcgccaggaccgatggccagcctctgcggtcttcacctgggggagcctcgttctaccactggggtgctgccgttccgcactcccagggcgatgctctttgtaggcatatgtgtcgcgctattggagaatctttcatcatgaaacggggagacagctttcttgacggcacacgctgcatgccgtccgggcccagggaagatggcaccctttcactatgtgtctcaggtagttgtcgcaccttcggctgcgatggtagaatggatagccagcaagtgtgggatagatgtcaggtgtgcggaggggataattccacctgcagccctaggaaaggcagctttacagccggccgtgcccgagaatacgtcacctttctaacagtgaccccaaacttgacaagtgtgtatatcgccaaccacaggccactcttcacccaccttgccgtaaggatcggtggcaggtacgtagtggccgggaagatgtcaattagccctaacacaacctacccatcactgctcgaggacggcagagtggagtaccgcgtggcactcacagaggaccgattgcccaggctggaggaaatccggatttgggggcccctgcaggaggacgccgatatacaggtctatcggaggtacggtgaggaatatggcaatctgacccggccagatataacgtttacatactttcagcccaagccgcgtcaggcttgggtctgggcagctgtccgagggccttgctcagtgtcgtgcggagctgggctgaggtgggtgaattattcctgcctagatcaggcccggaaggagctcgtagagacggtgcagtgtcaggggtcccagcagcctccggcatggccggaagcatgtgtgctagaaccatgccccccatactgggccgtaggcgatttcggcccctgctccgcttcatgtggcgggggattaagagagagaccagtaagatgtgttgaggctcagggatcactactgaaaaccctcccacccgccaggtgccgggctggggcacagcaacctgcagtggctctcgagacctgtaatcctcagccctgtcccgctagatgggaagtgtctgagccgagctcatgcacatctgccggaggcgcaggacttgccctggaaaatgaaacctgcgtgcccggagccgatgggctggaggcccccgtgaccgagggtccaggtagcgtcgatgagaaactgcccgctccggagccctgcgtaggaatgagctgcccacctggatggggacacctcgatgctaccagcgccggcgaaaaggcaccatctccctgggggtctataagaacaggagctcaagccgcccacgtgtggacgcctgccgcggggagttgttcagtgtcttgcggtcggggactgatggaactcagatttctttgtatggattccgccctgcgggttcccgtacaggaggagttatgtggcctggcgagcaagccggggtcccgtagggaagtttgccaggccgtgccatgtcctgcgcggtggcagtataagctcgctgcatgctcagtatcctgtggcagaggggtcgtgaggcgcattctttactgtgcaagggcccacggcgaggatgacggcgaggaaattctgctcgacacgcagtgccaggggctgccacgccctgagccccaggaagcgtgctcgctggagccctgtcctcccaggtggaaggtcatgtctttgggaccatgtagcgcctcatgcgggctcggaaccgcaagacggtccgtggcctgcgtgcagctggaccagggccaggatgtggaagtcgacgaagcagcatgcgccgccctcgtccgccccgaggccagcgtgccctgtctgatcgctgactgtacatatcgatggcacgtcggcacttggatggagtgctctgtgagctgcggggatggaattcagcgacggcgtgatacttgcttggggccccaggcccaagcaccagtccctgcagatttctgtcagcaccttccaaagccagtgaccgttcgtggctgctgggcaggtccttgtgtcggacagggaacaccatcccttgtcccacacgaagaagccgccgctcccggacgaacaacagcgacgcccgcaggcgcatcactcgaatggtctcaggctaggggcctgctttttagccccgccccacagcctagacggctgttgcctggaccccaggagaattccgtgcagagttcagcttgcggccggcagcatcttgagcctacagggaccatcgacatgagaggtccaggacaagctgattgcgctgtggctatcggtagaccgctgggcgaggttgtgacactgagggtcctggagtcgtccctcaactgttcggccggcgacatgctactgctgtggggccgtctgacatggagaaagatgtgtaggaagctgttggacatgactttctcgtccaagactaataccctggtggtcaggcaacgctgcgggcggccaggtggcggcgtccttctccgctatggaagccagctagcacccgaaaccttctacagagagtgtgacatgcagctgtttgggccatggggtgaaatagtgtcaccttccttgtcaccagccacatcaaatgctggggggtgccgactctttataaatgttgcgccgcatgcgcgtattgcaattcacgctctggcgactaacatgggcgcaggtactgagggagccaacgccagctacattttaatacgcgacacacactccctgaggaccacagcttttcacgggcagcaggtcctttactgggagagcgagagtagccaagcagaaatggaattcagcgaaggcttccttaaagcccaggccagtctcagggggcaatattggaccctccagtcctgggtgcctgagatgcaggatccccagagttggaaaggcaaggaaggcacc

SEQ ID NO: 5686 - DNA, 4281 bp, Artificial Sequence
  Description of Artificial Sequence: Synthetic coding sequence
atgcaccaaagacacccacgggcccgctgcccacctctgtgcgtggcaggaatcttggcatgcggattcctgcttggctgctggggcccctcccacttccagcaaagctgccttcaggctctggaaccgcaggcagtgtcctcttacctctcacctggagcgcccttgaagggacggcctccttcgcccggctttcaaagacaacggcagcggcagcgccgcgcagcggggggcatcttgcatctggaactgctggtagctgtgggtccggacgtgttccaggcgcaccaagaggacaccgagcgatatgtgctgactaacctgaatatcggagcggaactgctccgagatccgagcctgggagcacagttcagagtgcatctggtgaaaatggtcatactgaccgagcctgagggggcaccaaatatcaccgctaacctgacctcgagcctgcttagcgtgtgcggctggtcgcagaccatcaacccagaggacgacacggacccagggcatgctgacctggtactgtacatcacccggttcgacctggaactgccggatggcaaccgtcaggtgagaggcgtcactcagctcggcggagcctgttcgcctacctggtcatgcctgattactgaagataccggattcgatctcggggttactatcgcgcatgagatcggacactcatttggattggaacatgacggagcgcccgggtccggttgcggaccgtcgggacacgtgatggcatcggacggagcggcaccacgggccggcctggcatggagtccgtgtagccggaggcagctgctgtccctgttgtcagctggtcgggctagatgtgtgtgggacccccctcggccacagcctggatcggccggtcatccgcccgatgcgcaacctggtctgtattactcagcaaatgagcagtgcagagtggcctttggaccgaaggcagtggcatgcaccttcgctagagaacatctggatatgtgccaggcgctctcatgtcatacggaccctctcgaccagtcaagctgctcgcggctcctcgtcccgctcctggacgggactgagtgcggagtggagaaatggtgttcgaagggtagatgcaggtcgttggtggagttgaccccgattgcagctgtccacggcagatggtcatcgtggggaccgagatccccctgttcccggtcgtgcgggggaggggtggttacccgccgacggcagtgcaataatccgcgccctgcgtttggaggtagggcatgcgtcggagccgacctgcaggccgagatgtgcaacacgcaagcctgcgaaaagacccaacttgagttcatgtcgcagcaatgcgcccggactgacggacagccgcttaggtccagcccaggcggggcctcattctaccactggggcgctgctgtgccgcactcgcaaggggacgctctgtgtcggcacatgtgtcgcgcaatcggagagtcattcatcatgaagcggggagattcgttcctcgatggaactcgctgcatgccttccggccccagagaagatggcactttgtccctgtgtgtgagcggctcctgccgcacttttggctgcgacggtaggatggattcccagcaagtttgggaccggtgccaagtgtgtggaggggataatagcacttgctccccacgcaaagggagctttactgcgggacgggctagagaatacgtcaccttcctcaccgttactccgaacctcacctccgtctacatcgcaaatcacagaccgctcttcacccatctggcagtgcgcatcgggggtcgatacgttgtcgcgggaaaaatgtcgatcagccccaacaccacctacccgtccctgctggaggacggccgcgtggagtaccgcgtggctctgaccgaggacagacttcctcgcctcgaagagatccgcatctggggccctctgcaagaggatgctgatattcaagtctaccgacggtacggagaagaatacggaaacctgactaggcccgacatcactttcacttacttccagccgaagccgagacaggcctgggtgtgggccgccgtgaggggaccgtgttccgttagctgcggagccggacttagatgggtcaactactcgtgcttggaccaggcccggaaggagctggtcgagacggtgcagtgtcaggggtcccagcagccccccgcttggccagaagcgtgcgtgctggaaccgtgccctccttactgggctgtgggagactttggaccatgctccgcctcctgcggtggtggactgagagagcgccccgtgcgttgcgtggaagcccaaggatcgctcctcaagactctccctccggcaaggtgcagagccggggcccaacaacccgcggttgccctggaaacgtgcaacccacagccgtgcccagcgagatgggaggtgtcggaaccctcgtcgtgtacttcggctgggggtgccggattggctctggaaaatgaaacctgcgtgccaggagctgatggcctggaagcgccggtgactgaagggccgggaagcgtggatgaaaaactcccggcgcctgaaccgtgcgtgggaatgtcgtgcccgccgggatggggacacctggacgccacctcagctggagaaaaggcgccaagcccctggggatcaatccggaccggagcccaggcagcgcacgtctggactcctgccgcgggatcctgctccgtctcgtgtggtagagggctcatggaactccgattcctgtgcatggactccgcgctgcgtgtgcctgtgcaggaggagctttgcggactcgcatccaagcccggatcacggcgggaagtctgccaagcagtcccatgtccggcgcggtggcagtataaactcgcggcgtgttcggtgagctgtgggaggggggtggtgagacggatcctctattgcgccagagcacatggggaggacgacggggaagagatccttctggacacccagtgccagggcctcccgcgcccagagccccaggaggcttgttcactggagccctgtccgcctcggtggaaggtgatgtcgttgggaccgtgcagcgccagctgcggtctgggcactgcgcgccgatcagtggcttgcgtgcagctcgaccagggacaggacgtggaagtggatgaagcggcttgcgccgccctggtgcggcctgaggcctcggtgccgtgtctgatagcagattgcacctacagatggcacgtgggaacctggatggaatgctcagtctcatgcggcgacggaattcaaagacggcgtgacacctgcctggggccgcaagcccaggcccctgtccctgcggacttctgtcaacatctgccgaagccggtcaccgtgcgcggatgctgggcagggccatgcgtgggacagggaaccccatcactggtgcctcatgaagaggctgccgccccgggacgcactacggctactccggcaggagcgtcgctcgagtggagccaagctcggggactgctgttctcaccggcgccgcagccacggcgcttgctgccgggcccacaggaaaacagcgtgcaatcatcagcctgcggcaggcagcacctggagccgactggaactattgacatgcggggcccaggacaggcggattgcgcggtggccatcggtcgaccgcttggcgaggtggtgaccctgcgcgtcctggaatcgtccctgaactgctcggccggtgacatgctgctgctgtggggcagactgacttggcgcaaaatgtgccgcaaattgctcgacatgaccttttcgagcaagactaacactctcgtcgtgcgtcaacgctgcgggcggcctggaggaggagtccttttgcgctacgggagccagctcgcgcccgaaactttctacagagaatgcgatatgcaactgttcggcccttggggtgaaatcgtgagcccttcgctgtctcctgcaacctcgaatgccggcggctgtcgactgttcatcaatgtcgccccacacgcaaggatcgccattcatgccctcgcgaccaatatgggcgccggaactgaaggagccaacgcgtcctacattctcatccgggacactcatagcctgaggaccaccgctttccatggacagcaggtcctgtactgggaatccgaaagttcgcaggcagaaatggaattcagcgaggggttcctcaaggcgcaggcgtcactgcgcggacagtactggaccctgcagtcctgggtgcctgagatgcaggaccctcagagttggaagggaaaagagggaacc

SEQ ID NO: 5687 - DNA, 4281 bp, Artificial Sequence
  Description of Artificial Sequence: Synthetic coding sequence
atgcaccagcgccacccccgagcgagatgccctcccctgtgcgtcgccggcatcctcgcctgcgggtttctccttggctgctggggtcccagtcactttcagcaaagttgtctccaagcccttgagcctcaggctgtgagtagctacctttcccccggggcaccgctcaaaggcagaccacctagcccagggttccagcggcaacgtcagcggcagcgccgtgctgcgggcggaatactgcatctagagctgctggtcgccgtgggccctgatgtgttccaggcccaccaggaagataccgaacggtatgtactgaccaacttgaacatcggtgcggagctgctccgggacccttctttgggggcacaattcagagtgcatctggtgaaaatggtgatcctcacagaaccggagggcgctccaaacattaccgcgaaccttacaagttctctcctgtcagtgtgtggctggagccaaaccattaacccagaggatgatacggatcctggacacgcagacctggtcctgtatatcaccagatttgatcttgaactgcccgatggcaacagacaagtgcggggtgtgacacaattggggggagcttgtagtccgacttggagctgcttgatcactgaggataccgggtttgatcttggcgtgacgattgcgcacgagatagggcacagttttggccttgagcatgatggggcacctgggagcggctgcggaccatctggccatgttatggcttccgacggcgctgccccccgcgccggcctggcctggtcaccctgttcacggcggcaacttctgtctctgttgtccgccgggcgcgcgagatgtgtgtgggaccccccacggccccagccgggaagcgccgggcacccacctgatgcacagccaggcctgtactactcagcaaacgagcaatgcagggtcgcattcggacccaaagctgtcgcttgtacttttgcgagggaacacctggatatgtgccaggcgctctcgtgccatactgaccctcttgaccaatcctcttgctctcgcctgttagttccactcctcgatggtactgagtgtggagtcgaaaaatggtgtagtaaaggccgctgtcgctcacttgtcgagctcacacccattgcggccgtgcacgggaggtggtcttcttgggggcccagatctccctgctctcgatcctgcggcgggggcgtggtgaccaggcgacgccagtgcaacaaccccaggccagcttttggaggacgagcctgcgtgggtgcggacctgcaggcagagatgtgtaacacacaggcctgtgagaagactcaacttgaatttatgtcccaacagtgtgccagaaccgacgggcagccattaagatcatcacccgggggcgctagcttctaccattggggtgctgctgttccccatagtcagggggacgctctgtgcaggcacatgtgcagagctatcggagaaagctttatcatgaaaaggggagacagttttttagacggcacgaggtgcatgcccagcggcccacgcgaagatgggactctgagtctctgtgtcagtggttcatgtagaactttcggctgcgatggacgtatggatagtcagcaggtatgggataggtgccaggtgtgcggaggggacaactcaacttgtagcccaagaaagggaagcttcaccgcaggccgtgcccgagagtacgtgaccttcctgaccgtaactcctaatctcacttcagtctatatcgccaaccacagaccactgtttacacacctggctgtgagaataggcggcaggtatgtggttgctggcaagatgtccatatcgcctaatactacatatccctctctcttggaagatggtcgagtggagtacagggtagcactgaccgaagaccgccttcccagactcgaagaaatacgaatttgggggccactgcaggaagatgcagatatccaggtgtaccgacgctacggcgaggagtatggtaatctaacccgccccgatatcacgttcacatatttccaacctaaaccccggcaggcttgggtgtgggccgctgtgagggggccctgttctgtgtcatgcggcgcgggtctgcgttgggtgaattattcttgtctagaccaggccaggaaggagttggtggagacagttcagtgtcaggggagtcagcagccaccagcatggcctgaagcgtgcgtcctggagccctgcccgccatattgggccgtgggagactttgggccctgctccgcttcctgtggtggcggacttagagagaggccggtccgatgtgttgaagctcagggttcgctgttgaagacactccctcctgcccgatgccgagcgggggcacagcagcccgcggtggctcttgaaacatgcaacccacaaccttgtcctgcccgatgggaagtatctgaacctagctcctgtacgtcagccggcggtgccggtctcgccctagagaacgagacctgtgtccccggagcggatgggctagaagccccagtgacagagggaccaggaagcgtggatgaaaagctgccagccccagagccgtgcgtgggaatgagttgtcctccaggctggggacacctggatgcaacttccgccggtgagaaagcaccatctccctggggttcaattaggactggagcgcaggcagcccatgtttggacacccgccgcgggatcatgttcagtctcatgtggccgcggactgatggagttgagatttctctgcatggattccgctttacgcgtgcccgtgcaagaggaactgtgcgggctggccagtaaaccagggagccggcgggaggtgtgccaggcagttccgtgtcccgcccggtggcagtacaaactcgcggcctgcagtgtctcatgtggcagaggcgtcgtgcggcggatcctatattgtgccagggcccatggcgaggacgatggcgaggaaattcttctcgacacccaatgccagggcttgcctcggccggagcctcaggaggcatgttccctggagccctgtccgccgaggtggaaggttatgtcactggggccctgttccgcgagctgtggacttggaacagctcgacgatcagtggcgtgtgtccagttggaccagggacaggatgtggaggtagatgaagctgcctgcgccgccctggtcagacctgaggccagcgtcccgtgtttgattgccgattgtacatatcgctggcacgtgggtacttggatggagtgctctgtttcttgtggcgatggcatccagaggcgacgcgatacctgcttgggccctcaagctcaggcccccgttccagccgacttctgtcaacacctaccgaagcctgttaccgtccgaggctgttgggctggcccctgtgtcgggcaggggacaccatctctcgttccgcatgaggaagcggccgccccaggccggacgactgccacacccgcgggggccagcttggaatggtcccaggcccgcggcctgctcttctcgcctgccccccaaccaaggcgccttctaccaggccctcaggagaattctgtgcagtcttctgcgtgtgggcgccagcacctcgaacctacaggcacaatcgatatgcgaggcccagggcaggcagactgcgcggtcgccattggtcggccactcggagaagtagtgacccttcgcgtattggagtcgagcctcaactgctctgccggcgacatgctcctgttgtggggacgtctgacctggcggaagatgtgcaggaagctgctggatatgacatttagtagtaaaacaaatactctggtggtacgacagagatgtggccgcccgggaggcggagtattgttgagatacgggtcacagttggctccggagaccttttatcgggagtgtgatatgcagctgtttggaccttggggagagatcgtgagcccatctctgtcgccagctacgtccaacgccgggggttgccgactatttattaatgtcgctccacatgcccgaattgccatccacgctctggctactaacatgggggccggtacggaaggtgctaacgcctcctatatcctcatccgggatacccattctctgcggacaactgcatttcatggccagcaggtgctgtactgggaaagcgaatcctctcaggctgagatggagttctccgagggctttctcaaagcacaggctagcctccgaggacaatattggacgttgcagtcttgggtgcccgaaatgcaggacccccagtcttggaaggggaaggaggggacc

SEQ ID NO: 5688 - DNA, 4281 bp, Artificial Sequence
  Description of Artificial Sequence: Synthetic coding sequence
atgcatcagaggcatccgcgggcccggtgcccacccctgtgcgtggcgggtatattggcctgtggatttctactcggatgctgggggccttcccatttccagcaaagctgtttgcaggccctggagccccaggcggtctcttcttacttgtcacccggtgcgccactgaaagggcgtccaccctcaccaggcttccagcgccagagacagcggcagcggagggcagccgggggaatcctgcacctggagctcctagtagccgtaggcccagacgtgtttcaagcccaccaagaagacaccgaacgctatgtcctgaccaatctgaatattggggctgagctgttaagagatccaagtctgggagctcagtttcgagttcatctagtaaagatggtcatcttaacggaacctgagggtgcccctaacataactgctaatctgactagctctctcctgagtgtgtgcggatggagccagaccatcaatccagaggatgataccgacccgggccacgcagatctcgtactgtacatcacccggttcgatctggaactgcccgatggtaaccggcaagtgcgtggagtgactcagctggggggggcttgttccccaacttggtcttgcctcattacagaggacaccggtttcgacctaggggtaactatcgcccacgagattggccattctttcgggttggagcacgacggcgcaccaggatctggttgtgggccctcgggccacgttatggcgagcgatggagcagccccacgtgcaggactagcctggtcaccttgctccagacggcagctcctgagcttgctaagtgcaggtagagcacgatgcgtgtgggatcctcccagaccacagccgggaagtgccggccaccctcctgatgcgcagcccggactatactattcggcaaatgagcagtgtcgggtcgcctttggcccaaaagccgtagcttgcacgttcgccagagagcatttagacatgtgccaggccctgtcctgtcacaccgatccactggatcagtcatcttgtagcaggctgctggtgcctctgctggatggaactgagtgcggcgtggaaaagtggtgcagtaaggggaggtgcaggtctcttgttgagttgacccccatcgcagccgttcatggaaggtggagctcgtggggaccgcgaagcccttgctcacggtcttgcgggggcggtgtggtgaccagacgacggcagtgcaacaatccgcgcccagccttcggaggaagagcatgcgtaggtgccgatctgcaagctgagatgtgtaacacccaggcctgcgagaaaacgcagctggagttcatgagccagcagtgtgctaggacagacggccagcccctgcggtcctctccagggggtgcctccttttaccattggggcgcggcagtgccccacagtcaaggagacgctttgtgcagacacatgtgccgcgccatcggcgaatcttttataatgaaacggggcgattcctttttggatgggactagatgcatgccttcaggcccccgggaggatggaacactgagcctctgcgtgagcggctcttgccgtaccttcggctgcgatgggagaatggacagccagcaggtatgggatagatgtcaagtatgcggcggtgacaactcaacatgtagcccccgcaaggggagctttactgccgggagggcacgggaatatgtgacttttctaactgttacacctaacctgacatccgtttacatcgctaaccaccggccgctcttcactcaccttgctgtgagaatcggaggccgctacgtcgtcgccgggaaaatgagtatcagcccaaacacgacctacccgtcgcttctagaagacggaagggtggagtaccgggttgctctgactgaagatcgcctgccaagactggaagagattcggatttggggccctttgcaagaagacgccgatatccaggtttatcgtcggtacggcgaagagtacgggaacctgacgagacccgacataacgttcacttacttccagcccaaaccgagacaagcttgggtatgggctgctgtcagaggaccatgctcagtgagttgcggggctggccttcggtgggtgaactacagctgtttggaccaagctcgaaaggaactggtcgaaaccgtgcagtgtcagggcagtcagcagcctccagcttggccagaggcttgcgtgctcgagccctgcccaccttactgggcagtgggagactttggaccgtgttccgcctcatgcggtggcggtctcagagagcgtccagtaagatgtgtggaagcccagggaagcctactgaaaaccctgccaccagcaaggtgtagggctggggcgcagcagcctgctgtcgcattggagacgtgtaatccccagccatgccctgccagatgggaggtatctgaaccttcctcctgcaccagtgctggcggagctggcttagcgctcgaaaatgagacttgtgtaccaggagccgacggactggaggcccctgtaacagagggtcccggatcagttgacgaaaagcttcccgcaccagagccatgcgtggggatgtcatgcccccccggatggggacatctcgatgccactagcgccggagaaaaagctccatcaccatggggcagcatcagaacaggggctcaggcagctcacgtatggacccccgccgcgggctcttgttccgtgtcctgcgggcgcgggctgatggagctgagattcctctgtatggatagcgctctgcgcgtaccagttcaagaggaattgtgtggactagcttcaaaaccggggtccaggcgagaggtgtgccaggctgtaccctgtcccgctagatggcagtacaaattggccgcctgctctgtttcttgtggtcggggggtggtgcgccgcatcctttattgcgcaagagctcatggagaggacgacggcgaggagatcctgcttgacacacagtgccagggtttacctcggcccgaaccgcaagaggcctgctcattggagccttgtccccctagatggaaagtgatgagccttggaccctgcagtgcctcttgtgggctggggacagctcggaggagcgtggcttgtgttcagctggaccaggggcaggacgtggaagtggatgaagcagcttgcgccgcgttggttagacccgaagcctcggttccctgtttgatcgcagattgcacttaccgttggcatgtcgggacctggatggaatgcagcgtgtcttgtggcgacggtatccagcggcggcgggacacctgtttaggccctcaggctcaggctcctgtccctgcagacttctgccagcacctgccaaaaccagttacagttagggggtgttgggcagggccctgcgtcggacaggggactccaagcctggtgccgcacgaggaggctgccgcacccggacgcaccactgcgacaccagccggggcttccctggagtggtcccaggctcgcggcctgctattcagtccagccccccagccccggcggttacttcccggtcctcaagagaatagcgtgcagtcttctgcctgtggccggcagcacctcgaacccaccggcactatcgacatgcggggaccgggtcaggccgactgcgcagtagcaatcggcagaccactgggagaggtggttacacttagagtgctggagagtagccttaactgctcagctggcgatatgctgctcctatgggggaggctcacttggcggaaaatgtgtagaaagttgctcgatatgactttttcgtctaagacaaacaccctggtagtgagacagaggtgcggccgcccggggggcggcgtccttctgaggtatggtagtcagctcgcccctgagaccttctatagggagtgtgatatgcagctctttggcccatggggggagattgtgtcaccatccctttcccccgccacaagcaacgccggaggatgccgactgtttatcaacgtggctcctcatgcacggattgctatccacgccctggccactaatatgggcgcaggaacagagggagccaatgctagctacattctgatccgggatactcactctttgcgaaccaccgcctttcatggacagcaggtactttattgggaatccgagtctagccaggcagaaatggaattctcagaggggttcctaaaagcgcaagcttcattgcgcggacaatactggacacttcagtcttgggtcccggagatgcaagaccctcagagctggaaaggcaaggaaggaact

SEQ ID NO: 5689 - DNA, 4281 bp, Artificial Sequence
  Description of Artificial Sequence: Synthetic coding sequence
atgcatcaacgccatcctagagctcgctgcccacctctgtgtgtggcgggaatcctggcatgtggctttctgctgggatgctggggaccttcgcacttccagcagagctgtctgcaagcactggaacctcaagcagtctcgtcctacctgagcccgggggccccactcaagggcagaccaccgtcgcctggatttcagagacagagacaacgtcagcgccgagcagccggggggatcctgcatctcgaacttctcgtggcagtgggtcctgatgtgtttcaggctcaccaagaagatactgagcggtacgtcctgactaacctgaacattggtgcagagctgctgcgcgacccttcgcttggtgcacaatttcgggtccacctggtgaaaatggtgattctgaccgaaccagaaggagcaccaaacatcacggcaaacctgacctcttccctgctctcggtgtgtgggtggagccagactatcaatcctgaggatgacaccgacccagggcatgcagatcttgtcctgtacatcactaggttcgatcttgaattgcccgacggtaaccgccaggtgcggggagtcacccaactgggtggtgcatgttcgcctacctggagttgtctcatcactgaagatactgggtttgatctcggggtgactattgcacatgaaattgggcattcattcggacttgaacatgacggggctcctggtagcggttgtggcccatcgggacatgtgatggcttcggatggtgcagcacctcgtgcaggactggcctggtcgccatgttcacgtcggcagcttctctcgctgctttcggcggggcgggcaagatgtgtctgggatcccccaagaccccaacctggctcggcaggccacccaccagacgcacagcccggtctttactattcggctaacgagcagtgtagggtggcgttcggacctaaggcagtcgcatgtacttttgcccgggaacaccttgatatgtgccaagccctgagctgtcatactgatcccctggatcagtcgtcctgttcgcgcctgcttgtgccccttctggatggaactgaatgtggcgtggaaaagtggtgctcgaagggtaggtgtcggtcgctggtggaacttactcccatcgcagctgtgcatggaaggtggtctagctggggtccacgctctccatgttcaagatcctgcggtggaggtgtcgtcactcgtagaaggcagtgcaataacccaagaccagcatttgggggcagagcctgtgtgggagcggacctccaggcagagatgtgtaatactcaggcatgcgagaaaactcagcttgaattcatgtcccaacagtgcgcccggacggacggtcagccccttagaagctcacctgggggtgcgagcttctaccattggggagcagcagtgccgcatagccaaggtgatgcactgtgtcgccacatgtgtcgtgcaattggtgagagcttcattatgaagcgcggggattcatttctcgacggaacgcgctgtatgccaagcggacctagggaagatggtactctgtccttgtgcgtctcgggcagctgtagaacttttggctgtgacggccggatggattcgcaacaggtgtgggatcgctgtcaagtctgtggaggtgacaattcaacttgttctcctagaaaaggtagctttaccgcaggtagagccagagaatacgtgacctttcttaccgtgaccccgaacctgacctccgtgtacatcgcaaaccacaggcccctctttacgcacctggccgtgcgaatcggcgggaggtatgtggtggcagggaagatgtcaatcagccccaatactacctacccctcgctcctggaagatgggagggtggaataccgagtcgcacttaccgaggatcgactcccaagattggaagaaatcagaatctggggtccccttcaggaagatgccgacatccaagtgtacaggcgctacggcgaagagtacgggaaccttactagaccagatattaccttcacctactttcaaccaaagcctagacaggcctgggtgtgggcagcggtgcggggaccctgcagcgtcagctgcggcgcaggtttgagatgggtgaattactcatgcctggatcaagcacgaaaagaactcgtggagactgtgcaatgtcaaggaagccaacagcctcctgcatggcctgaggcctgtgtgctcgagccttgtcctccttactgggccgtcggagattttggtccttgttcggcatcctgcggcggaggtttgcgcgaaagacctgtccgttgtgtggaagcacagggaagtttgctcaaaactctgccccctgcacgctgtagagccggtgcacaacaacctgcagtggccctggaaacctgtaatcctcaaccgtgccctgctagatgggaagtgtcggaaccctcttcgtgtacctctgcgggaggggctggactggcactcgaaaatgagacttgcgtcccaggagctgatggtctggaggcgccagtgactgaaggacccggtagcgtggatgaaaagctcccagcaccagagccttgtgtgggaatgagctgtccccccggatggggacatctggacgcaacgtccgccggagagaaggccccatcgccatggggaagcattcgaactggtgcacaagcagcccatgtgtggacccctgcggcaggctcatgttcggtgagctgtgggcgaggtcttatggagttgcgttttttgtgtatggattccgcccttcgggtgcccgtccaagaggaactttgtggtctggcatccaagcctggttcgaggcgagaagtgtgccaagccgtgccatgtcccgcaaggtggcaatacaagctggcggcttgttccgtttcttgtgggcgcggagtcgtgagacgaatactttactgcgcacgagcacacggggaagatgatggagaggaaattctgctcgacactcagtgccagggtttgcccaggcccgagccacaagaagcatgttcccttgaaccatgtccaccaagatggaaggtgatgagcttgggaccctgttccgcatcatgcggactcgggaccgcaaggcggagcgttgcatgtgtgcaacttgatcaaggacaggatgtcgaagtggacgaagcggcttgcgccgcacttgtcagaccggaagcaagcgtcccttgtctcatagcggattgtacttaccgctggcacgtgggcacttggatggagtgttccgtcagctgtggagacggaatccaacgcagacgggatacttgtcttggcccacaagcccaggcccctgttccagcagacttttgtcaacatctgcccaaacccgtgaccgtccggggctgttgggcaggaccatgtgtcggtcaagggaccccctcactggtccctcatgaggaagcagctgctcccggacgtaccaccgcaacccccgcaggcgcatcacttgaatggtcacaagcacggggtttgctgtttagcccagcaccacagcctcgcagacttctgccagggccgcaagagaattcggttcaatcctcggcatgcggtagacagcacctcgagccaactggaactattgacatgagagggcctggacaggcagattgtgcagtggcaatcggccggcctcttggggaagtggtgaccctgagagtcctggagtcatcccttaactgttccgcgggtgatatgctcctcctgtggggtcggcttacttggagaaagatgtgtagaaagctccttgatatgaccttttccagcaagaccaacacgctggtcgtcagacaaagatgtggcaggccaggtggtggcgtgttgcttcgctacggctcccaactggcaccagaaaccttttatcgtgaatgtgacatgcaactgttcgggccgtggggagagattgtgtcaccttctctttcccctgctaccagcaacgcaggtggctgtcgtctgttcattaacgtggcccctcatgctcggatcgcaattcatgcacttgcaaccaacatgggtgccggaactgaaggggccaacgcatcatacattctcattagagatactcattcgcttcgcaccacggcattccatgggcagcaagttctgtactgggaatcggaatcatcgcaggcagaaatggagttttcggaagggttcctcaaggcacaagcatccctgcgtggtcagtactggactcttcagtcatgggtgccagagatgcaggaccctcaatcatggaagggaaaggaaggaact

SEQ ID NO: 5690 - DNA, 4281 bp, Artificial Sequence
  Description of Artificial Sequence: Synthetic coding sequence
atgcaccagcgtcaccctagagctcggtgcccacctctgtgcgtggcaggtattttagcttgcggatttttgttaggctgctggggtccttcccactttcagcagagctgtcttcaggccctggaaccccaggctgtgtcttcttacctttctcccggagcgcctctcaagggaaggccacctagtcctggattccaacgacagaggcagagacagaggagggccgcaggaggtatcctgcatctagagctgcttgtagcagtgggcccagacgtctttcaggcccatcaggaagatactgagaggtacgtacttactaacctgaacattggcgctgaactgctgagggacccaagtctcggagcgcaattcagagtgcatctggtcaagatggttatactaactgaacctgagggcgccccgaacatcaccgcaaacctcacttcttctctccttagcgtatgcgggtggtcacagaccatcaatcctgaggatgacaccgaccccggacatgccgacctggtgctgtatattacgaggttcgacctggaacttcccgatggaaaccggcaggtgcgtggtgtgacccagttagggggggcatgttccccaacttggtcttgcctgatcaccgaagatacggggtttgatctgggagtgactatcgctcacgagatcggacatagcttcggtctggagcacgatggcgcccccgggagtggctgcggcccaagtggacacgtaatggcctcagatggtgccgcaccacgcgcagggctggcttggagcccgtgttctaggcggcagctgctatctctgctatccgctggccgggcgcgttgcgtttgggacccaccgaggcctcagcccggatctgctggccatcctccggatgcacaacctggcttatattacagcgctaatgagcagtgccgcgttgcgtttggacccaaggctgtagcatgtactttcgctagggagcatctggacatgtgtcaggcacttagttgtcacacagacccattagatcaatcctcatgcagcaggttactggtcccgttgctggatggaaccgagtgcggagttgagaaatggtgcagtaagggacgctgtcgaagtttggtggaattaaccccaatagcggccgtccatgggagatggtcatcatgggggccccgtagtccttgctcacgcagttgcggcgggggcgtggtgacccgaagacgtcagtgcaacaaccccaggcctgctttcgggggcagggcctgcgtgggggcagacctgcaggctgagatgtgtaacacccaggcctgtgagaagacacagctcgagtttatgtctcagcagtgtgctcgcacagatgggcagccactacgatcgtccccaggaggggcgagtttctaccactggggagccgccgtgcctcacagtcagggcgacgctctgtgtagacatatgtgcagagcaattggggaatcttttattatgaagaggggcgacagttttctcgatggaacgcggtgtatgccttctgggccccgggaagatgggacactgtccctttgtgtgagtggctcttgtcgcacctttggctgcgacggcagaatggactctcaacaggtctgggataggtgtcaagtatgcggtggcgataattctacatgcagcccaaggaagggatccttcacagcaggcagagctcgcgagtatgtgacctttctcacagtaacccccaatttaaccagtgtctatatcgcaaatcatcgacctctctttacccatctggctgtgaggatagggggtcgctacgtcgtggccggaaaaatgtctatctcccccaacaccacttacccctctctgctggaggacggtcgagtagaatacagagtggcactgactgaggatcgtctgcccaggcttgaggaaataagaatctgggggccattgcaggaggatgccgacatccaggtgtaccggagatatggcgaagaatacgggaatctgacaagacctgacattacgtttacttattttcagcccaaaccaaggcaggcatgggtgtgggcagccgtgagagggccctgtagtgtgtcgtgcggagctggcctgcgctgggtgaactacagttgcctggaccaggctcgtaaagagctcgttgaaacagttcagtgtcagggttctcaacagcctcccgcgtggcctgaagcttgtgtcctggaaccttgcccgccgtattgggcagtgggcgacttcggcccctgttccgcttcgtgcggaggcggcttgagggagaggcctgtacgctgtgtagaagcacagggaagcctactcaagacccttcccccggctagatgtagagcaggagcacagcagcccgccgttgccctcgagacctgtaaccctcagccctgccctgcgagatgggaggtgtcagaacccagcagctgtacatcagctgggggcgccggactggccctggagaacgaaacctgtgtgcccggggctgatggactggaagcccccgtgaccgagggaccaggctcggtggatgaaaagctcccagctcccgagccgtgcgtgggaatgagttgccctcctggctgggggcacctcgacgccacctccgctggcgagaaagccccttcaccatgggggtcgattcgaaccggtgcccaagctgcacacgtgtggaccccagccgcaggtagctgctccgtgtcctgcggccgcggattgatggagctgcgatttctgtgtatggactccgccctgagagtaccggtccaggaagaactgtgtggactggcttcgaagcctggcagtaggcgtgaggtgtgccaggccgtcccttgcccagcacggtggcagtacaagcttgccgcttgctcagtgtcttgcgggcgtggcgtggttcgaagaatactctattgcgccagggcgcacggtgaggatgatggtgaggagatcctgctagatacgcaatgccaaggtctccctcgtcctgagccgcaggaggcatgtagtttggaaccttgcccaccccggtggaaggtgatgtcactgggcccttgtagcgcgtcctgtggccttgggaccgctagacgctcagtggcatgtgtgcagctggaccagggtcaggatgtggaagtggatgaagccgcctgtgccgcactagtgaggcctgaggcgtccgtgccttgtctcatagccgattgtacctaccgatggcacgtggggacctggatggaatgctcggtgagctgtggagacggaattcaaaggagacgcgacacctgccttgggccacaggcccaggcccctgtcccagccgacttttgtcagcacctgcccaaacctgttaccgtgcggggctgctgggctggaccctgcgtcggccagggcaccccgtctctggttcctcacgaagaggctgctgcccctgggcgtacaactgctaccccagccggggcgtctttggagtggtcacaggctaggggtttgctgttcagcccagccccacaacctagaagactactgcccggcccccaggaaaacagcgtgcagtcatctgcatgcggccgccaacaccttgagcctactggcactattgatatgcggggacccggacaagccgattgtgcagtcgccatcggacgtcctcttggggaagtagtcacactgcgggtgcttgagtcatcccttaattgctctgccggtgatatgctgctattgtggggcaggttgacctggcgaaagatgtgcaggaaactacttgatatgacgttttctagcaagaccaataccctcgtggttaggcagagatgtggacgacccggaggaggagtgttgctgcggtacggctcacagctagctcctgagacgttctaccgggaatgcgacatgcagctgtttggaccgtggggcgagattgtcagccccagccttagtccagcaacatctaatgccggcggctgcagattgtttattaatgtagctccccatgcacgcatcgctattcatgccctcgccacaaatatgggcgcagggactgagggcgcaaacgcctcctatattctgattcgcgacacccacagcttgagaactactgcgttccatggacagcaggttctctactgggaatctgagagctctcaggctgagatggagttcagtgaaggattcctaaaggcacaagcctcattgcgcggacagtactggacccttcagtcctgggtgcccgaaatgcaagatccacagtcttggaaggggaaagaaggcacc

SEQ ID NO: 5691 - DNA, 4281 bp, Artificial Sequence
  Description of Artificial Sequence: Synthetic coding sequence
atgcatcagaggcatcctcgcgctaggtgtcctcctctgtgcgtcgcaggaattttggcctgcggcttcctcctcggctgctgggggccaagccactttcagcagagctgtttgcaggctctcgaacctcaagccgtgtcatcctacctgtcccccggcgcccctctaaagggacgacccccaagtcctgggttccagagacaacgacagcggcagcgccgtgcagcgggcggtatattgcatctggagctgctggtagccgtgggacctgacgtgtttcaggcccaccaggaggataccgaacgctatgtgctgaccaacctcaacattggcgcggagctgcttcgggatccttccctcggtgcccagtttagagtacacctagttaagatggtgattctgaccgaacccgaaggcgcacctaatattaccgctaacctaacgagtagtctgctgagcgtgtgtggttggtcccagacaattaaccctgaggacgataccgatccaggccacgccgatctagtgctttacattacccgatttgaccttgaattaccggacggaaaccggcaagtccgcggggtaactcagcttgggggtgcatgctcaccaacttggtcctgtctaatcacggaagacaccggctttgacctaggggttacaattgcccacgaaattggtcacagctttgggctcgagcatgacggggcaccgggatccggatgtgggccttcaggacatgtcatggcgtctgacggggctgcacctcgcgcaggactggcctggagcccatgttccaggaggcaactgctttctctcctttccgccggcagggcacgatgtgtgtgggatccacctcggccccagcccggaagcgccggtcaccccccagacgctcagcccggactctactacagtgccaacgagcagtgtagggtagcgttcggacccaaggcagtcgcctgtacattcgcccgggagcatctggatatgtgccaggcactatcctgccataccgaccctctggaccaatcttcttgctctagactcctagtgccactacttgacggcaccgaatgtggagtggagaagtggtgcagcaaggggcgctgtagaagcctggtcgaattaactccgatcgctgccgtgcacgggcgttggtcaagttgggggcccaggtccccttgcagccgaagttgtggaggcggggttgtcaccaggcgacgccaatgtaataaccctaggcctgcctttggaggccgggcttgtgtgggagcggatctgcaggcagagatgtgcaatacccaggcgtgcgagaagacccagctagagtttatgtctcagcaatgcgcccgaactgatgggcagcctctccgatcatcccccgggggtgctagcttttaccattggggggccgctgtccctcacagtcagggcgatgccctgtgccggcacatgtgtcgcgcaatcggggagtcatttatcatgaagcgaggagactcgttcctggatggtacgcgctgtatgccctctggccctcgcgaggacggaacactttccctgtgtgtcagcgggagctgcagaacgttcgggtgtgatggccggatggactctcagcaggtgtgggacaggtgccaggtatgtggaggcgataactctacttgctcacctcgaaaagggagcttcaccgcaggccgtgctagagaatacgtgacgttcctaaccgtcaccccaaatttgacgtccgtgtacattgctaatcacagacccctattcacacatctggctgtgcgaattggtggcagatatgtcgtggcagggaagatgagtatctcaccgaatacaacgtacccttcactgcttgaggatgggcgtgtggagtacagggtcgcattgacggaggaccggctgccccgcctcgaagaaatcaggatctggggccctctgcaagaggatgccgacatccaggtgtacaggaggtatggcgaggaatacgggaacctgactcgtccggatatcactttcacatatttccaaccaaaaccaagacaagcctgggtctgggcggccgtaaggggcccttgttctgttagctgtggagcaggccttagatgggtcaattatagttgcctggatcaagccaggaaggagctggtggagaccgttcagtgtcaggggtctcaacagccacctgcttggcccgaggcatgcgtgctcgaaccttgccccccatactgggccgtgggagatttcggcccatgttcggcctcttgtggtgggggactccgggagaggcccgtacggtgcgtggaggcccaagggagtctgctaaagactttgcccccagcgaggtgtagagcgggtgctcagcaaccagccgtcgctctggagacgtgtaatccacaaccttgccctgcccgctgggaggtttccgagcctagttcctgcacgtctgctggaggcgcagggctcgccctggaaaatgagacgtgtgtccctggcgccgacggtctagaggctcctgtgactgagggtccaggatccgtggacgagaaattgccagccccggagccttgtgtcggcatgtcttgtccccctggctgggggcatctggacgctacctccgcgggtgaaaaagcacccagcccctggggatctatcaggactggagcgcaggccgcgcacgtgtggaccccagccgcgggtagctgtagcgtgtcttgcgggcgtggccttatggaacttaggttcttatgcatggacagtgccctcagggtacctgttcaggaggaattatgtggtttagcctcgaagcctggttcacgccgcgaggtttgtcaggctgtgccatgccccgccaggtggcagtataagctggccgcttgtagcgtgtcctgcggtaggggcgttgttagacgtatcctttattgcgcccgcgcccatggcgaagacgacggcgaggagatccttctggacacgcagtgccaaggcctccctcgccccgagcctcaagaagcctgttctctggaaccctgccctccacgctggaaggttatgtccctgggaccatgctccgctagttgtggcctggggaccgctcgccggagtgtcgcctgcgttcagttggatcagggacaggatgttgaggttgacgaggctgcctgtgcagcactggtgagaccggaagcgtcagtgccatgtttgatagccgactgcacatacaggtggcatgtgggcacctggatggagtgttccgtgagttgcggcgatggcatacaacggagacgcgacacttgtctagggccccaggcccaggcaccagtccctgctgatttctgccagcacctcccgaaaccagtgaccgtgagaggctgctgggccggtccgtgcgtgggccagggtaccccaagcctcgtcccccatgaagaagcagcagcccccggccgtactaccgcaacccctgccggagctagtttagaatggtcccaagccagaggactgctcttttccccagctccacagccaaggcggcttctccccggaccccaggaaaactccgttcagtcttctgcctgcggcaggcagcacctagagcctacggggacgatcgatatgcggggtcccggacaggccgactgtgctgtggcaattggaagaccactcggcgaagtagtcaccctccgagtacttgagagctcactgaactgctctgctggcgacatgcttctgctgtggggacgcctgacatggagaaagatgtgtcgaaagctgctggacatgacattctcttctaaaacaaacactctggttgtgagacaacgctgcgggaggcctggggggggggtcctcctgcgctatggttctcagctcgcccctgaaaccttttatagggaatgtgatatgcagcttttcggcccctggggtgaaatagtgagtccttccctatctccagctaccagcaacgccggtggctgccggctgtttataaacgtcgctccgcatgcaaggatagcaattcatgcccttgctactaatatgggcgctggaacagagggtgccaacgcttcttacattctcatacgcgacactcacagcctacggactaccgcgttccacggacagcaggtgctgtattgggagtctgagagcagtcaggccgagatggagttttccgaggggtttcttaaggcccaggccagtcttcgtggccaatactggactctccagtcgtgggtgccggaaatgcaagacccccaaagctggaagggcaaagaaggcacc

SEQ ID NO: 5692 - DNA, 4281 bp, Artificial Sequence
  Description of Artificial Sequence: Synthetic coding sequence
atgcaccagagacatccacgggcacgctgtcctcctctgtgtgtggcaggcattctggcttgcggctttctcctcggatgctggggaccgtcccactttcagcaatcgtgccttcaggccctggaaccacaggcggtgagcagctacctgtcgccgggagcacctctgaagggaaggccgccgtcgccagggttccagcggcaacgccagcgccagcgcagagccgcaggcggcatcctccacctcgaactcctcgtggccgtcggcccagatgtctttcaggcacaccaggaggacactgaacggtacgtcttgaccaacctgaacatcggagctgagctgctgagagatccatcactgggcgcgcagtttcgggtgcacctggtgaagatggtgatcctgactgaaccggaaggcgccccaaatatcaccgcaaatctcacgtcgtcgctgttgtccgtctgcggttggtcccagaccatcaaccctgaagatgataccgatccaggacatgctgacctcgtgctgtacatcactagattcgatttggagctcccggacggaaaccggcaggtccgcggcgtgacgcaactgggtggagcctgcagcccaacttggagttgccttatcaccgaggataccggttttgacctcggtgtgaccatcgcccatgaaatcggccacagcttcggcctggaacatgatggggccccggggtcaggctgcggaccgagcggacacgtcatggcatcagacggtgccgccccgcgcgctgggctcgcttggtccccctgcagccgccgccagctgctgagtctgctctccgctggacgggcaagatgtgtgtgggaccctccgcggccgcagccaggatcggcaggacacccgccagatgcccagccaggcctttactattctgccaacgaacaatgccgcgtggccttcggaccgaaagcggtggcctgtactttcgccagggagcacctcgacatgtgccaggcgctctcctgtcacactgacccactcgaccagtcgtcctgcagcagactgctggtcccgctgctcgatggtactgagtgcggtgtcgaaaagtggtgctcgaagggaaggtgccggtcattggtggagttgactcccattgcggcagtgcacggaaggtggtcgtcttggggcccccgctctccgtgttcccgctcgtgcggaggaggggtagtcaccagacgacggcagtgcaataacccgcgcccggcatttgggggacgggcctgcgttggtgcggatctgcaagccgagatgtgcaacactcaagcatgtgagaaaacgcagctggagttcatgtcccagcaatgcgcgcggactgatggacagccgctgcgctcgtccccaggaggtgcgtcgttctaccactggggggccgcggtgccccattcacagggggatgccctctgtcgccatatgtgccgcgcaattggagaatcattcatcatgaaaaggggtgattccttcctggacggaacccgctgcatgccgtccggacctagggaggacggaaccctctcgctgtgtgtgagcggaagctgtcgaaccttcgggtgtgacggtcggatggacagccaacaagtctgggaccgctgccaagtctgcggaggtgacaattcgacctgctcaccacgcaaaggctcgttcaccgcgggaagagcgcgggagtacgtgactttcctgaccgttactccaaatctgacttcagtctacatcgcgaatcacaggccgctgtttacccacctcgccgtcaggattggcggacgctacgtggtggcagggaagatgtccatttcaccgaacactacttacccttcactcctcgaggacggcagagtcgagtaccgggtggcgctcactgaagatcgcctgcctcggctggaggaaatacggatttggggtcccctgcaggaagatgctgatatccaagtgtaccgcaggtacggcgaagagtatggaaacctgacccgcccggatatcactttcacctactttcaacccaaaccacggcaggcgtgggtttgggcggccgtgcgcggaccgtgcagcgtctcctgcggagccggactgagatgggtgaattacagctgcctggaccaagcacgaaaagaactcgtggaaaccgtccaatgtcagggatctcaacagcccccagcatggcctgaggcctgcgtgctcgaaccgtgcccgccgtactgggctgtgggagacttcgggccgtgctcagcatcctgcggagggggactgcgggaacgcccagtccggtgtgtcgaggcccagggctctctgctcaagaccctgccgccggcccgctgcagagccggtgctcaacaacctgcggttgcgctggaaacgtgcaatccacagccctgccctgcaagatgggaggtgagcgagccctcgagctgcacctccgcaggcggcgcaggcctggccctggaaaacgagacttgtgtgccgggggccgatggtcttgaggctccagtcaccgaaggccccggaagcgtggacgaaaaactgcccgcgccggagccgtgcgtgggaatgtcctgcccgccgggatggggacacctggatgcaacctcagccggagagaaagcaccgtcgccatggggctcaatccggaccggggcgcaggcagctcacgtctggactccggccgccggtagctgctcggtgtcatgcggcaggggcctgatggagctgcggttcttgtgcatggattccgcgctgcgcgtgccggtgcaggaggaactctgcggcctggcctcgaagcccggaagtaggagggaggtgtgccaggccgtgccatgcccggcgcgctggcaatacaagctcgcggcatgctcagtgtcctgcggccggggggtggtccgccggatcctgtactgcgctagagcccacggggaggacgatggcgaagaaatcttgctggacactcagtgccagggactccccagaccggagccacaggaagcatgctctctggagccctgcccgccccgctggaaggtgatgtcactgggtccctgttccgcctcatgcgggttgggaactgcccggcggtcggtggcctgtgtgcagctggatcaaggccaggacgtcgaagtcgatgaggctgcgtgcgcagccctggtgcgcccagaggcctcagtcccatgcctgatcgcggactgcacttacagatggcacgtggggacgtggatggagtgctcggtgtcgtgcggagacgggatccagcgacggcgggacacgtgcttggggccgcaggcgcaggccccagtgccggctgatttctgccagcatctgccaaaacctgtgactgtcagaggatgttgggccggcccgtgtgtgggacagggtaccccttcccttgtccctcatgaagaagccgctgcaccgggacgcaccactgccaccccggcaggtgcatccctggaatggagccaagcccggggactgttgtttagccccgctccccaaccgcggcgcctgctgccgggcccgcaagaaaatagcgtgcagagcagcgcatgcggacgccagcatctcgaaccgaccggaaccatcgacatgcgcggtcctggacaagccgactgcgctgtggctatcggtcgccctttgggagaggtggtgactctgagggtgttggaatcgtcactgaactgctcggctggagacatgctcctgctgtgggggcgccttacctggcggaagatgtgccggaagctcctcgatatgaccttctccagcaagacgaacacccttgtggtgagacagcgctgcggcagaccgggaggtggagtgctgctgcgctacggatcgcagttggctcctgagacgttttatcgcgaatgcgacatgcagctttttggaccttggggagagatcgtgtcgccttctctgtcgccagcgacctcgaatgcgggcggatgtcggctgtttatcaatgtggccccacatgcgaggatcgcaatccacgccttggccactaatatgggagcgggaactgaaggggcgaacgcatcctacatcttgatccgggatacccactccctccgcactactgccttccatggccagcaagtcctgtactgggaatcggagtcaagccaagcggaaatggagttctcagagggtttcctcaaggctcaggcctcgctgcgcggacagtactggacccttcagtcgtgggtccccgaaatgcaggacccacagtcatggaagggaaaggaaggcacc

SEQ ID NO: 5693 - DNA, 4281 bp, Artificial Sequence
  Description of Artificial Sequence: Synthetic coding sequence
atgcatcaacgacatccaagagcgcggtgcccaccactttgcgtggccggaatacttgcctgtggatttctgctgggttgctggggaccttctcatttccaacaatcatgtctgcaggcactggaaccacaggccgtgtcctcatacctgagccctggagcgccactcaaagggcgaccaccttcgcctggatttcagaggcaacgtcaaagacagagacgggctgccggaggaattcttcatctggagctgctggtggcggtcggtcctgatgtgtttcaagcacaccaagaggataccgaacgctacgtccttactaacctgaacattggagcagaacttttgcgagatcctagcctcggagcgcagtttcgagtccatcttgtgaaaatggtcattcttaccgagccagaaggtgccccgaacataaccgctaacctgaccagctcactgctctctgtgtgtggatggtcgcaaactatcaaccctgaagatgataccgatcctggacatgcagatctggttctgtacataacgagatttgatctggagcttcctgatggtaacagacaagtccggggagtcacccagctgggcggtgcatgttcaccgacttggagctgcctgattaccgaggatactggctttgatctcggagtgaccattgcacacgagatcggacattcctttggcctggagcatgacggcgctcctggtagcggatgcggaccttcgggacatgtcatggcaagcgatggtgcggcaccaagggcaggacttgcctggagcccttgctcgagacggcaattgttgtcgctcctgtccgcaggccgcgcccgctgcgtgtgggatccaccgaggccgcaacctggaagtgctggccatccaccggatgcgcaaccaggtctgtactactccgctaacgagcaatgtagagtggcctttggccccaaggccgtcgcatgtacttttgccagagaacacctggatatgtgtcaagcgctctcgtgccataccgatccactggaccaatcgagctgctccagattgttggtgcccctgctggatggtactgaatgcggcgttgaaaagtggtgttcgaagggcagatgtcgttccttggtggagctcactccgatcgcggcggtgcatggacgttggtcatcttggggtccccggtcaccttgttccaggtcatgcggtggaggagttgttactcgcaggagacagtgcaacaaccctaggcctgcattcggtggtcgcgcatgcgtgggagcagacttgcaagccgagatgtgtaatacccaggcatgcgaaaagacccaactcgagtttatgtcccaacagtgtgcacggaccgacggccagcctcttaggagctcccctggaggggcctcattttaccactggggggccgcagtgccacatagtcagggagacgccctctgtaggcacatgtgtcgagcaataggagagtcctttatcatgaaaaggggagactcctttcttgatggaactaggtgcatgccctccgggcctcgagaagatggtaccctcagcttgtgtgtgtcgggatcgtgtcgtaccttcggatgtgatggaagaatggactcgcaacaggtctgggatagatgtcaggtctgcggaggcgacaactccacttgcagcccccggaaaggatcatttaccgcaggtagggcacgggaatacgtgacgtttctgaccgtcactccaaaccttactagcgtgtacatagccaatcaccggcctctgttcacgcaccttgctgtacgcatcggtggacgatacgtggtggcgggtaaaatgtccatatcgcctaataccacttatccttcccttctcgaggacggacgggtcgagtacagggtggcactgactgaagatagacttccaagacttgaggagatccgcatttggggaccacttcaggaagatgcagacattcaagtgtaccgtcggtacggtgaagaatacgggaatcttacgcgaccggatattacttttacctactttcaacccaagcctcgccaggcatgggtctgggcagcagtgcgcggtccgtgctccgtgtcatgtggagcagggcttcggtgggtgaattactcgtgtctggaccaggcacgaaaagaactggttgaaactgtgcagtgccaagggtcgcagcaacctccggcatggccagaggcatgcgtgctcgaaccctgtccaccttactgggcagtgggggacttcgggccttgttcggcatcttgcgggggcggtttgagagaacgccctgtgagatgtgtggaagctcaaggttcccttcttaagacgctccctcctgcaagatgcagagcaggtgcacaacaacccgcagttgcgctggaaacctgcaacccccaaccatgtcccgcgcgttgggaagtgtcagaaccctcatcctgtactagcgcgggtggagctggacttgcactggaaaacgaaacttgtgtgccaggagccgatggccttgaagcccccgtcacggaaggtccaggctcggtggatgaaaagctgcctgcacccgaaccttgcgtggggatgtcgtgtcctccaggttggggtcaccttgatgcaacttcggccggagaaaaagcacctagcccctgggggtccatcagaactggagctcaggcagcacacgtgtggactcccgccgcaggttcctgttcagtgagctgcggtcgaggcctcatggaactccgttttctgtgtatggacagcgcacttcgggtgccggtccaagaggagctttgcgggcttgcaagcaaaccaggctcgcggagagaagtgtgtcaggcggtgccttgtccagcccgctggcagtacaagctggcagcatgttcagtgtcgtgcggtagaggggtggtccggcggatcttgtactgtgcgagggcgcatggcgaagatgatggagaagaaatactccttgatactcaatgtcaaggactgcctagaccagagcctcaggaggcatgttcccttgaaccgtgcccaccccgttggaaagtgatgtccctgggaccatgtagcgcgagctgtggactcgggactgcccggcgtagcgtggcctgtgttcagcttgatcaaggacaggatgtggaggtggacgaggcagcctgtgcagcactggtgaggcctgaagcatcggtaccgtgcttgatcgcagattgcacctaccggtggcatgtgggaacctggatggaatgttccgtgtcctgcggtgacggaatccaaagacggcgcgatacttgcctgggacctcaggcccaagcccccgtgccagcagatttctgtcaacatctccctaagcctgtgactgttaggggatgctgggccggaccttgcgtcggccaaggtaccccatcactggtccctcatgaggaggcagcggcaccggggcggaccaccgcgacccctgccggagcgagccttgaatggtcacaagcgcgtggactgcttttttcgcctgccccacaaccgcggcggttgcttccaggtccacaggagaactcagtccaatcatcggcatgtggacgacaacatctggagcctaccggtaccattgatatgaggggacccggtcaggcggattgcgcagtggcaatcggacggcccctgggcgaggtggtgactctgagagtccttgagtcatctctgaactgttcggcaggcgatatgcttcttctctggggacgcctcacttggcggaaaatgtgcagaaaactccttgatatgactttttcgagcaagactaacaccctggtggtgcgccagcggtgcggacgaccaggtggaggtgttttgctcagatacggctcacaacttgcacctgaaactttttacagagagtgcgatatgcaactctttggcccttggggagaaattgtgagcccatcactgtcccctgcaacttccaatgcaggtggatgtagacttttcattaatgtcgcacctcacgcaaggatcgcaatacacgcgctggcaaccaacatgggtgccggaactgagggagccaatgcaagctacattctgattagagatactcactcgctccgtactacggccttccacggacagcaagtgctctactgggaatcggaaagcagccaagccgaaatggagttctccgaaggtttcctgaaggcacaggcatctcttcgcggacagtactggactctccaatcctgggtgccagaaatgcaggacccacagtcgtggaagggcaaggagggcact

SEQ ID NO: 5694 - DNA, 3306 bp, Artificial Sequence
  Description of Artificial Sequence: Synthetic coding sequence
atgttccagctgcctgtcaataaccttggcagcttgcggaaggcccggaaaacagtcaaaaagatcctgagtgacattggcctcgaatactgtaaggaacacatcgaggactttaagcagttcgaacccaacgacttctatttgaagaatacaacatgggaggacgtgggcctttgggatccctcccttacaaaaaatcaggattatcgtacaaaacccttctgttgtagtgcatgcccttttagtagtaagttcttttccgcatataagagccacttccgcaacgttcattccgaagacttcgagaaccgcatcctgctaaactgcccctactgtacctttaacgccgataaaaagacgctcgaaacccacattaaaatcttccatgcccccaacgcctccgctccgagttcctcactgagcacgttcaaagacaagaataaaaatgatggcctgaagcctaaacaggcagacagcgtggagcaggcggtctactactgtaaaaaatgcacttacagagatcccttatacgagattgtgaggaagcacatttatagagaacatttccagcatgtcgccgccccatacattgcgaaggcgggggagaagtcgctaaatggagccgtgcctctgggctccaacgcgcgggaagaaagcagtattcattgcaaaagatgtttatttatgcccaaatcttatgaagccctcgttcagcatgtgatcgaggaccatgaaaggattggttatcaggttactgccatgatagggcacacaaatgtggtcgtacctcggtcgaagcccttaatgttgattgcccccaagccacaggataaaaaaagcatggggctccctcctagaattggctccctggcctccgggaatgtgcgatctctgccctcccagcagatggtaaatcgcctatctatacctaagccaaacctgaatagcacgggagtaaatatgatgtcatcggtacacctccagcagaataactacggtgtaaaatctgtcggccagggatacagcgtcgggcagagtatgaggctcggactgggtggtaacgccccagtgtccattccccaacaatcccagtcagtgaagcagctcctcccctctggaaacggccggtcatatgggcttggctcggagcaacggtctcaggcccctgccagatattcccttcagtctgctaatgcgtcctcgctgagcagcggccagctcaagagcccctcactgtcccagtcacaggcctcacgggtactgggccagtcatccagcaagccagcggccgctgcgactggtcctccaccaggcaatacttccagcacgcagaaatggaagatttgtaccatctgcaacgagctattccccgaaaacgtctacagtgtgcactttgagaaggagcacaaagcagagaaagttccggccgttgccaactacattatgaagattcacaacttcaccagtaagtgcttatactgtaaccggtatctgcccactgacaccctactgaatcacatgctcatccatggactgtcttgtccctactgccgctccacctttaacgatgtggaaaaaatggcagcccatatgcgaatggtacacatcgatgaggagatgggacctaaaacagacagcacactctcctttgatctcactctgcaacaaggcagtcacaccaatatccatctactcgtcactacgtataacctccgggatgcaccagcggagtctgttgcataccacgctcaaaacaaccctcccgtgcctcctaaaccccagcctaaagtacaggagaaggccgatataccagtgaaaagctccccccaggcagccgtgccctacaagaaggacgttggcaagacactttgtcccttgtgtttctccattctaaagggtccaattagcgacgcccttgctcaccacctgcgagaaaggcatcaggtgatacagaccgttcaccccgtagagaagaagctgacatataaatgcattcactgccttggcgtctacaccagtaatatgaccgcaagcactatcacactccatctggtccactgccggggggtgggaaagactcagaacggtcaggacaagacgaatgccccttcgaggctcaaccagtccccctccttggccccagttaagcgcacttacgagcagatggagtttcccttgctcaagaagcgcaaactcgacgatgattccgattctccatcgttcttcgaggagaaaccagaggagcctgtggtcctggcacttgatcctaaggggcatgaagatgattcctatgaggcacggaagtctttcctaaccaaatatttcaataaacagccctatccaactcgacgcgagatcgagaagctcgctgccagcctttggttgtggaaatctgatatcgcaagccatttcagtaacaaacgtaaaaaatgcgtccgagattgcgaaaaatacaaaccaggtgtgctgttgggattcaatatgaaggagctcaacaaggtcaagcacgaaatggactttgacgccgagtggctgtttgagaaccacgacgagaaggactctcgggttaacgcatccaagaccgcggataagaagctaaatctgggcaaagaagatgactcatcgtcggattcctttgaaaacctagaagaggagagtaacgaaagcggttcccctttcgatccagtcttcgaagtcgaacccaaaatcagcaacgataaccctgaggaacacgttttaaaggtcatcccggaagacgctagtgaatctgaagaaaagctggaccagaaagaggacggttcgaagtacgaaaccatccatctcactgaagaacccaccaaactgatgcataatgctagcgactctgaggtggatcaggacgacgttgtagaatggaaggacggggcttcccctagcgaatctggtcctgggtcccagcaggtgtctgacttcgaagataacacatgcgagatgaagcccggcacatggtccgacgaatcaagccagagtgaagatgcaaggtcgagcaagccggccgccaagaaaaaagccactatgcaaggggacagagagcagttaaaatggaagaacagtagctatggcaaagttgagggtttttggagcaaggaccaatcacagtggaagaatgcaagcgaaaacgacgagaggctgagtaatccacagatcgagtggcagaattccaccatcgattctgaagatggagagcagttcgacaacatgacagatggagttgccgagcctatgcacgggagcttggccggggtcaagttaagctcacaacaggca

SEQ ID NO: 5695 - DNA, 3306 bp, Artificial Sequence
  Description of Artificial Sequence: Synthetic coding sequence
atgtttcaattaccagtgaacaatttgggatctctccggaaggcaagaaaaactgtaaaaaaaattctctccgatataggattggaatattgtaaggagcatatagaagatttcaagcaatttgagccaaatgatttttatttgaagaacacaacttgggaggacgtgggactgtgggatccctctttgacaaaaaatcaagattaccgtactaagcccttttgctgttcagcgtgcccattttcatcaaagtttttctctgcatataagtcacactttagaaatgtgcatagtgaggattttgaaaatcgcatattgctcaattgtccgtattgcactttcaatgctgacaaaaagactttggaaacacatattaaaatttttcatgctcctaacgcgtctgctccatcatcatcgctctcaactttcaaggataaaaataagaatgacggtctcaagcccaaacaagcagatagtgtcgagcaggccgtatactattgcaaaaagtgtacttacagagacccactttacgaaattgtgcgtaaacacatttaccgtgagcatttccaacatgttgctgctccgtacattgccaaagccggagagaaatcactcaatggagcggttccactaggctctaatgcacgggaggaatccagtatccactgtaaacgctgtttatttatgccaaagtcgtacgaagcccttgtgcaacatgtaatcgaagatcatgaacgcattgggtatcaagttaccgctatgattggacacacgaacgtagtcgtccctcgttcgaaaccgctcatgctgattgccccgaagcctcaggataaaaaatctatgggtttgccacctcgcataggatctttggccagtggaaatgtgcgttcgctaccatcacaacaaatggtcaaccgcctgtcgattccaaaaccaaatctaaactcgactggagtcaatatgatgtcgtcagtacacctccaacaaaataactacggggttaagtccgtcggacagggatattcggtcggacaaagcatgcgacttggacttggaggcaatgctccggtgtctattccacaacagtcccaatctgttaaacaactcctaccatcgggtaatggtcgttcttatggattaggttcagagcagcgtagtcaggctccagctagatattccctacaatctgctaatgcatccagtttgagttccgggcaactgaagagcccttcgctgtctcagtcacaagcatcgagagttctcggacaatcatccagtaaaccggcggcagcagctacgggaccaccaccaggaaatacatcgagcacacaaaagtggaaaatttgcacaatttgtaatgagttgtttccggagaatgtatactctgtgcatttcgaaaaagaacataaagctgagaaagtaccagccgttgcaaactacataatgaaaattcataatttcacctcgaagtgcttatactgcaatagatacttacctacggataccttattaaaccatatgcttattcatggtctttcttgcccatattgtcgtagtactttcaacgatgttgaaaagatggctgcacacatgaggatggttcacatcgatgaggaaatgggccctaagaccgattcgacacttagctttgatctgacacttcaacaaggctcacatacgaatatccacctccttgtgacaacttataatctaagagatgcacctgctgaatctgtggcttaccatgctcagaataatccaccagttccgcccaaacctcagcctaaggttcaagaaaaggctgacatcccggtcaaatcatcgcctcaggctgctgttccttataagaaggatgtgggtaagactttgtgcccactttgtttctctattttaaaaggaccaatctcagacgctctggcacatcatcttcgagagagacaccaagtgatccagacagtgcatcccgtcgagaaaaagctgacatacaagtgtattcactgccttggagtttacactagtaatatgactgcatctactataacgctccatctggtccattgtcgcggagtcggtaagactcaaaatggtcaggataaaaccaatgcgccaagccgcttaaaccaatcaccgtcgttggcaccagtcaagcgcacttatgaacagatggagtttccattgcttaaaaagcgtaaacttgatgatgattctgattctccatcgtttttcgaggagaagccggaagagccagttgtgttggcccttgatccgaagggacatgaggacgattcgtatgaggctagaaaatcgtttctaacaaagtactttaataaacaaccatacccaacccgaagggaaatagaaaaacttgcagcttcattgtggctttggaagagtgatattgcgtctcatttttccaacaaacggaagaaatgcgtaagagactgtgaaaagtacaagccgggagtactcctcggatttaacatgaaagaacttaacaaggtaaaacatgaaatggatttcgatgcagaatggttatttgaaaaccatgacgaaaaagattcgagagttaatgcaagtaaaacagctgataagaagcttaacctcggaaaggaagatgattcttcctcagatagcttcgagaacctggaagaagaaagtaatgaaagtggttctccgtttgacccagtgtttgaagttgagccaaagatctcgaatgacaaccctgaggaacatgtgctcaaggtgatcccagaggacgcttcggaatccgaagagaagctagatcaaaaagaggacggaagtaagtacgagacaattcatcttacggaagaaccgacaaaattaatgcacaatgcgtcagattctgaggtcgatcaagatgatgttgtcgaatggaaggatggagcgtccccatctgaatcaggaccagggagccagcaggtatcggattttgaggacaatacgtgcgagatgaagccagggacgtggtccgatgagtcatcacagagtgaagatgctcgttcaagcaagccagcagcaaaaaagaaagcgactatgcaaggagatcgtgaacaattgaaatggaaaaattcttcttacggaaaagttgaaggattctggtcaaaggatcaatcacaatggaagaatgcatcagaaaatgatgagcgtctttcaaatcctcaaattgaatggcaaaactcaacaattgatagcgaagatggggagcagttcgataatatgactgatggtgtcgcagagccaatgcatggatctcttgcaggtgtaaaattgtcttctcaacaggct

SEQ ID NO: 5696 - DNA, 3306 bp, Artificial Sequence
  Description of Artificial Sequence: Synthetic coding sequence
atgtttcagttgcctgttaataatctcggtagcctccgcaaagctcgaaaaactgttaagaagatcctgagtgacattggactggagtactgtaaggagcacatcgaggacttcaaacagttcgaaccgaacgatttttatttgaagaacacgacgtgggaagacgttggcctgtgggaccccagcctgacaaaaaaccaggactacagaaccaagccattctgttgctccgcttgtcctttcagcagtaagtttttctccgcttacaagagccatttccggaatgtacattctgaggacttcgagaatcggatcctcttaaattgcccctactgtacattcaacgccgacaagaagaccctagagacccatatcaaaattttccatgcccctaacgcctccgccccttctagtagtctgagcacatttaaagataagaacaagaacgacgggctgaagccaaaacaggccgacagcgtggagcaagcagtctactactgcaaaaagtgtacatacagggacccattatacgagatagtgcgcaaacacatttatagagagcacttccagcatgtggccgccccatatatcgcaaaggccggcgagaagagccttaacggagcggtgcctttagggagtaacgcaagagaagaatcctctatccactgtaaacgttgcctgtttatgccgaaatcttatgaagcattggtacagcatgtcatagaggatcatgaacggattggataccaggtcacggcgatgattggccacactaatgtggtagtcccccgatccaaaccactgatgctcatcgctccaaagccccaagataagaagagcatggggctgccccctcggattggcagtttggccagcgggaacgtcaggtctctgcctagtcaacagatggtcaatcgcctaagcatccccaaacctaacctgaatagcacaggggtgaatatgatgtccagtgtgcatctgcagcagaataattacggagttaaatctgttggacagggatattcagtcggacagagcatgaggctgggcctcggcggcaatgcgccagtgtcgatcccccaacagtctcagtcagtcaaacagctgttgccgagcgggaacggaaggagttatggcctgggcagcgagcaaaggtcacaagctccagccaggtactccctgcagtctgccaatgcttctagcttgagtagcggccagctaaaatcgccaagtctgagccagagccaagctagtagggtcctcggacaaagtagctctaagccggccgccgcagctacaggccctcccccgggcaatacatccagcacccagaagtggaagatctgtaccatatgtaacgagcttttcccagagaatgtctacagcgtgcattttgaaaaagagcacaaggccgaaaaggtgcctgccgtggcaaactacataatgaagatacataatttcacttctaagtgcctttactgtaacagatatttgccgaccgataccctgttaaatcacatgttgattcacggcctcagctgcccttattgtagatctaccttcaatgatgttgaaaagatggctgcacatatgcggatggtgcacatcgacgaggagatgggccctaaaacagactccacgctgagcttcgaccttactcttcagcaaggaagccacactaatattcatctgcttgttactacctataacctgagagatgctcccgccgagtccgtagcctaccacgcccagaacaaccctcctgttccccccaaaccgcagccaaaggtgcaggagaaggccgatattccagtaaagagcagcccccaggcggcggttccctacaagaaagatgtcggcaagaccctgtgccccttgtgcttctctatcttgaaaggtcccatctctgatgccctggcccatcacctcagagaacgccatcaggttattcaaacggtgcaccctgtagaaaagaagctgacatacaagtgcattcattgcttgggtgtgtacacttctaatatgaccgcgagcacaataaccctgcatttggtacattgtcgaggcgttgggaaaacacagaatggtcaggacaaaaccaacgccccttctagattaaaccagtcaccttctcttgcccccgtgaaacgcacctatgagcaaatggagtttcccctgcttaagaaacgcaagctggacgacgacagtgattctccatcattctttgaggagaagcccgaggagcctgtggtcctggctctcgatccgaagggccacgaggatgactcctacgaggcgcgcaaatcttttctcaccaaatattttaacaagcagccgtaccctactcgcagagagatcgaaaagctcgcagcaagcctgtggctctggaagtctgacattgcaagccactttagtaacaaacgcaaaaagtgcgtgagagattgtgagaagtacaagcccggggtcttgctggggttcaatatgaaggaactaaacaaagtgaaacacgaaatggacttcgatgccgaatggctgttcgagaaccatgacgagaaagacagccgagtgaacgcttccaagactgcagacaaaaaactaaacttgggaaaggaggatgatagttccagcgattctttcgaaaatttagaggaggaatcaaatgagagtgggtcgccgttcgaccctgtgttcgaagtagaacctaaaatctcaaatgataaccctgaagagcacgtcctgaaagtcattcctgaagatgcgtccgagagcgaggaaaaactggaccagaaggaagacggaagtaagtatgagacaatccatctaacagaagaaccaaccaaactgatgcataacgccagcgattctgaggtcgaccaggatgacgtggtggagtggaaagacggagcatctccttccgaatcaggtccaggctcacaacaggtgagcgactttgaggataatacgtgcgaaatgaaacctgggacgtggagtgacgagtcctcacagagcgaagatgctaggagctcaaaacctgctgctaaaaaaaaggccactatgcagggcgatcgcgaacagttgaaatggaagaattcttcttatggaaaggttgaggggttttggtccaaagaccagagccaatggaagaacgcctctgaaaacgacgagcgactttctaatccacagattgaatggcagaacagcaccatcgactctgaggatggtgaacagtttgacaacatgactgatggggtcgcagagcctatgcatggatcgctcgctggcgtcaaattgagctcacagcaggct

SEQ ID NO: 5697 - DNA, 3306 bp, Artificial Sequence
  Description of Artificial Sequence: Synthetic coding sequence
atgtttcaactgcccgtgaacaaccttggctccctacgcaaagctcgtaagacggtgaagaagatcctgagcgacattggccttgaatattgcaaagagcatatagaggattttaagcaattcgaacccaacgatttctacctgaagaatacaacctgggaagacgttggtttgtgggacccctcgctgacgaagaatcaagactatcgaacaaagccgttttgctgtagcgcttgccccttctcatccaagttttttagcgcctacaagtcccatttccgaaatgttcactcggaagatttcgagaaccgtatactgctgaattgcccgtattgtacattcaatgccgataagaaaacactggaaacgcatatcaagatattccacgcacccaatgcgagcgccccatcttcttcgctgagcaccttcaaagacaaaaacaagaacgacggtttgaaaccgaaacaggccgactcagttgagcaggccgtgtattactgtaagaagtgtacataccgcgatcctctttacgagatcgtccgcaagcatatctacagggaacactttcagcatgttgccgcaccgtacatcgcgaaggctggcgagaagtcactcaatggcgccgtgccgctcggctcgaacgcacgggaggagagtagcatacactgcaagcgttgcttgtttatgccgaagagctatgaagcactcgtgcagcacgtgattgaggatcatgaacgtataggttatcaggtcaccgcgatgattggacacacgaacgtggttgttccgcgctcgaagccgctgatgctaatcgcgcccaagccgcaggataagaagagtatgggcctaccgccccggatcgggagcttagcatcgggaaacgtaaggtctctgccctcccaacagatggtgaaccgtctgagcattcccaaacccaatctaaactcaaccggcgtgaatatgatgagttcggtgcaccttcaacagaataactacggcgtgaagtccgtgggccaggggtacagtgtgggtcagtcaatgcgcctgggtttaggcggcaatgcgccagtgagtattccccagcagtcgcagagtgttaagcaactgcttccaagcggtaacggacggtcctatggtctcggatccgagcagcgctcgcaggcgcctgcaagatactcgctgcagtcagcaaacgccagttccttgtcctcgggccagctgaagtctccctcattgtcgcagtcccaggcctcgcgagtgcttggccaatcttcaagcaagccagccgccgctgccactggacccccgcctggcaacacctcgtccacccagaaatggaagatatgcacaatttgtaacgaattgttccccgaaaatgtttacagcgtgcatttcgaaaaggagcataaggccgagaaggttcccgctgtggcaaactacataatgaagatacacaacttcacgtctaaatgcttgtattgcaacaggtacttacctaccgacacgctgctgaatcacatgctgatccacggtctaagttgcccctattgccggagtacgttcaacgatgttgaaaagatggcagcccacatgcgtatggtgcacatcgatgaggaaatgggcccgaagacggacagcactttgtccttcgacttgaccctgcaacagggcagccacactaacatacacctgctggttaccacctataacctgcgagatgctccagcggaatccgtcgcctaccatgcgcagaataacccgccggttccacccaaaccccagccaaaggtccaagaaaaggcagatatccccgtcaaaagttctccgcaggccgccgtgccctataagaaggacgttgggaaaaccctttgtcccctgtgcttctcgatattgaagggaccaatctccgacgccttggcgcaccacctgcgcgagcggcaccaagtgattcagaccgtgcatccggtggagaaaaaactgacctacaagtgtattcactgcctgggcgtgtacacatctaacatgacggcatcgacgatcacgctgcatctggtacactgccgaggagtgggcaagactcagaatggacaggacaagacgaacgccccctctcgcttaaatcagagcccaagtttagccccggtgaaacgcacctacgagcagatggaattcccgttgttgaagaagcgtaagctcgatgacgactcagacagcccatccttctttgaggagaagcccgaggagcccgtggtgctggccctcgatccaaaaggtcacgaagacgatagttatgaggcaagaaagtccttcctgacgaagtactttaataaacagccgtacccaacgagaagggagatagagaaactcgccgcctctctgtggctctggaagagcgacatcgcctctcattttagcaacaaacgtaagaagtgcgtgcgcgattgtgaaaaatacaagcccggcgtgttgctgggtttcaatatgaaggaactgaacaaagtcaagcatgaaatggatttcgatgccgagtggctattcgaaaatcacgacgagaaggacagcagggtcaacgcaagcaagactgctgacaagaagctcaatctgggcaaggaagatgacagttccagcgactctttcgagaatctcgaggaggagagcaacgagagcggaagtccctttgatcctgtgtttgaggttgaaccgaagatctcgaatgataacccggaggagcacgtgctgaaggtgatacccgaggacgcgtcggaaagcgaggagaagctcgatcaaaaagaagacggcagcaagtatgagaccatccatttgacggaggagccaacgaagttgatgcataatgcttcagacagtgaggtggatcaggatgacgttgtggagtggaaagatggtgcctccccctctgagtccggccccggctcccaacaggtgtccgatttcgaggacaacacgtgcgagatgaagccaggcacctggagcgacgaatcgtcgcagagcgaagacgcccgttctagcaaaccggctgccaagaagaaggcgaccatgcaaggagaccgcgagcagctgaagtggaagaacagttcttacggaaaggtggaaggcttctggtctaaggaccaatctcaatggaagaacgccagtgagaatgacgagcgtttatctaacccccaaatagaatggcaaaattcgactatcgacagcgaggatggggagcaattcgacaatatgaccgacggtgtcgctgagcccatgcatggatccctggccggcgtgaagctgtcatcccagcaggct

SEQ ID NO: 5698 - DNA, 3306 bp, Artificial Sequence
  Description of Artificial Sequence: Synthetic coding sequence
atgtttcagctccccgtcaataaccttggcagccttaggaaggctaggaagaccgtgaaaaagatcttgagcgatatagggctggaatattgcaaagagcatattgaagattttaaacagttcgaacctaacgatttttatttgaaaaatacaacatgggaagatgtcgggttgtgggacccttccttgacaaaaaatcaggattaccggactaagcctttctgttgttctgcctgtccattcagcagtaagtttttttctgcctataaatcccacttcaggaatgtgcacagcgaggatttcgaaaaccgaattctgttgaactgtccttattgcacctttaacgcggacaaaaagactctggagacacacatcaagatctttcacgctcctaacgcttctgcccctagcagcagtctaagcacattcaaagacaagaataagaacgatggattaaaacccaaacaggcagacagcgtggaacaggctgtttactattgtaagaaatgtacttatcgggacccattgtatgaaattgtccgaaagcacatctacagagagcatttccagcacgtagccgctccatacatagccaaggcaggagagaagtcacttaatggcgccgtgccgctgggctctaacgcacgtgaggaaagtagtattcattgtaagaggtgcttatttatgccaaaaagttacgaagcgttggtgcaacacgttattgaagatcacgagaggatcggctatcaagttactgcaatgataggccacactaatgttgtggtccctaggagcaagccgctgatgctcatagcccccaagccgcaggacaagaagtccatgggcctccctcctcgaatcgggtctctggcgtcaggcaatgtccggtcactgccaagtcagcagatggtgaatagactgtccattcctaaaccaaacctgaattcgacaggggtgaatatgatgtctagtgtgcatttacagcaaaacaattacggtgtgaagtccgtgggacagggctactccgtagggcagagcatgagacttgggttgggcggcaacgccccagtgagtattccgcaacagtcccagtcggtcaaacagttacttccctctggcaatgggcgttcctacggtttaggttcagaacagaggtcccaggcccctgccaggtactctctgcagtctgccaatgcctcctcactgtcttccggccaactcaagtccccatctctctcacagtcccaggccagcagagtgctggggcagagtagttctaagcctgctgctgccgccactgggcctcctccagggaataccagcagcactcagaagtggaagatttgcactatctgtaatgaactgttccctgagaacgtgtattccgttcacttcgagaaggaacataaagccgaaaaagtccctgctgtcgctaactatataatgaaaatccacaacttcacttcaaagtgcctgtactgtaacaggtacttaccaacggatacacttctgaaccatatgcttatccatggcctgtcttgcccctactgccgctcgacttttaatgatgtggaaaaaatggccgcccacatgcgaatggtccatattgatgaggagatgggaccgaagacagattccacactctcgttcgacctgactctgcagcaggggagccatacaaacattcatctcttggtgaccacatacaacctcagggacgctccagccgaatctgtggcataccacgcccagaataacccacctgtccctcccaagccccagccgaaggtccaggagaaggctgacattcctgttaagagttcaccccaagccgcagtgccgtacaagaaggatgttggcaaaacactgtgtcccctctgtttctctattttaaaaggaccaattagcgatgccttagctcaccatctgcgagaacggcatcaggttatccagacagtgcaccccgtcgagaagaaactgacctacaagtgtattcattgcctgggagtgtatacttcaaatatgacagcgtccaccataactctccatctggtacactgcaggggcgttgggaagactcaaaatggtcaagacaagaccaatgcaccaagcagactcaatcagtccccttcattagctcctgtgaagcgtacctatgaacagatggaatttccccttctgaagaagcgaaaactggatgacgactcagactccccaagtttctttgaggagaagccggaagagccagtagttttagctctcgacccgaagggacacgaagacgacagctatgaagcccgaaagtccttcctgaccaaatacttcaataaacagccatatcccacaagacgggagattgagaaattggctgccagcctgtggctgtggaaatctgatatcgcctcccatttctccaataaaaggaagaagtgtgtgcgagactgcgagaaatacaaaccaggcgtcctgctgggcttcaacatgaaagagctaaacaaagttaaacacgaaatggatttcgatgccgaatggctgttcgaaaatcatgatgagaaagacagtagagtgaatgctagcaagaccgcggataagaaactcaatctgggcaaggaggatgacagctcttccgattcatttgaaaacttagaggaagaaagtaatgagtccgggagtcccttcgaccccgttttcgaagtcgaacccaagatcagtaatgacaatccagaagagcacgttttgaaggtgatacccgaagatgcctctgagagcgaagaaaagttggatcaaaaagaagatggttccaaatatgagaccattcacttgaccgaggagcccactaaactgatgcacaatgcctctgatagcgaggtagaccaggatgatgtggttgaatggaaagatggggctagtcccagcgaaagcgggccgggatctcagcaagtatcagattttgaagacaacacgtgcgaaatgaagcccggcacgtggagcgacgaatctagccagagcgaagacgccagatcaagcaagccggccgcaaaaaagaaagctaccatgcagggtgatcgagagcaacttaaatggaagaatagcagctacggtaaggtggaaggcttctggagcaaagaccagagtcaatggaaaaacgcctccgaaaacgatgaacgtttgagcaacccacagattgaatggcagaattctaccattgactccgaggatggggaacagttcgacaatatgacggatggtgtggccgaacctatgcatggttcgttagccggagtgaaactgtcgtctcaacaggcc

SEQ ID NO: 5699 - DNA, 3306 bp, Artificial Sequence
  Description of Artificial Sequence: Synthetic coding sequence
atgttccaacttccagtgaacaatttgggctccctccgcaaggccagaaagacggtgaagaagatcctgagcgatattggcctggagtactgcaaggaacacattgaggatttcaaacaatttgaacccaacgatttctacctcaagaacactacttgggaagatgtgggactgtgggacccctcccttactaaaaaccaggattatcggactaagcctttttgttgttccgcgtgtccattctcgtcgaaattcttttcggcctacaaatcacacttccgcaatgtccactctgaagatttcgagaaccgtattctgcttaattgtccctactgtacctttaatgccgataagaaaactctcgagacgcacattaagatctttcacgcaccaaacgcatcggcaccgtcgtcgagcctgagcacctttaaggacaaaaacaagaatgacggactgaagcccaaacaagcagattcagtcgaacaggcggtttactactgtaagaaatgcacctaccgggatcccctttacgagattgtccggaagcacatttacagagaacactttcaacacgtggcggccccatacattgcaaaagcaggagaaaaatccctcaatggtgccgtgccccttggatcaaacgcacgagaggagtcctcaattcattgcaagcggtgtctgtttatgcccaagtcgtacgaggcccttgtgcaacatgtgatcgaagatcacgagagaatcggctaccaggtgaccgcaatgatcggacacaccaatgtggtggtgccccggagcaagccattgatgcttattgcacctaagcctcaagacaagaaatcgatggggcttccacctaggatcggctccctggcaagcggaaacgtgagatcgttgccatcgcagcaaatggtcaatcgcctgtccattcctaagcctaatctgaactcaacgggtgtcaacatgatgtccagcgtgcatcttcagcaaaacaactacggtgtcaagtccgtgggacagggttactctgtgggccaatcgatgagactggggcttggcggaaacgcaccagtctccatccctcagcagagccagtccgtcaagcaactgctcccaagtggtaacggacgctcatacggacttggttcggaacaaagatcgcaagccccagcaaggtactcacttcaatcggcaaacgcctcctcgctgagcagcggccaacttaaatcgcctagccttagccagtcacaggcatcaagagtgcttggacagtcctcctcaaagcccgccgcggcagcgactggtcctccccccggcaacacctcgagcacccaaaaatggaagatctgtactatctgtaacgagctgtttcctgaaaacgtctactcggtgcactttgaaaaggagcataaggccgaaaaggtgccagcagtggcgaattacatcatgaagattcataactttacctccaagtgcctctactgcaacaggtacctgcccaccgatacgctgctcaatcatatgttgatacacgggctttcgtgtccatactgccgatccacgtttaacgatgtggagaagatggcagcacatatgaggatggtccacatagacgaagagatgggccctaagaccgattcgacgctttcattcgacctgactctgcaacaaggatcccatactaacatccacctgcttgtcaccacttacaatctccgagatgctcccgcggaatccgtggcataccatgcacaaaacaaccctcctgtgcctccgaagccgcaacctaaggtgcaggaaaaggcagatatccctgtcaaaagctcgccacaagcggccgtcccttacaagaaggacgtgggcaagaccctctgtcctctgtgtttttcaattcttaaaggccctatttccgatgcattggcacatcacttgagagaacgtcaccaagtgattcagactgtccatccagtcgagaagaaactgacctacaagtgcattcattgtcttggtgtgtacacttcgaatatgactgcatccacgatcacccttcaccttgtgcattgtcgaggagtgggtaagacccaaaatggccaggacaaaaccaacgcgcctagcagacttaaccagtccccctcgctcgcgcccgtcaagcggacgtacgagcaaatggaatttccgctgctgaaaaagagaaagctcgacgatgattccgactccccttcgttcttcgaagagaagccagaggagccggtggttctggccctggatcctaaggggcatgaggatgatagctacgaagcgcgcaagtccttccttacgaagtacttcaataagcagccctaccccaccaggcgcgagatcgaaaaactggccgcatcactgtggctgtggaagtcggacattgcttcacatttctcaaacaagagaaagaagtgcgtgagagattgtgagaagtacaagcctggagtgctgctgggatttaacatgaaggaacttaacaaagtcaaacatgaaatggatttcgatgcagaatggctttttgaaaaccacgatgagaaggatagcagggtgaacgcgtccaagactgcagacaagaaacttaatctcggaaaggaggatgattcttcctcggattcctttgaaaacctggaggaggagtcgaacgagagcggatcccctttcgatccagtctttgaagtggagcctaagatatccaatgacaatcctgaggaacatgtccttaaagtgatccctgaagatgccagcgagtccgaggaaaaacttgaccaaaaggaagatgggagcaagtacgagactatccatctgaccgaggaaccaactaaactgatgcataacgcaagcgacagcgaagtggatcaagacgatgtcgtggagtggaaagacggtgcaagccctagcgaatccggacccggatcacagcaagtgtcagattttgaggacaatacttgcgagatgaaacccgggacttggtccgacgagtcctcgcagtcggaggatgcacgatcatccaagcctgcagccaagaagaaagcaaccatgcaaggagatagagaacaactgaagtggaaaaacagctcgtacggcaaggtcgagggcttttggtccaaggatcagtcgcagtggaagaacgcatccgagaatgacgagagacttagcaacccgcaaattgaatggcagaactctactatcgattcagaagatggagaacaatttgacaatatgaccgatggagtggctgagccaatgcatggttccctcgcaggagtcaaactttcatcacaacaggcc

SEQ ID NO: 5700 - DNA, 3306 bp, Artificial Sequence
  Description of Artificial Sequence: Synthetic coding sequence
atgtttcagctcccagttaacaacctcggttctctgcgaaaggcccgaaaaacagtgaagaaaattctctctgacattggactggaatactgtaaggaacatattgaggacttcaaacagtttgagcccaatgatttctatctgaagaacactacgtgggaagacgttggactctgggacccctccttgacgaaaaaccaggactacaggacaaagcccttctgctgcagtgcttgcccctttagcagcaaatttttctcagcatacaaaagtcacttccggaacgtacactctgaagactttgaaaaccgcatcctgctgaattgtccatattgtaccttcaatgccgacaagaaaactctggagacccacataaaaattttccatgcccccaacgcctccgctccatcatccagcctgtcaactttcaaagataagaacaagaacgacggacttaagccaaagcaggccgattctgtggagcaagctgtatattactgtaagaagtgcacatatagagacccattgtacgagatcgtcagaaagcacatataccgggaacatttccaacatgtggcggctccttacattgccaaagccggcgaaaagagccttaacggggccgtacctctggggagtaacgcacgcgaggagtcttctattcactgcaaacggtgtctgttcatgcccaagtcttacgaagctctggtacaacatgttatcgaagatcatgagcgaatcggataccaggtgacagccatgatcggacacacgaacgttgtggtcccaagaagcaagcccctgatgctgatcgctcctaagccccaggacaaaaagtccatgggactgccaccgcgaatagggagtctcgctagcggtaacgtccgctcacttcccagtcagcaaatggtcaaccggctgtctattcctaagcctaatctcaatagcaccggcgtgaatatgatgtcttcagtgcacctgcagcagaataattacggtgtgaagtctgtgggtcagggttacagtgtcgggcaatccatgcgactgggtcttggcgggaacgctcccgtatcaattccccagcaatcccagtctgttaagcaactcttgccatccggcaatggacggtcctacggactgggatcagagcagaggtcacaggccccagccagatactcccttcaatccgcaaacgccagctcactttccagcggtcagcttaaatccccctctcttagtcagagccaggcaagccgagtcctgggtcagtcttcctcaaaacctgctgcagccgctaccgggccaccccctggtaacacttccagtacgcagaagtggaagatctgcaccatatgtaacgagcttttccctgaaaacgtttattcagtccactttgagaaggagcataaggcggagaaggtgccagcagtagccaattatatcatgaagatacacaacttcaccagcaagtgtctttactgcaatagatacctgccgaccgacactctgctgaatcatatgctgattcatggactctcatgcccctactgtcgctccaccttcaatgacgtggagaagatggcagctcatatgcggatggtgcacatcgatgaagaaatgggcccaaaaaccgatagcacactgtcttttgatctgaccctgcagcaaggctcccacacgaatatccatctgctcgtaactacatacaatctgcgcgatgctcctgctgaaagcgtcgcataccacgcccagaataatcctccagttcccccgaagccacagcccaaggtacaggagaaagccgacattccggtgaagagctctccacaggctgcggtgccctataaaaaggacgtggggaagaccctgtgtccgttgtgcttcagcatccttaagggcccaatctccgacgccctggcccatcaccttcgcgagcggcaccaggtaatccaaacagtccatcccgtcgagaagaagttgacgtacaagtgtatacactgcctgggcgtatacacctctaacatgaccgcgtctacaatcaccctgcacttggttcactgcagaggtgttggcaagacccaaaacgggcaggataagactaatgcgccgagtaggctgaatcagagccctagcctggcaccagtgaagcgcacttatgaacaaatggagttcccactcctcaaaaagagaaagctggacgacgatagcgattctccatcctttttcgaagagaagcctgaagagccagtcgtcctcgctctggacccaaagggacatgaggatgatagctatgaagcgcgcaagagttttctcactaaatattttaataaacagccttaccccacaaggagagagatcgaaaagctcgctgcttctttgtggctttggaagagcgatattgcgtctcacttcagcaacaagcgcaagaaatgtgttcgggactgcgagaagtataaaccaggagtgctcctggggttcaatatgaaggagctcaataaggtgaagcatgaaatggatttcgatgccgagtggctgttcgaaaaccatgacgagaaggactcaagagtcaatgcaagcaaaacagctgataagaagctgaacctgggaaaagaagacgacagctcctcagactcattcgagaacctggaagaggagtctaacgagagcgggagtccctttgatccagtgtttgaggtcgaaccaaagatcagcaacgacaaccccgaggagcatgtcctgaaggtgatccccgaggatgcctccgaaagtgaggagaagcttgaccagaaagaggacggctctaagtacgagacaatacacctgaccgaggagccaacgaagctgatgcacaacgcatccgatagtgaggtcgaccaggacgacgtcgttgagtggaaggacggcgcaagcccaagtgagtctggccctggcagccaacaagtttcagactttgaggataatacctgcgaaatgaaaccaggcacctggtctgatgaatcttcccagtccgaagatgcccggagcagcaagcccgccgcaaagaagaaagccactatgcagggcgatagggaacagctgaaatggaagaatagcagctatgggaaagtggagggcttctggagtaaagatcaaagccaatggaaaaacgcctccgagaacgacgaacgcctgtctaatcctcagattgaatggcagaacagtaccatcgactcagaagacggtgaacaattcgacaatatgacagatggcgtagcagagccaatgcacggctccctggccggtgtgaagctgagcagccagcaggcg

SEQ ID NO: 5701 - DNA, 3306 bp, Artificial Sequence
  Description of Artificial Sequence: Synthetic coding sequence
atgtttcaattgcctgtgaacaatctgggctccctcagaaaggcaaggaaaactgtgaagaaaatactaagtgacattggactggagtattgtaaggaacatatcgaggattttaaacaatttgagccaaacgatttttatctcaaaaacaccacctgggaggacgtcggactatgggacccctcactgactaagaaccaggattatcgtactaagccgttctgctgctccgcctgccctttctcatctaagttcttcagcgcctataagtcccacttcaggaatgtgcatagcgaggattttgaaaatagaattcttctgaactgcccttattgcacattcaacgccgataaaaaaacactggaaacacatatcaagattttccatgcccccaatgccagcgccccctcttcctctctgagcacattcaaggataagaacaagaatgacggccttaagcctaaacaggccgactccgtggagcaagctgtgtactattgtaaaaagtgtacttatcgcgaccctctctacgagatcgtgagaaagcacatataccgggagcactttcagcacgtcgccgctccctacatcgccaaggcgggagaaaaatcccttaatggcgcggtgccactgggaagcaacgcacgagaggaatccagcatccattgtaagagatgccttttcatgccaaagagttacgaggcacttgtacagcacgttatcgaggaccatgagcggattgggtatcaggtcactgcaatgataggacacaccaacgtggtggtgcccagaagcaaaccattgatgctgattgcaccaaaaccccaagataagaagtcgatgggattaccgccccgaatcggatccctggccagcggtaacgtgagaagcctcccctctcagcagatggtgaataggctttccatacctaagcccaacctgaacagcacaggcgtcaacatgatgtccagcgtgcacctccaacagaacaactatggcgtaaagtctgtaggtcaagggtacagtgtaggtcagtccatgaggcttggcctgggcggtaatgccccagtgtccatccctcagcagtcgcagtcagtgaagcagctcctgccatccggcaacgggaggagctacggcctcggcagcgagcagcgtagtcaggctcctgcccggtatagcttacagagtgcgaatgcttctagtttaagcagtggtcagctgaagtccccttcactctcacagtcccaggcctcgcgggttctgggtcagtctagctccaaaccggctgccgccgccaccggtccaccccccggtaacacttcgagcacccagaagtggaagatttgcacaatttgtaacgagttatttcccgaaaacgtgtactcagtgcactttgaaaaggagcacaaagcggagaaggtgcctgcagtagccaattatattatgaagattcataattttacatccaagtgtctgtactgcaatcgttatttaccgactgacacattgcttaaccacatgctgatacatggtctgtcttgtccatactgcagatctacctttaatgacgtagagaagatggcagcacacatgcggatggtgcatatcgacgaggagatgggcccgaagactgattccacactgtccttcgatctgaccttgcaacagggctcccacacgaatatccatctgctggtgacaacatataatctgagagacgccccagccgagtctgtcgcgtaccatgcacagaacaaccccccagtgccaccaaagcctcagccgaaggtgcaggagaaggccgatatcccggtgaagagcagtccgcaggctgctgtgccttataagaaggatgtcgggaagaccctctgtccgttatgcttctcgatactcaaaggacctatcagtgatgcactcgcccatcatctaagggagcgacaccaagtcatacaaactgtgcaccctgtcgaaaaaaagcttacctataagtgtattcattgcctgggagtctatactagtaatatgactgcctcaaccatcacactgcacttagtgcactgccggggcgtgggcaaaacccaaaatgggcaggataagactaatgcaccctctcggcttaaccaatccccctcactggcacctgtgaaacgtacctatgaacagatggaattccctctcttgaagaagcggaagttggacgacgacagcgattctcccagttttttcgaagaaaagccagaggagcccgtggtcctcgccctcgatccaaaaggacatgaagacgacagctatgaggcgcgtaaatcctttctgacaaagtatttcaataaacaaccctatccaactcgacgtgagatcgagaaactcgcagcatccctatggctgtggaagagcgatatcgcaagccacttctctaataagaggaaaaaatgtgtacgagattgcgaaaagtacaaacccggtgtgctactcggatttaacatgaaagagctgaacaaagtcaagcatgagatggacttcgatgctgagtggttgttcgagaaccatgacgaaaaagattcaagggtgaatgctagcaagaccgccgataaaaaactgaaccttggcaaggaggacgattcttccagcgacagttttgagaatctggaggaagaatcaaatgaatcggggtcacccttcgatcctgtattcgaagtcgagcccaagatctccaatgataatccagaagaacatgtgctcaaggtaataccagaagacgcttctgagagcgaggaaaaactggaccagaaagaggatgggtccaagtatgagacaattcatctaacagaagagcctacgaagctgatgcacaacgcctcagacagtgaagtggatcaagatgatgtagttgaatggaaagatggtgcctccccttctgagagtggccctggatctcagcaagtatctgatttcgaagacaatacctgcgaaatgaaaccaggtacatggtcagatgagagttcacaatcagaagacgcccggagttcgaagcctgccgctaaaaagaaagctactatgcagggcgatagggaacagctcaaatggaagaactcaagttatgggaaggtcgagggcttctggtctaaggatcagtcgcagtggaaaaatgctagcgaaaatgacgaacggctgtctaatcctcaaatcgagtggcagaacagtaccatcgactctgaagacggggagcagtttgacaacatgaccgatggtgtggctgaacccatgcacgggtccctggctggggtgaaactctcttctcagcaggct

SEQ ID NO: 5702 - DNA, 3306 bp, Artificial Sequence
  Description of Artificial Sequence: Synthetic coding sequence
atgttccaactgcccgtcaacaacttgggatccctgcgcaaggccagaaagaccgtcaagaagatcttgtcagacatcggcctcgagtactgtaaagagcacatcgaagatttcaaacagttcgagcccaacgacttctacttgaagaacacaacctgggaagatgtcggactttgggatccgagcctcaccaaaaaccaggattaccgtactaagccattctgctgttctgcctgccctttcagctctaagttcttctctgcatataagagccactttcgtaacgttcatagtgaggatttcgagaaccgcatcttgctcaactgcccctactgcacattcaatgccgataaaaaaaccttggagacacacattaagatcttccacgctcccaatgcctcggcaccgtcgtcgtcgctctcgaccttcaaggataagaataaaaacgatgggctcaagccgaagcaggccgattccgtcgagcaagcggtctactattgcaagaagtgtacctatcgcgaccccctgtacgagattgtccgcaagcatatctatcgcgagcacttccagcatgtggcagccccttacatcgctaaggctggagagaagtcactgaacggagcagtccccctgggcagcaatgcacgtgaggaatcaagcatccactgcaagcgttgtctctttatgcctaagtcttatgaggctttagtgcagcacgttatcgaggaccatgaacgaattgggtaccaggtcacagccatgataggccataccaatgttgtggttccgcggagcaagcctcttatgctgatcgcccccaagccgcaagacaagaagagtatgggcctccccccgcgtattggctcgctcgcgtccggcaacgtacgttctctcccaagccagcagatggtcaacaggttgagtatcccaaagcctaacctgaatagcaccggcgtcaacatgatgtcgtctgttcacctgcagcagaataactacggggttaagagcgtgggacaggggtactcggtcggccagtcaatgcgcctcgggctcggaggtaatgcccctgtgagcattccgcagcagagtcagtccgtgaagcaactcctcccttctggcaacggtcgctcttacggcctggggtccgagcagcggagccaggcccccgcccgctatagcctgcagagcgctaacgcgagttccctgtccagcggtcaactgaagtcgccctcactctcacagagccaagcgagccgcgtgctcggtcagagttcctccaagcccgcggcggcagctaccggtccaccacccggcaacacctcgagtacccaaaagtggaaaatctgcacaatctgtaacgagctgttcccggagaatgtctattctgtccacttcgaaaaggagcacaaggcagaaaaggttccagctgtggctaattatattatgaagatccacaacttcaccagcaagtgcctttactgtaaccgttacctccccactgacacactgctgaatcacatgctgattcatggactgtcttgcccttactgtcggtctaccttcaacgacgttgagaagatggccgcgcacatgcgcatggttcacatcgacgaggaaatgggaccgaagactgattctacgttgtccttcgatctgaccctccagcagggtagccacaccaacatccacctgctcgtgaccacgtataacctgcgtgatgctcctgcagagagcgttgcctatcacgcacagaacaacccccctgtgccgcctaagcctcagcccaaggtgcaagagaaggccgatatcccggtcaagtccagcccacaggctgctgtcccgtacaagaaggacgtcggcaaaaccctgtgtcccctgtgcttctctatcctgaagggccccatctcggacgccctggctcaccatcttagagagcggcatcaggtcatccagacagtccaccctgtcgaaaaaaagttgacctacaagtgcatccactgcctcggcgtttacaccagtaacatgacggctagcaccatcaccctgcatcttgtccactgtcggggtgtgggcaagacccaaaacggccaggacaagaccaatgccccgtcccgtctcaaccagagtcctagcctcgcacctgtcaagcgtacctatgaacaaatggagttcccactccttaagaagcggaaactggacgatgactctgacagtccttcgttcttcgaggaaaagcccgaggagccggtggtcctggctctcgatcccaagggccacgaggatgactcctacgaggcccgtaaaagtttcctgaccaagtacttcaataagcagccctacccgacccgtcgtgagatagagaagctcgctgccagtttatggctgtggaagtccgacatcgctagccacttttccaacaagcggaaaaagtgcgtgcgagattgtgagaagtacaaaccgggggtccttcttggattcaacatgaaggaattgaacaaggttaagcacgagatggatttcgacgccgaatggttgttcgagaatcatgacgagaaggactcgcgcgtgaacgcgtctaagaccgccgacaagaagctcaacctcggcaaggaggacgatagcagctccgatagtttcgaaaatttggaggaggagtcaaacgagagtgggtctcccttcgaccctgtgtttgaggtcgaacctaagatctctaatgacaaccctgaagaacatgtcctcaaggtcatccccgaggatgcgtcggagtccgaggaaaaactggaccagaaagaagacgggtccaagtacgaaacgatacacctcactgaggagcccacgaagttgatgcataacgcgagtgatagcgaagtcgatcaggatgatgttgtcgagtggaaggacggcgcttctccttccgagagcggtcctggatctcaacaggtctcagactttgaggacaacacctgcgagatgaagcctggtacctggtcggacgagtcctcgcagtctgaagacgcacggagttcgaagcccgctgctaagaagaaggccacaatgcagggtgatcgggagcaattgaagtggaagaacagctcctacggtaaggtcgagggcttctggagtaaggaccagagtcagtggaagaatgcttcggaaaacgacgagcgtctctccaacccgcagattgagtggcagaactcaaccattgacagcgaagatggcgagcagtttgacaatatgactgacggcgtcgccgagccgatgcacggttcgctggccggcgtcaagttgtcgtcgcagcaggcc

SEQ ID NO: 5703 - DNA, 3306 bp, Artificial Sequence
  Description of Artificial Sequence: Synthetic coding sequence
atgtttcaattgccagtgaataaccttggctcactgcgaaaagcaagaaagactgtgaagaagatcctctccgacatcggcctcgagtattgcaaggagcatatcgaagatttcaaacagttcgaacccaacgacttttacctcaagaacacgacatgggaggacgttgggctctgggacccaagcctcactaagaaccaggattataggactaagcccttttgttgttctgcctgcccattttcttcaaaatttttctcagcctacaagtcacactttagaaacgtgcactcggaagattttgaaaaccgaatccttctgaactgtccatactgtacattcaatgccgataaaaagactctcgagactcatatcaaaatctttcacgcaccaaacgcgtctgcaccctcatcatccctctcgactttcaaggataagaacaaaaatgacggtcttaagcctaaacaggccgactcagttgagcaggcagtgtattactgcaagaaatgtacctatagggacccactgtacgaaatcgtcaggaagcacatctaccgcgagcactttcagcacgttgcagccccatatatcgccaaagctggggaaaaatctcttaacggcgccgtgcctctggggagtaacgcacgagaggaatcttccattcattgtaagcggtgtctgttcatgcccaagagttacgaggcgctagtccagcacgtgatcgaagatcacgagcggattggctatcaggttaccgccatgatcggacacacaaatgtagttgtgccccgatctaaacctctgatgcttattgctcctaaacctcaggataagaaatctatggggctgccccccagaattgggtctttagcctcaggcaacgttaggtctctaccaagtcaacagatggtgaatcgtctgtccatcccaaagcccaacctaaatagcactggtgtcaatatgatgtcatccgtacatctacagcagaacaattatggtgttaaaagcgtgggacaggggtatagcgtcggccaatcaatgagacttggcctgggcgggaacgctccggtttctataccacaacaatcgcagtccgtcaagcaactgctgccatccggtaacggccggagctacggcctgggctccgagcagcggtcccaagcccccgcgcgctactctctacagagcgcgaacgcctcgagcctgtcctcagggcaactgaagagcccgtcactatctcagagccaggcttccagggtactaggccagtcgtcatcgaaacccgccgcagccgccacagggcccccccctgggaataccagttctactcagaaatggaagatatgcaccatatgcaacgagctgtttcccgaaaatgtttattccgtccactttgagaaagaacacaaagcggaaaaagtacctgccgtcgcaaactatattatgaagattcataattttacgtcaaagtgtctgtactgtaataggtatctccccaccgacaccttattaaaccacatgctgatacacgggcttagctgtccttactgccgctccacattcaatgacgtggagaaaatggccgctcacatgaggatggtccatattgacgaagaaatgggtcccaagaccgactcgactctgtccttcgacctgactctgcaacagggcagccacaccaatatccacttactggtgacaacatataatctgcgggacgcgccggcggagagtgtagcctaccacgcccagaataaccctccggtaccacccaagcctcagcccaaggttcaggagaaggcagacattccggtaaaatcttctcctcaggcagctgtgccatacaaaaaagacgtcggcaaaactctctgtcccctatgtttcagcatcttgaaggggcccatttctgatgctctagctcaccatttacgagaaaggcaccaagtgatccagactgtgcaccccgtggaaaagaaactgacttacaaatgtatccactgtcttggcgtgtatacaagcaatatgactgcctccacaataaccttgcacttagtccattgtcgcggagtcggaaagactcagaatgggcaggacaagacaaatgctccttctaggctcaaccagtctccaagtctggctcccgtgaaacgtacgtacgagcaaatggagtttccccttctgaagaagcgtaagttagatgacgacagcgactctccatctttcttcgaagaaaagcctgaggagccggttgtgttggctctggaccccaaaggccatgaggacgatagctacgaggccagaaagagcttcctgacaaaatacttcaacaagcagccttatcctacgcggcgcgaaatagaaaagctagccgcctcactctggctgtggaaaagcgacattgccagccattttagcaataaacggaagaagtgcgtccgagactgcgagaagtacaagccaggagttcttctgggattcaacatgaaagagctgaacaaggtcaagcacgagatggatttcgacgccgagtggctattcgagaaccacgatgagaaggacagtcgggtaaacgcttcaaaaacagctgacaagaagcttaacctgggaaaggaggatgattcctcctcggattctttcgagaatctagaagaagaatctaacgagtccggcagtccattcgaccctgtcttcgaagtcgaacctaagattagcaacgataatccagaggaacacgtgttaaaggtcatccccgaagacgctagtgaatcagaagagaaattggaccagaaagaagacggttccaaatacgaaaccatacatctgacagaggaacctacgaagctcatgcataatgcctctgatagcgaagtggaccaggatgatgtagtcgagtggaaggacggcgcctcgccatcagagagtggccctgggtcccaacaggtgtccgacttcgaggacaacacgtgcgaaatgaaacccgggacgtggagtgatgagtcaagtcagtcagaggacgcccgcagttctaaacctgctgccaaaaagaaagccaccatgcagggcgacagggagcagttgaaatggaagaactctagctatgggaaggtcgaagggttctggagtaaggatcagtctcaatggaagaatgcgagcgaaaacgatgagcgactgtccaaccctcagatagaatggcagaactcgactatcgattccgaagatggcgagcagttcgacaacatgaccgatggcgtcgcagaacctatgcatgggagcctggctggcgtgaaactgtccagtcagcaggca

SEQ ID NO: 5704 - DNA, 3306 bp, Artificial Sequence
  Description of Artificial Sequence: Synthetic coding sequence
atgttccaactgcctgtaaacaatctgggctcgctgcgaaaggcgaggaaaacggtcaaaaagattctgagcgacattggacttgaatactgcaaggaacacattgaggatttcaagcagttcgaaccgaacgatttctacctgaaaaacactacctgggaagatgtcggactgtgggacccgtccctgactaaaaaccaggattacaggactaagcctttctgttgctcagcttgtccgttctcgagtaagttcttcagcgcatacaagtcgcactttcggaatgtccattcagaagatttcgagaaccgcatcctcctgaattgcccgtactgtacctttaatgcggataagaaaactctggagactcatatcaagatattccatgcaccaaatgcatcagccccatcgtcctcgttgagcacgttcaaggacaagaacaaaaacgacgggctgaagcctaagcaggccgactccgtcgaacaggccgtgtactactgcaaaaagtgtacctacagggacccgctgtacgagatcgtaagaaagcatatctatcgggagcactttcagcacgttgcggcaccatacatcgccaaggccggggagaagagcctcaacggcgcagtgccgctgggatcaaacgcacgggaagagtcgtcaatccactgtaagcggtgcctgttcatgccgaaatcatacgaagcgttggtgcagcatgtgatagaagatcatgaacggatcggataccaggtgactgccatgattggacatactaacgtggtggtcccacgctccaaacccctcatgttgatcgcgccgaaaccccaggacaagaaatcgatgggtctgccaccaaggattggatccctggcctcaggcaacgtccggagcctgccgtcacaacagatggtgaacagactgagcatcccgaagccgaacctcaacagcacgggagtcaacatgatgagctccgtgcacctgcaacagaataactacggagtgaagtcagtgggacaaggttactctgtcggccagtccatgcggctgggactcgggggaaatgcacccgtttcgataccccaacaatcccagagcgtgaaacaactcctgccgtccggaaatggccggtcgtatggactcggcagcgaacaacggagccaggcccctgcccggtactcccttcaatcggccaatgcgtcgtcgctgtcctcaggacaactgaagtccccatcactgagccagtcccaagctagccgggtcctggggcagagctcatcaaagcctgccgcggcggctaccggcccaccacccggtaacacttcatcgactcagaagtggaagatctgcaccatctgcaatgagctcttccctgagaacgtctacagcgtgcacttcgaaaaggaacacaaagctgaaaaggtcccggcggtggccaattacatcatgaagatccacaacttcacgtccaagtgcctgtactgcaaccggtacttgcccactgacacgctgttgaatcacatgctgatccatggcttgagctgcccctactgtcggagcacctttaacgacgtggagaaaatggcagcccatatgaggatggtccacatcgacgaagaaatgggtcccaagacggactcgactctgagctttgacctcactttgcagcagggctcccataccaacatccacctcctggtgaccacctacaatctgcgggatgcgccggccgagtcagtggcgtaccacgctcagaacaaccccccagttccaccaaagccgcagcccaaggtgcaggagaaagcagatattccggtgaagagctccccgcaagcggccgtcccttacaaaaaagatgtgggaaagactctctgccccctgtgcttctcgatcctgaaggggccgatcagcgatgctctcgctcaccacctgcgcgagcgccatcaagtcatccagaccgtgcatcctgtggaaaagaaacttacttacaagtgcattcactgtctgggagtttacacctcaaacatgaccgcgagcactatcaccctccacctcgtccactgcagaggggtggggaaaacccaaaatggccaagacaagactaatgctccgagccgactcaaccaatcaccgagccttgcgccggtgaagcggacctacgaacaaatggaattcccccttttgaaaaagaggaagctcgatgatgattcagactccccgtcattctttgaagaaaaaccggaggagccagtggtgcttgccctcgaccccaagggccatgaggacgattcctacgaggcacgcaagagcttcctgaccaaatacttcaacaaacagccatacccgacccgccgggagattgaaaaactggctgccagcctctggctgtggaagtccgacatcgcatcgcacttctcgaacaagagaaagaagtgcgtgagggattgcgagaagtacaagccgggcgtgctgctcgggtttaacatgaaggaactgaacaaggtgaaacacgaaatggacttcgacgcggagtggctgtttgagaatcatgacgaaaaggatagccgggttaacgccagtaagaccgccgacaagaagctgaaccttgggaaggaggatgattccagctcggacagcttcgagaacctcgaagaggaatccaacgaatccgggagcccattcgaccctgtgtttgaagtggaaccaaagatttccaacgacaaccctgaggaacatgtgctgaaggtgatcccggaggacgcgtcggaatccgaagaaaaactcgatcaaaaagaagatggatccaagtacgaaaccatccacctcaccgaggaacctaccaaactgatgcacaatgccagcgactcagaggtggaccaggacgatgtcgtcgagtggaaggatggagcgtcccccagcgaatcaggccctggatcacagcaggtgtcggacttcgaggacaatacttgcgagatgaagccgggaacctggtccgacgaatcctcacaatccgaggatgcccggtcgtctaaaccggcggcgaagaagaaggcgaccatgcaaggagatcgcgagcagctgaaatggaaaaactcctcgtacggaaaggtggaaggattctggtcgaaggatcagtcgcagtggaagaacgcgagcgaaaacgacgagagactctccaatcctcagatcgaatggcagaactcgaccatcgacagcgaggatggagagcagtttgacaacatgaccgatggtgtggccgagcccatgcatggatcgctcgccggagtgaagttgagctcccagcaggcc

SEQ ID NO: 5705 - DNA, 3306 bp, Artificial Sequence
  Description of Artificial Sequence: Synthetic coding sequence
atgttccagctgcctgtcaataacctcggctcgctgagaaaagcacgaaagaccgtcaaaaagatcctttcagatatcggactggagtactgtaaggaacacatcgaggatttcaagcaattcgagccgaatgacttttaccttaagaacacgacctgggaggatgtgggactctgggacccttcgctgaccaagaaccaggattaccggactaaaccattctgttgttcggcgtgtccgttttcatcgaagtttttcagcgcatacaagtctcacttcagaaatgtgcattcagaggattttgaaaaccgcatcctgctgaattgcccttactgcacttttaacgcggacaaaaagaccctggaaactcacatcaagatttttcacgcacctaacgcgtcggcgcctagcagcagcctgtcaacttttaaggacaaaaacaagaatgatggactgaagcctaaacaagccgacagcgttgaacaagcagtgtactactgtaaaaagtgtacctaccgcgatccgctttatgagattgtgagaaagcatatctaccgcgaacattttcagcacgtcgcagcaccctacatagccaaggcgggggagaaatctcttaacggagcagtgccactgggctcgaatgcacgggaggaatcatcaattcattgtaaaagatgtctctttatgccaaaatcttacgaggcacttgtgcagcacgtgatagaggaccacgaaaggattggataccaggtgactgcaatgattggacatactaacgtggtggtcccacgctcgaaacctcttatgttgatagccccgaagccgcaagataagaaaagcatgggacttccaccaagaatcggatccctggcctcgggtaacgtgcgcagccttcctagtcagcagatggtcaaccgcctctccattcccaaacctaaccttaactccactggtgtgaacatgatgtcgagcgtccatcttcagcagaataactacggggtgaagtcggtcggacagggttactcagttgggcagtcgatgcggttgggactcggcggaaatgcccctgtctcgattccccaacaatctcagagcgtgaagcagctgctgcctagcgggaacggaaggtcctacggtcttggaagcgagcaacgatcgcaagccccagctcggtactccctccagagcgcaaatgcaagctccctttcctccggacagcttaagagcccaagcctctctcagtcacaggcatcaagggtcctcggtcaatcctccagcaagcctgccgctgcagcgaccggacctccacctgggaacactagctcaacgcaaaagtggaagatttgtacgatttgcaacgaattgtttccggaaaacgtctattcggtgcactttgaaaaagaacacaaggccgaaaaagtgccagcggtcgcaaattacattatgaaaatccacaacttcacctccaagtgtttgtattgcaatagataccttcctactgacactcttcttaatcatatgctgatccatggactgtcctgtccttactgtcggtcaacctttaacgacgtggaaaagatggcagctcacatgaggatggtgcatatagacgaagaaatgggtcctaagacggattcgactctgagcttcgatctgactttgcaacaaggttcgcacactaacattcatctcctggtgactacgtacaacctgcgcgatgcacccgcagaatcggtggcctaccatgcccagaacaaccccccagttcccccaaagccccaaccaaaggtgcaagagaaggcggacattccagtcaagtcaagcccacaagcggcggtcccttataagaaggacgtgggaaagaccctttgcccactttgcttttcgattcttaaaggccccatatcagatgcacttgcccaccaccttagagaacggcaccaagtcatacaaactgtccaccccgtggaaaagaaactcacttacaaatgcattcattgccttggagtgtacacttcaaatatgactgcgtcaaccattacccttcatctggtgcattgccgtggggtgggtaaaacccaaaacggccaggacaagacgaatgctccgtcccgcctgaatcaatcgccaagcctcgcacctgtgaagagaacctacgagcagatggagttcccgctccttaagaaacgcaagttggatgacgattcggattccccgtcgtttttcgaggaaaagccagaagagcccgtggtcctggcgcttgaccctaagggacatgaggatgactcgtacgaggcaaggaagtcctttcttactaagtacttcaataaacaaccctacccaactcggcgggagatcgagaagctggcagcatccctgtggctgtggaagtcggatatcgcatcacacttctcaaacaagcgcaagaagtgcgtgcgggactgtgagaaatacaagcccggggtgctgcttggattcaacatgaaggagctgaataaggtcaagcacgagatggatttcgacgcagaatggctcttcgaaaatcatgacgagaaggattcgcgcgtgaatgcatcaaagaccgccgataagaaactcaaccttgggaaagaagatgactcctcatctgattcctttgagaatctggaagaggaatcgaacgaatcgggatctccatttgatccagtgtttgaagtggaaccaaagatatcaaacgataacccagaagaacacgtgctcaaggtcataccagaagatgcttccgaatcggaggagaagttggatcaaaaagaagatggatccaagtacgaaaccattcacttgaccgaggaacctactaaacttatgcataacgcatcagattctgaagtcgatcaagatgatgttgtcgagtggaaagatggcgcgtccccctcggagtccggcccaggaagccaacaagtgtccgactttgaggacaacacctgtgagatgaagcctggcacctggtcggacgaaagcagtcagtccgaagatgcacggagctcaaagccagcagcgaagaagaaggccactatgcagggggatcgcgaacaacttaagtggaagaactcgtcatacggaaaagtggaaggcttttggtcgaaggatcaatcacagtggaaaaatgcctcggaaaacgatgaacggcttagcaaccctcagattgagtggcaaaactctaccatcgactcagaggatggggaacaattcgataacatgaccgatggagtcgccgaacctatgcacggttcactggcgggtgtgaaactctcgtcacaacaggcc

SEQ ID NO: 5706 - DNA, 3306 bp, Artificial Sequence
  Description of Artificial Sequence: Synthetic coding sequence
atgttccagttgccagtgaataacctgggatccctgagaaaagctcgcaagactgtgaagaaaatcctctccgatatcggcctggaatactgcaaagaacacatcgaggacttcaagcagttcgaaccgaacgacttttatctcaaaaacaccacctgggaggatgtgggtctttgggatccatcgcttactaagaatcaagattaccgcaccaagcccttttgctgctccgcctgtccattttcttcgaagttcttctcggcatacaagtcacactttcggaatgtccactcagaagatttcgaaaatagaatcctcctcaactgcccctactgtactttcaatgcagataagaaaaccctcgaaacccacatcaagatcttccacgcaccaaatgcttcggccccatcgtcgtccctgtccaccttcaaggataagaacaaaaatgacgggctcaagcctaaacaagcagatagcgtggaacaagcggtgtactactgtaagaaatgtacctaccgtgatccgctgtacgagatcgtccgcaaacatatctacagggaacatttccaacacgtggcggccccgtacattgcgaaggcaggcgagaagtcgctcaacggcgccgtgccactgggatccaacgcacgcgaggaatcgtcgatccattgtaaaaggtgtctgttcatgccaaagtcatatgaagcgctggtgcaacacgtgatcgaggaccatgaaaggatcgggtaccaagtgaccgccatgatcggacacaccaacgtcgtggtcccacggtccaagccgctcatgctcattgctccaaagccacaggataagaagtccatgggactgccgccgagaatcggatcattggcctccggcaacgtgcgctcccttccaagccagcaaatggtcaaccgactctctatcccaaaacctaacctgaattccaccggggtgaatatgatgtcctcggtgcacctccaacaaaacaactacggagtgaagtccgtggggcagggatacagcgtgggacaatcaatgcgactcggtctgggtgggaacgcccctgtgtcaatccctcagcagtcccaatccgtgaagcagctgctgccaagcggcaacggtcggtcgtacggcctgggaagcgaacagcgctcccaggcgccagcacggtactccctgcaatccgccaacgcatcatcgctgagctctggccaactcaaatcaccgtcactgtcacagtctcaggcctcgcgcgtgctgggacagtccagctcgaagccggcagccgctgcgactggcccgccaccggggaacacgtcctcgactcagaagtggaagatctgcacgatctgtaacgagctgtttcctgagaacgtgtactcggtgcatttcgagaaggaacacaaggccgagaaggtccccgccgtggctaattacatcatgaagatccacaacttcacctcgaagtgcctctactgcaataggtacctgcctaccgataccctgctgaatcacatgctcatccacgggctgagctgcccttactgccggtcgactttcaatgatgtggaaaagatggcggctcacatgcggatggtccacatcgatgaggaaatgggaccgaaaaccgactccactctgagcttcgacttgaccctccagcagggatcgcataccaacatccatctgcttgtgaccacttacaacctccgcgatgccccggcagagtccgtggcctaccacgcccagaacaatccgccggtgccgccgaaaccccaaccgaaggtccaggagaaggcggatatcccagtcaagtcgtcgccacaggcagctgtgccatacaagaaggatgtcggaaagacgctgtgccctctttgcttctccatcctgaagggaccaatctcagacgccctggcccatcacctccgcgagcgccaccaggtgatccaaaccgtgcatccagtcgagaaaaagctcacctacaagtgcatccactgccttggagtgtacacgtccaacatgaccgcctcgaccatcactctccacctggtgcactgcagaggcgtgggaaaaacccagaatggccaggacaagactaatgcaccttcgcggctgaatcaatcacctagcctggcccctgtgaagcgcacttacgagcagatggagtttccactgttgaaaaagagaaaactggatgacgactccgattcgccttcctttttcgaagagaaacccgaagaaccggttgtgttggcactggatcctaagggacacgaggacgactcctacgaggcccgaaagtcttttctgacgaagtacttcaacaaacagccctacccgactaggcgggaaatcgaaaagctggccgcgtccctgtggctgtggaagtcggacatcgcctcgcatttttcgaacaagagaaagaaatgcgtgagggattgtgaaaagtacaagcctggagtgctcctgggcttcaacatgaaagagttgaacaaggtgaaacacgagatggatttcgacgccgagtggctgtttgagaatcatgacgaaaaagactcacgcgtgaacgcaagcaaaaccgcggataagaagctcaacctcggaaaagaagatgactcctcttcggattcattcgaaaacttggaagaagagtccaatgaatcgggctccccgtttgatccggtgttcgaggtggagccgaagatcagcaatgacaaccctgaggagcatgtgcttaaggtgattccggaagatgcaagcgagtcagaggaaaaactcgaccagaaagaagatgggtccaagtacgaaactatccacctgactgaagaaccgaccaaacttatgcacaatgcatcggactcagaagtcgatcaggatgacgtggtcgaatggaaggacggagcatcgccctcggagtcaggaccgggaagccagcaggtgtccgacttcgaagataacacttgcgaaatgaaaccaggcacttggagcgatgaatcgtcccaatccgaggacgcgcggtcatcgaagcctgcagctaagaaaaaggcaaccatgcagggagatagagaacagcttaaatggaagaactcgagctacggtaaagtggagggattctggtcaaaggaccaaagccaatggaagaatgccagcgagaacgacgagcggctgagcaacccccagatcgaatggcagaactccaccatcgactcggaagatggtgaacagttcgataacatgaccgacggcgtcgcggagccaatgcatgggtccctcgcaggagtcaagctgtcgtcccagcaggcc

SEQ ID NO: 5707 - DNA, 3306 bp, Artificial Sequence
  Description of Artificial Sequence: Synthetic coding sequence
atgttccaactgccggtgaacaacttgggttcactgaggaaggcacggaaaaccgtcaaaaagatcctttccgacattggactggaatattgtaaggaacatatcgaggactttaagcagtttgaaccaaatgacttttaccttaagaatactacttgggaggacgtggggctctgggacccgtccttgactaagaaccaggattacagaaccaaacctttctgctgttcggcttgtccgttctcatctaagtttttcagcgcctacaagtcccatttcagaaacgtgcactcagaagatttcgaaaacagaattttgttgaactgtccgtactgcaccttcaatgcagacaagaaaactctcgagactcacattaagatctttcatgccccaaacgcgtcagccccttcaagctcgctgtccactttcaaggataagaacaagaatgatggactgaagccgaagcaagcggactcggtcgaacaggcggtgtactattgcaagaagtgcacttatagggatccgctgtacgagatcgtcagaaaacatatctaccgcgaacacttccagcatgtggcagccccgtacatagccaaggccggagaaaagagcctgaatggggctgtgcccctgggctcgaatgcccgcgaggagtcctcgattcactgcaaacggtgtctcttcatgccgaagagctacgaggctttggttcagcacgttatcgaagatcacgaacggatcggctaccaggtgaccgccatgataggacacactaacgtcgtggtgccgcgttcgaagccgctcatgctgatcgcccctaagccacaggacaagaagagcatgggcctccctccccgcatcggcagcctggcgtcgggcaacgtgcggtcactgcctagccagcaaatggtcaaccgcttgtccattccaaagccaaatttgaactcaacgggcgtcaacatgatgtcaagcgtgcacttgcaacagaacaactacggcgtgaagtcggtcggtcagggatactccgtggggcaatccatgagactgggacttggtggcaacgctccggtgtcgatccctcagcaatcccagtccgtgaagcagctgctgccatcagggaatggcagatcctacggcctgggatcggaacagcggtcccaagcccccgcccgctacagcctccaatctgcaaatgcctcgagcctgagctccggccagcttaagagcccaagcctgtcccagtcgcaagcatcccgggtgctcggacagtcctcatccaagccagcggccgcggctaccgggccgcccccgggaaatacgtcgtcgacccaaaaatggaaaatctgcacgatctgcaacgaactgttcccagagaacgtgtactcagtccatttcgaaaaagagcataaggccgaaaaggtgccggccgttgcgaactacatcatgaagatccacaacttcaccagcaagtgcctgtactgcaaccgatacctgcctactgacactctgctcaaccacatgctgattcatggactgtcatgcccctactgccggtcgaccttcaacgacgtggaaaagatggcagcccacatgcggatggtccacatcgacgaagagatgggcccgaaaaccgattcgaccctgtcattcgacctcaccctgcaacaaggctcacacactaacatccacctgctcgtcaccacttacaatctgagagatgctcctgccgaatcggtggcataccacgcccaaaacaacccacctgtgccgccgaagccgcagccgaaggtgcaagaaaaggctgacatccccgtgaaaagctcgccacaagctgccgtgccttataagaaagacgtcggaaagacgctttgtcctctgtgcttcagcatcctcaagggtccaatctcggatgcgctggcccatcatctgagagaaagacaccaggtgattcagaccgtgcacccagtcgaaaagaagctcacctacaaatgcatccactgccttggtgtgtacacgtcgaatatgaccgcctcaaccatcaccttgcacctcgtgcactgtcggggagtcggcaagacccagaacgggcaggataagaccaatgccccgtcgaggctgaaccagtcaccaagcctcgccccggtgaagcgcacctacgagcagatggaatttcccctcctcaaaaagcgcaaactggatgatgatagcgattcaccatcattcttcgaagagaagccagaggaaccagtggtgctggcccttgatccgaaaggacatgaagatgactcctacgaggcgcggaagagctttctgaccaagtacttcaacaagcagccatacccgactcggcgggaaatcgaaaaactggccgcctccctgtggctgtggaagagcgacatcgcgagccatttctccaacaagcgcaagaagtgtgtgagagattgcgagaagtacaagccaggagtcctcctgggcttcaatatgaaggagctgaataaggtgaaacacgaaatggacttcgatgcagagtggctgttcgaaaatcacgatgaaaaggacagccgggtgaacgcgtccaagacggctgacaagaaactgaacctgggcaaagaggacgatagctcctccgactcatttgagaatctggaggaagaatcgaacgaatcaggatccccgtttgaccctgtgttcgaagtggaaccaaagatcagcaacgacaacccagaggaacatgtgctgaaggtgattccggaagatgctagcgagagcgaagaaaagctggaccaaaaggaggatggctcgaaatacgaaaccattcacctcaccgaggaaccgaccaagctcatgcacaacgcgagcgacagcgaagtggaccaggacgatgtcgtggaatggaaggacggggcgtcaccatcggagtcagggccgggatcccaacaagtgtcagatttcgaggacaacacttgtgagatgaagccgggaacttggtcagacgagtcatctcaatcggaggacgcccgcagctccaagccggccgccaagaaaaaagccactatgcagggagatcgcgaacagctcaagtggaagaattcctcgtacggaaaagtcgagggcttctggagcaaggatcagtcgcagtggaagaatgcctcggagaatgatgagcgccttagcaacccgcaaatcgagtggcaaaactccaccatcgattccgaagatggagagcagtttgacaacatgaccgacggagtcgctgaaccaatgcatggctcgttggccggagtgaagctgagctcgcagcaggcg

SEQ ID NO: 5708 - DNA, 3306 bp, Artificial Sequence
  Description of Artificial Sequence: Synthetic coding sequence
atgttccagctcccggttaacaaccttggaagcctgaggaaagccaggaagacggtaaaaaagattctctccgatattggcctggagtattgcaaagaacacatcgaggattttaaacagtttgagcctaatgacttttatctcaaaaacactacatgggaggacgttggactttgggatcccagtcttacgaaaaatcaagattaccgaaccaagcccttctgttgctccgcctgcccatttagctccaaattcttctccgcctataagtctcatttcagaaatgtgcactccgaggacttcgagaaccgtatactgctgaattgcccatattgcactttcaacgccgataagaagacgcttgagactcatatcaagatctttcacgcccctaatgcgtcggcaccgtcctcttctctgagcacttttaaggacaaaaacaaaaatgatggtctgaagcccaaacaggctgacagtgttgaacaggctgtctactattgcaaaaagtgtacataccgggacccactgtatgagattgtgaggaaacatatctatagagagcactttcaacatgtcgcagctccgtatatcgctaaggccggagaaaaaagtctgaatggagccgtacccctagggtccaacgccagggaggagagtagtattcactgtaagcggtgcctctttatgcctaagagttacgaggcactcgtccaacatgtgatcgaggaccatgaaaggattgggtatcaggtgaccgccatgataggacacaccaatgtcgttgttccccgcagcaagccacttatgctgatcgccccgaaacctcaggataaaaaatcaatggggctccctccccggatcggctccttggccagcggtaatgtccggagcctgccatcccagcagatggtgaatcgcctctctatccccaaaccgaacttaaattccaccggggtcaacatgatgtcttctgtccacttgcaacagaataactatggcgtgaagtccgttggccagggttactcggttggacaatcaatgcgactggggttaggtgggaacgcccctgtcagtatcccccagcagagtcagtccgtgaagcaattgctaccctccggaaacgggaggtcctacgggctgggcagcgagcagagatctcaagcgcctgcgcgttattccctgcagagtgcaaacgctagctccctgagcagcgggcagctgaaaagcccttcattgtcgcagtcacaagccagcagggtgcttggccagagctcttctaagccagctgctgctgccacgggacccccgcccgggaacactagttcaactcagaaatggaaaatttgcactatatgtaacgagttgttccctgaaaatgtgtacagtgtacacttcgaaaaggagcataaagccgaaaaagtgcctgcggtagccaattatatcatgaagatacataacttcacctctaaatgcttatactgtaaccggtacctcccgacggacaccctgctcaatcacatgttgatacacggtcttagctgcccatactgccgatctactttcaacgacgtggaaaaaatggctgctcacatgcgcatggtgcacatcgatgaggaaatggggcccaagaccgattcaactctgagctttgatctgactctgcagcaggggtcccatacgaacatccatctgctcgttaccacctacaatctgcgcgatgcacccgcagaaagcgtggcgtaccatgcccaaaacaatcctccagtgcctcctaagccacagcccaaagtgcaggagaaggcagacatcccagtgaaaagctcccctcaggcagccgtaccctataaaaaggatgtgggaaagacattgtgtcccttgtgcttctccatcctgaagggacccatttctgatgctcttgcccatcacctgagggaacgacaccaagtcatccagactgtgcaccccgttgaaaagaaactcacttacaagtgtatacactgtctcggcgtgtacactagtaacatgacagccagtacaattaccctccatctggtgcactgtagaggagtcgggaagacacagaacggtcaagacaaaacaaatgcacctagtagacttaaccagtcgcccagcttggcgcccgtgaaacggacatacgagcaaatggagttccctttactcaagaagcggaagctcgatgatgattctgattccccaagtttcttcgaagagaagccagaggagccggttgtcctcgcattggacccaaaaggacacgaagatgactcttacgaagctagaaaaagcttcttgacgaagtatttcaataagcagccctaccccacacgccgcgaaatcgagaagctcgccgctagtttgtggctgtggaagtctgacattgcttcccatttttcaaacaagcggaagaagtgcgttagagactgtgagaagtacaagccaggggtgctattagggtttaatatgaaagaactaaacaaagtaaaacatgagatggattttgacgccgaatggctgtttgagaaccacgacgagaaagattccagagtgaacgcctccaagacggctgacaaaaaattaaaccttgggaaggaggatgattcttcctcagacagttttgagaatcttgaggaggagtccaatgagtccggcagcccttttgatccagtctttgaagtcgagccaaagatttccaacgacaatcctgaggagcatgtgttgaaggtcatcccagaagatgcatctgagtcggaggaaaagctggaccaaaaagaggatggcagcaagtacgaaacaatacatctgacagaagagcctacaaagctaatgcataatgccagcgactcagaagtggatcaggacgacgttgttgagtggaaagacggcgcttctccatcggagagcgggcctggatctcagcaggtgtcggactttgaagataacacctgcgaaatgaagccaggcacctggtccgacgagtcaagccagagtgaagatgctaggagctcgaagcctgcagccaagaaaaaagccactatgcagggagatagggagcagttgaagtggaaaaactcttcctacggcaaagtggagggcttctggtctaaggatcagtctcagtggaagaatgcatcagagaacgacgaacggctctctaacccacagattgaatggcagaacagcactatagattcggaggatggagagcagttcgataacatgaccgacggtgtagctgaacccatgcacggttcgctcgcaggcgtgaagctgtctagtcagcaggcc

SEQ ID NO: 5709 - DNA, 3306 bp, Artificial Sequence
  Description of Artificial Sequence: Synthetic coding sequence
atgtttcaactccccgtcaacaacctaggatcccttaggaaggcccggaaaacagtgaagaaaatcctgagtgacatcgggctcgaatactgcaaagaacacatcgaagatttcaagcagttcgaaccgaacgacttctacttgaagaacaccacatgggaggacgtcgggttgtgggaccccagcctcacaaaaaatcaagattatagaaccaaaccattctgctgctcagcttgccctttctctagcaaattcttttccgcatacaagagccacttccggaatgtgcatagcgaggacttcgagaaccgcatcttgttgaattgtccatactgtaccttcaacgctgacaaaaagacactagaaacccatattaagatatttcacgctcctaacgcttccgctccctcatcgtctctgtcaacattcaaggacaagaataagaatgacggactgaaacctaagcaagcggacagtgtggagcaagccgtgtattattgcaagaagtgtacctaccgcgaccctctctatgagattgtgcgaaagcacatctacagggaacacttccagcacgttgccgccccctatattgcgaaagccggagagaagtcacttaatggagccgttccactgggcagcaacgcaagagaggagtcctctattcattgtaagcggtgtctgttcatgcccaagtcatacgaagctctggtgcagcatgtgatagaggaccatgagaggatcgggtatcaagtgacggccatgatcggccacactaatgtcgtggttccacgatctaaaccgctgatgctgatcgcccctaagcctcaggataagaagagtatgggcctcccaccacgaattggttccctcgcgagcgggaacgtgcgctccttaccatctcaacagatggtcaaccgcctgtccatccctaagccgaacctaaactccaccggggtcaacatgatgagcagcgtacatcttcaacaaaataattatggtgtgaaatccgtggggcaaggatacagcgtcgggcaaagcatgagactggggctcggaggtaacgctccagtatcaatcccccaacagtcacagagtgtaaaacaactattgccctccggaaatggaaggagctatgggcttgggagtgagcagagaagccaagcccccgctaggtacagtttgcagtccgcaaatgcctccagcttatcaagtggtcagcttaaatctccttctctctcacagtcccaggcatcccgcgtgttggggcagtcatcctcaaaacccgctgccgctgctaccgggcccccacccggaaacacaagtagcactcagaaatggaaaatctgtaccatttgtaacgagctcttccctgaaaatgtgtattccgttcatttcgaaaaggagcataaggccgagaaagtgcccgcggtggcaaactacataatgaagatacataatttcaccagcaaatgcctgtattgtaatagatatttaccaaccgacaccttgctgaaccatatgcttatacacggcttgtcttgcccctattgtcggtcaaccttcaatgatgtggagaagatggccgcccatatgcgcatggtgcacatagacgaggaaatggggcccaaaaccgattccaccctgtcctttgacctgacactacagcagggctcacacaccaacatccatttgctggtgacaacatataatttacgggacgcccctgccgagtcagtcgcatatcatgcacagaacaaccccccagttccaccgaagccccagcctaaggtgcaagaaaaggccgatatccctgtgaaatcttctccccaggctgctgttccttataagaaggatgtgggaaaaacattgtgccctctctgttttagtatactcaaaggccccatctctgatgctctagctcaccacttacgggagcggcaccaggttatccagacagtgcaccccgtggagaagaaactgacctacaagtgcattcactgcttgggagtgtataccagtaatatgacagcctctacaattacactgcacctggtccactgccgcggcgtcggtaaaacgcagaacggacaggataaaacaaacgcccccagcagactgaaccagagccccagtctggcaccggtaaagaggacctacgagcagatggaattcccgctgctgaaaaagagaaagttggacgacgatagcgatagtccatcattctttgaggagaaaccagaagagcctgttgtgcttgctctcgaccctaaaggccatgaagatgattcatacgaggcgcgtaagtcctttctgaccaaatactttaataaacagccctacccgacacggcgggagatagaaaagttagcggcgtccctgtggctgtggaagtctgatatcgcctctcacttctctaataaacgtaagaaatgtgtgcgtgactgcgaaaaatacaaacctggagtgctcctgggatttaacatgaaagagctcaacaaggtgaaacacgaaatggacttcgacgcggagtggctcttcgagaaccacgacgagaaggactcccgagtgaatgccagtaaaactgcagacaagaaactcaatctcggtaaagaagacgacagttcatctgactctttcgagaatttagaggaggaatccaacgagagcggaagccctttcgaccctgtgtttgaagttgagcccaaaattagcaacgacaatccagaggagcacgttcttaaggtgatacctgaagacgcctccgagagtgaggagaaacttgaccagaaagaagacggttctaagtatgagaccattcatctgaccgaggagccgacgaagctcatgcataatgcctccgattcagaggtggaccaggacgatgtggtcgaatggaaagacggagcctctcccagtgaatccggccccggctctcagcaggtctcagacttcgaggataacacctgtgaaatgaaacccggtacttggagcgatgagtcctcccagagtgaagacgctagaagtagtaaacccgcggccaagaagaaggcaacgatgcagggcgacagggagcagcttaaatggaagaacagctcgtatggaaaagtggaagggttttggtccaaggatcagagccagtggaaaaacgcctctgagaatgacgaacgcttatccaatccccagatcgagtggcagaactcaactatcgatagcgaggacggagagcagtttgataatatgactgacggggtagcggaacctatgcatggctctttagccggggttaagctttccagtcagcaggct

SEQ ID NO: 5710 - DNA, 3306 bp, Artificial Sequence
  Description of Artificial Sequence: Synthetic coding sequence
atgtttcaacttcctgtcaacaatctggggtccctgaggaaagcacggaagacagtcaagaagattctgtctgatattggtctggaatattgcaaagaacatatcgaggatttcaagcagtttgagcccaatgacttctatctgaagaacacgacctgggaggacgtggggctttgggatcctagcctgaccaagaatcaggactacaggactaaacccttctgctgcagtgcctgtcccttcagctctaagtttttcagcgcctacaagagccacttccggaacgtgcattctgaagatttcgagaaccgaattctcctcaactgcccatactgtacatttaatgccgacaagaagaccttggaaacgcacattaagattttccatgcgcccaacgccagcgctcctagttcgtccctttcaacctttaaggataagaataagaatgatgggctgaagcctaaacaggcagacagcgtggagcaagccgtatactattgcaagaagtgcacatacagagatccgctctacgaaattgttcggaagcatatctacagagaacactttcagcatgtagcggccccctatatcgctaaagctggggagaaatcactgaatggagcggtccccctgggaagtaatgcgcgcgaagaaagtagtatccattgtaagaggtgcctgttcatgccgaaatcttacgaagcattggttcagcacgtgatcgaagaccacgaaagaatcgggtatcaggtgaccgccatgattgggcacactaacgtcgtggttcctcggtccaaaccactgatgctcatcgcgccaaaaccacaggataagaagagcatggggctcccaccccggattgggagcttggctagcgggaatgtgcgaagcctaccctcacagcagatggtgaatcgtctatcgatccccaagccaaatctcaatagcacaggggtcaatatgatgagcagtgtgcatctccagcagaataactacggagtgaaatctgtcggtcaaggatactccgtggggcaatcaatgcgattgggcctgggcgggaatgcaccagtgtcaatcccccagcagtcacagtcagtgaaacagctgcttccatcaggcaacggacggagttatggattaggctctgaacaacggtctcaggcccccgcaaggtactccttacagagcgcaaacgccagttccctgagctccggccagctgaagagtcccagtctgtcccaatcgcaggccagtagggtgctgggccagtccagctcaaaacctgccgctgccgccaccgggccccctcccggtaacactagctcgactcagaagtggaagatctgtactatttgtaatgagctctttcctgagaatgtctactccgtacatttcgagaaagaacacaaggccgagaaggtgcctgcagtggctaattacattatgaagatccataatttcacttccaagtgcctgtactgcaataggtatcttcccactgacacactattgaaccacatgcttatccacggcctgagttgtccctactgtcgctctacctttaatgatgtagagaaaatggctgcgcatatgagaatggtacacatagacgaagaaatgggacctaagacagactctactttatccttcgacctgacattgcaacagggctctcataccaacatacacctccttgtcacaacatataatttgcgtgatgctcctgctgaaagcgtagcttatcatgcccagaataatcctccagtgcctcccaagccgcagcccaaggtgcaggagaaggcagatattcctgtaaaatctagtccacaagctgctgtcccctataagaaggatgttggtaagaccctatgccccctgtgcttttcaatcctgaagggccctatttccgacgcgttggcacatcacctgcgggaacgacatcaggtgatccagaccgtccacccggtggagaaaaagctgacatataagtgtattcattgcctcggtgtctacacatccaacatgacagcatccacgattaccctacatctggtccattgcaggggcgtcggtaaaactcaaaacggacaagacaagaccaatgcgccttcgagacttaatcagtcaccatccctggctccagtaaagaggacatatgaacagatggagtttccccttctgaagaagagaaagttggatgacgactccgactctccatcgttcttcgaggagaaacctgaggaacctgttgttctcgccctggacccaaagggacacgaggatgacagctacgaggccagaaaatctttcttaacgaagtatttcaacaagcagccttatcccactcggcgtgagattgagaagctggcggcctccctgtggctatggaagtccgatattgcctctcacttttccaataaaaggaaaaaatgtgtgagagattgcgagaaatataagcccggagtgctcctgggattcaacatgaaagagctgaataaggtgaaacacgaaatggattttgatgctgagtggctgttcgaaaaccacgacgaaaaagattcgagggtcaatgcttcaaagaccgccgacaaaaagctcaacctgggaaaagaggacgacagttcctctgattcttttgagaatctggaagaggaaagtaacgagagcggctccccatttgatcctgtgttcgaggtggaacccaagatttctaatgataacccggaagaacatgtccttaaagtgatcccagaggacgcttccgagagcgaagagaaattggaccagaaggaggacgggagcaaatacgaaactatccatctaactgaagagcccaccaagctgatgcataacgcatccgattctgaggttgaccaggatgacgttgtggagtggaaggatggagcctccccttctgagtcgggtccagggagtcagcaggttagtgactttgaggacaatacctgtgagatgaagcccggaacatggtctgatgagtctagtcaaagtgaggacgcccggtcctctaaacctgcagccaagaaaaaggccacaatgcaaggcgaccgggagcagctcaagtggaagaactcctcgtacggcaaggtggagggcttttggtccaaggaccagagtcagtggaaaaacgctagcgaaaacgatgagcggctctcaaacccccagatcgaatggcaaaattcgacaatcgactccgaggacggcgagcagttcgacaatatgaccgacggggtggccgaacctatgcacgggtctctagccggcgttaagctgagctctcaacaggcc

SEQ ID NO: 5711 - DNA, 3306 bp, Artificial Sequence
  Description of Artificial Sequence: Synthetic coding sequence
atgttccagctccctgtcaataatcttggctcgctgagaaaagctcgcaagactgtgaaaaagatcctctcagatattgggctcgagtattgcaaggagcatatcgaggatttcaaacagttcgagccaaacgacttctacctgaagaatactacttgggaggacgttggactgtgggacccgagtctgactaagaatcaagattaccgcactaagcctttctgctgcagcgcctgcccattttcgtcgaagttcttctcagcatacaagtcccatttccggaacgtgcactcagaggactttgaaaatagaatcctgttgaactgcccctactgtactttcaacgcagacaagaaaaccctcgaaacccacattaagatattccacgccccaaatgcctcggctccctcctcatcactgtcaacgttcaaagataagaacaagaatgacgggctgaagccgaagcaagctgattcggtggaacaggcagtgtactactgcaaaaaatgtacgtaccgcgacccgctgtatgaaatcgtccgcaagcacatctaccgggagcatttccaacacgtcgctgctccatacatcgccaaagccggagaaaagtccctcaatggagccgtgccgctgggatccaacgcccgcgaggaaagctccatccactgcaagagatgcctcttcatgccaaagagctacgaggcgctggtccagcacgtcatcgaggaccatgagcgaatcgggtaccaggttactgcaatgatcggtcatactaacgtggtcgtgcccagatcgaagcccctcatgctgatcgcgccgaaaccgcaggataagaaatcgatgggccttcctccgcggatcggttcgcttgcgtcgggaaacgtgcggagcctgccgagccaacagatggtcaaccgcctgtcgatcccgaagcctaacctgaactccacgggcgtgaatatgatgagctccgtccacctccagcagaacaactacggggtcaagtccgtgggacagggctacagtgtgggacagagcatgcgcctgggactcggaggaaacgcgccggtgtcgattccacagcagtcgcagtcagtgaagcagctgttgccgtcgggcaatggacgctcgtacggactggggtccgaacagcgctcccaggcccctgcacggtacagcctgcaatctgccaacgcctcctccctctcctcgggacaactcaagtcgccgtcactgagccagagccaagcgtcaagggtgctgggacagtcctcgtcgaagcctgcagccgccgccaccggcccaccgccaggcaacacgagctcaactcaaaagtggaaaatttgcactatctgtaatgaattgttcccagaaaacgtctactcagtgcacttcgaaaaggaacataaggcggaaaaggtgccggctgtcgcgaactatatcatgaagatccacaactttacgtcaaaatgcctgtattgcaatcgctacctgccgactgacaccctcctgaaccatatgctgatccacggcctgtcctgtccatactgtcggtccaccttcaacgatgtggaaaagatggcggctcacatgcggatggttcatatcgatgaggaaatgggccccaagaccgactctaccctgtcctttgacctcaccttgcagcagggaagccacactaacatccacctcctggtgaccacctacaacctgcgggatgccccggcagaatccgtcgcctaccacgcgcagaataatccgcccgtgccacctaaaccgcaacccaaggtgcaggaaaaggccgacatcccagtgaagtcgtcgccgcaggccgcagtgccgtacaagaaagatgtgggtaagaccctgtgcccactttgcttctccatcctcaagggaccgatcagcgatgctctggcccatcatctgagggagagacaccaggtgattcagactgtgcacccagtcgaaaagaagctgacctacaagtgcattcattgcctcggagtgtacaccagcaatatgactgcgtcgactatcacgctgcacctcgtccactgtcggggagtgggaaagacccaaaacgggcaggacaaaactaatgcgccttcacgactcaaccagagccctagcctggcacctgtgaaacggacctacgagcagatggaattcccactgctgaaaaaacggaagctcgacgacgactcagattcaccgtcatttttcgaggaaaagccggaagaaccggtcgtgctggcattggaccctaagggtcacgaagatgactcttacgaggccagaaagtcgttcctgaccaaatactttaacaaacagccatacccgaccaggcgcgaaatcgagaagttggcagcgtcgctttggttgtggaagagcgacatcgcctcccatttctcgaataaaagaaagaaatgcgtgagggattgtgaaaagtacaaacccggggtgctccttggattcaacatgaaggaacttaacaaggtgaagcacgagatggactttgacgccgaatggctctttgagaatcatgacgaaaaggattctcgtgtgaacgcgagcaaaaccgccgataagaagttgaacctcggaaaagaagatgatagctccagcgactcgttcgagaacttggaagaagagtccaatgagtccggatcacccttcgatccggtgtttgaagtcgaacccaagatctcgaatgacaaccctgaagagcacgtacttaaggtgattccggaggatgcatctgagagcgaggaaaaactggaccaaaaggaggacgggtccaagtacgaaactatccatctcaccgaggaaccaaccaaacttatgcacaacgcctcagattcggaggtcgaccaggacgatgtggtggagtggaaagacggagcgagcccttccgaaagcggccctggaagccaacaagttagcgacttcgaagataacacttgcgagatgaaaccgggaacttggtccgacgagtcatcgcaatctgaggacgcgagatcctcgaagccggctgccaagaagaaggccaccatgcaaggcgaccgcgagcagctgaagtggaagaactcgtcctacggtaaagtcgaaggtttttggagtaaagaccagtcccaatggaagaacgcgtcagaaaacgatgaaaggctgagcaatccgcagatcgaatggcaaaattccaccatcgatagcgaggacggcgagcaattcgacaacatgaccgacggagtcgctgaaccaatgcatggctccctcgcaggtgtgaagctgtcgtcacaacaagct

SEQ ID NO: 5712 - DNA, 3306 bp, Artificial Sequence
  Description of Artificial Sequence: Synthetic coding sequence
atgttccagttgcccgtgaacaacctgggaagtctgaggaaagccaggaagacggtgaagaagatcctgagtgacatcggcctagagtattgcaaagagcatattgaggattttaagcagttcgagccaaacgacttctatctgaagaacacaacctgggaagacgttgggctgtgggatccgtcattgaccaagaatcaggactatcgtacgaagcctttctgctgctccgcttgcccctttagtagtaagttcttctcagcctacaaaagccacttccgcaacgtgcatagcgaagattttgaaaatcgcatcttgctgaactgcccctactgcaccttcaatgccgacaaaaaaacactcgagacccacataaaaatatttcacgctccaaatgcaagcgccccctcatcctcactgtccacctttaaagataaaaacaaaaacgatggcttaaagcctaaacaggccgattctgtggagcaggctgtgtactattgtaagaagtgtacttatcgggatccactgtatgagatcgtgcggaaacatatttaccgggagcattttcagcatgtggccgccccctatatagcaaaggctggagagaagagcctcaatggggctgtcccactggggtcgaatgcacgcgaggagagcagtatccactgcaagcgttgtctattcatgcctaagtcttacgaggctctggtgcagcacgtaatcgaggatcacgagcgcatcgggtaccaggtcactgccatgattggccatactaacgtggtcgttcccaggagcaaaccactaatgcttattgcccccaagccccaagataaaaagtcaatggggttgccgcctcgcatcggctctctcgcctctgggaacgtgcggtctttgccaagccagcagatggttaacagactgtccatacctaaacctaatttgaactccaccggagtcaacatgatgagctctgttcacctgcagcaaaacaattatggggtcaagtcagtgggtcagggctactctgtggggcagagcatgcggctcggcctgggagggaacgcccccgtttctatacctcagcaaagccagtcagtgaagcagctgctgcccagcggaaatggtcgcagctatggcctcgggagcgagcagcgttcccaagctcctgccagatacagcctccaaagcgcgaatgcgtcttcactgagcagtggtcaactaaagagcccatctctgtcccagtcgcaggcgagccgcgtgttagggcagtccagctccaagcccgccgccgcagctacagggccacccccagggaataccagcagcactcagaaatggaaaatctgcaccatatgtaatgagctcttcccagagaacgtgtattccgtgcactttgagaaggagcacaaggctgagaaggtgccagccgtggcgaactatataatgaagatacacaattttacgagcaagtgtctgtattgtaacagatacctccctacagacacactcctgaatcatatgctcatccacggccttagttgtccttactgccgttccactttcaatgatgtcgagaaaatggcagctcacatgcggatggtgcatattgatgaggaaatgggacccaagaccgacagcacattaagctttgacttgaccttacagcagggctcacataccaatatccacctgcttgtgacaacctacaacctgcgggacgctccggccgagagcgtcgcttatcatgcacagaacaatccccccgtacctcctaagcctcagcccaaagtacaggagaaggcagatattcctgtgaagagcagcccacaggctgcagtgccatacaaaaaggatgtcggtaagacactctgcccgttgtgctttagcatactgaaggggcctatatcagatgcgctggcccatcacctgagggaacgccatcaggtgatccagactgtgcatccagtggagaaaaaacttacctacaagtgtattcactgcttaggcgtctacaccagtaatatgaccgcctcaacaatcaccctgcacctggtgcattgcaggggcgtcgggaaaacacagaatggtcaggacaagaccaatgccccctctaggttaaatcaaagcccaagtctggccccagtgaagcggacctatgagcagatggaattccctcttctcaaaaaacgaaaacttgatgatgactcagattcgcccagtttcttcgaagaaaagccagaggagccagttgtgctcgccctcgatccaaaaggccacgaggacgacagctacgaagctcgtaagtcgttcttgaccaagtactttaataagcaaccttatcccactcgtcgagaaatcgaaaagttggccgctagcctgtggttgtggaagtcagacatcgcctcccatttcagcaacaagagaaaaaaatgcgtgcgcgactgtgagaagtataagcccggtgtactccttggattcaacatgaaagaactcaacaaagttaagcacgagatggattttgacgccgaatggttgttcgagaatcatgacgaaaaagacagcagggttaatgcttcaaagactgcggataaaaaactcaacctcggcaaggaagatgactcctcctccgatagctttgagaatctggaagaagaatccaacgaaagcggttctccatttgatcctgtgtttgaggtcgaaccgaagatctctaacgacaatcccgaagaacatgtgctgaaagttatcccggaagatgcatccgagtccgaggaaaagctcgaccagaaggaagatggaagcaaatatgagactatacacctcacggaggagcccactaaactgatgcacaacgcgagcgatagtgaggtggaccaagatgatgtcgttgagtggaaggacggcgccagcccttccgaatccggccccggaagccagcaagtctctgacttcgaggacaacacctgtgagatgaagcccggcacgtggtcagatgagtcttcccagtccgaggacgcccggagcagcaagccagctgcaaaaaaaaaggctacgatgcagggagatcgggaacagctgaagtggaaaaatagcagctatggtaaagtggagggtttctggtctaaggaccagagccagtggaagaacgcatccgagaacgacgagcgtctgtccaatccccaaatcgaatggcagaactcaacaatagattccgaggatggagagcagtttgacaacatgactgatggagtggccgagcccatgcacggctctttagctggcgttaagctgagtagccagcaggcc

SEQ ID NO: 5713 - DNA, 3306 bp, Artificial Sequence
  Description of Artificial Sequence: Synthetic coding sequence
atgtttcagttgcctgtgaataacctcgggtcactgaggaaagcgagaaaaaccgtcaaaaagattctgtcagacatcgggttagaatactgtaaggaacatatcgaagattttaagcagtttgagcctaatgatttctatctgaagaacaccacgtgggaggacgtggggttatgggatccatccttgactaagaaccaagattaccgaacaaagcccttctgttgcagcgcttgtcccttcagttcaaaattcttttctgcctacaagtctcactttcgtaacgttcacagcgaggattttgagaacaggatcttactcaactgcccttactgcacatttaacgctgacaaaaagactctcgagacacatatcaagatctttcacgctcctaatgctagcgcccctagcagcagcctctcgacgttcaaggacaaaaataagaacgatggtctcaaacccaagcaggctgattctgtggaacaggctgtgtactattgtaaaaagtgcacatacagagaccctctgtacgagatcgtgcggaagcacatctaccgcgagcatttccagcacgttgcggccccctatatcgctaaggcgggggaaaaatctttaaacggggccgtcccactgggaagtaacgctagggaagagtcatccatacattgcaagcgttgcctcttcatgcccaagagttacgaagccctggtgcagcacgtaatcgaagaccacgagaggatcgggtatcaggtgacggctatgattggacataccaacgttgtggtgcctaggagtaagccactgatgctaatagcacctaagcctcaggataaaaagagcatggggcttcccccaagaattggatctctggcgtcgggtaacgtgaggtcattgccgagccagcagatggtgaaccgacttagtataccaaagcctaacctcaactctactggagtgaatatgatgagctcagtgcatctccagcagaacaattacggcgttaagtcagttggacagggctattccgtaggtcagagcatgcggctcggtttgggcggcaacgctccggtgtccataccacagcaatcacagtccgtcaaacagttgttgccttccggtaatgggcggtcttacgggctcgggtcagagcaaagatcacaagctcctgcccggtatagtctccagagcgccaatgcatctagcctcagctcgggccaacttaaatccccgagcctttctcagagccaagcctcccgtgtgcttgggcaaagcagttcaaagcccgctgctgcagctactggccccccaccgggaaatacatctagtactcaaaagtggaagatctgtacaatttgcaatgagctgttccccgagaatgtgtatagcgtacacttcgaaaaagagcacaaagcagagaaggtcccagcagtcgccaattacatcatgaaaattcacaatttcacctcgaagtgcctgtactgcaaccgctacttgcctactgataccttgctgaatcatatgctcatccacggtctttcttgtccctattgccggtcaactttcaacgatgttgagaagatggctgctcacatgaggatggttcacattgacgaagagatgggaccaaaaacagactcaacactttcatttgacctaacactccagcagggatctcacacaaatattcatctccttgtcacaacatacaatttgcgagacgcacccgcagagtctgtggcttatcacgctcagaacaatccgcccgtgccgcctaaaccacagccaaaagtacaggaaaaggctgatatcccagtcaagagttcgccacaagcagctgttccttacaaaaaagatgtggggaagacactatgccctctgtgcttttccattttgaagggacctatttctgacgctttagcccaccacctgcgggagaggcatcaggtcattcagactgtgcaccccgtagagaaaaagttaacttacaaatgcattcactgtttgggggtgtatacgagcaatatgaccgcctctaccattacacttcacctcgtgcactgccggggcgtgggaaaaactcagaacggccaggacaaaactaatgccccttcgagactcaatcagtctccctccctagctccagtcaaaagaacttatgagcaaatggagtttccactgctcaaaaaaaggaagcttgacgacgatagtgacagtccctccttcttcgaagaaaaaccagaggaaccagtggtgttggctttggacccaaagggccatgaagatgacagctatgaggcccggaagtctttcctgacaaaatacttcaacaagcagccatatcctacacgcagggaaatcgaaaagcttgccgcttcgctatggctgtggaagtctgacatagcgtctcacttcagcaacaagaggaaaaagtgtgttcgggattgcgaaaaatataagccaggggtcctcctgggattcaatatgaaggaactgaataaggttaagcatgagatggacttcgatgctgaatggctgtttgaaaaccacgatgaaaaagattcacgagtgaatgcatccaagaccgccgacaagaagctaaacctgggaaaggaagacgacagcagttccgacagctttgaaaacctggaggaggagtccaacgagtcaggctccccttttgatcccgtgttcgaggttgaaccaaaaatttcgaatgacaacccagaggagcatgtgctgaaggttattcccgaggatgcctctgaatccgaagagaagctcgatcagaaggaggatggctcaaagtatgagaccatccatctgacggaggagccaaccaaactaatgcataacgcctccgatagtgaggtggaccaagatgatgtggtggagtggaaagatggcgcttcaccttctgagtccgggcccggaagccagcaggtttctgacttcgaggacaacacatgtgagatgaaaccgggaacctggagcgatgagagcagtcagtccgaggacgcacggtctagcaaaccagctgctaaaaagaaggccaccatgcaaggcgatcgggagcaattaaaatggaagaattctagttatgggaaagtggaaggattttggagcaaagatcagtcccagtggaaaaatgcttctgagaacgatgaacgtctttcaaaccctcagattgaatggcagaatagtaccatcgacagtgaagacggggaacagttcgacaacatgacagatggcgttgccgaacctatgcatggaagcctggccggggtaaagctgagctctcaacaggct

SEQ ID NO: 5714 - DNA, 3306 bp, Artificial Sequence
  Description of Artificial Sequence: Synthetic coding sequence
atgtttcagttgccggttaataacttgggcagcttgcgaaaggctagaaaaacggtaaaaaaaatcctgagcgatataggattggaatactgcaaggaacacatcgaggatttcaagcaatttgagcccaatgacttttacctgaaaaataccacctgggaagacgttggtctttgggatccctccctcaccaagaatcaagattacaggacgaagcccttttgttgtagtgcctgtccattcagtagcaagtttttcagcgcctataagtcccacttcaggaacgtgcacagcgaggacttcgagaataggatcttactgaactgtccctattgcacctttaacgctgacaagaagactctggagacgcacattaaaattttccatgcgcccaatgctagtgccccctcatcgtccctgtcgacctttaaagataagaataagaacgacggccttaaacccaagcaggctgacagcgtggagcaggcagtatactattgtaaaaaatgcacctatcgagaccccttgtacgagatcgtgcggaagcatatctacagggaacacttccaacacgtggccgccccgtacatagctaaggctggagagaagtctctcaatggggctgtgccgctcggctccaatgctagagaggaatcttcaatccactgcaaacgctgcctgtttatgccaaaaagctatgaggcgctggtacagcacgtgatagaggaccatgagaggatcggctaccaggtgaccgccatgatcggccataccaatgtcgtagtgccccggagcaagcccttgatgctgatcgctccaaaacctcaagataagaagagcatgggccttcccccacgaattggctctttggcttctggcaatgtgagaagcttgccctcccagcagatggtgaaccggctgtctatcccgaagcccaatctcaattccaccggcgttaacatgatgtcttctgtccatctgcaacagaataactacggcgtaaaatccgttggacagggctactccgtcggccagtcaatgagacttggccttggaggtaatgctccggtgtccatcccgcagcagtcacaatcagtgaagcagttgttaccctccggtaatggtcggtcatatggcctgggatcagagcaaagatcgcaggcacctgcccgttacagccttcaatctgcgaatgcctcctcactgagttccgggcaattaaagagcccctcactgtcacagagtcaggcctctcgcgtgctgggacagagtagttctaaacccgcagcagcagctactggtccccccccaggtaacacttcatccacccagaaatggaaaatctgcacgatatgcaatgagctttttcccgaaaatgtctactcagttcattttgagaaggaacacaaagccgagaaagtgcccgcagtggcaaactacataatgaagatccacaactttacatctaaatgcctgtactgtaaccgctatctaccaaccgacacactcttaaatcacatgcttatacatggcctgagttgtccatactgcaggtccaccttcaatgatgtggaaaaaatggctgcacatatgaggatggtacacattgacgaggagatgggccccaagaccgatagtaccttatcgttcgatctgacattgcagcagggtagccacacgaacatacacctgctggtgaccacctataacctgcgcgatgctcctgcagaaagtgtggcgtaccacgctcagaataatcctcctgtccctcctaaaccccagcctaaagtccaggagaaggctgatatccctgtgaaaagtagtcctcaggctgcagttccgtacaaaaaggacgtcggaaagaccctgtgtcccctgtgcttttcaatactgaaagggcctatcagcgatgctctggcccatcatttaagagagaggcaccaggtcatacagaccgttcaccctgtggagaagaaactcacttacaagtgcattcactgcctgggggtttacacttccaatatgacagcaagcaccattaccctccacctcgtgcattgccggggcgtcggcaaaacacaaaacggccaggacaaaactaacgccccgagccgattaaatcagagtcctagtttggcgcctgtaaaacggacatacgaacaaatggagtttccccttcttaaaaagcggaagttggatgacgacagcgactcaccgtcgttcttcgaagagaaaccagaggaacccgtggttttggctctggatccaaaggggcacgaagacgattcatacgaggcacgtaaatctttcttgaccaagtattttaataagcagccttacccaacgagaagggaaatcgagaaactggcggcctccctctggttatggaaatctgacatcgcctcccatttttcaaacaaaagaaagaagtgcgtccgtgactgcgaaaagtacaagcccggggtattactgggtttcaacatgaaagagttgaataaggtcaagcacgaaatggatttcgatgcagaatggctgttcgaaaaccacgacgagaaagactccagagttaatgccagtaagactgctgacaaaaagttaaatctgggtaaagaagacgattctagcagtgatagcttcgagaacctggaggaggaatcaaatgaaagcggttccccttttgaccctgtcttcgaagtggagcctaaaatatctaatgataacccagaggagcatgtgttaaaggtcattccagaggacgcatccgagtccgaagaaaagctggatcaaaaggaggacggttcaaagtacgaaacgatccatctgactgaagaaccgacaaaactgatgcacaacgcatcggactctgaggtggaccaggatgacgtggttgagtggaaagacggagctagccccagtgagtcaggcccaggctcccaacaagtgtccgattttgaggacaatacctgtgagatgaagccaggaacttggagcgatgaatctagccagagtgaggacgctaggtcatcaaagcccgcggctaaaaagaaggccaccatgcagggagatcgagaacagctgaaatggaaaaatagcagctatggcaaggtggagggattctggagcaaagaccaaagtcagtggaagaatgccagcgaaaacgacgagcgcctatccaatccccagattgaatggcagaattccacaatcgactccgaggacggagagcagtttgataatatgacggacggcgtggcggaacctatgcatggtagcctagctggcgtgaagttatcgagccagcaagct

SEQ ID NO: 5715 - DNA, 3306 bp, Artificial Sequence
  Description of Artificial Sequence: Synthetic coding sequence
atgttccaactcccagtgaacaatctgggatcgttgagaaaagcgagaaagaccgtcaaaaagatcctgtcggatattggtctggaatactgtaaggaacatatcgaggatttcaagcaattcgagccaaacgatttctacctgaagaacaccacctgggaggacgtcggactttgggatccgtcattgactaagaatcaagattaccgtactaagcctttttgttgctccgcttgtccgtttagctcgaagttctttagcgcctacaagtcacattttcgcaatgtgcactcagaagatttcgagaaccggatcctgcttaactgtccatattgcacgtttaacgcagacaaaaagacccttgaaactcacattaagattttccatgcacctaatgcatctgcaccgtctagttcgctgtccactttcaaagataagaataagaacgatgggctcaaaccaaagcaagcagattcagtggagcaggcagtgtattactgcaagaaatgcacctacagggatcccctgtacgaaatagtgcgaaagcatatctatcgtgagcattttcaacacgtggcagcaccctacatcgcaaaagccggagaaaagtccctgaacggtgcagtgccactcggaagcaacgcacgtgaggaatcgagcattcattgtaagcggtgtctgttcatgcctaagtcctacgaagccttggtgcaacacgtgattgaagatcatgaacgcatcggataccaggtcactgcgatgataggacatacgaacgtggtggtgccacgtagcaaaccgctgatgctcatagcaccaaagccacaagacaaaaagtcaatggggctccctcctagaattgggtcccttgcatcaggtaatgtcagatcgcttccctcccaacaaatggttaatagactttcgattccgaaaccaaacctcaactcaaccggggtcaacatgatgtcatccgtccacctccagcaaaacaactatggagtgaagtcggtggggcagggctactcggtcggtcagtctatgcgacttggactgggtgggaacgcaccagtttccatacctcaacaatcccaatcggtgaagcaacttctcccttcgggaaatggaagatcgtacggtcttgggtcggaacagcgttcgcaggcaccagctcgttactcactgcaatcggcgaatgcatcgtcactgtcctcgggccagctgaagtccccttcgttgagccaatcccaggcatcgagagtgcttggccagtcgtcaagcaaacccgccgcagcagcgaccggacctccaccaggtaacactagttccactcaaaagtggaagatatgcaccatttgtaatgagttgtttcccgaaaacgtgtactcggtgcatttcgaaaaagaacacaaggcagaaaaggtgccggcagtcgcaaattacatcatgaagattcataactttacgagcaagtgtctgtactgtaacagataccttcctaccgatactctgcttaatcatatgctgatccacggtctgtcatgtccatactgccggagcaccttcaatgacgtcgaaaagatggccgcacatatgagaatggtccatatcgatgaggaaatgggacccaagactgactcgactcttagctttgatctcactcttcaacaaggctctcataccaatattcacctgcttgtgacgacttacaacctgcgagatgcacctgcggagtccgtcgcgtaccacgcacagaataatccacctgtccctcccaagccacagccgaaggtgcaagaaaaggcagatattcctgtgaaaagctcgccccaggctgcagtgccatacaagaaggacgtgggaaagactctgtgccctctgtgtttttcgattctcaagggtcctatctcggatgccctcgctcatcatttgcgcgaaagacaccaggtgatccaaaccgtgcatccagtggaaaagaagctgacctacaaatgtattcactgccttggagtctacacttcaaatatgaccgcctcgaccatcaccctccatctggtgcactgtcgtggtgtgggcaagacccagaacggccaggataagaccaacgccccttccagacttaatcaatcgcccagcttggcacctgtgaagcgcacttacgagcaaatggagtttccactcttgaaaaaacgcaaacttgatgacgactcagacagccctagcttttttgaggaaaaacctgaagagccagtcgtgctggctctggacccaaaggggcacgaggacgacagttacgaagcacggaaatcctttttgaccaagtacttcaacaagcagccatacccaacccggcgcgaaatcgagaagctcgcagcgtcactgtggctctggaagtccgatattgcaagccactttagcaacaaacgcaagaagtgtgtgcgggattgtgaaaagtacaagcctggagtgcttctcggatttaacatgaaggagcttaacaaggtgaaacatgaaatggattttgacgccgagtggctgttcgaaaatcatgatgagaaggactcccgggtgaatgcgagcaagaccgcggacaaaaaactgaatcttggtaaagaggacgactcgagcagcgactcgtttgagaacctcgaagaagaatcgaatgagtccgggagccctttcgaccctgtgtttgaagtcgaacctaagatatccaatgacaacccggaggaacatgtgcttaaggtgattcccgaggacgcatccgaatcggaagaaaaactcgaccaaaaggaagatggctcaaagtacgagactatccaccttaccgaggagccaaccaaacttatgcataacgcatccgatagcgaagtggaccaagatgatgtggtggaatggaaggacggcgctagcccttctgagtcgggaccaggatcgcagcaggtgtccgacttcgaggataatacttgtgagatgaagcccggaacctggagcgatgaaagctcgcaatccgaggatgcacgatcatccaaaccagcagctaagaaaaaggcaaccatgcaaggagatcgtgaacagcttaagtggaaaaacagctcatacggaaaggttgaaggtttttggtcaaaggatcagtcacagtggaaaaatgcatcagaaaatgatgagagactctctaacccacaaattgagtggcaaaacagcaccattgacagcgaggacggagaacaatttgacaatatgaccgacggggtggctgaacctatgcatgggagccttgcaggtgtcaagctgagctcccagcaggca

SEQ ID NO: 5716 - DNA, 3306 bp, Artificial Sequence
  Description of Artificial Sequence: Synthetic coding sequence
atgttccagctgcctgtaaacaatctgggaagtctccgcaaagctaggaagaccgtaaagaagatcctgagcgatataggccttgagtactgtaaggaacacattgaggatttcaagcagttcgaaccgaacgatttttacctgaaaaatacaacttgggaggacgtgggcctgtgggacccatcactcactaaaaatcaagattacaggaccaagcccttctgctgttccgcttgtccctttagcagtaaatttttctctgcatacaaaagccacttccgcaacgtgcattccgaggactttgaaaacaggatcctcctgaactgtccatactgcacgttcaacgctgacaaaaagactttggagacccacattaagatcttccatgcgccgaatgcttccgcgccctcctcctctttgtcaaccttcaaagataaaaacaagaacgacggattgaagccaaaacaggccgacagtgtggagcaagctgtgtattattgtaaaaagtgtacctatagagatccactgtacgaaatcgtaagaaagcacatttatagagagcactttcagcacgtagccgccccttacatagcaaaggcgggcgagaagtccctcaacggcgccgtgcctctgggatctaacgcccgcgaagaaagtagcatccactgcaagcgctgcttgttcatgccgaagtcttacgaggcactggtccagcatgtgatagaggatcacgagcgcatcggctatcaagtgacagcgatgatcggacatactaatgtcgtcgttcctcgctctaaaccgttgatgctgatcgcccctaagccacaggataaaaaatccatgggactgcccccgagaattggatctctcgcaagtggtaatgttcgctcactgccttcccagcagatggtcaacagactcagtattcccaagcctaacctcaatagtaccggtgtgaacatgatgagttccgtccatctgcagcagaataactatggcgttaaatccgtcggccagggctactctgttggtcaatctatgagactcggattgggtggaaatgcccctgtgtctatcccccagcaatctcaatcagtcaaacagttgctgcccagcggtaatggcagatcctacggtctgggttccgaacaacgctctcaggcgccggcgagatactccctccaaagcgctaacgccagcagcctgagcagtggccaattgaagtccccatccctgagtcagtcccaggcctctcgcgtgttgggccagtctagctccaagcccgccgcggccgctaccggacccccaccaggcaacaccagcagcactcaaaagtggaagatatgcaccatctgtaatgagctgttccctgagaacgtgtactccgtgcactttgaaaaagaacataaagctgagaaggtacctgccgtcgcaaactatatcatgaagatccacaatttcacatccaagtgcctgtactgcaatcgctacctgcctaccgacacgcttctgaaccacatgttgatccatggacttagttgcccttattgcaggagcacctttaacgacgtcgaaaagatggcggctcatatgcgcatggtgcacatagatgaggaaatgggcccgaagaccgattctaccttgtcattcgacctgaccttgcagcagggatcacacaccaacatacatctgctcgtcacaacctacaacctccgcgatgctcccgctgagtctgtggcataccacgctcagaacaatccccctgtaccccctaagccccagccaaaagtgcaggagaaagcggacattccagtcaagtcttcaccacaagcggctgtcccgtacaagaaggatgtgggtaagactctctgtcctctttgcttttctatcctgaaaggacctatttcagatgcccttgcacaccatctgcgcgaaaggcatcaggttattcagactgttcatcctgtggagaaaaagcttacatacaagtgtattcactgtctcggtgtgtacacctcaaatatgacggcttccaccataactcttcacctcgtgcattgccgcggcgtcggtaagacccagaacggtcaagacaaaactaatgcaccatctaggctcaaccaaagcccatcccttgccccagttaagaggacttacgaacagatggaattccccctgctcaagaaaagaaagctggacgatgatagtgattctccttcttttttcgaagagaagcctgaggaaccagtagtgctggccctcgacccaaagggtcacgaggatgacagttatgaagcccgcaagtctttcctcaccaagtactttaacaaacagccataccccactagaagggaaatcgagaagctggcagcctctctgtggctgtggaagtccgatattgctagtcattttagtaataagagaaagaagtgtgtcagagattgcgagaagtacaagcctggagtgctgctcggctttaatatgaaggaacttaataaggttaagcacgaaatggattttgacgccgagtggctcttcgagaaccacgacgaaaaagactcccgcgtgaacgcctccaagaccgccgataaaaagctgaatctcggtaaggaggatgattcttcctcagactctttcgaaaatttggaagaggaaagcaacgaatctggctctcctttcgatcctgttttcgaggtggaaccgaagatctctaacgacaaccctgaagagcatgttctgaaggtgatccccgaagatgcaagtgagtcagaggagaagcttgatcaaaaggaggacggctccaaatacgaaacgatccacttgacagaagagccaacgaagctcatgcacaacgcctccgacagcgaagtcgatcaggacgacgtcgtcgagtggaaagatggtgctagtccctccgaatcaggcccaggctctcagcaagtgtcagatttcgaggacaacacctgcgaaatgaagcctggaacgtggtctgacgagtcctcacagtctgaagacgccagatcttccaaacccgcggcgaaaaagaaggcaacgatgcaaggtgaccgcgagcaactgaaatggaaaaacagctcttatggaaaggtggagggcttctggtctaaggaccagagccagtggaagaatgcttccgagaacgacgagaggctcagcaacccccagatcgagtggcagaacagcactatcgattctgaggacggagagcagtttgacaacatgacagacggtgtggctgagcctatgcacggaagtcttgccggagtgaagctgtcaagtcagcaggct

SEQ ID NO: 5717 - DNA, 3306 bp, Artificial Sequence
  Description of Artificial Sequence: Synthetic coding sequence
atgttccagctgcccgtaaataacctgggcagtctccgaaaagctagaaagacagtgaaaaagatcctctctgatataggattagagtactgtaaggagcacatagaagacttcaagcagtttgagcctaacgatttttatctgaaaaatacaacgtgggaagatgttgggctgtgggatccatctttgaccaaaaatcaggactataggaccaagccgttttgctgtagtgcgtgcccttttagttccaagtttttctccgcatacaagtcacacttcaggaatgttcactccgaggactttgaaaaccgaattctactaaactgtccttactgcaccttcaatgccgataagaagactctcgaaacccatatcaaaatattccatgctccaaatgcatccgcaccgtccagcagcctttcaacattcaaggacaagaacaagaatgatggcctgaagcccaaacaggcggactctgttgaacaggcagtgtattactgcaaaaagtgtacatatcgtgatcccctgtacgagatcgtcagaaagcatatatacagggagcattttcagcacgtggcagccccttatatagctaaggccggcgaaaagtcactgaatggagctgtgcccctgggcagcaacgcacgggaggaaagcagcatccactgtaagcgctgcctcttcatgccgaaatcttacgaggccctggtgcagcatgtgattgaagaccacgagaggataggataccaagttacagcaatgattggccataccaacgtggtagtacctagatccaagccattgatgctcatcgccccaaaaccccaggataaaaagtcaatggggctgcctccaaggatcggatctctggccagtgggaatgttcgttctctaccgtctcagcagatggtgaatcgtctaagcatacccaagccaaacttgaacagtaccggtgtcaacatgatgtccagcgtgcacttgcagcaaaacaactacggagttaaatccgtcggccagggctactctgtgggccagagcatgaggctcggcctaggtggcaacgctccagtgagtattccacaacaatcccagtctgtgaaacaactgctgcctagcggaaatgggagatcatatggtctgggctccgaacagagatcccaagcacctgcccgatactcacttcagtccgcaaacgcttccagccttagcagtgggcaactgaagtccccatcactgagccagtctcaagcatctagagtactggggcaaagctcatcaaaacccgcagccgccgctactggtcctcccccaggtaacacctcttccactcagaagtggaagatttgtaccatttgtaatgaacttttccccgagaacgtctattccgtgcactttgaaaaggagcacaaagctgagaaagttcccgctgtcgccaactacattatgaagatccacaatttcacgagcaaatgcctatattgcaatcggtatcttcccactgacacattgctcaaccacatgttaatccatggcctaagctgtccctactgtaggtctaccttcaatgacgtcgaaaagatggccgctcacatgaggatggtgcacattgacgaggaaatgggcccaaaaaccgatagcacactgtcctttgacctaacactccagcagggtagtcataccaacatacatctgttggtgaccacgtacaacctgcgggatgcaccagccgagtccgtcgcataccacgcgcagaataacccacccgtaccccccaaaccgcagccgaaagtccaagagaaggctgacattccggtcaaaagtagccctcaggccgcggtgccgtacaagaaggacgtcgggaagactctttgtccgttgtgtttctctattttgaaagggccgatctcagatgcgctggctcaccacctgcgggagcgtcaccaggtgatccaaacggtccatcccgtggagaagaagctgacctacaagtgtattcattgcctcggagtctacacctctaatatgacagcgtctactattaccctgcatctggtacattgccgcggagtgggcaagacccagaacggtcaggataaaaccaacgccccctcccggctaaatcagagtccatctctcgctcctgtcaagaggacatatgaacagatggagtttccactcctgaaaaagagaaaattagacgacgactccgatagcccatcttttttcgaggagaagccggaagaacctgtggtcttggcactggaccccaagggacacgaagatgacagctatgaggccaggaagtcctttttaacaaagtactttaacaagcaaccctatcccactcggagggaaatcgagaagctggcagcttcgctgtggctgtggaagtcagacattgcatcgcacttttctaacaagcggaaaaagtgtgtgcgagattgtgagaagtacaagcccggcgttttgttgggattcaacatgaaagagctaaataaagtaaagcatgagatggacttcgatgctgagtggcttttcgaaaatcatgacgaaaaggactctcgcgtcaacgcaagtaagactgcagacaaaaagctcaacctcggaaaagaagacgattcttcctcagactctttcgaaaatttggaggaggaaagcaatgaaagtgggagtccttttgaccccgtgtttgaagtagagcctaagatctccaatgacaacccagaagaacacgttctaaaagtcatccctgaagacgcatcagagagcgaagagaagctggatcagaaggaagacggttctaagtatgagactattcatttgaccgaagaacctacaaagttgatgcacaatgcatctgattccgaggtcgaccaggacgatgtcgtggagtggaaggatggggcctcaccttccgaaagtggcccagggtctcagcaggtatcagattttgaagacaacacctgcgagatgaagccgggcacgtggtccgacgagagtagtcaaagcgaggacgcccggtcctcaaaaccagctgcgaaaaagaaggctacaatgcaaggggatagagaacagctcaagtggaagaattcctcatacggaaaggtggagggattctggtccaaggaccagagtcaatggaagaacgcctcggaaaacgacgagagactctcaaatcctcagatagaatggcaaaatagcactattgactccgaggacggcgaacagttcgataacatgacagacggggtggcggaacccatgcacggaagcctggcaggtgtgaagctaagtagtcagcaggct

SEQ ID NO: 5718 - DNA, 3306 bp, Artificial Sequence
  Description of Artificial Sequence: Synthetic coding sequence
atgttccaactgccggtgaacaatctgggatccctcaggaaggctagaaagactgtgaagaagattctgtccgacatcggtctggaatactgcaaggaacacatcgaagatttcaagcaattcgagcccaacgacttctatctgaaaaacacgacttgggaggacgtggggctgtgggatccgtcactcactaagaatcaagattaccgcaccaagcctttctgctgcagcgcctgcccgttttcgagcaagttcttcagcgcctacaaatcccatttcaggaacgtgcactcagaggactttgaaaaccgcatcctgctgaactgcccttactgcaccttcaacgctgacaaaaagaccttggaaacccacatcaaaatcttccatgctccaaacgccagcgcaccgtctagctctctttccacctttaaagacaaaaacaagaacgacgggcttaagccgaaacaagccgattccgtggaacaggctgtctactattgcaaaaagtgtacttaccgagatcctctgtacgagatcgtgcggaagcatatctaccgggagcactttcagcatgtggccgcgccgtacatcgcgaaggcgggcgaaaagagcttgaatggcgcagtgccgcttggatctaatgcccgcgaagagtcgtccattcactgtaagcggtgtctcttcatgccaaagtcgtacgaagctctggtgcaacacgtgatcgaagatcatgaaaggatcggttaccaggtcactgctatgatcggccacaccaacgtggtggtcccaagatccaagccgttgatgctgatcgccccgaagcctcaggataagaagtcaatggggctgcctccacgcatcggatcgttggcctccggaaacgtgcgctcactgccgtcgcaacagatggtcaatcgcttgtccatcccgaagcctaacctgaatagcaccggagtgaatatgatgtcctctgtccaccttcagcagaataactacggcgtcaagagcgtgggacagggatacagcgtgggccaatccatgaggctgggcctcgggggtaatgctcctgtgtccattcctcagcagagccagtcggtgaagcagcttctgccatcaggaaatggaaggagctacggactgggatccgagcaacggtcacaggcccctgcccgctactccctgcagtccgcgaacgcgtccagcctgtcatcgggacagctgaagagcccgtcactgtcgcaaagccaggcgagccgggtcctggggcaaagctcatcgaaaccggcagccgccgccaccggacctccgcctgggaacacctccagcactcagaagtggaaaatctgcaccatctgcaacgagctcttcccagagaacgtgtactcggtgcacttcgagaaagagcacaaggccgaaaaggtcccagctgtggccaactacatcatgaagatccacaatttcacctccaagtgcctctactgtaaccggtaccttccaactgacaccttgctgaaccacatgttgatccacgggctgtcgtgtccgtattgccggtccaccttcaatgacgtggagaagatggcagcccatatgcgcatggtccacatcgacgaagaaatgggccccaagactgactcaaccctgtcctttgatctgactctgcagcaaggatcgcatactaatatccacctgctggtgactacttacaatctgcgggacgcgccagccgaatcagtggcataccatgcacagaacaaccctccagtgccaccaaagccacagccgaaggtgcaggaaaaggcggatatcccggtcaagagctccccgcaggcagcggtcccttacaaaaaggacgtgggaaaaactctgtgcccactctgcttctccatcctcaaaggtcccatctcggatgctctcgcacatcatctgcgggaacggcaccaggtgatccaaaccgtgcatcctgtcgagaagaagttgacctacaagtgcatccactgcctgggcgtgtacacctccaatatgactgcatccactatcaccctgcatcttgtgcattgccgcggagtcggaaagactcagaacggacaggacaagactaacgctccctcacggctcaatcagtccccctcgctggcgcccgtgaagcggacttacgaacagatggagtttcctctcctgaagaaaagaaaactggacgacgatagcgactcgccttccttcttcgaggagaagccggaagagcctgtggtcctggccctggacccgaagggacacgaagatgactcgtacgaggcacgcaagtcgttcctgaccaagtacttcaacaagcaaccctacccgactcgccgcgaaatcgagaagctcgcggcgtccctgtggctgtggaagagcgatatcgcgagccacttcagtaacaagagaaagaagtgcgtgagagactgcgagaaatacaagcctggcgtcctgctcggcttcaatatgaaggaattgaacaaagtcaagcatgagatggatttcgatgctgaatggcttttcgaaaaccacgacgagaaggacagcagagtgaatgcgtcaaagaccgccgataagaaactgaacctcggaaaggaggacgactcatcgtcggattccttcgaaaacttggaggaggaaagcaatgagtccgggtcgcctttcgacccggtgttcgaagtggaaccgaagatctcgaacgacaacccggaagagcatgtcctcaaagtgatcccagaggacgcttccgaatcagaagagaagctggatcagaaagaggacggatcaaagtacgaaacgatccacctcactgaggagccgaccaagctgatgcacaatgcctcagacagcgaagtggaccaagacgatgtggtggaatggaaggacggagcctcgccgagcgaatcgggccccggatcccagcaggtttcagattttgaggacaacacgtgtgaaatgaagcctggcacctggagcgacgagtcgtcccaatctgaggacgcgagatcgtccaagccggctgccaaaaagaaggcgaccatgcagggggatagagagcagttgaagtggaagaactcaagctatggaaaggtggaaggcttctggtctaaagatcaaagccagtggaaaaacgcaagcgaaaacgatgagcggttgagcaacccgcaaatcgagtggcaaaattcgactatcgactccgaagatggagagcagtttgacaatatgaccgacggggtggcagagccgatgcacggatcccttgcaggggtgaaactgtcgagccaacaggct

SEQ ID NO: 5719 - DNA, 3306 bp, Artificial Sequence
  Description of Artificial Sequence: Synthetic coding sequence
atgttccaattacccgtaaataacctcgggtccttgcgcaaggcccgcaagaccgttaagaaaattttgagcgacatcgggctggagtattgcaaggaacacattgaggatttcaagcaattcgaacctaacgacttttacctgaagaatacgacatgggaggacgtgggtctatgggacccaagtcttacgaaaaaccaggattatcgaacgaaacccttctgctgctctgcctgccctttctcgagcaagttcttctcagcttataagagccatttccgtaacgtccattccgaggatttcgagaaccggatactgttaaattgcccctactgcaccttcaatgctgacaagaaaactcttgagacgcatatcaagatcttccacgcgccaaatgcttcggccccgtcaagtagtcttagcactttcaaggacaagaataagaatgatggactgaagccgaagcaggccgactccgtggagcaagcagtttactattgtaagaaatgtacatatcgtgaccctttgtacgaaattgtgcggaagcatatttatcgcgagcactttcaacacgtcgccgcaccctacattgccaaagcgggcgaaaagtcccttaacggggccgtccctttaggatcaaatgcacgcgaggaatcgagcattcattgtaagcggtgcctgtttatgccgaagtcatacgaagcccttgtgcagcacgtcatcgaggatcatgaacggatcggttaccaagtcacggccatgatcggccatactaatgtcgtagttccacggtcgaagcccttaatgcttatcgccccgaagccccaggacaagaagtctatgggcctgcccccgcggataggaagccttgcgagtggaaatgttcgttcactcccaagccagcagatggtcaataggctgtccatccctaagccgaatctgaactcaactggagttaatatgatgagctccgttcaccttcagcagaataactatggggtcaagtcagtcgggcaagggtacagtgttggacagtcgatgcggctcggcctgggcggtaacgccccagtttccatccctcagcagagccaatcggtgaagcagctattgccgtccggaaatggtaggagttatggactaggcagcgaacaaagaagtcaggcacccgcgcgctactcattgcaatctgcgaacgcctctagcctctccagtggccagctgaagtctccatctctgtcccagagtcaggcgagccgcgttctcggacaaagttcatcgaaaccagcggcggcggctaccggtccaccacctggcaacacaagctccacacaaaagtggaagatctgtactatttgcaacgagctttttccagaaaatgtgtactccgtgcatttcgaaaaagagcacaaggcggagaaggtccctgctgtcgcgaactatattatgaagatccacaatttcacctcgaaatgcctatattgcaatcgctatcttcctactgacaccctcttgaaccatatgctcatacacggattatcttgcccttactgccgctcaacatttaatgatgtcgagaaaatggccgctcacatgcggatggttcacatagacgaggagatgggcccaaagacggactctaccctgagcttcgacctcaccctacaacagggatctcacacgaacatacacctgttggttactacgtataatctgcgtgatgccccagccgaaagtgtggcttatcacgcgcaaaataacccgcccgtcccccctaagccccaaccgaaagtgcaggaaaaggccgatattccagttaagagctccccccaggcagcggttccctataaaaaggacgttggaaagacgctttgtcctctttgcttctctatcctcaaggggccgatctccgatgctctcgcccaccacttacgtgaacgtcaccaggtgattcagaccgtccatcctgtagaaaagaaactgacgtacaaatgcatccattgcttgggtgtctacaccagcaacatgactgcctccacgattacactccacctggtccattgcagaggggtcggaaaaacccaaaacgggcaagataagactaacgcgccgtctcggttgaatcaatccccaagtcttgctccagttaaaagaacatatgagcaaatggagttcccacttctcaagaagaggaaacttgatgatgatagtgactcgccgtcattcttcgaggagaaaccagaagagccggttgttctggcgctcgatcctaaggggcacgaggatgattcgtatgaagcccgaaaatccttcctgacaaagtacttcaacaagcaaccctaccctacgaggagagagattgaaaagttggcagcctccctttggttgtggaagtcggacatcgcgagccatttctctaataaacgcaagaaatgtgtcagagattgtgagaagtataagcctggtgttttgctgggctttaatatgaaagaactgaacaaggtaaaacacgaaatggacttcgatgctgagtggcttttcgaaaatcacgacgagaaggactcacgcgtcaacgcaagtaaaacggcggacaagaagctcaacttaggtaaagaggatgatagttcctcggattccttcgaaaatttggaagaagagagtaatgaatctggcagcccatttgaccccgtcttcgaggtcgaaccgaaaatcagtaacgacaaccccgaggagcacgtgctgaaagtaattcctgaggacgcgtccgaaagcgaggagaagctggatcaaaaagaagatggcagtaaatacgaaacgatccatctcaccgaggaaccgaccaagctcatgcataatgcgagtgacagcgaggttgatcaggatgacgtcgtggaatggaaggacggcgcgagtccttccgaaagcggaccagggtctcaacaagtgtctgactttgaggataatacatgcgaaatgaagcctggcacatggagcgatgaatcttcacaatccgaagacgcgcgttcaagtaagcctgcggctaagaagaaagccaccatgcaaggtgaccgtgagcagttgaagtggaagaatagtagctacgggaaggtggagggcttctggagtaaggaccaaagccaatggaagaacgcgtcggaaaacgacgaaagattgtccaaccctcagattgagtggcaaaacagtacgatcgactctgaggacggagagcagttcgataacatgacagatggggtggccgagcctatgcatggctcgctcgcaggcgtcaaactgagtagccagcaagct

SEQ ID NO: 5720 - DNA, 3306 bp, Artificial Sequence
  Description of Artificial Sequence: Synthetic coding sequence
atgttccaactaccggtgaacaatctcgggagcctgcgcaaagccagaaaaacggtgaagaagatactttctgacatcggacttgagtactgcaaagagcacatagaagacttcaagcagttcgaaccaaacgacttctacctcaaaaataccacatgggaagacgtcggcctctgggatccgagcctcaccaaaaaccaggattaccgtaccaaacctttttgctgtagtgcttgcccgttcagttcaaagttcttcagcgcatacaagagtcacttccgcaacgtacattccgaggatttcgagaatcgaatcctgctcaactgcccatattgcactttcaacgctgacaagaagaccctggagacccacatcaaaatatttcacgccccaaatgcaagcgctccttcttcatctctgtcaacgtttaaggataaaaacaagaacgatggcctgaagcccaaacaggctgactccgtggagcaggccgtgtactattgtaaaaaatgcacttaccgcgatcccctttacgagattgtgagaaagcatatttatagagagcatttccagcacgtggccgccccatacatcgccaaggccggagaaaaatctctgaatggcgctgtccccctgggttccaatgcccgcgaagagtcgtctatacattgtaagcgctgtttatttatgcccaagagctatgaagctctcgttcagcacgtcatcgaggatcacgagcgtatcggatatcaggtcaccgctatgattggacacacaaatgttgtcgtgccacggagcaagcccctaatgctgatcgccccaaagcctcaggacaaaaagagcatgggactgccaccacgcatagggtctctagcttcaggtaacgttagatctcttcccagtcagcagatggtgaacaggctgtccattcctaagcccaacttgaactccaccggcgttaatatgatgagtagcgtccatctgcaacagaacaattacggagtcaaatctgtgggccagggatattcggtgggacagagcatgagactgggcttgggaggcaacgcccctgtgtcgattccccagcagtcccagtcagtcaagcaactgctcccctcagggaacggtcgctcctacggactgggctccgagcaacgcagccaagccccggctcgttattcccttcagtcagcaaatgcgagttccctgtcgtccggacagctgaagagtcccagcctcagtcagtcacaggcgagcagagtcctgggacaaagcagctccaaaccagcagccgctgcaaccggacctccccctggcaacacatcttctacccagaaatggaaaatttgtactatttgcaatgagctgttccctgagaatgtgtattcggtgcatttcgagaaggagcataaggccgagaaggtgccagccgtagccaactacattatgaagatccacaacttcactagcaagtgtctctactgtaatcgttatctcccaacagatacattgttgaatcatatgctgatccacggactgtcatgcccatattgtagatccacttttaacgacgtcgaaaagatggctgcccacatgcgcatggtgcacatcgacgaggagatgggtccaaaaactgattcgaccttgtcatttgacttgacattgcaacaagggagtcacaccaacattcacttgctggtgactacttataatctcagagacgccccggccgaatcagtcgcatatcatgcacagaataaccccccggttccgcctaaaccgcagcctaaggtccaagagaaggccgacattcccgtcaaaagttctccccaagccgccgtgccatacaagaaagatgtgggcaagactctctgccccctctgtttctctattctgaaaggccctattagcgatgccctggcccaccacttgcgcgagcgtcaccaggttatccaaaccgtccatccagttgaaaagaagttaacctataagtgcattcactgcttgggggtgtacaccagtaatatgacagcctccactataactttacatctggtccattgccggggagttggcaagacccagaacgggcaggataaaactaatgccccctcgcgcctgaatcagtctccaagcttagcaccagtgaagcggacgtatgagcagatggagtttcccctgctcaaaaagaggaagctagacgacgacagcgatagtccctcatttttcgaagagaagcctgaggagcctgtcgtgctggctttggatccaaagggccatgaagatgattcttatgaagctaggaaaagcttcctcaccaagtattttaacaagcagccctacccaacgcgtagagaaatcgagaagctcgcagcgtctctttggttgtggaagtcggatatcgcctcacacttcagtaataagagaaaaaagtgtgtgagggactgcgagaagtacaagcctggcgtgttgctcggctttaatatgaaagagctcaataaggttaagcacgagatggattttgacgcggagtggctgttcgaaaatcacgatgaaaaggactcacgcgtcaacgcatccaaaacagcggacaagaagttaaacttaggcaaggaggatgacagttccagcgattccttcgaaaacctggaggaagaaagcaacgaatctggctcccctttcgaccctgtgtttgaggttgagcccaagatttctaacgataatcctgaggaacacgtgctgaaggtgatcccggaggatgcaagtgagtccgaagaaaaactggaccagaaagaagacggttccaagtacgagactattcatctgaccgaggagccaactaagctgatgcacaatgccagtgactctgaagtggaccaggacgacgtcgtggagtggaaggatggcgcttcacctagcgaatctggtccaggctcccagcaggtgagcgatttcgaagataatacatgcgagatgaagccagggacttggtcagatgaatcgtctcagagtgaagacgccagatcatctaaacctgctgcaaagaagaaggccacgatgcagggcgaccgagaacagctgaagtggaagaattctagctacggcaaggtggaggggttctggtccaaagaccaatcccagtggaaaaacgctagcgagaatgacgaaagactgagtaatccccaaatcgagtggcagaatagtactattgactccgaagacggagagcagtttgacaatatgaccgacggtgtcgccgagcctatgcatggcagcctcgcaggggtcaaactctcctcccaacaagct

SEQ ID NO: 5721 - DNA, 3306 bp, Artificial Sequence
  Description of Artificial Sequence: Synthetic coding sequence
atgtttcaactgccagtaaataacctgggttcccttaggaaggcgaggaaaacagtgaaaaagatcctgagtgacattggcctggaatactgcaaagaacacatcgaggatttcaagcaattcgagcccaatgatttttacttaaagaacactacatgggaagatgtcgggctttgggacccctcgttgacgaagaatcaagattatcggacaaagcctttctgttgcagtgcctgtccattttctagtaaatttttttcagcatacaagagtcacttcaggaacgtacactccgaggactttgagaaccgtattctgctcaactgtccttattgcacctttaacgctgacaagaagactctggagacacacataaaaatcttccacgctccgaacgcttccgcccccagctcatctctgtcaacatttaaggacaagaataagaacgatggactcaagccgaaacaggccgattcggtggaacaggccgtttattactgcaaaaaatgtacatatcgtgatcctctttacgagatcgtcagaaagcatatctaccgcgagcattttcaacatgtggctgccccctacatagcaaaagccggcgaaaagtctttgaatggcgcggtcccactgggctctaacgctcgggaggaatcgtcaattcattgcaagaggtgtctctttatgcccaagagctacgaagcgctcgttcaacatgttattgaggaccacgagcggattggataccaggtcacagccatgatcggacacaccaacgtcgtggttcctcgatccaaacccctcatgttgattgccccaaagccacaggataagaagagcatgggacttccaccccgaatcggtagcctggcaagcgggaacgtgcgttccctgccctcccagcagatggtaaataggcttagtatccccaagccgaaccttaactctacgggcgtgaacatgatgagctctgtacacctgcagcagaataactatggggtcaagtctgtaggacaggggtatagcgtgggccagtccatgagattaggactgggaggaaatgcgcctgtgagcattccccaacagagccaaagcgtcaagcagctgttgccgagcggtaatggccggtcatacgggttgggaagcgagcagcgtagtcaagcccccgcacgctactccctgcagtcagcaaatgccagtagcttgtctagtggccaactcaaatccccatccctgagtcagtctcaggcgagtcgggtactggggcagagctcctctaaaccggctgcagcagctaccggacctcctcctggtaacacttcaagtacgcaaaaatggaaaatttgcacaatttgtaatgagttattccctgagaatgtctattcagtccacttcgagaaggaacacaaggcggaaaaagtgcctgccgtggccaattacattatgaaaatccataatttcacttccaagtgtctctactgcaaccgttacctgccaactgacactctgctaaaccacatgctcatacacgggctgtcatgcccatactgtcgcagcaccttcaatgacgtcgagaaaatggctgcccatatgagaatggtgcatatcgacgaagagatgggacctaagaccgattcaactctgagcttcgacctgacactccagcagggaagccacacaaacattcaccttctggtgacaacgtataatctgcgcgacgcgccggcagagagcgtcgcctaccacgcccaaaataatccacctgtcccccctaagcctcaacccaaggtgcaagaaaaggcagatatccccgtaaaaagtagccctcaggccgctgtcccatataagaaggatgtgggaaagacactgtgtccactgtgctttagcattctgaaggggcccatctcagatgcattagcccaccatctgagggaacgacatcaggtgatacagaccgtgcatcccgtcgagaagaaactcacttataagtgcatacattgtcttggagtctacaccagcaacatgacagctagtaccattactctccatctcgttcattgtcgcggggtgggtaaaactcagaacggtcaggacaaaaccaacgcaccttcgcggttgaatcagtcaccttcactggccccagtcaagcgcacgtatgagcaaatggaattcccattgctcaagaaacgtaaactggacgatgatagcgattctccctccttttttgaggagaaacctgaggagccagtggtgttggcactggaccccaagggccacgaggacgattcctacgaggcgaggaagtcatttctgacaaagtatttcaacaagcaaccatatcctactcggcgggaaattgaaaaacttgcggcatcactgtggctctggaaatctgacattgccagccacttttcgaacaagcgaaagaaatgtgtgcgcgattgtgagaaatacaagccgggagtgctgttaggttttaatatgaaggaattgaacaaagtgaaacacgagatggattttgacgctgagtggctctttgagaaccatgatgagaaggactctcgagtcaatgcttctaaaacagccgataagaaactgaacctcgggaaggaggacgacagctcgagcgactctttcgagaatctcgaggaggagtctaacgaaagtggtagcccttttgaccctgtcttcgaggtagagcctaagatctcaaacgacaaccccgaggaacatgtcctaaaggtcatccctgaagacgcttcagagtctgaggaaaaactagaccagaaggaggatggaagtaaatacgagactattcatcttaccgaggagccgactaagcttatgcataatgcgagtgactccgaggtggatcaggacgatgtagtggaatggaaagatggcgcatctcctagcgaatccggacctggatcccagcaagtgtcggacttcgaggataacacatgtgagatgaagcctgggacgtggtccgacgagagctcccaaagcgaagatgctcgctcctctaagccagcagccaagaagaaggccacaatgcagggcgatagggagcagctaaagtggaaaaactctagctacggcaaagtagagggcttttggtccaaagaccaatctcagtggaaaaacgcttctgagaatgacgaaagacttagcaacccccagatcgagtggcagaactccacaattgatagcgaggacggtgagcagttcgataatatgacagacggcgttgcagagccgatgcatggtagccttgctggcgtgaagctgagtagtcagcaggct

SEQ ID NO: 5722 - DNA, 3306 bp, Artificial Sequence
  Description of Artificial Sequence: Synthetic coding sequence
atgtttcagcttccggtgaacaacctgggttcactgagaaaggctcggaaaaccgtgaagaagattctgtcagacattggtctggaatactgtaaggaacacattgaggactttaagcagtttgaacctaacgacttttatctcaagaacacgacgtgggaagatgtcggtctttgggatcctagcttgaccaaaaaccaggactacagaacgaagcccttttgttgcagcgcatgtcccttttcaagcaagtttttctccgcatacaaatcacattttaggaatgtgcactcggaggactttgaaaaccgcatcctcctcaattgtccttactgtacgtttaatgcagacaagaaaactctcgagactcacattaagatctttcacgcgcctaacgcatcggccccgagctcatcattgtcaactttcaaagacaagaataagaacgatggccttaagcccaaacaggcagactcggtggagcaagccgtgtactactgtaagaagtgcacctaccgcgatcctctgtacgaaattgtgagaaagcacatttaccgagaacatttccagcatgtggccgcaccctacatcgcaaaagcgggtgaaaagtcccttaacggcgcggtgcctctgggaagcaatgcgcgtgaggaatcatcgatccattgcaagcgttgtctgttcatgcctaagtcgtacgaggcgcttgtccaacatgtgatcgaggatcatgaaagaatcggttaccaggtgactgctatgattggccacaccaacgttgtggtgcccagatcaaaaccccttatgctgatagcgccgaagcctcaagacaagaagtcaatgggcctgccccctcgaatcggttctctggccagcggtaatgtgcgctcgctgccctctcaacaaatggtgaaccgcctgtcgatcccaaagcctaaccttaactcgactggagtgaatatgatgtcgtcggtccatctccaacagaataactatggagtgaagagcgtgggtcaaggatattcggtcggtcagagtatgcggctggggctgggcggaaatgccccggtgagcattccccaacagtcacaatcggtgaaacaattgctgccatcagggaacggaagatcatacggactgggctccgagcaaagatcgcaggcacctgctaggtactcgttgcaaagcgcaaacgcctcgtccctttcctctggtcagctcaagtctcctagcctttcccagtcgcaagcaagccgcgtgctcggacagtcctcttcaaaaccggcggcagcagcgactggacccccacccggaaacacgtcgtcaacccaaaagtggaagatttgtaccatttgtaacgagctgtttccagaaaacgtgtactccgtccattttgaaaaggaacataaggcggagaaggtgccagcagtggcgaactacattatgaaaatccacaatttcacctcaaaatgtctctattgcaacagatatttgcctactgataccctgctgaatcatatgctcatccatggcctctcctgtccatactgtagatcgacttttaacgatgtggagaagatggccgcacacatgcgcatggtgcatattgatgaagaaatgggcccgaaaaccgattcaaccctttcgtttgatttgactctgcaacaaggatcccataccaacattcacctgctcgtgacgacctacaacctgagggatgcaccggccgaatcggttgcataccatgcccagaacaacccacctgtccctcccaagcctcaaccaaaggtgcaagaaaaggccgatatccccgtgaaaagctctcctcaggcagccgtcccctacaagaaagatgtgggaaagacgctttgtccactttgtttcagcatcctgaaggggccaatatcggacgccctggcccatcaccttagagagcgccatcaagtgattcagactgtgcatcctgtcgagaaaaaactgacttacaagtgtattcattgtctgggagtgtacacgtccaacatgaccgcctcgactatcaccctgcatctcgtgcactgtaggggggttggtaaaactcagaacggccaggataagactaacgctccttctcgacttaatcaaagcccatcgctggcacctgtgaaaaggacctacgaacaaatggaattcccacttttgaagaagaggaagctggatgatgattcggattcgcctagcttttttgaggaaaaaccagaagaacccgtggtgcttgctctggacccaaagggtcatgaggatgactcctacgaagcacgaaagtccttcctgactaagtactttaacaagcagccgtaccctactagaagagaaattgaaaagttggccgcaagcctctggctttggaagtccgacattgcctcgcatttcagcaacaagaggaaaaagtgcgtgcgcgattgtgagaaatacaagccaggtgtgcttctgggatttaacatgaaggaactgaacaaagtcaagcatgaaatggattttgatgcggaatggctgttcgaaaaccatgatgaaaaggactcacgggtgaatgcaagcaagaccgcagataagaagctcaacctcggaaaggaagatgatagctcatcagattcatttgagaacctggaagaagaatccaatgaatccggaagcccgtttgatccagtttttgaggtcgagccaaagatctccaacgataacccagaagagcacgtgcttaaggtcatccctgaggacgcctcggagtcggaggagaaacttgatcaaaaggaagatggttccaagtacgaaactattcatctgactgaggagccgaccaagttgatgcataacgccagcgattcagaagtggatcaagacgatgtcgtggaatggaaggacggagccagcccatccgaatccggacctggctcgcaacaagtttcggacttcgaagataacacttgcgaaatgaagcctgggacctggtcggatgaatcgtcacagagcgaggacgccagatcctcgaagcccgcagcaaagaaaaaggccaccatgcaaggtgatcgagagcaacttaagtggaaaaacagctcttacggaaaggtggaaggtttttggagcaaagaccagagccaatggaaaaatgcatcagaaaacgacgagcggctcagcaacccccaaatcgagtggcaaaacagcaccattgacagcgaagatggagaacagttcgataacatgaccgatggagtggcagagccaatgcacgggtccttggcaggtgtgaaacttagcagccagcaagcc

SEQ ID NO: 5723 - DNA, 3306 bp, Artificial Sequence
  Description of Artificial Sequence: Synthetic coding sequence
atgttccagctccctgtgaacaatcttgggtcgcttagaaaggcacgaaagactgtgaagaagatcctgtcagacattgggctcgagtattgcaaggaacacattgaagattttaagcagttcgaacccaacgacttctatctgaagaacacaacatgggaggatgtgggcttgtgggacccttctctgacaaagaaccaagactaccggaccaagccattctgctgttcagcgtgtccatttagctccaaatttttcagcgcttacaaaagtcatttccggaacgtccatagtgaagacttcgagaatcgtatcctgctgaactgcccctattgcacctttaacgctgacaagaaaaccctggagacccacatcaagatctttcatgcacctaacgcctccgcccccagcagctctttgtccacatttaaggacaagaacaagaacgacgggttgaaacctaagcaggcggactccgtggaacaggctgtgtattactgcaaaaagtgtacctatcgagaccctctgtacgagatcgttcgcaaacacatctatagggagcatttccagcacgtggccgccccatatatcgcaaaagcgggagagaagtcgctgaatggggccgtccccctcggatctaacgcccgagaggaaagttctattcactgcaaacgatgccttttcatgcctaagtcctacgaggccctcgtccagcacgtgattgaagaccacgaacgcatcgggtatcaagtgaccgccatgatcggtcatactaacgtggtagtcccacggtctaagccgctgatgttaatcgcacccaagcctcaagacaaaaagagtatgggcctaccgcccagaataggaagcttagcatccggcaatgtgagaagcctgccctcacagcaaatggtcaataggcttagcattcccaaaccaaatcttaatagtactggagtgaacatgatgagctcggtgcacttgcagcagaataactacggggtgaaatccgtcggtcagggctatagtgtgggtcagagcatgagactggggttgggagggaatgctccagtgagtattccccagcagtctcagagcgtgaaacaattgctaccttcgggcaatggacggagttacggcctggggtctgaacagcgctctcaggctcctgctcgatactccctgcaatcagcaaacgctagctctctgtcgagtgggcagctcaagtcaccttcactgagccagagccaggcctccagggtgctcggccagagtagctctaagccagcggccgcagctacgggccccccaccaggcaataccagctcaacccagaagtggaaaatttgcacaatctgtaatgaactgttcccggaaaatgtgtacagtgttcacttcgagaaggagcataaagcagaaaaagttcctgctgtggccaactacatcatgaaaattcataatttcacgtcgaagtgtctgtactgtaaccggtatctgccgactgacaccttgcttaaccatatgttgattcacggcctgagctgcccctattgtcggtccacgttcaatgacgtcgagaaaatggccgcccatatgagaatggtgcacatcgacgaagagatgggtcccaaaaccgatagcacgctatcattcgaccttaccctccagcaaggctcacatacgaacatccacctccttgtaactacctacaatctccgcgacgccccagcagaatccgtggcttaccacgcccagaataacccgcctgtgccgcccaagccccagccaaaagttcaagagaaggccgatatcccggtcaagtcctctccgcaggcagctgtcccttataaaaaggatgtgggcaagaccctctgtccactgtgtttttcgattttgaagggccccatcagcgacgctcttgcccaccacctcagggagcgccatcaagtaattcagaccgttcatcctgtggaaaagaagttgacctacaagtgtattcactgtcttggggtgtatacctccaacatgactgcgagcactattacgctgcacctggtccattgcagaggcgtgggtaagacacagaacggccaggacaaaacgaacgctccctccagattaaatcagtccccaagtctagcccctgtgaaacggacttatgagcagatggagttcccactgttgaaaaagaggaagctcgatgacgactctgatagcccgtcctttttcgaggaaaagcctgaagagccagtcgtgctcgctttggatcctaagggccacgaagatgacagctacgaagcccgtaaatcatttctgacgaaatactttaacaagcaaccgtatcctacccgccgggaaatcgagaagctcgccgcttccttatggttatggaagtcagatattgctagccacttctccaacaagcggaagaagtgcgtccgagactgtgagaagtataaaccgggtgtacttctggggtttaatatgaaggaactgaataaggttaagcacgagatggacttcgatgctgagtggcttttcgaaaatcacgacgaaaaggattccagagtcaatgcttctaagaccgcagacaaaaaactgaacctgggcaaagaagatgattcctcaagcgacagtttcgaaaatctggaggaagagtctaacgagtccggctcaccttttgatcctgtattcgaggtggagcctaaaatctcaaacgataaccctgaggagcacgtcttgaaggtgatccccgaagacgccagcgagagtgaggagaaacttgaccagaaggaagacgggtcaaagtacgaaactatacatcttaccgaagagcctacgaaactcatgcataatgccagcgacagtgaggtggatcaggacgatgtggtggagtggaaggacggggcaagtccttcggagtccggacccgggagccagcaagtgtcagatttcgaggataatacctgcgagatgaagcccggcacatggagcgatgagagctcccagtctgaggacgccagatcgagtaagcccgctgctaagaagaaagccacgatgcagggagatagagagcagctgaagtggaaaaatagtagctacggcaaggtggagggtttctggagcaaggaccagagccagtggaagaacgctagcgaaaacgatgagcgacttagtaacccacagatcgagtggcagaactctaccattgactcagaggacggagagcagttcgacaatatgacggatggcgtcgctgagccaatgcacggtagtctggcgggcgtcaaactgtcctcccagcaagca

SEQ ID NO: 5724 - DNA, 3306 bp, Artificial Sequence
  Description of Artificial Sequence: Synthetic coding sequence
atgttccaactgccggtcaacaaccttggcagcctgcgcaaggcgcgcaaaactgtcaaaaaaatcctctcagacattggcttggagtattgcaaagaacatatagaagatttcaaacagtttgaacctaacgatttttatttgaaaaacactacatgggaggatgtcggtttgtgggatccgtcactaacaaaaaatcaagattacagaacgaagccattttgctgctcagcatgtcctttctctagcaagttttttagcgcctataaatcccacttcaggaacgttcatagtgaggattttgaaaatcgcattcttctcaattgtccgtactgtacgttcaacgcggacaaaaaaactctcgagactcatataaaaattttccatgccccaaatgcgtctgctccatcttctagcctgtccacatttaaggacaaaaataaaaatgacggccttaagccgaaacaggcagattctgtagaacaagcagtatattactgcaaaaaatgcacgtaccgggacccgttgtatgaaatcgtacgcaaacacatttacagagaacattttcaacatgtggcagcgccgtatattgcaaaagccggcgaaaaaagcctaaatggagcagttccgttgggaagtaatgctcgggaggaatcaagcattcattgtaaacgctgcctttttatgccgaaaagttatgaagctctagtacagcatgtgatcgaagatcatgaacgtattggttatcaggtcacagcaatgattggacatacaaacgtcgtagtaccgagatctaagcctttgatgctcattgccccaaagccccaggataagaaatccatgggtctccctcctagaattggtagccttgcttcaggaaatgtgcgctctcttcctagtcagcaaatggtaaatcgactcagcattccgaaacccaatcttaattcaacaggcgtaaacatgatgagtagcgtccacttacagcagaataattatggagtgaaatctgtcgggcaaggctacagtgtaggacagtctatgagactgggtttagggggcaatgctcctgtaagtattccacaacagtcccagagcgtcaaacagttactgccttcaggcaatggccgatcctatggcctgggttctgagcagagatcacaggctcctgctcgctattctctacagtcagccaatgctagctcattgtccagtggtcagttgaagtccccttctttatctcagtcacaggcttctagagtgcttgggcaaagcagctctaaaccggcagccgcagccaccggtccgcccccggggaatacgagttcaacgcagaaatggaagatttgtacaatctgtaatgaactgtttcctgaaaacgtgtattcagtgcattttgaaaaggaacataaggctgaaaaagtgccggcagtagcgaactatattatgaaaatccacaattttacatctaaatgtttatactgcaataggtatttaccgacagatacacttctcaatcacatgttaattcacgggctgtcatgcccgtactgccgctccacctttaatgatgtagagaaaatggcagcgcatatgcggatggttcatattgatgaagaaatgggaccgaaaacagacagcactttgtcttttgacttaactttgcagcagggctctcatacaaatatccacctgctggtgacaacgtataatctgagagatgcaccggcagagtccgtggcttatcatgcacagaacaatcctccagttccaccaaagccgcagccgaaagttcaagaaaaagctgatatcccggtcaagtcaagcccacaagctgccgttccatacaagaaggatgttgggaaaacgctgtgtccattatgcttttctattcttaagggaccgatcagtgacgctcttgcgcaccatctgcgggaacgccatcaagtcattcaaacagtacatcctgtcgagaagaagcttacttataagtgtatccactgcctcggagtttatacttcaaacatgacagctagcactataacgcttcacttagtacactgccgaggagtggggaaaactcaaaatgggcaggacaaaacaaacgctcctagccggcttaatcagagcccttcactcgcgcctgttaaaaggacgtatgaacagatggaatttcccctgcttaagaaaagaaaattagatgacgattctgactctccaagtttttttgaagaaaaaccggaagaaccggtggttcttgctttggatcccaagggacatgaagatgactcttatgaagccagaaaatcttttcttacaaaatatttcaacaaacagccttaccctactcgtcgtgaaattgagaaactggcagcaagcctctggttgtggaaatcggatatcgcctcgcatttttcgaataaacgtaaaaaatgtgtgcgggactgtgaaaaatataagccgggtgtgttgcttggcttcaatatgaaagagttaaataaggtcaaacatgaaatggattttgatgcagaatggttatttgagaatcatgacgaaaaggactcacgggttaacgcctcaaaaacagcggataaaaaactaaatctcggcaaagaagacgactcctctagcgatagcttcgaaaacctagaggaagaatcgaacgaatcaggatcaccttttgatccggtgtttgaagtcgaaccgaagatatcaaatgataaccctgaagagcacgtgttgaaagttattcccgaggatgctagcgaatcagaggaaaaattggatcagaaagaagacggctctaaatacgagactattcatcttaccgaagaaccgacgaagctgatgcataacgcgtcggacagcgaagtagatcaagatgacgtcgtcgaatggaaagatggggctagtccgtctgaatcgggcccgggatctcaacaagtgagcgatttcgaagacaatacctgtgaaatgaaaccgggtacgtggagcgatgaatcttcccaaagtgaggatgctcggagttcaaaaccggctgccaaaaagaaagcgactatgcagggagaccgcgagcaactgaaatggaaaaattcatcctacggaaaagtagaaggattttggagtaaagaccagtctcagtggaagaacgcttcagagaacgatgaaagattgtcaaatccacagatcgaatggcaaaattcaaccatagatagtgaagacggtgaacaatttgataacatgacagacggtgtcgcggaacctatgcatggcagtcttgcgggcgtaaagttatcttcacaacaggct

SEQ ID NO: 5725 - DNA, 3306 bp, Artificial Sequence
  Description of Artificial Sequence: Synthetic coding sequence
atgttccagctccccgtgaataacctggggtcactgcgcaaggctcggaaaaccgtgaagaagattctgtcggacatcgggctcgaatactgcaaggaacacattgaggactttaaacagttcgagccaaacgacttctaccttaagaacaccacttgggaagatgtgggactctgggatccgtcgctgaccaagaaccaggattaccggaccaagcccttttgctgctcggcttgtccgttctcgagcaaattcttctcagcatacaagtcgcacttccggaacgtccactccgaggacttcgagaaccggatcctgttgaactgcccatattgcaccttcaacgccgacaaaaagaccctggaaacccacatcaaaatctttcatgctccaaacgcgtcagccccttcctcctcactgtcgacgttcaaagataagaacaaaaacgacggactgaagcctaaacaagccgactccgtcgagcaggccgtgtactactgcaagaagtgtacgtatcgtgatccgctctacgaaatcgtgcggaagcatatctaccgggagcacttccagcatgtggccgccccttacatcgctaaggcgggcgagaaatcccttaatggagcagtcccactggggtcgaacgcacgggaagagtccagcatccattgcaagcgttgcctcttcatgcccaaatcctacgaagcgctggtccaacatgtgattgaggaccatgaaagaatcggataccaagtgactgccatgattggacacactaacgtggtggtgcctagatccaaaccactcatgcttatcgcccctaagccccaggataagaagtcaatgggcctgcctccgcgcatcggctcactcgcgtccgggaacgtcaggtccctcccatcacaacaaatggtcaatcggctgtccatcccgaaaccgaacctcaactcgactggtgtgaacatgatgagctctgtgcacttgcagcaaaacaactacggagtgaagtctgtggggcagggttactcggtgggccagtcgatgagattgggtctgggcggaaacgcgccagtgtcgataccgcaacagtcccaatccgtgaaacaactgctgccatcaggaaatggacgcagctatggtctgggaagcgaacagcgctcgcaggcgccagcccgctactcgctgcagtcggctaacgcatcgtcgctgtcgtccgggcaactgaagtcaccaagcctgtcccagtcacaggcctcaagagtgctgggacagtcatcctcgaagccagccgccgccgccactggtcctccgccaggaaacaccagctcaactcagaaatggaaaatctgcactatttgtaatgaactttttcctgagaatgtctattccgtgcacttcgaaaaggaacacaaggccgaaaaggtgccggcggtggccaactacattatgaagatccacaatttcacttccaagtgcttgtactgcaacagatacttgcctactgatactctcctcaaccatatgttgatccatggcctgtcttgtccgtactgtcgctcaactttcaatgatgtggagaaaatggcggctcacatgaggatggtgcatatcgatgaggagatgggcccgaaaacggatagcaccctcagtttcgatctgacgctccaacagggatcgcacaccaacatccatttgctcgtgactacttacaacctccgcgatgccccggccgagtcggttgcctaccatgcacagaacaaccccccggtgccgcccaagccgcagccaaaagtccaagaaaaggcagacatcccagtgaagtcgtcaccccaggctgcagtgccatacaagaaggacgtcggaaagaccctctgccctctgtgtttctccatcctgaagggtccgatctcggatgctctggcccatcatctccgggagcgccatcaagtgatccaaactgtccatcctgtggagaagaagctgacttacaaatgtatccattgtctcggggtgtacacgtcgaacatgactgcctccactatcaccctgcatctggtgcattgccgcggcgtcggcaaaacccaaaatggccaggacaaaaccaacgcgccgagcagactgaatcagtcaccgagccttgccccggtgaagcgcacctacgaacagatggaatttccactgttgaaaaagcgaaaactcgatgacgactccgattccccgtcgttttttgaggaaaagccagaagagccggttgtgttggccctggacccgaagggacacgaggatgactcgtatgaggctcgcaaatccttcctgaccaagtacttcaataagcagccatacccgaccagacgcgagatcgaaaaactggcggcgagcctgtggctctggaagtccgacatcgcttcccacttcagcaacaaaagaaaaaagtgcgtacgagactgcgagaaatacaagcccggtgtgctgttggggtttaacatgaaggagctcaacaaagtcaagcacgagatggactttgacgcggaatggctctttgagaatcacgacgagaaggactcccgggtgaatgcgtccaagacggctgataagaaactgaacctcgggaaggaggatgatagctcttcggacagcttcgagaacctggaggaggaatcgaacgagtcgggatccccgttcgacccggtgtttgaagtggagccgaaaatcagcaatgacaacccggaggaacatgtgctcaaggttatcccggaggacgcgagcgaatcggaggagaagctggatcagaaagaagatggcagcaagtacgagactatccatctgaccgaagagcctactaagttgatgcacaacgcttccgattccgaagtcgatcaggacgacgtggtcgaatggaaggatggagcctcaccttccgagtccggtcctggttcccagcaggtgtcagactttgaggacaacacgtgcgagatgaaaccaggaacctggtccgatgaaagctcgcagtctgaagatgcccggtcaagcaaaccggccgcgaagaagaaagcaactatgcagggagatagggaacagctgaaatggaagaactcatcttatggcaaggtggagggattctggtccaaagaccagtcccagtggaagaatgcctcggagaacgatgagcggctgtccaatccacagattgagtggcagaactcaactatcgactcagaggatggagagcagttcgacaacatgaccgatggggtggctgagcctatgcatggctcgctcgccggggtcaaactgtcgtcacaacaagcg

SEQ ID NO: 5726 - DNA, 3306 bp, Artificial Sequence
  Description of Artificial Sequence: Synthetic coding sequence
atgttccagttgcccgtgaacaatctcggctcccttagaaaggctagaaaaacggttaagaaaatcctgtcggatatcggcctggaatactgcaaggagcatattgaggactttaaacagtttgaaccaaacgatttctaccttaagaacactacttgggaagatgttggtctgtgggatccgtcgctgacgaagaatcaggactaccggaccaaacccttctgttgctcggcatgcccattctcgtcgaagttcttctccgcttacaaatcgcacttccggaatgtgcactcggaagattttgagaacaggattctgctcaattgcccgtactgtaccttcaacgctgataagaaaaccttggaaactcacattaagatcttccacgcgccaaatgcctccgcgccgtccagctcgctcagcaccttcaaagacaagaataagaacgatggattgaaaccgaagcaagcagactcagtcgaacaggccgtgtattactgcaagaaatgcacctaccgggacccattgtacgaaattgtgcggaaacacatctatcgggagcatttccaacacgtggcggccccatacatcgctaaggcgggagaaaaaagcctgaatggagccgtgcctttgggaagcaatgctagggaagaatcctcgatacattgtaagcggtgcctgtttatgccaaaatcctacgaggccctcgtgcagcatgtcatcgaggaccacgaacgcatcggataccaggtgactgccatgatcggacataccaacgttgtggtcccacgcagcaaaccgctcatgttgatcgcccctaagccgcaggacaagaagagcatgggcctgcctccgcgcatcggcagcctcgcatcaggaaatgttagaagcctgcccagccaacagatggtcaaccgcctgtcgatcccaaagccgaaccttaactcgaccggcgtgaatatgatgtcgagcgtccaccttcagcagaataactacggagtcaagtcggtcggccaggggtactcggtcggacaatcaatgagactgggtctgggaggcaatgctccggtgtccattccgcagcagtcacaaagcgtgaagcaactgctcccgtcaggaaatggcaggtcgtatgggctggggagcgaacagaggtcccaagcccctgctaggtactcacttcagtccgctaacgcctcgtcgctgtcgtcgggacaactgaagtcaccgtcgctctcccaatcgcaagcgtcaagagtcctggggcagtcatccagcaaaccagcggcggctgcaactggaccgccgcctggtaacacctcgtctacccagaagtggaagatctgcactatctgcaacgaattgtttccagagaacgtgtacagcgtgcattttgagaaggagcataaggcggaaaaagtcccggcagtggccaactacatcatgaagatccataactttacttcgaagtgtctgtactgcaacaggtacctgccgactgataccctgcttaaccatatgctgatccacggcctcagctgcccgtactgcagaagcaccttcaacgacgtggaaaagatggcagcacacatgcgcatggtgcacatcgacgaagaaatgggccccaagaccgactccaccctgtcgttcgacctcactctgcagcaaggatcccacactaacatccatctgttggtcacgacctacaacctgcgtgatgctccggcagagtccgtcgcttaccacgctcaaaacaacccacccgtcccgccgaaacctcaaccaaaggtgcaagaaaaggcagatatccctgtcaagtcatccccgcaagccgccgtgccttacaaaaaggacgtgggcaaaactctgtgcccgctctgcttttcgatcttgaaggggccaatctcggacgctctggcccatcatctgcgggagcggcaccaagtgatccagacggtgcacccggtggagaaaaagctcacctacaagtgcatccactgtctgggggtgtacacttcgaacatgactgcctccaccattactctgcatctcgtgcattgtcggggcgtcggaaagactcagaacgggcaagacaaaaccaatgccccatcgaggctgaatcaatccccctcactggctccggttaagcgcacctacgaacagatggagttcccccttctgaagaaacggaagctcgacgacgactccgattcgcccagctttttcgaggaaaaacccgaagagccagtggtgctcgcccttgacccgaagggacacgaggacgattcgtacgaggctagaaagtcctttttgactaaatacttcaataagcagccataccctacgcgacgagaaattgaaaagttggcggcatccctctggctctggaaatccgacattgcgtcacacttctcgaacaagaggaagaaatgcgtgcgagactgcgaaaagtacaagccaggtgtcctgctgggatttaacatgaaggaactgaataaggtgaagcacgagatggacttcgatgctgaatggctcttcgaaaaccacgatgaaaaggactcccgcgttaatgcatcaaagactgctgataagaagctcaacctcgggaaggaagatgacagcagctccgactccttcgagaatcttgaagaagaatctaacgaatctggctcgccatttgacccagtttttgaagtcgagccaaagatctcaaatgacaacccggaagaacacgtgctgaaggtgatcccggaggacgcttccgagtccgaggagaagctggatcagaaagaagatggatcgaaatatgaaaccatccacttgaccgaagagcccaccaagctcatgcataacgcatccgattcagaggtggaccaggacgacgtggtggaatggaaagacggtgcctccccttctgagtccggcccgggatcccagcaagtgtcagacttcgaagataatacttgtgagatgaagccgggcacttggagcgatgaatcgagccagagcgaagatgctcggtcaagcaagcctgccgctaagaaaaaagcaacgatgcagggagacagagagcagctcaaatggaagaactcctcatatggaaaggtggagggtttttggtcaaaggatcagtcccagtggaagaacgcctcagagaacgacgagcgtctgagcaatccgcaaatcgagtggcagaactccactatcgatagcgaggacggtgaacagttcgataacatgaccgatggagtcgccgagccaatgcacggaagcctcgccggggtgaaactgtcctcacagcaggcc

SEQ ID NO: 5727 - DNA, 3306 bp, Artificial Sequence
  Description of Artificial Sequence: Synthetic coding sequence
atgttccagttacccgtgaacaacctgggctctttgaggaaggcccgaaaaaccgtgaagaaaattctgtccgacattgggttggaatactgcaaggaacatattgaggatttcaagcagttcgaaccaaatgatttctacctaaagaataccacctgggaggatgtcggcctgtgggatccgagcttgacaaaaaatcaggactatcgtaccaagccgttttgttgctcggcatgccctttcagctctaagtttttttctgcttacaaatcccatttcagaaatgtgcattccgaggacttcgaaaatcgcatcttactcaattgcccttactgtacctttaacgcagataaaaagacgctcgagacacatatcaagatattccatgcaccaaacgcttccgccccctctagcagcctgagcacattcaaagataagaacaagaatgatggtctcaaaccaaaacaagccgactcagtagagcaggctgtgtattattgcaaaaaatgtacctacagagaccccttatacgagatcgtaaggaagcacatctaccgcgagcacttccagcacgttgccgccccctacatagcaaaggccggcgagaaaagcttgaatggagcagtgccgctgggcagcaatgcaagagaggaatccagcattcattgcaagaggtgcctgtttatgccaaagtcttatgaggctctcgttcagcatgtgatcgaggatcacgaaaggattggataccaggtaactgccatgataggccacactaatgtagtcgtgcccaggagcaagcccctgatgctgatcgcacctaaacctcaggataaaaagagcatgggtctccccccccgcatcgggtctctcgcatccgggaacgtgcgctcattgccgtcacagcagatggtgaacaggttgagtatcccaaagccaaatctaaactcaaccggtgtaaatatgatgagtagcgtgcatttgcagcaaaataactacggtgttaagagcgtgggtcaaggttattcagtagggcaatcaatgagactgggactgggtggtaatgctccagtctctattccccagcagagccagtccgtcaaacagctgttgcctagtgggaacggacggtcatacgggctggggagcgagcagcggtcccaggcccctgcccgctacagtctgcagtccgcaaacgcatccagcctgtcctcgggtcagctgaagtccccttcacttagccagtcgcaggccagccgcgtgctcggccagagcagctcgaaacctgctgcggcagcgactggaccgccgccaggaaacacaagctccacacagaagtggaagatttgtactatttgcaacgagctcttcccggagaacgtgtatagcgtgcactttgaaaaggagcataaagctgagaaggttcctgcggtagctaattatataatgaagattcacaatttcacctcgaaatgtttatattgtaacagatacctgcctaccgacacgttacttaaccatatgttgatccacggattgagctgcccctactgtagatcgacttttaatgatgtggagaagatggcggcacacatgagaatggtgcatattgacgaggaaatggggccaaaaacagacagtacccttagtttcgaccttacactgcagcagggctcccataccaatatccacctgctagtgacaacatacaacttacgcgatgctcccgccgaaagcgtggcttaccatgctcagaacaacccaccagtgcctcctaagccccagcccaaggtccaggaaaaggcagatatcccggtgaagtctagcccgcaggcagctgtgccgtataagaaagatgtgggaaagacactttgtcctctgtgctttagtattctgaaaggcccaatttctgatgctctagcacaccaccttagggagcgccaccaagtgattcagacggtgcatcccgtcgaaaaaaagctcacgtacaaatgtatccattgcttgggcgtgtacacgagcaatatgaccgcttccactataactctccacctggtgcactgtcggggcgtgggtaagactcaaaatgggcaggataagaccaacgcaccaagccgcctgaatcaaagtccttcactggcccccgtgaagaggacctatgagcagatggaatttccactcctgaaaaaaaggaaattggacgacgattcagattctccttcctttttcgaagaaaagccagaagagcctgtggtcctggcccttgaccctaagggccatgaggatgacagttatgaggcccgtaagtcgtttctgacaaaatacttcaataagcagccctatcctacccgtcgcgaaattgaaaaactggccgcctcactctggctgtggaagtcagatatagcatcacattttagcaataaaaggaaaaagtgcgttcgcgattgcgagaagtataaacccggggtgctgctcggcttcaacatgaaggaactgaacaaagtgaagcatgaaatggatttcgacgctgaatggctattcgaaaaccacgatgagaaggactcccgcgtaaacgcctcgaagaccgccgacaaaaagctgaatctcgggaaggaagacgacagttcttcagactcctttgagaatcttgaagaagaatcaaacgagtccggttcaccattcgatccagtgttcgaggtagagccaaaaatttccaatgataacccagaggagcatgtgctgaaagtgatccctgaagacgcctcagagtctgaggagaaattggaccaaaaagaggatggatccaaatatgagactattcatctaactgaggaacctacaaaactgatgcacaacgcatcagactccgaggtagatcaggacgacgtcgtggaatggaaagacggcgcctccccgtccgaatctggcccagggtctcaacaggtgagtgactttgaggacaacacttgtgaaatgaagccaggtacatggtcagatgagtcatcccagtccgaagacgcccggagttccaagcctgcggccaagaaaaaggctacaatgcagggagaccgcgagcaactaaaatggaagaactccagctatggcaaagtggagggtttctggtccaaagaccaaagtcaatggaaaaatgccagtgaaaatgatgagcgcctttccaaccctcagatcgagtggcagaattctacaattgactccgaggacggcgagcagttcgacaacatgacagacggggttgccgagccgatgcacggcagccttgccggcgttaagctctcttcacagcaggca

SEQ ID NO: 5728 - DNA, 3306 bp, Artificial Sequence
  Description of Artificial Sequence: Synthetic coding sequence
atgttccaactcccagtgaataacctaggctccctaaggaaagctaggaagacggtgaagaaaattctcagcgacatcggtctcgaatactgcaaggaacacatcgaagacttcaaacaattcgagcctaacgacttttacctgaagaacaccacgtgggaggacgtaggactgtgggatccatctctcacgaagaaccaggactatcgcactaagccattctgttgctccgcgtgccctttcagcagtaaattttttagtgcgtataagtcccacttccgcaatgtgcactcggaggatttcgagaaccgtatcctgctgaactgtccctactgtacgtttaacgccgacaagaaaacactggaaacgcacataaaaatctttcacgctcctaatgcaagcgcgccctcgtcatctctcagcacttttaaagataaaaataagaatgatggcctgaaacctaaacaggctgatagtgttgagcaggccgtatattactgcaagaagtgtacgtaccgtgacccattatacgagattgttcgtaaacacatatatcgagagcacttccagcatgtggccgccccgtatattgccaaggctggcgaaaaatcgttaaacggagccgtcccactggggtccaatgctcgagaagaaagctctattcactgcaagcgctgcctgtttatgcccaagagctatgaagctttggttcagcacgtgatagaagatcacgagcgtattgggtaccaggtcaccgcgatgatcggccataccaacgtggtggtgccccgatcgaaacccctgatgctgattgcacctaaaccccaggataagaaatctatgggactgccgccgagaattggctccctggcatctggaaacgtgcgttctcttccatctcaacagatggtcaaccgcctctctatccctaagccaaatctaaactcaaccggcgtaaacatgatgtcatcagttcatctccagcagaataactacggcgtgaaaagtgtcggtcagggctactcagtagggcagagcatgagactgggcctaggcggtaatgcacctgtatcaatcccacaacagtcacagtctgtgaagcagttgcttccttccgggaatggccgttcatacggtctgggaagtgagcagcggtctcaggccccagcgcgctactctctgcaatccgcaaacgcctctagtttgagctccggccagttgaagtcgccaagcctttcccagtcccaggcatcacgcgtgctcggacaaagctcgagcaagcccgccgctgctgcaacaggaccgccgcctgggaacacctcttctacccagaagtggaaaatatgcactatctgcaatgagctgtttccggagaacgtatattccgtccattttgaaaaggagcacaaggccgagaaagtgcctgctgttgctaattatatcatgaagatccacaatttcacaagcaaatgcctgtattgtaataggtatctacccacggataccctgctgaaccatatgttgatacacgggctcagctgtccatactgccggtccaccttcaacgatgtggaaaagatggccgcgcacatgcgcatggtacacattgacgaggagatgggaccgaagactgactcaaccctgagcttcgacctaactttacagcaggggagccatactaatatacacctcctcgtcaccacctacaacctgagggatgccccggccgaatccgttgcatatcacgcccagaataaccccccagtgcctcccaaaccacagccgaaagtccaggagaaagccgacattccggtgaagtcttctcctcaggccgctgtcccctacaaaaaggatgttggcaagaccctgtgtccattgtgtttctcaatccttaagggtccaatcagtgacgcactggcacaccacttaagagagaggcatcaggtgatacaaacagtccaccccgtggagaaaaaacttacatacaagtgcatccattgtctgggcgtgtacacttccaacatgacggcgagcaccataaccctccacctcgtccattgccgaggcgtgggcaaaacgcagaatgggcaggacaagacaaacgcaccttccaggctgaaccagagccctagcctggcccctgttaaacggacctatgagcaaatggagtttccgctgcttaagaaaaggaaactggacgatgatagcgactctcctagtttctttgaagaaaaaccagaggagccagtggtcctggccctagacccgaaggggcacgaagacgacagctacgaggcaaggaaatcctttcttacaaagtattttaacaaacagccttatccaactcggcgagagattgagaagctcgcggcgagcctttggctatggaaatcagacattgccagccacttttctaacaaacgaaaaaagtgtgtgagggactgtgagaagtacaaaccaggagtcttgctgggcttcaatatgaaagaactaaataaagttaagcatgagatggatttcgatgcggagtggctgttcgagaatcatgacgagaaggactcacgtgtcaatgctagtaaaacagccgacaagaagctaaatctcggaaaagaagacgacagcagctccgatagtttcgaaaacctcgaagaggagtcgaacgaatctggctctcctttcgatccagtgttcgaggtggagccaaagatatcaaacgacaacccagaagaacacgtgctcaaggttatccctgaagatgctagtgagagcgaggagaagcttgatcagaaagaggatgggtcaaagtacgagacgatccatctgaccgaagaacccacaaaactgatgcataatgcttctgattccgaagttgaccaggacgacgtggtggaatggaaggatggggcctctccctccgagtccggacctggaagtcagcaggtgtctgacttcgaagacaacacctgtgagatgaagcctggaacatggtctgatgaatccagtcagagcgaagacgcacggtccagcaaacctgccgcgaaaaaaaaagcaacaatgcagggggatcgcgaacagctgaaatggaagaatagctcctatgggaaggttgaaggcttttggagcaaggatcagagtcaatggaagaatgcttcagaaaacgacgagagactgtctaacccacaaatcgagtggcagaattcgactatagattctgaggatggagaacaatttgacaacatgaccgatggcgtggcagagccaatgcatggcagcttagcaggcgtgaagctgtcgtcccagcaagcc

SEQ ID NO: 5729 - DNA, 3306 bp, Artificial Sequence
  Description of Artificial Sequence: Synthetic coding sequence
atgtttcagctgcctgtaaataacttaggcagcttgcgcaaggccagaaagactgtcaagaagatcctctccgacatcggactggagtactgcaaggaacatatagaagatttcaagcagttcgagccgaacgacttctatctaaagaacaccacctgggaagacgtgggactgtgggacccttccctgactaaaaatcaggactataggaccaaaccattctgctgctcagcatgtccattttcttccaagttcttttccgcgtataagagccacttcaggaatgtgcactccgaagacttcgagaataggattctgctcaactgcccctattgcactttcaatgccgataaaaaaactctggaaacccacatcaagatctttcacgcaccaaatgcctctgcccccagctcttccttgtcaacctttaaagacaaaaacaagaacgatgggttgaagccaaagcaggccgatagtgtggaacaggccgtttattattgtaagaaatgtacgtatcgggaccctctctatgagattgtccgcaaacacatttaccgcgaacattttcaacacgtggcggctccctatatagctaaagccggggaaaaaagtttaaatggtgctgtgccactcgggtctaatgccagggaggagtctagcatccattgtaagcggtgtctgtttatgccaaaatcctacgaagctttagtgcaacacgtcattgaagatcacgagagaattggatatcaggtgactgccatgatcggtcatacaaacgtagttgtcccccggtctaagccgctcatgctgattgctcccaaacctcaggacaagaagagcatggggctcccaccccgtatcgggagcctggcaagtggaaacgtcaggtctctgccaagccagcaaatggtgaatcgcctaagcataccgaaacccaatttaaacagtaccggcgtgaatatgatgagcagcgttcacttgcagcaaaataactacggcgtcaaatcagtgggccagggatatagcgttggccagtcgatgcgactcggtcttgggggaaacgctccagtgtccataccccagcaatctcagagtgtgaaacaacttctgccaagcggaaacggcagaagttacggactgggctctgagcagcgctcgcaagctccagcgcgctattccctgcagtctgctaacgcaagtagtctttcgagtggacaactgaagtctccaagtttgagccaatctcaggccagccgggtgttgggacagtcctcatctaagccagccgctgctgccaccgggccgccgcccggcaatacatccagcactcaaaagtggaagatttgcactatctgcaacgaactgttccccgagaatgtttactccgtgcactttgagaaggaacataaagccgagaaagtgcctgctgtggccaactacatcatgaagattcataatttcaccagtaaatgtctttactgcaaccgatacctgcctactgatacccttctgaaccatatgctgatccatggtctgagctgcccttattgcagatcaacttttaacgatgtcgagaaaatggccgcgcacatgcggatggtccacatagatgaggagatgggtccgaagactgactcaaccttaagcttcgacttaaccctgcagcaagggtcccataccaacattcacctcctggttactacttataacctgcgggacgcaccagcagagtcagtggcataccacgctcagaacaacccccctgttcctccaaagcctcagcctaaggttcaggagaaagctgatatacctgtgaaaagtagccctcaggccgctgtgccttataaaaaggacgtgggaaaaacactgtgccccctgtgtttctcaatcctcaagggacccatttctgacgcactcgctcatcatctgcgtgaacgtcatcaggtgattcagacagtgcaccccgtggagaagaaactcacttacaagtgtatccattgcctgggggtgtacactagtaatatgacggcctccacaataacgctgcatctcgtacattgtagaggagtggggaaaacacagaatggtcaggataagacgaatgccccttcacggctcaaccagtccccctctttggcccctgtaaaaagaacctatgaacagatggaatttcctttgctgaagaagagaaagctggacgacgactccgacagcccttctttcttcgaggagaaaccagaggagccagtcgtgctggccctggaccctaaagggcacgaggacgactcctacgaggcccgcaagtcctttctcacgaaatactttaacaagcagccctatccgacaagacgggagatcgaaaaacttgccgccagcctttggctgtggaagagtgatattgcttcccactttagcaacaagagaaaaaagtgtgtgcgggactgtgagaagtacaagcccggcgtactgcttggattcaacatgaaggaactgaacaaagtgaaacatgaaatggatttcgacgcagagtggctgttcgaaaaccacgacgagaaagattcaagagtgaatgccagcaagaccgcagataagaaacttaatttgggcaaagaagatgactcttcctccgattctttcgagaatttggaggaagagtcaaacgagtcaggtagtccatttgatcctgtgtttgaggtggagcctaagatcagcaacgacaatcccgaagagcacgtgttgaaagtgattcctgaggatgcaagtgagagcgaggagaagttggatcagaaagaggatggtagtaaatatgaaacgattcacctgaccgaggagcctaccaaactgatgcataatgcatccgatagtgaggtggaccaggacgatgtcgtcgagtggaaagacggtgctagtccgagtgaatccggccctggctcccagcaggtgtccgatttcgaggacaacacttgcgagatgaagccaggaacctggtcagacgagtcatcccaaagtgaggacgccaggtcctctaagcccgccgctaagaaaaaggcaaccatgcagggggacagagaacagctgaagtggaagaattctagctacggcaaagtcgaaggcttctggagcaaggaccagagccagtggaagaatgcgtccgagaacgatgagagattaagcaatccacagatcgaatggcagaatagcacaattgactctgaagacggcgagcaatttgataacatgaccgatggagtcgcggagcctatgcacggctcactggcgggagttaagctgtcgtctcagcaggcg

SEQ ID NO: 5730 - DNA, 3306 bp, Artificial Sequence
  Description of Artificial Sequence: Synthetic coding sequence
atgtttcagcttccagtgaataatctgggcagcctgcgtaaggcaagaaaaactgtgaagaagattctgtcagatataggacttgaatactgtaaagaacatatcgaggactttaagcaattcgagccgaacgatttctacctcaagaacactacctgggaggacgtcggtctgtgggacccatccttgaccaaaaatcaagactatcggactaagccattttgttgctccgcatgtccattctcatcgaaattctttagcgcttacaagtcgcattttagaaacgtgcacagcgaagatttcgaaaacagaatcctgctcaattgtccctactgcacctttaacgcagacaaaaagaccctcgagactcatatcaagatctttcatgctccaaacgcatcggcaccatcctcttccctttccaccttcaaagacaaaaacaaaaatgacggccttaagcctaagcaagcagactcagtggaacaggccgtgtactactgcaagaagtgtacgtacagggaccctctttatgagattgtgcggaagcatatctatcgcgagcatttccagcatgtcgcggcgccctacattgcaaaggcaggtgagaaatcgcttaacggtgcggtgccccttggaagtaacgcaagagaggaatcatccatccattgtaagaggtgtcttttcatgccaaagagctacgaagcactggtgcagcacgtgatagaagatcacgagaggataggttatcaagtgactgccatgatcgggcataccaacgtggtggtcccaaggtcaaaacctttgatgctgatcgcacctaagcctcaggacaagaagagcatggggcttcctccaagaatcggtagcctggcaagcggtaacgtcagatccctcccaagccagcagatggtgaacagactgtccatccctaaacctaacctgaattccaccggagtgaatatgatgtcatcagtccatcttcagcaaaacaactacggagtgaagtcagtcggtcaaggttactcggtcggtcaatcaatgcgcctggggctgggaggaaatgcacctgtgtccattcctcaacaatcgcaatcggtgaaacaactgctcccatccggaaacgggagaagctacggtctgggatcagagcagagaagccaggcacctgcacgttacagcctgcagtccgcaaacgcatcgagcctttcgtcgggtcagctcaagtcaccctcactcagccagagccaagcctcccgagtgttgggtcagtcatcgtccaagcctgcagccgcagccaccggtccgccaccaggaaacaccagctcgactcaaaagtggaagatatgtactatctgtaatgagctgtttcctgagaacgtgtactcggtgcattttgaaaaggaacataaggccgaaaaggtgcccgctgtggcaaactacatcatgaagatccataactttacctccaagtgcctgtactgtaaccgctaccttccgaccgatacccttttgaatcatatgcttattcacggtctttcctgtccgtattgtcgctccactttcaatgacgtggaaaagatggccgcccatatgcgcatggtccatatagatgaggaaatgggacctaagaccgactcgaccctgagcttcgatctgaccttgcaacagggtagccataccaatattcaccttctggtgacgacctacaacctgcgagatgcacctgctgagtccgtcgcataccatgcacaaaacaatcctcccgtgccaccaaaaccacagcctaaggtccaagaaaaggcggatattccggtgaagtcctcacctcaggcagccgtgccatacaagaaggatgtcgggaaaacgctctgtcccctgtgttttagcattctgaagggacctatctccgacgcccttgcacatcatcttcgggaaagacaccaagtcatccagactgtgcatcctgtcgagaagaagctcacctacaaatgtattcactgtcttggcgtctatacctcgaacatgactgcctcgacgatcaccttgcaccttgtccattgtagaggagtcggaaagacccagaatggccaagataagaccaacgcaccctcgagattgaatcaaagtccttcgctggcaccagttaagcggacctacgaacaaatggaattcccactccttaagaaaaggaagctggacgacgattctgattcccctagcttctttgaagaaaaaccagaggaacctgtcgtcctggccctggacccaaagggccatgaagatgattcctacgaggcccggaagtccttcctgactaagtacttcaataaacaaccttaccctactcgccgtgaaattgaaaagctcgctgcctccctttggctgtggaagtccgacatcgcctcgcacttttcaaataagaggaaaaagtgtgtccgggactgtgaaaagtataaaccaggagtccttcttggctttaacatgaaggaacttaacaaggtcaagcacgagatggactttgatgcagaatggctttttgaaaaccacgacgagaaggattccagggtgaacgcaagcaaaaccgccgataagaagttgaatctgggtaaggaggacgattccagctccgacagctttgagaacctcgaagaagaatccaacgaatctgggtcaccctttgatcctgtgtttgaagtcgagcctaagatttcaaacgataacccagaagagcacgtgctgaaggtgattcctgaggatgcatcggaatctgaagagaaacttgatcagaaggaggatggatcgaaatacgagacgatccatcttactgaagaacctaccaagctgatgcacaacgcatccgattcggaagtggatcaggatgatgtcgtggaatggaaggatggggcatcaccatctgagtcgggacctggatcgcaacaagtctccgatttcgaagataacacctgcgaaatgaagcctggtacttggtcggatgagtcgtcgcaaagcgaagatgctaggtccagcaaacctgctgcgaagaaaaaggccaccatgcaaggagatagggagcaactgaagtggaagaattcgtcatacgggaaagtcgaagggttttggtccaaggatcagtctcagtggaaaaatgcgtccgaaaacgacgagcgtctgtcaaacccacaaatcgagtggcaaaattcgacgattgattctgaagatggagaacagttcgataacatgaccgacggagtggcagaacccatgcacggctcactggcaggtgtgaaactttcgtcgcagcaggca

SEQ ID NO: 5731 - DNA, 3306 bp, Artificial Sequence
  Description of Artificial Sequence: Synthetic coding sequence
atgttccagctgccagtcaataatctgggtagcctccgcaaggcccggaaaaccgtgaagaaaatcttgtcagatatcggactcgagtactgtaaagaacatatcgaggacttcaagcagttcgaacccaacgatttttaccttaagaacacgacttgggaggacgtggggctgtgggatccgtccctgaccaagaatcaagactaccggactaagccgttttgttgctccgcatgcccgtttagctcgaagttcttttccgcgtacaagtcccacttcaggaacgtgcactctgaggacttcgagaaccggatcctcctcaactgcccgtactgtacttttaacgctgataagaagacccttgagactcacatcaagatcttccacgcaccgaacgcctctgccccgagctcgtccctgtcaacttttaaggacaaaaacaaaaacgatggcttgaagcctaaacaggccgactcggtggaacaggcagtgtactactgcaagaaatgcacctacagagatccgctctacgagatcgtgcgaaagcatatctaccgggagcactttcagcatgtggcagcaccctacatcgccaaggccggagagaagtccctcaatggagctgtgcctctgggatccaacgctcgcgaggaatcctccatccactgcaagagatgtctgtttatgccaaagtcctacgaagcgctggtgcaacacgtgatcgaagaccacgagcggatcgggtaccaggtgacggccatgatcggacacacgaatgtggtggtcccgcgcagcaagcccctgatgctcattgcgccaaagccgcaggataagaagtccatggggctcccgccacgcatcgggagcctggcttccggcaacgtgagatccctcccctcgcagcagatggtcaaccgcctttccatccccaagcccaacctcaactcaaccggtgtgaacatgatgtccagcgtgcatctgcagcagaacaattacggagtcaagtcagtgggtcagggctactcagtgggacagtccatgaggctgggactgggaggaaacgcaccggttagcatccctcagcagtcgcagtcggtgaagcaactgttgccgagcggaaatggaaggtcctacggactgggatcggaacaacggtcacaagcacctgcgcggtactcgctgcaatcggcgaacgcgtcctctctcagcagcggccaactgaagtccccgtcgctctcgcaatcgcaggcctcgcgcgtgctcggacagagctcgtccaagccagcagcggccgccaccggacctccgcctggaaacacgagtagcactcagaaatggaagatctgcactatttgcaatgagttgttcccagaaaacgtgtactccgtacacttcgaaaaagagcacaaggcggaaaaagtccctgcagtcgcaaactacatcatgaagatccacaactttacctcaaagtgcctgtactgtaaccgctacctgcccaccgacaccctgctcaatcatatgttgatccacggcctgtcttgtccgtactgcaggtccaccttcaacgacgtggaaaagatggccgcccacatgcgcatggtccatatcgacgaagaaatgggccccaagacggatagcaccttgagcttcgacttgacccttcagcagggttcacataccaatattcatctgttggtgaccacttacaacctgagagacgccccggcggagtccgtggcctaccatgctcagaacaatcctcctgtgccaccgaagcctcaacctaaggtccaagaaaaggcggatatcccagtcaaaagctcccctcaagctgcggtcccatacaagaaggacgtcgggaaaaccctttgtccgctctgtttctccatccttaaggggccaatctcggacgcccttgcccatcatttgcgggaacggcaccaagtgattcaaaccgtgcaccctgtggagaagaaattgacttacaaatgcatccattgcctcggggtctacacctcgaatatgacggccagcactatcaccctccacctggtgcactgtcggggagtcggaaagactcagaacgggcaggataagaccaacgccccctcccggctgaaccagagcccaagcctggccccagtcaaacgcacttacgagcaaatggaattccccctgctgaagaagcggaagctcgacgatgactctgactcgccatcattctttgaagagaagccggaggaaccggtggtgctcgcgctcgaccctaagggccacgaggacgactcatacgaagccaggaagtcgttccttactaaatacttcaataaacagccttacccgactcggcgcgagatcgagaagctggccgcctccctgtggctgtggaaatcggacatcgcctcacacttctccaataagcggaagaagtgcgtccgggactgcgaaaagtacaagccgggggtcctcttgggcttcaacatgaaagaactcaacaaggtgaagcatgaaatggattttgacgccgagtggctgttcgagaatcatgacgaaaaggactcccgcgtcaatgcgtccaagaccgccgacaaaaagctgaacctcgggaaagaagatgactcctcgtctgactcattcgaaaacctggaagaagaatccaatgaaagcggtagtccgttcgatcccgtgttcgaggtcgaacccaagatcagcaatgacaacccggaggaacatgtgctgaaggtgatcccagaagacgcatccgaatcagaagaaaagctggaccaaaaggaagacggaagcaaatacgaaacgatccatctcaccgaagaacctaccaagctgatgcataacgcaagcgactcggaagtcgaccaggacgacgtcgtggagtggaaggacggggcctccccatcggagtccggacctggatcacaacaggttagcgatttcgaggataacacttgtgaaatgaagccgggaacctggtccgacgagagctcgcaatccgaggatgcgcgctcgtcgaaaccggcagcgaagaagaaggccactatgcagggggacagagaacaactcaagtggaagaattcctcatacggaaaagtggaaggcttctggtcaaaggatcagtcgcagtggaagaacgcctcggaaaatgatgaacgactgagcaatccgcaaatcgaatggcagaactcaaccatcgattccgaagatggtgagcagttcgataacatgactgacggtgtcgcggaaccgatgcacgggtccctggccggagtcaagctctcaagccaacaagct

SEQ ID NO: 5732 - DNA, 3306 bp, Artificial Sequence
  Description of Artificial Sequence: Synthetic coding sequence
atgttccagttgcctgtgaataacctggggagcctgcgcaaggctaggaagactgtgaaaaagatcctcagcgatatcggcctggagtactgcaaggagcatattgaagattttaaacagtttgagccaaacgatttctacctcaaaaacaccacctgggaagatgtgggcctctgggatcccagcctaacaaaaaaccaggattatcggaccaagcctttttgctgctctgcttgtcctttcagctctaaatttttctccgcatacaagtcccattttaggaatgtacactcggaggacttcgagaaccgcattctcctgaattgcccttactgcacatttaatgctgataagaaaaccctggagacccatataaagatttttcacgcccctaacgcctccgctcctagcagctcactcagcacttttaaggacaaaaataaaaatgatggactcaaacccaagcaggctgactcagtcgagcaggcggtgtactactgcaaaaagtgcacatatcgcgaccctttgtacgaaatcgttagaaagcatatttatagagagcattttcaacatgtggctgccccatacatagccaaggcgggagagaagtctctgaatggcgcggtccccctcggatcaaatgctcgcgaggagtctagcatacactgtaagagatgtctgttcatgcccaaatcttatgaagcattggttcagcacgtaatagaggaccatgagcgcatcggatatcaagtgacagcaatgatcgggcataccaatgtggtagtgcccaggtccaagccactcatgctgatcgcgccaaagccccaggataaaaagtctatgggactgccccccaggattggcagcctcgcaagcggaaacgtgcggagccttcccagccaacaaatggtcaaccgcctgagtatccctaaaccaaacctgaatagcacgggcgtgaatatgatgagcagcgtccacttacagcagaacaactatggagttaaatctgtaggtcaaggttacagtgttggccagagtatgcgtctggggttaggtggcaacgccccagtttccattccgcagcaatcgcagtctgtgaagcagctccttccttccggcaatggccgttcatacggcctgggaagcgagcaacggagccaggcaccagcccgctacagtctgcaaagcgcaaacgcttcttctctaagtagcggccagctgaaaagtccatctctatcacagtcccaagcttcacgggttcttgggcagtccagctctaaacctgctgcggccgccaccggaccacctcctggcaatactagctccacacagaagtggaagatttgcaccatttgcaacgagctgttcccagaaaacgtttactcggtccatttcgagaaggaacataaggcggaaaaggtgcccgccgtcgcaaactacatcatgaagatccacaactttaccagtaagtgcctctattgcaacagataccttccaacagacaccctgctcaatcatatgctcattcacggactatcctgtccatactgtagaagcactttcaacgatgtcgaaaaaatggccgcccacatgcggatggtgcacatagacgaggaaatgggccccaaaacagacagcactctcagtttcgatttgactctgcaacaaggatctcacactaacatacacctgcttgtgaccacttacaacttgagagatgccccagctgagtcagtggcctatcacgcccagaacaaccctcccgttcccccaaaacctcagccaaaggttcaggaaaaagctgatattcctgtcaagtcttcccctcaggctgccgttccatataaaaaggacgtcggaaaaacactttgtcccctctgtttctcaatcttgaaggggccaattagtgacgctctcgcacaccacctgagggaaagacaccaggtaattcagacggtgcacccagtggaaaaaaagctgacctataaatgcattcattgtctgggagtctataccagcaatatgaccgcaagcaccattacgctccaccttgtgcattgcaggggcgtcggaaaaactcagaacggacaggataaaacgaatgctcccagccggctcaatcaatcaccatctttggctcctgtcaagcggacctacgaacaaatggaattccctctgcttaagaaaagaaaactggatgatgactccgactcaccttcttttttcgaggaaaaaccagaagaaccagtggtgctcgccttggatcctaaagggcacgaggacgatagctatgaggctcggaagtccttcctgaccaagtacttcaataagcaaccctacccgacgcgccgggaaatcgaaaaactggctgccagcctgtggctgtggaaatctgatatcgctagccattttagcaacaagcgcaagaaatgcgtcagagattgcgaaaaatacaagccaggcgtcctccttggcttcaacatgaaggaacttaacaaagtgaagcacgaaatggattttgacgctgaatggctgttcgagaaccatgatgagaaggactcccgagttaacgcatccaagacggcagataagaaactcaacttgggaaaggaggatgacagcagctcggacagtttcgaaaacctggaggaagaatccaacgagagcggtagccccttcgatcctgtgttcgaggtcgaacctaaaatttcaaacgataacccagaggagcatgtgctgaaggtgattccagaagatgcaagcgaatccgaggagaagttggatcagaaagaggatggcagtaaatacgagacaattcatctgacagaagaacctacaaagcttatgcataacgccagcgacagcgaggtcgatcaagacgacgtagtggaatggaaggatggcgcaagtcctagtgagtccggacccggatcccaacaggtcagcgacttcgaagacaatacctgcgagatgaagcctggaacctggagcgatgaaagttctcaaagtgaagatgcacgctcctccaagcctgccgcaaaaaagaaagctaccatgcaaggagaccgggaacagctgaaatggaaaaattcgtcttacggaaaggtggagggtttctggtcaaaggaccagtcacaatggaagaacgcatcagagaatgacgagagactgagcaaccctcagatcgaatggcaaaactctacaatcgacagcgaggacggtgaacagttcgacaatatgactgatggagtggccgagcctatgcacggatctttggctggcgtcaagctctccagccagcaggca

SEQ ID NO: 5733 - DNA, 3306 bp, Artificial Sequence
  Description of Artificial Sequence: Synthetic coding sequence
atgttccaactcccagtcaacaatctcggatcgctgcggaaggcgcgcaagactgtcaagaagatcctttccgatatcggtctggaatactgtaaagaacatattgaagatttcaagcaattcgaaccaaacgacttttatctgaaaaacactacttgggaagatgtcggactgtgggatccatctcttaccaagaatcaagattaccgtaccaagcccttttgctgttcggcctgcccattctcctcgaagtttttctccgcatacaagtcacatttcagaaatgtccacagcgaggatttcgaaaatagaatcctcctcaactgtccatactgtacgtttaacgcagataagaaaactcttgagactcacataaagatattccatgcaccaaacgcatctgcaccgtcgagctcgctgtcgaccttcaaggataagaacaagaatgatggtctgaagcctaaacaggcagattccgtcgaacaagctgtgtactactgtaagaagtgtacgtatcgcgacccgctctacgagattgtcagaaagcacatttaccgggaacacttccaacatgttgcagcgccatacattgcgaaggcaggtgaaaagtcgcttaacggagccgtgccactgggttccaatgcaagagaagagtcatcgattcactgcaagcgctgccttttcatgccgaaatcctacgaggcgctcgtccaacatgtgattgaagatcatgagaggatcggataccaggtgacggccatgatcggacatactaacgtcgtggtgccacggtcgaaacctcttatgctgattgctcctaaaccccaagataagaaaagcatggggctgcctcctcgtattgggagcctcgcctcaggcaatgtgcgttcgttgccttcccagcagatggtgaataggttgtccatacccaagcccaacctgaactccacgggcgtgaatatgatgtcgtccgtgcatcttcagcagaacaattacggtgtcaagagcgtcgggcagggttacagcgtgggccaatcaatgcgcttgggtctgggtggtaatgcaccagtgtccataccgcagcagtcacagtctgtgaaacagcttcttccatccggaaacggccgatcctacggactgggctcggaacagcgctcgcaagcgcctgcgcgatacagccttcaatcggcgaacgcttcgtcacttagcagcggacagctcaagtcccccagcctctcacagtcgcaggcctcgagagtgctgggccagtcgtcctccaagcctgcggcagccgcaacgggtcccccgcctggcaatacctcctcgacccagaagtggaagatttgtactatttgtaacgaactctttccggagaatgtttactcggtgcattttgaaaaggaacataaggctgaaaaagtgcctgcagtggccaactacatcatgaagattcacaatttcacttcgaaatgcctctactgcaaccggtacctccctactgacaccctccttaatcacatgcttattcatggactgtcatgtccgtactgccgctcgacctttaacgatgtcgagaagatggcagcgcatatgcgaatggtccatatagacgaagaaatggggccaaagaccgactcaactctgagcttcgatctcaccctgcaacaaggatcgcataccaatatacatctccttgtcaccacttacaacttgcgcgacgcccccgcagaatctgtggcgtatcatgcgcaaaacaatccaccagtgcctcctaaaccacagccaaaggtgcaggaaaaggcggacattcctgtcaaaagctcgccccaggcagccgttccttacaagaaggacgtcggaaagaccctgtgcccactctgtttttccatcttgaagggaccgatttcggatgcgcttgcccatcacttgcgggaaaggcatcaggtgattcagactgtgcatccagtggaaaagaaactcacttacaagtgcattcactgtctcggcgtgtacacctccaatatgacggccagcactatcacccttcatctggtgcattgtcgaggtgtgggcaaaactcaaaacggacaagataaaaccaatgcaccgagcaggcttaatcaatccccttcgcttgcaccagtgaaacggacttatgaacaaatggagtttccccttctgaaaaagagaaagctcgatgatgatagcgactcccctagcttttttgaagaaaagccggaggagcccgtggtgcttgcactggatcccaagggtcatgaggatgatagctacgaggcacgcaagtctttcctgactaagtacttcaacaaacaaccctacccaacccggcgtgaaattgaaaaactggcggcatcgctctggctctggaagtctgatattgcttcacacttttcaaacaagcggaagaaatgtgtgagagattgtgaaaagtacaagccgggtgtgctcctgggttttaacatgaaggaactcaataaggtcaaacacgagatggattttgacgcagagtggctttttgaaaaccacgacgagaaagacagcagagtgaatgcatccaaaaccgccgacaaaaaactgaatctggggaaggaagatgatagctcctcagattcctttgaaaatctggaagaggaatcgaacgaatccggatcaccttttgaccctgtctttgaggtcgagcctaaaatcagcaatgataaccccgaggaacacgtgctgaaggtgatcccagaagatgcatcagaatcggaggaaaaactggaccaaaaggaggatggctccaaatacgagactatacaccttactgaagaaccaaccaaactcatgcataacgcatcagactccgaggtggaccaagatgacgtggtggaatggaaggatggggcaagcccctcggagtcagggcctggttcgcaacaagtctcagactttgaagataatacttgtgagatgaaacccggtacctggagcgacgagtcctcccaatcggaggatgcgcgctcttcgaaacctgcagcaaagaagaaggcaactatgcaaggagatcgagagcagcttaaatggaagaactcgtcatacggaaaggtcgagggcttttggtcgaaagaccagagccaatggaagaacgcaagcgaaaacgatgaacgcctctcaaaccctcaaattgaatggcaaaactccactatcgactcggaagatggagaacaattcgataacatgactgacggagtggctgaaccaatgcacggcagcttggcgggcgtgaagctgtcatcccagcaggca

SEQ ID NO: 5734 - DNA, 3306 bp, Artificial Sequence
  Description of Artificial Sequence: Synthetic coding sequence
atgttccaactgcctgtgaacaatctcgggtcccttcgcaaagctaggaaaactgtgaagaagatcctgtcagacatcggccttgagtactgcaaggagcatatcgaagatttcaagcaattcgaacctaatgatttctatttgaaaaacacgacttgggaggacgtgggtctgtgggacccttcgttgactaaaaaccaggattacagaactaaacctttttgttgcagcgcctgccccttttcgtccaagttcttctcggcctacaagagccacttcagaaacgtgcactccgaagatttcgagaaccgcatcctgctgaattgcccatattgcactttcaacgcggacaaaaagacgctggaaactcacatcaaaatctttcacgcaccgaatgccagcgccccgtcctcgtccctttccactttcaaggacaagaacaagaatgacggtcttaagccaaagcaagccgacagcgtggagcaggcagtctactactgcaagaaatgcacctaccgcgaccctctctacgaaatagtccgcaagcacatctaccgcgagcatttccaacatgtcgccgcgccgtacatcgccaaagccggagaaaaatcactcaacggagctgtgccgctcggctcgaatgctagagaagaatcctccatccactgcaagcggtgcttgttcatgccgaagtcgtacgaagccttggttcagcatgtcattgaggaccatgagcgcatcggttaccaagtgactgctatgatcggtcatactaatgtcgtggtgccaagatcgaagccgttgatgctgatcgcccccaagccgcaagataagaagtcaatgggcctgccgccgcggatcggatcgctggcgtccggcaacgtgaggtcgctgccgagccaacagatggtcaatcgcctttcaatcccgaagccgaacttgaactcgactggagtgaacatgatgtcctccgtgcacctccagcagaacaactatggagtgaagtctgtgggacagggatacagcgtgggacagtctatgcgcctgggcttgggaggaaatgcaccagtttccatcccccagcaaagccagtcggtgaagcagcttctcccgagcggcaacggtcggtcgtacgggctcggatcggagcaacggtcacaggcgccagctcggtattcgttgcagtccgcaaacgcttcttccctgtccagcggacagctgaaatccccatcactgtcacagagccaggcttctcgcgtcctcggacaaagctcatctaagcctgctgcggctgccactgggccaccgccaggcaacaccagcagcacccaaaagtggaagatctgtaccatctgcaacgaactctttccagaaaacgtgtactcggtccactttgagaaggaacacaaagccgaaaaggtccctgccgtggcgaactacatcatgaagatccacaacttcacctccaaatgcctgtactgcaaccgttaccttccaactgacaccctcctgaaccacatgctcattcacggactgagctgcccgtactgtcgctcgactttcaatgatgtggaaaagatggccgctcatatgagaatggtgcatatcgacgaggagatgggaccgaaaacggacagcaccctctcttttgacctgaccctgcaacaaggctctcataccaacattcacttgctcgtcaccacctacaatctgagagatgcccctgccgaatcggtggcttaccacgcccagaataatccgcctgtgccgcctaaaccacagccaaaagtgcaggagaaggccgacatccccgtgaagtcctcgcctcaggcagccgtcccatacaagaaagacgtgggaaagaccctgtgccctctgtgcttcagcatcctgaaggggcctatttcggatgcacttgcacaccacctgcgcgagagacaccaggtgatccagaccgtgcacccagttgagaaaaagctcacgtacaagtgcatccattgtctgggtgtgtatacgtcaaacatgaccgcctcgactatcaccttgcacttggtgcactgcagaggagtgggaaaaacccaaaacggacaggataaaactaacgccccgtcgcggttgaaccagagcccatccctggctccggtgaaacggacctacgaacagatggagtttcccctcctgaagaaacggaagctcgatgacgacagcgattcgccgtccttcttcgaagagaagcctgaagaaccggtggtgctggccttggacccgaagggccacgaagatgacagctacgaggccagaaaatccttccttaccaagtacttcaacaagcagccgtaccccactcggcgagaaatcgagaagctcgccgcgtcactgtggttgtggaagtcggatatcgcgtcgcacttcagcaacaagcgcaagaagtgtgtgcgggattgcgaaaagtacaagccgggagtcttgctcggcttcaacatgaaggaacttaacaaggtcaagcatgaaatggacttcgacgcggagtggttgtttgagaaccatgacgagaaagactcgagagtgaatgcttcgaaaacggcagataagaagctgaatctgggaaaggaggacgattcgtcatccgattccttcgagaacctcgaagaagaatcaaacgaatcaggttcgccgttcgacccggtctttgaagtggagcccaagatttcaaacgataacccggaagagcacgttctgaaggtcatcccggaagatgccagcgagtccgaggagaagctcgaccagaaggaagatggttccaagtacgaaacgatccatctgaccgaggaaccgactaagttgatgcacaacgcctcagactctgaagtggaccaagatgatgtggtggaatggaaggacggagccagcccctcagaatccgggccggggtcacaacaagtttcggatttcgaggataacacctgtgagatgaagccaggcacctggtccgacgagtcctcgcagagcgaggacgccagatcctccaagccagccgcaaagaagaaagccaccatgcagggagacagggaacagctcaaatggaaaaacagctcgtacggcaaggtcgaaggcttctggtcgaaagatcaatcccaatggaagaacgcaagcgaaaatgacgaacgcctctcgaatcctcagatcgagtggcagaactccaccatcgactccgaagatggggagcagtttgacaacatgaccgacggtgtggcagaacccatgcacggttcgctggcaggagtcaagctcagctcgcagcaggcc

SEQ ID NO: 5735 - DNA, 3306 bp, Artificial Sequence
  Description of Artificial Sequence: Synthetic coding sequence
atgttccagttgccggtgaataacctcgggtcattgaggaaggcccgaaagactgtcaagaagattctttcagatattggtctggagtactgcaaagagcatatcgaggatttcaagcagtttgagccaaacgacttttaccttaagaatactacttgggaagatgtgggtctgtgggacccatcactcacgaagaaccaggactacagaactaaacctttctgctgttcagcatgtcccttctccagcaaattctttagcgcgtacaagtcccattttcggaatgtccactcagaagattttgagaatcgaatcctgctcaattgtccttactgtacctttaatgccgacaaaaagactctggaaacccacatcaagatctttcacgctcctaacgcttcagcaccctcatccagcctgagcaccttcaaggataagaataagaacgatggactgaagcctaagcaagccgattccgtcgaacaagcagtgtactactgtaagaagtgcacttacagggaccctctttacgaaatcgtgcgtaagcatatctatcgggaacattttcagcacgtggcggctccatacatagccaaggcaggtgaaaagtcactgaacggagcagtgcccctcgggtcaaacgccagagaagaatcctccattcattgcaagagatgcctctttatgccaaaaagctacgaagcactggtgcagcatgtgattgaagatcacgaaaggattggttaccaagtgaccgcaatgattggtcataccaatgtggttgtcccaagatccaagcctctgatgcttattgctccgaaacctcaagataagaagtccatgggtttgccccctcgaatcggctcgcttgcctccggaaacgtgagatcccttccatcgcaacagatggtcaataggctgtccattccgaaaccaaatctgaatagcactggagtgaacatgatgtctagcgtccacctgcaacaaaacaattacggagtgaagtcagtgggccagggctactccgttggacaatcgatgcgtcttgggctgggcggtaatgcaccagtctcgattccccaacagtcccaatcggtgaagcagcttctcccttccggtaatgggcgctcctacgggttggggtccgagcagaggtcgcaagcaccagctcggtactctcttcaaagcgcgaatgcctcctcccttagctcagggcagcttaagtctccttcgctgagccaatcacaggcttcgcgcgtcctggggcaatcgtcatcaaaacctgcggcagccgcaactggccctccccctggcaatacctcgtcgacccagaagtggaagatttgtactatttgtaatgaacttttcccagagaacgtctactccgtccattttgaaaaggagcacaaggcagagaaagtgccggccgtggccaactacattatgaagattcacaactttaccagcaagtgcctgtactgtaatagataccttcctaccgacaccctgctgaaccatatgctcatccacggacttagctgcccatactgtagatccactttcaacgacgtcgagaaaatggcagcacatatgagaatggtgcatatcgatgaagagatgggtcccaagacggatagcacgctgtcctttgatctgacccttcaacaaggatcgcataccaacattcatctgcttgtcactacttacaacctgcgagatgccccggctgaatccgtggcctaccatgcacaaaacaacccgcctgtccctccaaagcctcaaccaaaggtgcaggaaaaagcagatatccccgtcaagagctcaccacaagcagcagtcccttacaagaaggatgtgggaaagaccctttgcccgctgtgtttctcgatattgaaaggtcctatttcagatgcgctggcgcaccatcttagagagagacatcaagtgattcaaaccgtgcatcctgtcgaaaagaagctgacttacaagtgcatccactgtcttggagtgtacacgtcgaacatgacggcatctactatcacccttcaccttgtgcattgcaggggagtgggaaaaacccagaatggtcaagacaagactaatgcaccctcacggctgaatcaatcgccatcactcgcgccagtgaaacgcacctacgaacaaatggagttccccctcctcaagaagaggaaattggatgacgactccgatagcccttctttctttgaagaaaagccagaagaaccagtcgtcctggcactggatccaaagggtcatgaagatgactcgtacgaggcccgcaagtccttcctcacgaagtacttcaacaaacaaccttacccaacccgcagagaaattgagaagctcgcagcatccctgtggctttggaagtctgacattgcgtcccatttttcgaacaagagaaaaaagtgcgtgagagactgtgaaaagtacaagcctggggtgctgctcggtttcaatatgaaggagttgaataaagtgaagcacgagatggattttgacgcagaatggctttttgaaaaccacgatgagaaggacagccgggtcaacgcgagcaagaccgccgacaagaaattgaatcttggaaaggaagatgacagcagctcggacagcttcgaaaatctcgaagaggagtccaacgagagcggcagccccttcgaccctgtgttcgaagtcgagccaaagatatccaacgacaatccagaggaacacgtcttgaaggtgattcccgaggatgcgagcgaatccgaagaaaaacttgaccagaaggaggacggatcgaaatacgaaaccattcacctcaccgaggaaccaactaaacttatgcataacgcttccgactcagaagtggatcaggacgacgtggtggagtggaaggatggggcctccccgtcagaatcaggaccgggttcacaacaagtgtcggattttgaagataatacgtgtgagatgaaacctggtacgtggtcggatgaatcgagtcagtccgaggacgccagatcaagtaagccagcagctaaaaagaaggccaccatgcagggggacagagaacaactgaaatggaagaactcatcctacggcaaggtggaaggattctggtcgaaggatcaaagccagtggaaaaatgcatctgagaacgatgagaggctttccaatccacagatcgaatggcaaaattcgacgattgactcggaggacggggaacagttcgataacatgactgatggtgtggcagaacccatgcacggtagcctggcaggtgtcaagctcagctcgcagcaagca

SEQ ID NO: 5736 - DNA, 3306 bp, Artificial Sequence
  Description of Artificial Sequence: Synthetic coding sequence
atgtttcagcttccggtcaataatcttggcagccttcgaaaggcacgtaagaccgtcaagaagatcctttcggacatagggctcgagtactgtaaggaacatatcgaggatttcaaacagtttgaacctaatgacttctaccttaagaatactacctgggaagatgtgggtttgtgggatccctccctcaccaagaatcaggattaccgtaccaaaccattctgctgctcggcttgcccattttcttcgaaattcttttccgcatacaaatcacactttagaaacgtgcatagcgaagatttcgaaaaccgcattctcttgaactgcccttattgtacctttaacgccgataagaaaactttggagacgcacatcaagatctttcacgcccccaacgcatccgccccatcctccagcctgtcgaccttcaaggacaagaataagaacgacggactcaaacccaaacaagcagattccgtcgaacaggcagtgtattactgtaagaagtgtacgtaccgtgatcctctttacgaaattgtgagaaagcatatctacagggagcattttcaacatgtggcagcaccatacattgccaaggcaggagaaaagtcgctgaatggggctgtgcccctgggctcgaacgcgcgagaggaatcctcaatccattgtaaacgatgccttttcatgcctaagtcctacgaggcgctggtgcagcatgtcatcgaggatcatgaacgcattggataccaggtgactgcgatgatcggccacactaacgtggtggtacctcgttcaaagccactgatgcttattgcacctaagccacaagataagaagtcaatgggtctgccccctcgcattgggtcgctcgcatccggaaacgttaggtcgctgccctcccagcaaatggtgaatagactgtcaatccctaaaccgaatctcaacagcactggagtgaatatgatgtcgagcgtgcacctgcaacaaaacaattatggggtgaagtcggtcggacagggttactcggtgggccagtccatgcgtctcgggttggggggaaatgcgcctgtgtcgatcccacaacagtcgcagtccgtgaagcaacttcttccttcaggaaatggccgttcatacggacttggtagcgaacagaggtcgcaagcgccagcgcggtacagcctccaatcagctaacgcctcatccctgtcgtcaggtcaactcaagtcgccttccctgtcgcaaagccaggcctccagggtcctggggcagtcgtcgtccaaaccagccgcagccgccaccggtccaccccctggaaatactagctcaactcaaaagtggaaaatctgtaccatttgtaatgaactgtttcctgaaaacgtgtactccgtgcatttcgagaaggaacataaggcagagaaggtcccagcagtcgcaaactacattatgaagattcacaactttacttcgaaatgtctttactgtaatcggtatctcccaaccgacaccctgcttaaccatatgctcattcacggcttgagctgtccatattgtcggtcaacctttaatgatgtggaaaagatggcagcacacatgcggatggtgcatattgatgaagaaatgggacctaaaaccgattcaaccctttcctttgacctgactcttcaacaaggtagccatacgaacatacaccttctggtgactacttacaaccttagagacgcgcccgctgaatctgtggcataccacgcacaaaacaaccctccagtcccgcctaagcctcaacccaaagtccaagaaaaggcggatataccagtgaaatcctccccacaagccgctgtgccttacaagaaggatgtgggaaagactctctgtccactgtgttttagtattttgaaggggcccatttcggatgcattggcacatcacctccgggagaggcatcaggtgattcagactgtccatccggtggagaagaagctgacttataagtgcattcactgcctgggtgtgtacaccagcaacatgaccgcatccactatcaccctgcatcttgtccattgtagaggcgtcggcaaaactcaaaacggtcaggataagactaatgcaccctcccgcctgaatcagtccccatcactggcaccggtcaaacgaacttacgaacagatggaatttccactgctgaagaaaagaaaacttgatgatgacagcgattcgccgtcattcttcgaggaaaaacccgaggaaccagtggtcctggcactggatcctaagggacatgaagatgactcgtacgaggcacgtaagtcatttcttaccaagtactttaacaagcaaccataccctactagacgagagatcgaaaagctggcagcgtccctgtggctttggaagagcgatattgcgtcccattttagcaataagcgtaagaaatgtgtgagagattgcgaaaagtacaaacccggagtgttgctgggcttcaatatgaaagagttgaataaagtgaagcacgaaatggatttcgatgcagagtggttgtttgaaaaccatgacgaaaaggatagccgagtcaacgcatccaagaccgcagacaaaaaactgaaccttggaaaggaagatgattcttcgtccgactccttcgagaacctggaagaagaaagcaacgagtcgggctcaccatttgatcctgtgtttgaggtggagccaaaaatcagcaacgataatccagaggaacacgtacttaaggtgatacctgaggatgcatcagaaagcgaagagaaattggaccagaaagaggacggatccaagtacgaaactatccatctgaccgaagagccaactaaactgatgcacaacgcctccgactccgaggtggaccaagacgacgtggtggaatggaaagatggggcatcaccatccgaatcgggtcctggatcacaacaagtctccgatttcgaggacaacacctgtgaaatgaaaccggggacgtggtcggatgaatcttcccagtctgaggatgcaagatcctctaagcctgcagccaagaaaaaggccaccatgcaaggagatcgggaacaactgaagtggaaaaactccagctacggtaaagtggaaggcttttggtcaaaagatcagtcccaatggaagaacgcaagtgaaaacgatgaaagactgtccaacccgcaaatcgaatggcaaaattcaaccatagattccgaagatggcgaacaatttgacaatatgactgatggcgtggcagagccaatgcatggttcccttgctggggtgaagctgagctctcaacaggca

SEQ ID NO: 5737 - DNA, 3306 bp, Artificial Sequence
  Description of Artificial Sequence: Synthetic coding sequence
atgttccagctccctgtgaataacttaggatctctgcgaaaggcacggaaaacagtcaagaaaattctgtctgatatagggctcgaatactgcaaggagcatatcgaagactttaaacagttcgagccaaacgatttctaccttaagaatacaacatgggaagatgtgggactgtgggacccatccctgaccaagaatcaggactataggactaaacccttttgttgcagcgcctgcccgttctcatccaaatttttcagtgcatacaagtcacacttccgaaatgtgcatagcgaagactttgagaatcgtattctgctcaattgtccctactgcacattcaacgcggacaagaagaccctggagacacatatcaagatctttcacgccccaaatgcctcagccccctcatcgagcctgagcacatttaaggacaagaacaaaaatgatggtttgaagcctaaacaggcagattccgtggagcaggccgtgtattactgtaagaagtgcacgtatagagatccgttatatgagatcgttagaaagcatatctaccgggagcactttcaacatgtggcagccccatacattgcaaaggccggagagaaatccctcaacggtgccgtgccactaggtagcaacgcccgggaagagtcctctatacattgtaagcgctgtctattcatgcctaagtcctacgaggcgctggtgcagcacgtgatcgaggaccacgagcgtattggctatcaagtgacagccatgatcggccatacaaatgtggtcgtcccccgcagtaagccactcatgctgattgctccaaaaccacaggataaaaaatcaatgggcctccctccgcggatcggatctctcgccagcggcaatgtcaggtcactaccgtcacagcagatggtaaacagactgtcaataccaaagcctaatctgaactcaaccggtgtgaacatgatgtctagtgtgcatttgcagcagaacaactacggtgttaaaagcgtgggccaggggtattccgtgggccagtctatgagattgggcctcgggggcaacgcgcctgtttcgatcccacagcagagccagtccgttaaacagttgctgccatccgggaacggtcgcagctacggccttgggtctgagcaaagatctcaggctcctgcccgatactccctgcaatcagctaacgcatcctcccttagcagcgggcaacttaaaagccccagcttaagccagtctcaagcatctcgtgtgctggggcaaagcagttctaaaccagctgccgccgctacaggcccacctcccggcaacacatcttcaactcaaaagtggaaaatttgtacaatttgtaatgagctgttcccggaaaatgtatatagcgtgcatttcgaaaaggaacacaaagcagagaaggtgcctgccgttgcaaactatataatgaaaattcataacttcacctcgaaatgtctgtattgcaataggtacttgcctacagatactctgctgaaccatatgctgatccatggactgtcgtgtccttattgccgatctacatttaatgatgtggagaaaatggccgcacacatgaggatggtccatattgacgaagagatgggtcctaagactgacagcactttgagttttgacctgaccctgcagcaaggctcacatactaacatccatctgttggtaaccacatataaccttcgcgatgcacctgcggaatccgtcgcataccatgcccagaacaatcctccagtcccccctaagccgcaaccaaaggtccaggagaaagccgacatcccagtcaagtcttcaccccaagctgcagtgccctataagaaggacgtgggtaaaacactgtgccctctctgcttcagcatcctaaagggccctatttcagacgccttggcccatcatctacgggaacgacatcaggttatacagaccgtgcaccccgtggaaaagaaattgacctataaatgcatccactgcctgggcgtgtacacttcgaacatgaccgccagcacaataacactccacctcgtgcactgccgcggcgtgggtaagactcagaatggtcaggacaagacgaatgctccgtcacgcctgaatcagagcccctccctggccccagtaaagaggacctatgaacagatggagttcccactcctgaagaagaggaaacttgacgacgattctgacagcccatcatttttcgaagagaagcctgaggagccagttgtgctggctttggatcctaagggccacgaggacgacagttatgaagcaagaaagagctttctgacgaagtacttcaacaaacagccctacccaacaaggagggagatcgagaagctcgctgctagcctgtggctgtggaaatctgacattgcatcccacttcagcaataaacgcaagaagtgtgtccgagactgtgagaagtataagccgggtgtacttctcggttttaacatgaaggagctgaataaagttaagcacgaaatggactttgatgctgaatggttgttcgagaaccacgatgaaaaagattcaagagtgaacgcgagtaagactgccgacaagaaattgaatttaggcaaggaggatgattcatccagtgactcttttgagaatctcgaagaggaatccaacgagagtggatctcctttcgacccggtgttcgaagtggaacctaagatctctaacgacaatcctgaggagcacgttctaaaagtgatcccagaggatgcttcagaaagcgaagaaaagctcgatcagaaagaagatggttctaaatacgaaacaatccatctgacagaagaacctaccaaacttatgcataacgctagcgattcggaggtggatcaagatgacgtagtcgagtggaaggacggagccagcccatctgaaagcggccctggctctcagcaggtcagcgattttgaggataatacatgcgaaatgaagccagggacgtggtccgatgaatcctcccagtctgaggatgcgcgatcatcaaagcctgccgctaagaaaaaagccactatgcagggagatcgtgagcaattgaaatggaaaaacagctcctacgggaaggtggaaggcttttggagtaaggaccagtcacagtggaagaacgcatctgagaatgacgagcgcctcagtaacccacagatcgaatggcaaaattccacaatcgattctgaggatggagagcagttcgataacatgactgacggcgtggcagagcccatgcatggcagtctcgctggagtgaagctcagtagccaacaggct

SEQ ID NO: 5738 - DNA, 3306 bp, Artificial Sequence; identical to SEQ ID NO: 5728
  Description of Artificial Sequence: Synthetic coding sequence

SEQ ID NO: 5739 - DNA, 3306 bp, Artificial Sequence
  Description of Artificial Sequence: Synthetic coding sequence
atgttccagctgccagtgaataacttggggtcgctgcgcaaggcaagaaagaccgtgaaaaagatcctgagcgacatcggactggaatactgcaaggaacacattgaagatttcaaacaatttgagccaaacgacttctacctgaagaacacgacttgggaggacgtgggactgtgggatcccagcctgacgaagaaccaggattaccgcacgaaaccattttgttgctcagcctgtccgtttagttctaaattcttcagcgcctacaaatcccactttcggaacgtgcactcagaggacttcgaaaaccgcattcttcttaactgtccgtactgtactttcaatgcggacaagaaaactctcgaaacccacatcaagatcttccacgctccaaacgccagcgccccttcctcatcgctcagcacgtttaaggacaagaacaagaatgacggcctcaagccgaagcaggcggactcagtggagcaggccgtctactattgtaagaaatgcacctaccgagatccactgtacgagatcgtgcggaagcatatctacagagagcatttccaacacgtggcagcgccttacatcgcgaaggccggcgagaaatcactgaacggcgctgtgccgctgggtagcaacgcccgcgaggaatccagcattcactgcaagcgctgcctgttcatgcctaagtcgtacgaagcgctcgtgcagcacgtgatcgaggatcacgagaggatcggatatcaggtcactgccatgatcgggcacaccaacgtcgtcgtgcctaggtcgaagccgctgatgctgatcgccccgaagccacaagataagaagagcatgggactcccgcccagaatcggatccttggcctccggcaacgtgcggtcgcttccatcccagcagatggtgaaccgcctctccattcccaaaccgaacctcaactcgaccggagtgaacatgatgtcctcagtccatctgcaacaaaacaattacggtgtcaaatcggttggccaaggatatagcgtgggccagagtatgcgcctgggactcggaggcaacgcaccggtgtccattcctcaacagtcacagtcggtgaagcagctgctgccgtccgggaatggacgcagctacggactgggctccgagcagcgatcgcaggctccagcacgatactcactccaatccgcgaatgcatcgtccctctcatcggggcagcttaagtcgccgagcctgtcgcaaagccaggcttcccgcgtcctgggacagtcctcatctaaaccggccgctgcagccactggaccgccaccagggaatacgtcgtcgacccagaagtggaagatctgcacgatttgtaatgagctgtttcccgagaacgtgtactcggtgcacttcgagaaggagcataaagccgaaaaggtgccggctgtggcaaactacatcatgaagatccacaatttcaccagcaagtgcttgtactgcaacagatacctcccgactgatactctgctgaatcacatgctcatccatggcctctcttgcccgtactgcagatcgaccttcaatgacgtggaaaagatggccgcccatatgaggatggtccatatcgatgaggagatgggccctaagactgactcgaccctctcatttgatttgactctccagcaggggagtcacactaacatccatctgctggtaaccacttacaatctccgagacgcgcccgcggagtccgtggcttaccatgcgcagaacaatccccctgtccctccgaagccgcagccgaaggtccaggaaaaggccgacatccctgtgaagagcagcccgcaggccgctgtgccgtacaagaaggacgtgggtaagaccttgtgtcccctctgtttctccatccttaagggaccgatctcagacgcactggctcaccacctgcgggagagacatcaggtgatccagactgtccacccggtggaaaagaaactgacttacaaatgcatccactgcctcggtgtgtacacctcgaacatgactgcttcgactatcactctccatttggtgcactgccggggtgtgggaaaaacccaaaatggacaagacaaaaccaacgcaccgtcccgcctgaaccagtcgccgtcccttgcgccggtgaaacgtacgtacgagcagatggaattcccactgttgaaaaagagaaaattggacgacgactcagactccccttccttctttgaagagaaaccagaagagcctgtggtgcttgccctcgacccgaagggacacgaggacgacagctacgaggctagaaagtccttcctgaccaagtacttcaataagcagccttatcccacccggcgggagattgaaaagctggctgcgtcgttgtggctgtggaagtcggatatcgcctcccacttcagcaataaacggaagaagtgtgtgcgcgattgcgaaaagtacaagcccggcgtgctgctcggcttcaatatgaaggaactcaacaaggtgaagcacgaaatggatttcgacgccgagtggctgtttgagaatcatgacgaaaaggactcgcgcgtcaatgccagcaaaacggccgacaagaagctcaacctggggaaggaagatgactcgtcatcagatagcttcgaaaacctggaagaggaatcgaatgaatcgggttccccgtttgatcctgtgttcgaagttgaaccaaaaatctcaaatgacaaccctgaagagcacgttctgaaggtgatcccggaggacgcttctgaatccgaagagaaattggaccaaaaggaggatggttcgaaatacgaaaccatccaccttactgaagagccgacgaaactgatgcacaacgccagcgattcagaagtggaccaagatgatgtggtggagtggaaggatggggcatcaccgtccgaatccgggccgggttcacagcaagtctcggatttcgaagataacacctgtgaaatgaagccaggcacttggtcggatgagtcctcgcagtcggaggatgcaaggtccagcaagccagctgcgaagaaaaaagccaccatgcagggagatcgggagcagctgaagtggaaaaactcatcgtacggtaaagtggaaggattctggtcaaaagaccagtcacagtggaagaatgcctccgagaacgacgagagactgtccaatccgcagatcgaatggcaaaactccactatcgattccgaagatggcgagcaattcgacaacatgactgatggcgtggctgagccgatgcatggatcgctcgccggagtcaaactgtcatcgcagcaggcg

SEQ ID NO: 5740 - DNA, 3306 bp, Artificial Sequence
  Description of Artificial Sequence: Synthetic coding sequence
atgtttcagctgccagtgaataatctgggtagcctgcgcaaggcacgaaagaccgtgaaaaaaattttgtctgatatcggattggagtactgcaaagagcatattgaggatttcaagcaatttgagcccaatgatttttatctcaaaaacactacatgggaagatgtggggctgtgggacccaagcctgactaagaatcaggactaccgaaccaaacctttctgctgctctgcttgcccattctctagcaaatttttttctgcatataagtcacactttcggaacgttcactccgaggactttgaaaatagaattctcttgaattgcccttattgcactttcaacgccgataaaaagactctggagacacacattaaaattttccatgcacctaatgcatcagctccaagttccagcctgagcaccttcaaagacaagaataaaaatgatggtctgaaaccaaaacaggctgacagcgtggagcaggcagtgtactattgcaaaaagtgtacctaccgcgaccccctttatgaaatcgtgcgcaaacacatctatcgggaacatttccagcacgttgccgccccatatatcgccaaagcaggggaaaaatctttgaacggggctgtcccgctgggatccaacgcacgcgaggagtcctctattcattgcaaaagatgtctcttcatgccgaagtcatatgaggcgctggttcagcacgtgattgaagaccatgagaggatcggctatcaggtgaccgcaatgatcggtcacaccaacgtggtcgttccgaggtccaaacccctgatgcttatcgctcccaagcctcaggataagaagtccatgggccttccacctcggattggtagcctcgcaagtggcaatgttcggagtctccccagtcagcaaatggtcaatcgcctctctattcctaaaccaaatttgaattctacaggggttaacatgatgagctctgtgcacctgcagcagaataactacggggtgaaaagcgtgggccagggctattcagtggggcagtccatgcggctgggcctggggggaaatgctcccgttagcatacctcaacagtctcagtcagtcaagcaactgctgccctcagggaatggtaggtcctatggcttgggatctgaacaacgctctcaggcacctgcaagatattctttgcagtccgcaaacgcgagcagtctctcaagcggccaactgaaaagcccttccctgtcccagagtcaggcctctcgcgtcctgggtcaaagttctagcaaacccgccgccgcagccacaggccccccccctggaaacacaagcagtacccagaagtggaaaatctgcacgatttgtaatgagctgttcccggagaacgtctactcagtgcactttgagaaagagcacaaagctgagaaggttccagccgtggccaattacataatgaagatacataatttcacttccaagtgtctctactgcaatagatacctccccacggacaccctgctgaatcacatgctgatccacggcctcagctgtccttattgccgatctacattcaatgatgtggagaaaatggccgcgcatatgcgcatggtgcatatcgatgaagagatggggcctaagaccgactccactctcagctttgatctgacactgcagcaaggtagccatactaacattcatctgctcgttacaacttacaacctgcgagacgcgccggcggaatctgttgcataccatgcccagaataatccacccgtgcctcccaagccgcaacccaaggtgcaggaaaaggccgacattcccgtgaagagtagtccacaggctgctgtgccatacaagaaggacgttggcaaaacgctgtgccctctgtgtttcagtatcctgaaaggtcccatcagcgacgcccttgcgcaccacctgcgggagcggcaccaggttattcaaaccgtgcatccagtcgagaaaaagctcacttacaagtgcatccactgtctcggcgtctatacctccaatatgacggccagcaccatcacactgcatctggttcactgtcgaggagtgggaaagacccaaaacggtcaggacaaaacaaacgctccatcccgcctgaaccaatcccccagcctggcacctgtgaagcgcacatacgaacagatggaatttcccctgctcaagaagaggaaactggacgacgacagtgatagcccaagtttttttgaggagaagcccgaggaacctgtagtcttggccctggacccgaaagggcacgaggatgacagctatgaggcacgcaagtcattcctcaccaagtactttaataaacaaccgtatcccactagacgagaaattgagaaactggctgcctcactgtggctgtggaaaagcgacatcgcctctcacttcagcaacaagaggaaaaaatgcgtccgcgactgtgaaaaatataaacccggagtgctgcttggcttcaacatgaaggaactcaacaaagtcaagcatgaaatggattttgacgcggaatggctcttcgagaatcacgacgaaaaggacagccgcgtcaacgccagtaagacagcggacaaaaagctcaacctgggaaaagaggatgactcttcctcagacagctttgaaaacctggaggaggagtccaatgagtctggcagtccattcgatcctgtcttcgaagttgagccaaaaatcagcaatgacaaccctgaagagcacgtgctcaaggttattcccgaagacgcttccgagagtgaggagaagctggaccaaaaggaggatgggagtaagtatgagactatccacctcacggaagagccaactaagctgatgcacaacgcttctgattccgaagtcgaccaggacgatgtcgtcgagtggaaagacggtgcttccccgtccgagtcaggtcccggatcccagcaagttagcgacttcgaagataatacgtgcgagatgaagccaggcacttggtctgacgagagctcacaatccgaggacgcacgcagctccaaaccagcagctaagaagaaagccacgatgcagggcgaccgagaacagctgaaatggaaaaatagctcatacggtaaagttgagggtttctggagcaaggatcagagccagtggaaaaacgcttcagagaatgatgaacgcctgagcaatccccagattgagtggcagaacagtaccatcgacagcgaggacggtgagcagtttgacaatatgaccgatggtgtggcagaaccaatgcacggctcccttgccggggtcaaactcagctctcaacaggcc

SEQ ID NO: 5741 - DNA, 3306 bp, Artificial Sequence
  Description of Artificial Sequence: Synthetic coding sequence
atgtttcagcttcccgttaataatctgggctccctccggaaagctcggaagacggtcaagaagatcctgtccgatatcggcctggagtactgcaaggaacacatcgaggattttaaacagtttgagcctaatgacttctacttgaaaaacactacctgggaggatgtggggctgtgggatccctctcttactaaaaatcaggattaccggactaagccattctgctgttctgcttgtccatttagttcgaagtttttttctgcctataaatctcattttcgaaatgtgcattctgaggatttcgagaaccgcatactactgaactgtccttactgcacattcaatgcagataagaaaaccctggaaactcacattaaaatctttcatgcgcctaatgcctcggcccctagctcctcactatccacatttaaagataaaaacaagaatgacggactaaagcccaaacaagcagattctgttgagcaggcagtctactactgtaaaaaatgtacctacagagatcccctgtacgagatcgtgcggaagcacatctatagggagcatttccagcacgtggcggccccttacattgccaaggccggagaaaagagcttgaatggggccgtgccattggggtcaaacgccagggaagaatctagcatacactgcaaacgatgcttatttatgccgaagtcttacgaggccctggtgcagcacgttattgaagaccatgaaaggatcggctaccaggtcaccgccatgatagggcacactaatgttgtggtgccacgaagcaagcccctcatgctcattgctcccaaacctcaggacaagaaatccatgggtctgccacctaggatcgggtcgctggccagcggtaacgtgagatccctgccatcacaacaaatggttaacagactgagtatcccaaaacctaatctgaacagcactggcgtgaacatgatgagcagcgtgcatctacagcaaaacaattacggtgtgaagagtgtcggtcaagggtattccgtaggacagtccatgcgactgggccttggaggtaatgctcccgtgagcatccctcaacagtcacagagcgtgaagcagctgttgccatctgggaacggtcgctcttatgggctcggtagcgaacagaggtcgcaggccccagcacgctactccctccagagcgccaatgcctcttcactgtccagcggccagctgaagagtccatcactgtcccagtcacaagcgagccgcgtgcttggccaaagttccagtaagccggcggcagccgcgaccggaccgccaccggggaatacctcatctacacagaagtggaagatctgcacaatttgtaatgaactttttcccgagaatgtgtattctgttcacttcgaaaaggagcacaaagcagaaaaagtgcccgctgtcgccaattacattatgaagattcacaacttcacatccaagtgtctgtactgcaatcgatacctcccgactgatacattgctaaaccatatgctaatacatgggctgtcatgtccatactgtaggtccacatttaacgacgtggaaaagatggccgcacacatgaggatggtacatattgacgaggaaatgggtccaaaaactgacagcacactgagctttgacctaaccctgcagcaggggagccatacaaatatccacctgctggtcacaacctacaacctgcgcgacgctcccgccgaaagtgtggcttatcacgcacagaacaatccaccagtgccccccaaaccacagcctaaagtgcaggaaaaagctgatatcccagtgaaatcctcgccccaggctgcagtcccttataagaaggatgtcgggaagactctctgccccttatgctttagtattctgaaaggaccaattagtgacgccctggctcaccatttgcgggaacgccaccaagtgatccagaccgtgcaccccgtcgagaagaagttgacatacaaatgcatacactgtctcggcgtgtatactagcaacatgactgcctcaacaattacattgcatctggtacactgtcgcggcgtgggaaaaacccagaatggtcaggacaagaccaacgctccctcacggctcaaccagtcgccttctttagctcccgttaaaaggacctacgagcagatggaatttccactcctgaaaaagcgaaagttggatgacgatagcgactccccttctttttttgaagaaaagcctgaggagcctgtcgtactcgcccttgatcctaaaggccacgaggacgactcttacgaagcccgaaaatcttttttgaccaagtacttcaacaaacagccttatcctaccaggcgcgagatcgagaagctcgctgcaagcctgtggctgtggaagagtgatatcgcttctcatttcagcaataaaaggaaaaaatgtgtaagggattgtgagaagtacaaacctggggttctgctgggatttaacatgaaagagttgaacaaggtcaaacacgagatggattttgacgccgaatggttgttcgaaaaccatgatgaaaaagactcacgcgttaacgcctccaagaccgctgacaaaaagctgaatttggggaaagaggacgattccagcagtgattccttcgagaatctggaggaagagagcaacgagtctggatctccatttgacccagtcttcgaagtggagcccaagatttccaacgacaaccccgaagagcacgttctgaaagtcatcccagaggatgcttcggaatcagaagagaagcttgaccagaaggaagatggctctaaatacgagacgattcacctcacagaggagcctacaaagctaatgcataacgccagcgattccgaggtcgaccaagatgacgtggtggagtggaaagatggcgcaagcccttctgaatccggccccggctcacagcaggtgagcgatttcgaggacaatacctgcgaaatgaaaccaggcacgtggagtgacgaaagctcccagagcgaggacgcacgctctagtaagcccgcagcaaaaaaaaaggcaaccatgcagggggacagggaacagctgaaatggaaaaatagcagctacgggaaagttgaaggattctggagtaaggatcagagccagtggaagaacgctagtgagaacgatgagcgactttccaacccacagattgagtggcagaattccacaattgatagcgaagatggcgaacagttcgacaatatgacagacggggtagccgaacccatgcacggaagcctggctggagtgaaactctcaagtcagcaagct

SEQ ID NO: 5742 - DNA, 3306 bp, Artificial Sequence
  Description of Artificial Sequence: Synthetic coding sequence
atgttccagttgcccgtaaacaacctagggtcacttcgcaaagccaggaaaactgtgaaaaaaattttatcagacataggactggaatattgcaaagaacatatcgaggatttcaagcagtttgaacctaatgatttttacctcaaaaacactacttgggaagacgtggggctgtgggatccttctctaacgaaaaatcaggactataggacaaaacctttctgttgtagtgcctgccccttttcttccaagttcttttcagcttataaatcccattttcggaatgtgcattctgaggatttcgaaaaccgaattctgctgaactgtccttattgcacattcaatgctgataaaaaaactctggaaacacatataaaaattttccacgccccaaacgcctcagccccatctagttccctttcaacttttaaggacaaaaacaaaaacgatgggctcaaaccaaaacaggccgattctgtcgaacaagctgtttattactgcaaaaaatgtacttatagagatcctctttatgaaattgtgagaaagcacatttatcgagaacatttccagcatgtagcagctccatatatcgcaaaagctggagaaaaatccctcaacggagcagtgccacttggaagtaatgcacgggaagagtcttctatacactgtaaaaggtgtctttttatgcccaaaagttatgaagcgctagtgcagcatgtcatcgaagatcacgaacggatcggatatcaggtgactgcaatgattggacatactaacgtggttgtcccgcgatcaaagcccctaatgcttatcgcacccaaaccccaggataaaaaatccatgggactgcctccccggataggatccctcgcctccgggaatgtacgctcattaccctctcagcagatggtgaacaggctcagtatccctaaaccaaatctaaactctacaggggtgaatatgatgagttctgtgcacctgcagcagaataattatggggtgaagtccgtgggacagggatattctgtggggcagtctatgaggctgggacttgggggaaacgctccagtaagtattccccagcaatctcagagtgtgaagcagcttctcccttctgggaatggaaggagttacgggcttggatccgaacaaaggtctcaggctccagcccgatattccctccagtcagcaaatgcttcttcactgtcttctgggcagctcaaatccccctcactctcacagagtcaggcttcacgggttttggggcagtcgagttctaaacccgctgcagccgcaacaggacccccacctgggaatactagttcaactcagaaatggaaaatctgtactatatgcaacgaactttttcccgaaaacgtgtattctgtacattttgaaaaagaacacaaagcagaaaaagtgcccgctgtcgctaattatattatgaaaatccacaactttacttctaaatgcctgtattgcaacaggtatctgcctacagatactctcctgaaccacatgctgatccacggactcagttgcccttattgtaggtcaacatttaatgatgtggagaaaatggctgcacacatgaggatggtgcatatcgatgaggagatggggcctaaaactgattctacactgtcgtttgacttaacgcttcagcaagggtctcatactaacatacatctgctggtcacaacatataatctaagggatgctcccgctgaaagtgtggcttatcacgcccagaataaccctccagtgccaccaaagccccagcccaaagtgcaggagaaagccgatattcccgtcaaatctagtcctcaagcggctgtgccctataaaaaggatgtcgggaaaacactttgcccattgtgcttctctatactgaaaggacctatcagtgatgccctagcacaccatctgcgagaaaggcaccaggtgatccagactgtgcatcctgtggaaaaaaaactgacatataaatgcatccactgcctgggggtgtatactagtaatatgacagcaagtacaataactttgcatctcgtccattgccggggggtggggaaaactcagaatgggcaggataaaactaatgcccctagtaggctgaatcagtcccctagtctcgctccagtgaaacgcacgtatgaacagatggaattccctttattgaaaaaacgaaagcttgatgacgattcggatagtccctcttttttcgaagaaaaacccgaagagcccgtggttctagctcttgatcctaaaggacatgaagatgattcgtatgaagcacgcaaatcttttctgacaaaatacttcaataagcaaccctaccctacaagacgagaaatcgaaaaattagcagcttctctgtggctttggaaatctgatatagctagtcacttttccaataaaaggaaaaaatgcgtgcgggattgcgaaaaatataaaccaggagtactcttggggtttaacatgaaagaactaaacaaagtaaaacacgagatggacttcgatgccgaatggctctttgagaaccacgatgaaaaagatagtcgcgtcaacgcttctaaaactgcggataagaaacttaatctaggaaaagaagacgattcatcctccgattcttttgaaaatctggaagaagaatcaaacgagtcgggatcacccttcgatccagtgtttgaagtggagcccaaaatttccaacgataatccagaagaacatgtccttaaagtgatacccgaagatgcttcagagtcggaagaaaaactggatcagaaagaagatgggtctaaatatgaaacgatccatctgacagaagagcccactaaactgatgcataacgccagtgattctgaagtcgatcaggatgatgtggtagaatggaaagatggggccagtcctagtgaatctgggcctggatcacagcaggtatctgatttcgaggataacacatgtgagatgaaacctggaacttggtcggatgaaagtagtcagagtgaagatgccagatccagtaaacctgcagccaaaaaaaaagcaacaatgcagggagatagggagcaattaaagtggaagaattcatcatacggaaaagtggaaggattctggagtaaagatcagtcccagtggaaaaacgcaagtgaaaatgatgaacgactgtcaaacccacagatagaatggcagaactctacaatcgattcagaagacggagaacagttcgacaatatgacagacggagtcgcagaacctatgcatgggtctctagctggagtgaaactgtcttcacagcaggcc

SEQ ID NO: 5743 - DNA, 3306 bp, Artificial Sequence
  Description of Artificial Sequence: Synthetic coding sequence
atgtttcaattgccagttaacaacctggggagccttaggaaggctcgcaagaccgtcaaaaagattctttcggatatcggcctggagtactgtaaggagcatatagaggactttaaacagttcgaacctaacgatttctacctcaagaataccacgtgggaagatgtcggtctgtgggaccctagcctgactaagaatcaagactacagaaccaagccgttctgttgttcagcatgtccattttcctccaagttcttttccgcatacaaaagccattttcggaatgtgcacagcgaggacttcgaaaaccgaattcttcttaactgcccttattgtacctttaatgccgacaagaaaacgctggaaacccacatcaagatttttcatgcccccaacgcctcagctccttcctcctcactgagcaccttcaaagataagaacaagaacgacggacttaagcctaaacaagcggactccgtggaacaggcagtgtactactgcaagaagtgtacttaccgcgatcccctctacgaaatcgtgcgtaagcatatctacagggagcactttcaacatgtggcagcaccatacatcgcaaaggcaggcgagaagagcctcaatggagcagtgcctctgggctccaatgcccgtgaagaatccagcattcactgtaagcgctgcctgttcatgccaaagagctatgaagcactggtccaacacgtcattgaggatcacgagcgtattggataccaagtgactgccatgattggtcacacgaatgtggtggtcccacgctccaaaccacttatgctgatcgcccccaagcctcaggataagaagtccatgggactcccccctcgcataggctcgcttgcatccggcaatgtgcgatccctgccttcgcaacaaatggtcaacagactcagcattcctaagccgaatcttaattcgaccggtgtgaatatgatgtcgtccgtgcacctgcaacagaacaactacggagtgaagtcagtgggacaggggtactcggtgggacaatcgatgcggctgggcctcggaggaaacgcccccgtctcgatcccacaacaatcacaaagcgtcaagcaacttctgcctagcgggaacggacgcagctacggcctcggttccgaacagcggtcccaggctcccgcacgatactcactgcaaagcgctaatgcatctagcttgagctcgggacaactgaaaagcccctctctgtcgcagtcgcaagccagcagagtcctgggccaatcatcgagcaagcccgcagcggcggcaactggtccaccgccaggtaacacttcgtcgactcaaaagtggaagatctgtactatttgtaatgaactgttccctgaaaacgtgtactcagtccattttgaaaaggagcacaaggctgaaaaggtgcctgcagtggccaattacattatgaaaattcataactttacgagcaaatgtctttactgtaatcgataccttcctaccgatactctcctcaaccatatgcttatacacggtctttcgtgtccttattgcagaagcacttttaacgatgtggagaaaatggcggctcacatgcggatggtgcatattgatgaagaaatgggacccaagaccgattcgactctgtcgttcgacctgaccctgcagcagggctcgcatactaacatccatcttttggtgactacttacaacctcagggacgcccctgctgaatccgtggcctaccatgctcagaacaatcctcctgtgcctccaaagccacaaccaaaggttcaagaaaaggctgatattcctgtcaagtcctcaccccaggcagcagtcccctacaagaaagatgtgggcaagaccctctgtcctctgtgtttttcaatactcaagggacctatttcggatgcactggcacatcatctgcgcgaaagacatcaagtgatccaaacggtgcatccagtggaaaagaagctcacttacaaatgtattcattgccttggagtgtacaccagcaacatgactgccagtaccattactcttcaccttgtccattgtaggggagtgggcaaaacccagaatggacaagataagactaacgcgccatcacggctgaaccaaagcccttccctggcaccggtcaaacgaacttacgaacaaatggaattcccgctgcttaagaagcgtaagctggacgatgactccgatagcccttccttttttgaagaaaaaccggaggaaccagtggtcctggcacttgacccgaaagggcatgaggacgatagctatgaagcgagaaagtcgttcctcactaagtatttcaacaagcaaccctacccaactcggcgggaaatcgagaagttggctgcctctctctggttgtggaagtcagacattgcatcccatttttcgaacaagagaaagaaatgtgtgagagactgtgaaaagtataagccaggcgtcctgttgggtttcaatatgaaggaattgaacaaggtgaagcatgaaatggactttgatgcagaatggctgtttgagaaccacgatgaaaaggattcacgggtgaatgcatctaagaccgcagacaagaaacttaacttgggaaaagaggacgactcttcgtccgactcgtttgagaacctggaagaggagtcgaacgagagcggaagcccgtttgaccccgtgtttgaagtcgagccaaaaatctccaacgacaacccagaagagcacgtccttaaggtgatcccagaggatgcatcagagagcgaagaaaaacttgatcaaaaggaggatggaagcaaatacgagactatacatcttactgaggagccgaccaagctcatgcataatgctagcgacagcgaagtggatcaggatgacgtcgtggaatggaaggacggtgcaagcccttctgaatccggaccaggcagccagcaggtgtcggatttcgaggataatacttgcgaaatgaagcctggaacgtggtccgacgaatccagccaatccgaagatgcacgtagctcgaagcccgccgcaaagaaaaaggcgaccatgcaaggcgatcgagagcagctgaagtggaagaactccagctacggaaaggtcgagggtttctggtcaaaggatcagtcccagtggaagaacgcctcagaaaatgacgaacggctctctaaccctcaaatagaatggcagaattcaactattgactcggaggacggagagcaatttgataacatgaccgatggagtggcagaacccatgcatggatccctcgcaggagtgaagctctcgtcacaacaggcc

SEQ ID NO: 5744 - DNA, 3306 bp, Artificial Sequence
  Description of Artificial Sequence: Synthetic coding sequence
atgtttcagctgcccgtgaataacctcggaagcctccgcaaggcaagaaagaccgttaagaagatcctctccgatatcggcctggaatattgcaaagagcacatagaggactttaaacaatttgagcccaatgacttctacttaaagaacactacttgggaggatgtggggctgtgggatccaagtctgacaaagaaccaggactaccggacaaaaccgttctgttgctctgcatgcccgttctcctctaaatttttcagcgcgtacaagagccacttcagaaacgtccactccgaggattttgaaaaccgaatcttgctgaattgtccatactgcacttttaacgccgataaaaagacccttgagacgcacatcaaaatttttcacgcacctaatgcctcagcaccctcatcttctctgtcaacgttcaaagacaaaaacaaaaatgatggcctgaaacctaaacaggccgactctgtggaacaggctgtttactactgcaaaaaatgtacctacagggatcccttatacgagatcgtgcggaagcacatttatcgcgagcactttcagcatgtggcagcgccttatattgctaaggcaggggaaaaaagcctaaacggcgctgtgcctttaggaagcaatgccagagaagaatccagcattcattgtaagagatgtctgttcatgccaaaatcctacgaggccctcgtgcagcacgtcatcgaagaccatgagagaatagggtaccaggtcactgctatgatcggtcacacgaacgtggtggtcccgcgcagcaaacccttgatgcttattgctcccaaaccccaagacaagaaatctatgggactgccaccaaggataggttccttggcttccggaaacgtgcgttccctgccatcccagcagatggtcaatcggttgagtatccccaaacccaacctaaattccacaggagtgaatatgatgtctagcgtacacctacaacaaaacaattatggagtcaaaagtgtggggcagggctacagcgtcggccaatctatgcgactgggtttgggcggaaacgctccggtaagtatacctcagcagtctcagagcgtgaagcagttattaccttctgggaatggcaggtcgtatgggttaggttccgagcagaggagtcaggccccggcccggtatagtctgcagagcgcgaacgcttcctctctgtcctccggacagctgaagtcccctagcctgtctcagtctcaagcttccagggttttgggacagtcctcaagtaaacctgctgcagcagcgacagggcccccccccggtaacacatcctctactcagaagtggaagatttgtacaatatgcaatgagctctttccagagaatgtttactccgttcattttgagaaggaacataaagccgagaaggtgcctgccgtagcaaactacataatgaagattcacaacttcacatctaaatgtctttattgcaaccgctatctccccactgatacgcttctgaatcatatgttgatacatgggctgtcctgcccctattgtagatctacatttaacgacgtcgaaaaaatggccgcccatatgcggatggtccacatagacgaggaaatgggcccaaaaactgatagtaccctgagttttgatttgactcttcagcaaggttctcacacgaacattcacctgctcgtgaccacttataacttgagggatgctcctgctgagtccgtagcctaccacgcccaaaacaaccctcctgtgccgcctaagccccagccaaaagtgcaggagaaggccgacattccagtgaaatcttcacctcaggctgccgttccatataagaaagatgtgggcaagacactgtgcccactctgcttctccatcctgaaaggtccaatcagcgacgctttggcccaccatctgcgggagaggcatcaggttatccaaactgtacaccctgttgaaaaaaaactgacgtataaatgtatccactgtctgggagtgtacaccagtaatatgaccgcgagcacaatcaccctgcatctcgtccactgtagaggcgttgggaaaacacaaaacggacaggacaaaactaacgccccaagtagattaaaccaaagcccttctttggctcctgtcaagagaacctacgaacagatggaatttcctctgctgaagaagaggaagctcgatgatgactcagattcaccaagctttttcgaggagaaaccagaagaaccagtggtgttggctttagatcccaagggtcatgaggacgatagctacgaggcacggaaatctttcttaacaaaatactttaataaacagccctacccaacacggcgagaaattgagaaattggccgcctcactttggctgtggaaaagcgacatagccagccacttctctaacaaaaggaagaaatgtgtgcgcgattgtgagaaatataaacccggcgtactgctcggtttcaatatgaaggagctgaataaggtcaagcatgagatggactttgatgccgagtggctctttgaaaaccacgatgagaaggactcccgcgtgaatgccagtaagaccgctgataaaaaactgaaccttgggaaggaggacgacagcagctccgacagttttgaaaatctggaggaggaaagcaacgagagcggctcaccattcgacccagtctttgaggtagagcctaagattagcaatgataaccccgaagaacacgtgttaaaggtgataccggaggatgcatccgaatctgaggagaaactggaccagaaagaggacggaagcaagtacgagaccatccacctgaccgaggaaccaaccaagctcatgcacaatgcgagcgactctgaagtcgatcaagacgatgtcgtcgagtggaaggatggcgctagccccagcgagtccggtcccggcagtcagcaggtgtcagacttcgaagacaacacatgtgaaatgaaaccgggcacgtggtctgacgaatcttcacagtcagaagacgcacggtcttctaaaccggccgccaagaagaaggcaaccatgcagggtgatcgggaacaactgaagtggaagaacagctcttatggcaaggtagaggggttttggtccaaagaccaaagccagtggaaaaacgccagtgaaaatgatgagcgattgagcaacccccaaatcgagtggcagaactcaaccatcgactctgaggacggcgagcagttcgacaacatgactgatggcgttgcagagcccatgcacggcagcttagccggggtcaagttgtcttctcagcaggct

SEQ ID NO: 5745 - DNA, 3306 bp, Artificial Sequence
  Description of Artificial Sequence: Synthetic coding sequence
atgtttcaattaccagttaataacttgggaagcttaagaaaagcaagaaagacagttaaaaaaatattaagtgatattggattagaatattgtaaagagcatattgaagatttcaaacagtttgaaccaaacgacttctatttaaagaatactacttgggaagatgtaggtctttgggatccatcactaacaaaaaatcaagattacagaacaaaaccattttgttgtagtgcttgtccattttcatcaaagttttttagtgcatataagagtcatttcaggaatgttcatagtgaagattttgaaaacagaattttacttaattgtccatattgtactttcaatgcagataaaaaaacccttgaaactcatattaagatatttcatgcacctaatgcatcagcaccatctagttctttatcaacatttaaagacaagaataaaaatgatggattaaaacctaaacaagcagatagtgttgaacaagcagtttattattgtaagaaatgcacttatagagatccattatacgaaatcgttagaaaacatatttatagagagcattttcaacatgtagctgcaccttatattgctaaagctggtgaaaagtctttaaatggagcagtacctcttggttctaatgctagggaagagagtagtattcattgtaaaagatgtctttttatgccaaagagttatgaagctttggttcaacatgttatcgaagaccatgaaagaattggatatcaagttacagctatgataggacatacaaatgttgttgttcctagatcaaaaccattaatgcttattgcacctaaaccacaagataaaaagtctatgggattaccacctagaattggaagtcttgctagtggaaatgttagaagtcttccatcacaacagatggttaatagattatctattcctaaaccaaaccttaactctactggtgttaatatgatgtcatcagttcatcttcaacaaaataattatggagttaaatcagttggacaaggatatagtgtaggacaatcaatgagattaggattaggaggaaatgcaccagtttcaattccacaacaatcacaatctgttaaacaattgcttccatcaggaaatggaagaagttatggattgggatcagaacaaagaagtcaagcaccagcaagatattctttacaaagtgctaatgcttcttctcttagtagtggacaattaaaatcaccaagtttatcacaatcacaagcttctagagttttaggacaatcatcttcaaaaccagctgcagcagctacgggaccaccaccaggaaatacatcatcaacacagaaatggaaaatttgtactatttgtaatgaactttttccagaaaatgtttattcagttcatttcgagaaggagcacaaagcagaaaaagttccagctgttgctaattatataatgaagatacataattttacctcaaaatgtttatattgtaatagatatttaccaactgacactttacttaatcacatgcttattcatggactttcatgtccttattgtagaagtacttttaatgacgttgaaaaaatggcagctcatatgagaatggttcatatagatgaagaaatgggaccaaagacagatagtacattatccttcgatttaacattacaacaaggatcacatactaatattcacttattagttactacttataacttaagagacgcaccagcagagagtgttgcatatcatgctcaaaataatcctcctgttcctcctaaaccacaaccaaaagtacaagaaaaagcagatattccagttaaatcttccccacaagcagctgttccatacaaaaaagatgttggaaaaactttatgcccattatgtttcagtattttaaaaggaccaataagtgatgccttggcccatcacttgagagaaagacatcaagtaattcaaacagttcatcctgtagagaaaaaacttacgtataaatgtattcattgtttaggagtatatacaagtaatatgacggcctcaacaatcactttacatttagttcattgtagaggtgttggaaaaacacaaaacggacaagataaaactaatgctccaagtagacttaatcaatcaccatcattagctccagttaagagaacatatgaacaaatggaatttccattattaaaaaagagaaaattagatgatgattctgatagtccatctttttttgaagaaaaaccagaagaaccagttgtcttagcacttgatccaaaaggacatgaagatgattcttacgaagctagaaaatcatttttaacaaaatatttcaataagcagccatatccaactcgtagagaaattgaaaaattagctgcttctttatggttatggaaatctgatatagcatctcatttcagtaataagcgtaaaaagtgtgttagagactgtgaaaaatataagccaggtgttttattaggtttcaatatgaaagaacttaataaggttaagcatgaaatggatttcgacgcagaatggttattcgaaaatcatgatgaaaaagattctagagttaatgcatctaaaactgcagataaaaaacttaatcttggaaaagaagatgattcatcatcagattcattcgagaatttagaagaagaaagtaacgaaagtggatctccttttgatcctgtatttgaagttgaaccaaaaatttctaatgacaatccagaagaacacgtattaaaggttataccagaagatgcatcagaatcagaagaaaaacttgatcaaaaagaagacggttcaaaatatgaaacgatacacttaacagaagaaccaacaaaacttatgcacaatgctagtgattcagaagttgatcaagacgatgttgtggaatggaaagatggagctagtccatctgaatctggaccaggatctcaacaggtttctgatttcgaagacaatacttgtgaaatgaaaccaggtacttggtcagatgagtcatcacaatcagaagatgctagatcatctaaacctgcagctaagaaaaaagctacaatgcaaggagatagagaacaattaaagtggaaaaattcttcatatggaaaagttgaaggattttggagtaaagaccaatcacaatggaaaaatgcttctgaaaacgatgaaagattaagtaatccacaaattgaatggcaaaattctactattgatagtgaagatggagaacaatttgataatatgacagatggagtcgctgaaccaatgcatggatctcttgcaggagttaaattatctagtcaacaagca

SEQ ID NO: 5746 - DNA, 3306 bp, Artificial Sequence
  Description of Artificial Sequence: Synthetic coding sequence
atgttccagctgcctgtgaataacctggggtcgctcagaaaggcccgcaagactgtgaagaagatcttgtccgatattggactggagtactgcaaggaacatatcgaggactttaaacaattcgaacctaatgatttctacctgaagaatacgacttgggaggacgtcgggctctgggacccatccctgaccaagaaccaggattaccgcactaagcccttttgctgctccgcatgcccctttagctcgaagttcttctcagcgtacaagtcgcacttccgcaatgtccactcggaggactttgaaaatcgcatcctgctgaactgtccctactgcacttttaacgcggacaagaaaactcttgaaactcatatcaaaatcttccacgcgccaaacgcttcagccccgtcctcgtcactctccaccttcaaggacaagaacaagaatgacggcctgaagccgaagcaggctgattccgtcgaacaagctgtgtactattgcaagaagtgcacttatcgcgacccgctgtacgaaatcgtgcgaaagcacatttatcgcgaacatttccaacatgtggccgctccatatatcgcaaaggccggcgaaaagtcactgaacggagctgtgccgctgggatcgaacgcccgggaggagagcagcatccactgcaagagatgcctcttcatgccgaagtcctacgaggccctggtgcagcatgtcattgaagatcacgaaaggatcggataccaagtgaccgcgatgatcggacacactaatgtggtggtgcctcgctcgaaaccactgatgctcatcgcaccgaagccgcaggacaagaagtcgatgggtctgccgcccaggatcggaagcctggcttctggcaacgtgagatcactgccttcccagcagatggtgaaccggctcagcatccctaaaccgaatctgaactccactggcgtcaacatgatgtcctccgtgcatcttcagcagaacaactacggagtgaaatcggttggtcaagggtactccgtcgggcaatcgatgcgcctgggcctcggaggcaacgcccctgtgtcgattccgcaacagtcgcaatcagtcaagcagctgctgccgtccggaaacggacggtcatacggactgggaagcgagcaaagatcacaggcgcctgcacgatactcattgcagagcgcgaatgcgtcatcactgtcgtcaggacagctcaaatccccgtcactgtcccagtcgcaggcctcccgcgtgctcgggcaatcgtcgagcaagccagcagctgcggccaccggtccaccgccgggaaatactagctcgactcagaagtggaagatctgcacgatctgcaacgaattgttcccggagaacgtctactccgtccactttgagaaggaacataaggccgaaaaggtgcccgccgttgccaattacatcatgaagattcacaactttacctcgaaatgtctgtactgcaacaggtacctccccaccgacactttgctcaaccatatgctgattcatggcctgtcctgcccatactgccggtccaccttcaacgatgtggagaagatggccgcacacatgcggatggtgcacatcgatgaagagatggggccaaagaccgactcgaccctgagcttcgacctcactctgcaacaagggagccacactaacatccacctgctcgtgacgacctacaatctgcgagatgccccagcggagagcgtggcgtaccacgcccagaataaccccccagtaccgccgaaaccacagcctaaggtccaggaaaaagcagatatccctgtgaagtcgtccccgcaggcagcggtgccgtacaagaaagatgtcggcaagaccttgtgtccgctgtgtttctccatcctgaaggggccaattagcgatgcgctcgcccaccatctgagagagaggcaccaggtgatccagaccgtccaccctgtggaaaagaagctgacctacaagtgcatccattgccttggagtgtacacctcgaacatgaccgcatcgacgatcactctgcaccttgtccattgcagaggagtgggtaaaacccagaacgggcaagacaaaaccaacgcgccaagcaggctgaatcagagcccgtcgcttgctcctgtgaagcggacgtacgaacagatggaatttccgcttctgaagaagcggaaactggatgatgattcagatagcccgtcattctttgaagagaagccggaggaaccagtcgtgctggcactggatccgaagggacatgaagatgattcatacgaagcaagaaaatcctttctgactaagtactttaacaagcagccgtacccgactcgccgtgagatcgaaaaactcgccgcttctctgtggctgtggaagtccgatattgcttcccacttctcaaataagaggaagaagtgtgtgcgcgattgtgaaaagtacaagccaggagtcctcctgggcttcaacatgaaggaactcaacaaggtcaaacacgagatggattttgacgctgaatggctcttcgaaaatcatgatgagaaggattcgcgggtcaacgcctcgaaaacggctgacaagaagttgaatctgggaaaggaggatgattcctccagcgattcgttcgaaaacctcgaagaggagtcgaacgaatcaggatcccctttcgatccggtttttgaggtggaacctaagatcagcaacgataacccagaagaacatgtgctcaaagttatcccagaagatgcttccgagtcagaggaaaaactggaccagaaggaggacggatcgaagtacgaaactatccaccttactgaggagcctactaaactcatgcataacgccagcgactccgaagtcgaccaggacgacgtcgtggagtggaaggacggagcatcaccttccgagtccggaccgggcagccagcaagtgtccgacttcgaagataatacctgcgagatgaaacctgggacttggtcagatgagtcaagccagagcgaagatgcccgatcgagtaagcctgcggcgaaaaagaaggcgactatgcagggcgaccgggagcagctgaagtggaagaattcgtcgtacggaaaggtggagggattttggtcgaaagatcagtcacaatggaagaacgcgtcggaaaatgacgaacggctgtccaacccacagatcgaatggcagaacagcaccatcgattccgaagatggcgagcaattcgacaatatgaccgatggagtcgcggagccgatgcacggctcgctggcgggcgtcaaactgtcctcgcagcaggcc

SEQ ID NO: 5747 - DNA, 3306 bp, Artificial Sequence
  Description of Artificial Sequence: Synthetic coding sequence
atgtttcaattaccggttaataatttaggttcgctacgtaaagcgcgaaaaacggttaaaaaaatattatcggatataggtctagaatattgtaaagaacatatagaagattttaaacaatttgaaccgaatgatttttatctaaaaaatacgacgtgggaagatgtaggtttatgggatccgtcgctaacgaaaaatcaagattatcgaacgaaaccgttttgttgttcggcgtgtccgttttcgtcgaaatttttttcggcgtataaatcgcattttcgtaatgttcattcggaagattttgaaaatcgaatactactaaattgtccgtattgtacgtttaatgcggataaaaaaacgctagaaacgcatataaaaatatttcatgcgccgaatgcgtcggcgccgtcgtcgtcgttatcgacgtttaaagataaaaataaaaatgatggtctaaaaccgaaacaagcggattcggtagaacaagcggtatattattgtaaaaaatgtacgtatcgtgatccgttatatgaaatagttcgtaaacatatatatcgtgaacattttcaacatgttgcggcgccgtatatagcgaaagcgggtgaaaaatcgctaaatggtgcggttccgctaggttcgaatgcgcgagaagaatcgtcgatacattgtaaacgttgtctatttatgccgaaatcgtatgaagcgttagttcaacatgtaatagaagatcatgaacgaataggttatcaagtaacggcgatgataggtcatacgaatgtagttgtaccgcgttcgaaaccgttaatgttaatagcgccgaaaccgcaagataaaaaatcgatgggtttaccgccgcgtataggttcgttagcgtcgggtaatgttcgttcgttaccgtcgcaacaaatggtaaatcgtttatcgataccgaaaccgaatctaaattcgacgggtgttaatatgatgtcgtcggtacatttacaacaaaataattatggtgttaaatcggtaggtcaaggttattcggtaggtcaatcgatgcgattaggtctaggtggtaatgcgccggtatcgataccgcaacaatcgcaatcggtaaaacaattactaccgtcgggtaatggtcgatcgtatggtttaggttcggaacaacgttcgcaagcgccggcgcgttattcgttacaatcggcgaatgcgtcgtcgttatcgtcgggtcaattaaaatcgccgtcgttatcgcaatcgcaagcgtcgcgtgttctaggtcaatcgtcgtcgaaaccggcggcggcggcgacgggtccgccgccgggtaatacgtcgtcgacgcaaaaatggaaaatatgtacgatatgtaatgaattatttccggaaaatgtttattcggttcattttgaaaaagaacataaagcggaaaaagttccggcggtagcgaattatataatgaaaatacataattttacgtcgaaatgtctatattgtaatcgttatctaccgacggatacgttactaaatcatatgctaatacatggtttatcgtgtccgtattgtcgttcgacgtttaatgatgtagaaaaaatggcggcgcatatgcgtatggtacatatagatgaagaaatgggtccgaaaacggattcgacgttatcgtttgatctaacgttacaacaaggttcgcatacgaatatacatctattagttacgacgtataatctacgtgatgcgccggcggaatcggtagcgtatcatgcgcaaaataatccgccggtaccgccgaaaccgcaaccgaaagtacaagaaaaagcggatataccggtaaaatcgtcgccgcaagcggcggttccgtataaaaaagatgttggtaaaacgctatgtccgttatgtttttcgatattaaaaggtccgatatcggatgcgctagcgcatcatctacgagaacgtcatcaagttatacaaacggtacatccggttgaaaaaaaattaacgtataaatgtatacattgtctaggtgtatatacgtcgaatatgacggcgtcgacgataacgctacatttagttcattgtcgaggtgttggtaaaacgcaaaatggtcaagataaaacgaatgcgccgtcgcgtctaaatcaatcgccgtcgctagcgccggtaaaacgaacgtatgaacaaatggaatttccgttattaaaaaaacgtaaattagatgatgattcggattcgccgtcgttttttgaagaaaaaccggaagaaccggttgtactagcgttagatccgaaaggtcatgaagatgattcgtatgaagcgcgaaaatcgtttctaacgaaatattttaataaacaaccgtatccgacgcgacgtgaaatagaaaaactagcggcgtcgttatggctatggaaatcggatatagcgtcgcatttttcgaataaacgaaaaaaatgtgtacgagattgtgaaaaatataaaccgggtgtattactaggttttaatatgaaagaattaaataaagtaaaacatgaaatggattttgatgcggaatggttatttgaaaatcatgatgaaaaagattcgcgagtaaatgcgtcgaaaacggcggataaaaaattaaatctaggtaaagaagatgattcgtcgtcggattcgtttgaaaatctagaagaagaatcgaatgaatcgggttcgccgtttgatccggtttttgaagtagaaccgaaaatatcgaatgataatccggaagaacatgttttaaaagtaataccggaagatgcgtcggaatcggaagaaaaactagatcaaaaagaagatggttcgaaatatgaaacgatacatttaacggaagaaccgacgaaattaatgcataatgcgtcggattcggaagtagatcaagatgatgtagttgaatggaaagatggtgcgtcgccgtcggaatcgggtccgggttcgcaacaagtttcggattttgaagataatacgtgtgaaatgaaaccgggtacgtggtcggatgaatcgtcgcaatcggaagatgcgcgatcgtcgaaaccggcggcgaaaaaaaaagcgacgatgcaaggtgatcgagaacaactaaaatggaaaaattcgtcgtatggtaaagtagaaggtttttggtcgaaagatcaatcgcaatggaaaaatgcgtcggaaaatgatgaacgtctatcgaatccgcaaatagaatggcaaaattcgacgatagattcggaagatggtgaacaatttgataatatgacggatggtgttgcggaaccgatgcatggttcgctagcgggtgttaaactatcgtcgcaacaagcg

SEQ ID NO: 5748 - DNA, 3306 bp, Artificial Sequence
  Description of Artificial Sequence: Synthetic coding sequence
atgttccaacttcctgtgaacaatctcggctcgttgcgcaaagcgcgaaagaccgtgaagaaaatcttgtccgatattggactggaatactgcaaagaacacatcgaggatttcaaacaattcgaaccgaacgatttctacctcaagaataccacctgggaggacgtcgggctgtgggatccgagcctgaccaagaatcaggattacagaacgaagccgttttgctgttcagcatgcccgttctcgtcgaaattcttctcggcatataagtcgcacttccgcaacgtgcattcagaagatttcgagaacaggattcttctgaactgcccctactgcactttcaatgcagacaagaaaactcttgaaactcacataaagatattccatgcgccaaacgcctcggccccaagcagcagtctgtcgaccttcaaggacaaaaacaagaacgacggactgaaaccaaaacaagccgattcagtggaacaagcggtgtactactgcaagaaatgcacttaccgcgatcctctttacgagatcgttagaaagcatatctaccgagaacatttccagcacgtcgccgctccttacatcgcaaaggccggcgagaagtccctcaatggcgcagtgccactggggtcgaacgccagagaagaatcgtcaatccactgcaagcgctgcctcttcatgcccaaatcgtacgaggctctggtccagcatgtgatcgaggatcacgaacggatcggttatcaggtgaccgctatgattggacacacgaacgtggtggtcccgcgttccaagccactcatgttgatcgcgcccaagccacaggacaagaagtcgatgggtctgccgccaagaattggatctcttgcctcgggaaacgtacgctccttgcctagccagcagatggttaatcggctttccatcccgaaacctaatctgaattcaactggtgtcaatatgatgtccagcgtccacctgcaacagaacaactacggagtgaaatccgtcggacagggatactcggtcggacagagcatgcgcctcgggctcggtggcaatgctccggtgtcaatccctcagcaatcgcaatccgtcaaacagctgctgcccagcggcaacgggagatcgtacgggctcggcagcgagcaacgttcccaggcaccggcaaggtacagtctgcaatctgccaacgcaagtagcctgagctccggacaactcaaatccccgtcactctcacagagccaggcctccagggtcctgggacagtcgtcgagcaagcccgctgccgctgccactggaccaccaccgggaaacacgagctctactcaaaagtggaaaatctgtaccatctgcaacgaactctttcctgaaaatgtgtattccgtgcatttcgaaaaggagcacaaggccgaaaaggtcccagctgtggcaaactacattatgaagatccataacttcaccagcaagtgcctctactgtaacaggtatttgccgactgatacccttctgaaccatatgctgatccatgggctgtcatgcccgtactgccgctcaacctttaatgacgtggagaagatggccgcacacatgcggatggtgcatattgacgaagaaatgggcccaaagactgacagcactctttcatttgatctcacgctccaacagggatcgcacactaacattcacctcctggtgaccacctataatctccgagacgctccggccgaatccgtggcataccacgcccaaaacaacccaccagtgcctccgaagcctcagccgaaggttcaagagaaggccgacattccggttaagtcctcacctcaggccgcggtcccctacaagaaggacgtgggcaagactctttgccctctgtgcttctctatcctgaaaggaccgatctctgatgctttggcgcaccatctgcgggagcgccaccaggtcatccaaaccgtgcaccctgtggaaaagaaactcacgtacaagtgcattcactgtcttggggtgtacacttcaaatatgactgcctcgaccatcaccctgcatctcgtccattgtcgcggagtgggtaaaacccagaacgggcaggataagactaacgctcctagccggttgaatcagtccccttccctggccccggtaaaacggacttacgagcagatggagttcccgctgctgaagaagcggaagctggatgatgatagtgactcgcccagcttctttgaggagaaaccggaagaaccggtggtgctcgctctggacccgaagggccacgaggacgattcgtacgaggccagaaagtccttcttgaccaaatactttaacaagcagccctacccgacccgcagagaaatcgagaaactggcggcgtccctttggctgtggaagagcgatatcgccagccactttagcaataagagaaagaaatgtgtgagagactgtgaaaagtacaaaccgggagtgctcctggggtttaacatgaaggaattgaataaggtgaagcacgaaatggacttcgatgccgagtggctgttcgaaaatcacgatgaaaaagactccagggtgaacgcgagtaagaccgcggacaagaaactgaatctggggaaggaggacgactcgtcgtcggactctttcgaaaacctggaggaagagtccaacgagtcgggatccccatttgatccggtgttcgaggtcgagccgaagatcagcaatgacaacccggaagagcatgtcctgaaggttatcccggaggacgcctcggaatcagaagaaaagctcgaccagaaggaagatggatccaagtacgaaactatccatttgaccgaagagcctaccaagctgatgcacaatgcgtcggacagcgaagtggatcaggatgacgtagtggaatggaaagatggagcgtctccatccgaatccggaccgggttcccaacaggtttcagactttgaggataacacttgcgaaatgaagccgggtacttggtcggacgagagctcacaatcggaagatgcgcggtcgtcgaagccggctgctaaaaagaaggcaactatgcagggagatcgcgaacagctgaaatggaagaactcttcatacggaaaagtggaaggattttggtcgaaggaccagtctcaatggaagaatgccagcgagaacgacgaacggctttctaacccacagatcgaatggcagaactcaaccatcgactcagaggacggcgagcagttcgataacatgaccgacggggtggcggagccaatgcacggctcgttggcgggagtgaagctgtcctcacaacaggcg

SEQ ID NO: 5749 - DNA, 3306 bp, Artificial Sequence
  Description of Artificial Sequence: Synthetic coding sequence
atgttccagctccccgtgaacaatcttggttccctgagaaaagcaagaaagactgtcaagaaaattctgtccgatatcgggctggaatattgtaaggagcatattgaagatttcaagcagtttgaaccaaatgatttctacctcaagaatactacctgggaagatgtgggactctgggatcctagccttacgaagaatcaagattacagaaccaagccgttctgttgctcggcatgccctttttcttccaaattcttctcagcgtataagtcgcatttcaggaacgtgcattcggaagatttcgaaaataggattctgctcaattgtccctactgtaccttcaatgccgacaagaaaactcttgagactcatatcaagatttttcacgcgccgaacgcatccgcccctagctccagcctctccacctttaaggataagaacaaaaatgacggtctgaagcctaaacaggcggatagcgtggagcaagcagtctactactgtaagaaatgtacttacagggaccctctgtacgaaattgtccgtaagcacatttaccgagagcatttccagcatgtggcagcaccgtacatagcaaaggctggggaaaagtcgctgaacggagcagtcccactgggttcgaatgcacgggaagaatcctcaattcattgcaaacgctgtcttttcatgcctaaatcctacgaagcactggtgcagcacgtgattgaagatcatgaaagaattggctaccaagtgactgcaatgattgggcacaccaacgtggtggtgccacgatccaagccactgatgctgatcgcacctaagccacaagataagaagtccatgggtctgccacctcgcataggctcgttggcatcgggtaatgtgcgatcattgccatcgcaacagatggtgaacagactctctattccaaaacctaacctgaactccaccggagtgaatatgatgtcgtccgttcatctccaacaaaacaactacggagtgaagtctgtgggtcaggggtactcagtcggtcaatcgatgcgcctggggctcggtggtaacgctccagtgagtataccgcaacagtcccaatccgtgaaacagctgctgccatcaggaaatggtcggtcgtacggactcggctccgaacaaagatcgcaggcgccagcaagatactccctgcaaagcgcgaacgcgtcgtctctgtcctccggtcaacttaagtccccttcgctgtctcaatcacaggcatcgagagtgcttggccagtcgtccagcaaacctgcggcagcagcaaccggacctcctcccggtaacactagctcaacccagaagtggaagatttgcactatttgcaatgaactctttccggaaaacgtctactccgtccactttgaaaaagagcataaggcagaaaaggtccctgccgtggccaactacatcatgaagatacacaactttaccagcaagtgtttgtactgtaatagataccttccgaccgataccctcctgaaccatatgcttatccacggactctcttgtccatactgcagatcaaccttcaatgacgtggaaaagatggcggcacatatgaggatggttcatattgatgaggagatgggtcccaagaccgactccactttgtcctttgacctcactcttcagcaaggatcacataccaacattcaccttttggtcaccacctacaatttgagagacgcgcctgcagaaagcgtcgcataccatgcacagaataatcctccagtccctcctaaaccccagcctaaggttcaggagaaagcggatattccagtgaagtcctcgcctcaggcagcagtcccctacaagaaggatgttggtaagactctgtgtcctctgtgtttctccattctgaagggtcctatatctgatgccctcgcgcatcacctgagagagagacatcaggtgatccaaactgtccacccagtcgaaaagaagctgacctacaagtgcatccattgtctgggtgtgtatacttccaacatgaccgcgtcgactatcactcttcatctcgtgcattgtcggggtgtgggcaagacgcaaaacggtcaggataagaccaacgcaccatccaggctgaaccaaagcccatctctcgccccagtgaaacgtacctacgagcagatggaatttccccttttgaagaaacgtaagctcgatgatgattcggatagcccttcctttttcgaggagaagccagaagaaccagtcgtcctggcacttgaccccaaagggcacgaagatgactcgtacgaggccagaaagtcattcctgaccaagtacttcaataagcaaccttaccctacccgtagagaaattgagaaacttgcagcttcactgtggctttggaagagcgatattgcatcccatttttcaaacaaacggaagaaatgtgtgcgggattgtgaaaagtacaaacctggagtcctcctgggctttaacatgaaggaactcaacaaggtgaagcatgaaatggactttgacgcagaatggcttttcgagaatcatgatgaaaaagattccagagtgaacgcttctaagactgcagataagaaacttaacctggggaaggaggatgattcatcgtcggactcatttgagaaccttgaggaagagtcgaatgaatcaggttcgccttttgatcctgtgtttgaggtggaacccaagatttcgaacgataacccggaagaacatgtcctgaaggtgatccccgaagatgcatcagaatcggaagaaaagctcgaccagaaggaagatggatcaaaatacgaaaccatccatcttacggaggagcctactaagctcatgcataatgcctcagactcagaggtcgaccaggatgacgtagtcgaatggaaggacggagcttccccttccgaatccgggcctggctcacagcaggtcagcgattttgaagataacacttgtgagatgaagcctggaacttggtcagatgagtcctcgcaatcggaagatgcacgtagctccaaacccgccgcgaagaagaaagcaactatgcaaggcgatcgggagcaactgaagtggaagaattcgagctacggtaaggtggagggattctggagcaaagaccaatcccaatggaaaaatgcgtcagaaaacgatgaacgtctgagcaatccgcaaatcgaatggcaaaactccactatcgattcagaggatggagaacaatttgataacatgacggacggcgtggcagaaccaatgcatgggtcacttgctggcgtgaaactttcgagccaacaagct

SEQ ID NO: 5750 - DNA, 3306 bp, Artificial Sequence
  Description of Artificial Sequence: Synthetic coding sequence
atgtttcagctgcccgtgaataatctaggaagccttcggaaggcccggaagactgtgaagaagatactatccgacataggtcttgagtactgtaaagagcatattgaggattttaagcagttcgagccaaatgatttctacctgaaaaacactacctgggaggatgttggcctgtgggatccctctctgaccaaaaaccaggattatcgaaccaagcccttttgttgtagcgcctgtcccttctcttctaaattcttcagcgcatacaagagtcattttaggaacgttcattccgaggatttcgagaacagaattctcttaaactgcccttattgcacctttaatgcagataagaaaaccctggagactcacataaaaattttccatgcacctaacgctagtgcaccaagctccagtctgtccacctttaaagataagaacaaaaacgacggtctaaagcccaagcaggccgacagtgtggagcaggcagtttattattgcaagaaatgtacatatagagatcctctatacgaaatcgttcgaaagcacatttaccgggaacattttcaacacgtcgccgccccatacattgctaaagccggcgagaagtccctcaatggagccgtgcctttaggcagtaatgccagggaggaaagcagtattcattgcaagaggtgcctgttcatgccaaagtcttacgaagctctggttcagcatgttatcgaggaccacgagcgaatcggataccaagtgaccgcaatgatcggacacactaatgtggtggtacccaggtctaaacccttaatgctgatcgcacctaagccacaggataagaagagtatggggttgcctccccgaattggcagcctagcaagcgggaatgtcaggtccctgcctagccagcaaatggtgaacagattgtctatacccaagccgaacctgaattctaccggggtgaacatgatgtcctcagtgcatttacagcagaataattacggggtcaagtcagtgggacaggggtactccgtgggccagtccatgcgactaggcctcggcggaaacgcacctgtcagtattcctcagcaaagtcagtcagttaaacagctgcttccaagtgggaatggcagatcttatggactggggtctgaacaaagaagccaggcacctgctcgttacagcctgcagtctgctaatgctagcagcttaagcagcggacagttaaagtcccctagtctatcccagagtcaagcatctcgggtcctaggccagtcctcctctaagcccgccgctgctgccactggcccccccccaggcaacacttctagtacacagaaatggaagatttgtaccatatgcaacgagctgtttcctgaaaacgtgtacagtgtgcatttcgaaaaagagcataaggcagagaaagtgcctgccgttgcaaattacattatgaagatccataacttcacctcaaagtgcctctactgtaatcgctacttaccaacagataccttactaaatcatatgttaatccacggcctgtcttgtccttactgtaggagcacttttaacgatgtagagaagatggcagctcatatgaggatggtgcatatagacgaggaaatgggacccaaaacagatagcacattgtcctttgacttaaccctgcaacaggggagtcacaccaatatccaccttctcgtcactacttataacctaagggacgcccctgccgagagcgttgcatatcatgctcagaataatcctccagtgcccccaaaaccacagcctaaagtgcaggagaaagctgatatcccagtgaaatcttccccacaggctgccgttccctacaaaaaggacgtgggaaagactctgtgtcctttatgttttagtatcctgaaggggcctataagtgatgctttggctcaccacctacgcgagcgccaccaggtcatacagactgtgcacccagtggagaagaagctgacttataagtgtatccactgtctaggggtgtataccagtaacatgacagctagtaccattaccctgcatctggtacattgtaggggggtggggaaaacccagaacggccaagacaaaaccaatgccccatcaagactgaaccagagtcctagcctggcaccagtgaagcgcacctatgagcagatggaatttcccctactgaagaagcgcaaacttgatgacgattctgacagcccttcttttttcgaagagaagcccgaggagcctgtcgttctagctctggaccctaaggggcacgaggatgactcctatgaagcccggaaatccttcttgactaaatattttaataaacagccttaccctaccagacgcgaaatcgagaaactggcagccagtctgtggctgtggaagtcagacattgcaagccactttagcaataagcgcaaaaaatgcgttagagattgcgaaaagtacaaacctggagttctcctcggctttaacatgaaggaactcaataaggtcaaacacgagatggacttcgacgccgagtggctcttcgaaaaccacgacgagaaggattctagagtgaatgcctctaagaccgctgacaagaagctgaacctgggcaaggaggacgactcatctagtgactccttcgaaaatctggaagaagaatcaaacgagtcaggctctccatttgatccagtgttcgaggttgagcctaagataagtaacgataaccccgaggagcacgtgttaaaagtgatccccgaggatgccagcgagtccgaggagaagctggaccaaaaggaggacggatccaagtacgaaaccatccacctgacagaggagcctacaaaactgatgcataatgccagtgattctgaggtggaccaagacgacgtcgtggaatggaaggacggagcatccccctccgagagcggccccggctcccagcaggtgagtgatttcgaagacaatacttgcgagatgaaacctggcacatggtctgacgaaagcagccagagcgaggatgccaggtcatctaaacctgctgccaagaaaaaagcaactatgcagggagatcgagagcaactgaaatggaagaacagcagctacggcaaggttgagggtttctggtccaaggatcagagtcagtggaaaaacgctagtgaaaatgatgaacgcctgtcaaacccccaaattgaatggcagaactctaccattgattccgaggatggggagcagtttgataacatgacagatggagtggcagaaccaatgcacggatccctcgctggagtgaaactgtcatcccagcaggca

SEQ ID NO: 5751 - DNA, 3306 bp, Artificial Sequence
  Description of Artificial Sequence: Synthetic coding sequence
atgttccagctgcctgtcaataacctggggtctctgcgtaaggcccggaagaccgtgaaaaaaatcctttccgatatcggtctcgaatactgcaaagaacacattgaggacttcaagcagttcgagccaaatgatttttacttaaaaaacacaacttgggaggacgtgggcctttgggacccatctctcactaaaaatcaggactatcgaaccaaaccattctgctgtagtgcatgcccgttctcttctaaattcttctccgcctacaaatctcatttccgcaatgtacattcggaggactttgaaaaccggatcctgctcaactgcccttattgtacattcaatgccgataaaaaaacattggagacacacattaaaatctttcacgccccgaatgcttccgcccctagctcttccctgtccacattcaaagacaaaaacaagaatgatggtctaaaacctaagcaggctgactctgtcgaacaagccgtgtactattgcaagaagtgcacctatcgtgatcctctctatgaaattgtgcgcaagcacatatatagggagcactttcagcacgttgccgcaccttacatcgcgaaggctggggagaagtccttaaacggggctgtgcccctgggctctaacgcccgcgaggaatcttcaatccattgtaagagatgtttgttcatgccaaagagctacgaggccctggtgcagcacgttatcgaggatcatgagagaataggttaccaagtcaccgcaatgattggacacacaaacgttgtagtaccaagatcgaagcctctgatgctgatcgctcccaagccgcaagataagaagagtatggggctgcctcctagaattgggtccctggcgtccggcaacgtcaggtccctcccttcacagcagatggtgaaccggttgtctatccccaaaccaaatctgaattcaaccggcgttaatatgatgtcttcagtgcatctgcagcagaataattatggggtgaaatcagtgggccagggatacagcgttggccaaagtatgaggttaggactaggaggaaacgcaccggtcagcataccgcagcagtcccaaagtgtgaaacagctccttccatcgggtaacgggcgaagctacggcctcgggtctgaacagaggagccaggcccctgctcgctactctttgcagtccgcaaacgcatcttctttgagcagtggacagttaaagtccccttctctctcgcagtctcaggctagtagagtcctgggacagagttcaagtaaacctgccgctgcagccaccggtccaccaccaggcaatacttcctctacacaaaagtggaaaatctgtactatatgtaatgaattgtttcctgagaacgtgtattccgtacactttgagaaagagcacaaggccgagaaggtccccgcagtggccaattatattatgaaaatccacaacttcactagcaagtgtctctactgtaatagatatttacctacggatacactacttaaccacatgctgattcatggactatcttgcccctactgcaggtctacatttaacgatgttgagaaaatggctgcacacatgcggatggttcatatcgacgaggagatgggaccaaaaaccgatagcaccttgtcctttgacctgactctgcagcaggggtcgcacactaacatacacttgcttgtgaccacatataacctgagagatgcccccgcagagtccgtggcatatcacgctcagaataacccgcctgtcccccctaaacctcagcccaaagtacaggaaaaagccgatataccggttaaatcctctccccaggccgctgtaccctacaagaaggatgttggcaagacactgtgcccactgtgcttttcgattctaaaaggccccataagtgatgcactcgctcatcacttgcgagaacgccaccaggtgatacagaccgtacacccagtggaaaagaaattaacttataaatgcattcactgcctgggtgtctacacgtctaacatgactgcctccaccattacgctgcacctggtgcattgtaggggcgtgggcaagacacagaacggccaggataagacaaatgcaccatctcggcttaaccagtcccctagcctggccccagttaagcgtacctacgagcaaatggagtttccactgctaaaaaagagaaaactcgatgacgacagcgattctccaagtttcttcgaagaaaaacctgaagagcccgtggtgctggccctagaccctaagggacacgaggacgactcatacgaagcgcgtaagtcattcttgaccaagtactttaacaagcaaccgtacccaacccgacgtgaaatcgaaaagctcgccgcctccctatggctgtggaaatcggatatcgcatcacactttagcaacaagcgaaaaaaatgtgtacgggattgcgagaagtataaaccaggggtgctcttgggtttcaacatgaaggaactcaataaggtaaagcacgagatggattttgatgctgaatggttgtttgagaatcatgacgagaaggacagccgcgtcaacgcttccaagaccgccgataaaaaattaaatcttgggaaggaggacgactctagttcagattcttttgagaaccttgaagaagaatctaacgagagcggctctccgtttgaccccgtatttgaggtcgagcccaaaatctccaacgacaatccggaggaacacgtgttgaaagtgattccagaggacgcatcagagagtgaggagaaattggaccagaaagaagatggcagcaaatatgagaccattcacctgaccgaagagccaaccaagctgatgcataatgccagtgattcggaggtcgatcaggatgatgtggtggagtggaaagatggtgcctcaccctctgagtcggggcccgggagtcagcaggtcagcgatttcgaagacaatacatgtgagatgaagccagggacttggtcagacgagtcctcacaaagtgaggacgcccgttcatccaaacctgctgcgaaaaaaaaagctactatgcaaggggaccgagagcagctgaaatggaaaaactcatcctacgggaaagtggaaggattctggagtaaggatcaatcccagtggaagaatgcaagcgagaacgacgagcggctctcaaaccctcagattgagtggcaaaactcaactatcgattctgaggacggtgaacaatttgacaacatgacagacggcgtcgccgagcctatgcatggctcactcgcaggcgtgaagcttagtagtcaacaggcc

SEQ ID NO: 5752 - DNA, 3306 bp, Artificial Sequence
  Description of Artificial Sequence: Synthetic coding sequence
atgttccaactcccagtgaacaaccttggatccctgcgaaaggcacgtaagactgtgaaaaagattcttagcgatattggtcttgagtactgtaaggaacatattgaggatttcaagcagtttgagcctaatgacttctacctcaagaataccacgtgggaggatgtgggattgtgggacccttcgctgaccaagaaccaggactaccggaccaagccattttgctgctcagcctgtcctttctcgagcaagttcttcagcgcctacaagtcccattttagaaatgtgcattcagaggactttgagaatagaattctcctcaactgtccatattgtacgttcaacgctgataagaaaacgcttgaaactcacataaagatattccatgcgcccaacgcatccgcgcctagctcgagcctctccacttttaaggacaagaacaaaaacgatggactgaagcctaaacaggcagattcagtcgaacaagcagtgtactactgtaagaaatgtacttaccgggacccactgtacgaaattgtgaggaaacatatctaccgggagcatttccaacatgtggcggcaccttacattgcaaaggcgggagagaaatcacttaatggtgcagtgccgctcggctccaatgcaagagaagagagctccatccactgtaaacgctgtcttttcatgcccaaatcctatgaagcccttgtgcaacatgtaattgaggaccacgagaggattggttaccaagtgaccgcgatgatcggtcataccaatgtggtcgtgccaaggagcaagcctctgatgttgatagcccctaagccacaggataagaagtcgatggggcttccaccgagaatcggtagcctcgcatccgggaacgtcaggtcgctgccatcccaacaaatggtgaacagactctcaatcccaaagcccaacctgaactcaactggggttaacatgatgtcctcggtgcatctccaacaaaacaattacggcgtgaaatctgtgggtcaaggctactccgtggggcaatccatgcgtctcggacttggaggcaatgcgcctgtgtcaataccccagcaaagccaatccgtcaaacagcttttgcctagcggtaacgggcggtcctacggccttggatccgagcagagatcccaagcaccggcacgatactccctgcaatcggcaaacgcttcgtccttgtcaagcggccagctgaagagcccatcgctgtcgcaatcccaggcctcaagggtgctcggtcagagctcatccaagcctgcagccgcagccactggtcctcccccagggaacacttcatccacccaaaagtggaaaatctgtaccatatgtaacgaactttttccagagaatgtgtacagcgtgcattttgagaaggaacacaaagcggaaaaggtccctgctgtggcaaactacattatgaagattcataacttcactagcaaatgtctttactgtaatagataccttcctactgatactcttcttaaccacatgctgatccatggtctttcatgcccatactgccgatccactttcaacgatgtggaaaagatggcagcacatatgcgtatggtgcatatcgatgaagaaatgggccctaagaccgattcgactctgtcctttgatttgacgcttcagcagggatcacataccaacattcacctgctggtcacgacttacaatctgagagatgccccggcggaatccgtggcgtaccatgctcagaacaaccctcctgtgcccccgaagcctcagccaaaggtgcaagaaaaggcagatatccccgtcaagtcgagcccccaggcggcagtgccctataagaaggacgtgggcaagactctgtgccctctttgtttttcgattctgaaaggtccaatctctgatgctctggcacaccatttgcgggaacgccatcaggtcatccagaccgtacacccagtggagaaaaagttgacctataagtgtatccactgtctgggtgtgtacacttcgaacatgacggcaagcactataacgcttcatttggtgcactgtcgaggtgtcggaaagacgcaaaacggacaggataagaccaacgccccatcgcgcctgaatcaatcaccttcacttgcaccagtcaagcgcacctacgaacagatggaatttccgcttctcaagaaaaggaagctggatgatgattccgactcgccttccttctttgaagaaaagcccgaagagccggtcgttctggcgcttgatcccaagggtcatgaggatgattcctacgaagccagaaagtcgttcttgacgaagtactttaacaagcagccgtaccctactagacgggaaattgagaaactggcagcctctctttggctttggaagtcggatattgcatctcatttttcgaataagcgaaagaaatgtgtgcgtgactgtgagaaatacaaaccaggggtgcttctcggatttaacatgaaggaactgaacaaggtcaaacatgagatggattttgacgcagaatggctgtttgaaaaccacgacgaaaaagattccagagtcaacgcgtccaaaactgctgataagaagctgaacctcggaaaggaagatgacagctcatccgatagcttcgaaaaccttgaagaagaaagcaatgagtccggttctccatttgatcccgtgtttgaagtggaacctaagattagcaacgacaatcctgaggaacatgtgctgaaggtcatacctgaagatgcctcggaatcggaggagaagctcgatcagaaagaagatgggagcaaatacgaaacgatccaccttaccgaagagcctaccaaacttatgcacaatgcatcggactctgaggtcgatcaagatgatgtggtcgagtggaaggacggagccagccctagcgagtcgggacccggaagccagcaggtatctgacttcgaagataacacctgtgaaatgaagcctggcacttggtcggatgaatcgtcccagtccgaggacgcacgtagcagtaagcctgcagcgaagaagaaggctacgatgcagggagatagggaacagctcaagtggaagaactcgtcatacggaaaggtggagggcttctggtcgaaggaccagtcgcaatggaagaacgcatccgaaaatgatgaacgcctgtccaacccccaaattgaatggcagaatagcaccatcgacagcgaggacggcgagcaattcgataacatgaccgacggagtcgcagaacctatgcacggttcgcttgccggtgtgaaacttagctcacagcaagca

SEQ ID NO: 5753 - DNA, 3306 bp, Artificial Sequence
  Description of Artificial Sequence: Synthetic coding sequence
atgttccagcttccagtaaataatctcggcagcctgagaaaggcacgcaagaccgtgaaaaagattttgtcagatatcgggctcgagtattgcaaggagcacatagaggatttcaagcagtttgagcccaacgatttttatctcaagaacaccacatgggaagatgtaggcctctgggacccttccctgactaaaaaccaggattaccggactaaacccttttgttgttcggcctgtccattcagtagcaagtttttttcggcatacaaatctcatttcagaaatgtccacagcgaagacttcgaaaaccggattctcctgaattgtccctactgtaccttcaatgcggataagaaaacgcttgaaactcatatcaaaatcttccacgcgcccaatgctagcgctccctccagctccctgagcacatttaaagataaaaataagaatgatggtctgaagcccaaacaagccgactctgtggaacaagccgtttactactgtaagaagtgtacataccgtgatccactctatgagattgtccggaaacatatctacagagagcacttccaacacgtggccgccccctatatcgccaaggcaggagagaaatctctgaatggtgcagtcccgttgggaagtaatgccagagaagagagctctattcattgtaagcggtgcttgttcatgcccaaatcttatgaggctctagtgcaacacgtgatcgaagaccacgagagaatcggataccaagtgacagccatgatcggccataccaacgtcgtcgttccccgcagcaaacctttgatgctaatcgcccccaaacctcaggataaaaagtcaatggggctacccccgcgcattggatcactagcaagtggaaatgtgaggtcattgccctcccagcagatggtgaaccgcttgagcatccccaaacctaacctgaattctactggagtcaatatgatgtcatctgtccacctgcagcaaaacaactatggcgtaaagagtgttgggcagggttattccgttggtcagtccatgcggctgggactaggtggcaacgcgccagtgagcatacctcaacagagccagtctgtgaagcagctgctcccatcgggtaacgggcggtcctacgggctcggctcagagcagcgaagccaggcacccgctcgctatagcctacagtccgcaaacgcgtcctccttgagcagcggtcagctcaagagcccctccctgtcccagagccaagcaagtagagttcttggacagagcagctccaagcccgcggcagccgccacagggcctccacccggtaataccagttccacgcagaagtggaaaatttgcacaatctgcaatgaactgttcccggagaacgtctactctgtccacttcgaaaaggaacacaaagctgagaaagtgcccgccgtcgcaaattacatcatgaagattcataacttcacctccaagtgcctgtattgcaaccggtatctcccaaccgacacacttctgaatcatatgctgattcacggattgagctgcccttactgccgaagtacctttaatgacgtagagaagatggcggctcacatgcgcatggtccacatcgacgaagagatggggcccaagactgacagtacactttccttcgacctaacactgcagcaaggcagtcatacaaatattcacctgctcgtgacaacttacaacctgcgcgacgcacctgctgaaagcgtggcttaccatgctcaaaataatccgcctgtccctcccaagccccagccaaaggtccaggaaaaagcagacatccctgtgaaatcatctccccaggccgcggttccttacaaaaaagatgtgggtaagaccctgtgccccctctgttttagcattcttaagggcccaataagcgacgctctggcccaccacttgcgggaacgacaccaagtgatccagaccgtccatccagttgagaaaaagctgacatataaatgtattcactgcctgggggtttacacctccaatatgaccgccagtacgataacgctgcacctcgttcactgtagaggagtggggaaaactcaaaatggtcaggataagacaaatgctcccagtagactgaatcagagtccaagtctggcacccgtgaaaaggacttacgagcagatggagttcccattactgaagaagaggaagctggacgatgacagtgacagcccgtcattcttcgaggaaaaaccagaggagcctgtcgttttggccttagatcccaaagggcacgaagacgactcctacgaggcccgcaaatcgtttctgactaaatacttcaataaacagccttatcccacgcggcgcgaaattgaaaagctagccgcgtctctttggctctggaagtctgacatcgcgagccattttagcaataagcggaaaaaatgtgtcagagattgcgagaaatataaacctggggttctgctcgggttcaacatgaaggagctgaacaaggtcaagcacgaaatggatttcgacgcagagtggctgtttgaaaatcacgatgagaaagatagccgcgtgaacgccagcaaaaccgcggacaagaaattaaatctggggaaggaagatgatagctctagcgatagttttgaaaatttagaggaagaaagcaatgaaagcggaagcccctttgacccagtatttgaagtggaacctaagataagtaacgacaatcctgaggagcatgttttaaaagtcatccctgaagacgcaagcgagtccgaagaaaaacttgatcaaaaggaagacggatcaaaatacgagaccatccacctaactgaggagccaacaaagctgatgcacaacgcaagcgactcggaagtcgaccaagacgatgtggtagagtggaaggatggtgctagtccatcagagagcggaccgggttcacagcaggtgtctgattttgaggacaatacttgtgaaatgaagcctgggacctggtctgacgagtcctcacaatccgaggatgctcgcagttctaaaccggccgccaaaaagaaagccaccatgcagggcgatcgtgaacagctgaaatggaagaattcgtcctatggcaaggttgaagggttctggtccaaagaccagtctcagtggaaaaatgcttcggaaaatgacgagcgtctgtccaaccctcaaatcgagtggcaaaactccactatcgactctgaggacggtgaacagtttgacaatatgaccgatggggtcgctgagcccatgcacggtagcctggccggtgtgaagctgagttcccagcaggcc

SEQ ID NO: 5754 - DNA, 3306 bp, Artificial Sequence
  Description of Artificial Sequence: Synthetic coding sequence
atgtttcaacttccggtgaataacctgggatctctgcggaaagccagaaagactgtgaagaaaattctctcggacatcggcttggaatactgtaaagagcacatcgaggacttcaagcagttcgagccgaatgacttctatttgaagaacacgacgtgggaggacgtcggattgtgggacccaagcctgactaagaaccaggattaccgaaccaagccgttttgctgcagcgcatgcccattcagctccaagtttttctcagcctacaagtcgcacttccggaatgtgcactcagaggacttcgaaaatagaatcctcctcaattgcccctactgcaccttcaatgccgacaaaaagaccctcgagactcacataaagatcttccatgcgccaaacgcctcggccccgagcagcagcctgagcacttttaaggacaaaaacaagaatgatgggttgaagccgaaacaggccgactcagtggagcaggcggtgtactactgcaagaaatgtacttaccgggatccgctttacgaaatagtaaggaagcacatttacagagagcatttccaacacgttgccgccccgtacatcgccaaagccggagaaaagtcgctgaatggggcagtcccactgggaagcaatgccagagaggagtcgtccatccattgcaagcgctgcttgttcatgccgaagtcatacgaagccctggtacagcatgtcatcgaagatcacgagcgcatcggttaccaggtcactgccatgatcgggcataccaacgtcgtggtgcccagaagcaagcctctgatgctgatcgccccgaaacctcaggacaagaagtctatgggactgccgcctcggattggatccctcgcatcaggcaacgtgcgctccctgccgtcgcaacaaatggtgaatcgcctgtcgatcccaaaaccaaatttgaatagtactggcgtgaacatgatgtcctcggtgcacctgcagcagaacaactacggcgtaaagagcgtcggacagggttattcagtgggccaatcaatgcgcctgggactgggaggaaacgccccggtgagtatcccgcagcaaagccagtccgtcaagcagctgctcccgtccggtaacggacgctcctacggcctcggatccgaacagcgctcgcaagcgccggctcgctactcgctccagtcagcaaacgcatcctcactgtcgtcaggtcaacttaagtccccgtccctctcgcagtcgcaggcgtcgcgggtgcttggccagtcctcgtcaaagcccgcagcagctgctaccggacctccgcccggtaacacctcatccacccagaagtggaaaatctgcaccatctgcaacgagctgtttcctgagaatgtgtactccgtgcatttcgagaaggagcacaaggctgaaaaagtgcccgcggtggccaactacatcatgaaaatccacaatttcacctcaaaatgcctgtactgcaaccgatacctgccaactgatacgctgctcaaccatatgctcatccacggactgtcatgtccatactgcagatccactttcaacgacgtcgaaaagatggcagcgcacatgcgcatggtccatatcgacgaagagatggggccaaagaccgatagcactctttcctttgatctgaccctgcaacaggggtcgcatactaacatccacctcctggtcaccacctacaacctgcgggatgccccggctgaatcagtcgcgtaccacgctcagaacaacccaccagtgcctccaaagcctcagccgaaggtccaggagaaggcggatatcccggtgaagtcgagccctcaagctgcggtgccttataagaaagacgtgggaaagactctgtgcccgctctgtttcagcattctcaaggggccaatcagcgacgctctggcacaccacctccgggagcgtcaccaagtgattcaaactgtgcacccagtggagaaaaagctgacgtacaagtgcatccattgtctgggcgtgtacactagcaatatgacggcgtcgacgatcactcttcaccttgtccattgccgcggagtgggaaaaacccagaacggacaagataaaaccaatgccccgtcacggctcaatcagtcgcctagcctcgcaccggtgaagcggacgtacgaacagatggaatttccgctgctgaagaagcgcaagctggacgacgattccgatagcccgtcgttctttgaggagaagcccgaggaaccagtggttctggctctggatccaaagggacatgaggacgattcctacgaggctcggaaatcattcctgacgaagtactttaacaagcaaccttatccgactcgcagagagatcgaaaagctcgcggcatccttgtggctgtggaaaagcgatatcgcaagccacttctccaacaagagaaagaagtgtgtgcgggattgcgaaaagtacaagccgggagtgctcttgggattcaatatgaaagagctgaacaaagtgaaacacgagatggacttcgacgccgaatggctcttcgaaaatcatgatgagaaggattcgcgggtgaacgcatcaaaaaccgcggacaagaaactcaacctcggaaaggaagatgatagcagttccgatagcttcgaaaacttggaagaggagtcaaatgaatccggctcgcctttcgacccggtattcgaagtggaaccaaaaatcagcaatgacaacccagaagagcatgtcctgaaggtaatcccggaagatgcctcggaatccgaagagaaactggatcaaaaagaagatggaagcaagtacgaaaccattcaccttactgaagaaccaactaagctcatgcataacgcctcagactcagaggtggaccaagacgacgttgttgaatggaaagacggtgcctctccttcagagtccggaccagggtcccagcaagtctcggactttgaggacaacacctgtgagatgaaaccaggcacctggtcggacgaatcatcccagagcgaggacgcgcgcagctcgaagcccgcggcgaaaaagaaggcgactatgcaaggggacagagaacaactgaagtggaagaattcgtcgtacggcaaagtcgaaggattctggtccaaggatcaatcccaatggaagaacgcttccgaaaacgacgaaaggcttagcaacccccagatagaatggcagaactccaccatcgacagcgaggacggggaacagttcgacaacatgaccgacggcgtcgccgaacctatgcacggatcgctcgccggtgtgaaactgtcctcgcagcaggcg

SEQ ID NO: 5755 - DNA, 3306 bp, Artificial Sequence
  Description of Artificial Sequence: Synthetic coding sequence
atgttccagctgcccgtgaacaatctgggcagcttgcgcaaggccagaaagactgtcaagaaaatcttgtcagatatcggcctggaatactgtaaagagcacatcgaggatttcaagcagttcgaaccgaatgacttttacctgaagaacactacctgggaagatgtgggtctgtgggacccatccctgactaagaatcaggattaccgcaccaagccgttttgctgctccgcatgcccattctcctcaaagttcttcagcgcctacaagtctcacttcaggaacgttcactcggaggacttcgaaaatagaattttgcttaactgcccttactgcactttcaatgcggacaaaaagacgctcgaaacccatatcaagatcttccatgccccgaacgcttcggcgccatcgtcctcactgagcaccttcaaggacaagaataagaatgatggactgaaaccgaaacaggcggactcagtggaacaagcggtctactactgcaagaaatgcacttatcgtgaccccctctacgaaatcgtccggaagcacatctaccgcgaacacttccaacatgtggccgccccttacattgccaaggcaggagaaaagtccttgaacggagctgtgccgctgggatcgaacgcacgggaagaaagcagcatccactgcaagcgctgcctgtttatgccaaagtcctacgaagccctggtccaacacgtcatcgaggaccacgaaagaatcggataccaggtcactgctatgatcggccacacgaatgtggtggtgccaagaagcaagccgctgatgcttattgctcctaagcctcaagataagaagtcgatgggtctgcccccaagaatcggatcactcgcgtcgggcaacgtgcgctccctcccttcccaacagatggtcaatcggctgtccatccctaagccgaacttgaactcaacgggcgtgaacatgatgtcgagcgtgcatctccagcaaaacaattatggagtgaagtcggtggggcaaggatactcagtcggacagtcgatgcgtttgggactgggtggtaacgccccggtttccatcccacagcagagccagtccgtcaagcagctgctcccgtccggtaacggacggtcctacggtctgggatcagagcaacggtcccaggccccggcgcgatactcactgcagtctgccaatgcctcgtccctttcatcgggacaactgaaatcgccgtctctgagtcagtcccaggcgtcaagagtgctcggccagtcctcctccaaaccggccgctgcagccaccgggccaccgccaggaaatacctcgagcacccagaagtggaagatctgcaccatctgcaacgaactgttccccgaaaatgtgtacagcgtgcacttcgagaaggagcacaaggccgaaaaggtgccggcagtggcaaactacatcatgaagatccataacttcacctcgaagtgcctttactgcaatcggtatcttccgactgataccttgttgaatcatatgctgatccacggactgagctgtccgtactgccgctccactttcaacgacgtcgaaaagatggcggcccacatgcgcatggtccacatcgacgaggaaatggggccgaaaactgactccaccctgtcctttgatctcacgctgcaacagggatctcacactaacatccacctgttggtcactacgtacaacctgcgcgacgcccctgcggaaagcgtggcctaccatgctcaaaacaacccgccagtcccacctaagccacagccgaaggtgcaggaaaaggctgacatcccagtgaaaagcagcccgcaggccgccgtaccgtacaaaaaagatgtcgggaaaaccctctgccctttgtgcttttcaatcctgaagggcccaatctccgacgcactggcacaccacctcagagagagacaccaagtgatccaaaccgttcacccggtggaaaagaagctcacttacaagtgtatccactgcctgggagtgtacacctcaaacatgactgcctccaccattactcttcatctggtccactgccggggagtcggcaagacccaaaatggacaggataagactaacgctccttcaaggctcaaccaatctcctagcctcgctccagtcaagcgtacctacgaacagatggaattcccacttctgaagaagcgcaagttggatgacgattcagactcaccgagcttcttcgaagagaaacccgaagaacctgtcgtgctggcactcgatccgaagggacacgaagatgattcctacgaagcgcggaagtcattcctcacgaagtactttaacaagcaaccgtaccctaccagacgcgaaatcgaaaagctggccgccagcctctggctctggaagtcggatatcgcctcccatttctcaaacaaacgcaagaagtgtgtgcgcgactgcgagaagtacaaaccgggtgtgctcttgggattcaatatgaaggaactgaataaggtgaagcatgagatggacttcgacgccgaatggctcttcgagaatcatgatgagaaagactcacgagtcaatgcctcaaagaccgctgacaaaaagctgaacctgggcaaggaagatgactcatcctccgatagcttcgagaacctcgaggaagaatcaaacgagtcaggatcaccgttcgatccggtgtttgaggtggagcctaaaatctcaaacgataacccggaggaacacgtcctgaaggtgatcccggaggacgcgtcggagtcggaagaaaagttggatcaaaaggaggatggaagcaaatacgaaaccattcacctgacggaggagccgaccaaactgatgcacaacgcctcagactcggaagtggaccaggacgacgtcgtggagtggaaagacggagcctcgccgtcagaaagcggcccgggttcccagcaggtgtccgatttcgaggacaacacctgcgaaatgaaaccaggaacttggtccgacgaaagctcacagtcagaagatgcgcggtcatccaagccggccgcaaaaaagaaggctactatgcagggcgaccgggaacaactgaagtggaagaattcgagctatgggaaggtggaaggattctggagcaaggaccaatcccaatggaagaacgcgtccgaaaatgatgaacgcctgagcaacccgcagatcgaatggcaaaacagcactatcgattcggaggatggcgaacagttcgacaacatgactgacggagtggcggagccgatgcacggctcgctggctggagtgaaactgtcgtcgcaacaggcg

SEQ ID NO: 5756 - DNA, 3306 bp, Artificial Sequence
  Description of Artificial Sequence: Synthetic coding sequence
atgtttcagctccctgttaacaaccttggcagcctgcgaaaagcccgtaagaccgtcaagaaaatcctgtccgacattggtctggagtattgtaaagagcacatagaggactttaaacagttcgagcccaatgatttttacctgaagaatacgacctgggaggatgtcggtctctgggacccaagcctcacgaaaaatcaggattaccgcacgaagccgttctgctgtagcgcgtgtccttttagctccaagttcttttccgcctataaaagccacttcaggaacgtccattcagaggatttcgagaatcggatcctgctcaattgtccgtactgcacgtttaatgcggataaaaaaacgttggagacccatattaaaatctttcacgcaccgaacgcatcagcgcctagcagtagcctaagcacgtttaaggacaaaaataagaacgacggcctcaaaccgaagcaggcggatagcgtagaacaggcagtgtattattgcaaaaagtgcacctaccgggaccctctgtatgagattgtgcgcaaacatatctaccgcgaacacttccagcacgttgccgcgccatacatcgcgaaggcaggcgagaaatccctgaacggtgctgttccattgggtagcaatgcacgggaagaatccagcattcactgcaagcggtgtctgtttatgccgaagtcttatgaagcgcttgtgcagcatgtgattgaggaccacgagcggattggttaccaagtgacggccatgatcggtcacaccaatgtcgtagtgccacgaagtaaacctcttatgctaattgccccgaagccacaggataagaaatcgatgggtctgccgcctcggatcggctctctggcgagcggcaacgtgcgtagcctgccttcccagcagatggtcaatcggctgagcattcccaagccaaacctgaattctaccggcgtaaacatgatgagttccgtccatctgcagcaaaataactacggtgtcaaaagcgtgggacaaggctacagtgttggtcagagcatgcgccttggtttaggagggaatgcgcccgtgtccatccctcaacaatcccaaagcgtcaaacaattgttaccaagcggtaacggtcgttcttacggcttgggctccgagcagcgcagccaggcaccggcacgctattccctgcaaagcgcaaatgcgtctagtttgagtagtggtcagctgaagagtccttctctgtcccaatcgcaagcgtctcgagttttgggtcagagctcctctaaaccggcagcagctgccacgggccctccgcccggcaatacctctagcacccaaaaatggaaaatctgcaccatttgtaacgagctgtttccggaaaatgtctatagcgtgcactttgagaaggagcacaaagctgagaaggtgccagcagtggcgaattatattatgaaaattcataatttcactagcaagtgcctgtattgtaaccggtacttgcccaccgatacgctgctcaatcatatgttgattcacggcttgtcttgcccttactgccgttccacctttaacgacgtggagaaaatggccgctcatatgcggatggttcatatagacgaggaaatgggcccgaagaccgacagcaccctgtcgttcgatttgacgctgcagcagggttcacatactaacatacacctgctggtgacgacctacaatctgcgcgacgcgccggccgagtcagtggcctaccacgcccagaacaatcccccagttccacctaagccgcagccaaaggtgcaagaaaaggccgacatcccggtgaaatcttcccctcaagcagctgtgccgtataagaaagacgtcggaaaaaccctgtgccccctgtgctttagcattctgaaaggccctattagcgatgctctggctcaccatctgcgcgagcgccaccaggtcattcagaccgtccatccggtggagaagaagctgacatacaaatgcattcactgtttgggcgtatatacctcgaatatgactgcttcgacaatcactctgcatcttgtgcattgtcgtggtgtgggcaaaacccagaacggtcaggacaagacaaacgccccgagccgcttgaaccagtcgccgagcctggcccctgttaagcgcacctatgagcagatggaattcccacttctgaaaaaaaggaaactggatgatgatagcgactctccatcattcttcgaagaaaaaccggaggaaccggtggtgcttgcgcttgatccgaagggccacgaggacgacagctacgaggctcgtaaaagctttctgactaagtattttaacaagcaaccataccccacccgccgcgagatcgaaaaactggctgcatcactgtggttgtggaagagtgatattgcctcacacttcagcaataaacgcaaaaagtgcgttcgtgactgcgagaagtataagcctggtgttctgctgggttttaatatgaaagaactgaacaaagtcaagcatgagatggatttcgacgcggaatggttgtttgagaatcatgacgagaaggacagcagggttaacgctagcaagaccgctgacaaaaagctgaatttaggtaaggaggatgacagctcttccgattccttcgagaacttggaagaggagagcaatgagagcggtagcccattcgaccccgttttcgaggtcgaaccgaagattagcaatgataaccccgaagagcatgtcctgaaagtgatcccagaagatgcaagcgagtcagaggagaagctcgatcagaaggaagacggtagtaaatacgaaactattcatctgactgaggagccaaccaagctgatgcacaatgcctcggacagcgaggtggaccaggatgacgtggtcgagtggaaggatggtgccagtcctagcgaaagcggtccggggtctcagcaggtgagcgatttcgaagacaacacctgcgagatgaagccagggacttggtctgacgaaagctctcagagcgaggacgcacgttcttcgaagcctgccgcgaaaaagaaggctaccatgcaaggtgacagggagcagctgaaatggaaaaatagcagctacggtaaggtggaagggttctggtccaaagaccagagccagtggaagaacgcgtcagagaacgatgagcgtctgagcaacccgcagattgagtggcagaactccactatcgacagcgaagacggcgagcagttcgacaacatgaccgacggtgtcgctgagccgatgcacggcagcctcgcaggtgtaaaactgagctcccaacaagca

SEQ ID NO: 5757 - DNA, 3306 bp, Artificial Sequence
  Description of Artificial Sequence: Synthetic coding sequence
atgttccagttaccggttaataacttgggaagccttaggaaagcgagaaaaactgttaagaagatcctgagcgatattggtctggagtactgtaaggaacatatagaagattttaagcagttcgaacctaacgatttctatctcaagaatactacatgggaagacgttgggttgtgggacccatctcttacaaagaatcaggactataggaccaagcccttctgttgttccgcgtgcccattctcttcaaaatttttttccgcatacaagagtcacttcaggaacgttcattcggaagattttgagaatagaatattacttaactgcccctattgtacctttaatgctgataagaagacattggaaacccatatcaagatctttcatgcccctaatgcttctgctccctctagttctctttcgactttcaaagataagaacaagaatgacggtttaaaacctaagcaggctgattcagtagaacaagcagtatattactgcaagaagtgcacctatcgtgaccccctctatgaaatcgtgagaaagcatatataccgcgagcattttcaacacgtggctgccccgtatattgccaaagctggcgagaagtctctcaacggtgctgtcccactaggttcaaacgctagagaagagagctccattcactgcaaaaggtgtctttttatgccaaaatcctatgaagctctggttcagcacgtcatcgaggatcatgaaaggattgggtaccaagttacagctatgattggacataccaatgtagtcgtcccacgatctaagcctttgatgcttattgctcctaagcctcaggacaagaaatccatgggtcttccacctagaattgggagcctagccagcggtaatgttcgatcacttccatctcaacagatggtcaacagactgtcgattcctaagcctaatcttaactctactggagtaaatatgatgagttccgtccatttgcaacagaataactacggagtgaagtccgtcggacagggttatagtgtcggacaatccatgcgactcggactggggggtaacgctcctgtaagtataccccagcaatctcaaagtgttaagcaacttttaccatcgggaaacggtagatcatatggtttgggctccgaacaacgtagccaagcccctgcacgatactcgcttcaaagtgctaacgcatcaagtctttctagtggacaattgaaatccccaagtctttcgcaatcacaagcttcgcgcgttctaggtcagtcttcctcaaaaccagctgctgctgcaaccggacctcccccgggaaacactagttccacccaaaagtggaagatttgcaccatttgcaacgagctctttcctgaaaacgtatattcagtgcacttcgagaaggaacataaggctgaaaaggttccagcagttgctaactatataatgaaaattcacaatttcacatcgaagtgcctctattgcaaccgctatcttccaaccgacacgcttcttaatcacatgttaatccatggactttcttgcccatattgccgttccacctttaatgatgttgaaaagatggctgcccatatgagaatggtgcatatagatgaggaaatgggtcccaagaccgattcaaccttgtcattcgacctaactcttcaacaaggaagtcacaccaatattcatctgttagttaccacatataatcttcgtgatgcccccgcagagtcagtggcatatcatgctcagaacaatccgccggtgccacctaagcctcaacccaaagtgcaggaaaaggctgatatccctgtaaagagtagcccacaagcagctgttccatacaagaaagacgtgggcaaaaccttatgtcctctgtgtttttcaattttgaaaggacctatctccgatgctctcgcgcaccatctccgtgaacgccatcaggtgattcagaccgtccatccggtcgagaagaagttaacttataagtgcatacattgccttggagtgtacacatccaatatgacggcatcaaccataacactccacttggttcattgtcgtggcgttggtaaaacgcagaacggacaagataagactaacgcaccatctaggctcaaccagtctccttcacttgcaccagttaagagaacctacgaacaaatggaatttcccttacttaagaagagaaaattggatgatgacagcgattctccgagcttcttcgaagaaaagccagaggagccagtcgttttggctttggatcctaaaggtcacgaagatgattcctatgaagctaggaagagcttcctgaccaaatacttcaataagcaaccttatcctacaaggagagagattgagaagcttgctgctagcctctggttgtggaaatctgatattgccagtcatttttcaaacaaacgcaaaaaatgcgttcgagattgtgagaagtataaacccggtgtgttgttgggatttaatatgaaagaactaaataaagttaagcatgagatggatttcgatgcggaatggttattcgaaaatcatgatgagaaggatagtcgagtgaacgcaagtaagacagctgacaagaaattgaacctcgggaaagaagatgatagcagctcagattctttcgagaacctagaggaagaatctaacgaatcaggtagcccgttcgatccggtttttgaggtggaaccgaaaatttctaatgacaatccagaggagcatgtgttgaaggttatccctgaagacgcttctgagtcagaagaaaagttggatcaaaaagaagatggtagcaaatacgagacgattcatctgacagaagagcctactaagcttatgcacaacgcctctgattcggaggttgatcaagatgatgtggtggaatggaaggacggtgcgagtccaagtgagagcggacccggtagccagcaggtgtctgattttgaggataacacttgcgagatgaagcccgggacgtggagcgacgaatctagccaatctgaagatgctaggagtagcaagcctgccgccaagaagaaagcgaccatgcagggtgatcgagagcaattgaaatggaagaattcatcatatgggaaagtcgaaggattttggagtaaagaccagtctcagtggaagaatgcttccgagaacgacgaacgtctctctaacccccagattgagtggcaaaattctaccatagatagcgaggatggcgaacagtttgacaacatgaccgacggagtagctgagccgatgcacggcagcttggcaggagttaagttgtcttcacaacaggca

SEQ ID NO: 5758 - DNA, 3306 bp, Artificial Sequence
  Description of Artificial Sequence: Synthetic coding sequence
atgttccaactgccagtgaataaccttggctcccttagaaaggcccggaaaaccgtcaagaaaattctgtcggatattggccttgaatactgtaaagaacatattgaagatttcaagcagtttgaacctaatgatttctacctgaagaataccacctgggaggatgtgggcctttgggatccttccctgaccaagaaccaagattacaggactaagcccttctgttgttcggcgtgtccattctcatctaaattctttagcgcgtataagtcgcactttagaaatgtccattccgaggactttgaaaataggatattgctgaattgcccatattgtaccttcaatgcagacaagaaaactcttgagactcacataaagatattccatgcccctaacgcatccgcacccagctcaagcctttccacctttaaggataagaacaaaaacgacggtctgaaaccaaagcaggccgattcggtggaacaggcagtgtactactgcaagaaatgtacctatcgcgatcctctttacgagatcgtgcgcaaacacatttaccgggagcatttccaacacgtggcagcaccatacattgcaaaagcaggcgaaaagagcctgaacggggcagtgcctctcggttcgaatgcaagagaagaatcctcgattcactgtaaaaggtgtctcttcatgcctaaatcgtacgaggcacttgtccagcacgtgatcgaagatcacgaaagaattggctaccaggtgactgcaatgatcgggcacactaacgtggtcgtgcccagatcaaagccacttatgctcatcgcccctaagcctcaagacaagaaatcaatgggcctgcctccccgaatcggaagcctcgcatccggaaacgttagatcactgccttcgcagcagatggtgaatcgcctgagcattccaaaacctaatctgaacagcactggtgtgaacatgatgtcgtccgtgcacctccaacaaaacaactacggagtcaagtccgtgggacagggatactcagtgggacagtcaatgagacttggactcggcggaaacgcccccgtgtcgatacctcagcaatcccagtcagtgaagcaactgcttccgtctgggaatggtcgctcgtacggactgggttcggaacaacgctcgcaagcacctgcaagatactctctccaatccgcgaacgcgtcctctctgtccagcggccaactgaaatcgcctagcctgagccagtcccaagcatctcgtgtgctgggacaaagttcgtccaagccagcagcagctgcgactggtccaccacctgggaacacctcctccactcaaaagtggaagatttgcaccatctgtaacgaattgtttccggagaacgtgtattccgtgcatttcgagaaagaacataaagcagaaaaagtacctgccgtggcaaactacatcatgaagattcataactttacttcgaaatgcctctactgcaaccggtaccttccaaccgacaccttgcttaaccacatgctgatacacggtttgagctgtccatactgtagatcgacctttaatgacgtggagaagatggccgctcacatgcggatggtgcacatcgatgaggaaatgggaccaaagaccgattccaccctctcgtttgacctgaccctccaacagggttcccatacgaacattcatcttctggtcaccacttacaacctgcgggatgcgccagctgagagcgtggcgtaccatgcccaaaacaatccgcctgtgccgcccaagccgcagcctaaggtgcaagaaaaggcggatatccccgtgaaatcatcaccgcaggcagcggtgccatacaagaaggacgtcggcaagactctgtgtcctctctgtttttcaattctgaagggacctatatccgacgccctggcgcatcatctgcgagaacggcatcaggtcatacagactgttcatcccgtggagaagaagttgacctacaagtgtatccactgtctgggagtgtacacctcgaatatgactgcctccactattaccctccatctggtgcactgcaggggggtgggcaagacgcagaacggacaagataaaaccaacgcaccaagccgcctgaatcagagcccttcgcttgcaccggtgaaacgaacctacgaacaaatggaattcccacttctcaagaagcggaagctcgacgatgattcggactcgccttcatttttcgaggaaaagcccgaggaacctgtggtcctggcgctggaccctaaggggcacgaagatgatagctacgaagctcggaaatcattccttaccaagtactttaacaagcaaccgtacccaactcggcgcgaaattgagaaacttgcagcatcactctggctctggaaatccgacattgcaagccacttttcgaataagcgcaagaaatgtgtgcgagattgcgaaaagtacaaacctggggtgctgctgggattcaatatgaaggagctgaataaggtgaagcatgaaatggactttgatgcagagtggctgttcgaaaaccacgatgaaaaggattctcgcgtgaacgcgagcaagaccgcagataagaagctgaatcttggaaaggaagatgattcctcatccgattcgtttgagaacctcgaagaagaatcgaatgaatcgggttcacctttcgacccagtgtttgaagtggagcccaagatatcgaacgataacccagaagaacatgtgcttaaggtcatacccgaggacgcctccgagagcgaggaaaagttggatcaaaaagaggacggatccaagtacgagactatccatctgaccgaagaaccaacgaagttgatgcataacgcttccgattccgaggtggaccaggatgatgtcgtcgaatggaaggacggagcctcgccttccgaatcgggaccaggttcgcaacaggtgtccgatttcgaggataacacttgtgagatgaaacctggaacttggtcggatgaatcgagtcaatcggaggacgcgagatcatccaaacctgccgcaaagaagaaagcaactatgcaaggtgatagggagcaacttaaatggaaaaactcgtcctacggcaaggtcgaaggtttttggtcaaaggatcaatcgcaatggaagaacgcgtcggaaaacgatgaaaggttgagtaatccacaaattgaatggcagaactcgactatcgatagcgaggacggagaacaattcgacaatatgacggatggagtggccgaacccatgcatggatccctcgccggagtgaagctgtcctcccaacaagcc

SEQ ID NO: 5759 - DNA, 3306 bp, Artificial Sequence
  Description of Artificial Sequence: Synthetic coding sequence
atgttccagctgccagttaacaatctcggcagcctgcggaaggccagaaagactgtgaagaagatcctctccgacatcgggctggaatactgcaaggagcacatcgaagatttcaagcaatttgagcctaatgacttctacctgaaaaacaccacttgggaggacgtggggttgtgggatccatcgctgactaagaatcaagactacaggactaaaccgttctgctgcagcgcctgccccttctcgtccaagtttttctccgcctacaagtcccatttccggaacgtgcatagtgaagatttcgagaaccggatcctgctgaattgcccttactgtactttcaacgccgacaagaaaaccctcgaaacccatatcaagatcttccatgctcctaacgcatcagccccaagctcctcgctgtccaccttcaaagacaagaacaagaacgacggactgaagcccaagcaggcagacagcgtggaacaggctgtgtactactgcaagaagtgcacttacagggacccactttacgagatcgtccggaagcacatttaccgggaacatttccaacacgtagcggccccatacatcgcgaaagccggcgaaaaatcgctgaacggagccgtgccgttgggcagcaatgcgcgcgaggaaagctccatccactgcaaaagatgtctcttcatgccgaagtcctacgaggcattggtgcagcacgtgattgaagatcacgagcgaataggataccaagtgactgccatgatcggacacacgaatgtggtggtcccacgctccaagcctttgatgctgatcgccccgaagccgcaagacaaaaagtccatgggactgccaccgagaattggcagcctggcctcaggtaacgtgagatccctcccaagccagcagatggtgaaccgactttcgatcccgaaacctaatctgaacagcaccggagttaacatgatgtcctcggtgcatctgcaacaaaacaattacggagtgaagtctgtggggcaaggttactcagtcggtcaatcgatgcgcctgggacttggtgggaacgcgccagtgtccatcccacagcaaagccaatctgtcaagcagttgcttccgagcgggaacggacggtcgtacggactcggatcggagcaaagatcgcaggcacccgctcgctattcattgcagtcggccaatgcgagctcgctgtcctcgggccagctgaagtccccttcactctcccagtcgcaggcgtcccgcgtgctgggacaatcatcatcgaagccggcagcggctgctaccggacctccgcccggcaatacttcctccactcagaagtggaagatctgtactatctgcaacgaattgttccctgagaacgtctactcagtgcacttcgagaaagagcacaaggcggaaaaggttccggctgtggccaactacatcatgaagatccataacttcacttcaaagtgtttgtactgcaacagatacctcccgaccgatacgctgcttaatcacatgctcatccatggactgtcatgcccttattgtaggtctaccttcaacgacgtggaaaagatggctgcgcacatgcggatggtgcatatcgacgaagaaatggggccaaagactgactcgacccttagcttcgacctgaccctgcaacaaggatcccacaccaacatccacttgctggtgaccacttacaacttgcgggacgcgcccgccgagtctgtcgcataccacgcacaaaacaatccacctgttccgcccaagccgcagccgaaggttcaggagaaggcggacatcccggtcaagtcctccccacaagccgccgtcccttacaaaaaggatgtgggaaagaccctgtgccccctgtgtttctccatcctcaagggaccgatttcggacgcccttgcacaccacctccgggaacggcaccaggtgatccagaccgtgcatcccgtggaaaagaagttgacttacaagtgcatccattgcctgggagtgtacacttccaacatgactgcctccaccatcaccctgcacctcgtgcattgccggggtgtcggcaaaacccagaacggacaggacaagacgaacgcacctagccgccttaaccagagcccgagcctggcaccggttaagaggacctacgagcagatggagttcccgctgctcaagaaacgcaagttggacgatgatagcgatagcccatcgtttttcgaggagaagccggaagaaccggtggtgctggccttggacccgaagggacacgaggatgactcttacgaggcgaggaagtccttccttactaaatacttcaataaacagccgtatccgacgaggcgcgaaattgagaagctggcggcttcactgtggctgtggaaatcagacatcgccagccatttttcgaacaaacggaagaagtgcgtccgcgattgcgagaaatacaaacctggagtgctgctggggtttaacatgaaagaattgaacaaagttaagcatgagatggacttcgatgccgaatggctgttcgaaaaccatgatgaaaaggatagcagagtgaacgcatcaaaaaccgctgacaaaaaacttaatctcggaaaagaggacgactcttcctcggactcattcgagaatctggaagaggaaagcaatgaaagcggttcaccattcgatccagtgttcgaagtggagccgaagattagcaacgataatccagaggagcatgtgctgaaagtgatcccggaggacgcatcggaaagcgaagagaagctggaccagaaggaggacggaagcaagtacgaaactatccatctgactgaagagcccactaaacttatgcataacgcctcagattcggaggtggaccaggacgatgtcgtggaatggaaggacggagcctccccgtctgagtccggaccaggatcccaacaagtctccgatttcgaagataacacttgcgaaatgaaaccgggcacctggtcggacgagtcaagccaatccgaggacgcacgctccagcaagccggcggccaagaagaaggctactatgcagggagacagggaacagttgaagtggaaaaactcctcctacgggaaggtggaaggtttctggtccaaagatcaatcccagtggaaaaatgcttccgagaacgatgagcgcctctccaacccacagatcgagtggcaaaattcgaccatcgactcggaggacggtgagcaattcgacaacatgaccgacggagtggcagagccgatgcacggatccctcgcaggcgtcaaactgtcctcccaacaggcc

SEQ ID NO: 5760 - DNA, 3306 bp, Artificial Sequence
  Description of Artificial Sequence: Synthetic coding sequence
atgttccagttaccagttaacaatctgggcagtctccgcaaagcacggaagacagtgaaaaaaatactaagcgatatcgggcttgagtactgtaaggaacacattgaagatttcaaacaatttgagcctaacgatttctacctgaaaaataccacatgggaagacgttgggctgtgggacccttccctcactaaaaatcaagactacaggacaaaaccattttgctgcagtgcgtgtcccttttcttcaaagttcttctccgcatataaatcccacttcagaaatgtccactctgaggacttcgaaaacaggatcttacttaactgcccatactgcaccttcaatgctgataaaaagacccttgaaacccacattaagatctttcacgctcctaacgcttccgcgccctcctctagcttaagcacttttaaagataagaataagaatgacggcctgaaaccaaaacaggctgattccgtggaacaggctgtgtactattgtaagaagtgcacctatagagacccgctgtatgagattgtgcgtaaacacatctatagggaacattttcagcatgtggcagccccatacattgccaaggctggagagaaatcacttaacggagccgtaccactgggaagcaatgcgagagaagaaagcagcatccattgcaaacgctgcttgtttatgcctaagagctacgaagctctggtgcaacatgtgatcgaggaccatgaacgaataggataccaggtgacagcaatgatcggtcacaccaacgtggtggtcccccgtagcaagcccttaatgcttatcgcaccaaaaccacaagataaaaagtccatgggcttaccaccaagaatcgggtcactggccagcggaaatgtcaggtcactgcctagccagcagatggtcaatcgcctttctataccgaagcccaacctgaacagcaccggcgtcaacatgatgtcctctgtccatcttcagcagaataactacggggtgaaaagcgttggacaggggtacagtgtaggccagtccatgcggctgggattgggcggcaacgcgcccgtatccatcccacaacaatctcaaagtgtcaaacagctgctgccctccggaaacgggaggagctacggcctgggcagtgagcaacgtagtcaggctccagcaaggtattctctgcagagtgccaacgctagtagcttgagtagtggacagttgaaaagtccatctctctctcagtcgcaggcttctcgcgtgctaggacaaagctcttcaaaacccgccgctgctgctactggaccccctcctggcaacaccagttctacacagaaatggaaaatctgtactatttgtaacgagcttttccccgaaaacgtgtacagtgttcactttgagaaggagcacaaagcagagaaagttcctgcagtagcaaactacataatgaaaatccacaacttcacctcaaagtgtctatactgcaatagatacctgcccacggataccctgcttaaccatatgctcatccacggcctgagttgcccttattgcagatcaacattcaatgacgtggaaaaaatggccgctcatatgaggatggttcatattgacgaggagatgggaccaaaaaccgatagtacactgagctttgacctgacccttcagcaaggttcccatacaaacatccatcttttagtgaccacctataacttgcgggacgcccccgcagagtcagtggcttaccacgctcagaacaatccccctgtacccccaaaacctcagcccaaggttcaagaaaaggcggacatcccagttaagagcagccctcaggcagctgtaccttacaagaaagacgtcggcaaaaccctgtgtcccctgtgcttcagcatcctcaaaggccccatctccgacgcactggcccatcatcttagggaaaggcatcaagtgatacagaccgtccaccccgtcgagaagaaactgacctacaaatgcatacactgtctgggagtgtatacctctaacatgaccgctagcacaatcaccctgcacctggtccattgtaggggggttggtaagacccaaaacgggcaggacaagactaacgctccttctaggctgaatcaatctccgtccctggcacccgtcaaacggacatacgaacagatggagtttcccttgctcaaaaaacggaagctggacgatgacagcgatagcccctcattcttcgaagaaaagccggaggagcctgtcgtcctcgctcttgatccaaagggacacgaggatgatagctacgaagccaggaagagcttcctcactaagtattttaacaaacaaccataccctaccaggagagaaatcgagaagctggcagcgtctctttggctttggaagtccgatatcgcctcccatttcagcaacaaaagaaaaaagtgcgttcgcgactgcgagaagtacaagccgggtgttctgttgggatttaacatgaaggagctcaacaaagtcaaacacgaaatggattttgatgctgagtggctgttcgagaaccacgatgagaaagatagtagggtgaacgcaagcaaaacagccgacaagaagctcaacctgggcaaggaagatgactccagtagcgactcatttgaaaatctggaagaagaaagcaatgaatccgggtcaccgtttgatcctgtgtttgaagtggaacctaaaattagtaatgataaccccgaagaacacgtgcttaaggtgattccggaggacgcctctgagtcagaggagaagctcgatcagaaagaagacggctcaaaatacgagaccattcacctcactgaagaacccacgaagctcatgcacaatgcttctgacagcgaggttgatcaagatgacgttgtggagtggaaagatggcgctagtccttcggaatctggccctggaagccaacaggtgagtgatttcgaggataacacctgcgagatgaaacccgggacttggtctgatgagtccagtcagtctgaagacgctagaagttccaagccagccgccaaaaagaaagctactatgcagggcgatagggagcagctcaagtggaaaaatagctcatacggaaaggtggaaggattttggtccaaagatcagagccagtggaaaaacgcaagcgagaacgatgagaggttgtctaacccacaaatagagtggcaaaacagtaccatcgatagtgaggacggcgagcaattcgacaatatgacagatggcgttgccgagccgatgcacggtagcttagctggcgttaagctcagttcccagcaggcc

SEQ ID NO: 5761 - DNA, 3306 bp, Artificial Sequence
  Description of Artificial Sequence: Synthetic coding sequence
atgtttcaactgccagtgaacaaccttggatctctccgcaaggcgagaaaaactgtgaagaagattctttccgatatcgggcttgaatactgcaaggaacatattgaggatttcaaacagttcgaacccaatgacttttaccttaagaacaccacttgggaagatgtgggtctgtgggacccatcgctgactaagaaccaagactatcgcactaagcctttctgttgttccgcatgtccctttagcagcaagttcttctcagcatacaagagccatttccgtaacgtccattcggaagattttgaaaataggattctcttgaattgtccatactgcactttcaacgcagataagaaaacgctggaaactcatatcaagatttttcacgcgccaaatgcaagcgccccttcctcgtcactttctaccttcaaggataagaacaaaaatgatggcctcaaacccaagcaggctgactcagtggaacaggcagtgtactactgcaaaaagtgcacctacagagatccattgtatgaaatcgttcggaaacacatataccgtgaacacttccagcacgtcgcagcaccgtatattgcgaaagccggagaaaagagccttaacggggcagtgccgctgggatccaacgcgagggaagaatccagcattcactgtaaaaggtgtttgtttatgcccaagagctatgaggcactcgtgcaacatgtcatcgaagatcatgaacggataggttaccaagtgaccgctatgattggccacaccaatgtggtggtcccccggtctaagccacttatgctgatagccccgaaaccccaagataagaagagcatgggccttcccccacgaattgggtccctcgcaagcgggaacgtgcgcagcctgccttcccaacagatggtcaacagattgtccattcccaaaccaaacctgaactccactggggtgaatatgatgagctcggtgcacttgcagcaaaacaactacggagtgaaatccgtcggacaaggttactcggtgggacaaagcatgagacttggacttggaggtaatgcaccagtgtcaatcccacagcaatcccaatccgttaagcagcttcttccatctggaaacggaagatcgtacggcctcggctcggaacaacgatcccaggcgcctgcacggtactcccttcagtcagccaacgcttcgtctcttagcagcggccagctcaaatcaccttcgctttcccaaagccaagctagccgggtgctgggtcaatcctcgtccaagcctgcagcggccgcaaccgggcctcctcctggcaacacctccagcacccagaaatggaagatatgtaccatttgtaacgagctttttccggagaatgtgtactcggtgcatttcgagaaggaacacaaggcagagaaggtgccagcagtggccaactacattatgaaaatacataactttacttcaaagtgtttgtactgtaaccgatacctgccaactgatacccttcttaaccatatgctcatccacggactttcctgtccctactgccgctcaacgtttaatgacgtggagaagatggccgcacatatgagaatggtgcacatagacgaggaaatgggaccaaaaactgattccacccttagctttgacctgactctccaacagggttcacacactaatatccatctgctggtcaccacctacaatctccgggatgcgccggcagaatccgtggcataccatgcacaaaacaaccctcctgtgccacctaagccgcaaccaaaggttcaggaaaaggcagatataccagtgaagtcatcaccacaagcagccgtgccttacaagaaggatgtgggcaagaccctgtgcccactctgtttttcgattctgaagggtccaatcagcgatgcgctggcccatcatctgcgcgagagacatcaagtgattcaaaccgtgcaccctgtcgaaaagaagctcacctacaagtgcatccattgtcttggagtctacacttcgaacatgaccgcctcaactataactctccacctggtccattgtagaggggtgggcaagacgcagaacggacaggacaaaactaacgccccgtccaggcttaatcagtccccaagcctcgcacccgtcaaacgaacctacgagcaaatggaatttcccctgctgaagaagagaaaactcgacgatgactccgactcgccttcctttttcgaagaaaagcccgaagagccggtggtgctggctcttgatcccaagggacacgaagatgattcttacgaagcgcggaagtcgtttcttaccaagtactttaacaagcaaccctacccgactcggcgagagatcgagaaactggcggcatctctgtggctgtggaagtccgatattgcatctcatttttccaataagcggaaaaagtgcgttcgggattgtgaaaagtacaagccaggtgtgctccttgggttcaatatgaaagaactgaataaggtgaagcacgagatggactttgatgccgaatggctgtttgaaaaccacgacgagaaggatagccgggtgaatgcaagcaagactgcagacaagaagctgaaccttggaaaggaagatgattcatcgagcgattcgtttgaaaatcttgaggaggaatccaacgaaagcggatcaccttttgacccagtctttgaagtcgagcccaagatttccaatgacaaccccgaggagcatgttctgaaggtgattcccgaagatgcatcagagtcggaggagaaactcgaccagaaggaagatggttctaagtacgaaaccatccatcttacggaagaacctaccaagttgatgcataacgcatccgacagcgaggtcgatcaggatgacgtggtggaatggaaagatggagcatccccgtcggaatcggggcccggttctcaacaagtctcggactttgaggataatacttgcgagatgaaacctgggacctggtccgacgaatcgtcgcaaagcgaggatgccagaagctcaaaacctgcggccaagaagaaagcaactatgcaaggagacagagagcaactgaagtggaaaaactcgtcttacggaaaagtcgaggggttctggtcgaaggatcaatcgcagtggaaaaacgcatcggaaaacgacgaacgcctttcgaatccacaaatcgaatggcagaattccaccattgactcggaagatggtgaacagtttgataacatgacggatggtgtggccgagcctatgcatggttccttggcaggggtgaagctgtcgtcacagcaagca

SEQ ID NO: 5762 - DNA, 3306 bp, Artificial Sequence
  Description of Artificial Sequence: Synthetic coding sequence
atgtttcagctacccgtcaacaatctgggatccctccgcaaggcccgcaagactgtgaaaaaaattctgagcgatatcggcctggagtattgtaaagagcatatcgaggacttcaaacaattcgagcctaacgacttttatctgaaaaacactacatgggaggacgttggtctctgggacccgtccttaactaaaaatcaggattatcgcactaagcccttttgctgctcagcatgtcccttttcaagtaagtttttctctgcatacaaaagccacttcagaaacgtgcactcggaagatttcgagaatcggattcttctgaattgtccttattgcaccttcaatgctgataagaagaccctggaaacacatatcaagatctttcacgcccccaacgcctccgctccctccagtagcctgagtacattcaaggataaaaataagaacgatggtcttaagcccaaacaggcggattccgtagagcaggccgtgtactactgtaagaagtgtacttaccgggatcccttatacgaaatcgtacggaagcatatttatagagagcactttcagcatgtggccgcaccttatattgctaaagctggcgaaaaatctctcaacggagccgttccgctgggcagcaacgctcgcgaagaatccagcattcattgtaagcgatgcctgttcatgcctaagagttatgaagctctagttcaacatgtgattgaggatcatgagaggattgggtatcaagtgacagccatgatcggccataccaacgtcgttgtgccaaggtccaagcccctgatgctgatcgcccccaaacctcaggataaaaagtctatggggctgcccccacgaatcggcagtctggcctctggtaacgttagatcactgccctcccagcagatggtgaatcgcttgtctatccccaagccaaatctgaactccacaggagtgaacatgatgtcgtctgttcacttacagcagaacaactatggggttaagagcgtgggacaaggctacagcgtgggccagtccatgagactggggctaggtggcaatgccccggtgagcatcccccagcaaagtcagtcagtcaagcagttactcccatccggcaacggtcgttcgtacggcctaggcagcgagcagcgaagccaggcccctgcgcgatacagtttacagtcagcaaatgcgtcatcgctctcttccggacagttgaagagcccctctctctcgcagtcccaggcatcacgcgtgctgggacaatcgtcctccaaacccgctgccgccgcaacggggcccccccctggcaatacgtcatctactcagaaatggaaaatctgcacaatttgcaacgaactgttccctgagaatgtctacagtgttcatttcgaaaaagaacataaggctgaaaaggtccctgccgtggccaactatataatgaagatccacaactttacatctaagtgtctgtattgtaatcgttatctgcctaccgataccctgctcaaccacatgctgattcacggcctcagttgcccttattgtcgttcgacattcaacgatgtggagaaaatggcggcacacatgcggatggtgcatattgacgaagaaatggggcctaagacagattcaacactcagctttgaccttacccttcagcagggatcccacacaaacatacatctcttggtgacgacttacaacctgcgggacgcccctgccgagagcgtggcatatcacgcacagaataacccccccgtcccccccaaacctcagcccaaggttcaggagaaagccgacatccccgtaaaaagcagtcctcaggcagcggttccttacaaaaaggatgtaggtaaaacactgtgccctctgtgcttctccattctcaaagggcctatttctgacgctctcgctcaccacttgcgtgagaggcaccaggtgattcagacagtccatcctgtcgaaaagaagctcacgtataagtgcatacactgtctcggggtgtacacctcaaacatgacagctagtacgatcaccttgcatttagtacactgccgcggtgtcgggaagacccagaatgggcaagacaaaacaaatgccccttctcgtctgaaccagagcccttccctcgccccagtcaaacgcacctatgagcagatggaattccccctgctcaagaagaggaagctggacgacgactccgacagcccatcattctttgaggaaaagccagaggagccagtcgtgctggcactcgacccaaaaggacatgaagatgatagttacgaggctcggaaaagttttttaacaaagtacttcaacaagcaaccctacccgacccgccgtgagatcgaaaagctcgccgcttctctgtggctgtggaaatcagatatcgcaagccatttctcaaacaagcgcaaaaagtgcgtgagggactgtgagaagtacaaacctggggtgctgttgggcttcaacatgaaggaactaaacaaagtgaagcacgaaatggattttgacgccgagtggctttttgaaaatcacgacgagaaggattctcgcgtgaacgcttctaaaacagccgataaaaagctgaacctcgggaaggaagatgattctagctcagacagcttcgaaaacttagaggaagaatccaacgaaagcggcagtccttttgacccggtgttcgaagtagaacccaaaattagtaacgacaaccccgaggagcacgttctgaaagtgataccggaggacgcatcagagagcgaggagaaacttgaccagaaagaggacggatctaagtacgagaccatccatctgacggaagagccaactaaactcatgcacaatgcatctgattcagaggttgatcaagatgacgtcgtggaatggaaggacggggcaagccccagtgaatcgggcccaggaagccagcaggtcagcgactttgaggataacacatgtgagatgaagcccgggacctggtcggatgaatcaagccagtcggaagatgccaggtcctccaagcctgctgccaagaaaaaggcaaccatgcagggtgatagggagcaactgaaatggaagaactcttcctatggtaaggtcgagggcttctggagcaaagaccagagccagtggaagaacgcctcggagaacgacgaacgcttatcaaacccacagattgaatggcagaactcaaccatcgattcagaggatggagaacagttcgataacatgactgatggcgtcgctgagcccatgcatggatccctggcgggagtcaagctgtcctcacagcaagct

SEQ ID NO: 5763 - DNA, 3306 bp, Artificial Sequence
  Description of Artificial Sequence: Synthetic coding sequence
atgtttcaattgcccgtgaataacctggggtctctccgcaaagcgaggaagaccgttaagaagattttatcggacattggtctggaatattgcaaggagcacatcgaggacttcaaacagtttgagcccaacgacttttacctgaagaacaccacctgggaggacgtgggcctctgggatccctcgctcactaaaaaccaggactacaggactaagccattctgctgttcagcttgtccatttagttcaaagtttttttcagcctacaagtctcacttcagaaatgtgcatagtgaggactttgaaaataggattctgctcaactgcccttattgcactttcaatgctgataagaagacgcttgaaactcatatcaagatctttcacgcacccaacgcaagcgccccaagttccagtttgagcacttttaaagacaagaacaagaatgacggtttgaagcccaagcaagctgattctgtggaacaggctgtctactactgcaagaaatgcacttaccgggacccgttgtatgaaatagtgcgtaaacacatttatcgagagcacttccaacacgtcgctgcgccgtatattgcaaaagcgggagaaaaatctctaaatggtgcagtcccgctgggctcaaacgcgcgggaagaatcttctatccactgtaagcggtgcttattcatgccaaagagttatgaggcgctggtgcagcacgtgatcgaggatcacgagcgaatcgggtaccaggtgaccgccatgatcggacatacaaacgtggtggtgccacgatccaagcccctgatgctgattgccccgaagccacaggacaagaagtcgatgggtctgccacctcgtattggatcactcgcttctggtaatgtccgaagcctgcctagccagcagatggtgaacaggctgtcgattcctaaacctaacttgaatagtacaggagtgaacatgatgagtagcgtgcatctgcaacagaacaactatggcgtaaagagtgtcggacagggatattccgtcggacagagcatgaggctaggactagggggaaatgctcctgtctccattccacagcagtcccagtcagttaaacagctgctgccctcagggaatggcagaagttatggccttggctcagaacagcgatcccaagcgcccgcacggtactccctgcagagtgccaatgcttcctcattgtcatcaggacagcttaagagcccttctctgtcccaaagccaggccagcagagttctgggccagtcctcgtctaagccagcagccgccgcaacaggtccgcccccggggaacacgagctcgacccagaagtggaagatctgtacaatctgcaacgaactgttccccgaaaatgtttatagcgtgcacttcgaaaaagagcacaaggctgagaaagtgcctgccgtcgccaactatataatgaaaatacacaacttcacgtctaagtgcctctactgtaatcggtacttgcccacagacactctgctcaatcacatgctgatccatggtctaagctgcccgtactgccggagcacattcaacgacgtggagaaaatggccgcacatatgcgcatggtgcacatcgacgaggagatgggacccaaaaccgattccaccctgtcatttgacctgactctgcagcaaggatcacacaccaatatacatttactggtaaccacgtacaatttgcgtgatgcacccgcagaatccgtggcataccacgcacagaataatcctcccgtaccgcccaaacctcaaccaaaggtacaggaaaaagctgatattcctgtcaagtcctccccacaggcggctgtgccatacaaaaaggatgtcggaaaaaccctctgtccactgtgcttctctatcctcaagggcccaatctccgatgcactcgctcaccaccttagagagcggcaccaggtaatccagactgtgcacccagtagaaaaaaagctgacctacaagtgtatccactgcctgggggtctacaccagcaacatgacagcttctaccattacgttacacctggtacactgccgaggtgtaggcaagacccagaacgggcaggataagaccaacgctccttccagactgaaccagtccccttctttagcccccgtgaagcgtacctacgaacagatggagtttccgctactaaagaaaaggaagttggacgacgactctgactccccatcgttcttcgaggaaaagccagaggaacccgtggtgctggccctagaccccaaaggccatgaggatgatagctacgaggcgcgaaaaagcttcctgactaagtactttaataaacaaccctatccgactagacgggagattgaaaagctggcggctagcctgtggctgtggaaaagtgatattgcatcccattttagtaacaaaaggaaaaagtgtgttcgagactgcgaaaagtataagcccggggtgttattggggttcaatatgaaggagctgaacaaggtcaagcacgaaatggattttgatgctgaatggttgttcgagaaccacgacgaaaaagattcccgggtcaacgcctcgaaaacggccgacaagaagctaaatctggggaaggaggacgatagttcatccgattcctttgagaatctggaagaggagagtaatgagtcaggaagcccttttgacccagtctttgaggtggaacccaaaatctccaatgataaccccgaagagcacgtccttaaggtcatccccgaggacgcctccgaatcggaagaaaaacttgaccagaaggaggacggctctaagtatgagactattcacctgacggaggagcccacaaagttaatgcataacgcaagcgattcggaggtggaccaggacgatgtggtggaatggaaggatggagcatctcccagtgagtcgggacccggaagtcagcaagttagcgattttgaagacaacacctgtgagatgaagcctggtacatggagcgacgaaagttctcagagtgaggatgcaaggtctagtaaacctgcggcaaaaaaaaaagctacaatgcagggcgaccgggaacagctgaaatggaagaacagctcctacggcaaagtcgaggggttctggagcaaagatcaatcacaatggaagaacgcgagcgaaaatgatgagcgcctgagcaacccacaaatcgagtggcagaacagcaccattgactctgaggacggtgaacaatttgataacatgacagatggggtggccgaaccgatgcacggaagcctcgcgggcgtcaagctgtcttcgcagcaggct

SEQ ID NO: 5764 - DNA, 3306 bp, Artificial Sequence
  Description of Artificial Sequence: Synthetic coding sequence
atgttccagctacccgtcaacaatctgggctccctgcggaaggcaagaaagacagtcaaaaaaatcctgagcgacatcggactggagtattgtaaggagcacatcgaggatttcaagcaattcgagcccaacgacttttacctgaaaaatacgacttgggaggacgttggtctgtgggacccatctctaacgaaaaatcaggactaccgtacaaaaccattttgttgctccgcttgcccctttagctcaaagttcttttctgcttacaagtcccactttagaaatgtgcacagcgaagatttcgagaataggatcctgctcaattgtccatactgtactttcaacgcagacaaaaaaaccctggaaacgcatattaagatattccatgcacccaacgcgagcgccccatccagctcactgagtacttttaaagataagaacaaaaacgatggactgaaacctaaacaggcggactccgttgagcaggcagtgtactactgtaagaagtgcacttaccgcgatccactgtatgagatagtccgcaaacacatctatcgcgaacatttccagcatgtggctgcgccatatatcgcaaaagcaggagagaagagcctgaatggtgctgtgccactggggtccaacgccagagaggagagttctattcactgcaaacggtgtctctttatgcccaagagctacgaggccctcgttcaacacgttatcgaggatcatgaaagaatcggctaccaggtgaccgctatgatcgggcacaccaatgtagtagtgcctagaagcaagccactgatgttgatcgctcctaagccacaggacaagaaaagcatgggcctacccccccgcatcggtagcttagccagcgggaacgtgagaagcctgccctcccagcagatggtcaacaggctctcaattcccaaacctaaccttaacagtacgggggtaaatatgatgagctccgtccatctacagcagaacaattacggcgtgaaatcagtgggccagggctactcggtgggccagagcatgagactcggcttaggggggaatgctccagtctcaataccacagcagtcccagtccgtcaagcagctgctgccctccgggaatggacggagttacggcctcggatccgagcaacggtcacaagccccggctcgatacagcctgcaatctgcaaacgccagcagtctaagcagcgggcagctgaagtctccatctttgtcgcaatcacaggcatcaagagtgctgggccagagcagctctaagcccgccgcagccgcgacagggcctcctccaggaaacacctcttccacacagaaatggaagatttgtacaatctgtaacgagctgtttcccgaaaatgtatactctgtccacttcgagaaggagcacaaggcagaaaaggttccggctgtcgctaactacattatgaagattcacaacttcacttccaagtgtctctactgtaacaggtaccttcccacagacactctgcttaaccacatgctcattcacggactgtcctgcccttattgtaggagtacattcaatgatgttgagaaaatggcagctcacatgcggatggttcatatcgacgaggaaatgggaccgaaaacggattcaacgctctccttcgacctgacactccaacaaggtagtcacacgaatattcatctcctcgtgaccacgtataatctccgcgacgctccagccgaaagcgtggcctaccatgcccagaacaatcccccagtgccaccaaaacctcagccaaaggtccaggagaaagcggatattcccgtgaagtccagcccacaggccgctgtgccctacaagaaagatgttgggaagaccttatgtcctctttgtttcagtatattaaagggacctatttcagacgctctagcccaccacctgagagagcggcaccaagttatccagactgttcatcccgtggaaaaaaaactgacctacaaatgcatccattgtctgggcgtctatacctccaatatgacggcgtcaacgataacactgcatctggtccactgccgaggagtagggaaaacccagaatggacaggataagactaacgctccctcacgcctcaaccagtccccgtcgctggccccggtgaagcgaacctatgagcaaatggaatttccactcctaaagaagcggaagctcgacgatgactcagatagcccctccttcttcgaggagaaacctgaagaacccgtggtactcgctctggacccaaaaggccatgaagacgactcttacgaggccaggaagtccttccttaccaaatacttcaataagcaaccatacccgacccggcgggagatcgaaaaactggcagcatcactgtggctctggaaaagcgacattgcctcccacttcagcaacaagagaaaaaagtgcgtgcgtgactgcgagaagtacaagcctggtgtcttgctgggattcaacatgaaggaactgaataaagtcaagcacgagatggactttgacgcagagtggctgttcgaaaaccacgacgagaaggacagtagggtcaatgcgagcaagaccgccgacaagaagctgaatttgggaaaggaagatgattcctcgtccgactcttttgaaaacctggaagaagaaagtaatgagtccggctctcctttcgaccccgtgtttgaggtcgagcccaagatatccaacgacaaccccgaagagcatgtgctcaaggttatacccgaggacgcctctgagtccgaagaaaagttagaccaaaaggaggatggatctaaatatgaaactatccatctcacagaagaaccaacaaagttgatgcacaatgcctcagactccgaggtggaccaggacgacgtcgttgagtggaaggacggagctagtccaagcgaaagcgggccagggagccagcaggtatccgatttcgaagacaacacctgcgagatgaaaccgggtacctggagtgacgagagttcgcagtctgaagacgcacgaagttccaagcctgcagcaaaaaagaaggccactatgcagggagaccgcgagcagctgaaatggaagaacagtagttatggtaaagtggaaggtttttggtccaaagaccagtctcagtggaagaatgcctccgaaaatgacgaacggctgtccaatccgcagatcgagtggcagaattctactattgatagtgaagatggggaacagttcgataatatgaccgatggcgttgctgaacctatgcacggcagcttggctggcgtgaagctgagttctcagcaggca

SEQ ID NO: 5765 - DNA, 3306 bp, Artificial Sequence
  Description of Artificial Sequence: Synthetic coding sequence
atgttccaactcccagtgaacaatctgggatcactgagaaaggcacgtaagactgtgaagaagatcctgagcgatatcggacttgagtactgcaaggaacatattgaagatttcaaacaatttgagcctaacgacttttacctgaagaacactacgtgggaggacgtgggcctgtgggacccttcactgaccaagaaccaggattaccggaccaagcctttctgctgctcggcttgtccattctcctcgaagttcttctcggcttacaagtcccacttccggaatgtgcattccgaagatttcgaaaaccgcatcctcctgaactgcccgtactgcactttcaacgcggacaagaaaacgcttgaaacccatatcaagatcttccacgcgccgaacgcatcggcgccgtcgtcgtctctgtcaaccttcaaggataagaataagaacgatggcctcaagccaaagcaggcggattccgtcgagcaggccgtctactactgcaagaagtgtacttacagggacccgctctacgagattgttcggaaacacatctacagagagcactttcagcacgtggccgctccatacattgcgaaagccggagagaagtccctgaatggagccgttcccctggggtcaaacgccagggaagaatcgtccatacattgtaagaggtgcctgtttatgcccaaaagctacgaggccctggtgcagcacgtaattgaggaccatgaacggatcggataccaagtgactgctatgatcggacacacgaatgtggtggtgccgcgctccaaacctttgatgcttatcgctcctaagccgcaagacaagaaatcaatgggcttgccaccgcgtatcgggagcctcgcctccggcaacgtccgctcgctcccatcgcagcaaatggtgaaccgcctgtccattccaaagcctaaccttaacagcactggggtgaatatgatgagctcggtccacctccagcagaacaattacggagtgaagagcgtcggacaaggatactcagtaggacagtcgatgcggctgggactcggaggaaatgcaccggtatctatcccgcaacagtcccagtctgtcaagcaacttctcccgagcggcaatggtcgcagctatggactcggttccgagcagcgatcacaagccccggcccggtactcacttcagtccgccaatgcgtcgtcgctgtcgtccggccagctgaaaagcccatcgctgtcccagagccaggcgtcgcgagtcctgggccagtcctcttcgaagcctgcggcggccgcaacgggtccaccaccagggaacacttccagcacgcaaaagtggaagatctgcaccatttgtaatgaactcttcccggaaaatgtgtatagcgtccacttcgaaaaagaacataaagcagaaaaggtgccggcggtggctaactacatcatgaagatccacaacttcacctccaagtgtctgtactgcaaccgctacctgccgaccgataccctgctcaaccatatgctcatccacgggctttcctgcccctactgcagatccacttttaacgacgtggagaagatggcggctcatatgagaatggtccacatcgacgaggagatgggtccaaagaccgattctaccctgtccttcgatcttaccttgcaacaaggatcacacactaatatccacttgctggtgaccacctacaacctccgcgatgcaccggcagaatcggtggcgtaccacgcccagaataacccgcctgtccctccgaagcctcagcctaaggtgcaggaaaaggcggacatcccggtaaagagctcgcctcaggcagcagttccgtataagaaggatgtgggcaagaccctgtgcccactgtgcttctccattctcaaaggaccaatctctgatgccctcgcacaccatcttagagagagacatcaggtgatccagaccgtgcaccccgtggagaaaaagctcacctacaagtgtatccattgccttggtgtgtacacctcaaacatgacggcttccactatcaccctccatttggtgcactgtcggggcgtcggtaagacccagaacggccaagacaaaactaacgcaccatccagactgaatcaaagcccgtccctggcgccggtcaaaaggacctacgaacagatggaatttccgctgctgaagaagcgcaagctggacgatgattcggatagccccagcttctttgaggaaaagccggaggaaccagtcgttctggccttggacccgaagggtcacgaagatgactcctacgaggcccggaaatcattcctcacgaaatacttcaataagcagccgtatccgactcgccgtgaaatcgaaaaactcgctgcaagcctgtggctgtggaagagcgatatcgccagccatttttcaaacaaacgcaaaaagtgcgtgcgcgactgcgagaaatacaagccaggagtgctcctgggttttaacatgaaagaattgaacaaagtcaagcacgagatggatttcgatgccgaatggctgttcgagaaccacgacgagaaagactcccgagtgaatgcttccaagaccgccgacaagaaactcaatcttggaaaagaagatgactcatcaagcgattcgttcgaaaaccttgaagaagaaagcaacgaaagcgggtccccctttgacccggtctttgaggttgaaccgaagatcagcaatgacaacccagaagagcatgtgctgaaggtgatcccggaggacgcgtcggagtcagaggaaaagctcgatcaaaaagaggacggatcgaagtacgaaactatccatcttaccgaggagccgactaaactgatgcataacgcgtccgactcggaggtggatcaggacgatgtggtagagtggaaggacggagccagcccttccgaaagtgggccagggtcgcagcaggtgtcggactttgaagataatacttgcgagatgaagccgggaacctggtcggacgaatcgtcccagtccgaggacgcccgcagctcaaaaccggctgccaagaaaaaagcaactatgcaaggagatagggaacagctgaaatggaagaactcgtcatacggaaaggtcgaaggcttctggtctaaggaccaatcacaatggaagaacgccagcgagaatgacgaacggctgagcaatccgcagatcgagtggcagaattcgactatcgactcggaggacggggaacaattcgacaacatgactgacggagtcgccgagccgatgcacggttcccttgccggcgtcaaactgtcgtcccagcaggcc

SEQ ID NO: 5766 - DNA, 3306 bp, Artificial Sequence
  Description of Artificial Sequence: Synthetic coding sequence
atgtttcaattgccggtgaacaacttgggttccctcagaaaggcacgaaaaacggtgaagaagatcctctcagacatcggtttggagtactgcaaagaacatatcgaggacttcaagcaattcgaaccaaatgatttctacctcaaaaacacgacttgggaagatgtgggactctgggatccgtcactgacgaaaaaccaggactacagaaccaagccgttttgttgcagcgcgtgtcctttctccagcaagtttttcagcgcatacaagtcccactttcgcaacgtgcattctgaggactttgaaaaccgtattttgctcaactgcccatactgtacttttaacgcggataagaaaacccttgaaactcacataaagattttccacgcacctaatgcaagcgcaccatcatcgagcctcagcacctttaaggataagaacaagaacgatggacttaaaccaaagcaggccgatagcgtcgaacaggccgtctactactgtaaaaagtgtacctaccgagatcctctctacgagattgtgcgcaagcacatttaccgcgagcattttcaacatgtcgcggcaccctacattgcaaaggccggagaaaagtctctgaacggggcagtccctctgggctcgaacgcaagggaagaatcttcgattcactgtaagagatgtctctttatgccgaaatcctacgaagcactggtgcagcatgtgatcgaagatcacgagcggattgggtaccaggtgaccgctatgatcggccatactaatgtggtcgtcccccgcagtaaacctctgatgctgatagccccaaagccgcaagataagaagagcatgggactgcctccaaggattggttcccttgcgagcggaaatgtcagaagcctgccctcccagcaaatggtgaacagattgtccatcccgaaaccaaatctgaacagcactggggtcaacatgatgagctccgtacatcttcagcaaaacaattacggcgtgaagtcagtgggacaaggctactctgtggggcagtccatgcgcctgggacttggcggaaatgcaccggtgagtattcctcaacaatcacaatcggtcaagcagcttctccccagcggaaatggccgttcctacggacttggctcagagcaaagatcacaagcccctgcaagatacagcctgcaatcggctaatgcatcgtctctgtcctcagggcagctgaagagcccttcgctgagccagtcacaagcatcgcgggtgctcggtcagtcatcgagcaagcctgcagctgctgcaactggtcccccacctggcaacacttcctccactcagaaatggaagatttgcaccatctgtaatgaactttttcctgaaaacgtgtactccgttcatttcgaaaaggagcacaaggccgagaaggttcctgcggtcgcaaattacataatgaaaattcacaactttacttcgaaatgcctgtattgtaacaggtacctgccgaccgataccctcctcaaccatatgctcatacatggcctgtcatgtccttattgtaggtcaacctttaacgatgtggaaaagatggcggcacacatgaggatggtgcacatcgatgaagaaatgggacccaagacggactccactctgtcatttgacctcaccctgcaacaaggcagccacactaacattcacctgttggtgaccacttataaccttcgtgacgcacctgccgaatcagtcgcctaccatgcacagaataatccacccgttccacctaagcctcagccaaaagtgcaagagaaggcggatattccggttaagtcgtcccctcaggccgcagtgccatataagaaggacgtgggtaaaaccttgtgcccgctttgcttctcgatcctcaaaggaccaatctcggacgctttggcccatcatttgagagagcgacaccaggtgatacagaccgtacacccagtggaaaagaagctcacctataagtgcatacattgtctgggcgtctacacctccaacatgaccgcttcgaccattactcttcaccttgtccattgccggggagttggaaagactcaaaacggtcaggataagactaatgcccctagcagactgaatcagtccccttccctcgcccctgtgaaacgcacctacgagcagatggagtttcccctgcttaagaaacggaagctggatgacgattccgatagcccgtccttttttgaagaaaagcctgaggaaccagtggtgcttgcacttgatcccaagggacatgaggatgattcttacgaagcgagaaagagcttcctgaccaagtacttcaataagcagccataccctactagacgggaaatagaaaaactcgcagcaagcctctggctgtggaaaagcgatattgcatcgcacttcagcaacaaacgtaagaagtgtgttcgggattgtgagaagtataaaccaggagtcctcttgggctttaacatgaaagagctgaataaggtgaagcatgaaatggactttgacgcagaatggctttttgaaaatcacgatgagaaggactctagggtcaatgcatcgaaaactgcagacaagaagttgaatctcggtaaagaagatgactcgtcgtccgactccttcgaaaacctggaagaggaatccaacgaatcggggagcccctttgacccggtgttcgaagtggaaccgaagatctctaacgataaccctgaagagcatgtgcttaaagtcattccagaggatgcctccgagagcgaggaaaaacttgatcaaaaggaagatggctccaagtacgaaactattcaccttaccgaggaacctacgaagctcatgcataacgcatccgattcagaagttgatcaggatgatgtggtggaatggaaagacggtgcttcaccaagtgaatccgggccaggttcccaacaagtgtccgactttgaggacaacacctgtgagatgaagcctggaacttggtccgacgagtcgtcacagtcggaggatgcaaggtcgtctaagccggccgcaaagaagaaggcaaccatgcagggtgatagagaacaacttaaatggaagaactcaagctacggtaaggtggaagggttctggagcaaggatcaaagccaatggaagaacgcatccgaaaatgatgagagactgtcaaaccctcagattgagtggcaaaactccacgattgactccgaagatggcgagcaatttgataacatgactgatggtgtggccgaacctatgcatggatcattggcaggagtgaaacttagttcacaacaagcg

SEQ ID NO: 5767 - DNA, 3306 bp, Artificial Sequence
  Description of Artificial Sequence: Synthetic coding sequence
atgttccagctgcctgtgaacaacctgggttccctgagaaaggcgagaaaaaccgtgaagaaaatactttcagatattggcctggaatactgtaaggaacacatagaggacttcaagcaatttgagcctaacgacttttacctgaagaatactacctgggaagatgtgggactctgggacccaagcctgaccaagaatcaggattacagaaccaagccattttgttgttcggcatgtcctttctcctccaagtttttcagtgcctacaagagccattttcggaacgtgcactccgaggacttcgaaaatcgaatccttctcaattgtccgtactgcacttttaacgcggacaaaaagacgttggagactcacatcaagatattccatgccccaaacgcatcggccccgtcgtcctccttgtccactttcaaggataagaacaaaaacgacggactgaagcctaagcaggcagactcggtcgaacaggcggtgtactactgtaagaaatgcacttaccgggatcctctgtacgagatcgtgcgcaagcacatttacagagaacatttccaacatgtggcggcaccctacattgcgaaggcaggggaaaagagccttaatggagccgttccgcttggtagcaacgcacgcgaagagtcgtcaattcactgcaaacgctgtctgttcatgcctaaatcatacgaggcactggtgcaacatgtcattgaagatcatgaaagaatcggttaccaagtcaccgcaatgatcggtcatactaacgtggtggtccctcgctcaaaacctctgatgctgatcgcgcctaagccacaagataagaagtcaatgggactgccccctaggattgggagccttgcatccggaaatgtcagatcacttcctagccaacaaatggtgaaccgtctttcaatccctaagccaaaccttaactccactggagtgaacatgatgtcgtccgtccaccttcagcagaataactacggggtcaagagcgtgggtcagggatactccgtgggtcagtccatgcgcctggggctcggaggtaacgctcccgtgagcattcctcaacaatcacaaagtgtcaaacaactgcttccctcaggaaatggaagatcgtacgggcttggtagcgaacaaagatcccaggccccagcgaggtactcccttcagtccgcgaacgcatcctcactgtcgtcggggcaactgaaaagcccttcgctgagccaatcgcaagccagccgggttctgggtcaatcgtcgagcaagcctgcagcagcggcaactggaccacctccagggaatactagcagcactcaaaagtggaagatctgtaccatatgtaatgaactgttcccagagaacgtgtattcggttcattttgaaaaggaacacaaggcggagaaggtgccggccgtcgcgaattacataatgaaaatccacaatttcacctccaaatgcctctactgcaacaggtacctgccgactgacacgctgctgaaccatatgcttatacacggtctgtcatgcccttactgtagaagcacctttaatgacgtggagaagatggcagctcacatgcgcatggtgcatattgacgaagagatgggacctaagactgactcgactctctcattcgatctcacccttcaacagggatcgcacaccaacatacacctgttggtgaccacctacaacctccgcgatgcccccgccgagagcgtggcataccatgcacagaataacccccctgtccctccaaagccgcaacctaaggtccaagaaaaggccgatattccagtgaaaagctcgcctcaagccgcagtgccgtataagaaggatgtgggtaagaccctctgtccgctttgtttttcaatcctgaaaggacctatatcggatgcccttgcccatcatctgcgcgaacggcatcaggtgatccaaaccgtccatcctgtggaaaagaaactgacctacaagtgtatccattgtcttggtgtttacacgtccaatatgacggcaagcaccattaccttgcatttggtgcactgtagaggggtgggtaagacgcaaaacggtcaggataagaccaacgcacctagcagactgaatcaatcgccctcgctcgcaccagtgaagcgaacctacgaacaaatggagtttcccctgctgaagaagaggaagctggatgatgactctgattcccccagctttttcgaagagaagcccgaagaaccagtcgttctcgcccttgatcctaagggccatgaggatgactcatacgaagcacggaagagctttctcaccaagtacttcaacaagcaaccataccctactagacgcgaaattgagaagctcgcagcaagcctgtggctttggaaaagcgacatagcctcccatttttcaaataagaggaagaaatgcgttagagattgcgaaaagtacaagcctggagtgcttctcggattcaacatgaaggaactcaacaaagtcaaacacgaaatggattttgatgctgaatggttgttcgaaaatcatgatgaaaaggattcgcgcgtcaacgccagcaagactgcagataagaaactcaatttgggcaaagaggacgacagctcgagcgattcatttgaaaaccttgaggaagagtcaaacgaaagcggatcccctttcgacccggtgttcgaagtcgagcccaagatctcgaacgacaatcctgaggaacatgtcttgaaggtcatacctgaggatgcgtccgaatcggaagaaaaacttgaccagaaagaagatggttcaaagtacgagactatccatcttactgaggaacccaccaaactgatgcataacgcatccgattcggaagtggatcaagatgatgtggtggagtggaaagatggggcctcacccagtgagtcaggccctggatcccaacaagtgtccgattttgaagataatacttgtgagatgaagcccggcacctggtccgatgaatcttcccaatccgaagatgcacgctcatcgaaacccgctgcaaaaaagaaggcgacgatgcagggagatcgggaacagctgaagtggaaaaactcatcgtacggtaaagtcgagggcttttggtctaaggaccagtcgcagtggaagaacgcaagtgaaaacgacgagcggctctccaacccccaaattgaatggcaaaattcgaccatcgattcagaggatggagaacagttcgataacatgacggatggcgtcgcagaaccaatgcacggctcacttgccggcgtcaaactcagctcacaacaagcc

SEQ ID NO: 5768 - DNA, 3306 bp, Artificial Sequence
  Description of Artificial Sequence: Synthetic coding sequence
atgtttcagttaccagtaaacaatctgggatccctccggaaggcccgtaagactgtaaagaagatcctatcagacataggactggagtactgcaaagagcacattgaagattttaaacagttcgaacctaacgatttctaccttaaaaataccacatgggaggatgtaggactttgggacccttccctaactaagaaccaggattataggactaagcccttctgctgctctgcgtgtccattttcgtccaagtttttcagtgcctacaagtcccactttaggaacgtgcatagtgaggattttgagaatcgaatactgctgaattgtccctattgtaccttcaacgcagacaaaaaaacactagaaactcacatcaaaatctttcatgcaccaaacgcctctgcgccctcttcatccttgagcacttttaaagacaaaaataagaacgatggtctgaagccaaagcaagcggatagcgtcgagcaggcggtctattactgtaagaagtgcacctaccgggatccgttatacgagattgtgcgcaagcatatctatcgagagcatttccaacatgtggctgccccttacatcgcgaaggctggcgaaaaatcactgaacggcgccgttcccctcgggagtaacgccagggaagaatcatccatccactgcaaaaggtgcctgttcatgcccaagtcatatgaagctctagtacagcacgtgatcgaggaccacgagcgcatcggctatcaggtgactgcaatgatcgggcacactaacgtggtcgtgcctcgctctaaaccgctgatgttgattgcaccgaagcctcaggataagaagagtatggggttgccccctcggatcggatcacttgcgtcaggcaacgtcaggtccctcccatcccagcagatggttaatcgcctgtccattcccaagcccaatctgaattccactggagtgaacatgatgtcgagcgtgcatctacagcagaataattacggggtgaaaagcgtgggacaggggtacagtgtaggtcagtccatgagattgggcctgggggggaacgctcccgtgtctatcccgcaacagagtcagtcggtcaagcagctgctcccttctgggaatggccgctcgtacgggctggggagtgagcagcgatcacaggcgcccgctcggtatagcctgcagtcagcaaacgcatcatctctctctagcggccagctgaaatcgccctcgctctcacaaagtcaggctagccgcgtattgggacaatcctccagtaagcctgcggctgctgctacaggccccccaccagggaacacctcgtcgacacagaaatggaagatatgtaccatctgcaacgagctcttcccagagaatgtatacagcgtgcattttgagaaagagcacaaggccgagaaagttccggcggtggccaattacatcatgaagatccacaatttcacttcaaaatgtctgtattgcaaccgctatctcccaaccgacaccttactaaatcacatgctgattcatggattgtcctgtccatattgtcgttctacgttcaacgatgttgagaaaatggcggcccacatgagaatggttcatatcgatgaagagatgggaccaaagacagactccacactctccttcgacctgacgctgcaacagggcagtcacacaaatatccatctgctggtgaccacctacaatctgagggacgctcccgccgaatccgtagcttatcacgcccaaaacaatccccctgtcccgcccaagccgcagccaaaggtgcaagagaaggcagatatccccgttaaatcctctccccaagcagctgtcccatataaaaaagacgtgggcaagaccttgtgtcctctgtgcttctccatccttaaaggacccatcagtgatgccctggcgcaccatctgagggagcgacatcaagtgatccagacagtacatccagtagaaaaaaagttgacctacaaatgcatccattgtctcggtgtgtatactagcaatatgacagcctcaactattaccctccatctcgttcactgcagaggtgtgggaaagacccaaaatggtcaggataagaccaacgctccctccaggttgaaccaatctcccagcctcgcccctgtaaaacgcacttacgagcaaatggagtttccgctcctcaagaagagaaagctcgacgatgactctgattccccctcgttctttgaggaaaagccagaggaacctgttgttcttgccctggaccccaaggggcacgaggatgacagctatgaggctcggaagtcgttccttacaaagtacttcaacaagcagccgtatccaacgcggagagagattgagaaattggccgcctctttatggctctggaaatctgacatcgccagtcatttctcaaacaaacggaaaaaatgcgtacgagattgcgaaaaatacaagccaggcgtgctcctgggtttcaacatgaaggaactcaacaaggtcaaacatgaaatggacttcgatgccgagtggttattcgaaaaccatgacgagaaggactcacgcgtgaacgcttccaaaaccgccgataagaagctgaacttggggaaggaggatgactcctcttctgattcatttgagaatctagaagaagaaagtaatgaatccggctccccgtttgaccccgtatttgaagtggaacccaaaatcagcaacgacaatcccgaagaacacgttctgaaggttatccctgaggacgctagcgagagtgaagagaaactggatcagaaagaggacggttcaaagtacgaaacaatccaccttaccgaagaacccaccaagcttatgcacaacgctagcgattccgaggtggaccaagatgacgttgttgagtggaaggatggggccagccccagcgaaagtggacctggctcacagcaggtgagcgacttcgaagacaacacgtgtgagatgaagcccggaacttggagcgatgagtcttcccagagcgaggatgctaggtcttcgaaacctgccgcgaaaaaaaaggccacaatgcaaggtgatcgagagcagctcaagtggaaaaattcttcatacgggaaagtggagggcttctggagtaaggaccaatcccagtggaagaacgcctcagaaaacgacgagaggctttctaacccccagatcgagtggcagaattccaccatcgactctgaggatggcgagcaattcgataacatgactgacggggttgccgaaccaatgcatgggagcctagccggcgttaaactctccagccagcaagcc

SEQ ID NO: 5769 - DNA, 3306 bp, Artificial Sequence
  Description of Artificial Sequence: Synthetic coding sequence
atgtttcagctgccagtaaataacctcggatctcttcgcaaggctaggaaaacagtgaagaaaatcctttcagacatcgggctcgaatattgtaaagaacacatcgaagacttcaaacagtttgaacccaacgatttctatctcaagaatacaacttgggaagatgtggggctgtgggatccatccttaactaaaaaccaggattatcgcactaaaccattctgctgttcagcttgccccttctcttcaaagtttttctctgcctataaatctcattttcggaatgtacactctgaagatttcgaaaatagaattttactaaactgtccatattgtacatttaacgccgataaaaaaacactggaaactcatataaaaatcttccacgcgcccaatgcctcagcacccagtagttcactgtctactttcaaagataaaaataagaatgatggattaaaacctaaacaggctgattcggtagaacaggccgtgtactactgcaaaaagtgcacatatcgggatcctctctatgagatcgtgagaaaacacatttatagggagcattttcaacatgtggcagcaccatatatagccaaagctggggaaaagtctctaaacggggctgtacccttgggaagtaatgcacgggaagagagttctatccattgtaaaagatgtttgtttatgcccaaatcatatgaagcgcttgtgcagcatgtaatagaggatcatgaaagaatcggataccaggttactgctatgatcgggcacacaaatgtggtggttccccggtctaaaccattgatgctgatagctcctaaaccccaggataaaaagtccatgggactgccaccaaggattggaagtctagctagtggaaacgtcaggtctcttccttctcagcagatggtgaaccgactgtctatccccaaacccaatctgaacagtacaggggttaatatgatgtcctccgtgcacctgcagcagaacaattatggggttaaatccgtgggacagggatatagtgtcgggcagtctatgcgattaggattaggggggaatgcgcccgtatccatcccccagcagtcccaatctgttaaacagctcctcccttcagggaacggacgttcctacgggctgggatccgaacagcgctcacaggcacccgctcggtattccctccagtcggccaatgcctcaagtctttctagtgggcagcttaagtctccctcgctctctcagtcacaggccagtagagttctagggcagtcctctagtaaacctgcggcagcagccacagggccccccccagggaacacaagttcgactcaaaaatggaaaatttgcactatatgcaacgaactctttcctgagaacgtttattctgtgcattttgaaaaagaacacaaagccgagaaagtcccagctgtggctaactacatcatgaaaatacacaactttacttctaaatgtctatactgtaaccggtatctccccacagatactctcctgaatcacatgctcattcacggactttcatgcccttattgtagatcaactttcaacgacgtagaaaaaatggccgcccatatgagaatggttcatatcgatgaagaaatgggacccaaaactgactctactctgtcttttgatctgactctccagcaaggatcccacacaaacatccatctcctggttacaacatataacctacgcgacgccccagcagagtctgtggcataccatgcccagaacaacccccccgtccctcccaaaccccagcctaaagtgcaggaaaaagctgatatccccgtgaaatcttctccccaagcagcagtgccttataaaaaagatgtaggaaaaactttatgtcccctctgtttctctatcctgaaagggcccatttctgacgccctcgcccaccatctaagggaacgccatcaggtgatacagactgtgcaccctgtagaaaaaaagctcacatataagtgtatacattgcctcggagtgtacacatccaatatgacagcatcaactattactttgcatctggtgcattgccgtggggtaggaaaaacacagaacgggcaagataaaactaacgctcctagtaggctgaaccagagtccctctctggctccagtgaaacgcacatatgaacagatggaatttccgctgctcaagaaaaggaaactagatgatgattcagactccccttctttttttgaagaaaagccagaagagcccgtggtgcttgctctcgatcctaaagggcatgaagatgattcctatgaagcccggaaatccttcctcacaaaatactttaacaaacagccatatcctactcggcgcgaaattgaaaaactggccgccagtctgtggctgtggaagagtgacatcgcctctcacttcagtaacaaacgaaagaagtgtgtccgggattgcgaaaaatataaacccggggtcctcttgggatttaatatgaaagaactcaacaaagtcaagcatgagatggacttcgatgctgaatggctcttcgaaaatcatgatgaaaaagattcccgcgtgaacgccagtaaaacagccgataaaaaattaaacctgggaaaggaggacgactctagttctgattccttcgagaatctggaagaagagagtaatgagtcagggtccccctttgatcctgtgtttgaagtcgagccaaaaatctccaacgataatcctgaagaacacgtgctaaaagtcatccctgaagatgcttctgaatctgaagaaaaactcgatcagaaagaagacgggtctaaatacgaaactattcatctgacagaagaacctacaaaactcatgcataatgcatctgatagtgaagttgatcaagatgatgtggtggagtggaaggatggagcctctccctccgaatctggaccagggtctcagcaggtctcagattttgaggataacacatgcgaaatgaaaccagggacatggtccgatgaatcttctcaatcagaggatgctaggtcatccaagccagctgcaaaaaaaaaagctactatgcagggagatagagagcaactgaaatggaaaaattcttcttatggaaaagtggagggattctggagtaaagatcagtctcagtggaaaaatgctagtgagaatgatgaaagactatctaatcctcagatagagtggcagaactctactattgattcagaagatggggaacagtttgataacatgacagatggggtcgccgagcccatgcatgggtctttggccggggtgaaactctcttcccagcaggct

SEQ ID NO: 5770 - DNA, 3306 bp, Artificial Sequence
  Description of Artificial Sequence: Synthetic coding sequence
atgtttcagctacctgttaacaatttaggttcactcagaaaggccagaaagaccgttaagaaaatcctatctgatattggtctggagtactgcaaggagcatatagaagactttaagcagttcgagccaaatgacttctatttgaagaatacaacgtgggaggatgtgggactgtgggaccccagcctcaccaagaatcaggattacagaacaaaacccttctgttgctccgcatgtcccttttcttctaagttcttcagcgcttataaaagtcacttccgcaatgtccattcggaggactttgagaaccgcatccttctcaattgtccctattgcactttcaacgccgataaaaagacacttgaaacacacatcaagatttttcacgcccccaatgcatcagctccgagttcatctcttagtacattcaaggataagaataagaatgacggacttaaacctaagcaggccgactctgtcgagcaagccgtctactattgtaagaagtgcacttaccgcgacccgttgtacgaaatcgtccggaagcacatctaccgcgagcattttcagcatgtcgcggcaccatatatagcgaaggcaggcgaaaagtcgctaaatggcgctgtccctctcgggtccaacgcccgagaagaaagctccattcattgcaaacggtgcctgttcatgccaaagagctatgaggcccttgtgcagcacgtgattgaggaccacgaacggatcggataccaggtgacagccatgattgggcacactaacgtcgtggtgcctcgctctaaaccactcatgttaattgcacccaagcctcaggacaagaaatctatgggtctccctccccgcatcggatcgcttgcctcaggcaatgtacgctcccttccttcacagcaaatggtcaatagactgtctattcctaagcccaatctgaactctaccggagtgaatatgatgagctccgtccacctgcagcagaacaactatggcgtgaaatcagtgggccaaggctatagtgttggccagtcaatgcgactcggattaggaggcaacgctcccgtaagtatcccccaacagtcccagtctgttaagcagctgctgccaagcggaaacggacggagttacggcctcggtagtgagcagaggtcccaggcccctgctcgatactccctgcaaagcgcaaatgcatcaagcctgagtagtggacagctaaagtcaccttctctatcccagagtcaggcgtcccgcgtgctgggccagagtagtagtaaacccgccgccgctgccactggtcctcctcccggcaatacctcttcaacgcaaaagtggaagatctgcaccatctgcaatgagctgttccccgagaatgtgtactccgtgcactttgagaaggagcataaggcggagaaagtgccagcggtagccaattatataatgaagatacacaattttactagtaaatgcctttactgtaatcgttacttgccaaccgatacattgctcaatcacatgctgattcacggcctctcctgcccctattgccggtcgacttttaacgatgtggagaagatggcagcacacatgaggatggttcacattgacgaggagatgggcccaaagaccgacagtaccctgagctttgatctgactttgcagcagggttcgcacactaacatccacctgctcgtcacaacgtataatctgcgagatgccccagccgaatccgtggcgtaccatgctcaaaataatccacccgtgccaccgaagccacagccgaaagtccaggaaaaggctgatattccagtgaaatcttctcctcaggcagccgttccctacaaaaaagatgtgggtaagaccctgtgtcccttgtgtttctcgattttgaaaggacccatatcagatgcacttgcccaccacttgcgtgaaagacaccaggtcatccagactgttcatccagtggagaaaaagctgacttacaagtgcatccattgtcttggcgtgtatacaagcaacatgaccgcctctaccatcaccctccacttagtgcactgccggggcgtggggaagacacaaaacggccaagacaaaacgaatgcaccttccaggctgaaccagtcgccctcgctagcacctgtgaagcggacctatgaacagatggagtttcctctcctgaaaaagagaaaacttgatgacgactccgattcaccatccttcttcgaggagaagccagaggaacctgttgtgttggcgctcgatccaaagggccatgaagatgactcctacgaagccagaaagtcgtttctcaccaagtattttaataagcagccgtaccccacaagaagagaaattgaaaaacttgcagcctctctgtggctctggaaaagtgacattgcgagccatttttctaataaacgcaagaaatgtgtgcgtgactgtgaaaagtataaaccaggggttctgcttggattcaacatgaaggaactgaacaaagttaagcacgagatggattttgacgccgagtggcttttcgaaaaccacgatgagaaggattccagagtgaatgcctcaaaaacagccgacaagaaactgaacctgggaaaggaggacgatagtagtagcgactcattcgaaaaccttgaggaggagtccaacgagtcgggcagccctttcgacccagtgtttgaagtcgaacctaaaatctccaatgataaccctgaagagcacgtgctgaaggtgatccccgaggacgcttctgagtccgaagaaaagttagaccagaaggaagacggtagcaaatatgaaactatccatctgaccgaagagcccacaaagctgatgcacaacgctagcgactccgaagtggatcaggacgatgtagttgagtggaaagatggtgcgtcgccgagcgagtctggacccggctctcagcaagtttccgacttcgaggacaatacttgcgagatgaaaccaggtacatggagcgatgaatcctcacagagcgaggacgcccgttctagtaagcccgcagccaaaaaaaaggctacgatgcagggcgatcgggagcagttgaagtggaaaaactcttcctacggaaaagtggagggattctggtcaaaagatcagagtcagtggaaaaacgcctctgagaatgatgaaagattatccaacccccagatcgaatggcaaaattctaccatcgacagcgaagacggcgagcagttcgacaatatgaccgacggggttgctgagccaatgcatggcagcctggcaggggtgaaacttagcagccagcaggct

SEQ ID NO: 5771 - DNA, 3306 bp, Artificial Sequence
  Description of Artificial Sequence: Synthetic coding sequence
atgttccagttgcccgttaataatctgggttcacttagaaaagctaggaagacagtgaaaaagattttgtcagacatcggcctcgaatactgcaaggagcacatcgaggacttcaagcaatttgaacctaacgacttttacttgaagaacactacctgggaggatgtcggtctgtgggaccccagcttgacaaagaatcaagactacagaactaagcctttttgctgctctgcatgtcccttctcttctaagtttttttcagcatacaagtctcactttagaaatgtgcattcagaggactttgagaaccgtattctgctgaattgcccctattgtaccttcaatgccgacaagaaaaccctcgagacccatatcaaaatctttcacgccccaaacgcttctgctccatcttcctccctgagtaccttcaaggataaaaataaaaacgacggacttaaacccaagcaggccgacagcgtcgaacaagctgtgtattactgcaaaaagtgtacatatcgtgatcccctttacgaaattgtgaggaagcatatttacagggagcatttccagcacgtagccgccccatacattgcaaaggctggcgagaaaagtctcaacggcgctgtaccactgggatctaacgcacgtgaggaatcttcaatccattgcaaacgctgtctttttatgcctaaaagctacgaggctctcgtgcagcacgtgattgaggaccacgaaaggattggttaccaagtcaccgccatgatcggccatacaaatgtggtcgttcctaggagtaaacccctcatgctgatcgcacccaaaccacaagataagaagtccatgggcctgcccccccgcatcggttccctggcctcaggcaacgtccgttcccttccctcacagcagatggtgaacaggctcagcatccccaagcctaaccttaactctactggcgtgaatatgatgtcatcagtccatctccagcagaacaattacggtgtcaaatctgtgggccagggttactccgttggccagtctatgaggctgggcctgggaggcaacgcccccgtcagtattcctcaacagtcccaatctgtcaagcagctcttgccttccggaaacggtcgctcttacggcctgggctccgagcaacgctcacaggctccagcacgttattccctgcaatcagcaaatgcctcttctctttccagtggtcagctgaaaagtccttccctctcccaatcccaagcctccagggtactcggtcaaagctccagtaagccagctgcagccgctaccggtcccccaccaggtaacacctctagtacccagaagtggaagatctgtacaatctgtaacgaactcttccccgagaacgtctattccgttcacttcgaaaaggaacataaagctgagaaggttccagccgtggctaactatattatgaaaatccataacttcacctctaaatgtttgtactgcaaccgctatcttccaactgatactttgctgaaccatatgctgatccacggactttcttgtccatactgtcgtagcactttcaacgacgttgaaaaaatggccgcccatatgcgcatggtgcatattgatgaggagatgggccccaaaacagactcaaccttgagcttcgacctgaccctgcagcagggctctcataccaacatccaccttctcgtgactacctacaatctcagagatgcacctgccgaatctgtggcctaccacgcacaaaacaaccctcctgtccctcctaagccacagcctaaggttcaggagaaggcagatatcccagtaaagagttctccccaggccgccgtgccatataagaaggacgtgggtaagaccctttgccccctctgctttagcatcttgaaaggacccatttccgatgcacttgctcaccacctcagggagcgccaccaagtaatccagactgttcaccccgttgaaaaaaaactcacctataagtgcattcactgcctgggagtctatacctccaacatgacagcctccaccatcacactgcacctggttcattgcaggggtgtgggaaagacacagaatggccaggacaagaccaacgcaccaagtagactgaaccagtccccaagcctggcccccgtcaaacgcacctacgaacagatggagttcccactgctgaagaagaggaagctggacgacgattccgattcccccagtttctttgaggagaagccagaggaacccgtggtgctggccctcgatcctaaaggtcacgaagacgactcatacgaagctaggaagtcttttctcaccaagtactttaacaagcaaccataccccactagacgcgagattgaaaaattggccgcttctttgtggctttggaagtcagatatcgcttcccacttctcaaacaaaaggaagaagtgtgtgagagattgtgagaagtacaagcccggagtgctgctgggattcaatatgaaagaacttaacaaggtcaagcacgaaatggatttcgatgccgagtggctgtttgaaaatcacgacgaaaaggattcaagagttaatgcatctaaaacagctgacaagaagctgaacctcggcaaggaagacgattccagtagtgactcctttgaaaatctcgaggaggaatctaacgagtctggctctcccttcgacccagtgtttgaggtggaacctaaaatcagcaacgataacccagaagaacatgtgttgaaggtgatccccgaagatgcatctgaatcagaggaaaagttggaccagaaggaggatggttcaaaatatgaaactattcatctgaccgaagagccaacaaaattgatgcacaacgcttccgattcagaggtggaccaggacgacgtagttgaatggaaagacggtgcatctccttcagagtccggaccaggaagtcagcaggtgtccgacttcgaggacaacacttgcgagatgaagcccggtacctggtcagatgaatctagccagagtgaggatgcacgtagttctaagcctgccgctaagaagaaagccacaatgcaaggcgacagggaacagctgaagtggaagaactccagctacggaaaggtcgaaggtttctggtcaaaggatcaatctcagtggaagaacgcctctgagaacgacgaaagactcagtaacccacaaatcgaatggcagaattccacaatcgacagcgaggatggcgagcaatttgataatatgaccgatggagtggcagagccaatgcacggctctctggccggtgtcaaactctcatcccagcaggct

SEQ ID NO: 5772 - DNA, 3306 bp, Artificial Sequence
  Description of Artificial Sequence: Synthetic coding sequence
atgttccagctgccggtgaacaacctgggatcactgagaaaggcaagaaaaaccgtcaagaagattctttcggacattggcctggagtactgcaaagagcatatcgaggactttaaacagttcgagccgaacgacttctacttgaagaatactacttgggaggatgttggactgtgggacccctcactgaccaagaaccaggattaccgcacgaagccgttttgctgctctgcgtgcccgttctcaagcaagttcttttcggcctacaagagccacttccgcaacgttcactcagaggacttcgagaataggatcctcctgaactgcccgtactgcaccttcaatgcagacaaaaagactctggagactcatatcaagatttttcacgctccgaacgcctctgcaccttcatcctcattgagcacttttaaggataagaataagaatgatggactcaagccgaaacaggcagactcggtggaacaggcagtgtattactgcaagaaatgtacctaccgcgatccactctacgaaatcgtcagaaagcacatctaccgggaacattttcaacacgtcgccgccccatatatcgccaaagcaggggagaagtccctgaacggagccgtgcctctgggctccaatgcgcgcgaggaatcctccatccactgtaagcgctgcctgttcatgccgaaaagctacgaagcgctggtccaacacgtcatcgaggaccatgagcggattggttaccaggtgactgcgatgatcggtcataccaacgtggtcgtgccgcggagcaaaccactgatgctgatcgcaccgaagcctcaggataagaagagcatggggttgccaccccggatcgggagccttgcatcaggaaacgtgcggtccctgccgtcccagcagatggttaatcgcctgagcattccaaaacccaacctcaatagcactggtgtgaatatgatgtcgtcggtgcacttgcagcagaacaactacggagtgaaaagcgtcggtcagggctactcggtgggacaatccatgagactcggcctgggaggtaatgctccggtgtccatcccacagcaatcacagtccgtcaaacaactgctgccatcgggcaatggtagatcatacggactcggcagcgaacaacgctcgcaggcacctgctcggtacagcctgcaatccgctaacgcgtcatcactcagttcaggacagctcaagtcgcctagcctgtcccaatcgcaggcctcccgggtcctcggccagtcctcctcgaaaccagccgcagctgctaccggaccaccaccggggaacacctcgtcgacccagaagtggaagatctgtaccatctgcaacgagttgttcccggaaaatgtgtactcagtgcattttgagaaagaacataaagccgaaaaagtgccggcagtcgccaattacataatgaaaattcacaacttcactagcaaatgtttgtactgtaatcggtacctgccaacggacacccttctcaatcacatgctgatccacgggctgtcctgcccttactgccggtcaaccttcaatgacgtggagaagatggccgcgcacatgcgaatggtccacatcgacgaggagatgggcccaaaaaccgattcgaccctgtccttcgacctcaccctgcagcaaggctcgcataccaacatccacctgctcgtcaccacctacaacctgcgggatgcaccggcggaatcagtcgcgtatcacgcacaaaacaacccgccggtgccgcctaaaccgcagccgaaggtgcaggaaaaggccgatatcccagtgaagagctcgccccaggccgcagtgccttacaaaaaggacgtgggaaagaccctctgcccgttgtgcttctctatcctgaagggtccaatctcggatgccctcgcccaccacctgagagagcggcatcaggtgatccagacggtgcatccggttgaaaagaagctcacctacaaatgcattcactgtctcggcgtgtacacctcaaatatgaccgcgtccaccatcaccctccacctggttcactgccgcggtgtcggaaagacccagaatggccaagacaaaactaacgctccgagtagactcaaccagtccccatcattggcccctgtgaagcgcacctacgaacagatggagttcccgctcctcaagaagagaaagctggacgatgattcggacagcccttccttcttcgaagagaagccggaagagcctgtggtgttggcactcgacccgaagggacacgaggacgattcctacgaagcacgcaagtcgttccttacgaagtactttaacaagcaaccgtacccgacccgacgcgaaatcgagaagttggcagcctccctctggctgtggaagtccgatatcgcctcacacttctccaacaagcgcaagaagtgcgtgagggattgtgaaaagtataagccgggagtgctgttgggcttcaatatgaaggagctcaacaaagtgaagcacgaaatggatttcgacgccgagtggctgttcgagaatcacgacgaaaaggacagcagggtcaacgcatccaagaccgcagacaagaagctgaatctgggtaaggaagatgactcgtcctcggactccttcgaaaacctggaggaggagtcaaatgagtccggaagcccgttcgacccagtttttgaagtcgagccgaagatctccaacgataacccagaagaacacgtcctcaaggtgatccctgaagatgcatcagagagcgaagaaaaactcgatcaaaaagaggacggaagcaagtacgaaaccatccatcttactgaagagccaactaaattgatgcacaatgctagcgatagcgaagtcgatcaggacgacgtcgtggagtggaaggatggagcctccccgtctgaatcgggaccgggttcccagcaggtatcagatttcgaggacaacacctgcgagatgaagccaggaacttggtcggacgaatcgtcgcagagcgaggacgcacgctcctcgaagccggccgcgaagaaaaaggccacgatgcaaggagatcgcgagcagttgaaatggaagaacagcagctatggcaaggtcgagggattctggtctaaggaccagagccagtggaagaacgcatcggaaaacgacgagcggctcagcaatccacagatcgaatggcagaactccaccatcgactctgaagatggcgaacagttcgacaacatgactgatggtgtcgctgaacctatgcacgggtcgctggcaggagtgaaactgtcatcacaacaagcc

SEQ ID NO: 5773 - DNA, 3306 bp, Artificial Sequence
  Description of Artificial Sequence: Synthetic coding sequence
atgttccaactgcctgtgaacaaccttgggagccttagaaaagcccgaaagactgtgaagaagattctgtcagatataggcctggaatactgcaaggaacatattgaggactttaagcagtttgaaccgaacgatttctacctgaagaataccacctgggaagatgtcggtctgtgggacccttcgttgacgaaaaaccaagactaccgaaccaagcccttctgttgcagcgcctgcccatttagctccaagtttttctcggcatacaaatcacattttaggaatgtgcattccgaagattttgaaaacagaatcctgctgaattgtccgtactgcacctttaacgccgacaagaaaactctggaaacccacattaagatatttcacgcacctaacgcatcggcaccttcatcctccctgtccacctttaaggataagaacaaaaacgacggccttaagccaaagcaggcagatagcgttgagcaggctgtgtactactgtaaaaagtgtacttacagagatccactgtacgaaatcgtaagaaagcacatttaccgtgaacattttcagcatgtggctgcaccttacatcgcaaaggccggtgaaaagtcgcttaacggagcggtgccactgggtagtaatgcccgcgaagagtcgtcaattcattgtaagaggtgtctgttcatgcctaagtcctacgaggcactggtgcagcacgtcattgaggaccatgaaagaattggttatcaagtgactgcaatgattggtcatactaatgtcgtggtgccacgcagcaaaccgctgatgcttattgcccccaaaccacaagataagaagtcgatgggcctgccacctcgaatagggagccttgcatcaggtaacgtgaggtcgctcccatcccagcaaatggtcaatcgtctgagtattcccaagcctaaccttaacagcactggggtgaacatgatgtcgagcgtgcacctccaacagaataactatggtgtcaagtcagtggggcagggctactcggtcggacagtctatgcggcttggattgggcggaaacgcacctgtgtccattcctcagcaatcacaaagcgtgaaacaactgctgccctctggaaatggccggtcctatggtctgggttccgaacaacgttcccaggctcccgctcggtactcgcttcaatccgcgaacgcatcctcgctgtcgagcggtcagcttaagtcgccttccttgtcgcaatcacaagcatcaagagtgctgggacagtcgtcgagcaaacctgcagcggccgccacgggacccccgcctgggaatacgtctagcactcaaaagtggaagatctgtactatatgcaatgaattgtttccagaaaatgtctactcggtgcatttcgaaaaggagcataaggcggagaaagtgccagccgtagcgaattacataatgaagattcataactttactagcaagtgcctgtactgcaacagataccttccaactgatacgctcctgaaccatatgctgatccacggcctttcttgtccttactgtcgctccaccttcaatgacgtggagaagatggcagctcacatgcgcatggtccatatcgatgaggagatggggccaaagaccgactcgaccctcagctttgacctgacccttcaacaaggttcccacactaacattcatctcttggtcactacctacaaccttcgtgatgcacccgcagagagcgtcgcataccatgcacagaacaatcctccggtgccacctaagccacaaccaaaggtgcaagaaaaggcggacatccctgtgaaaagcagccctcaggcggcagtgccttataagaaagatgtcggaaagactctttgcccactttgtttcagcatactgaaaggaccaatatccgacgccctggcacatcatctccgagagcgacaccaggtgatccaaaccgttcatcctgtcgagaaaaagctcacctacaaatgtattcattgtttgggagtatacaccagcaatatgaccgcatctactatcactctgcacctcgtgcactgtaggggcgtcggaaagacgcagaacggtcaggataaaactaacgccccgagcaggctcaatcaatcaccttcgcttgcaccagtgaagagaacctacgaacagatggaatttccgcttctgaaaaagcgcaagttggatgatgactccgattccccttccttttttgaggagaagccggaagaaccagtggtgctggcgctcgaccctaaaggacacgaggacgactcatacgaagcgaggaagtctttcctgactaaatacttcaacaagcagccataccctaccagaagagaaattgaaaaactcgcagcatcgctctggttgtggaaatcggatatcgcgtcgcacttttccaacaagaggaaaaagtgtgtcagagattgtgaaaagtacaaacccggtgtgctcctcggattcaacatgaaagagcttaacaaggtcaagcatgaaatggactttgacgctgaatggctttttgaaaaccacgacgagaaggattccagagtcaatgcttcgaaaaccgctgacaagaagctgaacctcggtaaagaagatgattcgtcatcagatagcttcgagaatctcgaggaagagtcgaatgagtcgggttccccattcgatccggtattcgaagtggaacccaagatctccaatgataacccggaggaacatgtgcttaaggtgataccagaggatgcctcggagagcgaagagaaactggaccaaaaagaggacggatcgaagtacgaaaccatacatcttactgaggaaccaaccaaactcatgcataacgcatcagacagcgaagtcgatcaggatgacgtggtggaatggaaggacggagcgtcgccttcagaatcgggccctggatcgcaacaagtgtctgactttgaagataacacttgcgaaatgaagcctggaacttggtcggatgaatcgtcccaatcagaggatgcacggtcgagcaagccagcagccaagaaaaaggctaccatgcagggagatcgggagcagcttaaatggaagaactcgtcgtatggtaaggtggaaggcttttggtcgaaggatcagtcccagtggaagaatgcatcggaaaacgatgaacgtttgagcaatccacagattgaatggcaaaacagcacgatcgatagcgaagatggagaacagtttgataacatgaccgatggggtggccgaacccatgcacggatcgctggcgggagttaagctgtcatctcaacaagcc

SEQ ID NO: 5774 - DNA, 3306 bp, Artificial Sequence
  Description of Artificial Sequence: Synthetic coding sequence
atgttccagctgccggtcaacaacctggggtcactgcgcaaggcccggaaaactgtgaagaagatcctctcagacatcgggctggagtactgcaaggaacatatcgaggacttcaagcaattcgagccgaacgacttctacctgaagaacactacctgggaggacgtcggactttgggaccctagcctcaccaagaaccaagactaccggacgaaaccgttctgttgctccgcgtgcccattttcgtctaaattcttcagcgcatacaagtcgcactttcggaacgtgcactcagaagatttcgagaataggatcctgctgaattgtccttactgtacttttaacgcggacaaaaagactctggagactcacatcaagatcttccatgcccccaacgcgtcggcgccgtcatcgtcgctgagtacgtttaaggataagaacaagaacgacggactcaagcctaagcaggcggattcagtcgaacaagcagtgtattactgcaagaagtgcacttaccgggacccgctgtacgagatcgtgaggaagcatatctaccgggaacatttccagcacgtggccgccccttatatcgctaaggccggtgagaagtcgctgaacggtgctgtcccgctcggatcgaatgcgcgggaggaatcgtctatccactgtaaacgctgcctcttcatgccgaagagctacgaggcactggtgcagcacgtcatcgaggaccatgaacggatcggatatcaggttactgcaatgatcggacacactaacgtggtcgtgccgcgctccaagccgcttatgcttatcgcgccgaaaccgcaagataagaaatcgatgggactgccaccgcggatcgggtccttggcttcgggaaacgtgagatccttgccttcccagcaaatggtgaatcgcctttccatccctaaaccgaacctcaacagcactggagtcaacatgatgtcatcagtccacctccagcaaaacaattacggcgtcaagtccgtgggacaaggatattcggtcggacagagcatgagactcgggctgggagggaacgcgcctgtgtccatccctcaacagagccagagcgtgaaacagcttctcccgagcggaaacggacgctcgtacggattgggctccgaacagaggtcccaagcaccggcacggtattcgctgcaaagcgcaaatgcttcgtcattgtcctccgggcagctgaaatcgccaagcctctctcagagccaggccagcagagtgctgggccagtcctcgtcgaagcctgccgcagcggctactggcccgcctccgggaaacacctcgtcgacgcaaaagtggaagatctgcacgatctgcaatgagctctttccagaaaatgtgtactcagtgcactttgaaaaggagcataaagcggagaaggtgccggccgtcgccaactacatcatgaaaatccacaatttcacgtcaaaatgcctgtactgcaatcggtacctgccgaccgacaccctgctgaaccatatgctgatccacggcctgagctgcccatactgccggtccaccttcaacgacgtggaaaagatggcagctcacatgcgcatggtgcacattgacgaagagatgggtccaaagaccgactcaacgctgtcctttgatctcaccctccagcaggggtcgcacaccaatattcatcttctcgtcacgacttacaacctgcgcgacgcgcctgcggaatccgtcgcctaccatgcacagaacaatccccccgtgcctccaaagccccaaccgaaggtccaggaaaaggcggacattccggtgaagtcctcaccacaggctgcggtgccttacaagaaggatgtgggaaaaactctttgccccctgtgtttctccatcctgaaaggcccaatctccgacgccctggcgcatcatctgagagagcgccatcaggtcatccagaccgtgcatcccgtcgagaaaaagctgacttacaagtgcatacattgccttggcgtgtacacctctaatatgactgcgtcgactattacgctccacctggtgcattgccgcggcgtgggcaaaactcagaatggccaagataagacgaacgccccgagccgcctgaaccaatccccttccctggcgcctgtgaagcggacctacgagcaaatggaattcccgctgctgaagaagagaaagctcgatgacgattcggactccccgtcgtttttcgaggaaaagcctgaagaacctgtggtcctcgcgctggatccgaaggggcacgaggacgattcctacgaggcacgcaagtcgtttctcaccaaatacttcaataagcagccatatccgacccgccgcgaaattgagaaactcgcagcgtcactgtggctgtggaaatccgacatcgcttcgcacttctcgaataaacggaaaaagtgcgtgagagactgcgaaaagtacaagccgggagtgctgctgggctttaacatgaaagaactcaacaaagtgaagcacgagatggacttcgatgcggaatggctgtttgaaaaccacgatgagaaagattcaagagtgaacgccagcaagaccgctgacaagaagctcaacttgggtaaggaggacgactcctcttcggactctttcgaaaacctggaagaagaatcgaatgagagcggaagccctttcgacccggtgttcgaagtggaacccaagatttcgaacgacaaccccgaagaacacgtgctgaaggtcatccccgaggacgcatccgagtcggaggagaagctggaccagaaagaggatggatcgaagtatgaaaccatccatctgactgaggaaccgaccaaactcatgcataatgcgtcagactcagaagtcgaccaggacgatgtggtcgaatggaaggacggcgcgtcgccgagtgaatcggggccgggctcccagcaggtgtcagacttcgaggacaacacctgcgagatgaaacccgggacctggtcggacgagtcctcgcagtcggaagatgccagatcatccaagccggccgccaaaaagaaagccacgatgcaaggtgaccgcgaacagcttaaatggaaaaactcgagctacggaaaggtggaaggattttggtccaaggatcagtcacagtggaagaatgcttcagaaaatgatgagcggctgtccaatccacaaatcgagtggcagaacagcaccatcgattcagaggacggagaacagttcgacaatatgaccgacggggtcgctgaaccgatgcatggatccctcgccggggtcaagctgagctcacagcaagcc

SEQ ID NO: 5775 - DNA, 3306 bp, Artificial Sequence
  Description of Artificial Sequence: Synthetic coding sequence
atgttccagctgccagttaataacctaggatccctacgaaaagcaagaaagactgtgaaaaaaattctttccgatataggactcgaatactgcaaggagcacatagaagattttaagcaatttgaacccaacgacttctatttgaaaaataccacgtgggaagatgttggcctctgggacccatctctgacaaagaaccaggactataggacaaaaccgttctgttgctccgcttgcccgtttagcagtaaatttttttctgcgtataagagccatttcaggaatgtgcactccgaagattttgaaaacagaatcctgttgaactgtccctattgtaccttcaatgccgataagaaaacgctggagactcacattaaaattttccatgcaccgaatgcctcagctccttctagctccctgtccactttcaaggataagaacaagaacgacggccttaagccgaaacaagcagactccgtggaacaggcagtatactactgtaaaaaatgcacttacagggacccactttatgagatcgtaaggaaacatatctacagagagcactttcaacacgtagccgctccatacatcgctaaggccggagaaaagagtctgaatggcgccgtgccgcttgggagcaacgcaagggaagagtcatctattcattgtaaaagatgccttttcatgccaaagtcctatgaggctttggtccagcatgtgatcgaggaccacgagaggatcggataccaggtaacggccatgatcggacacacaaatgtggtggtgcctcgatccaagcctttaatgctgatcgcgccaaaaccgcaggacaagaaaagtatgggcctccccccaaggataggttctcttgcgtcaggaaatgtccggagcctgcctagccagcagatggtgaacagactgagcatcccgaaacctaacctgaactcaactggtgtgaacatgatgtcgtcagtgcacctacagcagaataactatggggtcaaaagcgtggggcagggctattccgtaggccagagcatgcgactcggcttagggggaaacgccccagtgagcattccacagcagtctcagtccgtcaaacaactgttaccttccgggaacgggcgaagctatggactcggctccgagcaacgatcacaggcgccagctagatattcactacaatcggctaacgcctcaagtttgtcctctggtcagttgaagtccccttcgctgtcccagagccaagcctccagggtgttaggccagagctctagcaaaccagctgcagctgcaaccggccctccccccggaaatacctcctccacccagaagtggaaaatttgtacgatctgtaatgaacttttccctgagaacgtatattcagtgcatttcgaaaaggaacataaggccgaaaaggttccagcagtcgctaactacatcatgaaaatccacaacttcacctccaaatgtctgtattgtaatcgatatctgcctacggacactctcttaaatcatatgttaatccatggtctgtcctgcccttattgccgaagcaccttcaacgacgtggaaaagatggcggcacacatgaggatggttcatattgacgaagaaatgggtccaaaaaccgattccactctgagtttcgacctcacacttcagcagggatcacacactaacatccacctgctagttacgacgtacaatttgcgagacgcccctgccgaaagtgtagcctaccacgcccagaacaatccacccgttcccccaaagccacagcctaaagtgcaggaaaaggccgatattccggtgaaatcctccccgcaagccgccgtgccttataagaaagacgtcggtaaaaccctgtgccccttgtgtttctctatccttaaagggcctatcagtgatgctttggcccatcatctgagggaaagacatcaggtaatccagaccgttcacccggtggaaaagaaactgacctacaagtgcatccactgtctgggtgtgtataccagcaatatgacagcctcaacaataaccttgcatctggtccactgcagaggcgtgggcaaaacacagaatggacaggataagacaaacgcaccgagccggctgaaccaatccccctctctcgctccagttaaaagaacatacgagcagatggagttcccgctcttgaaaaagcgtaaactggacgacgatagtgactccccatcattcttcgaagaaaaacctgaggaacctgtggtattagctctcgatccaaaggggcacgaggatgacagttatgaggcaaggaaatccttcctgactaaatattttaacaagcagccctacccaacccgtcgtgaaatcgaaaaattagccgcaagtctgtggctttggaagagtgacattgcctctcacttctccaacaagagaaaaaagtgtgtcagggactgtgagaaatataaacctggagttctgttgggcttcaacatgaaagaactaaacaaagtgaagcacgaaatggatttcgatgccgagtggctctttgagaaccacgatgaaaaggattctcgggtgaatgcatccaaaaccgccgacaaaaaactgaacctggggaaggaagacgactctagctccgattcttttgagaaccttgaagaagaatctaacgaaagtggctccccctttgatcccgtgttcgaagtggagccaaaaattagcaatgacaaccccgaagaacatgtgctaaaggtaattcctgaagacgcttccgaaagcgaagaaaaactcgatcaaaaggaggacggttcaaagtatgaaacgatccacctcaccgaagagccaacaaagttgatgcacaacgcttccgatagtgaggtggaccaagacgatgtggttgaatggaaggatggggctagcccaagtgaatccggcccgggttcacagcaggtgtccgatttcgaagacaatacatgtgagatgaagcccggcacctggtccgatgaatcttcccagtccgaagacgctcggtcctcaaagccagctgcgaagaagaaagccacaatgcagggggatcgagagcagcttaagtggaagaactcatcctatgggaaagtggaaggtttttggtcgaaagatcagagtcagtggaaaaacgccagcgagaatgacgaaaggctgtccaatccccagattgagtggcaaaatagcaccatcgatagtgaagacggggagcaattcgataacatgaccgacggcgttgccgagccaatgcacggctccctggcaggggtgaagctttcctctcaacaggcc

SEQ ID NO: 5776 - DNA, 3306 bp, Artificial Sequence
  Description of Artificial Sequence: Synthetic coding sequence
atgttccagcttccggtgaacaacttgggttctctccgaaaggcgcgcaaaactgtcaagaaaatcctgtccgacatcggccttgaatactgcaaagaacacatcgaggacttcaagcagttcgaaccgaatgacttttacctgaagaacaccacgtgggaagatgtcggactttgggacccttcgctcaccaagaaccaggattaccggactaagcccttctgctgctccgcgtgtcccttcagcagcaagttcttttcggcatacaaatcgcatttccgaaatgtgcattcggaagatttcgagaatcgcatccttctcaactgcccgtactgcaccttcaacgccgacaagaaaaccctcgagactcatatcaaaatctttcatgcgcccaacgcatcggccccgtcctcgtcgctctcaaccttcaaggataagaataagaacgacggactgaaaccgaagcaggcggactcggtggagcaggcagtgtactactgcaaaaagtgcacttaccgtgacccgctctacgagatcgtgaggaagcatatctacagagaacacttccagcatgtggccgcaccgtacatcgccaaggcaggagagaagtcactgaatggcgcagtgccattggggtcgaatgctcgagaagaatccagcatccactgcaaacggtgcctcttcatgcccaagtcctacgaggccctggtccagcatgtgatcgaagatcatgaacgcatcggctaccaggtcactgctatgatcggacatactaacgtcgtggttccgcggtcaaagcccctcatgctcattgcccctaagccgcaagacaaaaagtcgatgggacttccgccccgcatcggaagtctggcttctggcaatgtgcggtccctgccgagccagcagatggtcaataggctctccatcccgaagccgaaccttaactcaacgggtgtgaacatgatgagttcggtgcacctgcagcaaaacaattacggcgtcaagtcagtgggacaagggtacagcgtcgggcaatcgatgcgcctcggactgggcggtaacgcaccggtgagcatcccacaacaatcgcagtccgtgaagcagctccttccctcgggcaacgggcgctcctacggactgggaagcgaacagcggtcgcaggcccctgccagatattcgctgcagagcgctaacgcgtcatcactcagctcgggacaactgaagtcaccaagcctgtcccagtcccaggcctcgcgcgtcctgggccaatccagctctaaaccggcggcagcagccaccggaccaccgcctggaaacaccagctcgacccagaagtggaagatctgcaccatctgcaacgagctgtttccagagaacgtctacagcgtccacttcgagaaggaacacaaagccgagaaggtccctgcggtggcgaattacatcatgaagatccacaacttcacctcaaaatgtctctactgcaaccgctaccttccgactgatactctcctgaaccatatgctcatccacggtctttcgtgtccgtactgtcgcagcacctttaacgatgtggaaaagatggccgcccacatgcggatggtgcatatcgatgaagaaatgggcccaaagactgatagcacgctcagctttgatttgaccctccagcaaggatcacacaccaatatccacctgttggtgactacctacaatctgcgcgacgcgcctgcagaatcggtggcataccacgcgcagaataatccaccggtgcctccgaaaccacagcccaaggtgcaggaaaaggccgatatcccagtgaagagctcgccacaggcagcggtgccttacaagaaggatgtgggaaagactttgtgtcccctgtgcttctcgatccttaaaggtccaatcagcgacgccttggcacaccacctgcgggaacgccaccaagtgattcagactgtgcaccccgtggagaaaaaactgacctacaagtgcattcattgcctgggcgtgtacacctcaaacatgacggccagcaccatcaccctgcatctcgtgcattgcaggggcgtcggaaaaacccagaatggacaggataagactaatgcaccgtcccggttgaatcaatcaccatcgcttgctccagtgaagcggacctacgagcagatggaatttcctctgctgaagaagcggaagctggatgatgatagcgactctcctagcttcttcgaggagaaaccggaagaacccgtcgtgctggccctcgatccaaagggtcatgaagatgactcctacgaagcccgcaagtcctttctgaccaagtatttcaacaagcaaccatacccgacgcgccgggagatcgagaagctggctgccagcctctggttgtggaaatccgatatcgcctcccacttctcaaataagagaaaaaagtgcgtgagggactgcgagaagtacaagcctggtgtccttctcggattcaatatgaaggaactcaataaggtgaagcacgagatggatttcgacgctgagtggctgttcgaaaatcacgatgagaaagactcgcgggtgaacgcctccaagaccgcggacaagaagctcaacctcggaaaagaggacgactcgagctccgacagcttcgaaaacctcgaagaggagtccaacgagtcgggttctcctttcgaccctgtttttgaagtcgaaccgaaaatctcaaacgataatccagaggaacacgtgctcaaggtcatcccggaggacgcatcggaaagcgaggaaaagctggaccaaaaggaggacggctcaaagtacgaaaccatccatctgaccgaagagccgactaagctcatgcataatgcttccgactcagaggtcgaccaagacgacgtggtggagtggaaagatggagcctccccctcggaatctggacctggctcgcagcaggtgtcggatttcgaggacaacacctgtgagatgaagcccggcacctggtcggacgaaagcagccagtcggaagatgcccggagctccaagcccgccgcaaaaaagaaagcgactatgcaaggagatcgagagcaactgaagtggaagaactcgagctacgggaaggtggaagggttttggtctaaagaccagtcgcagtggaagaatgcctcagagaacgacgaacggctgtccaacccgcaaatcgagtggcaaaattcgactatcgatagcgaagatggggaacaattcgacaacatgactgacggagtggccgaaccaatgcatggttccctggcgggagtgaagctgtcgtcccagcaagcc

SEQ ID NO: 5777 - DNA, 3306 bp, Artificial Sequence
  Description of Artificial Sequence: Synthetic coding sequence
atgttccaacttccagtgaataacttgggatcgctcaggaaagcccgaaaaaccgtgaagaagattcttagcgatatcggactcgagtactgtaaggagcatatcgaagatttcaaacagtttgaacccaatgatttctatctcaagaatactacttgggaagatgtgggtctttgggatccatcccttaccaaaaaccaggattatcgcactaagcctttttgctgcagcgcatgtccattctcatctaagtttttctcggcctacaagagccattttaggaacgtgcattccgaagatttcgaaaaccgcatcctgctgaattgcccatattgtacctttaacgctgacaaaaagactctggaaacccacattaagatttttcacgccccaaacgcaagcgccccttcaagctcactctccacttttaaggacaagaataagaatgacggattgaagccaaagcaggcagattcggtggaacaagccgtgtactactgcaaaaagtgtacctaccgggatccactgtacgaaatcgtgagaaagcatatctaccgggaacattttcagcatgttgcagccccctacattgcaaaggcaggtgagaagtcgctgaacggtgcagtccctctgggctcgaacgcaagagaggaatccagcatccattgtaagcgctgtttgtttatgccaaagtcctatgaggcacttgtccaacatgtcatcgaagatcatgaaaggataggataccaagtgacggcaatgatagggcataccaacgtggtggtaccccggagcaaaccccttatgctgattgcaccaaagccacaagacaagaaatcgatggggcttcctcccaggattggctcacttgcctcgggtaacgtgcgatcgctgcccagccaacaaatggttaaccgtcttagcatccccaagcctaatcttaattcaaccggagtcaacatgatgtcgtcagtacatcttcaacagaacaattatggggtaaagagcgtcggccaaggctatagtgtcggtcagtcgatgagacttggtcttggtggaaacgcacctgtgtcgatcccccagcagagccaatcggtgaaacagcttctgccttcgggtaatggaagatcttacggacttggttcggagcagcggagccaggctccggcacggtactccctccaatccgccaacgcatcaagcctctcctccggacaacttaaatccccctcgctctctcagtcgcaggcttcgcgtgtgctggggcaatcttcatccaaacctgccgcagcagcaactggtcccccgcccggtaacacgtcaagcactcagaagtggaagatctgcactatttgcaacgaactgtttccagaaaacgtgtactcggtccattttgaaaaggaacataaggcggagaaggtgccagcagtcgctaactacattatgaagatccataacttcacgtccaaatgcctgtactgtaataggtatcttccaactgataccctgctgaatcacatgctgatccacgggctcagctgtccatactgtcggtcgacttttaacgatgtggagaaaatggccgcacatatgagaatggtgcatatcgatgaggaaatgggtccaaagaccgattccaccctttcgtttgatctgactcttcagcaggggtcacatacgaacattcacctgcttgtgactacctacaacttgagggatgctcctgccgaatccgtggcataccatgcacagaacaatcctcccgttccaccgaagccacagccaaaggttcaagagaaggccgacatacccgtcaaatcttccccccaagccgccgtcccatacaagaaagacgtcggtaagaccctttgcccgctttgtttttccattctgaagggacctatttcggacgcactggcacaccaccttcgcgagcggcatcaggtgatacagactgtgcatcccgtcgagaagaaactgacgtacaaatgtattcattgtttgggagtctacactagcaacatgaccgcatcaaccattaccctccacctcgtccattgtcggggagtgggtaaaacccaaaacggacaggacaagactaatgccccttcgcgcttgaaccaatcgcctagcctggcacctgtcaagagaacctatgagcaaatggaatttccactgcttaagaagagaaagctggatgacgactccgactcaccatccttctttgaagaaaagccagaggaacccgtggtgcttgcactggatccgaagggacatgaagatgatagctacgaggcacgcaagagctttctgaccaagtacttcaataagcaaccatacccaactagacgggaaattgagaaacttgcagcatcactgtggctttggaagtcagatatcgcgtcccatttctcaaacaagagaaagaagtgcgtgagagactgtgagaagtacaagcctggcgtcctccttggtttcaatatgaaagaacttaacaaagtgaaacatgagatggatttcgacgccgaatggctgttcgaaaaccacgacgagaaggatagcagagtgaatgcatcgaaaactgctgataagaagctcaaccttggaaaggaagatgattcctcatccgattcgtttgagaatctcgaagaggaatcgaacgaatcgggctccccgttcgatcctgtgtttgaagtggaaccaaagatctccaacgacaatccggaggaacatgtcctcaaagtcattccagaggatgcctcagaaagcgaagagaaacttgaccagaaagaggatggatccaagtacgaaaccattcacctgaccgaggaacctactaaacttatgcataacgcaagcgactcggaagtggaccaggacgatgtggtggagtggaaagatggagcatcgccttccgagtcgggaccgggcagccaacaagtgtccgattttgaagataatacttgcgaaatgaaacctggaacctggtctgatgaatcctcccaaagcgaagatgcccgctcctccaagccggcagccaagaaaaaggccactatgcaaggggaccgagaacaacttaagtggaaaaactcatcctacggtaaggtggaagggttctggtcgaaggatcaatcgcagtggaagaacgcctcggaaaacgatgagcgactgtccaatcctcaaatcgagtggcaaaattcgaccattgactcggaggatggcgaacagttcgataacatgaccgacggggtcgccgaaccaatgcatgggtccctggcaggagtgaaactttcgtcacaacaagct

SEQ ID NO: 5778 - DNA, 3306 bp, Artificial Sequence
  Description of Artificial Sequence: Synthetic coding sequence
atgtttcagctgccagtcaacaacttggggtctctaagaaaagcacgaaagaccgtcaagaagatcttgtctgacattggactagagtactgcaaagaacacatagaggacttcaagcagttcgaacctaacgacttttacctcaagaataccacgtgggaggacgtcggtctctgggatccatcgctcacaaagaatcaggactaccgcacaaagccgttctgctgctctgcatgtccattttcatctaagttcttttctgcttataagagccactttcgcaacgtccatagtgaggattttgaaaaccggatcttgctaaattgtccatactgtacctttaatgccgataagaagaccctcgagacacacattaaaattttccacgctcccaatgcctccgcaccatcttcatccctctccaccttcaaagacaagaacaagaatgacggcctgaagccaaaacaggccgactctgtggagcaagccgtgtattactgcaagaaatgtacgtaccgtgacccactgtacgaaattgtacggaaacacatttacagagagcattttcagcacgtggccgctccttacattgccaaagccggagaaaagtcccttaacggtgctgtacccctgggatctaatgcccgcgaggaatcttccatccactgcaagcgttgtctcttcatgccaaaatcatatgaggccctggttcagcatgtgatagaagatcacgaacgtatcggatatcaggtcaccgcgatgattgggcacactaacgtagttgtgccaaggagtaaaccactgatgctgattgctcccaaaccacaggataagaagagcatgggcttaccaccccgcatcggctcactggcatccggcaatgtccggtctcttccctctcagcagatggtaaataggctctccatccctaagccaaacctgaatagtacaggagtgaacatgatgagctctgtacatctgcagcaaaacaactacggggtcaagagtgtgggccaaggttactcagtgggacagagtatgcgcctggggctgggtggaaatgccccggtgagcatcccccaacaaagtcaatcagtgaagcagctcctaccttcaggtaacggtcggtcttatggccttggtagtgaacagaggtctcaggcgcctgcccgatactcccttcagtctgctaacgcctcaagtcttagttctggccaactgaagtccccatcccttagtcagtcccaggctagtcgagtcttgggacagagcagtagcaagccagccgcagccgccaccggaccccccccgggtaatacctcttcaacccagaagtggaagatttgcacaatctgtaatgaattgtttccagaaaatgtatactcggtacactttgagaaagaacacaaagcagagaaagtgccggccgtcgccaactacattatgaaaattcataacttcactagtaagtgtctctactgcaatcggtatctgcccactgatacactcctcaatcatatgcttatccacgggctgtcttgcccatactgtcggtccaccttcaacgacgtggaaaagatggccgctcacatgcgcatggtgcacatcgacgaagagatgggacccaaaacggactccaccctaagctttgacctaactctacagcaggggtcccacactaatatccacctccttgttaccacttataatttgcgtgacgcaccagctgaaagcgtggcctaccacgcgcagaacaatcctccggtgcccccgaagccgcagccaaaagttcaggagaaagctgacatccctgtgaagtcctcccctcaggctgcagtgccctacaaaaaagatgtgggtaagaccttatgtcccctgtgcttttcaatcctaaaggggcctatcagcgatgcacttgcccatcatctgagagagagacatcaagtgattcaaacggtgcaccctgtggagaaaaagctcacttacaagtgcatccactgtctgggagtgtacacatctaatatgacagcgtctaccattaccctccatctggtgcactgccgcggcgtcggaaaaacacagaatggacaggacaaaactaatgctccctcaagactgaaccaaagcccttctttagccccggtaaaacgaacctacgagcagatggagttcccactgctgaaaaagcgcaagctcgatgatgatagtgactcccccagttttttcgaggagaagcccgaggaaccagttgtgctcgctctagacccaaagggtcacgaagatgattcttatgaggctcgtaaaagtttcctgacaaagtacttcaacaagcagccgtacccgacacggcgcgaaattgagaagctcgccgcttcgctgtggctctggaaaagtgatatcgctagccacttttctaataaacgaaagaagtgcgtaagagactgtgaaaagtacaagcctggggtgctcctggggttcaacatgaaagaacttaacaaagtgaaacacgagatggacttcgacgcagaatggttgttcgagaatcatgatgagaaagatagtcgtgtgaatgctagcaagacagctgataagaaactgaacctaggtaaggaagacgattcatcctccgattcattcgagaacctggaggaggagagcaacgagtccggaagcccttttgaccccgtgttcgaagtggagcctaagatatcaaacgacaaccccgaagaacatgtcctcaaggtaatacccgaagatgcttcagaatcagaagagaagttagaccaaaaggaggatggcagcaaatatgagactatccatttaactgaggaacccaccaaactgatgcataatgcttccgactccgaggtagaccaggacgatgtggtcgagtggaaagatggcgcaagtcctagcgaatcgggtccaggaagccaacaggtgtctgacttcgaggacaacacatgcgagatgaagcctgggacttggagtgacgagagcagccagtccgaggatgccaggagtagtaaacccgccgcaaagaagaaagctactatgcagggggatcgggagcagctgaagtggaaaaacagttcttacgggaaagtggaaggcttttggagtaaggatcagagccagtggaaaaatgcaagcgagaacgacgagaggttgtcaaacccacagatcgaatggcagaacagcaccatagatagcgaggacggggagcagtttgataatatgacggacggggtggctgagcctatgcatggatctctggccggcgtcaaattaagttcccagcaggca

SEQ ID NO: 5779 - DNA, 3306 bp, Artificial Sequence
  Description of Artificial Sequence: Synthetic coding sequence
atgttccaacttcccgtgaacaacctgggctccctgcggaaagcccggaaaactgtgaagaagatactttctgatatcggcctggagtactgtaaggagcatattgaggactttaaacaattcgaacccaacgatttctatttgaaaaatactacttgggaggatgttggactgtgggatccatcacttacaaagaatcaggactacagaacgaaaccgttctgctgctcggcatgtccgttctcatccaagtttttctccgcctacaagtcccattttcgcaacgtgcacagtgaagactttgagaacaggatcctccttaactgcccatattgcacattcaatgctgataagaagaccctggaaacacacataaagatctttcatgctcccaatgctagtgccccttcttctagcctctcaacattcaaggataagaataaaaatgacggactgaaaccaaaacaggctgactccgtggagcaagcagtgtactactgtaaaaaatgcacctatagagatccattgtacgaaatcgtgagaaaacatatttatcgggagcacttccagcatgtggcagccccctacatcgctaaggccggcgagaagtctctcaacggggcagttcctctgggctccaatgcccgcgaagaaagctccattcattgtaagcggtgcctattcatgcctaaaagttatgaggctctggtgcagcacgtgatagaggatcacgaacgaatagggtaccaagttactgctatgataggacacactaatgtggtcgttccacgcagcaagcctctcatgttgatcgctccaaaaccccaggacaaaaaaagcatgggcctccccccaaggatcgggtccctggcttccgggaacgtacgttctctgccctcccagcagatggtaaatcggctgtctatccccaaaccaaacttaaacagtacgggcgtgaatatgatgagttcagttcatcttcagcagaacaactacggcgttaagtcggtcggccaaggatattccgtgggccagagcatgcggcttggcctcggcggcaatgcaccagtttccattcctcaacagtctcaatctgttaaacagttactgccctccggcaacggaaggtcctacggactgggcagtgaacagaggtcacaggctcccgccaggtattccctgcaaagcgctaacgcttccagcttatcatcaggtcagctgaaatctccctccctctctcaatcccaggcgtcccgcgtgctcggacagagctcttccaagcctgctgcagccgccaccggtcctcccccggggaatactagttcaactcagaagtggaaaatctgtacgatatgcaatgaactttttcccgaaaacgtctactcagtgcactttgagaaagagcataaagctgaaaaggtgccggctgttgcaaattacatcatgaagattcacaactttacctctaagtgcctttattgtaataggtaccttccaacagatacgttgctgaatcacatgctgatccacgggctctcttgcccttactgtagatctacattcaacgacgtggagaagatggctgctcacatgcggatggtgcacatcgatgaggaaatgggacccaaaaccgattcgacattatcattcgatcttaccctacagcagggtagccacaccaacattcacctgttggtaacgacgtataacctgcgcgacgctccagccgaaagcgtggcttaccacgctcagaataacccgccagtaccacccaagccccaaccaaaagtccaggagaaagcagatatccctgtgaagtccagccctcaagccgcagttccctataaaaaagatgtggggaaaaccctgtgcccactgtgttttagtattctcaagggccctatctccgatgccctggcacaccatctccgggagaggcatcaagtcatccaaaccgtgcatccagttgagaagaagttgacgtataaatgcatccactgtttgggagtatatacatccaatatgacagcaagtacaattaccctccatttagttcactgtcggggtgttggaaaaacgcagaacgggcaggataagacgaacgctccgtctcgcctgaatcagtctccaagtctagcgcccgtgaagcggacttatgaacagatggagtttcctctcctgaagaagcgaaagctcgacgatgacagcgacagcccctccttttttgaagagaagcccgaggaaccagtagttctggcactcgaccccaagggtcacgaggacgatagctacgaagccagaaagtctttcttaaccaagtactttaacaaacagccataccccaccagaagggagattgagaagctggccgcgtctctgtggctttggaagagcgacatcgcttcccatttttcgaacaagcggaaaaaatgtgtccgcgactgtgagaagtacaagcccggcgtgctgctcggcttcaatatgaaagagctgaataaagttaaacacgaaatggacttcgacgcagaatggttgttcgaaaatcatgatgagaaagactcgagagttaatgccagtaagacagcagacaagaaactaaacctaggtaaggaagacgacagtagtagtgactcatttgagaacctcgaagaggagagcaacgaaagtggtagcccctttgacccagtattcgaagtcgaaccaaaaatctccaatgataaccctgaagagcacgtcttgaaggtcatccctgaggacgcttcggagtccgaagagaaactcgaccagaaggaggatggaagcaagtacgaaactatccatctcacagaggaacctaccaaactcatgcacaatgccagcgactccgaggtggaccaggacgacgtggtcgaatggaaggacggggcctccccatccgagagtggacctgggagtcagcaagtctccgacttcgaggacaatacctgcgagatgaaacccggcacttggagcgatgaatcttctcagtccgaagacgcaaggtcaagcaagcctgctgcgaaaaagaaggctaccatgcagggtgaccgggaacagctgaaatggaagaactcatcttatggaaaggtcgaggggttttggtccaaggatcagtcgcaatggaagaatgccagcgagaatgacgaacgtctgtcaaatcctcaaatagaatggcagaacagtaccatcgattcggaagatggggagcaattcgataacatgactgacggagtagcagaaccgatgcacggatcactagccggtgtaaagctttcctcccagcaggca

SEQ ID NO: 5780 - DNA, 3306 bp, Artificial Sequence
  Description of Artificial Sequence: Synthetic coding sequence
atgttccaattgcccgtgaacaatctgggcagtttgcgcaaggctcggaagaccgtgaaaaagattctctctgatataggactggagtactgtaaggagcatatcgaagattttaagcaatttgagcccaatgatttttacctgaagaacacaacgtgggaggacgttgggctgtgggacccgtccttgacaaaaaatcaggactacaggactaagcccttctgctgcagtgcatgtcctttcagttctaaatttttcagtgcttataaatcacactttagaaacgtccacagtgaggatttcgaaaacagaattctgttgaactgtccctattgtacgttcaacgccgataaaaagaccttggagacacatattaaaatctttcacgcgcctaacgcaagcgccccttcaagtagcctctccaccttcaaagataaaaataagaacgatggcttgaagccaaaacaggcggattccgtggagcaagccgtgtactattgtaagaagtgcacctacagggatcccctctatgagatcgtgaggaaacacatttacagagaacattttcaacacgtggccgcaccttatatcgccaaagccggtgagaagagcttgaacggcgccgtccctctgggctctaacgcccgggaggagagcagcatacactgcaaaaggtgcttgtttatgccaaaaagttacgaagcgctggtgcagcacgtcatagaggaccatgagcggataggatatcaggtgactgccatgatcggacacactaatgtcgtggttcccaggtctaagccactcatgcttatcgctccgaaaccacaggataaaaaatcaatgggtctcccccctcgaatcgggagtctggcttccggcaatgttaggtcactgccctcacagcagatggtaaatcggttgtccatccccaaaccaaacctgaacagtacaggggtcaacatgatgagctcagtgcatcttcagcaaaacaattacggcgtgaagagtgttggccaaggatactccgttgggcagtccatgcgcctcggcctcggcgggaacgccccagtttccatcccacagcagtcccaatctgtgaaacagctgcttccttccggcaatggtagatcatacggccttgggtccgagcagaggtcccaggcccccgcacggtatagtctgcaaagcgccaatgccagcagcttgtcttcaggccagcttaagagcccttccctgagccaatcccaggccagccgagtcctcgggcagtcctcttcaaagccggccgccgcagcgactggccccccccctggaaatacctctagcactcagaagtggaagatctgcaccatctgtaacgaactctttcctgagaacgtttacagtgtacatttcgaaaaggagcacaaagctgaaaaagttccggccgtagccaactacattatgaaaattcacaattttacaagtaaatgcctctattgcaaccgctacctccccaccgatacactccttaatcacatgctgattcacggactgagctgcccctactgtcgatctacattcaacgatgtcgaaaagatggccgcgcacatgagaatggtgcacatcgatgaagagatgggtcctaaaaccgactctaccctgtcctttgatctgaccctgcagcaggggagccacacgaacatccatctcctggtgacgacgtacaatcttagagacgccccagcagaaagcgtagcctatcatgcccaaaataacccccccgtcccaccgaaaccacagccaaaagtgcaggagaaagcggatataccagtgaagtccagcccacaggccgcagttccttataaaaaggatgttggaaagacgctctgtcccctgtgcttctccatcctgaagggccccatcagtgacgcccttgcgcatcacctgagggagagacaccaggttatccaaaccgtgcatccggtggagaaaaaattgacctacaaatgcattcactgtctgggcgtttacacaagcaatatgactgcaagcaccattaccttgcatcttgtgcactgcagaggtgttggaaagacccagaacggtcaggataaaactaacgcccccagccggctgaaccagtcaccctcactggctcctgtaaagcgcacctatgagcagatggagtttccgttgctgaagaagcgaaaattggatgacgattccgactcaccttccttctttgaggagaagcccgaagaaccggtagtgctcgctctggacccaaaagggcacgaggacgacagttacgaggcccgaaaaagttttctgactaagtatttcaataagcagccgtatccgacacggcgcgagatcgaaaagctggcagccagtctgtggctttggaaatccgacattgcctcccactttagtaacaaacggaagaagtgtgtgcgagactgcgagaaatacaaacctggggtgctcctcggattcaacatgaaggagctcaacaaggtgaagcacgagatggactttgacgccgaatggctgtttgagaaccacgacgagaaagacagccgggtgaacgcgtctaagaccgcggataagaaactgaacctggggaaagaggacgactcaagcagtgacagttttgagaatctggaggaggaaagtaatgaatcaggatcccccttcgacccagtgtttgaggtggaaccaaaaatttcaaacgacaaccctgaggagcacgtgctgaaagtgatcccagaggatgcctctgaaagcgaggaaaagttggaccagaaagaagacgggtccaagtacgaaactattcacctgacagaggaaccaacgaaactcatgcataatgcttccgactctgaggtggatcaggatgacgtggtggagtggaaagacggcgcaagccccagcgagtccggcccgggcagtcagcaggtctccgacttcgaggataatacttgcgaaatgaaaccgggcacttggtccgatgagtcttctcaatcagaggacgccagatcctcaaaaccagccgctaaaaaaaaggccacaatgcagggtgatagagagcaattgaagtggaagaacagcagttatggaaaagtggagggtttttggtccaaggaccagtcccagtggaagaatgcatccgagaacgatgaacgcctctccaacccccagattgagtggcagaactccacaatagatagtgaggatggtgaacagtttgacaatatgaccgacggcgtcgccgaaccaatgcacgggtccctggctggtgtaaaactctctagccagcaggct

SEQ ID NO: 5781 - DNA, 1092 bp, Artificial Sequence
  Description of Artificial Sequence: Synthetic coding sequence
atgccttatcagtaccccgcattgacaccggaacagaaaaaagagttgagtgatattgcccaccgcatagtggcacccggcaagggaattctcgccgcagacgaaagtactggcagcattgccaaaagattgcagagcattggaaccgagaacaccgaggagaatcgacggttttacagacagcttctccttaccgccgacgacagagtgaatccatgtattggcggggtgatcctcttccatgaaactttgtatcagaaagccgatgatgggcgaccattcccacaggtgattaaatctaagggaggggttgtcggaatcaaggtggataagggggtggtgccattagctggtacaaatggagagacaaccactcagggattggacgggctaagcgagcgttgtgcccaatataaaaaggacggcgccgatttcgcaaaatggagatgtgttctcaagattggagagcacaccccatcggccctggcgatcatggaaaatgccaacgtgctggcacggtacgcctcaatttgccaacagaacggtattgtccccatcgtggaaccagagatcttgccagacggggaccatgacctcaaaaggtgccagtacgtcactgagaaggtgctggccgcagtgtacaaagccttgagtgaccaccatatttacctcgaggggacgcttctgaagcccaacatggtgactcccggacacgcctgtacacaaaagttctctcacgaagagatcgctatggcaactgtaacggccctcagacgcacagtccctcctgctgtaactggtataacgtttctaagcggcggccagagcgaagaagaggcttctattaacttgaacgcaattaataaatgtccacttttgaagccctgggccctcaccttctcctatgggagggcgcttcaggcttctgcactgaaggcctggggcggtaagaaggagaacctgaaggccgcccaagaagaatatgtcaagagagcactggcaaattctctcgcgtgtcagggcaagtatactccctctgggcaagccggagccgctgcgtctgagtctctgtttgtgagcaatcacgcttat

SEQ ID NO: 5782 - DNA, 1092 bp, Artificial Sequence
  Description of Artificial Sequence: Synthetic coding sequence
atgccttaccagtaccctgcccttacaccggagcagaaaaaggagttgtccgatatcgcccaccgaatcgtcgctcccggcaaaggcatccttgccgccgatgagtccacaggatcgatagcgaagcgtctccagtcgatcggcaccgagaacaccgaagagaataggcggttctatcgtcagctcctgctcaccgcagatgaccgcgtcaacccttgtattggaggcgtcatcctatttcatgaaacgttgtaccaaaaggccgatgacggtcgtccattccctcaggtgataaaatccaaggggggagttgttggtatcaaggtcgataagggggtggtcccgctggccggtaccaacggtgagacgaccacccaggggctggacggcctgtccgagcggtgtgctcagtacaagaaggatggggcggacttcgcgaagtggcggtgtgttctcaagatcggagagcatactccttccgcgttggcgatcatggagaatgccaatgttctcgctcgctatgcctccatatgtcagcaaaatggcattgtgcccattgtggagccagaaattctgcctgacggtgatcatgaccttaaaaggtgtcagtacgtaaccgaaaaagttttggctgcagtttataaggcactatctgaccatcacatttacctagaggggacactactgaagcctaacatggtgactcctggccacgcatgtacacaaaaattctcccatgaggagatcgctatggccacagtgacggccttgcgccgtaccgtcccgcctgctgtgactggcatcaccttcctgtccggtggccagagtgaggaagaagccagtatcaacctcaatgccattaataaatgcccactgttgaaaccatgggcgcttactttttcctacggacgcgccctccaagcgtctgcgcttaaagcatggggcgggaagaaggaaaatctaaaagctgcccaagaagaatatgttaagcgggctctagcaaacagtttggcatgtcaagggaagtacactccgagcggtcaggcaggcgcggccgcctcggagtcgttgtttgtctcaaatcacgcatat

SEQ ID NO: 5783 - DNA, 1092 bp, Artificial Sequence
  Description of Artificial Sequence: Synthetic coding sequence
atgccgtatcaatatccagcgctgactccagagcaaaagaaagagctctcggatatcgcccaccggatcgtggcccctggaaagggaatcctcgctgctgatgagtccacgggatccatcgccaaacggctccagtccattggaactgaaaacacggaggagaatcgccggttctaccgccaactgctgctgaccgcggatgatcgggtcaatccttgcatcgggggagtgatcctgttccatgaaaccctctaccaaaaggcagatgacggtagaccgttcccgcaagtgatcaagagcaaggggggagtggtcggcatcaaggtcgataaaggagtggtcccgttggcaggcaccaacggggaaaccactactcaagggctcgatggactgtcggagcgctgtgcccaatacaagaaggacggggctgactttgctaagtggcggtgtgtgctgaagatcggcgaacacaccccctccgctctggcaatcatggaaaatgccaatgtgctggcccgctatgcttcgatctgccagcagaacggaatcgtgccaattgtcgaaccggaaatcctcccagacggggatcatgacctgaagagatgccagtacgtcaccgagaaggtccttgcggccgtctacaaagctctgtcggaccatcatatctaccttgagggcacccttttgaagccaaacatggtgacccccggccacgcgtgcacccagaagttctcacatgaagaaatcgctatggccaccgtcactgcactgcgccggactgtcccgccagcggtgactggaatcaccttcctgtccggcggccaatcggaggaagaagccagcataaatctgaatgctatcaacaagtgtccgctgctgaagccctgggcactgacttttagctacggacgggccctgcaggccagtgccctgaaagcgtggggtgggaaaaaggagaacttgaaggctgctcaggaggagtacgtgaagcgcgccttggccaactcccttgcatgtcagggaaagtacaccccgagcgggcaggccggagccgcggcaagcgaatcactgtttgtgagcaaccacgcatac

SEQ ID NO: 5784 - DNA, 1092 bp, Artificial Sequence
  Description of Artificial Sequence: Synthetic coding sequence
atgccctaccaataccccgctcttaccccagagcagaagaaggaactcagtgatatcgcccatcggattgtcgccccaggtaaagggatccttgccgctgacgagtccactgggtccatcgctaagaggttgcagagcattgggacagagaataccgaggagaaccggcggttttacagacagctcctgctaaccgctgatgacagagtgaacccgtgcattggaggggtcatcctgttccacgaaactctgtatcagaaggccgacgacggcaggccctttcctcaggtcataaaaagcaagggtggggtcgttggcatcaaggtggataaaggagtagttcccttagccgggacgaacggtgaaacaaccactcagggactggacgggctgtcagaacgctgcgcgcagtacaaaaaagatggagctgactttgctaagtggagatgcgtgctaaaaatcggtgagcacaccccaagtgctttggccataatggagaacgccaatgtactggctcgatatgcatccatttgccagcaaaacggcatcgtgcctatcgtggaacctgagattctgcctgacggggaccatgaccttaaaagatgtcaatacgtgactgaaaaggtgctggcggcagtctacaaggccttgtctgatcaccatatctatctggagggcaccctcctcaaacccaacatggtgactccaggccacgcgtgtacacagaaattctctcatgaagagattgccatggcaacagtcactgccctgcggcggactgtgccgcctgcggtgaccgggataacctttctctctggcgggcaatcagaagaggaagcaagcatcaatctgaatgcaatcaacaaatgtccactgcttaagccctgggctctaacgtttagctatggtcgagccctccaggcaagtgcactcaaagcgtggggtgggaagaaggaaaatctgaaggccgcacaggaagaatatgtgaagagggcgctagccaacagcctcgcctgccaaggaaagtacactccaagtggccaggccggcgccgccgcatcagaaagcctattcgtgtctaaccacgcatac

SEQ ID NO: 5785 - DNA, 1092 bp, Artificial Sequence
  Description of Artificial Sequence: Synthetic coding sequence
atgccttatcagtaccccgctctcactccagagcagaaaaaagagctttccgacatcgcacaccgcattgtggctccaggcaaaggcatcctggcagccgacgagagcacggggtcaatcgcgaagaggttacaaagtattggtacagagaataccgaggaaaacagacgcttttacagacagctgttactcaccgccgacgaccgcgttaacccatgcatcggaggcgtgatcttgttccacgaaactctgtaccagaaggccgacgacggacgacccttcccccaagtcattaaatccaaaggcggagtggttggtataaaggttgacaagggggtcgttccactggctggcaccaatggcgagacaaccactcagggtctcgatgggcttagcgagagatgcgctcagtataagaaggatggcgctgatttcgccaaatggcggtgcgtgctaaagatcggggaacacacaccttcagcactcgccatcatggagaacgctaacgtgctagcccgttacgcctccatctgtcaacagaacggaattgtccctattgtagaaccagagattctgcctgatggcgaccacgatctgaagagatgccagtacgtcacggaaaaagtgttggcagccgtgtacaaggcgctctccgaccaccacatataccttgaagggacgctgctgaaaccaaacatggtgacccccggccatgcctgtacacagaaattctctcacgaggaaattgccatggctacagtgacagccctcaggagaactgtaccacctgcagtaacaggcatcacatttctttctggcggccaatctgaagaggaggcctccataaacctcaacgccatcaacaagtgccccctgcttaaaccatgggccctaacattcagctacggacgggccttgcaagcgtcggccttaaaggcctgggggggcaaaaaagagaatctgaaagccgcgcaggaggagtatgtgaaaagggccctggctaactccctagcctgccagggaaaatacacgccttctggtcaggccggcgcggctgcctccgaaagtctgtttgtttccaaccacgcctac

SEQ ID NO: 5786 - DNA, 1092 bp, Artificial Sequence
  Description of Artificial Sequence: Synthetic coding sequence
atgccttaccagtaccccgccctgacaccggagcagaagaaggaactgagcgatattgcccaccggattgttgccccgggcaaggggatattagctgccgacgagtctacagggagcattgcaaagaggctgcaaagtatcggtacagaaaataccgaggaaaatcgcaggttttaccgacagctgctgcttactgcagatgatcgtgttaacccatgtattggaggggtgattctgttccacgagacgctataccagaaggcggacgatgggaggccattcccccaggtcatcaagtcaaaaggaggtgtggtagggatcaaggtagataagggtgtggttcctctggctggaaccaacggggagaccactactcaagggttggacggcctgagcgagagatgcgcacagtataaaaaggatggagcagactttgccaaatggaggtgcgtgctgaagattggagagcacactccgtccgcattggccatcatggaaaacgcgaatgtcttagccagatacgcctccatctgtcagcagaatggtatcgtgccaatagtggagccagagatcttgccagacggcgatcatgatttaaagcgctgtcagtacgttacagagaaggtgctggcagctgtgtataaggccctctcagatcaccacatttatctggaggggaccctactgaaacccaatatggtcactcccgggcacgcatgcactcagaaattcagtcacgaggaaattgctatggcgacagtgaccgctctcagacgcaccgtgccacccgcagtgactggcatcaccttcttgtccggcggacagagtgaagaagaggcttccattaatctgaatgccattaataagtgcccactgctgaaaccctgggcgctcactttcagctatgggagggcgctgcaggcatctgcactcaaggcatggggaggaaagaaggaaaacctgaaggccgcccaagaggagtatgtgaagcgagccctggccaatagcctcgcctgccaaggcaagtatactcctagtgggcaagctggggctgctgcatccgagtccctgtttgtgtctaatcatgcttac

SEQ ID NO: 5787 - DNA, 1092 bp, Artificial Sequence
  Description of Artificial Sequence: Synthetic coding sequence
atgccgtatcaatatcctgccctcactccagaacagaagaaagagctgtctgacattgctcatcggatcgttgctccaggcaagggtatcctcgccgctgatgaaagcacagggagtatcgcaaagcgattgcagagcatcggtactgagaacaccgaagaaaatagacgattctaccgacagctgctgctgaccgccgatgatcgagtaaatccttgcatagggggggtcatattgttccatgagacactgtatcagaaggccgacgacgggagacccttcccacaagtcataaaatcaaaaggaggtgtcgtggggattaaggtggataagggggttgttcctctggccgggaccaacggtgagactaccacccaagggctggacgggctgagcgagagatgcgcacagtacaagaaagacggcgcagactttgcgaagtggcgatgtgtactgaagatcggcgaacacaccccaagcgccctggcaatcatggagaacgcaaatgtgcttgctcgctacgctagtatatgccagcaaaacggtatcgtcccgattgtggagcctgagatactgccagacggagaccacgacctgaagagatgtcaatacgtgaccgagaaagtgctcgccgctgtgtataaggcactgtctgatcaccatatctatctcgaagggaccttgcttaaaccaaatatggtgactccagggcatgcttgtacgcagaaattttcacacgaggaaatcgctatggccacagtcaccgccctgcggaggaccgtgcctcctgccgtgacaggaataacattcctgtcaggggggcagtccgaggaggaggcaagcataaatctgaatgcaataaacaagtgccctttgctgaaaccatgggccctgaccttctcttacggacgcgctctgcaagcctcagccttgaaggcctggggtgggaaaaaagagaacctgaaggcagcccaggaggagtacgtgaaaagagcactggccaactctttggcgtgccaaggaaaatacacgcctagcggccaggcaggcgccgccgcttccgagtctctctttgtgagtaaccatgcctat

SEQ ID NO: 5788 - DNA, 1092 bp, Artificial Sequence
  Description of Artificial Sequence: Synthetic coding sequence
atgccctaccagtatccagcattgactcctgaacaaaagaaagagctctccgacatagcacacagaattgtggcgccaggtaagggtattctggccgccgatgagtccaccggctcgatagcaaaacggctgcaatcgatcggcaccgaaaataccgaagaaaaccggagattctaccgtcaactgcttcttaccgctgatgatagggtgaatccatgtatcggtggagtcattctcttccatgaaaccctctaccaaaaggccgatgatggtcgcccatttcctcaagtgattaagtcaaaggggggtgtggtcgggatcaaagtggacaagggtgtggttccgctggcaggtaccaacggagaaactaccacccagggcctcgatggtctgtcggagaggtgcgcgcagtacaagaaagatggcgcggactttgcaaaatggcggtgtgtgttgaaaattggggaacatactccttctgcacttgcaataatggagaatgcgaacgtcctcgctcgttacgcctccatttgccagcagaatggtattgtgcctatcgtggaaccggaaattcttcccgacggtgaccatgatcttaagagatgccaatacgtgactgagaaggtcctggcggcagtctacaaggcgctttcggatcaccatatctacctcgaggggactcttctgaagcctaacatggtgacccccgggcatgcgtgtacccaaaagtttagccatgaagagatagctatggcaacggtgactgcacttcgtaggactgtgccgccagctgtcaccggtataacctttctgagcggcggacaatccgaagaagaagcctcaatcaatctgaatgcaatcaataagtgtccccttctgaagccctgggccctgacgttttcctacgggcgcgcactgcaagcgtcagcactcaaggcatggggaggaaaaaaggaaaacctcaaggcagcgcaggaagaatacgtcaagcgggcattggcaaactcactcgcctgtcaaggcaagtacacccccagcggacaggcaggagcggcggcatcggaatcactgttcgtgagcaatcacgcttac

SEQ ID NO: 5789 - DNA, 1092 bp, Artificial Sequence
  Description of Artificial Sequence: Synthetic coding sequence
atgccctaccagtacccagccctgactcctgaacagaaaaaggaactctccgatattgcccataggatagtggccccaggcaagggcatcttagctgcagatgagtctactggctccatcgctaaaaggctgcagagcatcgggaccgagaacactgaagagaatagacggttttatcggcagttactgttaacagcggatgaccgtgttaatccctgtatcggtggagtgatactttttcatgaaacactgtatcaaaaagccgatgatggccgtcctttcccgcaggtgataaaatctaaaggcggcgtggtgggcattaaagtcgacaaaggggtcgtgcccctggccggcaccaacggagagactactacccagggactagatggtctgtcagagcggtgcgcccagtataaaaaggatggagcagacttcgctaagtggcgatgtgtactgaaaattggagaacacacaccaagtgcccttgccatcatggagaacgccaatgtgctggcccgctacgcttccatttgtcagcagaacggcatcgtcccgattgttgaacccgagatactgcctgacggggatcatgacttgaaaaggtgccaatacgtaacagagaaagtgctggccgctgtctacaaagctctttcagaccaccatatatacttggaagggaccctgctgaagccgaacatggtgactcctgggcatgcatgcacacaaaaattttcccatgaagagattgcaatggccacagttacggccctgaggcggactgtcccccccgctgtaaccggaattaccttcctgagtggcgggcaatccgaggaggaagcttccattaaccttaatgccatcaataagtgccccctactaaaaccatgggcacttacatttagctatggaagggcattgcaggcgagcgctctcaaagcatggggcggaaagaaggaaaacctgaaggctgcccaggaagagtatgtgaaaagggccttggccaacagcctggcttgccaaggaaagtacacaccctccggccaggccggtgccgctgcctcagagagtctgttcgtgagtaaccacgcatac

SEQ ID NO: 5790 - DNA, 1092 bp, Artificial Sequence
  Description of Artificial Sequence: Synthetic coding sequence
atgccgtaccagtaccccgctttaacacccgaacagaaaaaggaactctcagacatcgcacatcggattgtggcgcccggtaaggggatcctggctgccgacgagtccacaggcagcatcgctaaaagattgcaatctataggcactgagaataccgaagagaatcggaggttctaccgccagctcctcctgacagccgacgatcgtgtgaacccttgcattgggggcgttatcctgtttcacgaaactctttaccagaaagccgatgacggacgtccattcccacaggtaatcaagtcaaaaggcggagtcgttgggattaaagtcgacaaaggcgtagtaccactggctggtacgaatggtgagactacaactcaggggctggacggattgtccgagaggtgcgctcaatataagaaggacggcgccgacttcgcgaagtggcggtgtgtattgaagataggcgaacatacaccaagcgcactcgctatcatggagaacgcaaatgtgcttgcacggtacgcaagcatttgccagcagaacggcatcgtgcccattgtggagccagagatccttcccgacggagaccacgatctgaaaagatgtcagtatgttaccgagaaggttcttgcagcagtgtacaaagcactctccgaccaccatatctaccttgaggggaccctcctgaaaccaaacatggttacccctgggcacgcttgcactcagaaattttcacacgaggagatcgcgatggcgacagtgacggcactgcgccggactgttccgccagctgtgacaggaatcacctttttatccggcggtcaaagtgaggaggaggcgtccattaatctcaatgccattaataaatgtcccctgcttaaaccgtgggctctgacctttagctacgggcgcgcgctgcaggctagtgcccttaaggcctgggggggtaagaaagagaatctaaaggcagctcaagaggagtatgtaaagcgtgcgttggccaactccttggcttgtcagggcaaatacaccccgtctggtcaagcgggagccgcagccagcgagagcctcttcgtgtcgaaccacgcctac

SEQ ID NO: 5791 - DNA, 1092 bp, Artificial Sequence
  Description of Artificial Sequence: Synthetic coding sequence
atgccgtaccagtaccctgcactgactccggagcagaaaaaggaactgtccgacatagctcaccggatcgttgctccaggaaagggaatcctcgccgccgacgaatccactggcagcatcgccaaacgccttcagagtatcggaaccgagaacaccgaggaaaataggcgcttctatcgccagctgctgctcaccgcggacgatcgcgtcaacccttgcatcggcggtgtgatcctgtttcacgaaaccctttaccaaaaagctgacgatggccggccgttccctcaggtcatcaagtcgaagggtggcgtcgtgggaattaaggtggacaagggagtcgtcccactggctgggactaacggagaaaccactacccaaggactggacggcctgtcggaaaggtgcgcacaatacaagaaagatggcgccgattttgcaaagtggcggtgcgtgctgaagatcggagaacataccccgtcggccctcgcgatcatggagaacgcgaatgtgctcgcaagatacgcctcgatctgtcaacaaaatggtatcgtcccaattgtggaaccggaaatcctccctgatggcgatcacgacctgaagcggtgccagtacgtgacggaaaaagtgcttgccgcggtttacaaggccctgtccgaccaccatatctacttggaaggaaccctgctcaagccgaacatggtcaccccggggcacgcttgcacccagaaattctcccatgaggagatcgcgatggccactgtgacggcactccgaagaactgtgccacccgccgtgactgggatcaccttcctgtcaggaggacagtcagaagaggaggcctcaattaatttgaacgcaattaataagtgtccattgcttaagccctgggctctgactttcagctacgggagagcgctccaggctagcgccctcaaagcctggggagggaagaaggagaacctgaaagccgcacaggaggagtatgtgaagcgcgccctggcgaactcattggcctgccagggaaagtacactccgtcgggacaagcgggtgcagcggccagcgaatccctgttcgtgtctaaccatgcatac

SEQ ID NO: 5792 - DNA, 1092 bp, Artificial Sequence
  Description of Artificial Sequence: Synthetic coding sequence
atgccgtaccagtacccggccctgacccccgaacagaagaaggagctctcggatattgcgcacagaatcgtcgccccaggaaagggaatcctggcagccgacgagtcgacgggtagcatcgccaagcggctgcagagcatcggaactgaaaacacggaagagaacagacggttctaccgccaactcttgctcaccgccgacgatcgggtgaacccatgcataggtggagtgatcctgttccatgagactctttatcagaaggccgatgatggccgcccgtttcctcaggtcatcaaatcgaaggggggagtcgttggaatcaaggtggataagggagtggtgcccttggcaggaaccaacggcgaaaccactacccagggcctcgatggtctgtcagagagatgcgctcaatacaaaaaggacggcgcggacttcgcaaagtggcgctgcgtcttgaaaatcggggaacacactcctagcgcgctggctatcatggaaaatgccaacgtgctggcgcggtatgcctcgatctgccagcagaacggcatagtgcctatcgtggagcccgaaatcctcccggacggcgaccacgaccttaagcggtgccagtacgtgaccgagaaggtgctggcggcggtctacaaggccctttccgaccatcatatctacctggagggcactctgctgaagccgaatatggtgaccccgggtcatgcctgcacgcaaaagttcagccacgaagagatcgccatggctactgtgactgccctgcgccgcactgttccgccagccgtgactggcatcactttcctctcgggcgggcaatcagaagaggaggcgtcgatcaacctcaatgcgatcaacaaatgcccgctgttgaaaccttgggcactgaccttttcgtacggacgggcgctgcaggccagcgctctcaaggcctggggcgggaagaaagagaatctgaaggccgcgcaagaagaatacgtcaaacgcgcactggcaaactccctggcttgccagggcaagtacactccctcgggccaggcgggagcagcggcctcagagtcgctgtttgtttcgaatcatgcatac

SEQ ID NO: 5793 - DNA, 1092 bp, Artificial Sequence
  Description of Artificial Sequence: Synthetic coding sequence
atgccgtatcaatacccggcactgactcctgaacagaagaaggaactgtcggacatcgcccatcgcattgtggcaccgggcaagggaatcctcgcggcagacgaaagcaccggctccatcgccaagcggctccagtccatcggaactgagaacactgaagagaacagacgtttttaccgccagctcctgttgactgccgacgacagagtgaatccttgtatcggaggagtgatcctctttcatgagactctgtaccagaaggcggacgatggcaggcccttcccgcaagtcattaagagcaaggggggtgttgtgggaatcaaagtggataaaggagtggtgccgctggcgggtaccaacggagaaactactacccagggcctggatggactgagcgaacgctgcgctcaatacaaaaaggatggagccgacttcgcgaaatggcgctgtgttctcaaaatcggggaacatacgccttcggctctggccatcatggaaaatgccaatgtgcttgctagatacgcatcaatctgccaacagaacggtatcgtgccgatcgtggaaccagagatcctgccagatggagatcatgacctcaagaggtgccagtacgtcaccgagaaggtgctggctgccgtgtacaaagcgttgtccgaccatcacatttacctcgaaggaaccctgctgaaaccaaacatggtcaccccgggacacgcatgcacccaaaagttcagccatgaagagatcgcaatggccactgtgaccgcgttgagacgcaccgtgcctccggccgtgactggaattaccttcctcagcggagggcagtccgaggaagaagcctccatcaatctcaatgcgattaacaaatgtccgctgttgaagccttgggccttgactttctcgtacggacgggcgctgcaggccagcgcactgaaggcttggggaggaaagaaagagaacctgaaggcggcacaggaggagtacgtgaaacgggccctcgctaactccctggcctgtcagggaaagtacactccttcaggccaagcaggcgcggcagcctccgagagcctgttcgtttccaaccacgcttac

SEQ ID NO: 5794 - DNA, 1092 bp, Artificial Sequence
  Description of Artificial Sequence: Synthetic coding sequence
atgccataccaataccccgcactgacgcctgagcaaaagaaggaactttccgatattgcacaccgcatcgtggcaccaggaaagggcatcctggcagccgacgaatcgacgggctcaatagccaagcgacttcagagcattggaaccgagaacaccgaagaaaaccgaaggttctaccgccaactgctcttgactgccgacgatcgggttaatccttgtataggtggagtgatactctttcacgaaacgctgtaccaaaaggcggatgatggccgcccgttcccccaagtgattaagagcaagggcggtgtggtgggaataaaggtggataagggcgtcgtcccactggcgggtactaatggtgagactaccacccagggactggatggtcttagcgagagatgtgcccaatacaaaaaggatggcgcagacttcgccaaatggaggtgtgtgctcaagattggtgaacataccccttcggctctggcgattatggaaaacgcaaacgtccttgcaagatacgcaagcatttgtcaacaaaacggcatcgtccctattgtcgagccagagattcttcctgatggcgatcatgatttgaagagatgccagtacgtgactgagaaagtgctcgcagcggtgtacaaggcactctcggatcatcatatctacttggaaggaactctgctgaaacccaacatggtgacccctggtcatgcatgtactcagaagttttcgcatgaggagattgctatggccactgtcactgcactgaggagaaccgtccctcctgcggtgaccggcattacttttctttcgggtggacagtcagaagaagaggcgagcatcaatctcaatgcaataaacaaatgtcctctgctcaagccttgggctctcaccttctcgtacggcagagcactgcaagcatcggccctgaaagcgtggggaggaaagaaagaaaacctgaaggcggcgcaagaagaatacgtgaaacgggctctggcaaacagcctggcctgtcaggggaaatacaccccatcgggacaggcgggagccgcagcctccgaaagcctcttcgtgtcaaatcatgcttac

SEQ ID NO: 5795 - DNA, 1092 bp, Artificial Sequence
  Description of Artificial Sequence: Synthetic coding sequence
atgccgtaccaataccctgctcttactccggagcagaagaaggagttgtccgacattgctcataggattgttgcgcctggaaagggaatcctggcagccgatgaatccacggggtcgatcgcaaagaggctccaatccattgggacggaaaacactgaggaaaaccggagattctaccggcaacttcttcttaccgccgatgacagagtcaatccatgtattgggggcgtcattctttttcatgagactctgtaccagaaggccgacgacggacggccctttcctcaggtcattaagtcgaaagggggagtcgtgggtatcaaggtggataaaggcgtggtgcctctggccggaaccaatggagaaactactactcagggactcgatggtctgtccgaacggtgcgcacaatacaaaaaggacggagcagactttgcaaaatggcgatgcgtgcttaagattggtgagcataccccatcagccctggcaattatggaaaatgcgaacgtgctggcgagatatgcatccatttgccagcagaacgggattgtccccattgtcgagccagaaatactgcctgatggtgaccatgatctgaagcgatgtcagtacgtcaccgaaaaggtgctggcagcagtgtacaaggccctgtccgatcatcacatttacctcgaagggacccttcttaagcctaacatggtgacccccggacatgcatgtactcagaaattctcgcatgaagaaattgccatggccaccgtgaccgcgctgaggcgcaccgtgccacctgcagtcactggcataacgttcctgtcaggtggtcaatccgaggaagaagcatccattaaccttaatgccatcaacaagtgtcctcttctcaagccttgggctcttaccttttcgtatggacgtgcattgcaggcgtctgcactgaaggcctggggagggaaaaaggaaaaccttaaggcagcacaggaagaatacgtcaagcgtgcacttgcaaacagccttgcctgtcaaggcaagtacactccaagcgggcaggcgggcgctgccgcgtcagagtcgctctttgtctcaaatcacgcatat

SEQ ID NO: 5796 - DNA, 1092 bp, Artificial Sequence
  Description of Artificial Sequence: Synthetic coding sequence
atgccctaccaatacccggctctcactccggagcagaagaaagaactctcagatatcgcccacaggatcgtggcgccgggcaaaggaatcctcgccgctgacgaatcgaccggttctattgccaaacggcttcagtccatcggcactgagaacaccgaggaaaatcgccgattctaccggcagctcctgctcaccgctgacgatagagtaaacccttgcatcggaggcgtgatcctgtttcacgaaaccctgtaccagaaggcggatgacggtcgcccgttcccgcaggtcattaagtcgaaaggtggagtcgtgggcattaaggtggataagggcgtcgtgccgctggcaggtactaatggcgaaactaccacccagggactggacggactgagcgagagatgcgcacagtacaaaaaggacggtgctgacttcgccaagtggcggtgcgtgctgaagatcggcgaacacaccccgtcagccctcgcgatcatggaaaatgccaacgtgctggcgaggtacgcctcaatctgccagcaaaacggcattgtgccgatcgtggaacccgaaatcctgcctgacggagatcacgacctcaagagatgccaatatgtgaccgagaaggtgctggccgcagtgtacaaagccttgagcgatcatcacatttacctggagggaactctcctgaaaccgaacatggtgactcctggtcatgcctgtacgcagaagttttcacatgaggaaattgctatggcgaccgtgactgcgctccggcgcactgtgccacctgcagtgaccgggatcaccttcctgtcggggggtcaatccgaggaggaagcatccatcaatctgaacgcgatcaacaaatgtccgctgctgaagccgtgggcactgaccttctcctatggccgggccctgcaggcctccgccctcaaggcatggggcggaaagaaggagaatttgaaggcggcacaggaggaatatgtcaagagagccctggctaatagcctcgcctgccagggcaagtacacgccttccggacaggcaggtgccgccgcttccgaatcgctgttcgtctcaaaccacgcatat

SEQ ID NO: 5797 - DNA, 1092 bp, Artificial Sequence
  Description of Artificial Sequence: Synthetic coding sequence
atgccgtaccagtaccctgctctgactcctgagcagaaaaaggaattgagcgatattgcacacaggatagtggcaccgggcaaaggtattctcgcagcggacgaaagtactgggtcgattgctaagcgccttcagtccattggtacggaaaacaccgaggaaaacaggcgcttttacaggcagctcctgctgaccgcagacgatagagtgaacccatgtatcggaggagtgattctcttccatgaaactctgtatcaaaaggcggatgacggtcgtccttttcctcaagtgatcaaatccaagggcggagtcgtgggaatcaaggtggataaaggtgttgtgcccttggcagggactaacggagagactacgactcaagggctcgatggcctctccgaacggtgtgcacagtacaagaaggatggggcggattttgcaaagtggcgttgtgtactgaaaataggagagcatacgccaagcgcgctggccatcatggaaaacgccaacgtgttggccagatacgcatcgatatgccaacaaaacggcattgttccaattgttgaacctgagattttgccagatggtgaccacgaccttaagcggtgtcaatacgtcaccgaaaaggtgcttgcagctgtgtacaaggccctttccgaccatcacatctatctggagggcacccttctcaaacccaatatggtgactcctgggcatgcatgcacccagaagttcagccatgaggaaatagcaatggcaaccgtcactgcactcagaagaaccgtgccacccgcggtaactggaatcacttttctcagcggaggacaaagtgaagaagaggcttcgattaatcttaacgcaatcaataagtgccctttgttgaagccatgggcactgaccttctcctacggaagagcccttcaagcctcggcacttaaagcctggggtggcaagaaggaaaatcttaaagcagcacaagaggaatacgtcaagagggcccttgcgaattcacttgcatgtcagggtaagtataccccatcagggcaagcaggtgccgcagcttcggaatcactctttgtgtcgaaccatgcctac

SEQ ID NO: 5798 - DNA, 1092 bp, Artificial Sequence
  Description of Artificial Sequence: Synthetic coding sequence
atgccataccagtacccggcgctgacacctgagcagaagaaggagttgtccgacatagcacaccgcatagtggctccaggtaaaggaatcctcgccgcagatgaatctaccggctcaatcgctaagagactgcagagtataggaacagagaacaccgaagagaacaggagattctataggcagctgctcctgactgcagatgacagagtcaatccttgtataggaggtgtgatcctcttccacgagaccctgtaccaaaaagccgacgacggaagacctttcccacaagtgatcaagagtaagggtggagtggtcggcatcaaggtggacaagggagtagtcccactcgccggcaccaacggcgagaccaccacacagggcctggacggcctgtcagaaaggtgcgcgcagtacaagaaagatggagctgacttcgcaaaatggaggtgcgtgctgaaaattggagagcacactcctagcgcattggcaataatggagaatgctaatgtcctggcgaggtacgcgagcatatgccagcaaaacggtattgtgccaattgtggagccggaaattttgcctgacggcgaccatgacttgaaacgctgccagtatgtcactgagaaagtgctggcagctgtgtacaaggcactgtccgaccaccacatctacttggaaggaactctgctgaaacccaatatggtcacgccaggacatgcatgtacgcagaagttctcccatgaggaaatcgctatggccactgtcacagccctgcgccgcactgtccctcccgcggttactggtattaccttcctgtctggcggtcagtccgaagaggaggcgagcataaatctgaatgcgatcaataagtgccctcttctgaaaccatgggctcttactttctcatacggtagggctctccaagcaagtgccctgaaggcatggggtggcaagaaggagaacctgaaggcagcgcaagaagagtacgtgaaacgcgctctggcaaattctctggcgtgccagggcaagtatacgccatctggccaggcaggcgctgcagcttctgaatctctctttgtctccaaccatgcatac

SEQ ID NO: 5799 - DNA, 1092 bp, Artificial Sequence
  Description of Artificial Sequence: Synthetic coding sequence
atgccgtaccaatatccagcccttacccctgaacagaaaaaagagctttctgacattgcacaccgcattgtggcacccgggaaggggattctggccgctgacgaatcaacaggtagcatagcgaaaaggctccagagtattggaactgagaataccgaagaaaaccggagattttatcggcaactcctgttaaccgctgacgatagagtaaacccatgcattggcggcgtaatcctctttcatgaaactctgtatcagaaggctgatgacggccgtccgtttccccaggtgatcaaatctaagggcggcgtggtcggcatcaaagtggataagggcgtggtgccactcgccgggacaaatggggaaaccactacccaaggattggacggtctttctgagcgctgcgctcagtacaagaaagacggcgctgacttcgcaaagtggagatgcgtgctcaaaattggagagcatacaccatctgcactggcaatcatggaaaacgctaatgtcttggctcggtacgccagtatatgccaacagaacggaatcgtgccgatcgtcgagcccgaaatcctgcctgacggcgaccatgatctcaagcgatgccagtatgtgaccgagaaggtgctggctgcagtgtacaaggcactttcagaccaccacatctaccttgagggcacgctcctaaagcccaacatggtgacacctggacacgcgtgtacacagaagttctctcacgaagaaatcgctatggccacagtgaccgcactgagaaggacggtacctcctgcggttaccggcataaccttcctgagcggaggccaaagcgaagaagaagctagcatcaacctgaacgcaatcaacaaatgtccactgttgaaaccgtgggccttaacattttcctatgggcgcgccctgcaggctagcgctctgaaagcctggggcggaaaaaaggaaaacctcaaggccgctcaagaggaatacgtgaaacgcgctctggccaatagcctggcttgtcagggaaagtataccccttctggacaggctggggccgccgcttcggaaagccttttcgtgtcaaaccatgcctat

SEQ ID NO: 5800 - DNA, 1092 bp, Artificial Sequence
  Description of Artificial Sequence: Synthetic coding sequence
atgccatatcagtatcccgcgttgacaccggagcagaagaaagaactgtctgatatagcacaccgcatcgtggccccgggcaaagggattcttgctgccgacgagtctacagggagtattgcgaagaggctgcaatctatcggcactgagaacacagaagagaataggcggttttatagacagctcctgttgactgctgatgatagagtcaacccatgcattggcggcgtcatccttttccacgaaaccctttaccagaaggctgacgatggccgaccattcccccaagtaataaaatccaaaggcggggtagtcggcattaaggtggataaaggggttgttcccttggctggcacaaatggagagacaactacacaaggtctggatggcctgagtgagcggtgtgcccagtacaaaaaggatggggcagatttcgcaaagtggaggtgtgtcctcaaaatcggagagcatacaccgagcgccctggctatcatggagaacgccaacgtcctggctaggtatgcctcaatttgccagcagaatggtattgtaccaatcgtggagccggagattttgcccgacggcgaccacgacctgaaaagatgtcagtacgttactgaaaaggtgctcgctgctgtttataaagccttgagcgatcatcacatatacctcgaaggcacccttctgaagccgaatatggtgacgcctggccatgcatgtactcaaaaattcagccacgaggagatcgccatggcgactgtgaccgcactgaggagaaccgtgccacccgctgtgactggaatcacgttcttgtccggcgggcagtctgaggaggaagcgtctatcaatctgaatgccattaataagtgccctctgctgaagccctgggctctgacattcagctacggcagggctttgcaggccagcgccttgaaggcctggggcgggaagaaagaaaacctgaaggcagcccaggaagaatatgtgaaaagagctctggctaattcactggcttgtcaggggaaatacaccccatctggacaggcaggtgccgccgcctccgagtctctgttcgttagtaatcacgcatat

SEQ ID NO: 5801 - DNA, 1092 bp, Artificial Sequence
  Description of Artificial Sequence: Synthetic coding sequence
atgccttaccagtaccctgcccttaccccggagcaaaagaaggagctgtccgacatcgcacatcggatcgtcgcaccgggaaagggtatcctggcggcggatgagagcactggctctatcgcgaagcgcctccaatccattggcaccgagaacactgaggaaaaccggcggttctacagacaattgctgctgacggccgacgaccgcgtcaatccctgtatcggcggagtcatcctcttccatgagacgctttaccagaaagccgatgacggaaggccgtttccgcaagtgattaagagcaagggaggcgtggtcggcatcaaggtggataaaggtgtcgtgcctctcgccggaacgaatggcgaaactactacccagggacttgacggactgtccgaacggtgcgcccaatacaagaaagatggggcagacttcgcaaagtggcggtgcgtgctgaaaattggcgagcataccccgtccgcgctggcaattatggaaaatgccaacgtgctggccagatacgcatccatctgccaacaaaacggaatcgtccccatcgttgagcccgaaatcttgccggatggagatcacgatctgaaaagatgccagtacgtgactgaaaaagtgctggccgccgtgtacaaggccctctcggaccaccacatttatctggagggaactctcttgaagcctaacatggtgactccgggacacgcatgtactcaaaagttctctcacgaagaaattgccatggccactgtcacggcgctccgcagaaccgtgccacctgccgtgacgggaatcacttttctttccggcggccagtcagaagaagaggccagcattaacttgaacgcgatcaataagtgcccgctgctcaaaccatgggcccttaccttctcctatggtcgggctctgcaggcgtccgccctcaaggcctggggcggaaagaaggaaaacctgaaggcggcccaggaggagtacgtgaagagagccctggccaactcgctggcttgccagggaaaatacaccccgtcgggacaagcgggcgcagccgcaagcgaatcgctgtttgtgtcaaaccacgcctat

SEQ ID NO: 5802 - DNA, 1092 bp, Artificial Sequence
  Description of Artificial Sequence: Synthetic coding sequence
atgccctaccagtaccctgctctgaccccggaacagaaaaaggagctgtcagacatagcccatcgcatagttgcccctggaaagggcatcttggccgccgacgagtctacaggcagcatcgccaaaaggctgcagtctatcggcacagagaatactgaagaaaataggaggttttacaggcaacttctccttacagccgacgacagggtgaatccgtgtatcggaggggtaatcttatttcatgaaaccctgtaccagaaagccgatgacggacgcccttttccccaggtgatcaagtctaagggcggcgtggtcggcattaaagtggataaaggagtggtgccactcgccgggacaaacggagagacaaccactcaaggcctcgacgggttgtctgagaggtgtgcgcagtataaaaaagatggcgccgactttgcaaaatggcggtgcgtgttgaagattggcgaacacacaccgtcagctctggccattatggaaaatgccaacgtgcttgcccgctatgcctccatttgccaacagaatgggatcgtccccattgtcgaacccgaaatcctgcctgacggcgaccacgatctgaaacgctgtcaatatgtgacggaaaaagtgctggccgcggtttacaaagcactctcagaccaccacatctacctcgaagggaccctgctgaaacccaacatggtcactccagggcacgcgtgcacccagaagttttctcatgaggagatcgcgatggccaccgttaccgccctcagacggacagtcccccccgctgtcacaggcatcacctttttgagtggggggcagtccgaagaagaggccagcatcaatttaaacgccattaataagtgcccactcctcaaaccttgggcgttaaccttttcctatggccgagccttgcaggcgtccgctctgaaggcttggggcggcaagaaggaaaacctgaaagctgcgcaggaagagtacgtgaagcgcgcgctggctaactctctcgcatgccagggtaagtatactccatccggccaggccggagccgctgcctccgagtcactgtttgtgtctaatcatgcctat

SEQ ID NO: 5803 - DNA, 1092 bp, Artificial Sequence
  Description of Artificial Sequence: Synthetic coding sequence
atgccctaccagtatccagccttaacacccgaacagaaaaaggaactttccgatatcgcccatcgcattgttgcccctgggaaaggaatactcgcagccgatgaatctacaggatcaatcgccaaacggctgcagtctataggaacagaaaatactgaagagaaccgccgattctaccggcagctgttactgacagccgatgacagagtcaacccatgcatcgggggagtgatattatttcatgaaactctctatcagaaggcagatgatgggcggccctttcctcaggtgatcaaaagtaaagggggagtggtagggattaaagtagataaaggagtggtgccactcgccgggacaaatggagagactacaactcaggggttagatgggctatcggaacgatgtgcgcaatataagaaagacggagccgatttcgcgaaatggcggtgtgttcttaagataggggaacatacaccaagtgctttggccatcatggaaaacgccaacgtactcgcgcgatatgcttctatttgtcagcagaacgggatcgtcccaattgtggaacccgaaatcttaccagatggagatcacgatctcaaaagatgtcagtacgtgactgaaaaagtcttagccgctgtgtataaagccctctccgatcatcatatctatctcgaaggaacactactaaaaccaaatatggtgactcccggacatgcatgcacacagaaattctctcacgaagaaatagctatggctactgtaacagcccttaggcggacagtgcccccggccgtgacgggaatcacatttctgtctggagggcagtccgaagaagaagcctcaattaacttaaatgccataaataaatgtcctctcttgaaaccatgggccttaactttctcatatggacgggccctgcaggcaagtgcactgaaagcctggggggggaaaaaagaaaacctaaaagccgcccaggaagaatatgttaaaagagcccttgctaacagtctggcctgccaggggaaatatactccctctggacaggcaggagctgcagcctcagaaagtctctttgtatccaaccacgcgtat

SEQ ID NO: 5804 - DNA, 1092 bp, Artificial Sequence
  Description of Artificial Sequence: Synthetic coding sequence
atgccataccaataccccgcacttactcctgaacagaagaaggagctgtcggacatcgcccatcgcatcgtcgcacctggaaagggtatactcgcagctgatgagtccacgggatccattgcaaaaagacttcaatccattggcaccgaaaataccgaagaaaacagaaggttctatcgacagctgctcctgactgcagatgacagagtgaacccatgtattggcggagtgattctttttcatgaaactctttaccaaaaggctgacgacggccgcccgttcccacaggtgataaagagcaaaggaggtgtcgtggggattaaagtggataagggtgtagtgcctctcgcaggcactaacggcgaaaccacgacccaggggctggatggtctttcagaaaggtgcgctcagtataagaaggatggcgccgattttgccaagtggcgctgcgtcctcaaaattggtgaacacactccttccgcgcttgctattatggaaaacgcaaatgtcctggcaagatacgcctcgatttgtcagcaaaatggaatcgtgccaatagtggaacccgagattcttccggacggcgatcatgacctgaaacgatgtcagtacgtgaccgaaaaagtgcttgccgcagtctacaaggccctcagcgatcatcacatttaccttgaaggaaccctccttaaaccgaacatggtgactcctggacacgcctgcacccaaaagttttcccatgaggagattgcaatggcgaccgtcacggcccttaggcgtactgtgcctccggcagtgacgggtattaccttcctctcaggcggccaatcagaagaagaggcatcgattaacctcaacgcaataaacaagtgtcctctcctgaaaccttgggcgcttacgtttagctacgggcgagcactccaagcatcggccttgaaagcgtggggtggaaagaaagagaatctgaaggcggcacaagaagaatacgtcaagcgtgcacttgcaaactcacttgcatgccaggggaaatacacgccctcgggacaagcaggagctgcagcctctgagagcctttttgtcagcaaccatgcatat

SEQ ID NO: 5805 - DNA, 1092 bp, Artificial Sequence
  Description of Artificial Sequence: Synthetic coding sequence
atgccgtaccagtaccccgcactgactccagagcaaaagaaggaacttagcgacatcgcacatagaattgtggcccccggaaaaggaatacttgcggcagatgaatcgaccggatccattgcaaagcgcctgcaatccatcggcaccgagaatactgaagaaaacagacgcttctaccggcagctcctcttgactgcagatgatcgagtgaatccttgcatcggtggagttatcctgtttcacgagactctgtatcaaaaagcagacgacggtagacctttccctcaggtgatcaagagtaagggcggagtggtgggaatcaaggtcgataagggtgtggtgccactggccggcactaacggagaaactacgacccagggtttggatggcctgtcagaaaggtgtgcccagtacaagaaagatggtgcggattttgcaaagtggcgctgcgtgctcaagatcggtgagcatacccccagcgcccttgcaattatggagaacgcaaacgtccttgcaagatatgcgtcgatatgccaacaaaatggaattgtccctattgtggagcctgaaattctgcctgatggggatcatgatcttaagcggtgccaatacgtgacggaaaaggtcctggccgctgtgtataaggcgttgtcggaccatcacatatatcttgaaggaaccttgctgaagcccaacatggtgacccctggtcatgcttgcacccaaaagttttcgcacgaggaaattgcaatggcgaccgtgactgcacttagaaggaccgtccctcccgccgttacgggtatcacctttctctctggaggacaaagcgaggaagaagcctcgattaacttgaatgccataaacaaatgccccttgctgaaaccatgggcactgactttttcgtacggtagggcacttcaggccagcgcactgaaggcatggggtggaaaaaaggagaatttgaaggcggctcaagaagaatatgtgaagcgggctcttgcaaactcactggcatgtcagggtaaatacaccccgtcagggcaagcgggcgcagcagcatccgagtcactcttcgtctccaaccatgcgtac

SEQ ID NO: 5806 - DNA, 1092 bp, Artificial Sequence
  Description of Artificial Sequence: Synthetic coding sequence
atgccgtaccaatacccggcactgactcccgaacaaaagaaggagctgtcggatatcgcacatcggatcgtggcacctggtaaaggtattctggcggctgatgagtccactgggagcattgccaaacgccttcagtccattggaaccgaaaacactgaggaaaaccgtcgtttctatcgccaacttctcctgaccgccgatgatagagtgaatccatgtatcggaggtgtgatcctcttccacgaaaccctgtaccagaaggcagatgatgggcgccctttcccccaggtgattaagtccaagggtggagtggtgggcataaaggtggataagggtgtggtccccctggcaggaactaacggagagactaccacccaaggactggacggactttccgaacgatgtgcacaatacaagaaagacggtgcagactttgcaaaatggagatgtgtgctgaagattggagaacataccccctctgcacttgcaattatggaaaacgcaaatgtgttggcccggtacgcctctatttgtcagcaaaacggcatcgtccctattgtcgagcctgaaatccttcctgacggcgatcacgacctcaaacgctgccaatacgtcacggaaaaggtgcttgccgccgtgtacaaggcactgtctgaccatcacatataccttgaaggtaccctgttgaagccaaatatggttactccagggcatgcatgtacgcaaaagttttcacatgaagaaatcgcaatggcaaccgtgaccgcgctccgccggaccgtgcctccagcagtcaccggtatcaccttcctttcgggaggtcagtcggaagaagaagcctcaatcaatttgaacgccatcaataagtgccctcttctgaagccatgggctctgactttttcatacggaagggcactgcaggcatcggcactgaaagcatggggcggaaagaaggaaaaccttaaggccgcacaggaggaatacgtcaagcgggcgcttgccaactcacttgcctgtcagggcaagtacactccgtccggccaagctggagccgcagcatcggaatccctgttcgtgtcaaaccatgcatac

SEQ ID NO: 5807 - DNA, 1092 bp, Artificial Sequence
  Description of Artificial Sequence: Synthetic coding sequence
atgccctatcagtatccggcgctgacgcccgagcagaagaaagaactgagtgatatcgctcacagaattgttgctccaggcaaaggaattctagccgcagacgaatcaaccggctcaatcgccaagaggctccagtccatcggaacagagaacacagaagagaaccgccggttctatcggcagctgttactgacggccgatgatagagtgaatccatgcatcggaggcgtaatcctttttcacgaaacattgtatcagaaagccgacgatggtcggcccttcccccaggtgattaagagcaaagggggggtagtgggcatcaaagtggataagggcgtggtgcccctggccggaaccaacggtgagactacaacccaagggttggatggtctgtctgagaggtgcgcacaatataaaaaagacggtgccgatttcgcgaagtggcgctgtgtgctgaagatcggagaacacaccccatctgcacttgccattatggagaacgctaatgtgttagcccgatacgcatctatctgtcagcaaaacggcatcgttcccatcgtcgagcctgagatactacccgacggcgatcatgacctgaaacgttgtcagtatgtgacagagaaagtgctggctgcagtctacaaggccctttctgatcatcacatttatttggaaggaactctccttaaaccaaacatggtgacccctgggcatgcctgtacacagaaattctcccatgaagaaattgccatggccaccgtaaccgccttgcggagaacagttccgccggcagtaaccggtatcacattcctcagtggagggcaatctgaggaagaggctagtatcaacctaaatgctataaataagtgtcccctgttgaagccgtgggcactgaccttcagttatgggcgagcactgcaagcttccgccttaaaagcttggggcgggaagaaggagaatcttaaggctgctcaggaagagtatgtcaagcgagcgctggccaactcgttggcgtgccagggaaaatacacaccctcagggcaagctggggctgcagcatctgaatcccttttcgtgtctaatcatgcttat

SEQ ID NO: 5808 - DNA, 1092 bp, Artificial Sequence
  Description of Artificial Sequence: Synthetic coding sequence
atgccttatcagtacccagcactgacaccagaacaaaaaaaagaactgagtgacatagcccacagaatcgtagcaccagggaagggtatcctggccgccgatgaaagcacaggctccatagccaaaaggctgcagtctattggaactgaaaacacagaggaaaaccgacgtttctataggcagctcctgttgaccgcagacgatcgagtcaatccatgcatcggaggtgtgatcctttttcatgagacactgtaccaaaaggctgacgacgggaggcctttccctcaagtgatcaagagcaaagggggcgtagtgggaataaaggtggataaaggagtagtgcctttagcggggacaaatggcgagacgaccactcagggactggatgggctcagtgagcgctgtgctcagtataagaaggatggagccgatttcgccaagtggagatgcgtgctgaaaatcggagagcacacaccttcggctctagccataatggagaacgctaacgtcctggcgcgatacgccagtatctgtcagcagaacgggattgttcccattgtagaaccggaaattttgcctgatggggatcacgacttaaagcgctgccagtatgtgacagaaaaggtgttggcagcagtttacaaggcactaagtgatcaccatatctaccttgagggaaccctccttaagcccaacatggtgactcctggacacgcgtgtacccagaagttctcacacgaagaaattgccatggccactgtgaccgcacttagacggaccgtgccacccgctgtgactggcatcaccttcctgtcaggcgggcagtctgaagaagaggcctcaataaatctgaatgccataaacaagtgtcccctcctcaagccttgggccctgaccttctcttacggtagggcactgcaggctagtgcacttaaggcctggggaggtaagaaagagaatctaaaggccgcccaggaggagtacgtgaaaagggccctagctaactctctggcctgtcagggaaagtacactccctcagggcaggcaggcgcggcagcctcagagagtctttttgtctctaatcacgcttac

SEQ ID NO: 5809 - DNA, 1092 bp, Artificial Sequence
  Description of Artificial Sequence: Synthetic coding sequence
atgccctatcagtatcccgcactgacaccagaacaaaaaaaggaactgagcgatatcgcacatcggattgtggccccaggtaaggggatcttggcggccgacgagagtaccgggtctattgccaagcggcttcaaagcataggcacagagaatacggaggagaaccgaagattctaccgccagctgctacttaccgcagatgaccgggtgaacccctgcatcggaggcgtgatcctctttcacgagaccctgtaccaaaaagccgatgatggtaggccctttccgcaggtgataaagagtaagggaggagtggtgggaataaaggtggacaagggggtcgttcctctggcaggcacaaacggtgaaactacaacacaagggctggatgggttgagcgaaagatgcgcccaatataagaaggacggcgctgattttgccaagtggaggtgtgtactgaaaatcggcgaacataccccttctgccttggcaatcatggagaatgctaacgttctggcgcgttacgcttcaatatgtcagcagaatgggattgttccgattgtggagccggaaattttgcccgacggcgatcacgatctgaaacggtgccagtacgtgacagaaaaggtgctggccgccgtctataaggccctgtctgatcatcatatctatctggaaggaaccttgctgaaacctaacatggtcacccccggccacgcttgcacccaaaagtttagccatgaagaaattgcgatggcaaccgtaaccgccctgaggcggaccgtgcctcccgcagtaacaggaatcaccttcctgagcggggggcagtctgaagaggaggcctcaatcaatctaaatgctataaataagtgtcccttgctgaaaccctgggcccttaccttttcgtacggaagagctcttcaggcctcagcccttaaagcatggggtgggaaaaaggagaatttgaaagcggcccaggaggagtatgtgaagcgtgctctagctaactcactcgcctgtcagggcaaatatacaccatcagggcaagctggggccgccgctagtgaatctctgtttgtgtccaaccatgcttat

SEQ ID NO: 5810 - DNA, 1092 bp, Artificial Sequence
  Description of Artificial Sequence: Synthetic coding sequence
atgccttaccagtaccctgccctgacgcctgaacaaaagaaggaactgtctgacatagcgcatcgtatagtagctcccggcaaaggaatcctcgcggccgacgagtcaaccggctctattgcaaagcgactccagagcatcggcacggagaatactgaggagaaccggcggttttatagacagctcctgctgaccgcagacgaccgcgtgaatccgtgcattggaggtgtgattctttttcacgagactttgtaccagaaggcggatgatggtcgtccattccctcaggttatcaagtctaagggaggtgtagttggaataaaggttgacaaaggagtggtgccgttagctggtacaaacggcgaaaccactactcaaggccttgacgggctgagcgaacgctgtgcccagtataagaaagatggcgccgacttcgcgaagtggcgctgtgtgcttaaaataggggaacatacaccctccgcactcgccattatggagaacgccaacgtgttagcccgttacgcttcgatctgccagcagaatggtatcgtgcctatcgtggagcctgagattctcccggatggggaccacgacctgaagcggtgtcagtacgtgacagaaaaggttctggctgcagtgtacaaggccctctcggaccatcacatctatctggaagggaccctactgaaacccaacatggtgacgcccggccacgcctgcacccagaaattttcacacgaggaaatcgccatggctactgtgacggcattaagaaggactgtccctcccgctgtcactgggattaccttcctgtcggggggtcaatctgaggaggaggcctccatcaatctgaacgccatcaataagtgccccttattaaaaccctgggcgctaaccttctcgtacggcagagcactccaagcttctgcactgaaggcttggggtggcaaaaaggagaacctaaaggccgctcaggaggaatatgtgaagagagcactggccaattcactggcctgtcaagggaagtacaccccttccgggcaggcaggtgccgctgcctccgagtctctgttcgtgtcaaatcacgcctat

SEQ ID NO: 5811 - DNA, 1092 bp, Artificial Sequence
  Description of Artificial Sequence: Synthetic coding sequence
atgccttaccagtaccctgcactgactcctgagcagaaaaaggaactctccgacatcgcgcaccgcatcgtggcaccgggaaagggcatcttggcggcggatgagtccactgggtccatcgcaaagcggttgcagtccatcggtaccgagaacaccgaagaaaacagacggttctaccgccaactgcttctgaccgccgatgatcgcgtcaatccttgcatcggaggagtcatcctgttccatgaaaccctgtaccagaaggcggacgatggccggccgtttcctcaggtgatcaaatccaaagggggcgtggtggggatcaaagtcgataaaggtgtcgtgccgctggctggaaccaatggagaaaccactacccagggtctggacggactctcagagcgctgcgctcagtacaaaaaggacggcgctgatttcgccaaatggcgctgtgtgctcaagatcggagaacacacgccatcggccctggctatcatggagaatgctaacgtcctcgctcgctacgcttcaatctgccaacagaacggaatcgtgccaatcgtcgagccggaaatcctgccggatggcgaccacgatctgaaacggtgtcaatacgtcaccgaaaaagtgctcgctgccgtgtacaaggcactgagcgaccatcacatctacctggagggtactctgctgaagccaaatatggtgacgccgggacacgcctgcactcagaagttctcccacgaagaaatcgccatggcaactgtgactgccctcagacgcaccgtgccgcccgcagtgaccgggatcacctttctgtcgggaggacaatcggaagaagaagcctccatcaatctcaacgcgatcaacaagtgcccgctgcttaagccatgggccctgactttctcctacggaagagcgctgcaggcttcggcgctgaaagcatggggtggtaagaaggaaaacctcaaggccgcgcaggaagagtacgtgaagagagcccttgctaatagccttgcttgccaagggaagtacactccttcggggcaagctggagcggctgcgagcgagtccttgttcgtgagcaaccacgcatat

SEQ ID NO: 5812 - DNA, 1092 bp, Artificial Sequence
  Description of Artificial Sequence: Synthetic coding sequence
atgccataccaataccctgccctgacccctgaacagaagaaggaactgtcagatatcgcacaccgcattgtggcaccggggaaaggtattctggctgcggatgaatcgactggaagcattgccaaacggcttcagagcatcggcactgagaacaccgaagaaaatcgcagattctaccggcagctcctgcttaccgcggacgatagagtcaatccgtgtattggcggcgtgatcttgttccatgaaaccctttaccagaaggccgatgatggtcggcctttcccgcaggtgatcaagagcaaaggaggagtggtgggcatcaaggtggacaaaggtgtggtgccgctcgcgggaactaacggagaaaccaccactcagggtctggatggcctgtcggagcgctgcgctcaatacaagaaggatggagcggacttcgccaagtggagatgcgtgttgaaaatcggagagcacaccccatcagcgctcgccatcatggagaacgcaaacgtgctggctagatatgcctcgatctgccaacaaaacggcatcgtgccaatcgtggaacccgaaattctgccggatggtgaccatgacctgaaaaggtgccagtacgtcactgagaaggtcctggcagccgtctacaaggccctcagcgatcaccacatctatctggagggcactctgctcaagcccaacatggtgactccgggacatgcttgtactcaaaagttcagtcacgaagaaatcgctatggccactgtcactgccctgaggcgcacggtgccgccggccgtgactgggatcactttcctgtcaggaggacagtctgaggaggaggcttccatcaatcttaacgcgataaacaaatgcccgttgctcaaaccgtgggctctgactttttcgtacggccgcgccttgcaggcgagcgcacttaaggcgtggggaggaaagaaggagaacctgaaagcggcacaggaagagtacgttaaacgcgccctggctaactcattggcgtgccaaggaaagtacaccccgtcgggtcaggcgggagcggcggcctcggagtcgctgttcgtgtccaaccacgcctac

SEQ ID NO: 5813 - DNA, 1092 bp, Artificial Sequence
  Description of Artificial Sequence: Synthetic coding sequence
atgccgtaccagtatccagctttgacacccgagcagaaaaaggagctttccgatattgctcacagaatcgttgccccaggtaaggggattctggcagccgacgagagcaccggttcaattgctaagcgcctgcaatctataggcacggagaatacagaggagaacagacgcttctacaggcagttgctgctcacggcggatgatcgcgttaacccgtgtatcggcggggtgatcctgtttcatgagactctgtaccagaaggccgacgacgggcggccgtttccgcaggtgatcaaatcaaagggcggggtggtcgggatcaaggtggacaaaggcgtggtacctctggctggtacaaatggcgagactactacacagggcctggacggattgtcagagcgctgtgctcaatataaaaaggatggggctgacttcgccaagtggcgctgtgtcctcaagataggagagcacaccccaagtgctctggctatcatggaaaacgccaatgtactcgctagatatgcttctatttgtcagcagaatgggatcgttcccatcgtcgaacccgagatccttcccgatggagaccatgacctgaagaggtgccagtacgtgaccgagaaggtcttggccgcggtgtataaggcgcttagcgatcaccacatctatctggagggaacactccttaaaccaaatatggtcactccgggccacgcatgcactcagaagttcagccacgaagaaatcgctatggccactgttaccgcactgcgtcgtaccgttccgcctgccgtgacaggtatcacctttctgagtgggggccagagcgaagaggaggctagcattaacttaaatgcaatcaacaagtgcccactactgaaaccctgggccttgactttttcatacgggcgtgcgcttcaggctagcgccttaaaggcctggggaggtaaaaaggaaaacctgaaggctgctcaggaggaatatgtgaagcgcgcactggccaattcgttggcatgccagggcaaatatactcccagcggtcaagcaggtgctgcagccagtgaaagcctattcgtttccaaccacgcctat

SEQ ID NO: 5814 - DNA, 1092 bp, Artificial Sequence
  Description of Artificial Sequence: Synthetic coding sequence
atgccataccaatatcccgccctgacgcctgaacagaagaaggaactttctgacattgctcaccgcatagtcgcgccaggaaagggcatccttgccgccgatgaatccacaggtagtatcgcaaagcggctgcagtcaatcgggacagaaaacacagaggagaaccggagattctacaggcaactgctgctgaccgcggatgaccgggtcaatccctgcatcggcggcgtgatactgtttcacgagaccctctatcaaaaagcagacgatggccgaccctttccacaggtaattaaatccaagggcggggtggtggggatcaaggttgataaaggtgtcgtgcctctggctgggaccaacggggagacaacaacccagggcctcgacgggctgtccgagcgctgcgctcagtataaaaaagacggtgccgacttcgcaaagtggcggtgtgtcctgaaaatcggcgagcacacgccctcagctctggccatcatggaaaacgcgaacgtgctggcccggtatgcatctatatgccagcagaacggcatagtgcccatcgtagaaccagaaatacttcccgatggagatcacgatctgaaaaggtgtcaatacgtgactgaaaaggtcctcgctgccgtctacaaggcactgagtgaccaccatatctatttggaaggaaccctcctcaaacccaatatggttaccccaggccacgcatgtacgcagaagttctctcatgaagagatcgcgatggcaacagtgacagcgttgagaagaactgtgccccccgcagttaccggcatcacctttctctccggagggcaaagtgaagaggaggccagcatcaacttgaatgcaataaacaaatgtccccttctgaagccttgggcactcaccttctcctacgggagagccctgcaggccagcgccctgaaggcgtggggaggcaaaaaggagaaccttaaggctgcccaggaagagtacgtgaagcgagcacttgctaatagtttggcttgtcaggggaaatacacaccaagtggccaggccggagctgctgcttccgagtctctttttgtgtcaaaccatgcctat

SEQ ID NO: 5815 - DNA, 1092 bp, Artificial Sequence
  Description of Artificial Sequence: Synthetic coding sequence
atgccataccaataccctgcgctgacgccggagcagaagaaggaactgtcagatatagcgcacagaattgtggcaccaggaaaagggattctcgccgcagatgaatcgaccgggtccattgccaaacgtctgcaatcgatcggtaccgaaaacaccgaagagaacaggaggttctaccgccagcttcttctcactgcagacgaccgggtcaacccctgcattgggggagtgatcctgtttcacgaaaccctttaccaaaaggcagatgatggcagacctttcccacaagtgattaagtcaaagggtggcgtggtgggcattaaagtggataagggcgtggtgcctctcgccggaacgaatggtgagactactacccaagggctcgatggcctctcggagcgctgtgcacaatacaaaaaggacggagcagattttgccaaatggagatgcgtgcttaagatcggcgaacataccccatcagccctcgcaataatggaaaacgcaaacgtgctggcaagatacgcgtccatctgtcagcagaatggtatagtgcccatcgtggaaccggagattctcccggacggtgatcatgatcttaaaagatgccagtacgtcactgaaaaggtgttggcagccgtctacaaggcgttgtccgaccatcacatatacttggaaggaacccttctgaagccaaacatggttaccccgggtcatgcgtgtacccaaaagttttcgcacgaggagatagccatggccacggtgaccgcgctcagacgaaccgtcccacctgccgtcaccggaatcactttcctgagcggcggccagtcggaggaagaggcaagtatcaacctgaatgcaatcaataagtgtccgcttcttaagccatgggcactcactttttcctacggaagagcgttgcaagcatcggctcttaaagcatggggcggaaagaaggaaaaccttaaggcggcacaggaagaatacgtgaagagagccctcgcaaattcactcgcctgtcagggaaagtacacgccttccggccaagcgggtgcagccgctagcgaatcactcttcgtgtccaaccatgcatac

SEQ ID NO: 5816 - DNA, 1092 bp, Artificial Sequence
  Description of Artificial Sequence: Synthetic coding sequence
atgccgtaccagtaccccgcgcttactcctgaacaaaagaaggagctctcggatatcgcccatcggattgtcgccccgggcaagggaattctcgcggcagatgagtcaaccggaagcattgccaaacggctccagtcaatcggcaccgaaaataccgaggaaaatcggaggttttatcgccaactgctgttgaccgctgacgatcgggtgaacccatgcatcggaggtgtgatcctgttccacgagacgctgtaccagaaagccgatgacggtcgcccattcccgcaagtcattaagtcaaagggaggcgtggttggaatcaaggttgacaaaggagtggtgccgcttgctggcaccaatggtgaaactaccactcagggattggatggactctccgaacggtgcgcgcaatacaagaaagacggtgcagacttcgcaaagtggcgctgcgtgctgaagatcggcgagcacaccccctcggcactggcaattatggaaaacgcgaacgtgctggcacgttacgccagcatctgccagcagaacggaattgtcccgatcgtggaaccggaaatcttgccggatggagatcacgacctcaagcggtgccagtacgtgaccgagaaagtgctggcagccgtctacaaagctctgtcggaccaccacatctacttggagggtaccttgctcaagccgaacatggtgactccgggacatgcgtgcacccaaaagttctcgcacgaggaaatcgctatggccaccgtgactgcgctgagaaggacggtcccgcctgcggtgaccggtatcactttcctttcagggggccagtcagaggaggaagcatccatcaatctgaatgcaatcaacaaatgccccctcctcaagccatgggccctgaccttttcttacggaagggcgcttcaggccagcgccttgaaagcgtggggaggaaagaaggaaaatctgaaagccgcacaagaagaatacgtgaaacgcgccctggccaactctctggcttgtcagggaaagtacaccccatccgggcaggctggtgcagctgcttccgagtcattgtttgtctctaaccatgcatac

SEQ ID NO: 5817 - DNA, 1092 bp, Artificial Sequence
  Description of Artificial Sequence: Synthetic coding sequence
atgccatatcaatatccagcacttactcctgaacaaaagaaagaattaagtgatattgcacatcgtattgttgcacctggaaagggaattttggcagctgatgaatctactggatctattgcaaaaagattacaatcaattggaactgaaaatactgaagaaaatagaaggttttatcgacaacttcttttgacagcagatgatcgtgttaatccatgtattggaggagttatattattccatgaaactctttatcaaaaggctgatgatggtcgtccatttccacaagttattaaatcaaaaggtggagttgttggaattaaagttgataaaggagttgttccacttgctgggactaatggagaaacaactactcaaggattagatgggttatcagaaagatgtgcacaatataaaaaagatggagcagattttgctaaatggagatgtgttttaaaaattggagaacatacaccatctgctcttgctattatggaaaatgccaatgttcttgctagatatgcttctatttgtcaacaaaatggaattgttcctattgtagaaccagaaattcttcctgatggagatcacgatttaaaacgttgtcagtatgtaacagagaaagtacttgctgcagtatataaggctctttctgaccatcatatttatcttgaaggaactttacttaaaccaaatatggtaactccaggacatgcttgtacacaaaaattcagtcatgaagaaattgcaatggctacagttacagcccttagacgaacagtacctccagctgttacaggtattacattcttgagtggaggacaaagtgaggaagaagcttctataaatttaaatgctataaataaatgtccattacttaaaccatgggcacttactttttcatatggaagagcattacaagcctcggcattaaaagcatggggtggaaagaaggaaaacttaaaagctgcacaagaagaatatgtgaaaagagcattagctaattcattagcatgtcaaggaaaatatacaccttcaggtcaagcaggagcagctgcttctgaatcattatttgtttcaaatcatgcttat

SEQ ID NO: 5818 - DNA, 1092 bp, Artificial Sequence
  Description of Artificial Sequence: Synthetic coding sequence
atgccgtaccaatacccagccctcaccccggaacagaagaaagagctttcagacatcgctcatcgaattgtggcacctggaaagggaatcctggcggccgatgaaagcactggttcgatcgcaaagcgcctgcagtccataggaacggaaaacactgaggagaacagacggttttaccgccagctgctgctcaccgcagatgaccgggtgaacccgtgtatcgggggagtgattctgttccatgaaactctgtaccaaaaggccgacgacggacgccctttcccgcaagtcattaagagcaagggaggtgtcgtgggaatcaaggtggacaagggtgtagtgccactcgccggaaccaacggagaaaccacgacccagggattggatggcctgtcggaacggtgtgcgcagtacaaaaaggacggtgcagacttcgctaaatggcgctgcgtcctgaagatcggtgaacataccccttcggctctggcaatcatggaaaatgccaacgtgctggctagatacgcgtcaatctgccaacagaacggaatcgtcccgatcgtggaacccgaaatcctcccagatggcgatcatgatctcaaacggtgccaatatgtgaccgaaaaagtgctggcagctgtgtacaaagccctgagcgaccatcacatatacctggaggggaccctcctcaaaccgaacatggtaactccagggcacgcttgcacccagaagttttcgcacgaagagatcgcgatggcgactgtcactgcacttaggcgtaccgtcccgcccgctgtgacggggatcaccttcttgtcgggaggccagtcagaagaggaggcctcgattaatctcaatgccatcaataagtgcccactgctgaagccttgggcactgactttctcttacggacgggccctccaagcaagcgcgctcaaggcctggggcggtaagaaggaaaaccttaaggcggctcaggaggaatacgtcaagcgggccctggcgaattcccttgcttgtcaaggaaagtacactccatcgggacaagccggggcagcggcttccgagtccctgttcgtgtccaaccacgcatat

SEQ ID NO: 5819 - DNA, 1092 bp, Artificial Sequence
  Description of Artificial Sequence: Synthetic coding sequence
atgccatatcagtatccagcactgaccccagagcaaaaaaaagagcttagtgatattgcacaccgaattgtggcacccggcaagggcatcctggctgctgacgaaagcactggaagtatcgctaaaaggctccagtcgattggtacagagaatactgaggaaaacaggagattttacaggcaactgctcttgactgctgacgaccgagtaaacccctgcatcggcggcgttatcttattccatgagacgctctaccagaaagccgatgacggacgacccttcccgcaggtcatcaagagtaaggggggagttgtaggtattaaagttgataagggcgtcgtgcccctggccggaacaaacggtgagaccacaacacagggcctggatggcctgtccgaaaggtgtgcgcagtataaaaaggatggcgcggactttgccaaatggcgatgtgttcttaaaataggcgagcacacgccaagcgctctagctattatggagaatgccaatgtacttgccaggtatgcatctatatgtcagcagaatggtatcgttccgatcgtggaacccgaaattcttcctgacggcgaccacgatttaaagcgatgccagtacgttactgagaaggtactggctgctgtgtacaaagcgctgagcgatcaccacatctatctggaaggaacattattgaagccaaatatggtgaccccgggacacgcctgtactcagaagttctcccatgaggagattgcaatggcgaccgtgacagctctgcgacgtaccgttccccccgcagtgactggtataaccttcctcagtggcggacagtccgaggaggaagcttccatcaatctgaatgccattaataagtgtccactcctcaaaccgtgggccctgaccttctcatacggccgcgccctgcaggctagcgccttgaaggcctgggggggcaagaaggaaaacctgaaggctgctcaagaggaatacgtgaaaagggccctggcaaattctctagcctgccagggcaaatacacgcctagcgggcaggcaggggctgccgcctccgagtcactgttcgtgtctaaccacgcctac

SEQ ID NO: 5820 - DNA, 1092 bp, Artificial Sequence
  Description of Artificial Sequence: Synthetic coding sequence
atgccataccagtatccagcgttgacacctgagcagaagaaagagctcagcgatatcgcgcatcgcatcgttgcgccgggtaagggcattctggcagcggacgaatctacaggtagcatagcgaaacgactgcaaagcatcggcacggagaacactgaggagaatagaagattttatcgtcagctgcttttgacagctgatgaccgcgtgaacccgtgcatcggtggtgtgatcctgtttcatgaaaccctgtatcagaaggctgacgacgggcgtccattccctcaggtgattaaaagcaaggggggcgtggtgggtatcaaagtcgataaaggtgtggtccctttggcaggcactaatggcgaaactaccacgcagggactggatggtttgtctgagcgatgtgcgcagtacaagaaagatggtgcggatttcgctaagtggaggtgtgtgctgaagattggagagcacactcctagcgcgcttgcgattatggagaacgcaaacgttctggcacgctacgccagcatttgccagcagaacggtatcgttccgattgtggagccagaaattttgccagacggtgaccacgacctaaagcgctgtcagtatgtcactgagaaggttctagcagcagtctacaaagcgctgagcgatcatcatatctacctggagggcaccctgctgaagcctaatatggtaactccgggccatgcgtgcacccagaaattctctcacgaggagattgccatggcgaccgtcaccgcgctgcgccgcaccgtgcccccggccgtgaccggcatcacctttctgtctgggggccagagcgaggaagaggctagcataaatctgaacgcgatcaacaaatgcccattgttaaagccctgggcattaacattcagctatggtcgcgcactgcaggcttccgcgctgaaggcctggggggggaagaaagaaaatttgaaagcagcccaggaagaatatgtgaagcgcgcgctcgcgaatagcctggcatgtcaaggcaaatatactccgtcgggacaggcgggcgccgctgcctcagagtcactattcgtgtccaatcacgcttac

SEQ ID NO: 5821 - DNA, 1092 bp, Artificial Sequence
  Description of Artificial Sequence: Synthetic coding sequence
atgccttatcagtatcctgccctcacccctgaacaaaagaaagagctgagtgatatagcccatcggatcgttgcccctggtaagggcattctggctgccgacgagagcacgggatctatcgccaagcgactgcagtctatcgggactgagaacactgaggaaaacagaagattctatcgccagcttctcctgactgccgacgatcgcgtcaatccatgcattggcggagtgatccttttccatgaaacactctatcagaaggctgacgacggccgcccatttccacaggtcattaagagcaaaggaggggtggtcggcattaaggtggacaagggcgtcgtgcctttagccggcactaatggtgagacaaccactcagggcctcgacgggctctctgaacggtgtgctcagtacaagaaagacggtgcggacttcgcaaagtggagatgtgtgctgaaaattggcgagcatacgccttccgctctcgccattatggaaaacgccaatgttctggcaagatacgcctccatctgccagcaaaacgggattgtccctatcgtggagccggagatcctgccggacggcgaccatgacctaaagaggtgccaatacgttactgagaaggtacttgcagccgtctacaaagccttgtctgatcaccacatttatctggagggtaccctgctgaagcctaatatggtcaccccagggcatgcctgcacccaaaaattcagccacgaagaaatcgccatggctaccgtgaccgccttaagaaggaccgtgcctccagctgttaccgggataaccttcctgtctggaggccagtccgaggaagaggcgtctatcaatctcaacgccatcaataagtgccccttactgaaaccctgggcactcacattcagctatggaagagctttgcaggcctccgctctgaaagcgtggggaggcaagaaggagaacctgaaggctgctcaggaggagtacgttaagcgtgccctcgccaactcacttgcttgccaaggcaagtacacacctagtggacaggccggagcagcagccagcgaaagtctgttcgtgtctaatcacgcctat

SEQ ID NO: 5822 - DNA, 1092 bp, Artificial Sequence
  Description of Artificial Sequence: Synthetic coding sequence
atgccttatcaatacccggccctgactcctgagcaaaagaaggaactctcagatatcgcgcatagaatcgtcgcccctggcaagggaatcctggcagcagacgagtccactggatcaatcgcaaaacggcttcaaagcatcggtaccgaaaacactgaagagaataggcgcttttatcgccagcttttgctgaccgcagacgatcgggtgaacccctgcatcggcggagttatcctgttccatgagactctttaccaaaaggccgacgacggacgccccttccctcaagtgatcaagagcaaagggggcgtcgtcggaatcaaggtcgacaagggagtggtgcccttggctggtaccaacggagagactactacccaggggctcgacggtttgtcggagcgctgtgcgcagtacaagaaagacggtgccgatttcgctaagtggaggtgtgtgttgaagattggagaacatactccgtctgccctcgccatcatggaaaacgccaatgtgctcgcgcgctacgcctcgatctgtcagcaaaacggcatcgtcccgatcgtggaacctgagattttgccagacggcgaccacgatcttaagagatgccagtacgtgactgagaaggtgctggccgcagtgtacaaggccctgtcagatcaccacatttacttggagggaacccttctcaaaccgaacatggtgacgccggggcatgcgtgtacgcagaagttctcgcacgaagagatcgcgatggcgactgtgaccgcccttcgccgcaccgtcccgccggcagttaccggcattacctttctgagcggaggccagtccgaagaagaagcaagcattaatctcaacgccatcaataagtgcccactgctcaagccgtgggccctcacgttctcatacggccgggcgctgcaggcatccgcactcaaagcatggggtggtaagaaggaaaatctgaaagcagcccaagaggagtacgtgaaacgtgctctcgccaactcactcgcgtgccaaggaaagtacaccccatcggggcaggccggagcagctgcctccgaatctttgtttgtgtccaaccacgcgtac

SEQ ID NO: 5823 - DNA, 1092 bp, Artificial Sequence
  Description of Artificial Sequence: Synthetic coding sequence
atgccgtatcaataccctgctctgactccagaacaaaagaaggaactcagcgacattgcccaccggattgtcgcaccgggaaagggtatcctggcagccgatgagagcacgggttcgatcgcgaaaaggctgcaatccatcgggactgaaaacactgaagaaaaccgcagattctaccgccaactgcttctgaccgctgatgaccgggtgaatccatgtatcggaggagtgatactgtttcacgaaaccctttaccagaaagctgacgacgggcggccatttccgcaggtgatcaagtcgaaaggtggcgtggtgggaatcaaggtggacaaaggggtggtcccgctggcggggaccaacggcgagacgaccactcagggcctcgacggcctgtccgagcggtgcgctcagtataagaaggatggagccgacttcgccaagtggcggtgcgtcttgaagatcggggagcacaccccatcagcgcttgcaatcatggaaaacgccaatgtcctggcaagatacgctagcatctgccagcagaatggtatcgtccctatcgtggaaccggaaattcttcccgatggtgaccacgaccttaagcgttgtcagtacgtgactgaaaaggtgctggctgctgtgtacaaggccttgagcgaccaccatatctaccttgagggcactctcctcaagcccaacatggtgaccccgggacacgcctgcactcagaaattctcacatgaggagatcgccatggccaccgtgactgcgctgagacggactgtgccgcctgctgtgaccggaattaccttcctctcaggaggacagtcagaagaagaagcgtcgattaacttgaatgcgatcaacaagtgtcccctgctcaaaccgtgggccctcaccttctcgtacggccgggcgctgcaagcgtcagccctgaaggcttggggagggaagaaagaaaatctgaaggccgcgcaggaagaatacgtcaagcgggcgctggctaactcgctggcttgccaagggaagtacactcctagcggccaggccggagccgctgcatcggaatcgctcttcgtgagcaaccacgcttat

SEQ ID NO: 5824 - DNA, 1092 bp, Artificial Sequence
  Description of Artificial Sequence: Synthetic coding sequence
atgccgtaccagtacccagccctgacccctgagcagaaaaaagagctgtctgatattgcgcatcggatcgtcgcaccaggaaagggaatcctcgctgcagatgaatcgaccggaagcatagccaagcgattgcaatcaataggtactgagaatacggaagaaaataggcggttctaccggcagctcctgcttaccgcagatgatagagtgaacccatgtataggcggtgtgattctgtttcacgaaaccctgtaccaaaaggcagatgatggacggccttttccacaagtgatcaaatcgaagggtggcgtcgtcggcatcaaggtggacaagggtgttgtgcctctcgcaggaaccaatggggaaactactacccagggactggatgggttgtcggaacggtgcgcacaatacaagaaggatggggccgattttgccaagtggcgatgcgtgcttaagatcggagagcacacgccctccgctctggctattatggaaaatgcaaatgtcctggcgcgttacgcaagcatttgtcaacagaacggaatcgtccctatagtggaaccagaaatccttcccgacggggaccatgatttgaagcgctgccaatacgtaaccgaaaaggtgcttgccgcggtgtacaaggctctttcggaccaccacatatatcttgaggggaccctcttgaagccaaacatggtgacgcccggtcacgcatgtactcaaaagttctcgcatgaggagatcgccatggcaactgtcacggcgctgaggaggactgtcccccctgcagtgactggcatcacgtttctctcaggtggacagtccgaagaggaagcaagcataaatctcaacgctatcaacaagtgtcctcttctgaaaccatgggcacttactttctcctacggccgagctctgcaggcatccgcccttaaggcttggggtggcaagaaagagaacctgaaggcagcacaagaagagtacgtgaagcgtgcactcgcaaactcccttgcatgtcaaggtaaatacaccccctccgggcaagcaggcgccgcagcatctgaatcgctgtttgtgtccaaccacgcctac

SEQ ID NO: 5825 - DNA, 1092 bp, Artificial Sequence
  Description of Artificial Sequence: Synthetic coding sequence
atgccctatcagtatcctgcgttgactcctgaacaaaaaaaagagctgtccgatatcgcacatagaatcgtggcacccggcaaaggaatcctggctgccgacgagtccacgggatcaatcgcgaagcgcctgcagtcgatcggtactgagaatacagaagaaaacagacgcttttaccgtcagctgctgctaaccgctgatgacagagtgaacccgtgcataggtggggtcattctgtttcacgagaccctgtatcaaaaggcagacgacggtcgccccttcccgcaagtgataaagagcaagggaggggtggtaggtatcaaggtggataaaggggtcgtgccccttgccggaaccaatggtgaaactactactcagggtttggacggtctgtcggaacgatgtgcacagtataagaaagatggagccgactttgctaaatggaggtgcgtgctgaagatcggtgaacatacccctagtgccttggccatcatggagaatgcaaacgtgctggcccggtacgcctcgatatgccagcagaacggtattgtacccattgtcgagccggagattttaccggatggggatcatgatttgaagagatgtcaatacgtgaccgagaaggttctggccgccgtctacaaggctctgagcgaccatcacatctacctggagggcacccttctgaagcccaacatggtcacacccggacacgcatgcacccagaaattttctcatgaggaaattgccatggctacggttaccgctctgcgacgaacagtacccccagccgtgaccggaattactttcctgtctggcgggcagtctgaagaagaggcctctatcaacctaaacgctatcaataaatgtccgctacttaagccctgggccctgacattctcctatggaagggctctgcaagcctcggccttgaaggcttggggggggaagaaagagaacctcaaggccgcccaggaagagtatgtcaagcgcgctttagccaattcactggcctgtcaagggaaatacacccctagcggacaggcgggggctgcagcttctgaaagcctgttcgtgagcaaccacgcatac

SEQ ID NO: 5826 - DNA, 1092 bp, Artificial Sequence
  Description of Artificial Sequence: Synthetic coding sequence
atgccctaccagtaccctgccctcacccctgaacagaaaaaagagctctccgatatcgcacacaggattgtggctccaggcaagggcatccttgctgcggacgagtctaccggatccatagctaagagactgcagtcgattggaaccgaaaacaccgaggaaaatagacgtttttaccgtcaattgcttctgaccgcagatgatagagtcaatccatgtatcggaggagtgattctttttcacgaaaccctttaccaaaaggcagatgacggcaggccatttccccaggtgatcaaaagtaaaggaggtgtggtgggaatcaaggtcgataaaggtgtggtgcctcttgcgggaactaacggagaaactactacgcagggtcttgatggtctgtcggagagatgtgcacaatacaagaaggacggcgccgatttcgcaaagtggcgctgtgtgctgaagataggtgaacatactccctccgcactcgcaataatggaaaatgcaaatgtgcttgccagatacgcttccatatgtcagcaaaacggtatagttccgattgtcgagcctgaaattctgcccgatggtgaccacgatctgaagcgatgccaatacgtcactgaaaaggtgcttgcagcagtgtataaagcactctcggaccatcatatctacctcgaaggtaccctgctcaaacctaacatggtgacccctggtcacgcatgcacgcagaagttttcccacgaagaaattgctatggccaccgtgaccgccctgcggcggactgtgcctccagcagtgactggcatcaccttcctgtcaggaggtcaatcggaagaagaagcatccattaatctcaacgcaatcaataagtgtcctctgctgaaaccttgggcactcacttttagctacggtagagcgctgcaggcgtcagcacttaaggcttggggaggcaaaaaagagaaccttaaggccgcccaggaagaatacgtgaagcgagcgctggcgaattccctcgcctgtcaaggaaagtacactccatccggacaagccggagccgcagcatcggagtcgttgttcgtgtccaatcacgcatac

SEQ ID NO: 5827 - DNA, 1092 bp, Artificial Sequence
  Description of Artificial Sequence: Synthetic coding sequence
atgccctatcagtatccagccttgactccagagcagaaaaaggagctctcagacattgctcacaggatagtggcgcctggtaagggtatcctggctgcggacgaaagcacgggtagcatcgccaaacgcctacagagtattggcacggaaaacaccgaggagaacaggcgattctaccgccagctgctgctaacagcagacgatcgggttaatccctgcattggaggagtgatcctgttccatgagactctttaccaaaaagccgacgacggccgcccatttccacaggtaatcaagtccaagggaggtgttgtgggcattaaagtggataaaggcgtcgtgcctcttgcagggacaaacggagagactacaacacaggggctggatggcctgagtgagcgatgcgcccagtataagaaagatggcgctgatttcgccaagtggagatgcgtacttaagatcggcgagcataccccctctgctctcgccattatggagaacgccaacgtcctggcccgctacgcttctatctgtcagcagaacgggatcgtgcctatcgtcgagccagagatcctgccagatggcgaccacgatctgaagaggtgccagtatgtaacagaaaaggtacttgctgctgtctacaaagcactgtctgaccatcacatctacctcgaagggactcttcttaaaccaaacatggtgaccccgggacacgcttgcacccagaagttttcacatgaagagatagccatggccaccgttacagccctaagacgcacggtgccacccgcggtaacaggcattacatttttgtccggcggacaatctgaagaagaagcgagtatcaatctgaacgcaatcaacaaatgcccactgcttaagccctgggcactaaccttttcctacgggcgtgcactgcaggcatcggccttgaaggcatggggtggtaagaaagagaatctaaaagctgcacaggaagagtacgtgaaacgggctctggctaacagcctggcttgtcagggaaaatatacccccagtgggcaagctggtgcagcagcatctgaatccctgttcgtttctaaccacgcctac

SEQ ID NO: 5828 - DNA, 1092 bp, Artificial Sequence
  Description of Artificial Sequence: Synthetic coding sequence
atgccatatcagtatcccgccctgacccccgagcagaaaaaggagctgtccgacattgcgcaccggatcgttgcccctggcaaaggcatactggctgcagacgagagcacaggatctatcgctaagcgcttgcaaagcatcggtacagagaacacggaggagaatagacgtttttatcggcaacttttgctgaccgctgatgatcgagttaatccctgcataggtggcgttattctattccatgagactctctaccagaaggctgacgacggacgtcctttcccccaggtcattaagagcaaaggaggcgtagtcggaattaaagttgataaaggcgttgtcccacttgccggaaccaacggtgagacaaccacccaaggccttgatgggttgtcagagcgctgcgctcagtacaagaaggacggcgcagacttcgccaaatggcggtgcgtcctgaagatcggcgagcacacccccagcgcattggccatcatggagaatgccaatgttctggcgcggtacgcttccatatgtcagcagaatggaatcgttcctattgtggagcccgaaatcctcccagacggtgaccatgacctaaagcgatgccagtacgtcactgaaaaagtgctcgccgcggtttacaaagctctgagcgaccaccacatctacctagagggcactctgctgaagccgaacatggtcacccccggccacgcatgcacacagaagttcagccacgaagaaattgctatggccactgtgacggcactacgaaggaccgttccaccagccgtgactggcatcactttcctgtccggcggacagagcgaggaagaggcatccattaatctgaatgctattaacaaatgcccactgctgaaaccctgggctctgaccttttcttacggtcgcgcgcttcaggcatctgccctgaaagcttggggcggcaagaaggagaacctgaaagcagcccaggaagagtacgtgaagcgggcgttagccaattctctggcctgccagggaaaatacaccccatccgggcaggcgggcgccgccgcgtctgaaagcttgttcgtttcaaatcacgcatac

SEQ ID NO: 5829 - DNA, 1092 bp, Artificial Sequence
  Description of Artificial Sequence: Synthetic coding sequence
atgccttatcagtaccccgctttgacgccagaacagaagaaagaactctctgatatcgcccacagaatagtggccccagggaaaggaatccttgctgcggatgaatcaacaggatctatcgcaaagaggctgcagtctatcggaactgaaaatactgaggaaaatcgcaggttttatcgacagttattactcacagccgatgaccgtgtgaacccttgtattggaggggttatattgtttcacgaaacactgtatcagaaagcggatgacgggcggccctttcctcaggtaatcaagtcaaaagggggggtggtggggatcaaagtggacaaaggagttgtaccactagccgggacaaatggggagacaacgactcaagggctggacgggctgtcagaacggtgtgcccaatataaaaaagatggggcagatttcgctaagtggcggtgtgtacttaaaataggggagcacactccctccgcgctggccatcatggaaaatgctaacgtccttgcaaggtatgcatctatctgccagcagaatggaatcgtacccatcgtggaacctgagatcctgcccgatggagatcatgacctcaaaagatgccagtatgttacagaaaaagtcctggccgcagtatataaagctctgtctgatcatcacatatacctagaagggacactgctgaaacccaatatggtgacacctgggcacgcctgcactcaaaaattttcccatgaagagattgccatggccacagtaacagctctgcgacggactgtgccacccgccgtgacaggaatcacatttttgtcaggggggcagtcagaagaagaagcatctatcaatctgaatgcaatcaataaatgtccccttctcaaaccctgggcactgacattttcctacgggagggctcttcaggcttcagctttgaaagcctggggaggaaaaaaagaaaatcttaaggctgcccaggaagaatatgtcaaaagggcgctcgcgaactccctggcatgtcagggaaaatatactccctccggacaggccggggctgccgcctccgaatctctctttgtttctaatcacgcttac

SEQ ID NO: 5830 - DNA, 1092 bp, Artificial Sequence
  Description of Artificial Sequence: Synthetic coding sequence
atgccgtatcaatatccggcgctaacgccggaacaaaaaaaagaactatcggatatagcgcatcgaatagtagcgccgggtaaaggtatattagcggcggatgaatcgacgggttcgatagcgaaacgattacaatcgataggtacggaaaatacggaagaaaatcgacgattttatcgtcaattattattaacggcggatgatcgtgtaaatccgtgtataggtggtgttatattatttcatgaaacgctatatcaaaaagcggatgatggtcgtccgtttccgcaagtaataaaatcgaaaggtggtgtagtaggtataaaagtagataaaggtgtagtaccgttagcgggtacgaatggtgaaacgacgacgcaaggtctagatggtttatcggaacgttgtgcgcaatataaaaaagatggtgcggattttgcgaaatggcgatgtgtattaaaaataggtgaacatacgccgtcggcgctagcgataatggaaaatgcgaatgttctagcgcgatatgcgtcgatatgtcaacaaaatggtatagtaccgatagttgaaccggaaatactaccggatggtgatcatgatttaaaacgttgtcaatatgttacggaaaaagtattagcggcggtatataaagcgttatcggatcatcatatatatctagaaggtacgttattaaaaccgaatatggtaacgccgggtcatgcgtgtacgcaaaaattttcgcatgaagaaatagcgatggcgacggtaacggcgttacgacgtacggttccgccggcggttacgggtataacgtttctatcgggtggtcaatcggaagaagaagcgtcgataaatttaaatgcgataaataaatgtccgttattaaaaccgtgggcgctaacgttttcgtatggtcgagcgttacaagcgtcggcgttaaaagcgtggggtggtaaaaaagaaaatttaaaagcggcgcaagaagaatatgtaaaacgtgcgttagcgaattcgttagcgtgtcaaggtaaatatacgccgtcgggtcaagcgggtgcggcggcgtcggaatcgttatttgtatcgaatcatgcgtat

SEQ ID NO: 5831 - DNA, 1092 bp, Artificial Sequence
  Description of Artificial Sequence: Synthetic coding sequence
atgccatatcagtaccctgcactcaccccagagcaaaaaaaggagctgagcgatatcgcccaccgcatcgtagctcccggcaaggggattctggctgccgacgagagcactggcagcatagccaaaagactccagtccatcggaaccgagaacaccgaagagaacaggaggttctaccggcaactgttgctaaccgcagacgaccgcgtgaacccatgcatcggcggagtcatactgttccatgagactctgtaccagaaagccgatgatggacgcccttttcctcaagtgatcaaaagtaaagggggcgtggtgggcatcaaggttgacaagggcgtggttcctctggctggcacaaatggcgagacaaccactcaaggcctcgatggcctgagcgaacggtgcgcacagtacaagaaagatggcgcagacttcgcaaagtggagatgcgttcttaagatcggagagcacaccccaagtgcactggctattatggagaacgccaatgtgctggcaagatacgcctccatatgccaacagaacgggatagttccaatcgtcgagccagaaatccttccagacggagaccacgacctgaagcgatgccagtacgtcaccgagaaagtccttgcagctgtgtacaaagctctgagcgaccaccatatatacctggagggcacgctgctgaaacccaacatggtgaccccaggccacgcctgcacccagaaattttcgcatgaggaaatcgctatggctacagtaaccgctcttaggcggactgttccccctgcagtcactggcatcactttcctgtccggcggtcagtctgaagaggaagcctccataaacctgaacgctatcaacaagtgcccactgttgaagccttgggcacttacattcagttacggccgggctctccaggccagcgctttgaaagcatggggaggcaaaaaagaaaacttaaaggccgcacaagaagaatacgtcaagagagccctggctaactccctggcgtgccaagggaagtataccccaagcggacaagcaggggcggcagcctcggaaagtctcttcgtaagtaatcacgcttac

SEQ ID NO: 5832 - DNA, 1092 bp, Artificial Sequence
  Description of Artificial Sequence: Synthetic coding sequence
atgccttatcagtatcctgctctgactcctgagcaaaagaaagaactgtccgacatcgcccacaggattgtagccccgggcaagggcatccttgcggccgatgagagcaccggaagtatcgccaagagacttcagagcatcggaaccgagaatacagaagagaatcgccgcttctaccgacagctcctcttaaccgctgacgatcgggtcaatccctgtatcggaggagtcattctctttcatgaaacgctgtaccagaaagccgatgacggccgccccttcccccaagtgatcaagtctaagggcggagtggtgggcatcaaggtagacaaaggggtagtgcctttagccggcacaaatggagagactaccacacagggtttggatggacttagcgagcgttgcgcacaatacaagaaagacggcgcggactttgctaaatggcgctgcgtcctaaagatcggagaacacaccccgtcagctttagccatcatggagaacgccaacgtgctggctcggtatgccagcatctgccagcagaatggtattgtacctattgtcgaacctgagatattacctgacggcgaccacgaccttaagcgttgccaatatgttacagagaaggtgttggcggccgtttacaaggctttgtctgaccaccacatctaccttgagggcacattactgaaacccaacatggtgacacccggccatgcttgtacccagaagttttctcacgaagagatagcaatggctactgtgaccgctctgagaagaactgtcccccctgcagtgaccggtattactttcctgagtggtggccagtctgaggaagaggcgtcgattaatctgaacgcgatcaataagtgtccgctgctcaaaccctgggcactgacattttcttacggccgagcgttgcaagcaagtgccttaaaggcctggggtgggaaaaaggaaaaccttaaagcagctcaggaagagtacgtgaagagagccttggcaaactctctggcatgtcaagggaaatacacacccagcggccaagctggagcagcagcttctgaaagcctgtttgtcagcaaccacgcatac

SEQ ID NO: 5833 - DNA, 1092 bp, Artificial Sequence
  Description of Artificial Sequence: Synthetic coding sequence
atgccgtaccaatatccggccctcactccagaacaaaagaaagaactgtcggatatcgcccacaggattgtagcaccgggtaaaggaattttggcagcagacgagtcgaccggttccattgccaaacggctgcagtctatcggaactgagaataccgaagaaaacaggaggttctacaggcaacttctcctgaccgccgatgaccgcgtgaacccatgcattggcggagtcatcctctttcacgaaactctttaccagaaggcagatgacggacggcccttcccacaagtgatcaagtcgaaggggggcgtggttgggatcaaagtcgataagggggttgtccccctggccggcactaatggagaaaccaccacgcaagggcttgacggtttgtccgaaagatgcgcccagtacaagaaagacggagccgattttgccaagtggcgctgcgtgctcaagatcggagaacataccccttcggcgctggctatcatggagaacgcaaatgtgctggcacgctatgccagcatatgtcaacaaaacgggatcgtgccaatcgtggagccggaaattcttccagacggagatcacgacctcaagagatgtcagtacgtcaccgagaaggtgctggccgccgtgtataaagcgctctcggaccaccacatctacctggaaggaactctgcttaagccgaacatggtcaccccaggacatgcctgtactcagaagttcagccatgaagaaatcgcgatggccactgtgactgccctcagacggacggtgccgccagccgtgacgggaatcactttcctgtcaggaggccagtcggaggaggaagcatcaatcaatctcaatgccatcaacaaatgcccacttctgaagccttgggctctgaccttctcctacggacgtgccctccaggcttcagcactgaaagcctggggagggaagaaggagaaccttaaggccgctcaggaagaatacgtgaaacgcgccctcgcgaatagcctcgcatgtcaaggaaagtacaccccgtcgggacaggccggagctgcggcgtccgaatcactcttcgtgtcgaatcacgcctac

SEQ ID NO: 5834 - DNA, 1092 bp, Artificial Sequence
  Description of Artificial Sequence: Synthetic coding sequence
atgccgtaccagtacccggcgctgaccccggaacagaaaaaggagctgtccgacatcgcccatcggatcgtcgcaccggggaagggaatcctggcggccgatgagtcaactggaagcatcgccaaacggctgcagtccatcggcaccgaaaatactgaagagaatcgccgcttttaccgccagctgcttctcactgctgatgatcgcgtgaacccctgtatcggtggagtgattctgtttcacgagacgctctaccaaaaggccgatgacggacggccatttccccaggtgatcaaatcaaaggggggagtcgtgggcatcaaagtggacaaaggtgtcgtgccgctggcgggaacgaacggcgaaaccactacccaaggtcttgacggactgtccgaacgctgcgcccagtacaagaaggacggggctgatttcgcgaagtggcgctgtgtgctgaagatcggcgagcacaccccttccgcattggcaatcatggaaaatgctaacgtgctggcgcggtacgcatcgatctgtcaacagaatggaatcgtgccgattgtggaaccggagatccttccagatggagatcacgatttgaagcggtgccagtacgtgaccgaaaaagtgctcgctgcagtgtacaaggcactgtccgaccatcatatctacctcgaggggactctcctgaaaccaaatatggtgactccggggcacgcatgcacccagaagttctcgcatgaggagattgctatggccactgtgaccgcgttgcgccgcaccgtgccgccggcggtcactggaatcactttcctctcaggaggacagtcggaggaagaggcatccatcaacctgaatgccatcaataagtgcccgctcctgaagccttgggccctcactttctcctatggacgggctctccaggcctcggcgctgaaggcatggggaggcaagaaggaaaacctgaaggcagcccaggaggaatacgtcaaacgagccctcgccaactccctggcttgccagggaaaatacaccccgtcgggccaggccggagcagccgcgtcagagtccctgttcgtatccaaccacgcttac

SEQ ID NO: 5835 - DNA, 1092 bp, Artificial Sequence
  Description of Artificial Sequence: Synthetic coding sequence
atgccataccaatacccagccctgaccccagagcaaaagaaggaactctcggacatcgcacacagaattgtggccccaggaaaaggtatcctggccgctgatgaatccactggctccatcgcgaagcggctgcagagcattggcaccgaaaataccgaagagaatcggcggttctataggcagctcctcctcactgccgacgaccgcgtgaatccgtgtatcggaggagtcattctttttcatgaaaccctgtaccaaaaagccgacgatggacggccttttcctcaagtgataaagtcaaaaggaggagtcgttgggatcaaggtcgataagggcgtggtccctctggcagggaccaacggagaaacgaccacccaagggctggacggactttcagaacgttgcgcccagtacaaaaaggatggtgccgatttcgccaagtggcgatgcgttttgaaaatcggagaacacaccccgtcggcactggccatcatggaaaacgccaatgtgctggccagatacgcgtcgatctgccagcagaacggcattgtgccaatcgtcgagccggagatcttgccggacggtgatcacgatctgaagagatgccaatatgtgactgaaaaagtcctcgcggcggtgtacaaagcgctctcagaccatcatatctatctggagggaacgctgttgaagccgaacatggtgacccccggacacgcttgcacccagaagttctcccacgaagagattgcaatggcaactgtgaccgctctgcgtcgcaccgtgccacccgccgtgaccggaatcacgtttctgtccggcgggcaaagcgaagaggaagcatcgatcaacttgaatgccattaacaaatgccctctcttgaaaccttgggcccttactttctcatacggacgggcactccaggcgtctgccctcaaggcgtggggtgggaagaaggaaaacctcaaggcggcacaggaggagtacgtgaagcgcgccctcgcgaactctctggcctgtcagggcaagtacactccgtctggacaggctggtgcagcggcttcggaaagccttttcgtgagcaatcacgcttac

SEQ ID NO: 5836 - DNA, 1092 bp, Artificial Sequence
  Description of Artificial Sequence: Synthetic coding sequence
atgccataccaataccccgcacttacccctgagcaaaagaaggaactctccgacattgcacatagaattgtggcacctggaaaaggaatccttgcagcagacgaatccaccggaagcattgctaaaagactccagtcgatcggaaccgagaacaccgaagaaaacaggagattctaccggcaacttctgttgactgcagacgaccgtgtcaacccttgtatcggcggagtgattctgttccatgagactctgtaccagaaggcagacgatggccggcctttccctcaagtgattaagtcgaagggtggagttgtaggtattaaggtggataagggggtcgtgccccttgcaggcactaatggtgaaactaccactcagggactcgatggactttcagaaaggtgtgcgcaatacaaaaaggacggggcggacttcgcaaaatggcgatgtgttctcaagatcggagaacatactccctccgccctggcaattatggaaaacgctaatgtgctggcgcgatatgcatcaatttgccagcagaacggtattgtgcccatcgttgaaccagagattctgccagatggcgaccatgatcttaaaaggtgtcagtacgtgactgaaaaagtgctggcggcagtctacaaggccctctcggaccaccatatctatcttgaaggaacccttctcaagcctaatatggtgaccccggggcatgcttgcactcagaagtttagccacgaagaaatcgcaatggctactgttacggcactgcggcggaccgtccctcctgcagtgactggaataaccttcctgtccggtggacaatcggaggaagaggcatcgataaatctgaacgccattaacaaatgtcctctgctgaaaccatgggccctgacttttagctatgggagggcactgcaagcaagcgcccttaaggcatggggaggtaagaaggaaaatctgaaggccgcccaggaagagtacgtcaagagggcacttgcgaatagcctggcgtgccagggaaaatacacgcctagcggtcaggcaggtgcagcagcctccgaatcgctgtttgtgtcgaaccacgcatat

SEQ ID NO: 5837 - DNA, 1092 bp, Artificial Sequence
  Description of Artificial Sequence: Synthetic coding sequence
atgccataccagtaccctgccctgactccggaacagaagaaggagctcagcgacatcgcgcatcgcatcgtcgccccagggaaaggaatcctggcagctgacgaatcaaccggatcgatcgctaaacgcctgcaatccatcgggaccgagaacaccgaggagaaccggcgcttttacaggcagctgctcctcaccgcagacgatagagtgaatccctgcatcggaggtgtcatcttgttccatgaaaccttgtatcaaaaagcagacgatggacgacctttcccgcaggtgatcaagagcaagggaggcgtcgtgggaatcaaggtggataaaggggtggtgccattggctggtaccaacggcgagacgaccactcaagggctggacggactgagcgaacggtgcgcccaatacaagaaggacggtgccgattttgccaaatggcgctgcgtgctgaagatcggggaacacaccccgtcggcccttgcgatcatggagaacgcaaacgtcctggcccggtacgcttcaatctgccaacaaaatggtatcgtcccgattgtggagccagagattctcccggatggggatcatgacttgaaacgatgtcagtacgtcaccgagaaggtgctcgcggcggtgtacaaggccctctccgaccaccacatctaccttgagggaaccctgctgaaaccgaacatggtcactccaggacacgcttgcacccaaaagttcagccatgaagagatcgcgatggctaccgtgaccgctcttcgccgcactgtgcctccagctgtaactggaatcacgtttctgtcagggggccagtcagaagaagaggcatccatcaatcttaacgcgatcaacaaatgtccactgctgaagccgtgggcgctgaccttttcatacgggcgggcgctgcaggcgtcggccctcaaggcttggggaggcaagaaggaaaatctgaaagcggcgcaggaggaatatgtgaagcgcgccctggccaactcgctcgcctgccaaggaaagtacacccctagcggacaggcaggcgcagctgccagcgagtcacttttcgtgagcaatcatgcgtac

SEQ ID NO: 5838 - DNA, 1092 bp, Artificial Sequence
  Description of Artificial Sequence: Synthetic coding sequence
atgccttaccagtacccagctctgaccccagaacagaagaaagagctttccgatatcgcccatcggatcgtagcacccggcaaaggaatactagcggctgacgaaagcacggggagtatcgccaagcgactccagtctatcggcactgagaacacggaagagaataggaggttctataggcagctcttacttaccgccgatgatcgggtcaatccgtgtatcgggggtgtgatcctttttcacgaaacactgtatcagaaggcagatgacgggcgacctttccctcaagttatcaagagcaaaggtggcgtcgtaggcattaaagttgacaaaggagttgttcccctcgctggcactaatggcgagaccacaacacagggactggatggcctgtcagagcgctgcgctcagtacaaaaaagacggagccgacttcgcgaagtggcggtgcgtcttaaagatcggtgaacacaccccatctgccctggctattatggaaaacgcaaatgtcctggccagatacgcctcgatctgccagcagaacggcattgtgcccatcgttgaaccagagattctccccgacggggatcacgaccttaagcgttgtcagtacgttactgaaaaagttctggctgccgtctacaaagccttgtccgatcaccatatttaccttgaaggaacacttctgaagccaaatatggtgacgccaggtcacgcctgtacccagaaatttagccatgaagagattgccatggctaccgttaccgctctaagacgtactgttccacccgcagtgacaggcattaccttcctcagcggtggacagagcgaggaggaggccagcatcaacttgaacgcgattaacaagtgcccattgctgaagccttgggctctcactttctcgtacgggcgagccctccaggcttctgccctgaaggcgtggggtggtaagaaagaaaatttgaaggcggcacaggaggagtacgtgaaacgtgccctcgccaactcactcgcctgtcagggcaagtacactccatcgggccaggccggagccgcagcttcggaatctctcttcgtgtccaaccacgcttat

SEQ ID NO: 5839 - DNA, 1092 bp, Artificial Sequence
  Description of Artificial Sequence: Synthetic coding sequence
atgccttatcaatatccggctttgactccagaacaaaagaaggagctgagcgatatcgctcacaggatcgtggcccccgggaagggtattctggccgccgatgagagtaccggatcgatcgcaaagaggcttcaatcaatcgggactgagaacacagaggagaaccgacgcttctaccggcagctgctgctgaccgcggatgatcgagtcaatccatgcatcgggggtgttatattgtttcacgaaacactctatcagaaggccgatgatggacgtccattccctcaggtgataaagtcaaagggcggggttgtagggatcaaggtcgacaagggagtagtaccactggctggtacaaatggcgagacaacaacccaaggtctggacgggctgtccgaacggtgtgcccaatacaagaaagacggagccgactttgccaaatggaggtgcgtgctcaagattggtgagcacactccgagcgctctggctatcatggaaaacgctaacgtcctggctaggtatgcctctatttgtcagcagaacgggattgtacctatcgtggagccggaaatactgccagacggtgaccacgacttaaagcggtgtcagtatgtcactgaaaaggtgttagccgccgtgtacaaggcattgtcagatcaccacatttacctggaggggacccttctgaagcctaatatggtgaccccgggccacgcctgtactcagaagttctctcacgaagagattgccatggccaccgtcacagctctgcggcgcacggtccctccagcggtaaccgggatcaccttcttatcgggcgggcaatctgaagaagaagccagtattaacctgaacgctatcaataaatgccccctgttgaagccttgggcgctgacgtttagttatggccgggccctgcaggcctctgcattgaaggcttggggcggaaagaaggaaaatctcaaagccgcgcaggaggaatatgttaaacgagctcttgctaactctctggcctgtcagggaaagtatactcccagtggccaggcaggtgccgccgcctctgaatcactgttcgtgtcaaatcacgcctat

SEQ ID NO: 5840 - DNA, 1092 bp, Artificial Sequence
  Description of Artificial Sequence: Synthetic coding sequence
atgccctaccaatacccagccctgactcccgagcagaaaaaagagctgagcgatatcgcacaccggattgtggccccaggaaaaggcattttagctgccgatgaatctaccgggtcaattgccaagcgactccagagcattgggaccgagaatactgaggagaacaggaggttctacagacagctgctcctgactgctgatgaccgggtgaacccctgtattggtggggtcattctgtttcacgagaccctctatcagaaagccgacgacggcaggcccttcccccaagtgatcaaatctaaaggtggggtcgtggggattaaggtggacaagggggtggtgcctttagcagggactaacggagagaccacaactcagggcctcgatggtctctccgagagatgtgcccagtacaagaaggatggagccgacttcgccaagtggcggtgcgtgctaaaaatcggtgaacatacgccctccgccctcgctattatggagaacgctaatgtgttggccagatatgcgtctatctgccagcagaacggtattgtcccaattgtggagcccgaaattcttcctgacggtgatcacgatctgaagagatgtcagtacgtcacggagaaggtgctggccgctgtatacaaagccctcagcgaccaccacatttaccttgaaggaactctgctcaagccgaatatggtgaccccaggccatgcgtgcacgcagaaattctctcacgaggaaatcgcgatggcgacagtgaccgccctgcgtcgaacagtaccaccagctgtgacgggaataacctttctcagtggtgggcagagtgaagaggaggcgagtatcaatctcaatgctatcaacaaatgcccgctcttgaagccctgggccctgaccttttcctatggtagagctcttcaggcttctgcccttaaggcttggggtggaaagaaggaaaacctaaaagctgctcaagaggagtatgtaaagcgggcattggccaacagcttggcatgtcagggaaagtacacccctagcggtcaggccggggctgctgcatcagagagcctcttcgtatctaatcacgcctac

SEQ ID NO: 5841 - DNA, 1092 bp, Artificial Sequence
  Description of Artificial Sequence: Synthetic coding sequence
atgccatatcaatacccagctctgactccagagcaaaaaaaggaattgtctgacattgcacatagaatcgttgcacctggtaagggaatcttggctgctgacgagagcacaggatccattgctaagaggttacaatctatcggaactgaaaataccgaggagaatcgtaggttttacagacagctcttgctcaccgctgatgatagagtcaatccctgcataggaggtgtgatcctgttccatgaaactctctaccaaaaagcagatgatggacggccgttcccccaagttattaagtcaaagggaggagttgtagggataaaggttgataagggcgtggtcccattggccggaacaaatggagaaacaaccactcagggattagatggactttctgaacgatgcgcccagtacaagaaagatggcgcagattttgctaaatggcgttgtgttctcaagatcggagaacatactcctagcgcattggcgattatggagaatgctaacgtgctcgcccgatatgcttctatttgtcagcagaatggaattgtgccgattgttgaaccagagattctaccagatggtgatcacgaccttaaaagatgccaatatgtcacagaaaaagtgcttgcagcagtgtacaaagcgctgtcagaccatcacatttacctagagggcacactgttaaaaccaaacatggttacaccagggcacgcatgtacacagaaattttcgcatgaagagattgctatggccacagttactgctcttagacgaacagtgccgccagcggttacaggaattacctttctttcaggaggtcagtccgaagaagaagcatctatcaatctcaacgcgattaataaatgtccgttactcaagccgtgggctctcacattttcatatggaagagctctccaggcctccgctctcaaagcttggggaggaaaaaaagagaacctaaaggccgctcaagaagagtacgttaaaagagccctagctaattctcttgcttgtcaaggtaaatatactccatccggacaagcaggggctgcagcttcagagagccttttcgtttcaaaccacgcctat

SEQ ID NO: 5842 - DNA, 1092 bp, Artificial Sequence
  Description of Artificial Sequence: Synthetic coding sequence
atgccataccagtaccccgcgctcactccagagcagaaaaaggaactctccgatatcgcccaccggattgtggctccgggaaagggtattctggctgcagatgaatccaccgggtcaatcgcaaagcgcctgcagagcatcggtactgaaaataccgaggaaaaccgaaggttctaccgccaactcctgttgactgcagatgaccgggtcaacccgtgtatcggtggagtgattctgttccacgaaactctttaccagaaggccgatgacggccgcccgttccctcaggtgatcaagtcgaagggcggagtggtcggaatcaaagtggataagggagtggtgcctctggcgggaaccaatggtgaaaccacgacgcagggactcgatggactctcagaacgctgcgcacagtacaagaaggacggagcagacttcgccaaatggcggtgcgtcttgaagatcggcgagcatactccctccgccctcgccatcatggaaaacgctaatgtcctcgcgcgctacgcctccatctgccagcaaaatggtatcgtcccaattgtggagccagaaatcctcccggatggcgatcacgacctgaagaggtgtcagtacgttaccgagaaagtgttggccgctgtgtacaaggccctgagcgaccaccacatttatctcgaggggaccctgctcaagcccaacatggtgactcctggacacgcttgcacccagaagttctcgcacgaagagatcgctatggcgaccgtgaccgccctgcgccggacggtgcctcctgccgtcaccgggatcaccttcctctcgggaggacaatccgaagaagaggcgtccatcaatctgaatgcaattaacaagtgccctttgctgaagccatgggcgctgactttctcatacggaagagcgctgcaggcatcggccctgaaggcgtggggaggaaaaaaggaaaaccttaaggccgctcaggaggagtacgtgaagcgggctctcgcgaattccctggcgtgtcagggaaagtacaccccgtcgggacaggcaggtgcagcagcatcggaatcgctctttgtgtcgaaccacgcgtac

SEQ ID NO: 5843 - DNA, 1092 bp, Artificial Sequence
  Description of Artificial Sequence: Synthetic coding sequence
atgccctaccaataccccgctctcacgcccgagcaaaagaaagagctttcggatatagcacatcggattgtcgcgccaggtaagggcatccttgcggctgacgagagcacgggatccattgccaagcgactgcaatccatcggtactgaaaatactgaagaaaatcgccgcttttacagacagctccttctgaccgcggatgatagagtgaatccatgtatcgggggcgtgatactgttccatgaaaccttgtaccagaaggccgatgacggccgaccatttccacaagtgataaagtcgaagggaggagtggtgggcatcaaggtggataagggagttgttcctctcgctgggaccaacggagaaaccactactcaggggcttgacgggctctcggaaagatgtgcgcagtacaaaaaggacggagccgacttcgctaagtggaggtgtgtcttgaagattggtgaacacactccatcagcacttgcaatcatggagaacgccaacgtgctggcacggtacgcatctatttgtcagcaaaacggtatcgtgcctattgttgaacctgaaatcctccccgatggggaccacgatcttaaaagatgccagtacgtgaccgagaaggtcctcgcagccgtctacaaggcgctgtccgatcatcacatatatctcgaggggactcttctgaaacctaacatggtgacccctggccatgcatgcactcagaagttttcacatgaggagatcgcaatggcaacggtgaccgcactcagaaggaccgtgcctccagctgtcacgggaattacctttctgtccggaggtcaatcagaagaagaagcctccattaacctgaacgcaattaacaaatgtcctctgcttaagccttgggccctcactttcagctatggtagagcgcttcaagcatctgcgctgaaagcgtggggtggaaagaaggaaaatctgaaggccgcgcaggaggaatacgtcaagcgtgcgctcgccaacagcctcgcctgccaaggaaaatacaccccatcaggccaggctggcgccgctgccagcgaatcgctttttgtctccaatcatgcatac

SEQ ID NO: 5844 - DNA, 1092 bp, Artificial Sequence
  Description of Artificial Sequence: Synthetic coding sequence
atgccttaccagtatcccgcactcacgcctgagcaaaagaaagagctgtccgacattgcccatcgaatcgtggctccaggcaagggtatattagccgcagacgagtctacaggctctatcgcaaagcggctgcaatcaataggcaccgaaaatactgaggagaataggaggttttatcggcaactactccttaccgccgacgatcgagtgaatccatgtatcgggggggtcattctctttcacgagacactgtaccagaaagccgacgatggacggccttttcctcaggtgatcaaatccaaggggggagtcgttggtataaaagtagataaaggcgtcgtccccctcgccgggaccaacggggagaccaccacccaggggctggacggccttagcgagaggtgcgctcagtacaaaaaagacggcgccgacttcgccaaatggaggtgtgtattgaagataggggagcacactccatccgccttggccattatggagaacgcaaatgtactggctaggtatgcctccatctgccaacaaaatgggattgtacccattgtagagcccgagatccttcccgatggcgaccacgacctgaaaagatgccagtatgtgacagagaaagtactggccgccgtgtataaggcactaagtgaccaccatatctacttggaaggcacactgctgaaaccaaacatggtcacaccgggccatgcttgtacacagaaattcagccacgaggaaattgccatggccactgtaaccgccctgcggagaacagtccctccagccgttaccggcataacgtttctctccggcggtcaaagcgaagaagaagcttccattaatctaaacgccattaataagtgtccgctcctgaaaccttgggcgctcacattttcctacgggcgtgctctgcaggcctctgccttgaaggcatggggaggcaagaaagagaatctgaaggccgcgcaggaagaatacgtgaaacgtgcactagcaaattccttggcgtgtcaaggtaagtataccccttcgggccaggccggagccgccgcaagcgaaagtctgttcgtgagcaaccatgcatac

SEQ ID NO: 5845 - DNA, 1092 bp, Artificial Sequence
  Description of Artificial Sequence: Synthetic coding sequence
atgccctaccagtaccccgccctgaccccagaacagaaaaaggaactgtcagatattgcacatagaatcgtggcgccagggaagggaattctcgcagcggacgagagtaccggatcgatagccaagcgcttgcagtccataggtaccgagaataccgaagaaaatcgccgcttttaccgacagctgcttctgactgcagatgatagagttaacccatgtatcggtggtgtcattctttttcatgaaactctgtaccagaaggccgacgatggtcgccctttccctcaagtcatcaaatccaaagggggtgtggtgggtattaaggtggacaagggtgtggtgcccctggccgggaccaatggagaaactactacccaaggacttgatggactctctgaacggtgtgcgcaatacaagaaggacggcgcagattttgccaaatggcggtgtgtcctgaagatcggagagcataccccatcagcacttgctattatggagaacgcaaacgtgctggcaaggtacgcctccatttgtcagcagaacggaatcgtgcccatcgtggaaccagagattctgccagatggggaccatgatctgaagcgatgccaatacgtgaccgaaaaagtgctcgctgcagtgtataaggcgctttcggatcatcacatatacctggaaggaactttgcttaagcccaatatggtgactccaggccacgcgtgcactcagaaattctcgcatgaagaaattgccatggctactgtgactgcattgaggaggaccgtcccacctgcagtgactggtatcacctttctctcgggaggccaatccgaggaggaagccagcatcaaccttaatgcaattaacaagtgcccgctcttgaagccctgggccttgacttttagctacggtcgagccctgcaggcctcagcattgaaggcctggggaggaaaaaaggaaaaccttaaggcggcacaggaagagtacgttaagcgtgcacttgctaactccttggcttgccagggaaagtacaccccctccggccaagcaggagcggcagcctcggaatcactttttgtgtcgaatcatgcctac

SEQ ID NO: 5846 - DNA, 1092 bp, Artificial Sequence
  Description of Artificial Sequence: Synthetic coding sequence
atgccataccaatatcccgctctgacccccgaacagaagaaggagctgagcgacatcgcccaccgcatagtcgcaccaggtaagggaatcctcgcagccgacgagagcactggctccattgctaagaggctgcagtctataggtaccgagaatacagaggaaaatcgtaggttctacaggcaattgctccttaccgctgacgatcgcgtcaacccctgcatcggcggcgtaattctcttccatgagacactgtatcagaaggctgacgacggcaggccctttccccaggtgattaaatcaaaaggaggtgtcgtgggtatcaaggtggacaaaggcgtcgtccccttggctggtaccaacggagagaccaccacccaaggactcgacggcctgtcagagcgctgcgcccagtacaaaaaggacggcgccgatttcgctaagtggcgttgcgtgctgaagataggtgaacacactccctccgccctcgcaatcatggaaaatgccaatgttctggctaggtatgcctctatctgccagcagaacggtatcgtgcccatagttgaaccagaaatccttcctgacggcgaccatgatttgaaaagatgtcagtatgtgacagaaaaagttttggccgccgtttataaggctctttcagatcaccatatatatctggagggtacattgcttaagcctaatatggtgactcctggacatgcatgtacacaaaaattctctcatgaggagatcgccatggctacagtgaccgctctgaggcgcaccgtaccacccgctgtaacaggaattacctttctttcaggtggacagagcgaggaagaagcctccataaacttgaacgcaatcaacaagtgtcccttgctcaaaccttgggctcttaccttctcatacggtcgcgcactgcaggcttccgctctcaaggcatggggtggcaagaaggaaaatcttaaggctgcccaggaagagtatgtaaagagagccctggcaaattcactggcttgccaaggcaagtacactccatctggacaggctggagctgccgctagcgagtccctgttcgtcagtaaccacgcctat

SEQ ID NO: 5847 - DNA, 1092 bp, Artificial Sequence
  Description of Artificial Sequence: Synthetic coding sequence
atgccctaccagtaccctgctctgactcctgagcagaaaaaggagctttctgatattgcccatcggattgtcgctccgggtaagggaatcctggccgccgatgagagcactgggtctatcgctaagaggctgcaatcgatcgggaccgaaaataccgaggaaaaccgccgtttttatcgccaattactcttaactgccgacgaccgagtgaatccctgtattgggggggttatactgtttcatgagacactctatcagaaggcggatgacgggcggccatttccacaggtcattaaatccaagggcggcgtggtgggcataaaggttgataaaggtgtggtacccctggctggtacaaacggagaaactactacacagggactagatggcctgagtgagagatgtgcccagtacaagaaggacggggccgactttgcgaagtggcgttgcgtcctgaagattggggagcacaccccgtccgccttggccattatggaaaacgctaacgtgctggcaagatatgcctcaatttgtcagcagaatgggattgtcccaatcgttgaaccggagatactccctgatggagaccacgatctcaagcgttgtcagtatgttaccgagaaggttttggccgccgtttataaagccctgtcagaccatcatatctatctcgagggaaccctgctcaaacccaacatggtgactccaggccatgcgtgcacacaaaagttctcccatgaggaaattgccatggcaaccgtcaccgccttaagaaggaccgtgccacccgccgtgaccggtatcacctttctgtcaggcggacaaagtgaagaggaggcaagtattaaccttaacgcgatcaacaagtgccctcttctgaagccttgggccctgacgttctcctatggccgcgctttacaggcgtccgccctcaaggcctggggcggtaaaaaggaaaacttgaaagctgcccaggaggaatatgtgaaacgcgcgcttgcaaactctttagcctgtcaaggaaagtacactccctctggtcaggccggcgccgcagcatcagagagtctgttcgtgtcaaaccacgcctat

SEQ ID NO: 5848 - DNA, 1092 bp, Artificial Sequence
  Description of Artificial Sequence: Synthetic coding sequence
atgccctaccagtaccccgcccttaccccagaacagaagaaggaactttccgatattgcccatcggattgtggcacccggaaaaggtattctggcggccgacgaatcaaccggctcgatcgcaaagcggctccaatccattggaactgaaaacacggaggaaaacagacgcttttaccggcagctgctccttaccgcggacgatagagtcaacccatgtattggaggagtgatcctctttcatgaaaccctgtaccaaaaagcagatgacggtcgcccttttccacaagtgataaagtcgaagggcggtgtggtggggatcaaggtggataagggcgtggtgcctctcgccggcactaacggagaaaccacgacgcagggtctggacggcctttcagagcgctgcgcacagtacaagaaggatggagcagatttcgctaagtggaggtgtgtgttgaagatcggagagcacacgccttccgcactggcaatcatggagaacgccaacgtgttggcgaggtacgcatcaatttgtcagcaaaatggaattgtgcctattgtggaaccggaaatcctgcccgatggcgatcatgatcttaagcgctgtcaatacgtgaccgaaaaagtccttgcagccgtgtacaaagcactcagcgatcatcatatctatcttgagggtaccctgctgaaacccaacatggtcaccccaggtcatgcatgtactcaaaagttttcgcacgaagagatcgcaatggcaactgtgactgcactgagaaggaccgtcccaccagcagtgactggtattacttttctttcaggaggtcaatcagaagaagaggcatcgattaaccttaacgccataaacaagtgtcctctccttaaaccctgggctcttacgttttcctacggaagagcactccaggcgtccgcactgaaagcatggggaggtaaaaaggaaaacctgaaggcagcccaagaagaatacgtgaaacgcgcgctggcaaactccctcgcatgccagggaaagtacactccttcgggccaagcgggtgcagcagcatcggaatccctctttgtgagcaaccacgcctac

SEQ ID NO: 5849 - DNA, 1092 bp, Artificial Sequence
  Description of Artificial Sequence: Synthetic coding sequence
atgccctatcagtatcctgccctgacaccagaacagaagaaggagctctccgacatcgcacatcggatagtggcccctgggaagggcatccttgccgcagatgagtccacagggtccatcgccaaacggctacagtcaatcggcactgaaaacactgaagaaaaccggcggttttacagacagctgctgctgaccgctgatgatcgcgtgaatccatgtataggtggcgtcatactcttccatgaaacactgtatcaaaaagccgacgatggccgaccctttccccaggtgattaagagtaagggcggtgttgtggggattaaagttgataagggagttgtcccactggcaggcaccaacggcgagacaacaacccagggcctagatggcctgtctgagaggtgtgctcaatataagaaggatggcgctgactttgcaaagtggaggtgtgtcttaaagattggagagcatacccccagcgccttagctattatggaaaacgctaatgtcctagcccgctacgctagcatatgtcaacagaatggaatagttccaattgttgaaccagagatcctgcccgacggcgatcatgacttaaaacgttgccaatacgtcactgagaaagtgctggctgccgtgtataaggctttatccgatcatcacatctacctggaaggcaccctgctaaagcctaacatggtgacaccgggacacgcctgcactcaaaaatttagccatgaggagattgctatggccacagttacagccctaagaaggaccgtgccccctgccgttactggcataacctttctgtccgggggacaatccgaagaggaggccagcatcaatctgaacgccattaacaagtgcccacttctgaaaccttgggcccttaccttttcctatggccgggccttgcaggcctccgcactgaaggcctggggaggcaagaaggagaacttaaaagctgcccaagaggaatatgtcaaaagggcccttgccaacagcctcgcttgccaaggaaaatatacccccagcggccaggctggcgcagctgccagtgagagcctctttgtctctaatcacgcatat

SEQ ID NO: 5850 - DNA, 1092 bp, Artificial Sequence
  Description of Artificial Sequence: Synthetic coding sequence
atgccctaccagtaccccgcactgacaccagagcagaaaaaagaacttagtgatattgcccatagaatcgtcgcaccaggaaagggtattttggctgcagatgagtcaaccgggtctattgctaaaaggttgcagtcaatcgggaccgagaatactgaagagaatagaaggttctacagacaattactcctgaccgcagatgacagagtcaatccatgtatcggcggtgtcatcctgttccacgaaaccctttaccagaaggctgacgatggaaggccctttccacaggtcataaaatctaagggcggggtggtagggatcaaagtggataagggggttgttcctctagcgggcaccaacggggagaccacgacccagggcctggatggactcagtgagcgctgtgcacagtataaaaaagacggcgctgacttcgccaaatggcggtgtgtgttgaaaataggagaacacacaccttccgcgctggctattatggagaatgccaacgtactggcaaggtatgcttccatctgccagcagaacgggatcgtcccaatagtggagcccgaaatcctgccagacggggaccacgaccttaaaaggtgccagtatgtaaccgaaaaggtgctcgctgcagtttataaggccctatccgaccaccacatttatctggagggaacgctgttgaaacccaatatggttacccctggccatgcatgtacacagaagttttcccacgaagagatcgcaatggccaccgtaacagctctgcggaggaccgtcccaccggcagtaacaggtatcacctttctgtcgggcggccagtccgaggaggaggccagcatcaatctgaatgcaattaataaatgccctctgctaaagccatgggccctaactttctcctacggacgagctctgcaggcaagcgctcttaaggcctggggagggaaaaaggagaatctgaaggcagcacaggaagagtacgtgaagagggccctcgcaaatagtttagcatgccagggcaaatacactccatccggccaggccggtgccgctgcatctgagtcactgttcgtgagcaaccatgcctat

SEQ ID NO: 5851 - DNA, 1092 bp, Artificial Sequence
  Description of Artificial Sequence: Synthetic coding sequence
atgccgtatcaatatccagcactgacccctgagcagaaaaaggagctaagtgatatcgcacacaggatcgtggcacctggtaaaggaattctagctgctgatgaatccactgggagtattgcgaaaagactgcagagcattgggactgaaaataccgaggagaaccgaaggttttatcgccaacttctcctgaccgccgacgatcgagtaaacccctgcatcggcggcgttatcctgttccacgagacgctctatcagaaagctgacgacggcagaccatttccgcaggtgatcaaatcaaaagggggggttgtgggaattaaggttgacaaaggtgttgtgccgttggcaggaactaacggggaaaccaccacgcaaggactggatgggctcagcgagcgatgcgcacagtacaaaaaggacggggctgatttcgctaagtggcgctgtgtactgaagatcggcgaacatacaccatctgctttggcaattatggagaatgcaaacgtgctggcccggtacgcgagcatctgccaacaaaacggcatcgttcccattgtggagccagaaatccttccagacggcgaccacgacctaaaacggtgccagtacgtcaccgaaaaggtactggcagccgtgtataaggcacttagtgaccaccacatttacttggaagggaccctactaaagcccaatatggtcactccaggccacgcatgtacgcagaagttctcccacgaagaaatagccatggccaccgttaccgcactgaggcggacggtccccccagccgttaccggtatcacgttcctgtctggcggacagtccgaagaagaagcttcaattaaccttaacgctatcaacaaatgtcccctgctgaaaccctgggccttaactttctcttacggcagagccctgcaggcctctgctctgaaggcttgggggggtaagaaggagaacttaaaagccgcacaggaggagtacgtaaagcgtgcactcgccaatagcctggcctgccaagggaaatacacaccttcaggccaggcaggagcggcagcttctgaatcactattcgtgagcaatcatgcatac

SEQ ID NO: 5852 - DNA, 1092 bp, Artificial Sequence
  Description of Artificial Sequence: Synthetic coding sequence
atgccctaccagtatccggccttaacccctgagcagaagaaggaactgtcggatattgcacaccgtattgtggctccagggaaggggattctggcagcagatgagtcaacaggatctattgccaagagactgcaatcaattgggaccgaaaataccgaggaaaaccgacggttttatcgccagctacttctcacagctgatgacagggtaaatccctgcattggaggtgtgatattgtttcacgagaccctgtaccagaaggccgatgacgggagacctttcccgcaagtcataaaatctaaaggtggcgtcgtcggaatcaaggtcgacaagggagtggtgcccctcgcaggaacaaacggagagactacaacacaagggctggacggcctcagcgagagatgcgcccaatataagaaagatggagctgatttcgcaaagtggcgctgcgtgctgaaaattggtgaacacacaccctccgccttagccatcatggagaacgcaaacgtgctggccagatatgcatctatttgtcagcagaatggcatcgtgccaatcgtcgagcccgaaatcctgcccgatggagatcatgacctcaagcggtgccagtatgtgacagagaaggtgctggcagcagtctataaagccctcagcgaccatcatatataccttgagggcaccttattgaaaccaaacatggttaccccaggccacgcctgcacgcagaagttctcgcacgaagagattgcgatggcgaccgttaccgcattacggcgcacagtacctccagccgtgactggtatcacctttctgtctggaggccagagcgaagaggaggcttcaattaatctgaatgctatcaacaagtgcccactcctgaaaccatgggcactaacatttagttacggccgagccctccaagcctccgctctcaaagcctggggtgggaaaaaggagaatctgaaggcagcccaggaggagtatgtcaagcgcgccctcgccaactcgctcgcctgccagggaaagtacaccccaagtggccaggccggagcagccgcctcagagtcactgttcgtgtctaaccacgcatac

SEQ ID NO: 5853 - DNA, 1092 bp, Artificial Sequence
  Description of Artificial Sequence: Synthetic coding sequence
atgccctaccaatatcctgcgttaacccccgaacaaaagaaggagctttcagatatagctcatcgaatagtagctcccggtaagggcatacttgcagccgacgagtcaacgggtagtatcgcgaaacgtttgcagagcatcggaactgaaaacaccgaagaaaaccgacgattttaccgacagctgctgctaactgccgacgacagagtgaatccttgtattggaggggtgatcttgtttcatgagaccctttatcaaaaggccgatgacggtaggccctttccccaggtgatcaagagcaagggcggcgtcgtaggcatcaaggtggacaagggagtagtgccactggctggcactaatggagaaacaactacgcagggacttgatggtttaagcgaacgatgcgcacagtacaaaaaagacggggctgactttgcgaaatggagatgtgtgttaaaaattggagagcacacaccttcagccctggctataatggagaacgccaatgtcctcgcgaggtacgcatcaatctgccagcagaatggaattgtgccaatcgtagagccagagatattgcccgacggtgaccacgatttaaaacgctgtcagtatgtcacagaaaaggtgctggccgctgtgtataaggccctgagtgaccaccatatctacctcgagggcacgctcctgaagcccaacatggtgacgcccgggcatgcgtgtacgcagaagttctctcatgaagaaatagccatggcaacagttacagcgctacgtcgaaccgtcccacctgctgtaaccggtatcacttttctgagcggaggtcagagtgaagaagaagcttctatcaaccttaacgccattaacaaatgccctttgctgaaaccctgggccctgaccttttcctacgggcgggcactccaagcctcagcattgaaggcctggggaggtaaaaaggagaatctgaaagctgcccaggaagaatacgtaaagagagctttggccaatagccttgcctgccaggggaagtatactcccagtggacaagccggcgccgctgcaagcgagtctctgtttgtgtctaaccatgcctat

SEQ ID NO: 5854 - DNA, 1092 bp, Artificial Sequence
  Description of Artificial Sequence: Synthetic coding sequence
atgccataccagtaccctgcacttactcccgagcagaaaaaggaactgagtgacattgcccacaggatcgttgcccctggtaagggcatattggcggctgacgaaagcacaggatcaattgcgaagagactgcagagcatcggtaccgaaaacactgaagagaacagacggttctaccgccagctgctgctgacagctgacgaccgcgtaaacccctgtatcggaggcgtgattctctttcacgagactctttatcagaaggccgatgacggccgtccattcccccaggttataaagtctaaaggcggcgtggtgggtatcaaggtggataaaggcgtggtgccgctggcaggcacaaacggggagaccacgacccaaggactcgacggactctctgaacgctgtgctcagtataagaaggatggggctgattttgcaaagtggcggtgcgtccttaagattggggagcacacgcccagtgctctcgccattatggagaacgcaaatgttctggccagatacgcctcaatctgtcaacaaaatgggatcgtccctattgtagagcccgaaattcttcctgatggcgaccacgatcttaagagatgtcagtatgttaccgaaaaggtcctagcagccgtgtacaaagcactgtccgaccaccacatctacttggaggggaccttacttaaaccaaatatggtgacgcccgggcatgcctgcacccagaaatttagccatgaggagatcgccatggccaccgtgaccgccctccgtaggaccgtgccacctgcagttacaggaattacattcttaagcggtgggcagtctgaggaggaggctagtattaacctcaacgctatcaacaagtgccctctcctaaaaccttgggccctcacttttagctacggaagagctctgcaggctagcgctctgaaagcatgggggggtaagaaggagaaccttaaggccgcccaagaggagtatgttaaacgggcgcttgcaaactccctcgcttgtcagggaaaatacaccccctctggacaggcaggtgccgcggcttccgaatctctattcgtatcaaatcacgcatat

SEQ ID NO: 5855 - DNA, 1092 bp, Artificial Sequence
  Description of Artificial Sequence: Synthetic coding sequence
atgccttaccagtacccagcactcactccggagcagaaaaaagagctttcggacatcgcccaccgcatcgtggcgccggggaaaggaatcttggcagcggacgaatcgacggggtcgatcgcgaagcggctgcagtcgatcggaacggagaataccgaagaaaatcgaaggttctacagacaactcctgctcaccgctgatgaccgcgtcaacccatgcatcgggggcgtcatcctctttcacgagactttgtaccagaaagcagacgatggacgcccgttcccccaagtcatcaagagcaagggaggggttgtgggaatcaaagtggataagggagtggtcccactggctggaactaacggagaaaccaccacccagggattggatggactgtccgagagatgtgcgcaatacaaaaaagacggagctgattttgcgaaatggaggtgtgtcttgaaaatcggagagcataccccatcagcccttgctatcatggaaaatgccaacgtactcgcgcgctatgcaagcatctgtcaacaaaatggcatcgtgccgattgtcgaaccggagatcctgccggacggtgatcacgaccttaaacgctgccagtacgtgactgagaaagtgctcgctgcggtgtacaaagctctgtcagatcaccatatctacctggaagggacccttcttaagcctaacatggtgactcccggacatgcttgcactcagaagttcagccacgaggaaatagctatggccactgtgaccgcactgcgccggaccgtgcctcccgccgttactggtatcactttcctctccggaggacaaagcgaggaggaagcgtccataaatctgaacgcaatcaacaagtgcccactgctcaagccttgggcccttaccttctcgtacggaagggcgctgcaagcctccgccttgaaggcctggggcggcaagaaggaaaatctgaaggccgcacaagaggaatacgtgaagcgagctctggcgaatagtctggcgtgccaaggcaagtacaccccgtcaggacaggcgggcgcggccgccagcgaatcactgttcgtgtcaaaccatgcttac

SEQ ID NO: 5856 - DNA, 1092 bp, Artificial Sequence
  Description of Artificial Sequence: Synthetic coding sequence
atgccgtatcagtacccagcattaacaccggaacagaaaaaagaactgagcgatatcgcacacagaatcgttgcaccaggcaaaggcatccttgcggcagatgaaagcaccggctcgatcgctaaacggctgcagagcattggaacagaaaatacggaggagaataggcggttttatcgtcaactcctgttaactgctgatgatcgcgttaacccttgtattggcggagtaatattgtttcacgaaacgttatatcagaaggccgatgacggcagaccttttccccaagttattaagtcaaagggaggggtagttggcatcaaggttgataagggtgttgttccgcttgccggaactaatggagaaacgacgacgcagggactggacggcctttcggaacgttgcgctcaatataagaaagatggtgcggacttcgcgaagtggcggtgcgtcctgaaaataggagaacacaccccttcagccctggcgatcatggaaaatgcaaatgtgctcgcaagatatgcatccatatgccaacagaacggcattgtgccgatcgtagaacctgagatcctgcctgatggagaccatgacctaaaaagatgccaatacgtgacggaaaaagttttggccgccgtatacaaagctctgtcggatcaccatatctacctcgagggtactttactcaaaccaaatatggtcactccgggacatgcatgtacgcaaaaattcagccatgaagaaatcgcgatggcaacagttactgcccttcgcaggacggtgccacctgctgtgacaggcattacgtttctttccggaggacaatcagaagaggaagcatcaatcaacctcaacgccattaataagtgcccgttgcttaaaccgtgggctcttacgttttcctacggcagggcattacaggcaagtgcgctcaaggcatggggcggcaaaaaggagaacctgaaggcggcacaagaggagtacgttaagagagccctagcaaacagcctggcatgtcagggtaagtacaccccgtctggacaggcgggcgccgctgcatcggaatcactatttgtaagtaatcatgcgtat

SEQ ID NO: 5857 - DNA, 1092 bp, Artificial Sequence
  Description of Artificial Sequence: Synthetic coding sequence
atgccataccagtaccccgcccttacacccgaacaaaagaaggaattgtccgatattgcccaccgtatcgtagcacccggcaagggaatcctggccgcagacgaaagcacaggctcaattgcgaagaggctgcagtccatcggtacagagaacactgaagaaaatcgtcgattctacaggcaattgctgctgaccgcggacgatagagtgaacccttgtatcggaggcgtcatacttttccatgaaaccctttatcagaaagccgatgatggccggccctttcctcaggtgattaaatcaaagggaggtgtcgtgggaatcaaagtcgacaaaggagtcgtgcccctagcgggtaccaacggcgagaccaccacacaagggctggatgggttaagtgaacggtgcgcccagtacaaaaaggatggggccgactttgcgaagtggcgctgtgtgctcaaaattggcgaacatacacctagcgctctggctatcatggagaatgcaaacgtcctggctcgttatgcctccatatgccagcagaatggcatcgtgcccattgttgaacctgagatactgccagatggcgaccacgatctgaagaggtgtcagtacgtgactgagaaagtgctggctgctgtgtacaaggcgctttccgatcaccatatttacctcgagggcacgttgctaaaaccgaatatggtaacaccagggcacgcatgtacgcagaaattctcacatgaggaaatcgccatggctacagtcacagcgctgaggcgaacagtcccccctgcagtgaccgggatcaccttcttgagtggcggacagagtgaagaagaggcatccataaacctcaatgcaatcaacaaatgtccattgctaaaaccatgggcactcacattcagctatgggcgcgcactgcaggctagtgcgttgaaagcctggggagggaagaaggagaacctgaaggccgcccaagaagagtacgtgaagagggccctcgccaattcgttggcatgccaggggaagtacactccctcgggccaggcaggagcagcagccagcgagtcactgtttgtgtccaatcacgcatac

SEQ ID NO: 5858 - DNA, 1092 bp, Artificial Sequence
  Description of Artificial Sequence: Synthetic coding sequence
atgccttaccaatacccagcactgactccagagcaaaagaaggagctgtcggatattgcgcatagaattgtggcgcctggaaaagggatccttgccgccgatgagtccaccggttcaatcgcaaagcgcctgcagtccatcggaactgagaatactgaggaaaatagaagattttaccgtcagttgttgctgaccgcagacgatagggtgaacccttgtattggaggagtcatactgttccacgagactctgtaccaaaaggcagatgatggccgcccgtttcctcaggtcatcaagtcaaaaggcggcgtggtgggaattaaggtggataagggtgtggtcccgctggcaggcaccaacggggagactacgactcaaggtcttgacggactgagcgaacgctgcgctcagtacaaaaaagacggcgctgatttcgcaaaatggcgctgtgtgctcaaaattggagaacatactcctagcgcacttgcgattatggaaaatgccaacgtgttggcgagatacgcttccatctgccaacaaaatgggattgtgccgattgtggaacctgagattttgcccgacggtgaccatgatctcaaaagatgccaatacgtcacggaaaaggtgctggcagcagtgtacaaggcactttcggatcatcatatctatttggagggaactctcctcaaacctaatatggttactcccggacacgcatgtacccaaaagtttagccatgaagagatagcaatggctaccgtcactgcccttcggagaactgtgccgccagccgtgacgggtatcacctttctctcaggaggtcaatccgaggaagaagcatccattaacctgaacgcgatcaacaagtgtccgctcctgaagccctgggccctgaccttttcctacggtcgagcgctccaagcatcggcactgaaggcatggggtggtaaaaaggaaaatcttaaagccgcccaggaagagtacgtgaagcgagcactggcaaactccttggcctgtcagggaaaatacacgcctagcggtcaggccggcgccgccgcctcggaatccttgtttgtttccaaccatgcatac

SEQ ID NO: 5859 - DNA, 1092 bp, Artificial Sequence
  Description of Artificial Sequence: Synthetic coding sequence
atgccctaccagtaccctgctcttactccagagcaaaaaaaggagctgagcgacatcgcccatcggatcgttgccccgggcaagggcattttggctgcagacgagtccacaggctccattgccaaacgcctgcagtctatcggaaccgagaacactgaagaaaatcggcgattctatcgccagctgttgctgaccgccgacgatagagttaatccgtgcataggtggagtgattctgttccatgagaccctgtatcaaaaggccgacgacggcaggccattcccacaggtcataaagagtaagggaggagtcgttggaatcaaggtggacaagggagttgtgccgctagcaggcacgaacggagaaaccacaacgcagggtctcgatggtctgtcggagcgatgcgcccagtacaagaaagacggagctgattttgctaaatggcgctgcgtcctgaaaattggcgaacatacaccctcagcgctcgcaatcatggagaacgccaatgttctggcacgctacgcctccatctgccaacagaacggtattgtgcccattgttgaaccggagattctgccggatggcgaccatgacctgaagcggtgccagtatgtaaccgagaaggttctggccgcagtgtacaaggccctgagtgaccaccatatttacctcgagggcacacttctgaagcccaacatggttacaccgggacatgcgtgcacgcagaaattctcgcacgaggagatcgctatggccactgtgacagcgctgaggcgaactgtaccacccgctgtgacgggcatcacgtttttgtcgggtggtcagtctgaggaagaagcctccatcaacctcaacgcaatcaataagtgcccgctgttgaaaccgtgggcacttaccttttcatacggccgggccctacaggcctcggccctgaaggcttggggaggaaagaaggagaatctgaaggccgctcaggaggagtacgtgaagcgcgcccttgccaattccctcgcctgccagggcaagtacacaccttccggccaggcaggcgcagctgcttcggaatcactgtttgtctcaaatcacgcctac

SEQ ID NO: 5860 - DNA, 1092 bp, Artificial Sequence
  Description of Artificial Sequence: Synthetic coding sequence
atgccttaccagtacccagctcttactccggaacagaagaaggagttgtccgatatcgcccacaggatcgtggcgcccggtaaagggatccttgcggccgacgagtcaaccggatctatagcgaagcgcctccaaagcatcggtaccgagaacacggaggagaaccgacgcttctacagacaactgctgctgaccgctgacgatcgcgtgaatccatgcatcgggggagtaatcctcttccacgaaactctgtaccagaaagcggacgacggacggccgttccctcaagtcatcaagtcgaagggcggcgtcgtggggatcaaggtcgacaaaggcgtcgtgccgctggccggtactaacggcgagacgaccacccaggggctcgatggactcagcgaacggtgtgcccaatacaagaaggacggtgccgatttcgccaagtggagatgcgttttgaaaatcggagagcacaccccctcagccctggccattatggaaaacgccaacgtgctggctcggtacgcctcaatttgccagcagaacggaatcgtgccgatcgtggagccagagatacttccggacggggatcacgacctgaagcggtgccagtacgtcactgaaaaggtgctggcggcggtgtacaaagcacttagcgaccaccatatctacttggaaggaactctcctcaagcctaatatggtcactccaggacatgcgtgcactcagaagttttcacacgaagaaattgccatggcgaccgtgaccgccttgcgccggaccgtgccgccagccgtgacgggtatcaccttcctctccggaggacagtcggaggaagaggcatcaatcaacctcaacgcaatcaacaagtgccctcttctcaagccatgggccctgaccttctcctatggcagggctttgcaagcatccgccctgaaggcgtggggaggaaaaaaggagaatttgaaggcggcccaggaagaatacgtgaagagggctctggcaaactcattggcgtgtcagggaaaatacactccgagcggacaagccggcgcagccgcgtcggaatcgctgttcgtgtcaaatcacgcctac

SEQ ID NO: 5861 - DNA, 1092 bp, Artificial Sequence
  Description of Artificial Sequence: Synthetic coding sequence
atgccctaccaataccctgcccttacgcccgagcagaagaaggagctcagcgacatcgcgcaccgtattgtcgctcccggcaagggaatcctcgccgctgacgaatccactggctctattgccaagcgcctgcaatctatcggtacagagaacaccgaagaaaaccgtcggttttaccgtcagctgctcctcactgcggatgatcgcgtgaacccttgtatcggtggcgtaatcctcttccacgagacactctatcagaaggccgacgacgggcgccctttcccccaggtcatcaagagcaagggaggtgttgtgggcattaaggtggacaagggagtcgttccactagctggcaccaacggtgagaccactacccaggggttagacggtctctccgagcgttgcgcgcagtacaagaaggacggagcggatttcgcgaagtggcgctgcgtcctcaagatcggcgaacataccccttcggctctggctattatggaaaacgccaacgtgctcgcccgttacgcctccatctgtcagcagaatggcatcgtcccgatcgtcgagcccgagatcctgccggacggtgaccatgacctaaagcggtgccagtacgtcaccgagaaggtcctcgccgcagtctataaggccctctccgaccaccatatttacctggagggaacactgctgaagcccaatatggtcacccccggtcacgcctgcacgcaaaagttctcccacgaggaaatcgccatggcgaccgtgaccgccctgagacgcaccgtcccgccggctgtcaccggtatcacgttcctgtctggaggtcagagtgaagaagaggccagcatcaatctaaacgccatcaacaagtgccctctactgaagccgtgggcattgacattctcgtatgggcgagcccttcaggcatctgccctcaaggcctggggtggtaagaaggaaaacttgaaggccgctcaggaggagtacgtgaagcgcgcactcgcgaactccttggcctgccagggaaagtataccccatccggccaggccggagccgccgctagcgaatccctctttgtttctaaccacgcgtat

SEQ ID NO: 5862 - DNA, 1092 bp, Artificial Sequence; identical to SEQ ID NO: 5828
  Description of Artificial Sequence: Synthetic coding sequence

SEQ ID NO: 5863 - DNA, 1092 bp, Artificial Sequence
  Description of Artificial Sequence: Synthetic coding sequence
atgccgtatcaatacccagctctgacaccagagcagaagaaggagttgtcagacatcgcccatagaatagtggcccctgggaaaggaattctcgctgcagatgagtcaactggaagcatagctaagaggcttcagtccattggaactgaaaacacagaagagaataggcgcttttacaggcagcttcttttaactgcggacgatagggtaaacccatgcattgggggtgttattcttttccatgagacattatatcaaaaggcagatgatggacgaccttttcctcaggttataaagagcaaagggggtgttgtgggtataaaggttgataagggagtggttccactggctgggaccaatggagaaacaactactcaagggctcgatggccttagcgaaaggtgtgcacagtataaaaaagatggagcggattttgctaaatggagatgtgtcttgaagatcggcgaacacaccccttctgctcttgccatcatggaaaacgctaacgttcttgcaaggtatgcttccatttgtcagcagaatggcatagtccctatcgtcgaaccagaaattctgcccgacggcgaccacgatctaaaacgatgccagtatgtcactgaaaaggtgttggcagccgtgtataaggccctgagtgatcatcatatttatcttgaaggcacgttattgaagccaaacatggttacacctggtcatgcttgcactcaaaaatttagtcacgaggaaattgctatggctaccgttactgctcttagacggacagtgccaccggccgtgactggcataactttcttgtcaggaggacagtctgaagaagaagcctcgattaaccttaatgctattaacaaatgccccttgcttaagccatgggcacttacattcagctatggaagagcattgcaagcgtctgctttgaaggcatggggtggaaaaaaggaaaacttgaaggctgcacaagaggagtacgtcaagcgggcgcttgcaaattcactcgcatgtcagggtaagtataccccaagcggtcaggcgggtgcagctgcatcagaatctcttttcgtgtctaaccatgcttac

SEQ ID NO: 5864 - DNA, 1092 bp, Artificial Sequence
  Description of Artificial Sequence: Synthetic coding sequence
atgccctatcagtatcccgcgctgaccccagaacaaaaaaaggagctgtccgatatcgcccaccgtatcgtggcaccgggaaaagggatcttagctgccgacgagtctactggctccatcgccaagaggctgcaatcgatcggtaccgagaatacagaggagaacagaaggttttatcggcagctcctgctgactgccgacgacagagtaaacccatgcattggtggagtgatcctgtttcacgaaacgctctaccagaaagcagacgatggcaggccttttcctcaggttatcaaatctaagggaggagtagttggtatcaaggtagacaaaggtgtggtacccctggcgggcaccaatggcgagactacaacccagggcttggacgggctctctgagaggtgcgcccagtacaagaaggacggcgcagacttcgcgaagtggcgctgtgttctaaagatcggcgaacatactcctagcgccctggccataatggagaatgctaacgtactagcacgatacgcgagtatttgtcagcagaacggtatagtccctatcgtggagcctgagatactgcccgacggagaccacgacttgaaacggtgtcagtacgtgaccgaaaaagtgcttgcagcagtctataaggcactgagcgaccaccacatttatttggaggggaccctgctgaaacctaacatggtgactcccggacacgcctgtacacagaaattttcccacgaggaaatagccatggccaccgtgaccgcacttcgcaggacagtacctccagcagtcactgggataacctttctgtcaggtgggcagagcgaggaggaagcaagcataaatctaaatgcgataaacaagtgtccactcttgaagccttgggcgttgactttttcctatgggcgggcgctacaggcctcagccttgaaggcatgggggggaaagaaagagaatctgaaagcagctcaggaggaatatgtgaagcgagccttggccaacagtctggcatgtcagggcaagtacacgccctcggggcaggccggtgccgcagccagcgagtcgctgttcgtgtctaaccacgcttac

SEQ ID NO: 5865 - DNA, 1092 bp, Artificial Sequence
  Description of Artificial Sequence: Synthetic coding sequence
atgccgtaccaataccccgcacttacccccgaacagaagaaggagctgtctgacattgcacatcgcattgttgcacccggaaaaggaatcctggcagcggatgagtccactggcagcatagcaaaacgcctgcaatccattggcaccgagaacactgaggaaaaccgccggttctaccgtcaactccttcttactgcagatgatcgggtgaacccatgtatcgggggagtgattttgttccatgaaacgctgtaccagaaggcggacgacggaaggcctttcccacaagtcatcaaatcgaaaggtggtgtggtcggaatcaaggtggataagggagtggtccctctcgcaggaactaacggggaaactaccacccaagggcttgatggtctgtcggaaagatgtgcacaatacaaaaaggatggcgcagattttgccaagtggaggtgtgtgcttaagattggagaacatacccccagcgctcttgcaataatggaaaacgccaacgtcctggccaggtacgcgtcgatttgccagcagaatggtattgtgccaattgtggaacctgaaatccttccagatggggaccatgatctgaagaggtgtcaatacgttaccgaaaaggtcctcgcagcagtgtacaaggcactgtccgatcatcacatctacctcgagggtactctcctgaagccaaacatggtgactcctggacacgcctgtacgcaaaagttttcgcatgaggaaatcgccatggcaacggtgaccgccctcagacgtaccgtgccccccgcagtgactggcattacctttctgtcgggtggacagtccgaagaagaagcaagcattaatctcaatgcaattaacaaatgtccactcctgaaaccatgggcccttaccttttcatacggcagagctcttcaggcctcggcactcaaggcatggggaggtaagaaggaaaaccttaaagcagcacaagaggagtatgtcaagcgagcacttgcaaattcgcttgcatgtcagggaaagtacacgccttcgggtcaagccggcgccgcagcctccgagtcgctgtttgtgtccaaccatgcatac

SEQ ID NO: 5866 - DNA, 1092 bp, Artificial Sequence
  Description of Artificial Sequence: Synthetic coding sequence
atgccatatcagtaccccgccctcacacctgaacagaagaaggaactctccgatatcgcccacagaattgtggcccctggaaaaggaattctcgccgccgacgaatctactggctccatcgccaagcgcctgcagagcattggcactgaaaatacggaggagaatcggcggttttatcgacagttgctcctgacagcagatgacagggtgaatccatgtatcggaggggtgatcctgtttcacgaaactctgtatcaaaaggcggatgacgggagaccctttccccaggtcatcaaatccaagggtggcgtggtcggcataaaagttgataagggggttgtgcctctcgctgggacaaacggcgaaacgaccacacagggcttggacggcctttctgagagatgcgctcagtataaaaaggacggggccgattttgccaagtggcgctgtgtcttgaagataggggaacacaccccatcagcgctggcaattatggagaacgccaatgtcctggctcgatatgctagtatctgccagcaaaatggtatagttccaatcgtggagcctgaaattttaccagacggcgaccatgatttgaagaggtgccagtacgttacagagaaagtgcttgcagcagtttataaggctctgtccgatcaccatatctatctggagggaacattactgaagcctaacatggtgactccgggacacgcttgtacacaaaagttctcccacgaagagattgccatggcaacagtgaccgccttgcggcgcacagtcccgcctgccgtcacaggcataaccttcctttcgggaggtcagtctgaagaagaggcgtccataaacctcaacgccattaacaaatgtccattgctgaaaccttgggcactgacatttagctacggcagagccttgcaggcctctgccttgaaggcatggggagggaagaaggagaacttgaaagcagcacaggaggagtacgtcaaacgtgcgctcgccaactctctggcctgtcaaggcaaatatacgcctagcggacaagcaggtgcagcagcgtccgagagtttgttcgtaagtaatcatgcgtac

SEQ ID NO: 5867 - DNA, 1092 bp, Artificial Sequence
  Description of Artificial Sequence: Synthetic coding sequence
atgccataccagtaccccgcactgacgccagaacagaagaaggaactttccgacatcgcacatagaattgtggcacccggaaaaggcatacttgcagcagatgaaagtactggatctattgccaagcggctgcaatcgattggaacggaaaatacggaggaaaacagaaggttctacagacaattgctgctgactgcagatgacagggtgaatccttgtattgggggagttattctctttcacgagactctgtaccagaaggcagatgatggacgccctttcccacaggtcatcaaatcaaaaggaggggtcgtgggtattaaggtggataagggggtggtgcctctcgccggtactaacggagaaaccactacccaagggctcgatgggctctcagaacggtgtgcacaatacaaaaaggacggagcggactttgcgaaatggaggtgcgtgctgaagatcggagagcacaccccttccgcacttgcaattatggaaaacgctaatgtgctggcgcgctacgcatccatctgtcaacaaaacgggattgtcccaatcgtagaaccagaaattctgccagatggcgatcatgatttgaagcgttgtcagtacgtgactgagaaagtcctcgccgccgtctacaaagcattgtcggaccaccatatctaccttgaaggaacgcttctgaagcctaatatggtgactccgggtcacgcatgcacccagaagttttcccatgaggagatcgctatggcgactgtgaccgccctccgcagaaccgtgccgcccgcggtaaccggcatcaccttcctgagcggtggtcagtctgaagaggaggcgtcaattaacctgaatgcgattaacaagtgcccactcctcaaaccgtgggcgttgactttttcatatggacgtgctcttcaagcaagcgcgctgaaggcatggggtggaaagaaggagaacctcaaggcagctcaggaggaatacgtgaaacgggcccttgcaaactccctcgcatgtcaaggaaagtacactccctcgggccaagccggtgctgccgcatcagagtcacttttcgtctcaaaccatgcttac

SEQ ID NO: 5868 - DNA, 1341 bp, Artificial Sequence
  Description of Artificial Sequence: Synthetic coding sequence
atgtccgcgtctaagattcctttgttcaagatgaaggacctgattctcatcctgtgcctgctggaaatgtccttcgccgtgcctttcttcccgcagcagtcaggtacacccggtatggccagtctgtccctggaaacaatgaggcaactcggtagtctccaaaggctgaacaccctgtcccagtactcaaggtacggttttggaaagtctttcaactctttgtggatgcacggactgctcccccctcacagctcactgccctggatgaggccacgcgaacatgagacccaacagtatgagtactctttgcccgtgcatccacctcctttgccgtctcagcctagcctgaagccgcaacaacccggacttaaaccatttttgcagtccgccgccgctactaccaaccaggccaccgccttgaaggaagcacttcagccacccatccatctcggtcacctgccgctccaagaaggcgaactgcccctggtgcagcaacaagtcgcaccctctgacaaaccaccgaaaccagaactgccaggcgtagattttgctgacccacaaggtccaagcctccccggcatggactttcccgacccacagggcccttctctgccaggtcttgattttgcagatccccagggttccaccatctttcagattgccagattgatctctcacggcccgatgccacagaataagcagtctcctctctatcctggtatgctgtacgtgccattcggtgctaatcaacttaatgctcccgctcgcctcggtattatgagtagcgaggaagtggccggcggaagggaggaccctatggcttatggcgcgatgttccctggcttcggaggtatgcgccccggatttgaaggcatgccgcataacccggccatgggtggtgattttacactggaattcgattctcctgtcgctgctacaaaaggccctgagaacgaggaaggcggagcccaaggcagtccaatgcccgaggctaaccccgataacctggagaaccccgccttcctgactgagcttgagcctgccccccacgctggtctgttggcgcttccaaaggatgacataccgggcctgccaagaagcccctccggcaaaatgaaaggtcttcccagtgtgacgccagctgccgccgatcctttgatgacccctgaactggccgacgtgtataggacctacgacgctgatatgactacgtctgtggactttcaagaggaggcaacgatggataccacaatggctccgaattccctgcagaccagtatgcccggcaataaggctcaggagcccgagatgatgcatgacgcttggcacttccaggagcca

SEQ ID NO: 5869 - DNA, 1341 bp, Artificial Sequence
  Description of Artificial Sequence: Synthetic coding sequence
atgagcgcgagtaagattccactcttcaagatgaaagacctgatcctgattctctgcctgctcgagatgtcatttgcagtgccttttttcccgcaacaaagcggcaccccgggaatggcctcactctccctcgagactatgcgccagctgggttcactgcagcggctgaacaccctgtctcagtattcaagatacggcttcggaaagtcttttaactcactgtggatgcacggattgttgccgcctcactcctcgctgccttggatgcgcccacgggaacacgaaacccagcaatacgaatactcgctgcctgtccacccgcctccactgccatcacagccgtccctcaagcctcagcaaccaggactcaagccattcctccaaagcgcggcagcaactaccaaccaagcgactgccctgaaagaagcgcttcaacccccgattcatctcgggcacctgccactccaagaaggagagctcccgctggtgcagcagcaggtggctccgagcgacaaaccgccgaagccggaactgcccggagtggacttcgccgatccccagggaccatcgctgccaggaatggatttcccggacccacaaggcccttcgctgccgggcctggatttcgccgatccgcaagggagcacgattttccagatcgccagactgatatcacatggaccgatgccccagaacaagcaatcaccgctgtacccgggaatgctttacgtgccattcggagccaaccaactgaatgcccctgcccggctcgggatcatgtcgtcggaagaggttgcaggaggccgcgaggaccccatggcatacggagcaatgttcccaggtttcggagggatgcggccgggatttgaaggaatgccacacaacccggcgatgggaggagatttcacccttgagttcgacagcccagtcgccgcaaccaagggaccggagaatgaagaaggaggggcccagggatccccgatgccggaggcaaatccggacaacctcgagaacccggcatttctcaccgagctggaaccagcgcctcatgccggattgctcgccctgcctaaggatgatatccctggtctgccacgctcgccttcaggaaagatgaaaggcctgccgtccgtgactccggcagcggccgacccgctcatgaccccagagctggccgacgtgtacaggacttacgacgccgacatgaccaccagcgtggacttccaggaagaagctaccatggacactactatggctccgaattcactgcagacgtccatgccgggaaacaaggcccaggaaccggagatgatgcacgacgcgtggcactttcaagagcct

SEQ ID NO: 5870 - DNA, 1341 bp, Artificial Sequence
  Description of Artificial Sequence: Synthetic coding sequence
atgagcgctagcaaaatacccctcttcaaaatgaaggacctcatcctcattctctgcctgctggagatgagtttcgccgtaccatttttccctcagcagagtggtactcctgggatggcatctctcagcctggaaacgatgcggcagcttggctctttgcagcgactgaatacactatcccagtactccagatacggattcgggaagagtttcaatagcctttggatgcatggactgctgccaccgcacagtagcttaccttggatgagaccaagggagcacgaaactcaacagtacgaatacagtctgccagtccacccgcctcctctgccttcacagccctcactgaagccccagcagcccggactgaaaccattcctccagtctgccgctgccactactaatcaggctaccgctctgaaggaagccctgcagccgcctatccatctgggccacttgcctttacaggagggcgagctgcccttggtgcaacagcaggtggctccatctgacaaaccaccaaagcccgagctgcccggggtcgatttcgccgacccacagggtccttctttaccgggcatggatttccctgacccacaagggccgtctctccccgggctggacttcgccgacccacagggctctacgattttccagatcgcaaggctgatttctcatggccccatgccgcagaataagcagtctccactctaccccgggatgttatacgttcctttcggcgccaatcaacttaatgctcccgctcgtctgggaatcatgtcgtccgaagaagttgccggtggaagagaagatccaatggcgtatggggctatgtttcccggcttcggggggatgcgacctgggtttgagggaatgccccacaaccctgctatgggaggggactttaccctcgagtttgattctccagtcgccgctacgaaggggcccgaaaacgaggagggtggtgcccagggaagccccatgccggaggcaaatccagataatcttgaaaacccagcctttttgaccgagttggagcccgctccccatgccgggctgctggccctgcctaaggatgatattcccggtttgcctcgctcccctagcggtaagatgaaaggattgccgtctgttacccccgccgcggccgacccactgatgacccctgagctggcggatgtctacagaacttacgatgctgatatgactacaagcgtggacttccaggaggaagcaaccatggacaccacaatggcccccaatagcctacaaacttctatgcccgggaataaggcgcaggagccagagatgatgcatgacgcttggcatttccaagagcct

SEQ ID NO: 5871 - DNA, 1341 bp, Artificial Sequence
  Description of Artificial Sequence: Synthetic coding sequence
atgtcggcctcaaagatccccctcttcaaaatgaaagaccttatccttattctgtgtctgctcgaaatgtcgtttgccgtccccttttttccacagcaatcaggtacccctggcatggctagcctttccctggaaaccatgcggcagctgggatcgctgcagaggctgaataccctgagccaatactcccgctacggcttcggaaaatcgtttaactccctctggatgcatggtttgctgccgccgcactctagccttccgtggatgcgtcctagggaacatgagactcagcaatacgagtactcactgccggtccatcctccacctctgccatcacagccatccctcaagccccagcagccagggctgaagccgttcttgcaaagcgccgccgcgacgactaaccaggcgacggcactcaaagaagcgctgcaaccgccaatccatctgggacaccttccactgcaagaaggagaattgccactggtgcaacagcaagtggcaccgtccgataagcctcccaagccggaactgccaggagtggattttgccgacccacagggaccttccctcccgggaatggatttcccagacccccaaggtcctagcttgccaggcctggacttcgccgacccgcaaggatcgaccatcttccagatcgcccgcctcatctcacacggaccaatgccgcaaaacaagcaatcccctctgtacccaggaatgctgtacgtgccgttcggagccaaccagctcaacgccccagcacggctgggaatcatgtcgagcgaggaagtggcgggcggacgcgaggaccctatggcttacggggccatgttcccgggattcggaggaatgcgccctggattcgaaggcatgccgcacaacccggccatgggtggagacttcaccctcgaatttgactctccggttgccgcgactaagggaccggaaaacgaagaaggaggagcccaaggaagcccaatgcccgaggccaaccccgacaatctggaaaacccggcgttcctcaccgaacttgagccagcaccgcatgcgggcctgctggccctgccgaaggatgacatcccaggtctgccccgcagcccgagcgggaaaatgaagggactgccgtccgtgaccccagccgccgcagatccattgatgaccccggagctcgcagacgtctaccggacttacgatgctgatatgaccacctccgtggacttccaggaggaggcaactatggataccactatggctccgaactccctgcaaacttcgatgccaggaaacaaggcacaggaaccagagatgatgcacgacgcttggcacttccaggagccg

SEQ ID NO: 5872 - DNA, 1341 bp, Artificial Sequence
  Description of Artificial Sequence: Synthetic coding sequence
atgtcggcctcgaaaatcccgcttttcaaaatgaaggatctcatcctcatcctgtgcctgctggaaatgtccttcgcggtgcccttttttcctcaacagtcgggaactccgggcatggcttccctttcgctcgaaactatgcggcagctcggctcacttcaaagattgaacactctgagccaatactcccgctacggctttggcaagagctttaattctttgtggatgcacggactgctcccgcctcactccagcctgccgtggatgcgcccgcgagaacacgaaacccagcagtacgaatacagtctgccggtccaccctccgcccctgccgtcgcagccatccctgaagcctcagcagccgggactgaagccattcctgcaatccgccgcggcaaccacgaaccaagccactgcgctgaaggaagctctccaaccgccaatccatttggggcatctgccactccaagaaggtgaactcccactggtccagcagcaggtggcgccctcagacaaaccaccaaaaccggaactcccgggcgtcgatttcgccgatccacaaggaccgtcattgccggggatggacttccccgaccctcagggacctagcctcccaggactcgacttcgcggaccctcaagggtcgaccatcttccaaatcgcacgcctgatctcgcacggcccgatgccgcaaaacaagcagtccccgctgtaccctggaatgctctacgtgccgttcggtgccaaccagctgaacgcaccggcccgcctgggaattatgtcctcagaagaggttgccgggggaagagaggacccaatggcatatggagcgatgtttccgggattcggaggcatgcggcccggattcgagggtatgccgcataatccggcaatggggggagactttactctggaattcgactcgcctgtggcggcgaccaaaggacccgagaatgaggagggtggggcgcagggatcacctatgccggaagccaatccagacaacctggagaatccggctttcctgaccgagcttgagccagccccgcatgccggattgctggccctgccaaaggatgacattccaggactgccaaggtcccccagcggtaagatgaagggcctgccctcggtgacccctgccgcagccgaccccctcatgaccccggagcttgctgatgtgtaccggacctacgatgcagacatgactaccagcgtggatttccaggaggaagctactatggatactacgatggccccaaacagcctccagacctcaatgcctggcaacaaggctcaggagccagaaatgatgcacgacgcctggcacttccaggaaccg

SEQ ID NO: 5873 - DNA, 1341 bp, Artificial Sequence
  Description of Artificial Sequence: Synthetic coding sequence
atgtctgctagcaagattcctctgttcaagatgaaggatcttattctcatcttgtgcctcctagaaatgtctttcgccgtgcctttcttcccacaacaatcaggtactcctggaatggccagtctttcactggaaacgatgcgccaattgggttcgcttcagcggttaaatacactctcacaatattctagatacggatttggaaaatctttcaactccctgtggatgcatgggttacttcctcctcacagttctctgccttggatgaggcctagagaacatgaaacccaacagtatgagtactcattaccagtccaccctcctccactcccttctcaaccgtcgctaaagcctcagcagcctggactcaaacccttcttgcagtcagcagcagctaccaccaaccaagctaccgcgcttaaagaagcattgcagccacctattcatctcggacacctcccattgcaagaaggagagcttcctttggtccaacaacaagttgcaccttccgataagccacccaagccggagcttccaggcgtcgattttgctgacccacagggtccttcactacccgggatggatttccccgatcctcaaggtccaagtcttccgggtcttgattttgcagatcctcaaggatcgacaattttccaaatagctcgtctgatatcgcacggcccaatgccccaaaacaaacaaagtccactatatcctggtatgctctacgtgccattcggagctaatcaattgaacgcacctgcgcgtcttggtattatgagtagcgaagaggtggcaggaggtcgtgaggacccaatggcgtacggggcgatgtttcctggatttggtggtatgaggcctggctttgaggggatgccacataatccagctatgggtggagatttcactttggagtttgatagcccagttgcagccacaaaaggtcctgagaatgaagaggggggcgcacaaggctcaccaatgcccgaggcaaacccggataaccttgaaaacccagcattcctcacagagttggagccagctccacatgcaggacttttggctttgccaaaggatgatattcctggcctacctcggtctcccagcggtaagatgaaaggtttacctagtgtgaccccagcagccgctgatccactaatgacaccggaacttgcagatgtctatcgtacatacgatgctgatatgaccacatcagtcgatttccaagaggaagccacaatggatactacaatggctccgaactctttgcaaacctccatgcctggaaacaaagctcaagagccagagatgatgcacgatgcttggcatttccaggaaccc

SEQ ID NO: 5874 - DNA, 1341 bp, Artificial Sequence
  Description of Artificial Sequence: Synthetic coding sequence
atgagcgctagcaagattcctttattcaagatgaaggatcttatactcattctatgtctcttggaaatgagctttgcagtccccttcttcccccagcagtccggtacgccggggatggcgtctctctctttagaaacaatgcgtcagctaggaagccttcaaagactgaatacattatcccagtattctcgttacggtttcggcaagagcttcaatagcctgtggatgcatggactgctcccgccgcattcctcactgccatggatgagaccacgtgagcatgagacccagcaatatgagtactccctccccgtgcatccaccccctctgccgtcccaacccagtctgaagcctcagcagcctggtctaaagccgttcctgcaatctgcggccgcaactacaaaccaggctaccgcactgaaggaggcactccaacctccaatccatctagggcatcttccactgcaggagggagagctgcccttggtccaacagcaggtggccccgagcgataaaccgcctaagccggagctcccgggagttgacttcgctgatcctcagggcccctcgctacctggtatggattttcctgatccccaaggaccaagcttgcctggattggatttcgccgacccgcaaggatccacaatattccaaattgcacgtctaattagtcacgggccgatgccacaaaataagcaatcacctttgtacccaggcatgctatacgttcccttcggtgcgaaccaattgaacgctccagctaggcttggcatcatgtcttccgaagaagtcgcaggaggcagagaggatcctatggcctacggtgccatgtttcccggtttcggtggcatgcgcccaggttttgagggcatgccacacaacccggctatgggtggggacttcacactcgaatttgatagccccgtggccgcaacaaagggtccagagaacgaggagggcggagcacagggatcgcccatgccagaggccaaccccgataacctggagaacccggcgttcctcactgaactcgaacctgcgccacatgcaggtcttctcgccctacctaaagatgacatccctggtttgcctagatcccctagtggtaagatgaaggggctgcctagcgtcacaccggctgcggccgatccgcttatgacacccgaactcgctgatgtgtaccggacatacgatgcagacatgacaacgagtgtggactttcaggaagaagctactatggacacaacaatggcgcccaactcgcttcaaacatctatgcccgggaacaaagcacaggaacccgagatgatgcacgatgcgtggcatttccaggaaccg

SEQ ID NO: 5875 - DNA, 1341 bp, Artificial Sequence
  Description of Artificial Sequence: Synthetic coding sequence
atgagcgcctcaaaaatccccctgttcaagatgaaggacttgatattgattctgtgcctgttggagatgtcttttgccgtgcctttctttccacaacaatccgggacgcctgggatggccagccttagtctagagaccatgagacagctgggaagcctccagcgactgaacaccctgagccagtacagtaggtacggatttggtaaatcttttaactctctgtggatgcacggccttctgcctccccatagcagtttaccttggatgaggccacgagaacacgaaacgcaacaatacgagtactctcttccagtgcacccccccccgctgccttcccagccttctttgaaacctcagcagccaggactcaaaccatttttacaatcagccgctgccacgaccaatcaggcgacggccctgaaggaggctctgcagcctcctattcacctcgggcacctcccactgcaggaaggggaactccctctggtgcaacagcaggtcgccccatctgacaaaccgcccaagcctgaacttcccggagtggactttgccgatccccaaggccccagtctcccaggtatggatttccctgacccacaagggcccagtctcccgggcctcgattttgcagatccacaagggtcaacaattttccaaatcgccaggctgatatcacacggacccatgcctcaaaataaacagtcaccattgtatcctgggatgctgtatgtgcctttcggcgccaaccagctgaatgcacccgctcgcctaggaatcatgagctcggaggaagtcgctggcggacgcgaggaccccatggcatatggagccatgttcccgggtttcggaggtatgagacctggtttcgagggaatgcctcacaaccctgccatgggcggggacttcaccctagagtttgattctcccgtggccgcaactaagggcccagaaaacgaagaggggggagctcaggggtctccgatgccagaggccaatccggacaatttagaaaaccccgccttcctaactgagctagaaccagctcctcacgccggtctactggccctgcctaaagacgacatcccgggccttcctcgctctccgtccggcaagatgaaggggctgccaagcgtcaccccagctgctgcggacccgctgatgaccccggagttggctgacgtctatagaacctacgatgctgatatgacaacctccgttgattttcaagaagaagcgacaatggataccaccatggcccctaattctcttcagacgagcatgcccggcaataaagcccaggagcctgagatgatgcacgacgcatggcactttcaggagccc

SEQ ID NO: 5876 - DNA, 1341 bp, Artificial Sequence
  Description of Artificial Sequence: Synthetic coding sequence
atgtctgcttctaagataccactttttaaaatgaaagatcttatccttatcctatgtcttttagaaatgtcatttgcagttccattttttccacaacaatctggaacacctggaatggcatcattaagtttagaaactatgagacaactcggaagtctacaaagacttaatacattatcacaatattcaagatatggattcgggaagtctttcaattctttatggatgcatggattattaccacctcatagtagtttaccatggatgagacctcgtgaacatgaaacccaacaatatgaatattcacttccagtacatcctccaccattaccatctcaaccttcattaaaaccacaacaaccaggattaaaaccattcttacaatctgcagcagccactacaaaccaagcaactgcacttaaggaagctttacagccaccaattcatttaggacatcttccattacaagaaggagaacttcctttggttcaacaacaagtagctccatcagataaaccaccaaaaccagaattaccaggagttgattttgcagatccacaaggtccttcccttccaggtatggattttccagatccacagggtccatctttaccaggattagatttcgcagaccctcaaggttcaacaatctttcaaattgctagattaatttctcatggacctatgccacaaaataaacaaagtccactttatcctggaatgttatatgttccatttggtgccaatcaactaaatgctcctgcaagattaggaattatgtcatctgaagaagtagctggaggaagagaagatccaatggcatatggagctatgttcccaggatttggaggtatgagaccaggttttgaaggaatgcctcataatccagctatgggtggagattttacgcttgaatttgattcaccagttgctgcaactaaaggacctgaaaacgaagaaggtggagctcaaggttcaccaatgccagaagcaaatccagataatcttgaaaaccctgcatttttaactgaattagaaccagctccacatgctggtttacttgcattacctaaagatgatatacctggtttaccaaggtctccatctggaaagatgaaaggattaccttcagttacaccagctgctgctgacccattaatgactcctgaacttgctgacgtatatagaacgtacgatgctgatatgacaactagtgtagatttccaagaagaagctactatggatactacaatggctccaaattctttgcaaacatctatgccaggaaataaggcacaagaaccagaaatgatgcatgatgcttggcattttcaagaacca

SEQ ID NO: 5877 - DNA, 1341 bp, Artificial Sequence
  Description of Artificial Sequence: Synthetic coding sequence
atgagcgcctccaagatacctctgttcaaaatgaaggatctgattttaatcttgtgcctacttgagatgtctttcgctgttccattcttcccacagcaatcgggaacacctggtatggcctcgctgtcgctagaaactatgcgccagctcggatctctgcaaaggctgaataccctgtcgcagtactcccgatacgggtttggaaagtcttttaactctctgtggatgcatggcctccttccacctcacagctcgttgccatggatgaggcccagagagcacgagacacagcagtacgaatactctcttccggtgcaccctccccccctgcctagccagccaagcctgaagccacagcagccaggtctaaagccctttctgcaatctgccgcggccacaactaaccaggcaactgcactgaaggaggctctacagcccccgattcacctgggacacttaccactgcaggagggcgaactcccactggtgcagcaacaagtcgccccaagcgataagccccctaagcctgaattacccggtgttgacttcgccgacccacagggtccttcactgcctgggatggattttccagatccacagggcccgagtctacccggcctggattttgcagaccctcagggctcaaccattttccagattgcccggctgatcagtcacggaccaatgcctcagaacaaacagtcgccgctttacccaggcatgttatatgtgccttttggcgctaatcaactgaatgcaccagcccggcttggaatcatgtcaagtgaagaggtagccggcggtcgtgaggaccccatggcttatggcgctatgtttcccgggttcggagggatgcgcccgggattcgaagggatgccccataacccggcaatggggggagacttcaccttggagttcgattctccagtggctgccacaaagggaccagaaaatgaggagggcggcgctcaaggcagccctatgcccgaagctaacccagacaatctcgaaaatcccgcttttctgaccgagctggagccagccccgcacgccggactcctagctctgcccaaggacgatattcccgggctgcccaggagcccatctggaaagatgaaagggctcccctcggtgactcctgccgccgccgacccgctcatgacaccagaactcgccgatgtgtaccggacctacgatgctgatatgacaacaagtgtggatttccaggaggaggccaccatggataccacaatggcacctaactcacttcagacatccatgcctggcaacaaggctcaggaacccgaaatgatgcacgacgcctggcactttcaagagcct

SEQ ID NO: 5878 - DNA, 1341 bp, Artificial Sequence
  Description of Artificial Sequence: Synthetic coding sequence
atgtcagcttccaaaatccccctgtttaaaatgaaagacttaatcctgattttgtgtctgctagagatgtcattcgctgtgcccttctttcctcagcagtctgggacccctggaatggcctccctgtctttggagaccatgaggcagctgggttctctgcagcgtttgaatacgttatctcagtactcaagatacggattcggcaagtccttcaactccctctggatgcacggcttattgcccccgcacagctccctgccttggatgagaccccgcgagcatgagactcaacaatacgaatactcgctgcccgtccatccaccgccactcccctctcagcccagcctgaagccacaacaacctgggctgaaacctttcctccagtccgccgcagcgaccacaaaccaggcgaccgcactcaaagaggccctgcagccacctatccatctagggcacctccccttgcaggagggagagctaccactggtacagcaacaggtcgcaccctccgacaagccccccaagcctgaactcccgggagtagactttgcagacccacagggcccatcccttcctggaatggacttccccgatccccagggtccctctctgcctggtctagactttgcagatccacaaggctccactatttttcagatcgctagactgatatcacatgggcctatgccgcagaacaagcaatctccactgtatcccggtatgctttacgtgcctttcggcgcaaatcagctgaatgcacccgcacgactgggcattatgagctcggaagaggtagcaggcggcagagaggacccaatggcctacggggctatgttccccggttttggaggcatgaggcccggcttcgagggaatgccccataatccggccatgggtggcgacttcaccctcgaatttgattctccagtcgccgcaactaaggggccggagaacgaggagggaggggcgcaaggcagccctatgcctgaagctaaccccgataacttagagaacccagcctttctgacagaactggaaccagcaccacacgctgggctgttagccctccccaaggacgatatccccggcctgccacgcagcccaagtggcaaaatgaaagggttacctagcgtcacacctgccgccgccgatccgctcatgacacccgagctcgctgatgtatacagaacatatgatgcagacatgaccacctctgtagattttcaggaggaagctacgatggatacaaccatggcccctaatagcctacagacttccatgccgggaaacaaggcccaggagccagaaatgatgcatgacgcctggcacttccaagaacct

SEQ ID NO: 5879 - DNA, 1341 bp, Artificial Sequence
  Description of Artificial Sequence: Synthetic coding sequence
atgagcgcatccaagatcccgttgttcaagatgaaggatctgatcctcatcctgtgcttgcttgagatgagcttcgctgtccccttttttccccaacagtcgggtacacccgggatggccagcctgtcgctggagactatgcgccaactaggatctctccagcgcctgaataccttaagtcagtactcgagatacgggttcggcaaatcattcaactctctctggatgcatggccttctgcccccgcattctagcctaccctggatgcgacctagagagcatgagacgcagcagtacgagtatagcttgccagtgcaccctcctcctctgccaagtcagccctctcttaagccccagcagcccggtttgaagccattcctacaaagtgccgctgccacaacgaaccaggctacagccttgaaggaggcgttgcaaccgccgatccatctcggccatctacctctccaggagggggaattgccactcgtgcagcagcaggtggccccctcggataaaccgcccaaaccagagctacccggtgttgattttgccgacccgcaaggacccagcttgcccggtatggacttcccagacccccaaggcccgagcctgcctggtctggacttcgctgacccacagggcagtacgatcttccaaattgcccgtctgatatcccatggcccaatgccacaaaacaaacagagccccctgtaccccggaatgctgtacgtgcccttcggtgctaaccagctcaatgcgccagcgcggttaggtattatgtcttctgaggaagtggctggcggccgtgaggatccaatggcctacggagcgatgttcccgggattcggcggaatgcggccgggtttcgaaggcatgccacacaatccggccatggggggagacttcaccctggagttcgattctccggttgctgctactaaaggcccagagaacgaagagggaggcgctcaaggctcgcccatgccggaggccaaccccgataatctagaaaacccagcattcttgacagagctcgagcctgctccccatgctggcctgcttgcgttgcccaaagacgacataccgggattgccgcgctccccaagcggtaagatgaagggactgccctccgttacccccgcggcagccgatccactgatgacccccgagctggcagatgtctacagaacatacgacgccgatatgacgacctcggtagattttcaggaggaggccacgatggatacaaccatggccccgaatagtctacaaacatcgatgccgggcaataaggcccaggagcccgaaatgatgcacgacgcctggcatttccaggagcct

SEQ ID NO: 5880 - DNA, 1341 bp, Artificial Sequence
  Description of Artificial Sequence: Synthetic coding sequence
atgagcgcgtcaaagattccccttttcaaaatgaaggatctcattcttatactttgtctgttggaaatgtcgtttgcagttcccttttttccccaacaatcaggaactccagggatggcttcactgtcactggaaaccatgagacagttggggtcgcttcagcgcctgaacacgctgtcacaatacagcagatatggatttggaaagtcctttaactccctgtggatgcacggactgctcccaccgcatagctcactcccatggatgcggccgagagaacatgaaacccaacaatacgaatactcccttcctgtccatcctccgcctctgccttctcagccaagcctcaagcctcagcaacctggactgaagccatttctgcaatccgccgcagcaactaccaatcaggctacggcgcttaaggaggcacttcaacccccaatccacctcggacacctgcccctgcaggagggcgaattgccgctggtccagcagcaagtggctccctcggataagccccctaagccagagcttcctggcgttgactttgcggacccacagggtcccagccttcccggaatggattttccggatcctcagggaccatcccttcccgggctggacttcgccgatccccaagggagcactattttccaaatagcacgcctgatttcacatggtcctatgccccaaaacaaacaatcccctctttacccaggcatgctttacgtcccctttggtgcaaaccaactgaacgcacctgcgcgtctgggcattatgtcgtcggaggaagtggcaggtgggcgggaagatcctatggcgtacggagcaatgttcccgggatttgggggaatgcgaccgggttttgaaggtatgcctcacaatcccgcaatgggaggcgacttcaccctggaatttgattcaccagtggccgcaactaagggaccagagaatgaagaagggggtgcacaaggctccccaatgcccgaggcaaatcctgacaaccttgaaaacccagcatttcttactgaactcgagcccgccccgcatgctggtctgttggccctcccgaaggacgacatccccggacttccgagaagcccttcggggaaaatgaagggactgccatcggtgactccagcagccgcagatccactgatgacccctgaacttgccgacgtgtacagaacctacgacgctgatatgactacgagcgtggactttcaagaagaagcgacgatggatacgaccatggcgccgaactcactgcaaacgtcaatgccaggtaacaaggcccaagagccagaaatgatgcacgatgcatggcattttcaggaacct

SEQ ID NO: 5881 - DNA, 1341 bp, Artificial Sequence
  Description of Artificial Sequence: Synthetic coding sequence
atgtccgcgtccaagatccctctcttcaagatgaaggacttgatcctgattctctgcctcctggagatgtcattcgcagtcccgttcttccctcagcagagcggaactccgggcatggcgagcctcagcctcgaaactatgcgccaactgggttccctccaaagactcaataccctgagccagtactcccggtacggtttcggcaagtcgttcaacagcctgtggatgcacggccttctgcctccccactcctccctgccatggatgcgtccaagggagcatgagactcaacagtatgaatactcactcccggtgcatccgcccccactcccatcgcagccgagccttaagccacaacaaccagggcttaagccgttcctccaatccgcggccgccaccactaaccaagctaccgccctcaaggaagctctccaaccgcccatacatctgggacacctcccgcttcaggagggagagctccccttggtgcaacaacaagtcgctccgtccgacaaacctccgaagcctgagctgccgggggtggactttgccgaccctcagggaccatcgctcccaggtatggacttcccagacccacagggaccgtcgttgcctggcctggatttcgcagacccgcagggatcaaccatctttcagatcgcgcggctcatttcccacggtcccatgccgcagaacaagcaaagccccctctacccgggaatgctctacgtgccatttggagccaaccagctgaatgccccagcgcgcctcggcattatgtcatcagaagaggtggcaggaggacgggaagatccaatggcatacggagcgatgtttcccggattcggcggaatgcgccctgggttcgagggcatgccgcacaatcccgcaatgggcggagatttcaccctcgaatttgatagtcctgtcgccgcaactaaaggtccagaaaacgaagaaggaggcgcccaggggtccccgatgccggaggccaatcctgacaacttggagaacccggccttcctgactgagctcgagcccgccccacatgcagggcttctcgcgctgccgaaagacgacatcccaggactgccacgcagtccgtcgggcaaaatgaagggactgccttccgtgacccctgcagccgcagatcctttgatgaccccggaactggccgacgtgtaccggacttacgacgcagacatgactacctccgtcgacttccaggaagaagccaccatggacacgactatggcgccgaactcgctgcagacctctatgcccggcaacaaggcgcaggagccggagatgatgcacgacgcgtggcatttccaggaaccg

SEQ ID NO: 5882 - DNA, 1341 bp, Artificial Sequence
  Description of Artificial Sequence: Synthetic coding sequence
atgtcagcctcgaagataccgttgttcaagatgaaggacctgatcctcattctttgtctgcttgaaatgtcgtttgctgtgccattctttccacagcagtccggaactcctggaatggcatcactgtcacttgaaaccatgcgccagcttggatctcttcaacggttgaataccttgagccaatacagcagatacggcttcgggaagtcattcaatagcctgtggatgcacggactgctcccgccgcactcgtcgctcccctggatgaggccaagagagcacgagactcagcagtacgagtactccctgccagtgcatcctccgcctctgccctcacagccatctctgaagccacaacaaccggggctgaaaccgttcctccagtcagcagcggctaccaccaatcaggctaccgcgttgaaagaggcccttcaaccgccgatccacctcgggcatctccccctccaggagggtgaactgcctcttgtccagcaacaagtcgctccgtcggacaagccgccgaaaccggagttgcctggagtcgactttgcagacccacaaggcccctcgctgccggggatggatttccctgacccccagggaccatccctgcccggccttgacttcgccgatccgcagggatcgaccatcttccagatcgcgcgcctgatctcccatggcccgatgccacagaataagcagtccccgctgtatccgggaatgctctacgtgccattcggagcaaaccagctgaacgcccccgcaaggttgggcattatgtcgagcgaagaagtggcaggaggccgggaggatccgatggcctacggcgccatgttccctggtttcggtggaatgcggccgggcttcgaaggtatgccacataacccggccatgggtggggattttacgctggaattcgacagccccgtggccgcgacgaagggaccagaaaacgaggaaggcggggcccagggaagtccaatgccggaagcgaatccggataacctggaaaatcccgcgtttctcaccgagctggagccagcccctcacgctggactgctggcgctgccgaaagacgatattcccggactgccacgttcccctagcggaaagatgaaaggattgccttcagtcactccggcggcagctgacccgttgatgaccccagagttggcagatgtataccggacttacgatgccgacatgactacctcggtggactttcaagaagaggcaactatggacaccacgatggcccctaacagcctccagactagcatgcctgggaacaaggcacaggaaccagaaatgatgcacgacgcatggcacttccaagagcct

SEQ ID NO: 5883 - DNA, 1341 bp, Artificial Sequence
  Description of Artificial Sequence: Synthetic coding sequence
atgagcgcatcgaagattcctctctttaagatgaaagatctgattctgatcctgtgtctgctcgaaatgagctttgcagtcccttttttcccccaacaaagcggtactcctggaatggccagcctgtcgttggaaactatgagacagcttggtagccttcagagacttaatactctttcacaatacagccggtacggatttgggaagagctttaactcgctctggatgcacggacttctcccaccacattcatcccttccttggatgcgccctcgagagcacgaaactcagcaatacgaatactcgttgcctgtgcatcctccacctcttccatcccaacctagccttaagccgcagcaaccgggtctgaagcctttcctgcagtccgcagcggcaactacgaaccaggccaccgctctgaaggaagcactccaacctcccatacatctgggtcaccttcctctgcaagagggcgaactgccgcttgtgcaacagcaagtggctccatcagataagcctcctaaacccgaacttccaggggtggatttcgcagatccacagggaccctcgctgccggggatggattttcctgatccccaaggaccttcactgccaggcctcgactttgcagatccccagggaagcaccatctttcagattgcaagactgatctcacacggaccaatgccacaaaacaaacaaagccccctctaccccggcatgctgtatgtgccctttggagccaaccagctgaacgcacctgcgagacttggtattatgtctagcgaggaggtggcaggtggtagagaggacccaatggcctacggcgcaatgtttcctggattcggaggcatgcggcctggcttcgagggtatgccacataatccagcaatgggcggggatttcaccctggaatttgacagccctgtggccgctaccaaggggccagaaaatgaggaaggaggggcacagggttccccaatgcccgaagccaatcctgacaacctcgaaaatccggcgtttctcacggagcttgagccagctccacatgcagggctgttggccctccctaaagatgatataccaggcctgcctcgctcgcctagcggaaaaatgaaaggactcccatctgtgactcctgcagctgccgatccgcttatgactcctgaacttgcagatgtctacagaacttacgacgcagatatgaccacctcagtggattttcaagaggaagccaccatggatactaccatggcacctaattctctccagacttcaatgccgggcaataaggcacaagagcctgaaatgatgcatgatgcttggcattttcaagaacct

SEQ ID NO: 5884 - DNA, 1341 bp, Artificial Sequence
  Description of Artificial Sequence: Synthetic coding sequence
atgtccgcgtctaaaattcccctcttcaaaatgaaggatctgatcttgatcctctgtctgctggaaatgtccttcgccgtgccattctttccacagcagagtggaacccctggtatggctagtttgtcccttgagacgatgcgccagctgggcagtcttcagcgtctgaataccctgtcccagtactcccgctatggattcgggaaaagttttaattcactttggatgcatgggttgctccccccgcattccagcttgccatggatgagaccgcgtgagcatgaaactcagcagtatgagtactcccttcctgttcatcctcctccactgccttcccaaccttccctgaaaccgcagcagcctggcctgaagcctttcttgcagagtgccgccgccacgacaaatcaggctactgctctcaaagaggccctccagccccctattcacctaggtcacctgccactgcaggagggagaactccctctggtccagcaacaggttgccccttctgataaaccacctaaaccggagctgccaggtgtggacttcgccgatccccaagggccgagcctgcctgggatggacttccccgaccctcagggaccatcgcttcccgggctcgatttcgccgatccacagggctctacgatctttcagattgcacgcctgatctcccacggaccaatgccccagaacaagcagagtccactgtacccagggatgttgtacgttccttttggggcaaaccagctcaatgctcccgccagactgggaattatgagtagtgaagaagttgcgggcgggagagaagaccctatggcatacggcgccatgttccctggctttgggggtatgcgaccggggtttgaaggcatgccccacaatccagctatggggggagactttaccttagagttcgactcacccgtcgcggcgactaagggaccggagaatgaggagggcggagctcagggcagtcccatgcccgaagccaaccctgacaacctggaaaatccagcattccttacagagctcgagcccgcgccacacgctggcctgctggctctgccaaaagacgatattcccggacttccccggtccccctccggcaagatgaaaggcctccctagcgtaacacccgccgctgcagatccgcttatgacgcccgagctcgccgacgtttaccgcacctacgatgctgacatgacgacatccgtcgatttccaggaggaagcgaccatggataccacgatggcgccaaactcactccagacatctatgcccggaaataaagctcaagagccggagatgatgcacgatgcatggcattttcaagaaccc

SEQ ID NO: 5885 - DNA, 1341 bp, Artificial Sequence
  Description of Artificial Sequence: Synthetic coding sequence
atgtccgccagcaaaattcctctgttcaagatgaaagatctcatcttgatcctttgtttgttagaaatgtcgtttgcagttccgttttttcctcaacagtcaggtacccccgggatggcatctctgtccctcgagacgatgagacagctgggaagtctgcagaggttaaatacactgtcacaatactctaggtacggctttggtaagagctttaacagcttgtggatgcacggtctgctccccccccactcctctcttccatggatgagaccgagggaacatgaaacccagcagtatgagtactcacttccagttcacccgccacctctgccgtcccagcctagcctgaaaccccagcagcctggactgaagcccttcttgcagtccgctgccgccaccactaatcaggccacggccctgaaagaagcactgcaacctcctatccaccttggccacctccctctacaggagggcgagctgccgttggtgcagcagcaagtcgccccaagcgacaagcccccgaaacctgagctcccaggagtagattttgcagatccacagggaccaagcctccctggcatggacttccccgaccctcagggaccatcccttcccggacttgactttgcagacccacagggatcaaccatattccagattgcccggctgatctctcatgggcccatgccccaaaacaaacagagtccactgtaccccgggatgttgtacgttccatttggggcgaaccagttaaatgccccagcacgtttaggcataatgtcttccgaggaggtcgccggcgggcgtgaagatcccatggcttatggcgccatgtttcccggctttggtggtatgaggcccggcttcgagggaatgccccacaaccccgcaatgggcggagactttaccttggagttcgattccccagtggctgctacaaagggccccgagaacgaagaagggggcgcgcaaggctcccccatgcccgaggcgaatccagacaacctggagaatccggccttcttgacggaactagaacctgcccctcatgccgggctgttggcacttccaaaagacgatattcccgggttaccccggtcccctagcgggaagatgaagggcctcccatcagtcaccccggcagcagctgacccactgatgaccccagaactcgctgacgtgtatcggacttacgatgcagatatgactacctctgtggactttcaggaggaagcaaccatggataccacaatggcacccaattcactccagacaagcatgcccgggaataaggcccaggagcccgagatgatgcacgacgcttggcactttcaggagccc

SEQ ID NO: 5886 - DNA, 1341 bp, Artificial Sequence
  Description of Artificial Sequence: Synthetic coding sequence
atgtcagcgagcaagatccccctcttcaaaatgaaagacttgattctgattctatgtctccttgagatgagcttcgcagttcccttctttccacaacaatctggtacccctggtatggcctcactttctctggagacaatgaggcagctgggctctttacagcggttgaatactctgagtcagtatagtcgttacggcttcggcaaaagcttcaattcactctggatgcacgggctcttgcctccgcatagcagtttaccctggatgcgccccagggagcatgagacccaacaatacgagtatagtctcccagtgcaccctccacccctgccctcacagcccagcctaaaaccacaacaaccagggctaaagccgtttttgcagagcgccgccgccaccactaaccaggccaccgccctgaaggaggcactgcagcctcccatccatctgggccacctgcccctccaggagggcgaactgcccttggttcagcagcaagtagccccgtcagacaagccacctaagccggagctgccaggggtcgactttgctgatccccaggggccgtccttaccggggatggacttcccggaccctcaaggacccagtttgcccggtctcgactttgccgacccgcagggctcgacgatttttcagattgctagactaatctctcatggaccaatgccacagaataagcagagtcctctataccccggaatgctgtatgtgcccttcggcgccaatcagctcaatgcacccgcgcgtctcggaattatgtcctccgaagaagtggctggaggtagggaggatcccatggcctatggggccatgttccccggcttcgggggcatgcgtcccgggttcgaaggcatgccacataacccagcgatgggcggggactttaccctcgagttcgatagtcctgtggcagccaccaaaggccctgaaaacgaagagggaggggcccagggcagccccatgccagaagccaatccagacaatctggaaaaccccgcgtttctaactgaactggagcctgccccacacgccggacttctcgctcttcccaaggacgacattccagggctgccccggtctccgtcagggaagatgaagggtctcccatcagtgacacctgcagctgcggaccctctcatgactcctgaactggctgacgtgtatcggacgtatgacgcggacatgactacttctgtggacttccaggaggaggctaccatggataccaccatggctccaaacagcctgcagacaagcatgcccggcaataaggcacaggagcccgagatgatgcatgacgcctggcacttccaagagccc

SEQ ID NO: 5887 - DNA, 1341 bp, Artificial Sequence
  Description of Artificial Sequence: Synthetic coding sequence
atgtccgcgagcaaaataccactctttaagatgaaagacctgattttgatactgtgtttgcttgaaatgagctttgcagtgcctttcttccctcaacagtcaggaactccaggcatggcaagcctttcgcttgaaaccatgcgtcagctgggatcactccaacggcttaacacgctctctcaatacagcagatacggatttggaaaatcgtttaactcgttgtggatgcatggacttttgcctccacatagttcgcttccctggatgcgcccaagagagcatgaaacgcaacagtacgaatactccctcccagtgcacccaccaccactcccttcgcagccatcgctcaagcctcaacaacccggattgaaaccctttcttcagtccgcagcagcaacgactaatcaggcaactgcccttaaggaagcactgcagccacctatccacctgggacatcttccactccaagagggtgaactgcccctcgtgcaacagcaagttgcaccctcagataagccaccaaagccggagctgccaggggtggactttgcagatcctcagggaccatcacttcccggcatggactttccagatccacaggggccttccctgcctgggctcgatttcgcagacccccaggggtcaactattttccagatcgcgaggctgattagccacggtcccatgccacaaaacaagcagtcacctctctacccggggatgctctacgttcctttcggtgcaaaccaattgaacgcaccggcacgtctgggtattatgtcatccgaagaggtggctggtggaagagaggaccctatggcatacggcgcaatgtttcctgggtttggtggaatgcgccctggctttgagggcatgcctcacaaccctgcaatgggaggagattttaccctggaattcgactcgccagtggcggcaaccaaggggccggagaatgaagagggaggcgcacaagggtcccctatgcctgaagcgaacccagataacttggagaatcccgcatttctgactgaactggagccagcaccccacgccggactgcttgccctgccaaaggatgacattccgggactgccccgctccccatccggtaagatgaaaggacttccttccgtgactcctgcagcagccgacccccttatgactcctgaactggcagatgtttaccggacctatgatgccgacatgactacctcagtggatttccaggaagaagcgaccatggacacgaccatggcccctaactccctgcaaaccagcatgccaggtaacaaagcacaagaacccgagatgatgcacgacgcatggcatttccaagagccc

SEQ ID NO: 5888 - DNA, 1341 bp, Artificial Sequence
  Description of Artificial Sequence: Synthetic coding sequence
atgagcgccagtaagatcccccttttcaagatgaaggacttgatcctcatcctgtgtcttctagagatgtcattcgccgtaccattcttcccacagcagtctggaactcctggtatggcgagtctgtctcttgaaacgatgagacagctgggaagcctgcagagactgaatacgctgagccagtactcaagatacggctttggaaagagtttcaatagtctgtggatgcatggtctcctacccccccattctagcctgccttggatgcgcccaagagaacacgaaacccagcagtacgagtactctctccctgttcaccccccaccactgccttcacaaccgagtctcaagcctcagcagcccggactgaagcctttcctgcagtctgccgccgcgactaccaaccaagccaccgctcttaaggaggcattacaaccccccatccacctaggtcacttgcctctgcaggagggtgagcttccactcgtgcagcagcaggtcgctccctcggacaaaccgcctaagcccgaattacctggggtggactttgctgatccacagggtccatcactgcccggcatggacttccctgacccccagggtccgtctctgccaggcctggatttcgctgacccacaggggtctactatctttcagatcgcccggctgatctcacacggtcccatgcctcagaacaagcaaagcccattgtaccccggcatgttgtatgttccctttggggcgaaccaacttaacgccccagcacggttgggaattatgtcaagcgaagaggtagccggtgggagagaagatcctatggcttacggtgcaatgttccctggtttcggtggtatgcggccaggcttcgaaggaatgccgcacaacccagctatgggcggcgatttcacactcgagtttgatagcccggtggccgctaccaagggtccagagaacgaagagggaggagctcaggggtccccaatgccagaagcgaacccagataatctggaaaaccctgcattcctgactgagctggaacccgccccccacgccgggctactcgccctgccgaaagatgatatccccgggctgccacgctctccatccggcaagatgaagggactgccctctgtgaccccagcagcggcagatcccctgatgacaccagagctggcagacgtctatagaacatatgacgccgatatgacaactagcgtcgatttccaagaggaagctaccatggacacaaccatggcccccaactccttgcagacgagcatgcccggaaacaaggcacaggagcctgagatgatgcatgatgcttggcattttcaggaaccc

SEQ ID NO: 5889 - DNA, 1341 bp, Artificial Sequence
  Description of Artificial Sequence: Synthetic coding sequence
atgagcgcatcgaaaatcccgcttttcaagatgaaggatctgatcctgatcctctgtctgctcgaaatgagcttcgctgttccgttcttcccgcaacaatctggaactccaggaatggcgtcactcagcctggagacgatgcgccaactcggctcccttcaaagactcaacactctgagccagtactcccggtacgggttcggaaagagcttcaactcgctgtggatgcacgggctcctgccaccgcactccagcctgccttggatgcggccgcgggagcatgaaacccaacagtacgaatattccctgccagttcacccgccacccctcccatcgcaaccatcattgaagccgcagcagccaggtctgaagccattcctgcagagtgctgccgcaactactaaccaagccactgcgcttaaagaagcactgcagccgcccatccatttgggccacctccctttgcaggaaggagaactcccgctggtccagcagcaggtcgcaccttcagacaagccgcctaaaccggaactgccgggggtcgattttgcggacccgcaaggcccctcgctgccgggcatggactttccagatccgcaggggccgtcgttgccgggactcgacttcgccgatccgcaaggatccaccatctttcaaatcgcacgccttatctcgcatggccctatgccgcagaataaacagagcccgctgtaccccggaatgctctacgtcccgttcggagcaaaccaacttaatgccccagcaagactcgggattatgtccagcgaagaggtggctggtggaagagaggaccccatggcgtacggagctatgttccctgggttcggcggcatgcgcccgggattcgaaggaatgccgcataacccggcaatgggaggcgactttactttggaattcgacagcccggtggcagcgactaaggggcctgaaaacgaggaaggcggtgcccagggctcgccgatgccggaggcgaaccctgacaatctggagaacccggcctttctgactgaactggaaccggctccccatgccggattgctggcactgccaaaggacgatatcccaggacttccgagatcaccttcgggtaagatgaaaggactcccgtcagtgaccccggccgcagccgacccgctgatgacgccggagctcgctgatgtctaccggacctacgacgctgacatgaccacgtcggtggatttccaggaggaagcaaccatggacaccactatggcgccgaattccctgcaaactagtatgccgggtaataaggcgcaagagcccgagatgatgcatgatgcctggcatttccaagagccg

SEQ ID NO: 5890 - DNA, 1341 bp, Artificial Sequence
  Description of Artificial Sequence: Synthetic coding sequence
atgtccgctagtaagatccctctgtttaagatgaaggatcttattctgatactgtgcctccttgagatgtcattcgctgtccctttcttccctcaacaatcagggacacctgggatggcaagcctaagtctagaaacgatgaggcagctggggagcctacagcgacttaatacattatcacagtactcccgttacggatttggaaagagcttcaatagtctctggatgcacgggttgttgccaccccatagctctctgccctggatgcgtccccgtgagcatgagacccagcagtacgaatactctcttcccgtacacccgccccctcttccaagccagccctccctgaagccccagcagccagggttgaagccctttctgcagtctgcagccgctaccacaaatcaggccaccgccctgaaggaggccctgcagccacccatccacctaggacacctgccactgcaggagggggagctgccacttgtccagcagcaagtcgcgccctctgacaagccacccaagccagagctccctggagtggacttcgccgaccctcagggtccaagtctcccaggcatggactttcctgatcctcaggggcctagtcttccaggccttgatttcgctgacccacaggggtctaccatcttccagatcgcccgcctgataagtcacggccctatgccacaaaacaagcaatcccctctgtatccagggatgctatatgtcccgttcggcgctaatcagctcaacgcgcccgctaggctaggtataatgtccagtgaggaagttgccggggggcgggaggacccaatggcctatggagccatgttccccggattcggcggaatgagacccgggttcgagggcatgccacacaacccagccatggggggggattttacactggaattcgattcaccagtggccgccactaagggccctgagaatgaagaaggcggcgcccagggctcccctatgccagaggccaacccggataatctggagaatccagccttcttgacagagctggaacctgcacctcacgcgggactgttggcactgcctaaggacgatattcccggccttccacggtctccctcgggcaagatgaagggactgccctccgttacccccgcagcagctgatccactcatgactccagagctggccgacgtatacaggacttacgacgcggacatgactacgagcgtcgactttcaagaggaggcaaccatggacactacaatggccccaaatagcttacagacctccatgccaggcaacaaagctcaggagcctgaaatgatgcatgacgcctggcactttcaagagccg

SEQ ID NO: 5891 - DNA, 1341 bp, Artificial Sequence
  Description of Artificial Sequence: Synthetic coding sequence
atgagcgcaagcaagattcctctgtttaagatgaaggacctcattctcattctttgcctgctcgagatgtcttttgccgtccctttctttccgcagcagtccgggacccccgggatggcgtcgctctctttggaaaccatgcgccagctcgggtcgcttcagaggcttaataccctgtcgcaatactcccggtacggctttggaaagtcctttaactccctttggatgcacgggcttctccctcctcactcgagccttccatggatgcggcctagagagcatgaaacccagcaatacgaatactcgctgcctgtgcatcctccccctcttccgagccaaccttccctcaaaccacaacagcccggcctcaaaccgtttctccaaagcgcagctgctactaccaaccaggcgacggctctgaaggaagcgctccagcctcccattcacctgggacatttgccacttcaagagggtgaacttcccctggtgcaacaacaagtggcacccagcgataagcctccgaagcctgaattgcccggagtggacttcgcagatccccaaggaccgtcacttccaggaatggatttccctgatccacagggacctagcctccctggccttgatttcgcagaccctcaaggctccacgatcttccaaattgctagactgatttcccatggtccaatgcctcagaataagcagtccccactgtaccctggaatgctttatgtgccctttggagcaaatcagcttaacgcacctgcgcgcctcggaataatgtcgtcagaagaagtggcaggagggagagaggacccgatggcatatggagcgatgtttccaggttttggtggcatgcgaccggggttcgaaggcatgcctcacaaccctgcaatgggcggcgattttaccctcgaatttgattcgcccgttgcagcaactaagggacctgaaaacgaggaaggcggggctcaaggaagcccaatgcctgaagcaaacccggacaacctcgaaaacccagcatttcttaccgaacttgagcctgcaccccatgctggactgcttgctctgcctaaggatgacatccctggccttccccgcagcccatcaggaaagatgaagggtctgcctagcgtgactcctgctgccgcagacccacttatgaccccggagcttgcagatgtctaccggacctacgacgcggacatgacgacttcggtcgattttcaagaggaagccactatggataccaccatggcgcctaattcacttcaaacttcaatgccaggcaataaggcacaagaaccggagatgatgcatgatgcctggcatttccaagaacca

SEQ ID NO: 5892 - DNA, 1341 bp, Artificial Sequence
  Description of Artificial Sequence: Synthetic coding sequence
atgagtgcttcgaagattcccctgtttaagatgaaagatctgattctaattctctgtctgcttgagatgtctttcgccgtgcctttcttccctcagcagtcagggacccccggcatggcgtctttgtctttggagacaatgaggcagctgggcagcctccagagactcaacaccctcagtcagtattctcggtacggtttcggcaagagcttcaattcattgtggatgcacggtctgctgcccccccactcatccttgccgtggatgcggccacgagaacatgagactcagcagtacgaatactcactgcccgtccacccccctcccctgccctcgcagccctccctcaagcctcaacaacccggcctgaagccatttctccagagtgcggctgccactaccaatcaggctaccgccctcaaagaggcactgcagccacccattcatctgggacatctgcctctccaagaaggggagctacccttggtgcagcagcaagttgccccatctgacaagccgccaaagcccgaactgcctggcgtggacttcgccgatccccaaggtccctccctgccaggaatggattttccagaccctcagggcccttcattgcccggcttagacttcgccgatcctcagggcagcaccatctttcaaattgccaggctcatctcacatggccccatgccacaaaacaagcagtccccactttatcccggcatgctttatgtcccttttggcgcgaatcaacttaacgccccggcccgtctggggattatgtctagtgaagaagtggcgggcgggcgcgaggatccgatggcttatggtgctatgtttccaggcttcgggggaatgcggccggggttcgagggcatgccccataacccagccatgggcggcgacttcacactggagttcgactctcccgttgctgccacaaaagggcctgagaacgaagaaggcggcgcgcaaggaagtcccatgcccgaagcgaatccagacaatttagagaatcctgcttttctgacagaactggagccggcacctcatgctggactgttagctctgcctaaagatgatatccctggcctgcccaggagccctagcgggaaaatgaagggcctgccctctgtcacccccgccgcggcagacccgttgatgacgccagaactggccgatgtgtacaggacatacgacgccgatatgacaacaagcgtagatttccaagaagaagccacaatggataccactatggcgcctaatagccttcaaacctctatgcccggtaacaaagctcaggagcctgaaatgatgcatgacgcctggcactttcaggaacca

SEQ ID NO: 5893 - DNA, 1341 bp, Artificial Sequence
  Description of Artificial Sequence: Synthetic coding sequence
atgagcgcttcaaagattcccttgttcaaaatgaaggatctcattctgatcctgtgcctcctggaaatgtcttttgctgtgccttttttcccacagcagagtggaactccagggatggcttcgctctctctggagacaatgaggcagctcggcagcctccagcggctgaatacccttagtcagtacagcagatatggttttgggaagagttttaactcattatggatgcatggtttgctgcctcctcactcaagtctcccttggatgagaccaagagaacacgagacacagcagtatgagtattctttgcctgtacacccaccccctcttccatcccagccatctctcaaaccacaacagcccggactcaaacccttccttcagtcggcagctgcaaccaccaaccaagctaccgcccttaaggaggccctgcaacccccaatccacctcggccacctgccgctgcaagagggggaacttcccctggtgcagcagcaggtggccccaagcgataaacccccaaagccagaactgccgggagtcgactttgccgacccccagggtccatcccttcccggtatggacttccccgacccacaagggccctccctccctggactggatttcgctgatccacaagggtccacaatcttccagatcgctagactcatatcccatggtccaatgcctcagaacaagcagtcccctctttaccccggcatgttgtacgtgcctttcggagcaaaccaactgaacgcccccgcaaggctcgggatcatgagctcggaggaagttgccggggggcgggaggacccaatggcgtacggggcaatgttccccggttttggaggcatgagacccggctttgagggaatgccacataaccccgccatggggggagactttacactcgaattcgattcacccgtagctgccacaaagggcccagagaacgaggaaggaggtgctcagggaagtcccatgcccgaagcgaacccagacaatctggagaaccccgcattcctgaccgaactcgagcctgctcctcacgctggcctgcttgctctgcccaaagacgatattcctggacttccccgatccccaagtggcaagatgaaggggttgccttcagtgactcctgccgccgcagatcccttaatgactcctgagcttgcagacgtctatagaacctacgatgccgacatgacaacatccgtcgatttccaagaagaggctacgatggacaccaccatggctcccaattcattgcagacaagtatgccaggcaacaaagcccaggagcccgagatgatgcatgacgcctggcattttcaagaacct

SEQ ID NO: 5894 - DNA, 1341 bp, Artificial Sequence
  Description of Artificial Sequence: Synthetic coding sequence
atgtccgcaagcaagatcccactcttcaagatgaaggatcttatcctgatactgtgccttctggagatgtcgtttgcagtgcctttctttcctcaacagtcaggcacgccaggaatggcaagccttagcctggaaaccatgcgacaacttggctcgcttcaaagactgaacactctttcccaatactcgcggtatggattcgggaagtcctttaactcgctttggatgcatggtttgcttccacctcattcatcgctgccttggatgcgccctcgggagcatgaaactcagcagtacgagtactcgctgcctgtgcatccgccgcctctgccctcgcaaccctccctgaagccgcaacagcctggtttgaagcctttcttgcaatccgcagccgctactaccaatcaggcaaccgcccttaaggaggcactgcaaccccctatccatctcggacatctccccctccaagaaggagagctccctctcgtgcagcagcaagtggccccatcggataagccccctaaacccgagctccccggtgtggattttgcagatcctcaaggtccgagcctcccaggtatggatttcccggaccctcaggggccatcgcttcctggacttgacttcgcagatccccagggctcgaccattttccagattgcgcgtcttatttcgcacggtccaatgccacagaacaaacagtcacccctttacccagggatgctgtacgtgcctttcggcgcaaaccagctcaacgcaccagcacggctcggtatcatgagctccgaggaggtggccggtggaagagaagatccaatggcgtacggtgccatgtttcctggatttggaggcatgcgccctggatttgaaggtatgcctcataaccctgccatgggaggagattttaccctggaatttgacagccctgtcgccgcgaccaaagggcctgaaaatgaggaaggtggagcgcagggttcaccaatgcccgaagcaaatcctgataatcttgagaatccagccttccttactgaacttgaaccagcaccacatgctggactgctcgcacttcccaaggacgatataccaggactgccccgcagcccttcgggtaagatgaagggactgccttcggtcaccccagccgcagctgatccactgatgacccctgagcttgcagatgtctacagaacttacgatgcggatatgaccaccagcgttgactttcaggaagaagccactatggacactactatggcgccgaactccttgcagacttcaatgccaggcaataaagcccaggaaccggaaatgatgcacgatgcgtggcatttccaagagcca

SEQ ID NO: 5895 - DNA, 1341 bp, Artificial Sequence
  Description of Artificial Sequence: Synthetic coding sequence
atgagcgcttccaaaatacccctgttcaaaatgaaagacctcattctgatcttgtgcctcctggagatgtcattcgccgtaccatttttcccccagcagagtggaacccctggcatggcttccctgtctctggaaacaatgcgccagttaggatcacttcaaaggctcaatacactcagccagtattcccggtacggtttcggaaagtcattcaattctctttggatgcatggactgcttcccccgcacagttccctgccatggatgagaccaagagagcacgaaactcagcagtacgagtattccctaccagtacatccccctccgttgccgtcccagccgtccctcaaaccacagcagcctgggcttaaacctttcctgcaaagtgccgccgccacaaccaatcaggctaccgctctgaaggaggccttacagcctcccattcacctggggcaccttcctctgcaggaaggagagctgcctctggtacagcaacaagttgcgccgagtgataagccgcccaaaccagagctgcctggcgtcgatttcgccgacccgcagggacccagtctgccaggtatggatttccccgatccccagggcccgtccctgccaggactagactttgctgacccacaggggagcaccatcttccaaattgcaaggctgattagccacgggccgatgccgcagaataagcaaagcccgctgtatccaggaatgctttacgttccgtttggtgctaatcagcttaacgcccccgcccgactgggaatcatgtccagcgaagaggtcgccggagggcgtgaggatcccatggcatacggggcaatgttcccgggttttggggggatgaggccaggattcgagggaatgccgcacaaccccgcaatgggcggagacttcactctggagttcgattcccccgtggccgccaccaagggtccagagaacgaggaaggcggagcccagggttcgccgatgccagaagctaatcccgataatctcgagaaccccgctttcttgaccgagcttgaaccagctccacacgctgggctgcttgccttacctaaagacgacatccctggcctgccaagaagtccatccgggaaaatgaagggactgccatctgtgacccctgctgccgccgaccctctaatgactccagagttagccgatgtctaccgtacatacgatgccgatatgaccacctccgtggattttcaggaggaagccacaatggatactactatggctcccaatagcctccagacatctatgcccggcaataaggcacaggagccggagatgatgcatgatgcttggcacttccaggaaccg

SEQ ID NO: 5896 - DNA, 1341 bp, Artificial Sequence
  Description of Artificial Sequence: Synthetic coding sequence
atgtcggcatcaaagatcccactttttaagatgaaagatctgatcctcatactgtgcctcctcgaaatgagcttcgcagtgcctttcttcccgcagcagtccggtactcccggaatggcttcactgagccttgaaactatgcgccagctgggatctctccagcggctcaatactttgtcccaatactcccgttatggattcggcaagagcttcaattccctgtggatgcatgggctgctcccgccacatagctcactcccatggatgcgcccacgcgaacacgaaactcagcagtacgaatactcactgccagtgcatccgccgccgcttccaagccaaccgtccttgaagcctcagcaaccgggcctgaagccgttcctccagagcgcggccgctactaccaatcaggctactgcactgaaagaggcacttcaacctcccatccacctgggacacttgccactgcaggagggagagctgccgctggtccagcagcaagtggccccgtcggacaagccgccgaagccggaactgccaggagtggactttgcagacccccaaggaccatccctcccgggaatggacttcccggatccgcagggaccgtcacttccaggacttgactttgctgatccacagggatcaactatcttccagatcgcccgcctgatttcgcacgggcctatgccccagaataagcagtcccccctttacccgggcatgctctacgtcccgttcggggcgaaccagctcaacgcgccggccagactgggaatcatgtcctcggaggaggtggcaggcggaagagaagacccgatggcgtacggggcaatgttcccgggattcggcgggatgcggccgggtttcgagggcatgcctcataacccggcaatgggaggcgacttcaccctggaattcgatagcccggtggcggctaccaagggaccggagaacgaagagggaggagcccagggttcgccaatgccagaggctaatcctgataacctggagaaccctgcattcctgactgaactggaaccggcgccgcatgccggcttgctggcactgccgaaggacgatatccccggactgccgcggtcgccatcaggaaaaatgaagggcctcccgtcggtgactcctgctgcagccgatcctctgatgactcctgagttggccgacgtgtacagaacttacgatgccgacatgactaccagcgtggatttccaggaagaggcaaccatggacacgacgatggcacccaatagcctgcaaacttcgatgccggggaataaggcccaagaacctgagatgatgcacgatgcatggcacttccaagaacct

SEQ ID NO: 5897 - DNA, 1341 bp, Artificial Sequence
  Description of Artificial Sequence: Synthetic coding sequence
atgtccgcctcgaagatccctctcttcaaaatgaaggacctgatcctgatcctctgcctgttggagatgtcgtttgccgttccctttttccctcagcagtcaggaaccccggggatggcgagcctgtccctcgaaaccatgagacagcttggaagcctgcaacggctgaataccctgtcccagtactctcggtacggattcggaaagagctttaactcactgtggatgcacggtttgctccctcctcattcctccctgccatggatgaggccacgagagcacgaaacccaacaatatgagtactccctgccggtgcacccgccgccgcttccgtcgcagccgagcctgaagccacaacagccgggactgaagcctttcctgcagtccgccgccgctaccactaaccaggccactgctctgaaggaggctttgcaaccgcccatccacctgggccatctgccgctgcaggaaggagaactgcctctcgtccaacagcaggtcgccccgagcgataagccgccaaagcctgaactgcctggagtggacttcgcagatcctcagggaccttcactgccgggtatggatttcccggatccgcaggggccgagcctcccgggcctggattttgcggacccacagggtagcaccatcttccaaatcgctagacttatctcgcacgggccgatgccgcaaaacaaacagtcgccgctgtaccctgggatgctttacgtgccgtttggagcgaatcagctcaacgccccggctcgccttggcatcatgtccagcgaggaggtggctggcggccgcgaggacccgatggcatacggggctatgttcccgggcttcggcgggatgcggccagggttcgagggaatgccgcacaatccagccatggggggagacttcacgctcgaattcgattcgccggtcgcagcaacgaagggccctgagaatgaagagggcggagctcagggcagccctatgccggaggcgaaccccgacaatctggagaacccagcttttctcactgaactcgaacctgcacctcacgcgggactcctggcgcttccgaaggacgatatcccgggcctgccgcggtcgccgtcgggcaagatgaagggcctcccgtcggtgaccccggccgcggcggacccgcttatgactccggaactggcagacgtgtataggacctacgatgcagacatgacgacctcggtggacttccaggaagaagccactatggacaccactatggccccaaactccctccaaacttcgatgccgggaaacaaggcgcaagaaccggagatgatgcacgatgcatggcacttccaagaaccg

SEQ ID NO: 5898 - DNA, 1341 bp, Artificial Sequence
  Description of Artificial Sequence: Synthetic coding sequence
atgtctgcctctaagatccccctgttcaagatgaaggatctcatcctgatcttgtgccttcttgaaatgagcttcgcagtaccttttttcccccagcagtcgggtacacctggtatggcctcgctctcgctggaaactatgagacaactgggtagcctgcagcgcttgaatactctatcgcagtactcacgctacggtttcggtaagtcatttaactcgctctggatgcacggcctacttcccccccactccagcctcccgtggatgcgacctcgcgaacacgaaacccagcagtatgagtacagcttgcctgtccaccctcctcccttgccctctcaaccctctcttaagccccaacagcctggtttgaagccatttttgcaatccgccgcggccaccactaatcaggccactgcgctcaaggaggccctccagcctccaatccaccttggtcatctgcccttgcaggaaggtgaattgcccctcgtccagcaacaagtcgccccttccgataaaccccctaagccagagttgcccggcgtcgacttcgcggatccccagggaccgtccctgccaggtatggacttcccggaccctcaaggcccgagtctccccgggttggatttcgctgacccgcagggctctaccatcttccagattgcacgcctgatttcccacggaccaatgccgcaaaacaagcaatcccctctataccccggtatgctttacgttccattcggagcgaaccagctcaacgcccctgcccgcttggggatcatgtcgtctgaggaggttgctggcggtcgagaggatcccatggcttacggcgctatgtttcccggttttgggggaatgcgcccgggctttgagggtatgccacacaaccctgccatgggcggagatttcactttggaatttgactctccggtggccgctaccaagggccctgagaatgaggaaggcggtgcacagggctctcctatgcccgaggcgaaccccgataacttggagaacccagccttccttacggaactcgaacccgctccccacgctggactcctcgccctccccaaggatgacatcccggggcttccccgcagccctagcggtaagatgaagggattgcctagcgttacgcctgccgcggccgatcctctgatgacaccagagctggcggacgtataccggacgtacgatgccgacatgacgacgagtgtcgacttccaggaggaggcgacgatggacaccactatggctccgaacagtctccagacgtccatgcccggcaacaaggctcaggagcctgagatgatgcacgacgcctggcacttccaggagccc

SEQ ID NO: 5899 - DNA, 1341 bp, Artificial Sequence
  Description of Artificial Sequence: Synthetic coding sequence
atgagcgcctccaaaatcccactatttaaaatgaaagatctgattctgatcttgtgtctcttggagatgtcttttgccgttcccttctttccccaacagagcggaaccccgggtatggcctcactgagtcttgaaactatgagacagctgggctctcttcaacgtctcaacactctgagccagtactctcgctacgggtttggcaaatcctttaatagcctctggatgcacggactgctgcccccacatagctctctgccatggatgagacctagagagcacgaaacgcagcaatacgaatatagtttgccagtccacccacccccactcccctctcagccttccctaaagccccaacaacccggcttgaagccattcctccagtctgcggccgctacgactaaccaagctaccgcgttaaaagaagcactgcagccgccgatccacctaggtcatctccccctgcaagaaggggagctgcctctggtgcagcagcaggtcgcccccagcgacaagccacctaaacccgaactccccggggtcgatttcgcagaccctcagggtccctcactccccggtatggattttcctgatccacagggtccatcactgccaggactcgactttgctgaccctcaaggatctactatcttccagatcgcacggttgatttctcatggccccatgccccagaataaacagtcacctctgtaccccggtatgctctatgtgccatttggtgcaaaccagctcaacgctcccgcccgtttaggcataatgtccagcgaggaggtcgccggaggcagggaagacccgatggcctacggggcgatgtttccaggatttggtggcatgcggcctgggtttgagggaatgccccataaccccgctatggggggcgacttcacactcgaattcgactcccctgtagcagctacaaaagggccagagaatgaggaggggggcgcccaaggtagccccatgcctgaggcaaatcccgataatttggaaaatcctgcctttcttactgaacttgaaccagccccccatgctggcttgctggctcttcccaaagacgacatccctggcttgcctagaagcccttcgggaaagatgaaaggattaccaagcgtgacacctgcagctgcagaccccctgatgactcccgaactcgcagacgtgtatcggacgtacgacgcggacatgactacttctgtggacttccaggaggaggctacaatggacactacaatggcccctaactccctgcaaactagcatgcctggcaacaaagctcaggagcccgagatgatgcacgatgcatggcactttcaggaaccc

SEQ ID NO: 5900 - DNA, 1341 bp, Artificial Sequence
  Description of Artificial Sequence: Synthetic coding sequence
atgtctgcatcaaaaatacctctctttaagatgaaagatttgattctgatcctgtgcctgctcgaaatgtcattcgcagtgcctttcttcccccagcaatcagggacaccaggaatggccagtctttctctagaaactatgcgacagctcggatctttacagcgactgaacacactatcacagtatagtagatatggatttggaaaaagtttcaactccctctggatgcatggactgctgcctcctcattctagtttgccttggatgagacctagggagcacgagacacagcagtatgaatattcactccccgtgcatcctccacccttaccttcgcagccatctctcaaaccacagcagcctgggctaaaaccatttcttcagtcagcagccgcgacaactaaccaggcaacagcacttaaagaggctctccagcctcctattcatctcgggcacctgcccttgcaggaaggggaacttcctctcgtccagcagcaggtggccccttctgataaaccccccaaacccgaactccccggggtagatttcgctgatccacaaggacccagtctcccaggaatggacttccccgatccacaggggccttcactgcccggacttgatttcgccgatccacaggggtcaacaattttccaaatagcacgccttatcagtcacggacctatgcctcagaacaaacagtccccactttatcctggaatgctatatgtgccattcggagcaaatcagctgaacgctcccgctcgactcgggatcatgtcttctgaggaagtggccgggggaagggaagatccaatggcatatggggctatgtttcctggatttggaggaatgcgccctggatttgaagggatgccccataacccagctatgggaggggattttacactcgaatttgatagtccagtcgctgccactaaaggaccagaaaatgaagaaggaggagcccagggatcccctatgcctgaggccaaccctgataatctagaaaatcccgccttcctgacagaattagaacctgccccccatgcggggttgctggcccttcctaaagatgatatccctgggctcccccggagtcccagtggaaagatgaaaggactccccagtgttactcctgctgctgcagatcctcttatgactcccgaactcgccgacgtatacagaacttacgacgcagacatgactacatctgtggatttccaggaagaagccacaatggatacaacaatggcccccaactccctacagacttcaatgcccgggaataaggcacaggaacctgaaatgatgcacgatgcctggcattttcaggagcca

SEQ ID NO: 5901 - DNA, 1341 bp, Artificial Sequence
  Description of Artificial Sequence: Synthetic coding sequence
atgagtgcaagtaagattcctttattcaaaatgaaagatctaatcctgattctctgtttgctcgagatgtctttcgccgtacccttctttccccaacagtctggcacgcctggtatggctagcctgtctctcgagacaatgcggcagcttggctctttgcagcgactgaataccctctctcagtatagtcgatacggcttcggtaagagttttaacagcttgtggatgcacggcctgctcccgccccatagtagcctgccctggatgaggcccagagagcacgagacgcaacagtacgaatattccttacccgtccatccccctccccttccctctcaaccgagcctgaagcctcagcaaccaggattgaaacctttccttcagtcagccgcggccaccaccaatcaggctacagcacttaaggaggctcttcagcctcccattcatctggggcatctgcccctacaagaaggagagcttccattggtgcaacagcaagtggctccatctgataagcctcctaagccagaactccctggagtcgacttcgctgacccccagggaccttctctgcctgggatggatttccctgacccccagggaccgtccctgcccgggctagactttgcggacccccagggctcaactatattccagatcgcccggcttataagtcacggccccatgccccagaataagcagagccctctttacccaggaatgctgtacgttcccttcggagccaaccagcttaatgcacctgcgaggctgggtatcatgtccagcgaagaggtcgcggggggacgggaggacccaatggcatatggcgccatgttcccagggttcggcggcatgcgcccaggtttcgaggggatgcctcataatccggcaatgggcggtgattttaccctggaattcgattctccagtcgcagctaccaagggaccagagaatgaggaggggggagcacaagggagcccgatgcccgaagccaatcctgataatttagagaacccagcgttcttgactgaactggagcctgccccacacgcaggactactagcgttgccgaaagatgatatccctggactccctagatccccttctggcaaaatgaagggactgccaagcgtgactcccgcagcggctgacccgctgatgacaccagagctagccgacgtgtaccgaacctacgatgctgatatgacgacgtccgtcgatttccaggaggaagccacaatggacactacaatggctcccaactcgcttcagacctctatgccgggcaataaagcgcaggagcccgagatgatgcacgatgcatggcactttcaggagccc

SEQ ID NO: 5902 - DNA, 1341 bp, Artificial Sequence
  Description of Artificial Sequence: Synthetic coding sequence
atgtccgctagtaagattcctctgttcaaaatgaaagatctgatcctgatcctctgtctgctcgaaatgtcctttgctgtgcctttctttcctcagcagtcgggaactcctggaatggcttcgttgtcgctcgaaaccatgagacaattggggagcttgcagaggctgaacaccctctcacagtacagccgatacggatttggtaagagctttaacagcctttggatgcatggtctgttgcctcctcacagctccctcccttggatgaggccacgagagcacgaaacccaacaatacgaatacagccttcctgtgcatccccctcctctgccaagccaaccttcgctgaagcctcaacagccagggctcaagcccttcctccaatcggcagccgcaaccactaatcaggccactgcactgaaggaggctctgcaaccgccaatccacctcggacatctcccactgcaagaaggtgagctgccacttgtgcaacagcaggtcgccccttccgataagcctcccaagcctgaacttcccggtgtggactttgccgatccgcagggtccttccctgcccggcatggattttcctgaccctcaagggccttccctccccggtttggattttgccgatccccaaggatcaaccatcttccagatagcgaggctcattagccacggcccaatgcctcagaataagcaatcccccctctacccaggaatgttgtacgtgccattcggagcaaaccaactgaacgcaccggctcgacttggaattatgtcctcagaggaagtggctgggggcagagaggaccctatggcatacggtgcaatgttccccgggttcggtggaatgcgccccgggttcgaaggcatgccccataaccctgccatgggaggtgatttcaccctcgaatttgattccccggtggcagccactaagggaccagagaacgaggagggtggagcccaaggatcacccatgccagaggcaaacccagataatctggaaaacccagccttccttaccgagcttgaacccgcccctcatgccggactcctggcgcttccaaaagacgacatccctggattgccacgttcgccctccgggaagatgaagggactgccgtcagtcacccccgcggccgctgatccgcttatgactcctgaactggctgatgtctaccggacttatgacgcagacatgaccactagcgtggactttcaggaggaagcaaccatggataccacgatggctccaaactcgctgcaaacttcaatgccaggcaataaggcacaagaaccagagatgatgcatgatgcgtggcattttcaagaaccc

SEQ ID NO: 5903 - DNA, 1341 bp, Artificial Sequence
  Description of Artificial Sequence: Synthetic coding sequence
atgtccgcctctaagatcccactgttcaaaatgaaagatctgatcttaatcctctgccttttggagatgtccttcgctgtaccattcttcccccaacagtcgggaaccccaggcatggcctccctttctcttgagaccatgaggcagcttggcagtctgcagcggctgaataccttgagccagtactctagatatggcttcggaaagtcgtttaattcactgtggatgcacggactcctccccccccatagctcgctgccctggatgcgaccacgggagcatgaaactcaacaatatgagtattccctcccagtacaccctccaccactgcccagccagccaagtctgaagccacagcaacctggcctaaagcctttcttgcagagcgccgcagccacaaccaaccaggctaccgcgctgaaagaagcccttcagcctcctatccacttaggtcacctccccctgcaggaaggggaactgcctctggtccagcagcaggtggccccttctgataagccgccaaagcccgagctgccaggagtggattttgcggacccacagggccctagtctcccgggcatggatttccccgacccccagggcccttcgttgccaggtttggatttcgccgatcctcagggctccactatctttcagatcgcacggctgatttcgcacggaccaatgccccagaacaaacaaagcccattgtacccggggatgctgtatgtgcctttcggcgcgaaccaactgaatgcaccagcgcggctgggcattatgagctcagaagaagtggcagggggtcgcgaagatcctatggcgtacggggccatgtttcctggattcggcggcatgagacccggattcgagggaatgccacataacccagccatgggcggcgatttcacactggagttcgattcccctgtggccgcgacgaaaggtccagagaacgaggagggaggagcccaggggagccctatgccagaagcaaacccggataatctggagaaccctgcgttcctgactgaactggagccggctccacatgccgggctcttggctcttccgaaagacgacataccgggcctgccgagatctccttctggtaaaatgaagggactgccttccgtcactcctgcagccgccgatccactaatgactccagagctagccgacgtgtatcggacttatgatgccgatatgaccaccagcgtagactttcaggaggaggccaccatggacaccacaatggccccaaacagcctgcagacaagtatgcccgggaataaggcccaggaaccagaaatgatgcacgacgcatggcacttccaggagccc

SEQ ID NO: 5904 - DNA, 1341 bp, Artificial Sequence
  Description of Artificial Sequence: Synthetic coding sequence
atgtccgcctcaaagatccctctatttaaaatgaaagatcttattctgatattgtgtctcctggaaatgagcttcgcagtgccattcttcccccagcagagtggtacccctggtatggcgtccctaagcttagagactatgcgccagttagggagcctccaaaggttgaacacactttcgcagtactcccgatatggtttcggcaaaagcttcaatagtctctggatgcatggacttctgccccctcactcgtcactcccctggatgagaccccgagaacacgagacgcagcaatatgaatactcattgccagtgcaccctcctcccctaccgtctcagccctcactaaagccacagcagcctgggcttaagccgtttttgcagagtgccgcagccactaccaaccaggccactgcactaaaagaggccctacaacctcctatacacctcggccaccttcccctccaggaaggcgagctcccactcgtccagcagcaagttgcaccttccgacaagcccccgaagcccgagctgcccggcgtggactttgccgacccgcaggggccctccctacctggcatggacttcccagatcctcaaggaccttccttgcccggactggactttgcggaccctcaggggagtacgatcttccagattgctagactcatttcccacgggcctatgccccagaataagcagtcgcccctgtatcccggcatgctctatgttccctttggcgctaatcagctgaacgcccccgcacgcctgggcatcatgagcagcgaagaagtggcaggagggcgcgaagatccaatggcatatggggcaatgttccctggtttcggtggtatgagaccgggtttcgagggcatgccacataacccagcaatgggtggggactttaccctggagttcgattcaccagtggcagcaacaaaaggacccgaaaatgaggagggaggcgcacagggatctccaatgccggaggccaatcctgataacttagagaatcctgctttcctgaccgaacttgagcctgctccacacgccgggctgctggctttgccaaaagacgacatccccgggcttcctagatcaccatctgggaaaatgaaaggccttcctagtgtgactcccgcagccgctgatcctttgatgactcctgaactggctgacgtctaccgtacctatgacgctgatatgacgacatccgtggatttccaggaggaggccaccatggacaccactatggccccaaactccctgcagacttcgatgcctggtaataaggctcaggagccagaaatgatgcatgacgcgtggcatttccaggagccg

SEQ ID NO: 5905 - DNA, 1341 bp, Artificial Sequence
  Description of Artificial Sequence: Synthetic coding sequence
atgagcgcaagcaagattcccctgttcaagatgaaagaccttattctgatcttgtgcttgcttgaaatgtctttcgccgtgcccttcttcccccagcagagtggcacccccggcatggcatctctgtccctggagactatgaggcaactcgggtccctccagcggcttaatacactttcccagtatagtcggtacggtttcggtaaaagcttcaatagtctgtggatgcatggactgttgccaccccactcctctctcccatggatgcgcccgagagagcacgaaacccaacagtacgagtattccctgcctgtacaccccccacccttgccaagccaaccgtctctgaagccgcaacagcccggattgaagccattcctccagagcgctgccgccaccaccaaccaggcgaccgcgctgaaggaagcacttcagccacccatccacttgggacatctgccactgcaggaaggggaactgcccctggtgcagcagcaggtggccccttcagacaaaccacccaaaccggagctccccggcgtggactttgcagatcctcaaggaccttctctgccaggcatggactttccagacccacagggcccctccttgccagggctggactttgccgacccgcagggctccacgatctttcagatagcgagacttattagccatggtcctatgccacagaacaagcagagccctctgtaccctggtatgttgtatgtcccctttggcgccaatcagctcaatgctccagccaggctgggtataatgtctagtgaagaagtcgccggcggtcgggaagatcctatggcgtatggcgcaatgtttcctgggtttggcggtatgagacctggatttgagggcatgccacacaaccccgccatgggtggggatttcactctggagttcgatagccctgtcgcagcaacgaagggccccgagaatgaagaaggtggcgctcagggcagccctatgccagaggccaatcctgataatctcgaaaatccagcatttcttacggaactggagcctgccccacacgctgggctgctggcattgccaaaggatgacattcccggtctccctcgatctccctccggcaagatgaaaggtctccctagtgtgacccccgccgccgctgaccctcttatgacacctgaattggccgacgtctacagaacctacgacgcggacatgacaacgagcgtggatttccaagaagaagctaccatggacacgacaatggcacccaacagcttgcagacatccatgcccggcaataaggcccaagagcctgagatgatgcacgatgcctggcatttccaggagccc

SEQ ID NO: 5906 - DNA, 1341 bp, Artificial Sequence
  Description of Artificial Sequence: Synthetic coding sequence
atgtcggcctccaagatccccctgttcaagatgaaggacctgatccttatcctctgcctgctggaaatgtcatttgcagtgccgttcttcccgcaacagtccgggactccagggatggcgtccctttccctggaaaccatgcgccagctcggatcgctgcagaggctgaacacgctgtcacagtactcgcggtacggtttcggtaaatccttcaatagcctttggatgcacggtctgctgcctcctcactcaagcctgccgtggatgcggccgcgggaacacgaaacccagcagtacgagtacagcttgccagtccatccaccgcctctgccatcgcagccatctctgaagccgcaacagccgggattgaaaccgtttctgcagagcgccgctgccaccactaatcaagcaactgccttgaaggaggcgctgcagccgccaatccaccttggacacctgccgttgcaagagggcgagctcccgctggttcagcagcaagtggccccgtctgataagccaccgaagccagaactcccaggggtggacttcgcggatccccagggccccagcctgcccgggatggacttccctgatccgcaggggcccagcctgcctggcctcgacttcgcagacccacaggggtcgactatcttccaaatcgcccgcctgatttcccatggcccaatgcctcagaacaagcagtcgccgttgtaccctgggatgctttacgtgcccttcggagcgaaccagctgaacgcgccggccagattgggaatcatgtctagcgaagaagttgcaggagggagggaagatccgatggcttacggagcaatgttcccaggattcggaggaatgaggccgggatttgaagggatgccgcataacccagcaatgggaggagatttcacgcttgagttcgattcgccggtcgccgcgaccaagggccccgagaatgaagaagggggcgcccaaggatccccaatgcctgaggccaacccagataatctggagaatccagcgttcctcaccgaactcgaaccggccccgcatgccggtctgctcgccctgcctaaggacgacatcccaggtttgcctcggtccccgtccgggaaaatgaaggggctgccgtcagtgaccccggcggccgcggacccactgatgactccagagctggcggatgtgtacagaacgtacgacgctgatatgaccacctcagtggactttcaagaggaggccaccatggataccaccatggccccgaacagcctgcagacgagcatgccaggaaacaaagcccaggagccggaaatgatgcacgatgcttggcacttccaggaaccg

SEQ ID NO: 5907 - DNA, 1341 bp, Artificial Sequence
  Description of Artificial Sequence: Synthetic coding sequence
atgtccgcctctaaaatccccttgttcaagatgaaggacttaattctgatcctgtgccttctggaaatgtccttcgccgtcccattcttcccacagcagtcggggacccccggcatggcttctctgagcttggagactatgcgacagctgggcagcttgcagagactgaacacactgtcacagtatagccgttacgggtttggaaagtcgttcaactcgttatggatgcatggtctgctgcctccgcattcaagcctgccatggatgaggccccgagagcacgagacccagcaatacgaatacagcctgccggtccatccccccccactcccatctcaacctagtctgaagccacagcagcccggacttaagcccttcctgcagtccgccgcagctactacaaaccaagcaactgccctgaaagaggccctgcaaccccctatccacctggggcatctccctctacaggaaggggagctccctctcgtgcagcagcaggtagctcctagcgacaagccgccaaaacccgagcttcctggcgtggacttcgcagaccctcaaggtccaagtctgcctgggatggacttcccggatccccaagggcccagtttacccgggctagatttcgcggatccccaggggtcaacaatcttccaaatcgctaggctgatcagtcacggacccatgccccagaacaaacaatctcctctgtatcctggcatgttgtacgttccattcggtgccaaccagcttaatgctccagctagactgggaatcatgagctcagaagaggttgccggtggtagagaggacccaatggcatatggtgcaatgttccctgggtttggtggaatgcgacccggtttcgagggtatgccccataatcctgccatgggcggcgatttcaccctggaattcgactcccccgttgccgctaccaagggccctgaaaacgaggaagggggagctcaaggctctcccatgcctgaagcaaacccagataacctcgagaacccagctttcctgaccgagctggaaccagcaccacacgcagggctgttagctttgcctaaggacgatatccctggcctcccccgaagcccaagcgggaagatgaaaggattgcccagtgttacaccggctgcagccgatccattgatgactcccgaattggcggatgtgtacagaacatacgacgccgatatgaccacaagtgtggattttcaagaggaggctacaatggacactacgatggccccgaactctctgcaaaccagcatgccggggaataaagcacaggagccggaaatgatgcacgatgcctggcatttccaagaacca

SEQ ID NO: 5908 - DNA, 1341 bp, Artificial Sequence
  Description of Artificial Sequence: Synthetic coding sequence
atgtcggcgtcgaaaataccgctatttaaaatgaaagatctaatattaatactatgtttactagaaatgtcgtttgcggtaccgttttttccgcaacaatcgggtacgccgggtatggcgtcgctatcgttagaaacgatgcgtcaattaggttcgctacaacgtctaaatacgttatcgcaatattcgcgatatggttttggtaaatcgtttaattcgctatggatgcatggtttattaccgccgcattcgtcgctaccgtggatgcgtccgcgagaacatgaaacgcaacaatatgaatattcgctaccggtacatccgccgccgttaccgtcgcaaccgtcgttaaaaccgcaacaaccgggtctaaaaccgtttctacaatcggcggcggcgacgacgaatcaagcgacggcgttaaaagaagcgctacaaccgccgatacatttaggtcatttaccgttacaagaaggtgaattaccgttagtacaacaacaagtagcgccgtcggataaaccgccgaaaccggaactaccgggtgtagattttgcggatccgcaaggtccgtcgttaccgggtatggattttccggatccgcaaggtccgtcgttaccgggtttagattttgcggatccgcaaggttcgacgatatttcaaatagcgcgtttaatatcgcatggtccgatgccgcaaaataaacaatcgccgctatatccgggtatgctatatgttccgtttggtgcgaatcaattaaatgcgccggcgcgtttaggtataatgtcgtcggaagaagttgcgggtggtcgtgaagatccgatggcgtatggtgcgatgtttccgggttttggtggtatgcgtccgggttttgaaggtatgccgcataatccggcgatgggtggtgattttacgctagaatttgattcgccggttgcggcgacgaaaggtccggaaaatgaagaaggtggtgcgcaaggttcgccgatgccggaagcgaatccggataatttagaaaatccggcgtttctaacggaattagaaccggcgccgcatgcgggtctattagcgttaccgaaagatgatataccgggtttaccgcgttcgccgtcgggtaaaatgaaaggtttaccgtcggttacgccggcggcggcggatccgttaatgacgccggaactagcggatgtttatcgtacgtatgatgcggatatgacgacgtcggttgattttcaagaagaagcgacgatggatacgacgatggcgccgaattcgctacaaacgtcgatgccgggtaataaagcgcaagaaccggaaatgatgcatgatgcgtggcattttcaagaaccg

SEQ ID NO: 5909 - DNA, 1341 bp, Artificial Sequence
  Description of Artificial Sequence: Synthetic coding sequence
atgtccgcatcaaaaattccgctgtttaagatgaaggacctcattttgattctgtgtctcctcgagatgtcttttgccgttcccttctttccacagcagagtggaacccccggcatggcatccctttcactggagacaatgaggcagctgggctccctgcagaggctgaacacattgagtcagtacagccgctacgggtttgggaagtcctttaactctctttggatgcacggcctacttccaccccacagttcccttccctggatgcgccccagggaacacgagacccagcaatacgagtatagcctgcctgtccaccctcctccactcccttcccaaccgtccctgaaaccacagcagccagggctcaagccgttcctccagagtgccgccgccaccacaaaccaggcgacggccttgaaggaagcgctccagccaccaatacatctgggacacctgcctttgcaggagggcgagttaccactcgtgcagcagcaagtggcgccgtctgacaagcctccaaaaccagaactcccaggcgtggatttcgccgatcctcagggaccaagccttcccggaatggactttcccgaccctcagggtccctcactccctggccttgactttgcggaccctcagggatctacgatattccagatagcccggctcatcagtcacggaccaatgcctcagaacaagcagtcacccctctaccctggaatgctatacgtgccctttggcgctaatcagctaaacgccccagctagactcggcataatgtcaagtgaggaggtggccggggggcgggaggatccaatggcgtacggggctatgttccccggttttggagggatgcgacctggttttgaagggatgcctcataaccccgccatgggcggcgattttactcttgaattcgattcccccgtagcagctaccaaggggccagagaatgaagagggcggagcccagggatccccaatgcccgaagccaatccagataacttggagaatccagcattcctgacagagctggaacctgccccgcacgccggtcttttagctcttccgaaggacgacatcccaggcctgccaagaagcccatccgggaagatgaaagggctccccagcgttaccccagctgcagccgatcctcttatgactcctgaacttgcagatgtgtaccgaacatacgacgctgacatgaccactagcgtcgattttcaagaggaagccaccatggatacaactatggccccaaatagcttacagacaagtatgcctgggaataaagcacaggagcctgaaatgatgcatgacgcctggcattttcaggaaccc

SEQ ID NO: 5910 - DNA, 1341 bp, Artificial Sequence
  Description of Artificial Sequence: Synthetic coding sequence
atgtccgcctccaaaatcccgctgttcaagatgaaggatctgatcttgatcctgtgcctgctggagatgtccttcgcggtgccgttcttcccgcaacaaagcggtaccccgggaatggcgtcgctttccctcgagactatgcggcaactgggctcgctccagcgcctcaacacgctgtcgcagtacagcagatacgggttcgggaagtctttcaactcgctgtggatgcacggactgctgccaccacactcgtcactcccctggatgcggccgcgcgaacacgaaacccagcagtacgaatactccctgccagtccatcccccacctcttccttcccaaccgagcctcaaacctcagcaacctggcctgaagccctttctgcagtcggcagctgcgaccaccaaccaggcaactgcactgaaggaggcactccagccccctatccacctgggacacctcccgctgcaggaaggcgagctccccctggtccagcagcaggtcgcgccaagcgacaagcctccaaaacctgaactgccgggcgtggacttcgccgacccgcaaggtccgtccctccctggaatggactttcctgatccgcaagggccgtcgctgcctggactcgactttgcagatccgcaaggctcaactatcttccagatcgctagacttatttcgcacggccctatgccacagaataagcagagcccgctgtacccgggaatgctgtacgttccttttggtgccaatcagcttaacgctcccgcccgactggggattatgtcctccgaagaggtggccgggggacgggaagatccaatggcatatggagcgatgttccctgggtttggagggatgcgtccgggcttcgagggaatgccacataaccccgctatgggaggagatttcaccctcgagttcgacagccccgtggcggccaccaaaggcccagaaaacgaggagggaggagcccagggatccccgatgccggaggcgaacccggacaacttggaaaacccagctttccttacggaactggaacccgcgccgcatgcaggactgctggccctgccgaaggacgatatcccagggctgccccggtcgccatcgggaaagatgaaaggactgccttcggtgactccagcggccgcagatccgctgatgactccggaactcgccgacgtgtaccggacctacgacgccgacatgacgacttcagtcgacttccaagaagaagccactatggacaccacgatggctccaaactcgttgcaaacctcaatgccaggcaataaggcacaagagcccgaaatgatgcatgatgcctggcactttcaagaacca

SEQ ID NO: 5911 - DNA, 1341 bp, Artificial Sequence
  Description of Artificial Sequence: Synthetic coding sequence
atgtccgccagtaaaatccccctgtttaagatgaaggatttaattcttatcctctgccttctggagatgtccttcgctgtacctttcttccctcagcagtccggcactcccgggatggcatctctctctctggagacaatgcggcagctgggctcactccagagactgaataccctgtcccaatatagcaggtacggttttgggaaatcctttaattctttgtggatgcacggcctgctgccaccccactcatccctcccgtggatgaggcccagggaacacgagacccagcagtatgaatacagcctgcccgtgcacccaccgcccctgccgtcccaaccttcacttaagccgcagcagcccgggctcaaacctttcttacagtcagcagccgctactaccaatcaagccacagctctaaaagaggccttgcagcctccaattcacctggggcatctccctttgcaggagggcgagcttccacttgtgcagcaacaggttgcgcctagtgacaagccccctaaacctgaattgcctggcgtcgactttgccgatcctcaaggcccgtccttacctggaatggacttccccgacccacagggcccctcactacccggcttggacttcgctgatccacaggggagcacaatatttcaaattgcccggctgatttcccacggcccaatgccacagaacaagcagtcccccctgtatccagggatgctgtacgtgccgttcggggccaatcaactgaacgcccccgcccggctcggaattatgtccagcgaggaagtggccggaggacgcgaggatcctatggcttacggcgcaatgttccctggcttcggggggatgcggcctggattcgagggcatgccccacaatcctgcaatgggcggggatttcaccttggagttcgattctcctgttgccgcaactaaggggcctgagaatgaggagggaggcgctcaaggttcccccatgcccgaagccaatcctgataatctggagaacccggcctttctcacagagctcgagcccgccccccacgctgggcttctagcattgcccaaggacgatatccccggtcttcctaggagcccaagcggcaaaatgaagggcctcccgagcgtcacacctgccgcggccgaccccctaatgactcccgagctggcagacgtataccgaacatatgatgctgacatgaccaccagcgtagactttcaggaggaagcaacgatggacaccacgatggccccaaacagtctgcaaacaagtatgcccggcaacaaggctcaggagccagaaatgatgcacgatgcttggcattttcaagagccc

SEQ ID NO: 5912 - DNA, 1341 bp, Artificial Sequence
  Description of Artificial Sequence: Synthetic coding sequence
atgtccgcaagtaagatcccgctgttcaaaatgaaagaccttattcttatcctgtgtctgctcgagatgtccttcgcagtgcctttctttcctcagcaatcgggaactcccggcatggcatcattgtcgcttgaaacgatgcggcaactgggttcccttcagcgccttaatactttgagccagtactcgaggtacggatttgggaaatcgttcaattctctctggatgcacggccttttgcctccccattcctccctgccttggatgaggccgagagagcacgaaactcaacaatacgagtactctttgcccgtccatccaccgccgctgccatcacaaccgtcgctgaaaccacaacaaccaggactgaagccctttcttcagagtgcagcagctaccaccaaccaagcaaccgcactgaaggaagcactccaaccacctattcacctgggacatctcccgctgcaggaaggcgagctcccactggtgcaacaacaggtcgccccatccgacaagccccctaaaccggaattgcctggagtggacttcgctgatccacaggggccatccttgcctggtatggacttcccggatccacagggtccttcgcttcctggactcgatttcgcagacccacagggatccactatctttcaaattgcacggctcatttcccacggaccaatgcctcagaataagcagtccccgctctatccagggatgctctacgtgccttttggcgcaaaccaactgaacgcacctgcacgccttggcataatgtccagcgaggaagtggcaggaggcagagaagatccaatggcttacggtgcaatgtttccgggattcggtggtatgcgcccaggatttgaaggaatgccacataaccctgcaatgggcggagattttaccttggaattcgatagccctgtcgcggcaaccaagggacctgagaatgaggagggtggcgcccaaggctccccgatgcctgaggcgaacccagataaccttgagaatcctgcgtttctgaccgaactggaaccagctccccatgctgggctcctggcacttcccaaggacgatattccgggactgccacgctcgccatcaggcaagatgaaggggctgccctcggtgactcctgcggcagccgaccccctcatgacgcccgaacttgcggatgtttaccgtacttacgatgccgacatgaccacttccgtggacttccaggaagaagcaactatggatactaccatggcaccaaacagccttcagactagcatgccaggaaacaaggcccaagaaccagagatgatgcatgatgcttggcatttccaagagcct

SEQ ID NO: 5913 - DNA, 1341 bp, Artificial Sequence
  Description of Artificial Sequence: Synthetic coding sequence
atgtcggcgtcgaagattcctctgtttaagatgaaggacctgatcctgatactttgtctgctggaaatgtcgtttgcagtgcctttctttcctcaacagtccgggacccccgggatggcaagccttagcctggaaaccatgagacaactgggaagtctgcagcgcctcaacaccctttcacagtactcgagatacggatttgggaagtcgttcaactcgctgtggatgcacggacttcttcctcctcattcatccctgccttggatgaggccacgggaacatgaaacccagcagtacgaatactcacttcccgtccatcctcctccacttccttcccaaccatcgcttaagccacaacagcccggcctcaagccgtttcttcaatcggccgcagcaactacgaaccaagccactgccctcaaagaggctctccaacctcctattcatcttggtcatctgccactgcaagagggagaactcccattggtgcagcagcaggtggcaccctcggataaaccaccaaagcctgaactcccaggtgtcgatttcgccgatccccaaggcccgtcacttccaggaatggacttccctgatccacaggggccttcccttcctggactggatttcgctgacccacaagggtcgactatattccaaatcgcgcgactcattagccacggtcccatgccgcaaaacaagcagagccccctttaccccggtatgctgtacgtgcctttcggagcgaatcagcttaatgcaccagctcgccttggaattatgagctcggaagaggtggcgggcggcagggaggatcccatggcatacggcgcgatgtttccaggttttggggggatgcggcccggatttgagggaatgccgcataatccagccatgggaggtgactttacccttgagtttgactcgccagtggccgcaaccaagggacccgaaaatgaagaaggtggcgcacagggaagtcctatgcctgaagcgaatcctgataacctcgagaaccctgcatttcttaccgaactggaacctgcaccacatgctgggctgcttgcccttcctaaagacgatataccaggtctgccccgctccccatcaggcaaaatgaaaggtctgccgtcagtgacccccgcagcagcagatcctttgatgactcctgagttggcagatgtttaccggacctacgatgctgatatgactacttcagtggacttccaggaagaagccactatggataccaccatggcaccgaattcgttgcagacttccatgcctggtaacaaggcgcaagaaccagagatgatgcatgatgcatggcattttcaggaacct

SEQ ID NO: 5914 - DNA, 1341 bp, Artificial Sequence
  Description of Artificial Sequence: Synthetic coding sequence
atgtccgcgtcaaagatcccactcttcaaaatgaaggacctgatactgattctttgccttctcgaaatgtcgtttgccgtgcccttcttcccacagcagtcggggactcccggaatggcatccctctccctggagactatgcgccaactgggaagccttcaacgccttaacactctgtcacagtactcaagatatggatttggtaagtcgttcaactcgctgtggatgcatggacttctccctccacattcgtcgctgccatggatgcgtcccagagaacacgaaacccagcaatatgagtactcgctccccgtccatcctccaccgcttccttcgcagccttcgctcaaacctcaacaacctggacttaaaccattccttcaatcggccgccgctactaccaatcaggcaactgcgctcaaagaggcacttcagccaccaattcacctcggccacctccctttgcaggaaggcgagttgccgcttgtgcaacaacaggtggcaccatccgacaagcctcccaagcctgaacttcctggagtggacttcgccgacccgcagggcccgtcactgccagggatggactttccagatcctcaaggtccttcccttcccggacttgactttgccgatccacaaggatctacgatcttccagattgcacgcttgatatcgcatggaccaatgccccaaaacaaacagtcacctttgtaccccggcatgctctacgttccttttggagcaaaccagctgaatgccccagcgagactggggattatgtcctccgaagaagtcgcaggagggagagaggacccgatggcctacggcgcaatgtttccaggatttggtggtatgaggcccggatttgagggcatgcctcacaatcctgcaatgggaggggattttactcttgagttcgatagccccgtcgcagcaaccaagggaccagaaaatgaagagggcggcgcacagggcagccctatgcccgaagccaacccagataatctggaaaatcctgcatttctgaccgagctggaacctgccccacatgccggactccttgcactcccaaaggacgacatcccaggactccctcggtcaccatcgggaaagatgaaggggcttcctagcgtcactccagcagcagcagatccactcatgacccccgagttggctgatgtgtacagaacctacgacgcagatatgactacgtcggtcgatttccaagaggaggcaaccatggataccactatggcacccaactcccttcaaacctcgatgcctggaaataaggcacaggaacctgaaatgatgcatgacgcgtggcattttcaggagcct

SEQ ID NO: 5915 - DNA, 1341 bp, Artificial Sequence
  Description of Artificial Sequence: Synthetic coding sequence
atgtctgccagtaaaattccgctgttcaagatgaaggatctcatcctgatcctttgcctgctggagatgagctttgccgtgccattctttccccagcagtcaggcactcctggaatggcctctctctccttggaaacaatgcggcaactgggatctctgcagcggctgaacacactctctcagtattccaggtacggcttcgggaagtcatttaatagtctttggatgcatggcctcttacccccacatagctcactgccctggatgcgccccagggaacatgagacccagcagtatgaatattccctccctgtccaccctcctcccctgccatcccaaccatctttaaaaccacagcaaccgggcttaaagccttttcttcagtccgctgccgcaaccactaaccaggctactgcgcttaaagaggctctgcagccgcctatccatttaggccacctcccacttcaggaaggagagctgcccctcgtgcagcaacaggttgcacctagtgataagccccccaaacctgaactccctggggtcgattttgctgaccctcagggccctagcctgccggggatggattttcctgatccacagggccccagtctgcccggccttgacttcgcagacccacaaggctccaccatctttcagatcgcacggttgatcagccacggtccaatgccccaaaacaagcaatcgccactgtatcctggaatgctctacgtgccgtttggcgcaaatcaacttaatgctcctgcgcgtcttgggatcatgtcttctgaggaggtcgcaggaggacgcgaggatccaatggcttacggagccatgtttcctggctttggaggaatgagacctggcttcgagggaatgccgcacaacccagcaatgggaggggattttactctggaatttgatagtccagtcgccgcaacaaagggtccagaaaatgaggagggcggagcccaggggagccccatgcctgaagcgaaccctgacaacctcgaaaacccagcctttcttaccgaacttgagcccgcacctcatgccggcctgttggctttgccgaaggatgacatacctggactccccaggagtccaagcggcaaaatgaagggcttgccctctgtgacccctgccgctgctgacccgctgatgacccctgaactggcagacgtgtacaggacttacgatgcagatatgactaccagcgtcgactttcaggaggaggcaaccatggatactacaatggctcctaacagcttgcagacatctatgcctggaaacaaggcacaggaaccagagatgatgcatgacgcttggcacttccaggagcct

SEQ ID NO: 5916 - DNA, 1341 bp, Artificial Sequence
  Description of Artificial Sequence: Synthetic coding sequence
atgtccgcgtcaaagatccccctgtttaagatgaaagatctcatcctcatcttgtgtctgctggaaatgtctttcgcagtgccgttttttcctcagcagagcggcacgccgggaatggcctccctgtcactggagactatgaggcagctcggatccctccaacgcctgaacaccctgtcgcagtactcccgctacggattcggaaagtcgtttaacagcttgtggatgcatggactgcttccgccgcactcatccctcccgtggatgcgcccccgcgagcacgagactcagcaatacgaatactctctgccagtgcatccacctcctctgccttcccagccgagcctcaaacctcaacagccgggactgaagcccttcctgcagtcagcagccgctaccaccaatcaggccaccgccctcaaggaggcgctgcagccgcctatccatcttggtcacctgcccctccaagagggcgaactgccgctggttcaacagcaagtggcgccatcggacaaaccaccgaaacctgaattgcctggggtggattttgcagatcctcagggcccgtcactgccgggaatggatttccctgacccacaaggcccttcactgccagggctggacttcgcagacccgcagggctccaccatttttcagatcgccagattgatctcgcacggtccgatgccgcagaacaagcaatccccgctctacccgggtatgctgtatgtcccgttcggagccaaccagctgaacgccccggccagactcggaattatgtcgagcgaggaagtcgccggaggacgggaggacccgatggcatacggagccatgttcccgggtttcggaggaatgcggccgggattcgagggtatgccgcacaatccggcaatgggaggagacttcaccttggaattcgactcaccggtggcagctacgaagggcccagagaacgaagagggaggtgcccaggggagcccgatgccggaggccaatccagacaatctggaaaacccagcctttctgaccgaactggagccagcccctcacgctgggctgctggccctccccaaggacgacatcccgggcctgccaagatcgccgtctggaaagatgaaaggcctgccgtcggttactcccgctgctgcagacccgctgatgactccggaacttgcggatgtctaccggacttacgatgcagatatgacgacttcggttgactttcaagaagaagccactatggataccaccatggcaccgaactccttgcagaccagcatgccaggaaacaaggcccaagaacccgagatgatgcacgacgcgtggcatttccaagagccg

SEQ ID NO: 5917 - DNA, 1341 bp, Artificial Sequence; identical to SEQ ID NO: 5911
  Description of Artificial Sequence: Synthetic coding sequence

SEQ ID NO: 5918 - DNA, 1341 bp, Artificial Sequence
  Description of Artificial Sequence: Synthetic coding sequence
atgagcgcctctaagattcccctctttaaaatgaaagacctgattctgatcctatgtttgcttgaaatgtccttcgcagtccccttctttccgcagcagtcaggcacgcccgggatggcaagtctgtccctggagaccatgaggcagctcggatccctgcaacgcttgaatacactcagtcagtactccaggtatggctttggcaagagcttcaatagtctgtggatgcatggtttacttcccccacactcttctttgccctggatgcggccgcgggagcatgagacacagcaatatgagtactctttaccagtgcatccccctccgctgccttctcagccatccctcaagccccaacagcccggtctcaagccattcctccagtccgccgctgctacaacaaaccaggccaccgcactcaaggaggcactgcagccccccatccatctgggccatcttccgctgcaggaaggtgagctgccgctggttcagcagcaggtagcgccatcagacaagccccctaagcctgagctgcccggcgtggacttcgccgatccccaggggccgagcttgccgggcatggatttcccagatcctcaaggtccttcactccctgggctcgacttcgccgatccccagggttcaacaatatttcagatcgcgaggctgatctcgcatgggcctatgccacagaacaagcagagccccttgtaccccggaatgctgtacgtgccctttggcgccaaccaactcaatgcccccgcgaggcttggtattatgtccagcgaggaggtggctgggggtcgagaagaccccatggcatacggcgctatgttcccaggcttcggaggcatgcgtcctggattcgagggcatgccccacaatccagctatgggcggtgattttacattagagttcgattcacctgtggcggccactaaagggccggagaacgaggagggcggcgcacagggctctcccatgcccgaagccaatccagacaatcttgagaacccagcattcctgactgagttggagcccgctccccatgccggtctgctggcacttccaaaggatgatatcccaggactgccccgctctccaagtggtaagatgaaagggctgcccagcgtgacaccggcggctgctgatccactcatgactcccgagcttgccgacgtgtaccggacttatgacgcagatatgacgacaagcgtcgactttcaagaggaggccacaatggacaccactatggctccaaacagcctgcagacatcaatgcccggcaacaaagcacaggagccagagatgatgcatgatgcctggcactttcaggaaccc

SEQ ID NO: 5919 - DNA, 1341 bp, Artificial Sequence
  Description of Artificial Sequence: Synthetic coding sequence
atgtccgcgtccaagatccctttattcaaaatgaaggacctcatcctcatcctttgtctcctggaaatgtcattcgcagtaccgttctttccgcaacagtcaggcaccccgggcatggcatccctcagccttgagacaatgcgtcaactggggtctctccaaagactcaacacccttagtcaatattctaggtacggcttcggcaagtctttcaatagtctgtggatgcacggcttgctccctcctcacagtagcctgccctggatgagaccaagggagcacgaaacacagcagtatgagtatagcctcccagttcaccccccacctctcccctcccagccctcactaaaaccccagcagcctgggctcaagccattcctacagagcgctgctgccacaaccaaccaagctacagcactgaaggaggccttgcagccgcccatccatttggggcatctgccactccaggagggtgagctgcccctagttcagcaacaggtggcgccttctgacaaaccacccaaacccgagctacctggcgtggacttcgcagatcctcaggggccatccctccctggaatggacttccccgacccccagggtccgtcactgcccggacttgatttcgccgacccccagggttctactatctttcagatcgcaaggcttatctctcacgggcccatgccccaaaacaaacagtccccactgtatcctggtatgctgtacgtgccgtttggagcaaaccagctaaatgctcctgccaggctaggtatcatgagcagcgaggaagtcgccggcggccgcgaggaccccatggcctacggtgccatgttcccagggtttggcggcatgcgtccaggattcgagggaatgccacacaatccagccatggggggtgacttcaccttagaatttgactctccagttgcagctactaagggaccagagaacgaagaaggaggtgcccagggctcacccatgcctgaagcaaaccctgataacttggaaaatcccgccttcctcaccgagctagagccagctccgcatgcaggtctcctggcacttcccaaagacgacatccccgggttaccacgatctccctctggtaagatgaagggtttgccttccgtgacacctgccgccgcagacccccttatgacccccgagttggcggatgtgtatagaacatacgatgcagacatgactaccagcgtggacttccaggaagaagctacaatggacaccaccatggcccccaactcactgcagacttctatgcctggaaacaaggcacaggagcctgaaatgatgcacgacgcttggcactttcaggagcct

SEQ ID NO: 5920 - DNA, 1341 bp, Artificial Sequence
  Description of Artificial Sequence: Synthetic coding sequence
atgtcagcaagtaagatcccgttatttaaaatgaaagacctgattctcatcctctgcctactcgagatgagctttgcagtgcccttctttccccagcaatccggcacccctggcatggcgtcgctcagccttgaaacaatgcgccaattggggtcattgcagcggctgaatactctgtcacagtactcccggtacggctttggaaagagcttcaatagcctatggatgcatggactattacccccccactcgtcactcccctggatgaggccaagagagcatgagacacagcagtatgaatactctttgccagttcatccaccgcctcttccgtctcagccatctctgaaaccgcagcagccaggcttgaaaccttttctccagtccgcagctgccacaaccaaccaagccaccgccttaaaagaagctttgcaaccccctatccatctgggtcatttacccctgcaagagggcgagctgcccttggtccagcagcaggttgccccctctgacaagccccccaaacccgagctgcctggggtggacttcgcagatcctcaagggccatcactgcccggaatggatttccctgaccctcagggtccgtccctcccaggccttgacttcgccgatccccagggcagcacgatttttcagatcgctcggcttatcagccatggtcctatgcctcagaacaaacagtcccccctatacccgggcatgctgtacgtgccctttggcgcgaatcagttgaacgcgccagccaggcttgggattatgagtagtgaggaagtggccggtggtcgagaagaccctatggcttacggggccatgttccccggctttggcggaatgagacccggcttcgagggaatgccacataacccagccatgggaggggatttcaccctcgagtttgattcaccagtcgcagctaccaagggtccggagaatgaagagggaggtgctcaagggagtcctatgcctgaggccaatcctgacaatctcgagaaccccgcctttctgaccgagctggaacctgcgcctcacgctgggctgctcgctctacctaaagatgatattccgggactaccaagaagcccctcaggcaagatgaagggcctcccgagcgtgaccccagctgccgctgacccccttatgacacctgagttggcggatgtctatcgcacatacgatgctgacatgaccacgtccgtggacttccaagaggaggcaactatggacactactatggctcctaatagtcttcaaacgtctatgccaggtaataaggcgcaagagccagagatgatgcatgatgcctggcattttcaggagccg

SEQ ID NO: 5921 - DNA, 1341 bp, Artificial Sequence
  Description of Artificial Sequence: Synthetic coding sequence
atgtcagcctcgaaaatcccccttttcaagatgaaagatttgatcctaatcttatgtctactcgagatgtcattcgctgttcccttcttccctcagcagtctggaacacctggcatggccagcctgtcactggaaaccatgagacagttgggttctctacagagattgaataccttgtctcagtacagcagatacggattcggaaagtcttttaacagcctttggatgcacggactgctgcctcctcattcttcgctaccttggatgagaccaagggaacatgaaactcagcagtatgaatattctctccccgtgcatccaccaccccttcccagtcagccaagtctcaaaccgcagcagcccggccttaagccttttttgcagagtgccgcagccacaactaatcaggccacggcactcaaggaggctctccagcccccgattcacctgggtcatctgccactgcaggagggagagcttccgttggtccagcaacaggtcgcaccctcagacaagccgcctaaacccgaactgccaggtgtggattttgcagatccccagggaccatcgttacctggaatggattttcccgacccgcaggggccaagtctgccaggcctggacttcgcagaccctcaaggcagcaccatcttccagatagcacggctgatcagccacggccccatgccccaaaataaacaatcccctctctatccaggcatgctctatgttccatttggggccaatcagcttaatgcccccgctcggttgggaatcatgtcgtctgaggaggtggccggtggaagagaagacccaatggcttacggggccatgtttccaggattcggcggtatgcggcccgggttcgaaggaatgccccacaaccccgcgatggggggagacttcaccctcgaattcgactcccccgtcgccgctaccaagggcccagagaacgaggagggcggggctcagggctcgccgatgcctgaggctaaccctgacaacctggagaacccagcttttctcactgaactcgagcccgccccccacgccggcctcctggctcttccaaaggacgatattcccgggctgccccgatctccttcagggaaaatgaaagggcttcccagcgtgacccccgccgccgcagaccctttaatgactcccgagctagcagatgtttatcgcacatatgatgctgacatgactacatctgtggattttcaagaagaggctactatggatactaccatggcccccaactccctccagacctccatgcccggaaacaaagctcaagagcctgagatgatgcacgacgcctggcactttcaggagcct

SEQ ID NO: 5922 - DNA, 1341 bp, Artificial Sequence
  Description of Artificial Sequence: Synthetic coding sequence
atgagcgcgtcgaaaattccgctgtttaagatgaaggacctcatcttgatcctgtgtctgctcgaaatgtcgttcgccgtcccgttcttcccgcagcagtcaggaacccctggaatggcctcactgtccctcgaaaccatgcgacagctgggaagcctgcaacgcctgaacactctgtcccagtactcccgctacggtttcggcaagtccttcaatagcttgtggatgcacggactgctcccgccccactcatcccttccgtggatgcggcccagagaacacgaaactcagcagtacgaatacagcctcccggtgcacccgcctccgctgccgtcgcagccttcactgaagccccaacaaccgggactgaagccgttcctccagtcggctgctgctactaccaatcaagccaccgccctcaaagaagctctgcaaccgccgatccatctcggacatctgccgctgcaagagggcgaattgccgctggtccagcagcaagtggctccatccgataagccaccaaaaccggagctgccaggagtggactttgcggacccgcaaggcccttcactgccaggaatggacttcccagacccgcagggaccatcgctgccgggattggatttcgccgatccacaaggaagcactatcttccagatcgcccggctgatatcccatgggcctatgccacagaataagcagtcaccgctgtaccccgggatgctgtacgtgccgttcggcgccaaccaactgaacgccccggcgcggctggggatcatgtcatcggaggaggtggcaggcggcagggaggacccgatggcctacggagccatgttcccaggattcgggggcatgcggccgggatttgagggtatgccgcacaacccggccatgggtggagattttactctcgaattcgactcaccagtggccgcgacgaaaggccctgagaatgaggagggcggcgcacagggcagccctatgccggaagcaaacccagacaacctcgagaacccagccttcctcacggaactggagcctgcacctcatgccggactgcttgccctgccaaaagatgatatccctggcctcccccggtccccatctggaaagatgaagggcctcccttccgttactcccgccgcagcggatcctctgatgacccctgagctcgctgatgtatacagaacctacgacgctgacatgaccacttccgtggattttcaggaggaggccaccatggacactaccatggccccgaactctctccagacctccatgcctggaaacaaggcccaagagccggaaatgatgcacgatgcctggcatttccaggagccg

SEQ ID NO: 5923 - DNA, 1341 bp, Artificial Sequence
  Description of Artificial Sequence: Synthetic coding sequence
atgagcgcctccaaaatccctcttttcaagatgaaagatctgattctcattctgtgtctgctggaaatgtcttttgccgtgcccttttttccgcaacagtcgggaacccctggcatggcaagcctctcccttgaaaccatgcgccaactcggttctctgcaacgtctgaacaccctctcacaatactccaggtacgggtttggaaagagctttaactcgctttggatgcatggccttcttcctcctcattcatcccttccttggatgaggccgagagagcacgaaacgcaacaatacgaatactcgcttcccgtgcatcctccgcctcttccctcgcaaccaagcctcaaaccccaacagccagggctgaagccgtttctgcaatcggcagcagcaactaccaaccaggcgacggctcttaaggaggcactgcaacctccgatccatctgggacatctccctctgcaggaaggcgaattgcccctggtgcaacaacaagtcgcaccgtcggacaaacctcctaagcccgaactccctggagtggattttgcggacccacagggaccatcacttcccggaatggatttccccgatccgcagggcccttcacttcctggtcttgattttgcagatcctcagggaagcactatctttcaaattgcaagacttattagccatgggcctatgccacagaataaacaatcacctctgtacccgggcatgctctacgtgccctttggcgctaatcagcttaacgccccagcaagactgggaatcatgtcgtcggaagaagtcgcaggtggccgcgaagatccaatggcgtacggagctatgtttcctggctttggcggaatgcgaccaggattcgagggtatgccgcacaatccggccatgggaggagatttcacccttgaatttgattcgccagtcgcagcaactaagggtcctgagaacgaagaaggaggggcacagggaagccccatgccagaggcaaacccagataatcttgaaaacccagcgttcctgaccgaactcgaacctgcaccacacgcagggctgcttgctctgccaaaggatgacattcccggtttgcccagatccccctctggcaagatgaaaggacttccttcagtgacccctgcagcagcggatccacttatgactccagagctcgcagatgtgtaccggacttacgacgcagatatgaccacctccgtggattttcaggaggaggccaccatggataccacgatggcacctaattcgcttcaaacgtcgatgccagggaacaaagcacaagagcctgaaatgatgcatgatgcatggcactttcaagagccg

SEQ ID NO: 5924 - DNA, 1341 bp, Artificial Sequence
  Description of Artificial Sequence: Synthetic coding sequence
atgtccgcatccaaaattccactgttcaagatgaaggatctgatactcattttatgcttgctagagatgtcctttgctgtgccctttttcccacagcagagcggcactcctggcatggcaagccttagcctggaaaccatgagacagctgggctctctgcagcggctgaacaccttgtcacaatacagcagatatggctttggtaagagcttcaactcactgtggatgcatggcctgctgccaccacacagcagtctgccctggatgaggccgcgcgagcatgagactcagcaatatgaatactccttgccagtgcacccgcctccgctgccgagccaaccaagccttaagcctcaacagccgggcctcaaaccttttttgcagtccgcagcggccactacgaaccaagcgactgcgctgaaggaggcccttcagccgcctatccacctcggtcacctgccgctccaggaaggcgaattgccccttgttcaacaacaggtggcaccaagcgacaaaccgcctaaaccagagctgccgggtgtggacttcgcggatccacagggcccaagcctcccaggtatggactttcctgatccgcaggggccttcgttgccggggctggattttgcagatccacagggttccaccatctttcaaatagccaggctgatttctcacggcccgatgccacagaataaacaaagcccactctaccccggtatgctttatgttccttttggtgcaaatcagctcaacgcaccagctcgtctggggattatgagtagcgaggaggtagcggggggtcgggaagacccaatggcatatggcgcgatgttcccgggatttggtgggatgagacctggtttcgaaggtatgcctcacaatcctgcaatgggtggcgattttaccctggaatttgactccccggtagctgcaaccaaaggtccagagaacgaggagggtggggcacagggcagcccgatgccagaggctaaccctgataacctagaaaatcctgcattcttgaccgagctagagccggcgccacatgcgggccttctggcactgccaaaggacgacatccctggactgccccgctcgccatcgggtaaaatgaagggcctgccttccgtaaccccggccgcggccgaccctctgatgaccccggagttggcagacgtttatcgaacctacgatgcggacatgaccaccagcgttgattttcaggaggaagctaccatggatacaactatggcaccaaacagcctgcagaccagcatgcctggcaacaaggcccaggaaccggagatgatgcacgacgcctggcactttcaggagcca

SEQ ID NO: 5925 - DNA, 1341 bp, Artificial Sequence
  Description of Artificial Sequence: Synthetic coding sequence
atgtccgcttccaagatcccgctgttcaagatgaaggatctgattctgattctgtgtctcttggagatgtccttcgcagtccccttcttccctcagcaaagcggcacccctggcatggcgagcctctcgctcgagactatgcgccagcttgggagcttgcaaagacttaatactctctcgcagtattcacgttacggatttggaaagtcgtttaacagcctgtggatgcacgggctgctgccaccgcattcatcattgccctggatgaggccaagagaacacgaaacgcaacagtacgaatactcactgccagtgcatcctccgccgctcccttcgcagccatcgctgaaaccgcagcaacctggtctgaaaccgttcctccagtcagctgcagcgactactaaccaggcaaccgcgctcaaagaggctttgcagcccccaatccatcttggacacctgccgttgcaggaaggagagctgcctctggtgcagcagcaggtggccccctcggacaagccgcctaagccagagttgcctggagtggatttcgcagacccacagggaccaagcctgcccggtatggattttcctgacccccagggcccgtcgttgccgggcctggacttcgctgacccgcagggttcaaccatcttccagatcgctaggttgatttcgcatggaccaatgcctcagaataaacagagcccactgtacccgggaatgctgtacgtgccatttggcgcaaatcaactgaatgccccggcacgcctgggcatcatgtcctcggaggaggtggccggaggaagagaggacccaatggcctacggggccatgttcccgggtttcggcggcatgcggccaggattcgagggtatgccccataaccctgcgatgggcggcgactttactctggagttcgattccccggtcgctgccaccaagggaccggaaaatgaagaaggaggcgctcaaggatcgccaatgccggaagccaacccagacaaccttgagaacccggcctttctgaccgagctggagccggcaccgcacgctgggttgctggcgctgccaaaagacgatatcccaggtctgccccgctctccctcagggaagatgaaaggacttccgtccgtcactccggccgccgccgaccctctcatgactcctgagctcgctgacgtgtaccgcacttacgacgccgacatgacgacctcagtggatttccaggaagaggcgaccatggacactactatggctcccaattcgcttcagacctcgatgccgggaaacaaagcccaggagccggagatgatgcacgacgcctggcacttccaagagcca

SEQ ID NO: 5926 - DNA, 1341 bp, Artificial Sequence
  Description of Artificial Sequence: Synthetic coding sequence
atgagcgctagtaagattcctctgttcaagatgaaagaccttatccttattctttgcctgctggagatgtcttttgctgtgccgttcttcccgcagcagtctggaacacctgggatggctagtctgtccctcgagaccatgcggcagctgggaagcttgcagagacttaataccctgtcccaatactctaggtacgggttcgggaagtctttcaattccttgtggatgcacggattgctgccccctcactcaagccttccttggatgaggcccagggagcacgagacgcagcagtacgagtactctctcccagtccacccaccacccctcccaagtcaaccctccctgaagcctcaacaaccaggactgaagccttttctgcaaagtgcagcggcgaccaccaatcaagctacagctctgaaggaggccctgcagccccctattcacttggggcacctgcctctgcaagagggcgagctgccactggtgcagcaacaagtcgctccctctgacaagccgcctaaaccagagttgccaggagtggacttcgctgacccccagggaccctcccttcccggtatggacttcccggacccccaggggcctagcctgccagggttggactttgcagatccacaaggttcaacgattttccaaatcgctaggttgatctctcatggacccatgccccaaaataagcagtcccctctctatccagggatgctgtacgtgccatttggagcaaaccaattgaacgcccccgcccggctgggaattatgtctagtgaggaagtggccgggggccgggaagatccaatggcctacggcgccatgtttcccggattcggtgggatgagaccagggttcgagggcatgcctcataacccagctatgggtggtgacttcaccctggagttcgactcccccgtggctgcaacgaagggtcctgagaacgaggaggggggcgctcagggatcaccaatgcctgaagcaaaccccgacaatctggagaatcctgcatttttgactgagcttgagcctgccccccatgcgggcttgctcgctctgcctaaagacgatataccaggtttgcctcgctcaccctctggcaagatgaaggggctgcccagtgtgacccccgcggctgcagacccactgatgaccccggaactggctgacgtttaccgcacatacgacgccgacatgacaacgtcagtagatttccaggaggaggcaacaatggacaccacaatggctcccaactcacttcagacaagtatgccagggaataaagcacaggaacccgagatgatgcacgacgcgtggcacttccaggaaccc

SEQ ID NO: 5927 - DNA, 1341 bp, Artificial Sequence
  Description of Artificial Sequence: Synthetic coding sequence
atgtcagccagcaagatcccgctgttcaagatgaaggatctcatccttatcctgtgcctgctggagatgtcgttcgcagtgccgttcttccctcaacagtcgggaactccgggaatggcttcactgtcccttgaaacgatgcggcaactcggttccttgcaacggctgaataccttgtcgcagtacagccggtacggattcggaaaatccttcaattcactgtggatgcatggactcctgccgccgcactcttcactgccctggatgcgcccgagagaacacgaaacccaacagtacgagtattcgctgccggtccatccaccgccgctgccatcccaaccgtcccttaagccgcagcaaccggggctgaagccgtttctgcagtctgcggccgcgactaccaaccaggcgacggcactgaaggaggctctccagcccccaattcacctgggccatttgccgctgcaggagggagagcttcctcttgttcagcagcaggtggcgccgtcggacaaaccaccgaaacccgagctccctggcgtcgatttcgctgatccacaaggccctagcctgccaggcatggacttccctgatcctcaagggccgtctctgccgggattggactttgcggacccccaaggcagcaccattttccagattgcaaggctgatctcgcatggcccgatgcctcagaacaagcaatccccactgtacccagggatgctgtacgtccctttcggggcgaaccaattgaatgcccccgcccggctcggaattatgtcctcagaagaggtggccggaggaagagaggacccgatggcgtacggagccatgtttcctggcttcggaggaatgcggcctggatttgaaggcatgcctcacaaccctgcgatgggaggtgatttcactctggaattcgattccccggtcgccgctaccaaaggtccggaaaacgaggaaggaggagcccagggttcaccgatgccggaggctaaccccgataacttggagaacccggcttttctgaccgagcttgaaccagcccctcacgccggactcctggcccttcctaaggacgacatcccgggactcccgagatcgccctcgggaaagatgaagggattgccatccgtgaccccagccgcggcggatcctctgatgaccccggagctcgctgacgtgtaccgcacctacgacgcggacatgactacttccgtggacttccaagaagaagcaacgatggataccactatggcccccaactcccttcagacttcgatgccaggtaataaggcgcaggaacccgaaatgatgcacgacgcgtggcactttcaagaacct

SEQ ID NO: 5928 - DNA, 1341 bp, Artificial Sequence
  Description of Artificial Sequence: Synthetic coding sequence
atgtcagcatcgaagatccccctgttcaaaatgaaggacctgattctcatcttatgcctcctggaaatgtcttttgcggtcccattcttccctcaacaatctggtacaccggggatggcttcactgtcccttgaaacaatgcggcaactagggtctttgcagcgcttgaacactctaagccagtacagccgttatggctttggcaaatcttttaattccttgtggatgcatggattactgccccctcattcgtcattaccatggatgaggccaagagagcatgaaacacagcaatatgaatattcccttccggtccatccgccgccgttgccgtcccaaccaagccttaagcctcaacagccagggctcaaaccgtttctgcagagcgcggccgcaactacgaatcaggccaccgcacttaaagaagcacttcaacctcctattcatctaggtcatttacctttacaggaaggtgaacttccgttggtccagcaacaggtggcgccgagcgataagccgccgaaaccagagttgccgggcgtcgatttcgcagatccgcaagggccaagtctgccgggcatggattttccggatccgcaaggcccatctttgccgggtctggactttgctgaccctcagggaagcacaatttttcaaattgcgcgtctgatttcacatggaccgatgccgcagaacaaacaatcaccgctgtatcctggcatgctatatgtcccgtttggcgcaaatcagttgaacgccccggccagactgggcatcatgagctcagaagaagttgccgggggccgggaagacccgatggcatatggcgctatgtttccgggtttcggggggatgaggcccggttttgaaggcatgccgcataatccagcgatgggcggagatttcacgttggaatttgattctcctgttgcggctacaaaaggaccggagaatgaggagggcggtgcacaaggtagccctatgccggaagcaaacccggataaccttgaaaatccggcttttcttacggaacttgaacccgcaccgcatgcaggcttgcttgctttgccaaaagatgatatcccagggttacctcggtccccgtcaggaaaaatgaaggggcttccgagcgtaactcctgcggcggcggatcctcttatgaccccagagcttgcggatgtctaccgaacatatgacgctgatatgacaacgtcagttgattttcaggaggaagcaacaatggataccaccatggcgccgaattcacttcagacatctatgccaggaaataaggcacaagagccggaaatgatgcacgatgcttggcactttcaggaacct

SEQ ID NO: 5929 - DNA, 1341 bp, Artificial Sequence
  Description of Artificial Sequence: Synthetic coding sequence
atgagcgcatccaagatccccttgttcaagatgaaagacctgatcttgattctatgcctcctggagatgagttttgccgttccattctttccccagcagagtggcactccaggaatggctagcctgagtctggaaacaatgagacagttgggatcgcttcaaagactgaatacactgagtcaatacagtcgatacggctttgggaaatctttcaattcactgtggatgcatgggctcctgcctccacatagctctctgccatggatgaggccgcgagagcatgaaacacagcagtatgaatattctcttcccgtccatcctccccctttaccgagtcagccatcccttaagcctcagcagcctggcctgaagcctttcctgcagtcagccgccgcaacaacgaatcaagcgaccgccctgaaggaagccctgcagcctcctatacacttgggacacttgccactgcaggagggagagctacccctggtacagcagcaggtggcaccaagcgacaagccacccaagcctgagttgccgggcgtagatttcgccgacccgcaaggaccttctttgccaggtatggatttccccgatccgcaggggccatcgctgcccggtcttgatttcgctgatcctcaggggtctaccatcttccagattgctcgtcttatttcccacggcccgatgccccagaacaagcaatctcccctgtatcctgggatgctttacgtgcccttcggcgccaatcagcttaatgcgcctgcccggttagggatcatgtcttctgaagaagtcgccggggggagggaagatccaatggcctacggcgcaatgttccccggattcggagggatgcggcctggtttcgaaggtatgcctcacaatccagcaatggggggggacttcaccctggagttcgactcaccagtggcagctacaaagggccctgagaatgaagagggtggagcccaagggagccctatgcccgaggccaatcctgataatttggaaaaccctgcattcctgacggaactagaaccagccccacacgccgggctccttgccttgcctaaggacgatataccaggcttgcctcgaagcccaagcggaaagatgaaaggactgccttcggtcacaccagccgcagcggacccgcttatgacccccgagttggcagatgtgtataggacgtacgacgccgatatgacgacctccgtcgatttccaggaagaggccaccatggacacgacaatggctcctaattccctgcagacctccatgcccggaaacaaagcgcaagagccagagatgatgcacgacgcatggcactttcaggaaccc

SEQ ID NO: 5930 - DNA, 1341 bp, Artificial Sequence
  Description of Artificial Sequence: Synthetic coding sequence
atgtcagcatccaagataccgttattcaaaatgaaagatttaattcttattctctgtcttctggaaatgagctttgccgtgccgttttttccacagcaaagtggcactcctggtatggcatcgctttcgcttgagacaatgcgtcaattaggatccctccagcgccttaacactttgagtcaatactcgcgttacggatttggaaaaagctttaactctttatggatgcatggtttgcttcctccacattcttccctcccatggatgcgcccaagagagcacgaaacacagcagtatgagtatagcttgccagtgcatccacccccattgccgtcgcagccctcactgaagccacaacaaccaggattaaaaccttttctgcagtcggcagcagcgacgactaatcaagcgacggcgctgaaagaggcccttcagcccccaattcacctaggacacttgccgctccaagaaggagagctaccacttgttcaacaacaagttgccccatctgataaaccaccaaagccagagctcccaggcgttgatttcgctgacccacagggtccatcgctaccaggcatggatttcccagacccgcagggaccttctctacctggccttgatttcgcagatcctcaagggtctacaatatttcagattgccagactgatatcccatggaccaatgccacagaacaagcaaagtccattatacccgggaatgttgtatgtaccgtttggggcaaatcaattgaacgctcctgcccgtctcggaattatgagctcagaagaagttgcgggaggtcgtgaggatccaatggcatacggagcaatgtttccgggattcggaggaatgcgacctggctttgaaggtatgccacataatccagcaatgggaggcgattttactcttgaattcgattcaccagtagcagcaactaaaggaccagagaacgaagagggcggtgcacaaggatccccgatgccggaagcaaacccagacaacctagaaaacccagctttcctgacagagctggagccggcgcctcatgccggacttctggccttgccaaaagacgatataccgggactgccccgttccccgtcgggaaagatgaaaggactaccttcagttactcctgctgcagctgatccattgatgacccccgagcttgcagatgtttatagaacttatgatgcagacatgaccacgtctgttgatttccaggaagaagctaccatggatactacaatggctccaaacagtcttcaaacttcaatgccaggcaacaaggcacaagaaccggaaatgatgcacgatgcatggcatttccaagagcca

SEQ ID NO: 5931 - DNA, 1341 bp, Artificial Sequence
  Description of Artificial Sequence: Synthetic coding sequence
atgtcagcttccaagatacctctttttaaaatgaaagacctgatccttattctatgcttgctcgaaatgtcctttgcggtccccttttttccccaacagtccgggacgccaggaatggcctccctctccctggagacaatgaggcagctcgggtctcttcagcggctgaacactctgtcccagtattccagatatggcttcggaaaaagctttaatagcctttggatgcatggactcttgcccccgcactcaagtctcccctggatgcgaccgagagagcacgagacacagcaatacgaatactccctgcccgtgcacccacctccactaccatcccagcctagtctcaagcctcagcagccggggctgaagccatttctgcagagtgccgctgcgactactaatcaagctaccgccctcaaggaagcactgcagccgccaatccacctcgggcatctgccactgcaggagggagagttacctttggtgcagcaacaggtcgcacccagtgacaagccccccaaacctgaactgcccggggtggacttcgccgacccccaggggcccagcctgccagggatggatttccctgatccccagggtccgtcactcccaggcctcgatttcgccgatccacagggttctacaatcttccagatcgctcggctgatctctcatgggcctatgccacagaacaaacagtctcccctgtacccgggtatgctttatgtgcctttcggcgccaatcagcttaacgctcccgccagactcggtattatgagcagcgaggaggtcgctgggggccgagaagatcccatggcctacggcgccatgtttccgggatttggagggatgaggcctggctttgagggcatgccccacaaccccgccatgggcggggatttcacactcgaatttgattcaccggtcgctgccaccaaggggccagagaacgaggaggggggagcccagggttccccaatgccggaagccaacccagacaacttagagaatcctgcctttctaacggaactagagcccgccccgcacgcgggactgctcgccctgcctaaagacgacattccaggcctgcctcggagcccatctgggaagatgaagggcctgccatcggtgacaccagccgcagccgatcccctgatgactccagaacttgccgacgtgtaccgcacatacgacgcagatatgacaaccagcgtggacttccaagaagaagccacaatggatacaaccatggcccccaactccttgcagaccagtatgcccggaaataaagcgcaggagcctgaaatgatgcacgatgcctggcacttccaggaacct

SEQ ID NO: 5932 - DNA, 1341 bp, Artificial Sequence
  Description of Artificial Sequence: Synthetic coding sequence
atgagtgcctctaaaatacctctcttcaaaatgaaagacctgatcctcatcctctgtctactcgaaatgtcttttgccgttccttttttcccccagcagtcggggactccagggatggctagtcttagtctcgaaacaatgcgccagctagggtctcttcagaggttgaacactctatcccagtattctcggtatgggttcggaaaaagttttaacagtctgtggatgcatgggttgttaccgccacattcttcactcccctggatgaggcctagggaacatgaaacacagcagtatgaatatagtctgccagtccacccccccccactcccctctcagccttctctaaagccccagcagcctgggttgaaacccttcctccagtccgccgctgccactacaaatcaggccactgccctaaaagaagctctccagccccccattcacttagggcatctgcccttgcaggaaggagaactgcccctggtgcagcagcaggtggctccttctgataagccacctaaacctgaactccctggagttgatttcgcggatccccagggaccatcactcccagggatggatttccccgatccacaggggccctctcttcccggacttgacttcgcagatccccaggggtcaacaatttttcagatagcaagactcatatcacatgggccaatgccacagaataagcagtcgccactttatcccgggatgctttacgtaccattcggagccaaccaactgaacgctcctgctcggctggggattatgtcctccgaagaagttgctgggggacgggaagatccaatggcatatggagctatgttcccaggatttggagggatgagaccagggttcgaaggaatgccccataatccagcaatggggggggatttcactctggaatttgattctcccgtggcagccactaaagggccagaaaacgaagaagggggggctcaaggatccccaatgcctgaagctaaccccgataacctggagaatcctgcatttctgactgaactggagcctgctcctcatgcaggactcctagctcttcccaaagacgatatcccaggactccccaggtctcccagtggaaaaatgaaggggcttccgtccgtgacaccagcggcagctgacccattgatgacacctgagcttgcagacgtctataggacttacgatgccgatatgactacttctgtagatttccaggaagaggctactatggatacgactatggcccccaattctcttcagacatccatgcccggaaacaaagcccaggaaccagaaatgatgcacgacgcgtggcattttcaggaaccc

SEQ ID NO: 5933 - DNA, 1341 bp, Artificial Sequence
  Description of Artificial Sequence: Synthetic coding sequence
atgtcggctagcaagatcccattattcaagatgaaggacctgattctcatcctctgcctgttggagatgtccttcgctgtcccattttttccacagcaaagcgggacaccaggaatggcatcactctccctggaaaccatgaggcagctggggtctctgcagcgacttaacactctaagtcagtactccaggtatggctttggaaagagcttcaacagcctgtggatgcatgggctacttccccctcatagctccctcccttggatgagaccaagagagcacgagacacagcaatacgagtactctctaccagtgcatccacccccactcccatctcagccaagccttaagccgcaacagccgggtctgaaacccttcctgcagagcgctgccgccaccacgaaccaggcaaccgcgctcaaggaggccttacagcccccaattcacctggggcacctgcctctccaggaaggcgagttaccccttgttcagcagcaagtggctccttctgacaagccgccaaagcctgagctgcctggcgtcgactttgcagacccgcagggtccctccttgccaggcatggacttccctgatcctcagggtcctagcctgccgggtctggactttgccgacccccagggaagcacaatcttccagattgccaggctgatcagccacggacccatgcctcagaacaaacagtcacccttatacccaggcatgttgtacgtgccatttggtgccaatcagctgaatgctccggcccgcctggggataatgagttccgaggaagtggcggggggacgggaggaccccatggcgtacggagccatgtttccaggattcggaggcatgcgccctgggttcgagggtatgccccacaatccagccatggggggcgactttaccctggaattcgatagccctgtggccgcgaccaagggcccggagaacgaggaggggggcgcacagggctcgccaatgcctgaggccaatccggacaacctggagaatccagctttcctgaccgagcttgaaccagccccgcacgccggactgttagcgctgcctaaggacgacattcccggcttacctcgatcaccctcaggaaagatgaaaggtctgccctctgttacgcccgcagcggcagatccactcatgacacccgaactggcggacgtttaccgcacctacgacgctgacatgactacctctgtggatttccaggaagaggccactatggacacgaccatggcccctaattccctgcaaacctctatgccaggtaacaaggcccaggaaccagagatgatgcacgacgcttggcattttcaggaacca

SEQ ID NO: 5934 - DNA, 1341 bp, Artificial Sequence
  Description of Artificial Sequence: Synthetic coding sequence
atgtctgcctccaaaattcctctgtttaagatgaaagacctcatcctgattctgtgcctcctcgagatgagctttgcggttccattcttccctcagcagagtgggactccgggcatggcctcgctgtcgctcgaaacgatgcggcagctgggatctctgcagaggcttaacaccttaagccagtactcccggtatggcttcgggaaaagttttaattccctgtggatgcacggtcttctaccaccacacagcagcctcccctggatgagaccgagggagcatgagacccaacaatatgagtattccctccctgtgcatccaccccctctaccctcacagccctcactgaagccccagcagcccggattgaagcccttcctgcagagcgctgctgctacgaccaaccaagcaactgcactgaaagaagccctgcagcccccaattcatctcggtcacttgcccctgcaggaaggtgagctccctcttgttcagcagcaagtggctccatcagacaaaccaccaaagcccgaacttcctggcgtggattttgccgatccccagggtccttcgttacccggcatggacttcccagatccacagggccctagcttgccgggtctcgattttgctgatcctcaggggtctaccatttttcagattgccaggctgatatcccacggaccaatgcctcaaaacaaacaatctccattataccctggaatgctgtatgtgcccttcggagcgaaccaactgaatgcccccgcgcgcctgggcatcatgtcatctgaggaagtggccggcggcagggaggacccgatggcctacggcgcgatgttcccaggttttggcggaatgcgtcctgggttcgaaggcatgccacacaatccagctatggggggcgactttactctcgagttcgacagcccagtcgcagctactaagggccccgagaacgaagaagggggtgcacaggggagccctatgcccgaggctaatccagacaatcttgagaacccggcctttctgacggagttggaaccagcccctcacgccggcctactcgcgctgccaaaggatgacatacccgggctgccgaggtctccaagcggcaaaatgaaaggactgccatctgtcaccccggccgcagcggaccccctgatgactcccgaattggcagacgtgtacagaacatatgacgctgatatgaccacatcggttgacttccaggaggaagccacaatggacaccacaatggccccgaacagtctccagacgtccatgccgggtaacaaggcacaggagcccgagatgatgcatgacgcctggcactttcaggagcct

SEQ ID NO: 5935 - DNA, 1341 bp, Artificial Sequence
  Description of Artificial Sequence: Synthetic coding sequence
atgtcggcttcgaaaattccgttgttcaagatgaaggatctgatcctgattctgtgtctgcttgaaatgtcgtttgctgtcccatttttcccacagcagagcggaacgcctggaatggcctcattgtcactcgaaactatgagacaacttggatcacttcagcggctcaacaccttgagccagtattctcgctacggttttggaaagtcattcaactccctctggatgcacggcctccttcctccacactcctcccttccgtggatgcgcccccgcgagcatgaaacgcaacagtacgaatactctctgccagtgcatccgcccccgctgccaagccaaccctcgctgaagccccagcagcccggactcaaaccattccttcagtccgccgccgccactaccaaccaggcgaccgctttgaaggaagcgctgcagccgcccatccatctgggacacctgcccttgcaagagggagaactgccgctcgtccagcagcaagttgcaccgtccgacaagccaccgaaaccagagctgccgggcgtggactttgctgatcctcaagggccttctctcccgggcatggatttccctgacccacagggcccgtcgctgccgggtcttgacttcgcggatcctcagggatcaaccatattccagatcgcacgcctgatctctcacggacctatgccacagaacaagcagtccccactgtacccgggtatgctctacgtgccgttcggggcgaaccaattgaatgcacctgcacggcttggaatcatgtcctcggaggaggtggcgggaggacgggaggatccgatggcgtacggggccatgtttccgggcttcggagggatgcgcccgggctttgaagggatgccacacaatcccgctatgggaggcgacttcaccctcgaattcgacagtcctgttgctgccactaagggaccggagaacgaggaaggtggagcgcaagggtcaccgatgccagaggcgaatccggacaatctggaaaaccctgcgttcttgaccgagctggaacctgcacctcacgctggcctgctggcgttgccgaaggacgacattccggggctcccgcgctccccttcaggcaaaatgaagggcttgcccagcgtgactccggccgccgccgacccgctgatgacgcctgaactcgccgacgtgtaccgaacttacgacgccgacatgactacttcagtcgacttccaagaggaagccaccatggataccaccatggctccgaactccctgcaaacttcgatgcctggtaataaggctcaggaacctgaaatgatgcacgatgcatggcatttccaggaacct

SEQ ID NO: 5936 - DNA, 1341 bp, Artificial Sequence
  Description of Artificial Sequence: Synthetic coding sequence
atgtctgctagtaaaatcccactgtttaagatgaaggatctgattctgatactttgtcttttagagatgagtttcgctgttccctttttcccacagcaatcaggaactcccggcatggcttccctgtccctggaaactatgagacagctcggtagcctacagcggttgaatacacttagtcaatacagccggtatggatttggtaagagcttcaactcactctggatgcacggactgctccccccccattcctccttgccctggatgcggccccgcgaacatgagacacagcagtacgagtactcactgccagtgcatcccccccctctgcccagccagcctagtctgaagccccagcagcccgggcttaagccctttctgcagtccgccgctgcaacgacaaaccaggcaaccgctcttaaggaggccctgcagccgccaatacatctgggccatttgcctctccaggaaggggaattgcctcttgtgcagcaacaagtcgccccatccgataagccaccgaagccagaactcccaggcgttgattttgctgatccgcaaggaccatcattacccggcatggattttccagacccccaggggccttccctgccaggtctcgatttcgctgatccgcaaggcagcacaatattccagatcgccagactgatttcacacggccctatgccacagaacaaacaaagccctctctaccctggcatgctttacgtcccattcggggccaatcagcttaatgcccccgccagactcggaattatgtcttcggaggaggtggccggaggacgcgaagatccaatggcctacggcgccatgttccccggctttggcggcatgagacctgggttcgaggggatgccacataaccctgccatgggcggcgactttaccctagaatttgatagtccggtggctgcaaccaaagggccagaaaatgaagagggtggtgcgcagggttcacccatgcccgaagctaatccagacaacctcgaaaatcctgcctttctcacggagctcgagcctgctcctcatgctggtttactggcactcccaaaagacgatatcccgggtcttcctcgcagcccatcgggtaaaatgaaaggtttgccatctgtaactccagctgctgctgatcctctgatgacaccagaactagccgatgtttatcggacttatgacgcggatatgaccacgtctgttgactttcaagaggaggctacaatggatacaacaatggctccaaacagtctacagacctcaatgccggggaacaaggcccaagagccagagatgatgcatgacgcctggcactttcaggaaccc

SEQ ID NO: 5937 - DNA, 1341 bp, Artificial Sequence
  Description of Artificial Sequence: Synthetic coding sequence
atgagcgcgtccaagatccccctcttcaagatgaaagacttgatcctgatcctgtgcttgctggaaatgtccttcgccgtgcctttcttcccacagcaatcaggcaccccgggaatggcctcgctgagcctggaaaccatgcggcaactgggatccctgcagcgcctgaataccctctcgcaatacagcaggtacggattcggcaagtcgtttaactccctgtggatgcacggattgctgccgccacattcctcgctcccatggatgcgaccgagggaacacgaaacccagcagtatgagtatagcctgcccgtgcacccaccaccgttgccatcgcagccgtcactgaaaccgcaacagccggggctgaagccatttctccagtctgccgccgcgaccaccaaccaagcgacggcactgaaggaagcccttcagccgccgatccacctgggccatctcccgctgcaagaaggtgagctcccgctggtccaacagcaggtcgccccgtccgacaagccccctaagccggaacttccgggggtcgatttcgctgacccgcagggaccgagcctcccaggcatggatttcccggatccacagggcccatcgctgccaggattggattttgcagaccctcagggatcgacgattttccagatagctaggctcatttcccatgggccgatgccacaaaacaaacagtccccgctttacccgggaatgctgtacgttccgttcggagcgaaccagctgaatgctcctgccagactcggaatcatgtcgtccgaagaggtggcgggaggaagagaggacccgatggcttacggagcgatgttcccgggattcggaggcatgcggcccggattcgaaggaatgccacacaacccagccatggggggcgatttcaccctggagttcgattccccggtggcagctactaaggggcctgaaaatgaggagggaggggcccagggtagccctatgccagaggccaaccctgacaacctcgaaaacccagctttcctgaccgaactggagccggcaccacacgcggggctgctcgctctccccaaggacgatatccctggactgcccaggagcccttcgggcaaaatgaagggactgccgagcgtgactcctgcagccgctgacccactgatgaccccggaattggcagatgtctatagaacttacgatgccgacatgactacctccgtggacttccaggaagaagcaactatggataccaccatggccccaaattcgctgcagacttcgatgccaggcaataaggcacaggaaccggagatgatgcacgacgcgtggcattttcaggagcca

SEQ ID NO: 5938 - DNA, 1341 bp, Artificial Sequence
  Description of Artificial Sequence: Synthetic coding sequence
atgtccgcaagcaaaattcccctctttaagatgaaagacctgattcttattctctgtttgctggaaatgtcctttgcagtgcccttctttccacagcagtctggaaccccaggaatggccagcctttctctggaaactatgcgacaacttggatccctccaaagactgaataccctcagccagtattcgcggtacggattcggtaagagcttcaattccctctggatgcacggcctgcttccccctcattcctcactcccttggatgaggccacgtgaacacgaaactcagcaatacgagtactcgcttcctgtgcatccgccgccccttccatcacaaccatcgctcaagcctcagcaaccagggcttaaaccctttctccaatcggccgctgcaaccaccaaccaagcaaccgcgctcaaggaagcccttcagcctccgatccatctgggccaccttcctcttcaagaaggcgagctgcctctcgtgcagcaacaggtggctccatccgacaaacccccgaaaccggaactccctggtgttgattttgcggatcctcaaggtccatcacttcccggcatggatttcccggaccctcaaggcccatctctgcctggccttgatttcgccgaccctcaaggatcgacgatctttcagatagcccgtctcatttcgcatggtccgatgccgcagaacaaacagtcccctctgtacccaggaatgctttacgtccccttcggagcaaaccaactgaatgcacctgcccgcctcgggatcatgagctcagaagaagtggcggggggccgcgaggatcctatggcttacggagcgatgttccctggatttgggggaatgaggccggggtttgaaggtatgcctcataaccctgcgatgggaggtgatttcactctggaattcgactctcctgtggccgcaaccaagggtccagaaaatgaggaggggggtgcacaaggatctccaatgcccgaggccaacccggacaaccttgagaatcctgctttcctcacggaattggaacccgcccctcacgcagggctcctggctctgcccaaggacgatattcctggacttccaagaagcccctcgggcaagatgaagggtttgccttcagtgaccccagcagctgcagatccgttgatgacccccgagttggcagatgtctaccggacctacgatgcagacatgactacctccgtggactttcaagaagaagcaactatggatactacgatggcaccaaactcactgcaaacctccatgccaggaaataaggcacaggaacccgagatgatgcacgatgcatggcattttcaagagcct

SEQ ID NO: 5939 - DNA, 1341 bp, Artificial Sequence
  Description of Artificial Sequence: Synthetic coding sequence
atgagcgcttccaagatcccgctcttcaagatgaaggatctgattcttatcctgtgcttgctcgaaatgtcgttcgccgtgccatttttcccacagcagtcaggtaccccgggaatggcaagcctgtcgcttgaaaccatgcgccagcttggatcgcttcagcggcttaacaccctctctcaatacagccgctacggctttggcaagtcattcaactctctgtggatgcacggactcctgcctccacatagctccctgccttggatgcggcctcgggaacatgagactcagcaatacgagtactcgctcccagtgcaccctcctccccttccaagccaaccatcactgaagccacagcagccagggctgaagccttttttgcaatccgcggcggccaccaccaatcaagcaaccgcccttaaagaagcgcttcaacctcctattcatctcggacatcttccactgcaagaaggcgaattgcctctggtccagcaacaagttgcaccatcagataagcctcccaagccagagcttccgggggtggatttcgcagacccgcaaggtccgtcgctgccagggatggactttcctgacccccaaggccccagcctgccagggttggattttgcagacccacaaggctcaactatcttccaaattgcacgcctgatctctcacggaccaatgcctcaaaacaaacaatccccactttaccctggaatgctctacgtgccattcggcgcaaatcagctgaatgcacctgcacgcctgggtattatgtcctcggaggaggtggcaggcgggcgtgaggaccctatggcatacggtgctatgttccccggattcggagggatgaggcccggtttcgaaggtatgccccataacccggcaatgggtggagacttcaccctggaatttgactcccccgtggccgcgactaagggtccagaaaacgaagaaggaggagcccaggggtcgccaatgcctgaggcgaaccctgataatcttgagaatccggcatttcttactgagctggaacctgcgccacatgcagggctccttgcacttccgaaagatgacattcctggattgccaagaagcccctcgggaaagatgaaaggtctgccctcggtgaccccggcagcagcagatccactgatgactcctgagctcgcagatgtgtacagaacttatgatgcagatatgactacttccgtcgatttccaagaagaagcaactatggacactactatggctcctaacagcttgcagacgtcgatgccaggtaataaggcccaggagccagaaatgatgcatgacgcatggcactttcaagaaccc

SEQ ID NO: 5940 - DNA, 1341 bp, Artificial Sequence
  Description of Artificial Sequence: Synthetic coding sequence
atgtcggccagcaagattcccctgttcaagatgaaagacctgattctgattctttgtctgctggagatgtcgtttgcagttccttttttccctcaacaatcagggaccccaggaatggcaagcctgtcacttgaaaccatgcgtcaactcggttccctgcagaggctgaacaccctctcgcagtactcccgatacgggtttggtaagtcctttaacagcctgtggatgcacggacttctgcctccccactcatcattgccatggatgcggccgagagagcatgaaacccaacagtatgagtactccctgcccgtgcatccccctcctctgccttcacagccgagccttaaaccccagcagccaggccttaagccttttctccaaagcgcggcagccactaccaaccaagccacggcgctgaaggaggcactgcagccaccgattcacttgggccaccttccgctgcaagagggggagctgccactcgtgcaacaacaagtcgcgccctccgacaaacctccaaaacccgaactccccggtgtcgattttgccgatccccaagggccgtcgttgccaggcatggattttccagatccccaaggtccatcgcttccgggcctggattttgccgaccctcaagggtccacgatatttcagatcgcgagacttatttcacatggacctatgccacagaacaagcagtcgcctctttacccaggtatgctgtatgtgccatttggtgccaatcaacttaatgcacctgcacggcttggtattatgtcatcggaagaggtggccggaggaagagaggatccgatggcatacggagcgatgtttccaggatttggtggaatgcgccccggtttcgaaggaatgcctcataacccagccatgggaggtgactttactttggaatttgactcccctgtggcagcaaccaaggggcctgagaatgaagagggtggcgcacaaggcagccctatgccagaagcaaatccagataacctggaaaacccggcttttctcactgaacttgagcccgcgcctcatgcaggtctgctggccctgcctaaagatgatatcccaggccttccacgcagcccttcgggcaagatgaaagggctcccatccgtcactccagcggccgcggatccactcatgacccctgaattggcagacgtgtacagaacttatgatgcagatatgacgacctctgtcgatttccaggaagaagctacgatggacaccaccatggcacctaactctcttcagacttccatgccaggtaacaaggcccaagagcctgagatgatgcatgatgcgtggcacttccaagaacct

SEQ ID NO: 5941 - DNA, 1341 bp, Artificial Sequence
  Description of Artificial Sequence: Synthetic coding sequence
atgagcgcatccaaaatcccactctttaagatgaaggatctgatcctgatcctttgcctccttgagatgtcgtttgccgtcccgttttttccccagcagtcaggaacgccgggaatggcatccctgagcttggaaaccatgagacaactgggaagccttcagcgacttaataccctttcgcaatactcacgctacggttttggtaagtccttcaactcgctgtggatgcatgggcttcttccccctcactcgagcctgccttggatgcgtccacgtgaacacgaaacccaacaatacgaatactccctgcctgttcatcctccaccactccccagccaacccagcctgaagccccagcaaccaggactgaagcccttccttcagtccgcagcagcaactaccaatcaagcaactgcacttaaggaagcgctccagccgcccatccacctgggtcatcttccactgcaagaaggagaactccctctggtgcagcaacaggtggcccctagcgacaagcctcccaagcctgaacttcctggagtggatttcgccgacccacaaggaccctcccttccgggaatggattttcctgacccccaaggaccgagccttccgggactggattttgcggatcctcaaggttctactatctttcagatagcacgcctgatttcacacggacctatgcctcaaaacaaacaatcccccctctaccctggtatgctttacgtgcccttcggagccaaccagctcaacgcaccagcaaggctgggaattatgtccagcgaagaggtggcgggaggaagagaagatcctatggcttacggggcaatgtttcctggctttggaggtatgcggccaggctttgagggcatgcctcataacccagcaatgggtggcgattttacgctggagttcgactcccccgtggctgcaactaagggaccagaaaatgaagagggaggcgcccagggatcaccgatgcctgaggcgaatccggacaaccttgagaatcctgcttttctgacggagctcgaaccggccccacatgccggactgcttgcactgccgaaggatgatattcctggactcccacgctcaccatcaggtaagatgaaaggccttccctcggtgactccagcggcagcagacccactcatgacccccgaactggctgatgtgtacagaacgtacgacgcagatatgaccacgtcggtggattttcaggaagaggcaactatggatactaccatggctcctaattccctccagacgtcgatgcctggtaataaggcccaggagcctgagatgatgcatgatgcatggcactttcaggaaccg

SEQ ID NO: 5942 - DNA, 1341 bp, Artificial Sequence
  Description of Artificial Sequence: Synthetic coding sequence
atgagtgcctcaaaaattccgttgttcaaaatgaaggatctgattcttatattatgcctgctggagatgtccttcgctgtacctttcttcccgcagcagagtggcactccaggaatggcatccctctccctcgagactatgcgtcagctggggagtcttcaacgacttaatacactgagtcagtatagtaggtacggctttggaaagtctttcaactccctctggatgcacggtcttctgccaccgcacagttccttgccgtggatgcggcctagggagcatgaaactcagcagtacgaatattccctgccggttcatcctcctcctctcccaagccagccctcactgaaaccgcagcagccaggcctgaaaccctttctgcagtccgcggctgccacgaccaatcaggctacagccttgaaagaggccttacagccgcccatacacctgggacaccttcctctccaggagggggagctgccactggtgcagcagcaggtggcgccttcagacaaaccgccgaagccagagttgcctggtgtcgacttcgccgaccctcaggggccctctctgccgggcatggatttccccgatccgcaaggccctagcctgccgggcttggattttgccgatccccagggctccacaatattccagatcgctcggttgattagccacgggcccatgccgcaaaacaagcaaagcccactttacccgggcatgctgtacgttccattcggagccaatcaactgaatgccccagcgcgcttaggaatcatgtcgagcgaagaggtggccggaggtcgtgaggacccaatggcttacggcgctatgtttcccgggtttgggggaatgagacccgggttcgaagggatgcctcacaatcctgcaatgggtggcgactttaccctagagtttgatagcccagtggccgccaccaaggggcccgagaacgaagagggaggagctcagggctcccccatgccagaagctaatcctgacaacttggaaaaccccgcgttccttacagaactggagcctgcaccgcacgctgggttactcgctcttcccaaagacgatatcccaggcctcccccgatctccgtccggtaagatgaaagggctgcctagcgtaacacccgcagccgccgaccccctcatgacaccagaactggccgatgtgtaccgaacttatgacgcggatatgactacatctgttgactttcaggaggaggccactatggatacgaccatggcccctaacagtctacagacctctatgcctggaaacaaagctcaggagcccgagatgatgcacgacgcctggcactttcaggaacca

SEQ ID NO: 5943 - DNA, 1341 bp, Artificial Sequence
  Description of Artificial Sequence: Synthetic coding sequence
atgtccgcatcgaagattccattatttaaaatgaaagatttgattttaattctttgcctcttagagatgtccttcgctgttccattctttccccagcaaagtgggacacctgggatggcgagcctctcactggaaacgatgcggcaactgggttctctgcagcggctgaacacactgtctcagtatagtcgctatgggtttggaaaatccttcaattctctatggatgcacggtttgttgccaccccacagttcactcccttggatgcgaccacgtgagcatgaaactcagcagtacgagtactcactcccagtacaccctccaccacttcccagccaaccaagtctgaagccccaacagcctgggttgaaacccttccttcaaagtgctgctgccacaacaaaccaggccactgcactcaaggaagcccttcaaccacctatccacctgggtcatctgccgttacaggaaggcgagcttcctctggttcagcagcaggttgccccttcagataaaccgcctaagcccgagctcccaggggtcgactttgccgatcctcagggcccaagcttgccaggcatggacttcccagacccccagggaccatccctacctgggctcgattttgccgacccccaagggagcacgatattccagatcgcacggttaataagtcatgggcccatgccgcaaaataagcagtcccccttgtatccaggcatgctgtacgtgccattcggcgcaaatcagctgaacgcccccgctcgtcttggcataatgtcaagcgaagaggtggcaggggggagggaggaccccatggcctatggtgcaatgttccccgggttcgggggaatgcgtccagggtttgagggcatgccacataacccggccatgggaggtgatttcacattggagttcgactcgccggtggccgcgactaaaggccccgaaaacgaagagggaggggcccagggctccccaatgcccgaggcgaatccggataacttggaaaatcccgcctttctgacagaactagagcctgcaccgcatgcggggctgttggccctgcccaaggatgacatcccaggattgcccagatccccctctggaaagatgaaaggtctgccgtctgtaaccccagcagcagcagaccccctgatgaccccagagctggctgacgtgtaccggacttacgatgctgacatgaccacatcagtagacttccaagaggaggctacgatggacactactatggcccccaactctcttcaaacatccatgccaggcaacaaagcacaggagcctgagatgatgcacgatgcttggcattttcaggaacct

SEQ ID NO: 5944 - DNA, 1341 bp, Artificial Sequence
  Description of Artificial Sequence: Synthetic coding sequence
atgagcgcatcaaagattcctctgttcaaaatgaaagacttgatcctgattctgtgcctgttggaaatgagcttcgcggtgccattcttcccacagcagtcggggaccccggggatggcgtcgttgtcgctcgagactatgcgccaactgggctcgctccaaagactcaacactctctcacagtactcgcgctacggcttcggaaagtcatttaactccttgtggatgcacggtctgttgccacctcactcttcgctgccatggatgcgcccgcgtgaacatgagacgcaacaatacgaatactccttgccggtgcacccaccaccgctcccctcgcaaccgtccctcaagccgcagcaacccggcctcaagcctttcctgcagtcggcagcggcaactaccaatcaggccactgcgctgaaggaggcactccagcctccaatccatctcggccacctgccgctgcaggagggagaacttccgctggttcaacagcaggttgcgccttcggacaaaccccctaagccggaactgcctggcgtggatttcgctgatccccaaggtccgagcctgcccggaatggactttccggacccacagggaccatcgcttccaggactggacttcgccgacccgcagggctccactattttccagatcgcgcggctcatcagtcacggacctatgccacagaacaaacaatcgccactctaccctggaatgctgtacgtgcccttcggagctaatcaactcaacgcccctgctcgcctcggaatcatgagctcagaggaggtcgccggaggccgcgaggacccgatggcgtacggagccatgttcccgggattcgggggaatgcgacctggattcgagggaatgccgcacaaccccgcaatgggcggggatttcaccctggaattcgactccccggtcgcggcgactaagggccctgaaaacgaagaaggaggagcgcaaggaagccctatgcccgaggcgaatccagataatctcgaaaacccggccttcttgacggagctggaacctgcgccgcacgctgggctgctggcacttccgaaggacgacatcccgggcctgcctcgctccccctctggaaagatgaagggtctgccttccgtgaccccggctgctgctgacccgctgatgaccccagagctcgcagatgtgtatcgcacttacgacgcagacatgactacctcagtggactttcaggaagaagccactatggacaccaccatggcccctaactcactgcaaacctcgatgcctgggaacaaagcccaagagcctgagatgatgcatgacgcgtggcatttccaggaaccc

SEQ ID NO: 5945 - DNA, 1341 bp, Artificial Sequence
  Description of Artificial Sequence: Synthetic coding sequence
atgagcgcatccaaaatcccactgtttaagatgaaagaccttatccttattctttgtctgcttgagatgtcgttcgccgtgccttttttcccacaacaatcaggaactcctggaatggcgagcctttcacttgaaaccatgagacaactcggttcgctgcaaagactcaacactctttcccagtactctcgatacggatttgggaagagctttaactccctgtggatgcatggactgcttccaccacattcgagcttgccttggatgcgaccgagagaacatgagactcaacagtatgaatactcgcttcctgtgcacccacctcctctgcctagccaaccttcgcttaagcctcagcagcctggtctgaagccatttcttcagtccgcggcagcgacgacgaaccaagccactgcacttaaagaggctctgcaaccacctatacatcttggacatctccctttgcaagaaggagaattgccacttgtgcagcaacaggtcgcgccctcggataaacctccaaagccggagttgcccggggtggatttcgcagacccccaaggaccttcactcccaggcatggatttccccgatccacaaggaccgtcgctgcctggcctcgattttgcagaccctcagggttcgaccatattccagatcgcccgacttatcagccatggaccaatgcctcaaaacaagcagtcaccgctttaccctggtatgctgtacgtcccattcggtgcaaaccaacttaacgccccagcacgcctcggtattatgtcctccgaagaagtcgccggtggcagagaggatcctatggcctacggagcaatgttccctggattcggtggaatgaggccaggattcgaggggatgcctcataaccccgcaatgggaggcgattttactttggagtttgattcaccagttgcggcaactaagggaccagaaaatgaagaggggggtgcacagggttcgccgatgccagaagccaacccagataatcttgaaaaccccgcctttcttactgaactcgaacccgcacctcatgcaggcctgctggccctccctaaggatgacattcccggcttgccacgaagcccatcaggtaagatgaagggacttccatcggtgaccccggccgcagcagatccgttgatgacccctgagctggcggatgtctaccggacttacgatgcagacatgaccacctcggtggattttcaagaagaagcaaccatggatactaccatggcgccgaatagcctccaaacttcaatgcctggtaataaggcgcaggagcctgaaatgatgcacgacgcgtggcatttccaggagcct

SEQ ID NO: 5946 - DNA, 1341 bp, Artificial Sequence
  Description of Artificial Sequence: Synthetic coding sequence
atgtctgcatccaagattcctctcttcaagatgaaggacttgattctcatcctttgcctgctcgaaatgtctttcgcagtgcctttctttccccaacagagcggaacccctggtatggcatccctgagccttgagacaatgcgccagttgggcagtctgcaaaggctcaatacactgagtcagtactcacgctacggattcggcaagagctttaactccctgtggatgcacggtctcttgcctccacactctagtctcccttggatgagaccccgtgagcacgaaacccagcagtatgaatatagtctccccgtccacccacctcccctgccatcccaaccctcacttaagccccaacagcctggtctcaaaccattcctgcaatcagccgcagccaccactaatcaggcaaccgctttgaaggaggcactccagccaccaattcaccttggccatcttcctctccaagagggcgaactgcctcttgtccagcaacaagtcgccccatctgacaagccacccaagccagagttgcccggcgttgattttgcagatcctcagggaccctcacttcctggtatggacttccccgacccccaaggcccctctctccccggcttggatttcgcagatccacagggctctaccatctttcaaatcgctaggctcatcagccatggacctatgccccagaataagcagagccctttgtaccctggtatgctgtatgttcccttcggtgccaaccagcttaacgcccccgcaagattgggaatcatgtcatctgaggaagtcgccggaggccgcgaagaccccatggcctacggtgcaatgtttcctggtttcggtggcatgcgtccaggttttgaaggaatgccccacaatcctgcaatgggaggcgacttcacactcgaattcgactcacccgtggccgctacaaagggccctgaaaatgaggagggtggcgctcagggttcccctatgccagaagctaaccccgacaacctggaaaatcctgctttcttgacagagttggagcccgcaccacacgccggtcttctcgctcttcccaaagatgatatccccggcctccctcgctcccccagcggaaaaatgaagggtctgccatctgtaactcccgccgctgcagatcccttgatgacacccgagttggcagacgtgtaccgcacttatgacgcagacatgaccacaagtgttgattttcaggaggaggccactatggacacaaccatggcccccaacagtctgcaaacttcaatgcctggcaacaaggctcaggagcccgagatgatgcacgatgcttggcatttccaagaacca

SEQ ID NO: 5947 - DNA, 1341 bp, Artificial Sequence
  Description of Artificial Sequence: Synthetic coding sequence
atgtccgcctccaagatcccgctgttcaagatgaaggatctgatcctcatcctgtgtctgctggagatgtcattcgccgtcccattctttccacaacagtcaggcactccaggtatggctagcctgtctctcgagacgatgcgccagctgggttcgctgcaaagactcaatacgctctcccaatactcaagatacggttttggcaaaagtttcaactcgctttggatgcatggactgctgcctcctcactcgtcgctgccgtggatgcggccccgcgagcacgaaactcagcagtacgaatactccctccccgttcatcctccgccactgccgtcccagccgtcactcaaaccgcagcagccggggctgaagccctttctgcaatccgctgccgcaactaccaatcaggccaccgctctcaaagaagctctgcaaccgccgatccatctgggccacctgccactccaggagggagagctgccgctggtgcagcaacaggtcgccccgagcgataagccgccgaaaccggaactgccgggcgtcgattttgccgatccacaggggccgtccctgccaggaatggacttcccagaccctcaaggtccttcgctgccggggctcgacttcgcggaccctcagggatcaactatattccaaattgcgcggttgatttcgcacggaccgatgccgcaaaacaagcagagcccgctctacccgggaatgctgtacgtgccattcggagcaaatcagctgaacgcaccggcgcggctgggaatcatgtcctcagaggaagtcgccggaggaagagaagatccaatggcttacggagctatgttcccgggctttggaggaatgaggcccggattcgaaggcatgcctcacaacccagccatgggaggcgacttcactctggagtttgattcgccagtggcggcgaccaagggacctgaaaatgaggaaggaggtgctcagggtagcccgatgccggaggctaacccggataacctggaaaacccagcatttctgacggaactggagcccgctccccacgctggactgctggcgcttccaaaggatgacatcccaggcctgccgcgctcaccgagcggaaagatgaagggactgccgtcagtgaccccggccgcagccgacccattgatgaccccggaactcgctgacgtctatagaacctacgatgccgacatgaccacttcagtggacttccaagaggaggccactatggacactactatggcgcctaattcactgcagacctccatgccgggaaataaggcccaggagccggaaatgatgcacgatgcatggcatttccaggaacct

SEQ ID NO: 5948 - DNA, 1341 bp, Artificial Sequence
  Description of Artificial Sequence: Synthetic coding sequence
atgtcggcatcgaagataccattgttcaaaatgaaggatcttatcctgatcctgtgcctgctggaaatgtcgtttgctgtgcccttttttccgcaacagtccggcaccccaggaatggcctcgctgtcccttgaaaccatgcgccaactcggatctctgcagcggctcaatactcttagccagtattcgcgctacggattcggtaagtcgttcaactcgctgtggatgcatggactgctgccgccccattcttcgctcccgtggatgcgccctcgcgaacatgaaactcagcagtacgagtactcgcttccagtgcacccacctccactgccttcgcaacctagcctgaagccccagcaaccagggcttaaaccattcctgcaatccgcggcagctaccactaatcaagcaacggctctgaaagaagcccttcaaccgccgatccatctgggacacctgccgttgcaagagggagaactgccgctggtccagcagcaagtggccccatccgacaaaccaccgaaacctgaattgcccggcgttgacttcgcggacccacagggcccgtccctcccagggatggacttcccggatccgcaaggaccgtccctgccgggcttggatttcgctgatccgcagggatccacgatcttccagatcgcgagactcatctcacatggaccgatgccccagaataaacagagcccactctacccgggcatgctctacgtgccgtttggagcgaatcagctgaatgcacccgcgcggctgggaatcatgagctccgaggaggtggcgggcggtagggaagatccgatggcatacggagccatgttcccgggattcggaggtatgaggccgggattcgaggggatgccacacaaccctgctatgggcggggatttcaccctggaatttgatagcccagtggccgccactaagggccctgagaacgaggagggaggcgcgcaaggatcacctatgccggaggctaaccccgataacctcgagaaccctgcattcctgaccgagttggagcccgcgccccatgctgggcttcttgccctgccaaaagatgatatcccgggactgccgcgtagcccgagcgggaagatgaagggtctgccatcagtgacccccgctgccgccgaccccctgatgactcccgagctcgccgacgtctacaggacctatgacgcagacatgaccacctccgtcgatttccaggaggaggcgactatggacactaccatggctccgaactcactgcaaacctcgatgccgggaaacaaggcgcaagagccggagatgatgcatgatgcatggcactttcaggaaccg

SEQ ID NO: 5949 - DNA, 1341 bp, Artificial Sequence
  Description of Artificial Sequence: Synthetic coding sequence
atgtcggcctccaagatccccctttttaaaatgaaagatctcatccttatactgtgcttgctggagatgtctttcgctgttcctttcttcccacagcaaagcgggacccctggtatggcttctctgagtcttgagaccatgagacagctggggtctcttcaacgcttgaacacactgtcccagtacagccggtacggcttcggcaagtcattcaacagtctgtggatgcacgggttactgcctccgcattcaagtctgccttggatgcgaccaagggagcatgaaacccagcagtatgaatactccctccctgtgcaccctccccctctccccagccagcctagcctcaagccacagcagcccggcttgaagccattcctccagtccgccgctgcaaccactaatcaggccacagcccttaaagaagctttacaacctccaattcatctcggccacttgcccctacaagagggtgagctgcctttggtgcaacagcaagtggccccatccgacaagcctcccaagcctgagttgcctggtgtggattttgctgacccacaagggccttctctcccgggcatggacttccccgatccacagggtcctagcctgcctggcctggacttcgccgatcctcagggctcaactattttccagatcgcacggttgatcagccatgggcccatgcctcagaacaagcagtcccccctttacccagggatgttatacgtcccctttggcgcaaatcagcttaacgctccagcccggctgggaatcatgtccagcgaagaagttgccggcggcagggaagacccgatggcctatggagccatgtttcccggatttgggggtatgcgccctggcttcgagggtatgccccataaccccgcaatgggtggagatttcaccttggaatttgatagccctgttgcagctactaagggacccgaaaacgaagaaggcggggcccagggtagccccatgcccgaggccaacccagataacctcgaaaaccccgcgtttctcaccgagttggaaccagcaccccacgccgggctgttggcactccccaaggacgatattcctggactcccccgcagcccgagcggtaaaatgaagggtttaccctctgtgacaccggccgccgccgatccccttatgacgcctgaactggccgatgtttacagaacctacgacgcagatatgactacgagtgttgatttccaggaggaggccactatggatactaccatggctcctaacagcctccaaacgtctatgccgggaaacaaagcacaggaacctgaaatgatgcatgacgcgtggcacttccaagaacca

SEQ ID NO: 5950 - DNA, 1341 bp, Artificial Sequence
  Description of Artificial Sequence: Synthetic coding sequence
atgagcgcaagcaaaatacccctctttaagatgaaagacctcatcttgatcctttgcctcctggaaatgtccttcgcagtcccatttttcccacaacagagtgggactcccggaatggctagtttgtctcttgaaaccatgcgacaactgggttcactgcagagactcaacaccctgtcacagtatagtaggtatggtttcgggaaatcctttaacagcctctggatgcacggcctcctccccccgcacagctcactgccgtggatgagaccccgagagcatgaaacacagcagtacgagtacagcctgccagtgcacccgcctccactgcccagtcagccatccctgaaaccccagcaacctggtcttaagccgttcctgcagtcagccgccgcaacgaccaatcaggcgaccgccctgaaggaagctttgcagccaccaatccacctgggccacttgccccttcaggaaggtgaattgcctttggtgcaacagcaagtggctcctagcgataagcccccaaaacctgagttgcctggcgtcgatttcgctgacccccagggaccgtccttgccagggatggactttccagatcctcaaggaccttcactccctggacttgactttgcggaccctcagggctccacaatttttcagattgccagattgatttcacatgggcccatgccccagaataaacagagtcctctgtacccaggcatgctgtacgtaccgttcggcgcgaaccaattgaacgcacctgcccgcctgggaatcatgtcaagtgaagaagttgctggaggacgggaagacccaatggcctatggggcgatgtttccgggctttggcgggatgcggcccgggtttgaaggcatgccccataacccggcaatggggggcgactttacactggagtttgactctccggtcgccgccactaaagggcctgaaaatgaggaggggggtgcgcagggctctcccatgccagaagcgaatccggacaacctcgaaaatcccgcttttttgacagaattggagcccgcaccccatgctggactcctcgccctgcctaaggatgacatcccgggcctccctcgaagcccgtcaggcaagatgaagggactgccatctgtgacccccgcagcggccgatccgctcatgacccccgagttggccgatgtgtaccgcacttatgacgcggacatgaccacttctgtggatttccaagaggaggcgaccatggacaccaccatggcgccgaactcccttcagacttccatgcctggcaacaaagcccaagagccagaaatgatgcacgacgcctggcatttccaggaaccc

SEQ ID NO: 5951 - DNA, 1341 bp, Artificial Sequence
  Description of Artificial Sequence: Synthetic coding sequence
atgtccgcttctaagataccgcttttcaagatgaaagaccttatccttattctttgtcttttggagatgtcgttcgcagttcccttttttcctcagcaaagcggaactccgggtatggcctctctctcgctggagacgatgagacagctcggatcactgcaacggctcaataccctgagccagtactccagatacggatttggtaagtcattcaattcgctttggatgcatggactcctcccacctcactcgagccttccgtggatgcgaccaagagaacatgaaacccagcaatacgaatattcacttcccgtccatcctccaccattgccttcgcaaccatcccttaagccccaacaaccggggcttaaaccgtttcttcaatcagcagcagcaactactaatcaagcaactgccctgaaggaggccctgcaacccccaatccatctcggacatctccctctgcaagaaggcgaacttcccctcgtgcagcagcaggtggcccccagcgacaagcctcctaagccagaactgcctggcgtggacttcgcagacccccaaggtccatcacttcccggaatggatttcccggatccccagggcccatcgctccccggattggactttgcagaccctcaggggagcaccatatttcagattgcacgcctgatatcgcatggacctatgccccagaacaaacagtcacccctttacccaggcatgctgtacgtgcctttcggcgcaaatcagctcaacgcgcccgcaagactcggaattatgtcctccgaggaagtggcaggcggtcgcgaggacccaatggcatacggtgctatgtttcccggttttggcggtatgcgccccggatttgaaggtatgcctcacaaccccgccatgggaggagatttcaccctggaattcgattcgcccgtcgcggctacgaagggtcctgaaaacgaggaagggggagctcaaggttcacccatgcctgaggcaaatcctgataacttggaaaatccagcgtttctgacggaacttgaacccgccccacatgccggcctgttggcactccccaaagacgatatacctgggctcccgcggtcacctagcggcaaaatgaagggcctcccctcggttacgcccgccgccgctgatcccctgatgactccggaactggcggatgtgtaccgtacgtacgatgcggatatgaccacctcggtcgattttcaagaagaagcaacgatggatactaccatggcacctaactccctgcaaacctccatgccaggaaacaaggcacaggagccagagatgatgcacgatgcctggcacttccaagaacct

SEQ ID NO: 5952 - DNA, 1341 bp, Artificial Sequence
  Description of Artificial Sequence: Synthetic coding sequence
atgtccgccagcaaaatcccgctttttaagatgaaagatctgattctgatactttgcctgctggagatgagcttcgcagtaccattcttcccccaacagagcggcactcctggcatggcgtctctcagtctcgagaccatgaggcagctggggtcattacagcgcctgaataccctgagtcagtattccagatatggatttggcaagagcttcaatagtctctggatgcacggactgcttccaccacactcctctcttccatggatgcggccgcgggagcatgagacacaacagtatgaatattctttacctgtgcacccacctccacttcctagccaacctagcttgaagccacagcagcccgggctcaaaccattccttcagagcgcggcggccacaaccaatcaggccacagccctgaaggaggctctgcagccacccatacatttgggtcacctgccactccaagagggcgaactccctttggtccagcagcaagtggccccatctgacaagccaccgaaacctgaactgcccggcgttgactttgccgatccacaagggccctccctgcctggaatggactttccagatccgcaagggcccagtttgcccggcctggacttcgccgatccacaggggtccaccatattccaaatagccaggcttatcagtcacgggcctatgcctcagaacaagcagtcccccctgtacccaggcatgctctacgtgccattcggtgctaatcagctaaacgctccagccagactggggattatgtcctctgaagaagttgctggtgggagagaagaccctatggcctacggggccatgtttcccggctttggcggcatgcgtcctgggttcgagggcatgccacataaccctgctatgggcggcgattttaccctcgagttcgattcacctgttgccgccacgaagggcccagagaacgaggagggaggtgcccaagggtcccccatgcccgaggcaaacccggacaacctcgaaaatcccgcgttcctgaccgagctggagcccgcgcctcatgcaggcctgctggcattgcctaaggacgacatcccgggcctgcctcgctcgccatctggtaagatgaaggggctgccttccgttacccccgcagcagctgatccactgatgacacctgagctggcagacgtgtatcggacttacgacgccgacatgacaacctccgtggattttcaggaggaagccacaatggacaccacaatggctccgaattcccttcagacgtcgatgcctggcaacaaagcccaggaacccgagatgatgcatgacgcttggcattttcaggagcca

SEQ ID NO: 5953 - DNA, 1341 bp, Artificial Sequence
  Description of Artificial Sequence: Synthetic coding sequence
atgtctgctagtaagattcccctgtttaagatgaaggatctgattttaatcctctgcctgctcgaaatgtccttcgctgtgcccttcttcccacagcaatccggcactccagggatggccagcctgtcactggaaacaatgagacaactaggcagcctccagagactgaacacactgagccaatacagcaggtacgggttcgggaagagcttcaacagcctgtggatgcacggcctgctacctcctcatagttctctcccatggatgcgtcccagagaacatgagacccagcagtatgaatatagcctgccagtgcaccctcccccactgccttctcagccaagtctgaagccacagcagccagggcttaagccatttctgcagagcgccgctgccactaccaaccaagccacagcactgaaagaggctctgcagccacccattcacctgggtcatctgccacttcaggagggagagctgccactggtgcagcaacaggttgccccatctgacaagccccctaaaccagagctgccaggcgtggacttcgcagatccacagggccctagtctgcccgggatggacttccccgatccacagggacctagtctgcctgggctggatttcgccgaccctcaggggtcaaccatatttcagattgcccgtctcattagccatggacctatgccacaaaataaacaatctcccttgtatccaggaatgctatacgttccatttggtgctaatcagctgaacgccccagctcggctagggattatgtccagcgaggaggttgctgggggacgggaagaccctatggcctatggcgctatgtttcctggctttggaggtatgagaccaggatttgaaggcatgcctcacaatccagcaatgggcggagatttcacactcgagttcgactctcctgtggccgctaccaaaggccctgagaatgaagagggcggtgcccaaggctctccaatgcctgaagccaatccagacaacctggaaaaccctgctttcttaactgagctagagcccgcccctcacgcaggcttattagctctgcctaaagacgacatacctgggctacctcgcagcccaagcggcaaaatgaaggggctgccttctgtgactccggctgctgctgaccctctgatgactcctgaactggcagacgtttaccggacctacgacgcagacatgaccacatctgtggacttccaggaagaagccactatggacacaacaatggcccccaattcactgcagacatccatgccaggcaataaagcccaagagccagaaatgatgcacgatgcctggcacttccaagagcct

SEQ ID NO: 5954 - DNA, 1341 bp, Artificial Sequence
  Description of Artificial Sequence: Synthetic coding sequence
atgtccgcatccaaaatccctttgtttaagatgaaagatcttatccttatcttgtgtcttttggaaatgtcatttgcagtgccattctttcctcagcagtcgggtacgccaggtatggccagcctgtcgttggaaacgatgagacaactgggttccctgcaacgtttgaacaccctgagtcagtactcgaggtatgggtttgggaagtcgttcaatagcttgtggatgcatggtctgctgcccccacattcgtccctgccatggatgcggcccagagaacacgagactcaacaatacgagtacagcctgcccgtgcatcccccaccactgccatcccaaccaagcctgaaacctcagcagcctggcctcaagccctttcttcaatcggcagcggccactactaaccaagcaaccgctcttaaggaggcgctgcagccgccgattcatcttggacacttgcctttgcaggaaggtgaactgccccttgtccagcaacaggtcgcaccgtcagataagccccccaaacctgagctgccaggagtggacttcgcagacccccagggaccatcgctccctggtatggattttcctgaccctcaaggaccctctcttcctggactcgattttgccgatccgcaaggctcaactatattccaaattgctcgtctgatatcgcatggtccaatgccacagaacaaacaatctcctctttaccctggaatgctctacgtgccttttggtgcaaaccagctgaacgcgccagcacggctggggatcatgtcatcagaagaagtagcaggggggcgcgaagatcctatggcctatggggcaatgtttcctggctttggtgggatgcgcccggggttcgagggcatgccacataatccagccatggggggtgacttcaccttggagtttgactctcctgtggcggcaacgaagggccctgaaaatgaggaaggaggagcacagggttcaccaatgccggaagccaatccagataaccttgagaatccggcgttcttgacggagctcgaacccgcacctcacgcgggactccttgcacttcccaaggacgatattcccggactgccaaggtcgccatctggcaagatgaagggactcccttcggtgactccagccgcggcggatccacttatgacccccgagctcgcagacgtctacagaacctacgatgctgatatgaccacctcagtggactttcaagaagaagccactatggataccactatggctcccaactcccttcaaaccagcatgccagggaacaaggcacaggaacctgaaatgatgcatgacgcatggcacttccaagaacca

SEQ ID NO: 5955 - DNA, 618 bp, Artificial Sequence
  Description of Artificial Sequence: Synthetic coding sequence
atgggaacgtggattcttttcgcatgcctggtaggcgcggcatttgccatgcctctgccgcctcatcctggacatccaggctatatcaacttttcctacgaaaattcacattcccaggcgattaatgtagacagaattgcactggttctgacgccattaaagtggtatcagtcaatgattaggccgccatattcgagctatgggtacgagccgatgggaggatggcttcatcaccaaattatacctgttgttagccaacaacatccattaactcatacacttcagtcgcatcatcacatccctgtagtcccggcccagcagccgcgggttagacaacaggcattaatgccggtacctgggcagcagagcatgacaccgactcaacatcatcaaccgaacctgcctctgccggcacaacagccgtttcagcctcagccggtgcagccacagccacatcagcccatgcagccgcagcctccagttcagcctatgcaaccacttctgcctcaaccgccgctcccgccaatgttcccgcttagaccgcttcctcctatccttcctgacttgcatctggaagcatggcccgccactgataagactaagcaggaagaagttgat

SEQ ID NO: 5956 - DNA, 618 bp, Artificial Sequence
  Description of Artificial Sequence: Synthetic coding sequence
atgggtacctggattttattcgcctgccttgtgggcgcagcgttcgcaatgcccctgccaccccaccccggtcacccgggctacatcaatttttcctacgaaaattcccacagtcaggccatcaacgtggatcgcatagcgttggttctgacccccttgaagtggtaccagagtatgattcgtccaccctacagcagctatggttatgagccgatgggaggctggctgcaccaccaaataattcccgtggtgagtcagcagcatcccttgacacacactctgcagtcccatcatcatatacccgtggtgccggcgcagcaacccagggtccggcagcaggcacttatgcccgtacccggccaacagtctatgacgcccacacagcatcaccagccaaacctgccattgccagcgcagcagccctttcagccgcagccagttcagccccaaccccatcagccgatgcaaccccagccgccggtgcaaccaatgcaaccactcctacctcagccgccgctgccccctatgttcccacttcgcccactgccacccatcttgccagacctgcacctggaagcttggccggccacagacaagacgaagcaggaggaggttgat

SEQ ID NO: 5957 - DNA, 618 bp, Artificial Sequence
  Description of Artificial Sequence: Synthetic coding sequence
atgggaacctggattctctttgcatgtctggtgggcgccgcctttgcgatgcctcttcccccgcaccctggccatccgggatacatcaacttctcctatgagaactctcactcccaggccattaacgtggacagaatcgctctcgtcctaactcccctgaagtggtatcagagcatgatacggccaccctactctagttatggctacgagcccatgggaggttggctgcaccatcagatcatccccgtggtgtctcaacaacacccactcacacacacccttcagagccatcaccacatacccgtggtgcctgcacagcaaccccgcgtgcggcagcaagccttaatgcccgtaccaggtcagcagagtatgacccctacccagcaccatcagcccaatctgcccctccccgcccaacaacccttccagcctcaaccagtgcagccacagcctcaccagcctatgcagccacagccccccgtccagcctatgcaaccgctactgccacagccaccactgcctccaatgttcccgcttaggcccctgccaccaatcctccccgacctccaccttgaagcatggccagcgactgataaaactaagcaggaagaggtggac

SEQ ID NO: 5958 - DNA, 618 bp, Artificial Sequence
  Description of Artificial Sequence: Synthetic coding sequence
atgggtacatggatcttattcgcttgcctggtcggcgccgcattcgcaatgcccctgccgccacaccctgggcaccccggatacataaatttctcatatgagaatagccattcacaagcgattaacgtagacagaattgccttggtcctgacgccactgaagtggtatcagtctatgattagacctccgtatagttcgtatggttacgagccgatgggcggctggctgcatcaccagattatcccggtcgtgagccaacagcaccccctgactcacacattgcaaagccatcaccacatcccggttgtcccagcccaacagcccagagtgagacagcaagcattaatgcccgtgcccggacagcaatccatgacgcccacccagcaccatcaacctaatctacctctcccagctcagcagccatttcaacctcagccagtccaaccccagcctcatcaacctatgcaaccacagccccccgtgcagcctatgcagcctttactgccccagccacctctccccccaatgtttcctctcagacccctgccccccatactccctgatcttcacctggaggcttggcccgccactgacaaaacaaaacaagaggaggtggac

SEQ ID NO: 5959 - DNA, 618 bp, Artificial Sequence
  Description of Artificial Sequence: Synthetic coding sequence
atgggtacttggattctctttgcctgtctggtgggcgcagcattcgccatgcctttgcctccacacccgggacatcctggatacataaacttttcatacgagaattcacactcgcaggcaattaacgtggacagaattgctcttgtcctgacccctctcaaatggtaccaatcgatgattagacctccttactcctcctatggatacgaaccgatgggtggttggctgcatcatcagattattccagtggtgtcgcaacagcatccactcacgcatacgctgcagtcgcatcaccatattcccgtcgtgccggcgcaacagccccgcgtgcgccagcaggctcttatgcctgtgcctggccaacaatccatgacgccaacccaacaccatcaaccgaatctccccctgcctgcgcaacaacccttccagccacaaccggtgcaaccacagcctcaccagcctatgcagccccagccacccgtgcaacccatgcaacccctgcttcctcaacctccattgccacccatgtttccactgaggccactcccaccgatcctcccagatctgcacttggaggcatggccagccacggataagaccaagcaggaagaagtcgac

SEQ ID NO: 5960 - DNA, 618 bp, Artificial Sequence
  Description of Artificial Sequence: Synthetic coding sequence
atgggtacctggatactctttgcatgtctggtgggggcagccttcgctatgcctcttccaccccatccaggacatcctggttacatcaacttttcatacgaaaacagccactcacaggctatcaacgtcgataggattgcactggtgctgactccactcaagtggtaccagtccatgattagacccccatactcgtcctacggatacgaacctatggggggatggcttcatcatcagatcattcctgtcgtctcgcaacagcaccctctgactcatacccttcaatcacatcatcatattccagtggtgccagcccaacaacctcgagtgaggcaacaggcactcatgcctgtccccggacagcaatcaatgacgcctactcaacatcatcaaccaaatctgccgcttcccgcacaacaaccttttcaaccacagcctgtccagccacaaccccatcaacctatgcaacctcaaccccctgttcagcctatgcagcctcttctgccacagcctcctctgcctcctatgttcccacttcgtcctttgccacctattcttcctgatcttcacctcgaagcctggcctgcaaccgataagactaagcaagaagaggtcgac

SEQ ID NO: 5961 - DNA, 618 bp, Artificial Sequence
  Description of Artificial Sequence: Synthetic coding sequence
atgggaacttggattctgttcgcatgtctggtgggggcagcatttgccatgccactgcctccccatcctggtcatccaggttacataaactttagctacgagaactctcattcccaagcgataaacgtggacagaatcgcactcgtccttacgcccctgaagtggtaccagtcgatgattcggccaccatactcgtcctacgggtacgaacctatgggcggatggctccaccatcagattatcccagtcgtgtcccaacaacatccacttactcataccctccaatcacaccaccatatccccgtcgttcccgcccaacagccgcgcgtgcgacagcaggcacttatgcctgtgcctggccaacagtcaatgactcccacccaacatcaccaaccaaacctgccgcttcctgcacagcaaccattccagccacagcctgtccaaccacaaccacatcagcctatgcaacctcaacctccagtccaaccgatgcagcctctgttgcctcagcctcctctgcctcccatgttccctcttcgacctcttcccccaattcttcctgatctgcatctggaggcctggcctgccaccgataagaccaaacaagaagaagtcgac

SEQ ID NO: 5962 - DNA, 618 bp, Artificial Sequence
  Description of Artificial Sequence: Synthetic coding sequence
atgggtacatggatattatttgcttgcttagtgggcgcagcgtttgccatgcctctgcccccccatccagggcaccccgggtatatcaatttcagttatgagaattctcactctcaggctatcaatgtggacagaatcgccttagtcctaacgcctctgaagtggtaccaaagcatgatacggccgccctactcatcatatgggtacgagcccatgggagggtggctacaccaccagatcattcccgtcgtttcccagcagcaccctttgacgcacacgctccaatcccaccaccatattccagttgttccagcccagcaacctagggttcgccagcaggccctcatgccggtcccaggccagcagtctatgacaccaactcagcaccatcagccgaacctgcccctgccagcgcagcagcccttccaaccccagccggtgcagcctcaaccccatcagcctatgcaaccgcagccccccgtccaaccaatgcagcctctcttgcctcaacctcccctcccacctatgttccccctccgaccactgcctccgatactgcctgacttgcacttggaagcatggcctgccacggataagacgaaacaggaggaagttgac

SEQ ID NO: 5963 - DNA, 618 bp, Artificial Sequence
  Description of Artificial Sequence: Synthetic coding sequence
atgggaacatggattttatttgcttgtttagttggtgctgcatttgctatgccattaccaccacatcctggtcatccaggatatataaattttagttatgagaattctcattctcaagcaattaatgttgatagaatcgctttagttctcactccattaaaatggtatcaatcaatgattcgtccaccatattcatcttatggatatgaacctatggggggatggttacatcatcaaattattcctgttgttagtcaacaacatccattaactcacacacttcaaagtcatcatcatataccagtagttccagctcaacaaccaagagtgaggcaacaagcattgatgccagttccaggacaacaatcaatgacaccaacacaacatcatcaaccaaatttaccattaccagcacaacaaccatttcaaccacaaccagttcaaccacaaccacatcaaccaatgcagccacaacctccagttcaaccaatgcaacctctcttaccacaaccaccattaccacctatgtttcctcttcgtccacttccaccaatattaccagatttacatcttgaagcatggccagcaacagataaaactaagcaagaagaagttgac

SEQ ID NO: 5964 - DNA, 618 bp, Artificial Sequence
  Description of Artificial Sequence: Synthetic coding sequence
atgggtacctggatcctgttcgcatgcctggtcggtgccgcttttgccatgccactcccaccccacccaggccacccaggatatattaactttagctacgagaactcacacagtcaagctatcaatgtggacagaatcgcactggtgttgaccccccttaagtggtatcagtctatgatcaggcccccatacagctcctatggttacgaacctatgggtggctggctgcaccatcagatcatccctgtcgtttcccagcagcatcctctcacccacaccctccagagtcaccatcatatccccgttgttcccgcccagcaaccccgtgtccgtcaacaagccttgatgcccgtccccggacagcagtccatgaccccaacccagcatcatcagccaaacctccccctgcccgcacagcagccctttcagccacaacctgttcagccacagccccaccagcccatgcagccacaaccccccgtccagccaatgcaaccacttctcccccaacctccacttccacctatgttccccctgaggcccctcccaccaatccttcctgatttgcacctcgaggcttggcctgccactgacaagacaaagcaggaagaggtggat

SEQ ID NO: 5965 - DNA, 618 bp, Artificial Sequence
  Description of Artificial Sequence: Synthetic coding sequence
atgggaacgtggattctgttcgcatgtttggtgggtgcagcatttgcaatgcctctgcctccacatcccgggcacccaggctacatcaacttctcttatgagaatagccattcccaggcgattaatgtagatcggattgcgctcgtgcttacccccctcaagtggtaccagtcgatgattcgccctccgtactcatcatacggctacgaacccatgggcggatggctccatcatcaaatcattccagtggtatcccaacaacatcctctgacccacactctgcaatcgcaccaccatatccctgttgtgcccgcccagcagccgagggtgagacagcaagcacttatgcccgtgcctggacaacaatccatgaccccgacccagcatcaccaacctaacctcccgctgcctgcgcagcaaccatttcaacctcaaccagtgcagccgcaacctcaccaacctatgcaaccacagcccccggtccagccaatgcagccccttctcccacagcctcctcttccaccaatgtttcctcttcgtcctctcccgccgatcttgccggacctgcaccttgaggcgtggcccgccactgacaaaactaagcaagaagaagtcgat

SEQ ID NO: 5966 - DNA, 618 bp, Artificial Sequence
  Description of Artificial Sequence: Synthetic coding sequence
atgggaacttggatcttgtttgcctgcctggtgggagcggcgtttgcaatgccgctgcccccacaccctggacacccaggttacatcaacttcagctatgagaatagccatagtcaagctattaacgtggatagaatcgctctggtgctgacccccctgaagtggtaccaatcaatgatacgcccaccgtacagttcctatgggtacgaaccgatgggagggtggctccaccaccagataatccccgtggtgtcccaacagcacccactcacacataccctgcaatcacaccaccacatacccgtcgtccccgcccagcaaccccgggtgagacagcaggccctcatgccggtcccaggccagcagtccatgacacccacccagcaccatcagcccaatcttcctctgcccgcccagcagcccttccagccccagccagtgcagccccagccccaccagcccatgcagccccagccgcccgtacagccgatgcagccattattgccacaaccaccgctgccacctatgttccctttacgccccctgccaccaattctcccagacctgcacctcgaagcttggcccgcaaccgataagaccaaacaggaggaggtggat

SEQ ID NO: 5967 - DNA, 618 bp, Artificial Sequence
  Description of Artificial Sequence: Synthetic coding sequence
atgggaacctggattctgttcgcctgccttgtgggcgcagcctttgctatgcctctgccccctcaccctggacaccctggctacatcaacttctcttatgaaaactcacactctcaagccatcaatgtcgaccgcatagctctggtgctaacacctctgaagtggtaccagtctatgatccggccaccctatagtagttatggctatgaaccaatgggcggctggctgcaccaccagatcatccctgttgtgagtcagcagcatcctttgactcatacactgcagagccatcatcacattcctgttgtgccagcccagcagccgagggtgcgtcagcaagccctgatgccagtgcctggtcagcagtctatgacccccacccaacatcaccagccaaatctacccctcccggcccagcagccctttcagccacagcctgtccagccacagccccatcagcctatgcagccccagccccctgtgcagcctatgcagcccctactgccccagcctcctttgccaccaatgttcccactgcggcctctgcctccaattctccctgacctgcacctggaagcatggccagctactgacaagaccaaacaggaagaggtggat

SEQ ID NO: 5968 - DNA, 618 bp, Artificial Sequence
  Description of Artificial Sequence: Synthetic coding sequence
atgggaacctggattctgttcgcctgtttggtgggagcagcattcgcaatgccgttacccccacatcccggacaccccgggtatataaatttctcttatgagaattcccattcacaggccattaacgtggataggattgcactggtgctgaccccactgaaatggtatcaaagcatgatccggccaccttacagctcttatggatatgagcctatgggtggttggttgcaccaccaaatcattccagtggtctcgcaacaacatccactcacccatacccttcagagccaccaccatatccccgtggtaccggcccagcagcctagggtaaggcagcaagccctgatgccggtgccgggacagcagtctatgacacccacgcaacatcatcagcctaacttgcctctgccggctcagcagccgttccagcctcaacccgtgcagcctcagccgcaccaaccaatgcagccacagcctcccgtgcagcccatgcagccgctccttccgcaaccccccctgccccctatgtttcccctgaggccactgccacctattttgcccgatctgcacttagaagcctggccagcaaccgacaagactaagcaggaggaggtggac

SEQ ID NO: 5969 - DNA, 618 bp, Artificial Sequence
  Description of Artificial Sequence: Synthetic coding sequence
atgggaacctggattctctttgcctgtttggtaggagctgcttttgcgatgccattgccccctcatcctggccaccccggatacatcaatttttcctacgagaacagccacagccaggcgatcaacgtggatcggatcgctcttgtgcttaccccactgaagtggtaccaatccatgatccgtccgccatattcaagctatggctatgagcctatgggcggttggttacatcaccagattatcccagtcgtgtctcaacagcacccactgacccacacactgcagagccatcaccatatccccgtcgtccccgctcaacagccaagagtcaggcagcaggctctgatgcctgtccccggccaacagtctatgacaccaacccagcatcatcagcccaatttgccgctgcccgcccaacagccatttcagccccagcctgttcaaccacagcctcaccaacccatgcagccacagcccccggtccaacccatgcagccactgctccctcagccacccttgccaccaatgtttccactgagaccactgccacctatcctccccgacttgcacctcgaggcttggcctgctaccgataagactaagcaggaggaggtggat

SEQ ID NO: 5970 - DNA, 618 bp, Artificial Sequence
  Description of Artificial Sequence: Synthetic coding sequence
atgggcacctggatactgttcgcatgcctggtgggagctgcgtttgccatgcctttgccaccccacccgggacaccccgggtatattaacttctcctacgaaaacagtcattcccaggccatcaatgtggatcggatcgcgctagtgctcaccccactgaagtggtatcagagtatgatccgccccccttattcttcctacggttatgagccaatgggagggtggctgcatcaccagatcatacctgtcgtgagccagcagcatcctttaacacacaccctgcaatcacatcaccacatacccgtggtacccgcccaacagccccgcgtccgacaacaggctctcatgcccgtgcccggccagcaatctatgacaccaacacagcaccaccagccaaatctgcctctgccagcacagcagccattccagccccagccagtacaacctcaaccgcatcagcctatgcagcctcagcctccagtccagccgatgcagcccctgcttccccagccaccactcccacccatgtttcctttacgccctttgccccccatactgccagatttgcatctggaggcatggcctgctacagataagacgaagcaggaggaagtggac

SEQ ID NO: 5971 - DNA, 618 bp, Artificial Sequence
  Description of Artificial Sequence: Synthetic coding sequence
atggggacctggattctgtttgcgtgcttagtgggagccgccttcgccatgcccctacccccacatccaggtcacccagggtatattaacttcagttacgagaattcacacagtcaagccattaacgttgaccggatcgctctcgtgctgactccccttaagtggtaccagagtatgatacggcccccgtatagttcctacggttacgagcccatgggaggctggttgcatcatcaaattatccccgttgtctcacaacaacatcctctgacccacacactccagtcacatcatcatataccggtggtaccagctcagcagccacgggtgaggcaacaggctctaatgccagtacctggacagcagtccatgactcccacacaacaccatcagccgaatttgcctctgccagctcagcaaccgtttcaaccccagcccgtacagccgcagccacaccagcctatgcagccccaaccgccagtgcagccaatgcaacccctactgccccaacccccgctgccacctatgtttcccctcagaccccttccccccattctgccagacctgcacctggaggcatggcctgcaacagataaaacgaagcaagaggaggtcgat

SEQ ID NO: 5972 - DNA, 618 bp, Artificial Sequence
  Description of Artificial Sequence: Synthetic coding sequence
atgggaacgtggatcctgtttgcttgtctggtaggagcggcgttcgcaatgcctctgcccccacatcctggccatccggggtatattaatttttcttatgaaaatagccattctcaggccatcaacgtcgatagaatcgcactggtgctgacccccctgaagtggtaccagtctatgatccgcccaccttactccagttatggctacgagccaatgggtggctggctccaccaccagattatccccgttgtgtcacagcagcatcccctaactcacacccttcagtctcatcatcatattccggtagtaccagcacaacaacctagggtcagacagcaggctttaatgccggtaccggggcagcagtcaatgacgcctacacagcatcaccagccaaacctgccgttgcctgcccagcagccctttcaaccacagcccgtgcagcctcagccgcaccagccaatgcagccacagccacctgtccagcctatgcagccgctactcccccagccccccctgccccctatgtttcctcttcgtccactaccgccgatcctccccgacctccacctggaggcgtggcctgctacggacaagaccaaacaggaagaggtggat

SEQ ID NO: 5973 - DNA, 618 bp, Artificial Sequence
  Description of Artificial Sequence: Synthetic coding sequence
atgggcacctggattctgttcgcctgcctggtgggcgcggcgttcgctatgcccctccctccacatcccgggcatcccggctacatcaacttcagctatgagaactctcatagccaggctatcaatgtcgacagaatcgccctagtcctaacaccgctgaaatggtaccagagcatgatccggcccccgtacagtagctacgggtatgagcccatggggggctggctgcaccaccagattatccccgttgtgagccagcaacatcctcttacacacacactgcagtctcaccatcatattcccgtcgtgcctgcccagcagccccgcgtgcggcagcaagctctgatgcccgtccctggacagcagagtatgaccccgacgcagcaccatcagcctaacttacccctgccggcacagcagccattccagccccagcccgtccaaccccagccccaccagcccatgcaacctcagcctcctgtccagcccatgcagccacttcttccccagcctcccttgccccccatgttccctttgaggccactgccccctatattgccagacctacatctggaagcctggccagccactgacaaaactaaacaggaggaagttgac

SEQ ID NO: 5974 - DNA, 618 bp, Artificial Sequence
  Description of Artificial Sequence: Synthetic coding sequence
atgggtacttggatactcttcgcctgcctggtgggtgcagcgtttgctatgccactccctccgcacccagggcatcccggttatatcaacttctcgtacgaaaactcccacagccaggcaataaatgtggatcggatcgccctggtcctgacccctctgaagtggtaccagagtatgatcaggcccccttactcatcttatggatatgagcccatgggagggtggcttcaccatcagatcatccctgttgtcagtcagcaacaccccctgacccataccctgcaaagccaccaccacatccccgtggttcccgctcaacagcctcgagttaggcagcaggctcttatgcctgtccctggccagcagtctatgactcctacccagcaccaccagcccaacctccccctacctgctcagcaaccattccagccacaaccagtacaaccccagccgcatcaacccatgcagccccagcctcccgttcagcccatgcagccgttgctcccccaacctcctctgccacccatgtttccacttaggccacttccacccattctccctgatcttcacctggaagcttggccagcaacagataagaccaaacaggaagaagtggac

SEQ ID NO: 5975 - DNA, 618 bp, Artificial Sequence
  Description of Artificial Sequence: Synthetic coding sequence
atgggaacatggattctgtttgcctgcctggtgggcgcggccttcgcaatgccactgccaccccatcctggtcacccggggtacatcaatttttcgtacgaaaattctcatagccaggccattaatgtagaccgaatcgccctggtgctcacacctttgaaatggtaccagagtatgatccggccgccctattcttcctacggttatgaaccaatgggaggttggctccaccaccagattataccagtggtcagtcagcaacaccccctgacacacactcttcagagccaccatcacattcctgtggtgcccgcgcagcagccaagggttcgacagcaggccttgatgcccgttccgggccagcaaagtatgaccccaacccaacaccatcagcccaacctacctctgcctgcacaacagccttttcaaccacaacccgtacagccacagccacatcagcccatgcagccacagcctcccgtccagcccatgcaaccgttgcttccgcagccccctctgcctcccatgttccctctgaggccactgccaccaattctccccgacctgcacctcgaagcgtggccagccaccgataagaccaaacaggaggaagtggac

SEQ ID NO: 5976 - DNA, 618 bp, Artificial Sequence
  Description of Artificial Sequence: Synthetic coding sequence
atgggtacgtggatactatttgcgtgtttagtaggtgcggcgtttgcgatgccgctaccgccgcatccgggtcatccgggttatataaatttttcgtatgaaaattcgcattcgcaagcgataaatgttgatcgtatagcgctagttctaacgccgctaaaatggtatcaatcgatgatacgaccgccgtattcgtcgtatggttatgaaccgatgggtggttggctacatcatcaaataataccggtagtatcgcaacaacatccgctaacgcatacgttacaatcgcatcatcatataccggttgttccggcgcaacaaccgcgtgtacgacaacaagcgctaatgccggtaccgggtcaacaatcgatgacgccgacgcaacatcatcaaccgaatttaccgttaccggcgcaacaaccgtttcaaccgcaaccggtacaaccgcaaccgcatcaaccgatgcaaccgcaaccgccggtacaaccgatgcaaccgctattaccgcaaccgccgctaccgccgatgtttccgctacgtccgttaccgccgatattaccggatttacatttagaagcgtggccggcgacggataaaacgaaacaagaagaagttgat

SEQ ID NO: 5977 - DNA, 618 bp, Artificial Sequence
  Description of Artificial Sequence: Synthetic coding sequence
atgggcacttggatcctcttcgcgtgtctcgtcggcgcagcgttcgccatgccccttcccccccatccaggccacccgggctacatcaatttctcgtatgagaactcgcattcccaggccatcaacgtcgaccgcatcgctctagtgctgacccccctcaagtggtaccagagcatgatccgccccccctactccagctatgggtacgaacccatgggcggttggctgcaccatcaaatcatacccgtagtgagccaacaacaccccctgacccatactctgcaatcccaccaccacatccccgtcgttccggcgcaacagccaagagtccgccagcaggctctgatgccggtccccgggcagcagtcgatgacaccgacgcagcaccaccagcctaatctgcctttgcccgcccagcagcccttccagccccagcccgtccagccccagccacaccagcccatgcagccccagccccctgttcagcctatgcaaccgctcctcccgcagcccccgctccctcctatgttccccctgcgtccgctgccgcccatcctgcccgatctccacttggaagcctggccggccaccgacaagacgaagcaagaggaggtcgat

SEQ ID NO: 5978 - DNA, 618 bp, Artificial Sequence
  Description of Artificial Sequence: Synthetic coding sequence
atgggaacatggatcttattcgcttgtctggtgggggccgcttttgcaatgcctcttcccccacatcctggacacccaggctacattaacttttcttacgagaatagccacagccaggctatcaatgtggacaggatcgctcttgtgctcacccccctgaagtggtatcagagtatgatccgcccaccatattccagctatggctatgaacccatggggggctggctgcaccaccaaatcataccagtggtctcccagcagcacccattgacacacacactccagagccaccatcacatcccagtcgtccctgcacagcaacccagggtgaggcagcaggctcttatgccagttcccggccagcagtctatgactccaacccaacaccatcagccaaatctgccacttcccgcacaacagccttttcagccccaaccagtccagccccagccacaccaacctatgcaaccccagccccccgtgcaacctatgcagccacttcttcctcaaccacctctgcctcccatgtttccacttagaccactcccccccatcctgccagatttgcacttagaagcttggccagccacggataaaacaaagcaagaagaggtggat

SEQ ID NO: 5979 - DNA, 618 bp, Artificial Sequence
  Description of Artificial Sequence: Synthetic coding sequence
atgggcacctggatattgtttgcctgcctggtgggggctgcattcgccatgccactgcctccacacccgggccatccaggatacatcaacttctcttatgaaaatagccattcacaagcaattaatgttgaccggatcgcgctggtgttgaccccattgaagtggtaccagtcaatgatcagacccccgtactcttcctatggctacgagccaatgggagggtggctgcaccaccagatcatccctgtggtctcacagcagcatcccctcacgcataccctgcagtcccaccaccacatcccagtcgtgcctgcgcagcaaccacgggtccggcagcaggccctcatgcccgtgccaggccagcagtctatgacgccgactcagcatcaccaaccaaacctccctctccccgcacagcagccattccagccacaaccggtccaaccccagccccaccagcccatgcagcctcagcctcccgtacagcctatgcagcccctcctgccacaaccaccactcccaccgatgtttccactgcgacctctgccccccatcctcccagacctccacctcgaggcttggcccgcgacagacaaaaccaagcaggaggaggtggat

SEQ ID NO: 5980 - DNA, 618 bp, Artificial Sequence
  Description of Artificial Sequence: Synthetic coding sequence
atggggacctggattctgtttgcgtgcctggtgggagcagcctttgccatgccacttccaccacacccgggacacccaggatacattaacttttcctatgagaacagccactcacaagcaattaacgtggacaggatcgcactggtgcttactcctctgaagtggtaccaatccatgattaggccaccgtactcgtcgtatggatacgagcctatgggcggatggcttcatcatcaaatcatacctgtcgtgtcgcaacagcatccactgacccacacccttcagtcgcaccaccatatccctgtggtcccagctcaacaacctcgtgtgcgccagcaggccttgatgcctgtgcctggccagcaatccatgacgccaacccaacatcatcaaccaaaccttccgcttccggcacaacagccattccagcctcaaccagtgcaaccgcagcctcaccaaccaatgcagccgcagcctccggtgcagccaatgcaaccccttctcccccaacctcctctcccacctatgtttccacttagaccacttcctcccattttgcctgatctccatttggaagcctggcctgcgaccgataagaccaaacaagaagaagtggat

SEQ ID NO: 5981 - DNA, 618 bp, Artificial Sequence
  Description of Artificial Sequence: Synthetic coding sequence
atgggaacctggatcctgtttgcgtgcctggtgggtgcagcctttgccatgcctctgccgccccatccaggtcatccagggtacattaacttttcctacgaaaactcgcactcccaagcaattaacgtcgataggatcgcactggtgctcactccactcaagtggtaccagtcaatgatccgtcctccttactcctcgtacgggtacgagcctatgggcggatggcttcaccatcagattattccagtggtgtcccagcaacatcctcttacccacactctgcagtcgcatcaccacattcccgtggtgcctgcccaacaaccgcgcgtgcggcaacaagcactgatgccagttccagggcaacaatcgatgacccctactcagcaccaccaaccaaacctgccactgcctgcccagcaacctttccagcctcaacctgtgcagccacagccacatcaacccatgcaaccccagccaccagtccaacctatgcaaccacttctgccacagcccccacttccacctatgttcccgcttcgtcccctgcctccaattctccccgatcttcatttggaggcatggccagcaacggataagaccaaacaggaagaagtggac

SEQ ID NO: 5982 - DNA, 618 bp, Artificial Sequence
  Description of Artificial Sequence: Synthetic coding sequence
atgggaacctggatcctgtttgcctgtctggttggagccgcgtttgctatgcctcttcctccccacccgggccatcccggctatatcaatttcagctacgagaattcccatagtcaggcaatcaatgtggaccgaattgccctggtgcttactccactgaagtggtaccaatctatgatccggcccccctattcttcatacggatacgagcctatgggcgggtggctgcaccatcaaatcattccagtcgtcagccagcagcaccctttgactcacacactgcagagccaccaccacattcctgtggtgcctgctcaacagccccgagtgagacaacaggcgctcatgcctgtgccggggcagcagagcatgaccccgactcagcaccatcagcctaacttgcccttgcctgcccagcaaccattccagccacaacctgtgcagccacagcctcaccagcctatgcagccgcaaccacccgtgcagccgatgcagcccctgctgccacagccccccctcccccccatgtttcccctccgcccactgccgcccatactgcccgacttgcatctcgaagcttggcccgctacagacaaaaccaagcaagaggaggtggac

SEQ ID NO: 5983 - DNA, 618 bp, Artificial Sequence
  Description of Artificial Sequence: Synthetic coding sequence
atgggcacctggatcctgtttgcgtgcctggtgggagcagcatttgcgatgcctctgccaccgcacccgggacaccctggatatatcaatttctcatacgagaacagccattcacaagcgatcaacgtggatcgcatcgcgctggtcctcactccgctcaagtggtaccaatcaatgattcggccaccatactcctcatacggatacgaaccaatgggcggctggctccatcatcagatcattcccgtggtgtcccagcaacatccgctgacccatactctccagagccaccaccatatcccagtggtccccgcccaacagcctcgggtccgccaacaggccctgatgccggtccccggacagcagtcgatgaccccgacgcagcaccaccaaccgaatctgccactgccggctcagcaacctttccagcctcaaccggtgcagccgcaaccgcaccaaccgatgcaaccccagccgcctgttcagccaatgcaaccgctcttgccacagccaccccttccgccgatgttcccactgaggccactccctccaattctgccggatctgcacctcgaggcatggccggccaccgacaagaccaaacaagaggaggtcgac

SEQ ID NO: 5984 - DNA, 618 bp, Artificial Sequence
  Description of Artificial Sequence: Synthetic coding sequence
atgggtacgtggattctgttcgcatgcctggtgggggcggcgttcgctatgccgctgccgccgcaccctggccatccaggctacatcaatttcagctatgagaattcccacagccaggccattaatgtggatcgcatcgccctggtgctgacccctctgaagtggtaccagtctatgattcgtccgccatattcaagctacggttatgagcctatgggcggatggctgcaccaccagatcattccagtcgttagccagcaacatcctctgacccacacccttcagagccatcatcacatccctgtggtaccagctcagcaaccgcgcgttcgccagcaggcactgatgccggtcccgggccaacagagcatgactccaacgcagcatcatcagcctaacctcccattgccggcccaacagcccttccaaccacagccagtgcagccgcagcctcaccagccgatgcagcctcagcctccggtgcagccaatgcagcccctgttgccgcaacctccgcttccgccgatgttcccgcttaggccactgccgccaatactgccagatcttcacctggaggcatggcctgccacggataagaccaagcaggaggaagtggac

SEQ ID NO: 5985 - DNA, 618 bp, Artificial Sequence
  Description of Artificial Sequence: Synthetic coding sequence
atgggaacctggattctttttgcatgtcttgtgggtgcagcatttgctatgcctctgccaccacaccctggccacccaggctacatcaacttcagctatgagaactcacactcacaggcaatcaacgtggataggatcgcgcttgtgctgacccctcttaaatggtaccaatcgatgattcgtccaccctacagctcgtacggttacgagcctatgggtggttggctgcatcatcagataattcccgtggtgtcccagcagcatccactcacccatacccttcaaagccatcaccatattcctgtcgttcctgcacagcagccacgggtccgacagcaggcgctgatgcccgtgccgggacaacaatcaatgacccctactcagcaccatcagccaaacctgccactgccagcacagcaaccatttcagcctcaacctgtccaaccacaacctcaccaaccaatgcagccacaaccccccgtgcagcctatgcaaccactcctgccacaacctcccctgccacctatgttcccacttaggcctttgccccctatactcccagatctccacctcgaggcatggccagccaccgataagactaagcaggaagaagtggat

SEQ ID NO: 5986 - DNA, 618 bp, Artificial Sequence
  Description of Artificial Sequence: Synthetic coding sequence
atgggtacgtggatcctcttcgcctgtctcgtcggagcggccttcgcaatgccgttgccgccgcatccggggcacccaggatacattaacttctcctatgaaaattctcacagccaagctatcaacgtggatcggatcgctctggtcctgacccctctgaagtggtaccagagcatgatcagaccgccttactcgtcatacggctatgagccgatggggggctggctgcaccatcagataataccggttgtctcgcagcagcatccgctgactcataccctgcaaagccaccatcacatcccagtggttcctgcccagcagcctcgggtgcgccaacaggccctgatgccggtgcctggccaacaatcgatgactccgactcagcaccaccagccgaatctcccgctgccagcacaacagccgtttcagccacaacccgtgcagccgcagccacatcaacccatgcagccgcaacccccggtgcagccaatgcagccactgcttccccaaccacctctccctcccatgttcccgctgcggccgctgcctccgatcttgccggatcttcaccttgaagcgtggccggcgaccgacaagaccaagcaagaggaagtggac

SEQ ID NO: 5987 - DNA, 618 bp, Artificial Sequence
  Description of Artificial Sequence: Synthetic coding sequence
atgggaacctggatcttgtttgcttgtctggtgggggccgcgtttgccatgcctctcccaccccaccctggccatccgggctacatcaacttctcgtacgaaaacagccactcccaggcgattaacgtcgacaggatcgccctcgtgcttaccccactgaagtggtaccagtcaatgattcgcccgccatactccagctatggatacgaaccaatgggagggtggctgcaccaccaaatcatcccggtggtgtcgcagcagcacccgctgactcacaccctgcagtcccaccaccacatcccggtcgtgccggcccaacaacctcgcgtccgccagcaggcgttgatgcctgtgccaggccaacagtcgatgacgcctactcagcatcatcagccaaaccttccgctgccggcgcagcagccattccagcctcagccggtgcaaccacagccacaccagccgatgcagccacaaccgcctgtgcaaccaatgcagccgctcctcccccaaccacctttgcccccaatgttccccttgcgtccgctcccgccgatcctcccagatctgcatctggaggcgtggcctgccaccgacaagactaagcaagaggaagtggat

SEQ ID NO: 5988 - DNA, 618 bp, Artificial Sequence
  Description of Artificial Sequence: Synthetic coding sequence
atggggacgtggatcctcttcgcctgcctggtgggtgctgcctttgccatgccgctcccgccgcacccagggcatccaggctacatcaacttctcatacgaaaactcgcatagccaagcgatcaatgtggatagaatcgctctggtcctgaccccattgaagtggtaccagtcaatgatccggccgccgtacagttcatacggatatgagccaatgggaggatggctgcaccatcagattatcccagttgtgtcgcagcagcaccctctgacccacaccctgcaatcccatcatcacatacccgtggtgcctgcgcagcagccccgagtgcgtcagcaggcgctcatgccggtcccgggacagcaatccatgactcccactcaacaccatcagccgaacctccctctgcccgcccaacaacccttccagccacaaccagttcagcctcaaccacaccagcctatgcagccccaaccgccggtacaaccaatgcagccgcttctgccgcaacctccactgccccctatgttcccgctccgcccccttccgccaatcctgcctgacctccacttggaagcatggccagcaactgataaaaccaagcaagaggaagtggac

SEQ ID NO: 5989 - DNA, 618 bp, Artificial Sequence
  Description of Artificial Sequence: Synthetic coding sequence
atgggcacttggatcctttttgcatgcctggtgggggcggcattcgctatgcctttgcccccgcatccagggcatcccggttacattaacttctcctacgaaaattctcactcacaggcgatcaacgtggaccggatcgccttggtgctcactccgctcaagtggtaccaatcaatgatcagaccaccttacagctcctacggatatgagccaatgggaggatggctgcaccatcagatcatcccagtcgtgtcgcagcagcatccgctcacgcatactctgcaaagccaccaccatattccagttgtgccagcccagcaaccgcgcgtgaggcagcaagcactgatgcctgtcccaggacaacagtcgatgacgccaactcagcatcatcaacctaatctgccgctgccggcccagcagcctttccagccccagccagtgcaaccgcaaccgcaccagcctatgcagccccagccgccggtgcagccgatgcagccactgttgccacaaccgccgctcccgccgatgtttccgctgaggcccctgccgccaattctgccggacttgcacttggaggcctggccggccaccgacaagactaagcaggaggaggtggat

SEQ ID NO: 5990 - DNA, 618 bp, Artificial Sequence
  Description of Artificial Sequence: Synthetic coding sequence
atgggaacctggattctctttgcctgcctcgttggcgcggcattcgctatgcctctccctccccatccagggcaccctggatacattaatttctcgtatgagaattcccatagccaggcgataaatgttgatcggattgccctcgtccttacaccactaaagtggtatcagtccatgattcgaccgccatattcatcttatggctacgagcctatggggggctggcttcaccaccaaattattcctgtcgtctctcaacaacacccacttactcacacgttgcaatctcaccaccatatcccagttgtacctgcacagcagcctagagtccggcagcaagcacttatgccagtgccaggccagcagagcatgacccccactcagcatcaccaacctaatctgccccttccagctcaacaacccttccagccccaacccgtccagccccagccccatcagcccatgcagccccagccgccagtgcaacctatgcaacccttgcttccccaacccccactgccccctatgttcccactgaggccactgccacctattttacccgacctacatcttgaggcgtggcctgcaacagataagactaagcaggaggaagtcgat

SEQ ID NO: 5991 - DNA, 618 bp, Artificial Sequence
  Description of Artificial Sequence: Synthetic coding sequence
atgggcacttggattctgttcgcctgcctcgtcggcgccgcgtttgcgatgccgctccctccgcacccggggcatccgggatacatcaacttctcgtacgaaaactcgcattcacaagcgatcaacgtggaccgcatcgccctggtgctcactcctctgaagtggtatcagtccatgattcgcccaccgtactccagctacggttacgagccaatgggaggatggctccatcaccagatcatccctgtggtgagccaacagcatccgctgacccataccctccagtcgcaccaccacatcccagtcgtgcctgctcagcagcctcgggtcaggcagcaggccttgatgccggtgccaggacaacagtcaatgacgccgacccagcatcaccaacctaatctccccctgcccgctcaacaaccattccagccgcagcctgtccagccccaaccgcaccagccgatgcaaccacaaccaccggtgcaaccaatgcagccactgcttccccagccgccgttgcccccaatgttcccgcttagaccgctgcctccgatcctgccggacctgcacctggaagcatggccagcaaccgataaaactaagcaggaagaggttgat

SEQ ID NO: 5992 - DNA, 618 bp, Artificial Sequence
  Description of Artificial Sequence: Synthetic coding sequence
atgggaacttggatcctgtttgcctgtctcgtaggcgcagcatttgccatgccactcccaccacatcccggtcaccccggatacatcaacttctcgtacgaaaactcgcactcgcaggctattaacgtggaccgcattgcgcttgtgctcactcccttgaagtggtaccagtccatgatccgccctccctactcgagctacggatatgaacccatggggggatggctccatcatcagattataccggtggtgtcccagcaacacccgcttacccacactctgcaatcccatcaccacattcccgtggtccctgcacagcagcctagagtccgacaacaggccctgatgccagtgcctggtcagcaatctatgactcctacccaacatcatcaaccaaaccttcctcttccagcacaacaaccctttcagcctcagcctgtgcagccacagcctcatcagcctatgcaaccacagcctccagtccaaccgatgcagccacttctgccacaacctccattgccccctatgttccctcttagaccacttccgccgatccttccagatcttcatctcgaggcctggccggccaccgacaagaccaagcaagaagaggtggat

SEQ ID NO: 5993 - DNA, 618 bp, Artificial Sequence
  Description of Artificial Sequence: Synthetic coding sequence
atggggacttggatccttttcgcttgtctcgtaggagccgcctttgctatgcccctgcctccacacccaggacatcctggatacataaatttttcttatgagaactcccattctcaggctatcaatgtagataggattgccctggtcttaacacccctgaaatggtatcagtctatgatcaggccaccttattcttcttatgggtacgaacccatgggggggtggctccatcatcagatcatacctgttgtatctcagcagcatcctttgactcatactctacagtctcatcaccacataccagtggtgcctgcccagcagccgcgagtacgccagcaggcactcatgccagtgccaggacagcaatctatgacacccacacagcaccaccagcccaacctgcccctcccagcccagcagcccttccagccccagccagtacaaccacagcctcaccagcccatgcagcctcagcctccagtgcagcctatgcagcctctccttccccagccacctctgccccccatgttccccctaagaccactgccccctatactacctgatcttcatttggaggcttggcccgcaactgataaaactaaacaggaagaagttgat

SEQ ID NO: 5994 - DNA, 618 bp, Artificial Sequence
  Description of Artificial Sequence: Synthetic coding sequence
atgggaacctggatcctgttcgcctgcctggtcggcgccgcattcgcgatgcccttgccgccgcacccaggccacccgggatacatcaacttctcatacgaaaactcgcattcccaggctatcaatgtggatcgcattgccttggtgctgaccccccttaaatggtatcagtcgatgatcagaccgccatactccagttacggatacgagccaatgggtgggtggttgcaccaccagatcatccctgtggtttctcaacagcatccgttgacccacactctccaatcccaccatcatattccggtcgtgccggctcagcaaccacgcgtcaggcaacaggcactgatgcctgttccaggacagcagtcgatgacgccaactcagcaccatcaaccaaacttgccgctcccggcacagcaaccatttcagccgcagccggtgcaacctcaaccgcaccagccgatgcagccccaacctccggtccaaccaatgcaaccacttctgccgcagcccccgctccctccaatgttcccgctgcgtccgctcccgccaatactcccggacctgcatctggaagcctggcccgccaccgacaagaccaagcaggaagaagtggac

SEQ ID NO: 5995 - DNA, 618 bp, Artificial Sequence
  Description of Artificial Sequence: Synthetic coding sequence
atggggacatggattctattcgcctgtctggtcggtgctgctttcgcaatgccactgcctccccatccaggacaccccggttatattaatttctcatacgagaatagccattcccaagctattaatgttgacaggatcgctctcgtgcttacgccactgaagtggtaccagtcgatgatacgccctccctacagcagctacgggtatgagcctatgggaggatggctgcaccatcagattatccccgtagttagccagcagcaccccctaactcacacgctccagtcacatcaccatattcccgtcgtgccagcacagcaacccagagttaggcaacaggcactgatgcctgttcccggccagcaatctatgacccctacacaacatcatcagccgaacctaccattaccagcccaacagccgttccagccccagccagtccagcctcaaccccatcagcctatgcagccccagccaccggtgcagccaatgcagccactgttacctcaaccaccactcccccctatgtttccactgaggccattgccacccatactcccagacctgcatctggaagcctggcctgccaccgacaagacgaagcaggaggaggtggac

SEQ ID NO: 5996 - DNA, 618 bp, Artificial Sequence
  Description of Artificial Sequence: Synthetic coding sequence
atggggacttggatcctttttgcatgtctcgtgggtgccgcatttgcgatgcctctccctcctcaccctggccaccccggatacattaacttttcttatgagaactcacattcacaggcaattaacgtggacagaattgcactcgttcttacccctctgaagtggtaccaatcgatgattcgcccaccgtacagctcctacgggtacgagccgatgggaggttggttgcatcatcagattataccggtggtgtcgcaacaacacccgcttactcacacgcttcagtcgcatcatcatataccagtcgtcccagcacagcaacctcgtgtgcgtcaacaagctctgatgccggtgccaggacaacaatccatgaccccgactcaacaccatcagccaaatctgccgcttccggctcagcagccttttcaacctcaacccgtgcaaccacagccgcaccaaccaatgcaaccacaacctccagtgcaaccaatgcagccactgctgcctcagccccctctcccgcccatgtttcccctcagaccactgcctcccatccttcctgatcttcatctggaggcgtggccagcgactgacaagaccaaacaggaagaggtcgat

SEQ ID NO: 5997 - DNA, 618 bp, Artificial Sequence
  Description of Artificial Sequence: Synthetic coding sequence
atgggaacctggattttgtttgcgtgcttggttggcgcggccttcgccatgcctctacctccacatcctgggcatccgggctacatcaatttttcgtatgaaaattcacactcacaggccatcaatgtggatcgcatcgccctggttctgacaccactgaagtggtatcagagcatgatccgcccgccctactcatcgtatggatacgagcccatgggaggatggctccaccatcagataattcccgtggtatcacagcagcacccacttacgcataccttgcaaagccatcatcacatacctgttgtgcccgctcaacagcctcgggtgcgccagcaggctctcatgcccgtgcccggtcagcagtcaatgacacccacccagcaccaccaacccaatctccccttgccagcccagcagccattccaacctcagccggtgcagcctcaaccccatcagcctatgcagcctcaaccccccgtccaaccaatgcaacccctgctgcctcagccaccgttacccccaatgttcccactgcgcccgcttcccccaattctcccggatctgcaccttgaagcctggccggcgaccgacaaaacaaagcaggaagaagtagat

SEQ ID NO: 5998 - DNA, 618 bp, Artificial Sequence
  Description of Artificial Sequence: Synthetic coding sequence
atggggacatggatcttattcgcatgtctagtgggagctgccttcgcaatgcctttgccaccccacccaggacaccccgggtacatcaacttttcctatgaaaactcccattcccaggccattaatgtggatcgaatcgccctcgtgttgactcccctcaaatggtatcagtctatgatccggcctccatatagttcttatggatatgaacccatggggggatggctccatcatcaaatcattcccgtcgtgtctcaacagcatcccctgacacacacattgcagagtcaccatcacattcctgtggtccctgctcagcagcccagagtgagacagcaagccttaatgcccgtaccaggacagcagtctatgacacccactcagcatcaccagcctaacctgccattacctgcgcagcagccttttcaaccacaacctgtgcagccacagcctcatcagcccatgcagccacagcctcccgttcagccaatgcagccactcctcccacagcctcccctccctccaatgtttcccctacggccacttcctccaatattgcctgatcttcaccttgaggcctggcctgccacagataaaacaaaacaggaagaagtggat

SEQ ID NO: 5999 - DNA, 618 bp, Artificial Sequence
  Description of Artificial Sequence: Synthetic coding sequence
atgggaacctggattctttttgcgtgtctggtgggagctgcttttgccatgccgctcccccctcatccaggacacccggggtacataaacttttcatacgaaaattcccactcccaagcaatcaacgtggacaggattgcactggtcctgacccctcttaagtggtaccagtcgatgatccgcccaccttactcatcgtatggatacgagccgatggggggatggctccatcaccagattatccccgtggtcagccagcaacatccgctgactcatactcttcagtcgcaccaccatattcccgtggtgcctgcacaacagccacgtgtgagacaacaggctctcatgcctgtgcccggacaacaaagcatgacccctactcagcatcatcaacctaacctgccacttccagcccagcagccttttcagcctcaaccagtgcagcctcaaccgcatcagccaatgcagcctcagcctcctgtgcaaccaatgcagccactccttcctcaaccacctctcccgccaatgttccctctgcgacctttgcctcccatcctgcctgacctccatctggaagcatggccagccaccgataaaaccaaacaagaggaagtggac

SEQ ID NO: 6000 - DNA, 618 bp, Artificial Sequence
  Description of Artificial Sequence: Synthetic coding sequence
atgggcacttggatcctcttcgcatgtctggtgggagctgcgttcgccatgccactgccaccacacccaggccaccccggatacatcaactttagctacgaaaattcgcactcacaagccatcaatgtggacagaatcgctctcgtcttgactccgcttaagtggtatcaatctatgatccgcccaccctactcctcatacgggtacgaacccatggggggttggctgcaccatcagatcatcccggtcgtgagccaacagcatccccttactcacaccctgcagtcccaccatcacatccctgttgtgcctgcccagcagcccagagtgcgccaacaagcgttgatgccggtgccaggacagcagtccatgacccctactcagcaccaccaaccgaacctcccactgccggcgcagcagccttttcaaccacaacctgtgcagccacaaccgcatcagccaatgcagcctcagccgcccgtgcaacctatgcagccgctgctgccacagcctccgctcccgccgatgttcccgcttaggccactgccccctatccttccggatctgcacctggaagcgtggcccgcaactgacaaaactaaacaggaggaggtcgac

SEQ ID NO: 6001 - DNA, 618 bp, Artificial Sequence
  Description of Artificial Sequence: Synthetic coding sequence
atgggaacctggatcttgttcgcatgcctcgttggagccgccttcgccatgccactgccaccgcacccgggccacccgggctacatcaatttcagctacgaaaacagccactcacaggccattaacgtggaccggatagccctggtgctgaccccactcaagtggtaccaatcgatgatccggccaccttactcttcctacggttacgagccgatgggagggtggctgcatcatcaaatcatcccagtggtatcacagcaacatccgctgactcatacgctccagagccaccaccacatcccggttgtcccagcccagcaaccccgcgttcgccagcaagcactgatgcctgtcccaggacagcagagcatgacgccgactcagcaccatcaaccgaacctgcccctgccggcgcaacagccgtttcagccacagcctgtccaacctcaaccacaccagcctatgcagcctcaacctcccgtgcagccgatgcaaccgctcctcccacaaccaccattgccgccaatgttcccccttagacctctgccgcctatcctgcctgatctgcacttggaggcctggcctgcgaccgacaagaccaaacaggaagaagtcgat

SEQ ID NO: 6002 - DNA, 618 bp, Artificial Sequence
  Description of Artificial Sequence: Synthetic coding sequence
atgggaacctggattttgtttgcttgtctggtgggggccgctttcgcaatgccgctgcctccacatccaggacaccccggctatattaacttttcttacgaaaactcgcactctcaagccattaacgtggatagaatcgcacttgtcctaaccccccttaagtggtatcagtcaatgattcggccaccctatagtagttatgggtacgagcctatgggagggtggcttcatcaccaaataattcctgtagtgagccagcagcatcccctcacgcacacattacagtctcatcatcacatccccgtagtgccagcccaacaaccacgggtgcgtcagcaggccctcatgcctgtgcccgggcagcagagcatgaccccaacccagcaccaccagccgaacctccccctgccggctcagcaaccgttccagccgcagccagtgcagcctcagcctcatcaacccatgcagccccagcctccagtccaacccatgcagccactcttacctcagcctcccctaccaccaatgtttcccttgcgtccactgccaccgatccttcccgatttacacctcgaggcctggcccgcaaccgacaagaccaagcaggaggaggtcgac

SEQ ID NO: 6003 - DNA, 618 bp, Artificial Sequence
  Description of Artificial Sequence: Synthetic coding sequence
atgggaacctggatcctctttgcgtgccttgtgggagccgcattcgccatgccgctgccgccccacccgggtcatccggggtacatcaacttctcatacgaaaactctcattcgcaggcgatcaatgtcgacaggattgcgctcgtgcttacccctctgaagtggtaccagtcaatgatccggccaccatacagctcctatggatacgagccgatggggggctggttgcatcaccagatcattccggtggtgtcacaacagcatccgctgactcacacgctccagtcccaccaccacatccccgtggtgccggcgcaacagcctcgcgtacggcaacaagccttgatgccagtgccaggtcagcagagcatgacgcctacccaacaccaccagccaaatctcccgctgcctgcccagcaacccttccaaccacagccagtacaaccgcagccacatcagcccatgcagcctcaaccaccagtgcaaccgatgcagccgctcctgcctcagcccccgctgcccccgatgtttcccctgcgcccccttccaccgatcctcccggatctgcatttggaagcctggccggcaacggacaagaccaaacaagaggaggtcgat

SEQ ID NO: 6004 - DNA, 618 bp, Artificial Sequence
  Description of Artificial Sequence: Synthetic coding sequence
atgggcacttggatcctgttcgcctgcctggttggcgccgcgtttgctatgccgctcccgccgcatccagggcatccgggatacataaactttagctacgaaaattcacattcgcaggcaatcaatgtcgataggatcgctctggtgctgactccgcttaagtggtatcaatcaatgatcagaccgccctattccagctacggatacgagcctatgggagggtggcttcaccaccagatcattccggtcgtctcgcagcaacacccgctcacccacaccctgcagtcccaccatcacatcccagtggtgccagcacaacagcctcgtgtgcgccagcaggcccttatgccagtgcctggacagcaatcaatgacgcccacgcagcatcaccagccgaacctccctttgcctgcgcagcaaccatttcaaccgcagcccgtgcagccccagccccatcagccaatgcagccccaaccgcctgtccaaccgatgcagcctctgctgccgcagcccccgctgccaccaatgttccctctgcgaccgctccctcctattctgccagaccttcatcttgaagcgtggccggctactgataaaaccaagcaggaggaagtggac

SEQ ID NO: 6005 - DNA, 618 bp, Artificial Sequence
  Description of Artificial Sequence: Synthetic coding sequence
atgggcacgtggatactcttcgcgtgtcttgttggagcagccttcgcaatgccccttcccccacatccggggcacccaggttacatcaacttttcctatgaaaatagccattctcaagccattaacgtggaccggatcgcacttgtgctcacccctttgaagtggtaccagtccatgatccgacccccttactcatcttacggatacgaacctatggggggatggctgcatcaccagattatcccggtagtctcacagcaacaccccttgactcacaccctgcagtcgcatcatcatattcctgtggtcccagcgcaacaaccacgcgtcagacagcaggctctgatgccagtgcctggtcagcaatcgatgaccccgacccaacatcatcaaccaaacctgcccctgccagcacagcagccgtttcaaccacaacccgtgcaaccgcagccgcatcagcctatgcaacctcagcctccggttcaaccgatgcagcccttgctgcctcaaccgcccctcccgccgatgtttccactgcggccactccctccaattcttccagatcttcaccttgaagcctggccagcaactgataaaaccaagcaagaggaggtcgac

SEQ ID NO: 6006 - DNA, 618 bp, Artificial Sequence
  Description of Artificial Sequence: Synthetic coding sequence
atgggaacctggattctttttgcctgtcttgtgggagcagcatttgcaatgccattgcctccccacccaggacaccccggatacatcaacttctcctacgagaattcgcattcacaggccattaacgtcgatcgaattgcacttgtcctgacgcctcttaagtggtaccagtctatgatcagacccccatactcgtcgtacggttatgaacctatggggggctggttgcatcatcagataatcccagtcgtctcgcagcaacaccccctgactcacaccctgcaatcccaccatcatattcccgtcgtgcctgcgcaacaaccacgggtgagacagcaagccctgatgcctgtgcccggtcaacaatccatgactcccactcagcatcatcagccaaacctccctctgcctgcgcagcagccatttcaacctcaacccgtccaacctcagccacaccagccaatgcaaccacaaccgcctgtgcaaccgatgcaaccacttcttccccagcccccgcttccacctatgttccctttgcggccgcttcctccgatcctgccagacttgcatctggaagcatggcccgcaactgataagaccaagcaggaagaagtcgac

SEQ ID NO: 6007 - DNA, 618 bp, Artificial Sequence; identical to SEQ ID NO: 5990
  Description of Artificial Sequence: Synthetic coding sequence

SEQ ID NO: 6008 - DNA, 618 bp, Artificial Sequence
  Description of Artificial Sequence: Synthetic coding sequence
atggggacgtggatccttttcgcctgcctggtcggtgccgcattcgctatgccattgcctccccatcctggacacccaggatacattaacttttcgtacgagaattcccattcgcaagccatcaacgtggatcggatcgcgttggtgctgactccactgaagtggtaccagtcgatgattcgccccccgtacagctcatacggctatgaaccgatgggaggctggcttcaccatcagattataccagtggtgtctcagcagcacccgctgacgcacactctccagtcccatcaccatatcccggttgtcccagcccagcagccgcgggtgagacagcaagcactgatgccggtcccgggacaacagtccatgacccctacccaacaccaccaacccaacctgccactgcctgcccagcagcctttccagccacagccagtccagcctcagccacatcagccaatgcagcctcaaccacccgtgcagccgatgcaaccgctgctccctcaaccgccgttgccgcccatgttcccactgcgcccgctcccccctatcctgccagatctccacctcgaagcgtggcctgcgaccgacaagaccaaacaagaggaagtggac

SEQ ID NO: 6009 - DNA, 618 bp, Artificial Sequence
  Description of Artificial Sequence: Synthetic coding sequence
atgggcacctggatactctttgcgtgtctcgttggagccgcctttgctatgccccttcccccacacccaggacaccccggctacatcaatttttcatacgagaactctcactctcaggccataaatgtcgaccgtatcgcactagtgctgacaccacttaaatggtatcagagtatgatacgcccaccgtacagcagctacggttatgagcccatgggcgggtggctgcaccatcagatcattcctgttgtatctcagcagcaccctctgacacacaccctgcagtctcatcaccatatcccggtcgtccccgctcagcagcccagggttagacagcaggctctgatgcctgtgcctgggcagcaaagcatgactccgacccagcaccaccagcccaatctaccattgcccgcacagcagcccttccagccccagcccgtccaaccccagcctcaccagccaatgcaaccccagccaccagttcagcccatgcagcctctgttgccccagccaccacttcctccaatgtttcccctgaggccgcttcctcctatactgcctgatcttcacttggaagcgtggccagctaccgataaaaccaaacaggaggaggttgac

SEQ ID NO: 6010 - DNA, 618 bp, Artificial Sequence
  Description of Artificial Sequence: Synthetic coding sequence
atgggaacctggatcttgttcgcatgcctggttggagcggctttcgctatgcctctcccgccacatcctgggcatccaggctacattaacttctcctatgaaaattcccactcgcaagcaatcaatgtcgatagaatcgccctggtgctcaccccgctgaagtggtaccagtcaatgatccggcccccgtattcaagctacggatacgaacctatgggcggatggctccatcaccagatcattccggttgtctcgcaacaacatcccctgacgcacactctgcaatcccaccatcacatcccggtggtgccggcgcagcagccgcgcgtccggcaacaagcactcatgccggtcccgggccaacagagcatgacccctacccaacaccatcaaccaaaccttccattgcctgcccaacaacccttccagccgcagcctgtgcaaccacagccacatcagccgatgcagccccagccaccggtccaaccaatgcaaccacttctcccgcagccgccactgccgccgatgtttcctctgcggccactccctccgatcctgccggacctgcatctggaagcctggcccgccaccgacaagactaagcaggaggaagtagat

SEQ ID NO: 6011 - DNA, 618 bp, Artificial Sequence
  Description of Artificial Sequence: Synthetic coding sequence
atggggacctggatcttgtttgcttgcctggtgggggcagcgttcgcgatgccactgcctccccacccgggacacccaggatacatcaacttcagctacgagaatagccattcacaggctatcaacgtggaccgcattgcactcgtgctcaccccgctgaagtggtaccagtcgatgattcggcctccttactcctcgtacgggtacgagcccatgggcggatggctgcaccaccaaatcatccctgtcgtgtcccaacagcacccacttactcacactctccagtcccatcatcacataccagttgtgccggcccagcagccccgggtgcggcagcaggcgctcatgccggtgccgggacaacagagcatgactccgacccagcatcaccagcctaaccttccactcccggcccaacagccattccagccccaaccggtgcagccacagccacatcaacctatgcagccgcagccgccagtgcagcctatgcaacccctcctgccgcaaccgccactgccgccaatgttcccgctgcgcccgctccccccgatcctgcctgatctccacttggaagcatggccggccacggacaagactaagcaggaggaagtcgat

SEQ ID NO: 6012 - DNA, 618 bp, Artificial Sequence
  Description of Artificial Sequence: Synthetic coding sequence
atggggacctggatactttttgcatgtctcgtgggtgcagcgttcgcgatgccactgcctccccatcctggacaccctggttacatcaacttcagctatgaaaatagccattcccaagcaatcaacgtggatcgtattgcgttggtccttacccctcttaaatggtatcagtcgatgatcagacctccctactcctcgtacggttacgagcctatgggtggctggcttcatcatcagattattccggtcgtgtcacaacaacatccactgactcataccctccaatcacatcaccacatcccagttgtgcctgcacaacaacctcgcgtgaggcagcaagcactcatgcccgtgcccggccagcaatccatgactcctacccaacaccatcagccgaacctccctctccctgcccaacaaccatttcagcctcagccagtgcaacctcaaccgcaccagcctatgcaaccgcagccccctgttcaacctatgcaaccactgctgccgcaaccccccttgccaccaatgtttcctctgaggccgctgcccccaattctgcctgaccttcatcttgaagcatggcccgctactgacaagaccaagcaagaagaagtggat

SEQ ID NO: 6013 - DNA, 618 bp, Artificial Sequence
  Description of Artificial Sequence: Synthetic coding sequence
atgggaacttggattttatttgcctgcctcgttggggctgcttttgcaatgccattgccgccacatcctggacatccaggttacattaatttctcttacgaaaactcccactcacaagctatcaatgttgatcgtatcgcacttgtacttacgccactgaagtggtaccagtcgatgatccgacctccatattcttcttatgggtatgagccaatgggaggctggttgcatcatcaaattatacctgtagtgagtcaacagcacccattgacccacacattacaaagtcaccaccacattccagtcgtccctgcgcaacagccccgcgtgagacagcaggcacttatgcccgttccaggccaacaaagcatgaccccgacacagcaccaccaaccaaacctgccacttccagctcagcaaccgtttcaaccacaaccagtgcaaccgcagccgcaccagccaatgcagccacaacctccagtgcaaccaatgcaaccgttgcttcctcagccgccgttgccaccgatgtttccattgcggcccttaccaccaattctaccggatttgcatttggaggcatggcctgcaacagacaaaaccaaacaagaggaggtagat

SEQ ID NO: 6014 - DNA, 618 bp, Artificial Sequence
  Description of Artificial Sequence: Synthetic coding sequence
atgggaacgtggatccttttcgcttgtctcgtcggggcagccttcgcaatgcccctgcctccacacccgggccacccaggttacatcaacttctcatacgagaattcccatagccaagcaatcaacgtggacagaattgcccttgtcctgaccccactcaaatggtatcaatccatgatcaggcccccctatagctcctacgggtatgaaccaatggggggctggttgcatcaccaaattatccctgtggtcagccagcaacatccgttgacccacactctacagagtcaccaccatatccccgttgtgccggcccagcagcccagagtgcggcaacaggcgttgatgcccgtgcccggccaacaatccatgacgcccactcaacaccaccagccaaatttaccactcccagcacaacagcccttccagccccagccagtgcagcctcagccccatcaaccaatgcagccacagccaccggtccagcctatgcagcctctgctgccgcagccgccactgccacctatgttcccattgcggccccttccacccattcttccagacctccacctggaggcatggccagccacggacaaaaccaagcaggaggaggtggat

SEQ ID NO: 6015 - DNA, 618 bp, Artificial Sequence
  Description of Artificial Sequence: Synthetic coding sequence
atggggacttggatcctgttcgcctgtctcgtgggagcagcattcgctatgccgctgccaccacatcccggacaccccggatacattaatttttcttacgagaacagtcattcccaggccatcaatgttgatcggatcgcactcgtgttgacacccctcaaatggtaccagtcgatgattcgcccaccctacagctcttacgggtatgagcccatggggggatggctgcaccatcaaattatcccagttgtctcacagcagcatcctctaactcacactttgcagtcgcaccaccatatccccgtcgtgccagcccagcaacctcgagtccgtcaacaggcacttatgcccgtcccaggacagcagtcaatgacccctacccaacaccaccagcccaatctgccgttgccagcccagcagcctttccaaccccagcccgtacagcctcaaccccaccagcctatgcagccccagcctcccgtccagcctatgcagcctctgctgcctcagcccccgttaccgcccatgttccctctacggccgctcccccctatcctgccagaccttcatctcgaagcttggcctgctactgacaaaaccaaacaggaagaggtcgac

SEQ ID NO: 6016 - DNA, 618 bp, Artificial Sequence
  Description of Artificial Sequence: Synthetic coding sequence
atgggaacatggattcttttcgcgtgtctggttggtgcggcatttgctatgccgctcccacctcatccgggacaccctgggtatatcaacttctcgtatgagaattcacattctcaggcgatcaatgtcgaccgcattgcacttgttttgaccccattgaaatggtatcaatccatgatccgacctccttactcttcgtacggctatgaaccgatgggtggatggctgcatcatcaaattatccctgttgtgtctcaacagcacccactcacacataccttacaaagccatcatcacattcccgtagtgcccgctcagcaaccccgagtccgacagcaagctttgatgcccgttcctgggcaacagtcaatgacaccgacccaacatcatcagcctaacctccctttgccagcccaacagcccttccagccgcaaccggtgcagcctcagccgcaccagccaatgcaacctcaaccacccgttcagccgatgcagccgttactgccgcagcctcctttgcctccaatgtttccactacgtccattaccccctatactgcccgacctacacttggaggcgtggcccgcaaccgataaaacgaagcaggaggaagtcgac

SEQ ID NO: 6017 - DNA, 618 bp, Artificial Sequence
  Description of Artificial Sequence: Synthetic coding sequence
atgggaacttggattttgttcgcttgcctggttggagccgcatttgctatgcccttgcccccacacccgggtcacccaggatacattaacttttcatatgagaacagccatagccaagccattaacgtggatcgaattgcactggtcctgactcctctcaagtggtaccagagcatgatcaggcctccatacagcagctatggatatgaaccaatggggggctggctccaccatcagatcattcctgttgtctctcagcagcatcctctgacccataccctgcagagccaccatcatattcctgttgtacccgcacagcaaccccgcgtgcgacagcaagccctgatgcccgtgcccgggcagcagtcaatgacgcccacccaacaccaccagcccaatctgcctctccccgcccagcagcccttccaaccacagcccgtgcagcctcagccacaccagcctatgcaaccgcagccccctgttcaacccatgcagcctctgctgccccagcctcccttaccccctatgttccccctacggcccctgccaccgattcttccggatctgcacttggaggcctggcctgcaacggataagacaaaacaggaagaagtagat

SEQ ID NO: 6018 - DNA, 618 bp, Artificial Sequence
  Description of Artificial Sequence: Synthetic coding sequence
atgggaacctggatcctcttcgcctgcctggtgggtgccgcgtttgctatgcccctgccgcctcacccaggccacccaggctatatcaatttctcctacgaaaactcccactcacaagctatcaatgtggatcgcattgcactggttctgaccccgctgaagtggtaccagagcatgattcggccaccgtactcctcctacggttacgaacctatgggagggtggttgcatcatcaaatcatcccggtcgtgtcacaacagcatccactgacccatactctccagagccatcatcatatcccagtggtgccagctcagcagccgcgggtgcgtcaacaggcgctgatgccagtgccgggacaacagtccatgaccccgacgcagcaccaccagccgaacctgccactgccagcccagcaacccttccaaccccaacccgttcagccgcaaccgcaccagccgatgcagccgcagcctccggtgcagccgatgcaacctctgttgccgcaaccaccgctcccgcctatgtttccactccgaccactgccgccaatcctgccggacctgcacctggaggcctggcccgctactgataagaccaaacaggaagaggtggac

SEQ ID NO: 6019 - DNA, 618 bp, Artificial Sequence
  Description of Artificial Sequence: Synthetic coding sequence
atgggaacatggattctcttcgcttgtctcgttggagctgcgttcgccatgcccctcccgccgcacccaggacaccccggctacatcaacttctcatatgaaaacagccatagtcaggcgatcaacgtggacagaatcgctttggtgttgacccccctcaagtggtaccagtccatgatccgccccccctactcatcttacggttacgagcccatgggtggctggctgcatcaccaaattatccccgtcgtgagccaacagcaccctctgactcataccttgcaatctcatcatcatatccccgtggtccctgcccagcagcccagggtgcgccaacaggcccttatgcctgttccaggtcagcagtctatgacccctacacaacaccatcaaccaaatctccccctgcccgcgcagcagcctttccagcctcagccggtgcagccccaaccccaccaacccatgcagcctcaacccccggtgcaacctatgcaaccactgctcccacagccgccgctccctccaatgttccctttgaggcccctgcccccaatcctcccagatctgcacctggaagcgtggcctgctactgataagaccaagcaggaggaagtggac

SEQ ID NO: 6020 - DNA, 618 bp, Artificial Sequence
  Description of Artificial Sequence: Synthetic coding sequence
atggggacgtggatactgttcgcctgtctggtcggcgcagccttcgctatgcctctgcctccacatccgggacaccccggctacatcaatttttcttacgaaaattcccactcccaggcaattaatgtagacaggatcgccttggtgctgactcccctgaagtggtaccagtccatgatccgccctccttattcatcttacggctatgagcctatgggcggttggcttcaccaccagatcattccagtggtcagccagcaacacccactcactcatacccttcagagtcaccatcacatcccggtggtacccgctcagcagccccgggtccgtcaacaggccctgatgcctgtaccaggccagcaatctatgaccccaactcaacatcaccagcccaacttgcctctgccagcacagcagcctttccagccccagcccgtgcaaccccagcctcaccaacccatgcagccccagccacccgttcagccaatgcagcccctacttccacagccaccccttccacctatgtttcctttaagacctctgcctcccatccttcccgatctccatttggaggcctggccagcaactgataaaactaagcaggaggaggtggac

SEQ ID NO: 6021 - DNA, 618 bp, Artificial Sequence
  Description of Artificial Sequence: Synthetic coding sequence
atgggcacctggatcttgttcgcctgcctggttggagcagcattcgccatgcctcttccaccgcatccgggccacccgggttacatcaactttagttacgaaaactcgcacagccaggcaatcaacgtcgatagaatcgccctggtgctcactcctctgaagtggtaccaaagcatgatccgcccaccatactcatcatacggctacgagccgatgggcgggtggctgcaccatcagattatcccggtcgtgagccagcagcacccactgacccacaccctgcaatcgcaccaccatatcccagtggtgccagcccagcagccacgggtccgccagcaggcgctgatgccggtgcccggccagcaatcaatgactccaactcagcaccatcaaccgaacctgccactcccagcccagcaacctttccaaccgcagcctgtgcagccccagccacatcaacccatgcaacctcaaccgcctgtgcaaccgatgcaaccactcctcccgcaaccgccgctcccaccgatgttccctctccgcccgttgccgcccatcctgccggatctgcacctggaagcgtggccggcaactgacaagactaaacaggaggaagtggac

SEQ ID NO: 6022 - DNA, 618 bp, Artificial Sequence
  Description of Artificial Sequence: Synthetic coding sequence
atgggcacgtggattcttttcgcatgtctggtgggcgctgcgtttgcgatgcctctcccaccccaccctggacaccctggctacattaacttctcttacgaaaattctcactcacaagctattaatgtagaccgaatcgctttagtgctgacccctcttaaatggtaccagtcaatgatacgaccgccgtatagcagttatggttacgaaccaatgggcgggtggctccaccaccagattatcccagtggtgtcacagcagcatcccctgactcacaccctccagagtcatcaccacatccctgtggttcccgcccaacagcccagggtcagacagcaggctttaatgcccgtgccaggacaacagtccatgactccgacccagcatcatcagccaaatttgccactgcctgcccaacagcccttccagccgcaaccggtccagccacaaccgcatcaaccgatgcagcctcaaccaccggtgcagccgatgcaacctctgctgccacagccgccactcccacctatgtttcctctgagacctctccctcctatcctgccggatctgcacttggaagcttggccagccacggacaaaacaaagcaagaggaagttgac

SEQ ID NO: 6023 - DNA, 618 bp, Artificial Sequence
  Description of Artificial Sequence: Synthetic coding sequence
atgggtacgtggattctgttcgcgtgtctggtgggagccgcctttgcgatgccccttcccccccatcctgggcatcccggatacattaatttctcttacgagaactcccattcacaggcgattaatgttgaccgaatcgctctggtgttgacgccactcaagtggtaccagagtatgatccgacctccatactcctcttacgggtacgagccaatgggcggctggctgcaccatcaaataatccccgttgtaagtcaacaacatccgctgactcataccctgcagtcacaccatcatattcccgtggtcccagcccagcagcctagggtgaggcagcaagccctgatgcccgtccccggacaacagtccatgactcctactcaacatcaccagccaaacctgccactgcctgcccagcaacccttccagccacaacccgtgcaaccacagccacatcagcccatgcagcctcagccccctgtacagcccatgcagcctctgcttccccagcctccgctgccccccatgtttcctctgcgtccactaccaccaatcttgcccgaccttcacctggaagcttggcctgccaccgataagacaaagcaggaggaagtggac

SEQ ID NO: 6024 - DNA, 618 bp, Artificial Sequence
  Description of Artificial Sequence: Synthetic coding sequence
atgggaacatggatactattcgcctgtctggttggggccgcatttgctatgcccctgcctccgcatcctggtcatccaggatacattaatttcagctacgagaactcccattcacaggcgataaacgttgaccgaatagctctggttctgactccattaaagtggtaccagtccatgataagaccaccatactcgagctacgggtatgaacccatgggcggatggctgcaccaccagatcataccagtggtttcgcaacaacatcctctcacacatacgcttcagagccaccaccacattcctgttgtacccgcccagcaacctcgtgtccgtcagcaggcactcatgcctgttcccggccagcagagtatgacacctacacagcaccaccagccgaacctgccgctgccagcccagcagcccttccagccacaacctgtccaaccacagccccaccaacccatgcagccgcagcctccagtgcagccaatgcagccgttgctcccacaacctccactgccacccatgttccccctgcgtcctctgccaccaattctgcccgatttacatctggaggcatggcccgctactgataaaacgaagcaggaggaagttgat

SEQ ID NO: 6025 - DNA, 618 bp, Artificial Sequence
  Description of Artificial Sequence: Synthetic coding sequence
atggggacctggattctgtttgcatgtctggtgggtgcggcatttgctatgcccctgccacctcaccctggacatcctggttacataaacttcagctacgaaaattctcattcccaggccattaatgtggacagaattgctctggtcttgacccctttgaagtggtaccaatccatgattcggcccccttactcctcgtacgggtatgagccaatgggaggttggctgcatcatcagattatccctgtagtctcccagcaacacccgctcactcacactcttcaaagccatcaccatatccctgtggtgcctgcgcaacaaccccgcgtccgacaacaagcacttatgcctgtgccaggccaacaatccatgacccccacccaacatcaccagcccaatctcccgctcccagcacaacaaccattccagcctcaaccggttcaaccccaaccccaccagcctatgcagccacagcctcccgtccaacccatgcagcctctccttccacaacctcccctgccgcctatgttccccctcaggcctctccctcccatcctgcccgatctccatcttgaggcatggcccgcaactgataagactaaacaagaagaagtggac

SEQ ID NO: 6026 - DNA, 618 bp, Artificial Sequence
  Description of Artificial Sequence: Synthetic coding sequence
atgggcacatggatcctgtttgcgtgtttggtgggggctgcattcgccatgccccttccccctcaccctgggcacccaggctacataaatttttcctacgaaaattctcacagtcaagcgattaatgtagaccggatcgcactggtgcttacaccactgaaatggtatcaatcaatgatacgacccccatatagctcctatggctacgagccaatgggtggctggctgcatcatcagataatcccagtggtttctcagcagcatcctctcacccacacactgcaatctcaccaccacatcccagttgtgccggcacagcagcctcgggtgaggcaacaagcgttgatgcctgtgcctgggcagcagtcaatgacacccacacaacaccatcagcccaacctgccactccccgcacagcagcccttccaaccccagccagtgcaaccccagccacatcagccgatgcagccacagcccccagtgcagccaatgcaacccctccttccgcagcccccactgccaccaatgttccctcttcgtcctctcccacctatcctcccagatcttcatctggaggcttggccggccacagacaaaaccaagcaggaagaggtcgat

SEQ ID NO: 6027 - DNA, 618 bp, Artificial Sequence
  Description of Artificial Sequence: Synthetic coding sequence
atgggcacgtggatcctgttcgcctgcctggttggagcagccttcgctatgcctctgccacctcatccaggacaccccggatacatcaatttcagttacgagaattcacacagccaggccattaatgtggatcggatcgctctggtccttactccacttaaatggtatcaatccatgattagaccaccctatagcagctatgggtacgaaccaatggggggatggttgcaccaccagatcatacccgttgttagccagcagcatccactgacgcatacactccagtcacaccatcacatccccgtggtgccagcacagcaacctcgcgtgaggcagcaggctcttatgcccgtgcccggtcagcaatccatgacacccacacaacatcaccagcctaacttgcccctccctgctcaacagcccttccagccacagccagtgcagccccagccacaccagcccatgcaaccacagcccccagtgcagcctatgcaacctctgctcccgcagcctccactccctcctatgtttccactgagaccactcccacctatcctgcccgacctgcacttggaggcctggcctgcgaccgataagactaaacaggaggaagtggat

SEQ ID NO: 6028 - DNA, 618 bp, Artificial Sequence
  Description of Artificial Sequence: Synthetic coding sequence
atggggacctggatcttattcgcatgtttggtaggcgctgcttttgcaatgccgttgcccccccacccaggccaccctggctatattaatttctcttacgaaaattcacactcccaagcgataaacgtggacaggattgctctggtgcttaccccacttaagtggtaccagtcaatgatacgtcccccttattcttcctatggttacgagccgatgggcggttggctgcaccatcagatcatacccgtcgtgagccagcaacacccactgacacacacactgcagtcgcaccaccatatccccgtggtgcctgctcagcagccgagggttcggcagcaggccctcatgccagtgcccggacagcagtctatgacaccaactcagcaccaccagcctaatcttccccttccagcccagcagccgtttcagccccagccggtgcagccccagcctcaccagcccatgcagccccagccccccgttcagcccatgcagccactgttgccgcagcctccgctgccgcccatgtttccgttgaggccactgcccccaatactgccggacctccacctggaagcatggccggccaccgacaagaccaagcaggaggaggttgac

SEQ ID NO: 6029 - DNA, 618 bp, Artificial Sequence
  Description of Artificial Sequence: Synthetic coding sequence
atggggacatggatactgttcgcatgtcttgtcggggcagccttcgccatgcccctcccccctcaccccgggcacccaggctacatcaacttcagctacgaaaattctcattctcaagcaattaacgtcgatcgaattgccctcgtcctgaccccgcttaagtggtaccagagtatgattcgcccaccctactcaagttacggctacgaacccatgggtggttggttgcatcaccagattatccccgtcgtgagccagcagcatcctctgacccacactcttcaatcacaccaccacattccggtggttcccgcccaacaaccacgggtgcgccagcaggccttaatgcccgtgcccggacaacaatctatgactccgacccagcaccaccagcccaatctccccctgcccgcccagcagccatttcagccccaaccggtgcagccccaaccacatcagcccatgcagccacagccgcccgtgcagcccatgcaaccactgctgccgcagcctcctctgcctcccatgttccctttgcgaccactccctcctatcttgcccgacctacacctggaggcctggcccgccaccgataaaacgaagcaggaggaggtggac

SEQ ID NO: 6030 - DNA, 618 bp, Artificial Sequence
  Description of Artificial Sequence: Synthetic coding sequence
atgggaacctggatcctgttcgcatgtctggtgggtgcagcttttgcaatgccactgcccccacaccccggacatccgggatacattaacttctcgtacgaaaatagccatagccaggccataaacgttgataggatcgcactcgtgctcacccccctcaagtggtaccaatccatgatacgacccccttactcgagctacggatatgagccgatgggtggatggcttcatcatcaaatcattccagtcgtttcgcagcagcacccgcttactcatactctgcagtcccatcatcatattccagtggtcccagcacaacagcctcgcgtgagacaacaggccctcatgccagtccctggacagcaatccatgacccctacccaacaccatcaacctaacctcccgcttcctgctcagcagccatttcagcctcagccagtgcaaccacagcctcaccagccgatgcagccgcaaccaccagtgcaacctatgcaacctcttctcccacaacctccactcccgccaatgtttccactgcgtcctcttccacccatcctcccggacctccacctcgaagcatggcctgcaaccgataagaccaagcaagaggaagtggat

SEQ ID NO: 6031 - DNA, 618 bp, Artificial Sequence
  Description of Artificial Sequence: Synthetic coding sequence
atgggaacctggatcctatttgcctgcttggtaggggccgcctttgctatgccattaccaccacaccccggccatcccggctatatcaattttagttacgagaattcccatagccaagcaatcaatgtggatcgaattgcccttgtgctgactcctctgaagtggtaccagagcatgatcaggcccccctactccagctacggctatgagccaatgggaggatggctgcaccaccagataattccagtcgtctcccagcagcatccactgacccacactctccagtcccaccaccacattccagtggtgcctgcacagcagccacgtgtgcgccagcaggccttaatgcctgtgccaggccagcagagcatgactccgacacagcatcatcaacccaatttaccactgcctgcacagcagccattccagccacagccagttcaaccacagccgcaccagcccatgcaacctcagccccctgttcaaccgatgcagccgctgttgccacaacctccgctgcccccaatgttcccgttaagaccattgcccccaattttgccagaccttcacctggaagcttggccagctactgataaaactaaacaggaggaggtagac

SEQ ID NO: 6032 - DNA, 618 bp, Artificial Sequence
  Description of Artificial Sequence: Synthetic coding sequence
atgggaacatggattctgtttgcctgcttggttggcgcagcctttgcgatgcccctgccgcctcaccccggccaccccggatatataaatttctcatatgaaaattctcattctcaggccataaacgtcgataggatcgccctggtgctgacgccgctgaaatggtatcagtctatgatcaggcccccctattcctcttacgggtatgaacccatgggtgggtggttgcaccaccaaatcatccctgtcgtgtctcagcaacaccccttgacccatactctgcagtcccatcatcacattcccgtagtaccggcacagcagcccagggtgagacagcaggccctcatgcccgtccctgggcaacaatccatgactcccacccagcaccatcagcctaacctacctctgcctgcacagcagccatttcagccgcagcctgtccagccgcagccgcaccagccgatgcaacctcagcccccagtgcagccaatgcaacccctgttacctcaaccccctctgcctcctatgtttccgctgcgacccctgcctccaatcttgccagacctgcaccttgaggcctggcccgctaccgataagacgaagcaggaggaggttgat

SEQ ID NO: 6033 - DNA, 618 bp, Artificial Sequence
  Description of Artificial Sequence: Synthetic coding sequence
atgggcacgtggatcctcttcgcatgtctggtgggcgccgcctttgcgatgccgctgcccccgcacccaggacacccaggatacatcaatttttcctacgaaaactcgcattcgcaggccatcaacgtggaccggattgcgctggtgctgactccgctgaagtggtaccagtcaatgattagaccaccctactcgagctacggctacgaaccgatggggggctggcttcaccatcagatcatcccggtggtgtcccaacagcacccgcttactcacaccctgcagagccaccatcacatcccagtcgtcccagcacagcaaccacgcgtgcggcagcaggcgctcatgccagtgcctggacagcaatcgatgacccctactcagcatcaccagcccaacctcccactgccagcgcagcaacctttccagcctcagccggtccagccacagccgcaccagccgatgcagccccagccaccggtccaaccaatgcaaccactgctgcctcagccgcctctgccgccgatgttcccgctgcgccccctccctcccatccttccggatctgcatctggaggcatggcccgctactgacaagacgaagcaggaagaagtcgat

SEQ ID NO: 6034 - DNA, 618 bp, Artificial Sequence
  Description of Artificial Sequence: Synthetic coding sequence
atgggaacctggatcctgttcgcatgcctggtcggcgccgcgttcgctatgcctcttccgccacatccaggacatccagggtacatcaacttttcctacgaaaactcgcatagccaggccatcaacgtcgaccgcattgccctcgtccttactcccctcaagtggtatcagtcaatgatccgcccgccctacagctcgtacggatacgaacccatgggtgggtggcttcaccaccagattatccctgtggtgtcacaacagcaccccctcacgcacactctgcagagccaccaccacatcccggtcgtgccggcccagcagccacgcgtccggcagcaagcccttatgcctgtgccaggacagcagtcgatgacgcctacccagcaccatcagccgaacctgccactgcctgctcagcaaccattccagccgcagcccgtgcagccgcagcctcaccagccaatgcaaccgcagcctccagtgcagccgatgcagccgctgctgccgcaaccaccgctgccgcctatgtttccactgaggccgctgccacctatcctcccagacctccacttggaggcatggcctgctaccgacaagaccaagcaggaagaagtggat

SEQ ID NO: 6035 - DNA, 618 bp, Artificial Sequence
  Description of Artificial Sequence: Synthetic coding sequence
atgggcacgtggatactgtttgcctgtctcgtgggcgccgcctttgctatgcctttgccgccacatcctggtcatcctggctacataaactttagctacgagaactctcattctcaggccataaacgtcgaccgcattgctttggtcctgaccccccttaagtggtatcagagcatgattcgaccaccttattccagctatggctatgagccaatgggagggtggctgcatcaccagataatccccgtggtttcccaacagcaccctttgacccacacactccagtcccaccatcacatccctgtggttccggcacagcagccccgggtgcgccagcaggccctgatgccagtcccgggccaacagtctatgacccctacccagcatcaccagcccaacctgccactgccagcgcagcagcctttccagcctcagcctgttcaaccacagccccatcaaccaatgcagccccagcctcccgtgcaaccaatgcagccactcctgccacagcccccgctgcctccaatgttcccactgagaccgctccctcctattctgcccgaccttcatcttgaggcttggccggctacggataagacaaagcaggaagaggtggac

SEQ ID NO: 6036 - DNA, 618 bp, Artificial Sequence
  Description of Artificial Sequence: Synthetic coding sequence
atgggaacatggatcttatttgcctgtctcgtgggagccgccttcgccatgcctctgccacctcatcctgggcatcctggctacatcaacttctcctatgagaactcacactcccaggcgatcaacgtcgatagaattgctttggtgcttacacccttaaagtggtaccagagcatgattagacctccctattccagctacggctacgagcccatgggggggtggttacaccaccagatcataccagtcgtgagccaacagcatccccttacacacacactccagagtcaccatcacatccctgtggtgccggctcagcagccccgagtgcgacaacaggcccttatgcctgttcctggccagcagtcaatgacccccactcagcaccaccagccaaacttgccgctcccagcgcagcagccatttcagcctcagcctgtccaacctcagccgcaccagccgatgcagccgcagcctcccgtgcagccaatgcagcccctgctgcctcaaccgcctcttccccccatgtttcccctgaggcctcttccaccaatactcccagacctccaccttgaggcctggccggcgactgataaaacaaagcaggaggaagttgat

SEQ ID NO: 6037 - DNA, 618 bp, Artificial Sequence
  Description of Artificial Sequence: Synthetic coding sequence
atgggaacctggattctcttcgcctgcctggttggagctgcatttgccatgccgttgcctccgcatccgggacatccaggatacatcaacttttcctacgagaactcacactcgcaagcaatcaatgtggacaggattgcactcgtcctgaccccgttgaagtggtaccaatccatgatcagacccccgtattcctcctacggatacgaaccaatgggaggctggctccatcatcaaatcattccagtcgtctcgcaacagcaccctctcacgcacaccctgcaatcacatcaccacataccagtcgtccctgcgcagcaaccgcgggtgcgccaacaggcacttatgccagtccctggtcaacagtcgatgactccaacccagcaccaccaaccgaatctcccacttccggcgcagcagcccttccagccacaaccggttcagccacaaccacatcagccgatgcagccacaacctccggtgcagcctatgcagccgctcctcccgcagccgccactgccaccgatgttcccgttgcgtcccctgccacccatcctgcctgacctgcatctggaagcctggccagccactgataagaccaagcaagaggaagtggac

SEQ ID NO: 6038 - DNA, 618 bp, Artificial Sequence
  Description of Artificial Sequence: Synthetic coding sequence
atgggaacatggattttgttcgcttgtctcgttggcgctgcctttgcaatgccactccccccacatcctggacatcccggttacatcaattttagctacgaaaatagtcattcccaagcgattaacgttgataggattgctctcgttcttacacctctaaagtggtaccagtcaatgataaggcctccttactcttcatatggatatgaacctatgggaggttggcttcaccaccaaattatcccagttgtttcccagcaacaccccctcacacacaccttgcagagccatcaccatattcctgtggttcctgcccaacaaccgagagttagacagcaagctcttatgccagttcctgggcaacaaagcatgactccgacgcaacaccaccaaccaaacttaccattgcctgctcaacagcccttccaacctcagcctgttcaacctcaaccacaccaacctatgcagccccaacctcctgtgcagcctatgcaaccccttcttccacagccgcctctaccgccaatgtttcctctacgaccacttccaccgatcttgccagatttacatctagaggcgtggcctgccaccgataagacaaagcaagaagaggttgac

SEQ ID NO: 6039 - DNA, 618 bp, Artificial Sequence
  Description of Artificial Sequence: Synthetic coding sequence
atggggacctggatactctttgcctgtttggtgggggcggcatttgcgatgccgcttccgccacacccgggccatcctgggtacattaacttttcatacgaaaacagccattcgcaagccataaacgtggataggattgcactggtccttactcctctgaaatggtatcagtctatgattaggcctccgtactcctcctacggatacgagccaatgggtggttggcttcaccaccagatcatccctgtggtttcgcagcaacacccactgacccatacgctccaatcgcatcatcatattcctgtcgtgcctgcacagcaacctcgagtgcgccagcaagctctgatgccagtgcctggccagcaatcaatgactcctacccaacatcaccaaccaaatctgcctcttccggcacaacagcctttccaaccacagcctgtgcagcctcagccccatcagcctatgcagccccaaccgccagtccaacccatgcagccactgctgcctcaaccaccacttccccctatgttcccactccgtccgcttcctcccattctcccggatctgcatcttgaagcgtggccagccaccgacaagactaagcaagaagaggtggac

SEQ ID NO: 6040 - DNA, 618 bp, Artificial Sequence
  Description of Artificial Sequence: Synthetic coding sequence
atgggaacttggatactgtttgcatgccttgtgggtgcagcctttgcaatgcctcttcctcctcatccgggacatcctggttacatcaatttctcatacgaaaactcacattctcaagcaattaacgtcgatcgcatcgccttggtactcaccccattgaaatggtatcaatccatgatacggccgccgtactcctcctacggttacgagccgatggggggttggctgcatcatcagattatacctgtcgtgtcgcaacaacatcctctgacccacacgcttcagtcacatcaccacattcctgtggtcccggcccaacaaccccgagtccggcagcaagcactgatgcccgtgccagggcagcaatcaatgacgccaacccagcaccaccaacctaacctcccacttcccgctcaacaaccttttcagcctcagcccgtgcagccccagcctcatcagcccatgcagccacaaccgccagtgcaacctatgcagcctctccttccacagcccccacttcctccaatgttccccctgcgcccactgccccctattctgcctgatcttcatctcgaagcatggcccgcgaccgacaagaccaagcaagaagaggtggat

SEQ ID NO: 6041 - DNA, 618 bp, Artificial Sequence
  Description of Artificial Sequence: Synthetic coding sequence
atggggacctggatactttttgcttgtctggtgggagccgcctttgctatgcctcttccaccacaccccggacatcccgggtacattaacttctcttatgagaactctcattcccaggctatcaatgtggatagaatcgcgctcgtcttgactcctctaaagtggtatcaaagtatgatccgacccccttacagcagctatggatatgagccaatgggcggatggttgcatcaccagatcatacccgtggtgagccagcaacatccgcttacccatactttacagtcacatcatcacatacccgtggttcccgcacagcagccccgtgttcggcagcaggccctgatgccagtgcccggccagcagagcatgaccccaacgcagcatcatcaacctaacctccccctgccggctcagcagccctttcagcctcagccagttcagcctcagccacaccaaccgatgcagccacagccacccgtacagcctatgcagccactgcttcctcagccgcccctccccccgatgtttccactaagaccactcccgcccattcttccggatttacatctggaggcctggcctgccaccgacaagacaaagcaggaagaggtggat

SEQ ID NO: 6042 - DNA, 4596 bp, Artificial Sequence
  Description of Artificial Sequence: Synthetic coding sequence
atgggtcactccaagcagatccgcattttactattaaatgagatggagaagctcgagaaaacactgtttcggttggagcagggatacgagctacaatttaggctcggaccaactctccagggaaaagccgtgactgtctataccaactatcccttccctggcgaaacttttaatcgcgaaaaattccggagtctcgattgggagaatcccactgaaagggaagatgactcggataaatactgtaagctcaacctccagcagagtggcagttttcagtactatttcctgcaaggaaacgagaagtctggcggtggatatattgttgtagaccctatcctgagggtcggcgcggataaccacgtgctgccgctggactgcgtgaccctgcagaccttcctggcaaaatgcttgggtcccttcgatgagtgggagagtcgtctgagagtcgccaaggagtcagggtacaatatgattcattttactccccttcagacattgggtttatcaagaagctgttacagtctcgccaaccagctggagctgaacccagactttagtcgacccaatagaaaatatacatggaatgacgtggggcagctcgtcgagaaacttaaaaaggaatggaacgtaatttgtatcactgacgtggtgtacaatcacacagcagctaattctaagtggattcaagagcatccggagtgcgcatacaatttggtcaattctccacacttgaagcccgcatgggtgctagaccgcgccttgtggaggtttagctgcgatgtggcagagggaaaatataaagagaagggcatccccgcactaattgagaacgaccaccacatgaactcaatcagaaaaatcatttgggaagacatctttcccaagctcaagttatgggaattctttcaggtggatgtgaataaggccgtcgaacagtttcgaaggctgttaacacaggaaaacagaagggttacgaagagcgacccaaatcagcatctcactattatccaagatccagaatacaggcggttcggatgcaccgtggatatgaacattgccctcactacatttatcccccacgataagggcccggcggccattgaagaatgttgcaactggtttcacaaaaggatggaggaactcaattctgaaaaacacaggctgattaactaccaccaggaacaggctgtgaattgcctgctgggcaacgtattctacgagcggctcgccggccatggccctaagcttgggcctgtcactcggaaacatcctctggtaacccgttattttacattccctttcgaagagatcgattttagtatggaggagtcaatgattcatctgcccaacaaggcctgtttccttatggcccacaacgggtgggttatgggggatgacccactgaggaactttgccgaacccggctctgaagtgtacctgcggcgcgagctgatatgctggggcgacagcgtgaaactgagatatggcaacaagcctgaagactgcccttatctgtgggctcatatgaaaaagtacacagagatcacagcgacgtacttccagggggtgagactggacaactgccatagtacacccctccacgtcgctgaatacatgctcgacgccgctcgcaatctgcagcctaatttgtacgtcgtggcagagctgttcactggttccgaggacctggacaatgtatttgtcacacggttgggcatctctagtctgattagggaggccatgtctgcatataatagccacgaagagggacggttagtgtataggtacgggggggagccggtcggaagttttgtacagccctgtctgaggcccctgatgccagctatcgcacatgccctgtttatggacataacccatgacaatgagtgccctatagtccataggtctgcatacgatgcattacccagtactacaatcgtgtccatggcctgttgcgcttccggaagtacccgggggtacgatgagctggtgccccatcagatctcagtggtatctgaggagcggttttatacaaaatggaacccggaggcccttccaagtaacaccggggaagtgaatttccaatctgggatcatcgctgctcgctgtgccataagcaagcttcatcaggagctgggcgccaagggtttcatccaggtctacgtggaccaggtggacgaggatattgtggccgtcacacgccactccccatcaatccatcagtccgtggtggcagtctctcggacagccttccgtaaccccaagaccagtttttatagtaaggaagtgcctcagatgtgcattccaggaaagatagaagaagtcgtcctcgaggctagaactatagagcgcaatacgaagccctaccgaaaggacgagaatagcattaatggaactccagacatcaccgtcgagattagagagcatatccagctcaatgagagcaaaatcgtcaaacaggctggcgtggcaaccaaggggcctaacgaatatatccaagagatcgaattcgagaatttatcccccggctccgtcatcatctttagagtgtcactagacccccatgctcaggtcgcagtgggtattcttaggaaccacctgacccagttttccccacactttaaaagcggatccctcgccgtggacaacgcggatcccattcttaagattccgttcgcctctctggcttcacggttgacgctagcagaattgaatcagatactttaccggtgtgaaagcgaggagaaggaggacggcgggggatgttatgatattcctaactggtccgctctgaaatacgccggcctacaaggcttgatgtcagtgttagctgagatccgaccgaaaaacgaccttggccaccccttctgcaataatcttaggtccggtgattggatgatcgattatgtgagtaacagattgatttcccgttccggaaccatcgccgaagtcggcaagtggctgcaggccatgtttttttatctgaagcaaatccctaggtatctcataccttgctactttgacgccattctgattggagcctatacaacccttctagatactgcttggaagcagatgagctcctttgtgcagaacggatctacatttgtcaaacacctgagcttgggtagcgtgcaactttgcggcgttggtaagttcccgagtcttcccatactaagccctgccctgatggacgtgccgtataggctcaatgaaattacgaaagagaaggagcagtgttgcgtttccctggcggcaggactgcctcatttctccagtggtattttccgttgctgggggcgggacacattcatagctctgaggggcattctcctgatcactggtagatatgtggaggcccggaacatcattctagcctttgcgggtactttgcgccatggtcttattccaaacctgcttggggagggaatttatgcccggtacaattgccgagacgccgtttggtggtggctgcagtgcatccaggactactgcaagatggtacccaatggtctggatatcctcaaatgccccgtgagcagaatgtaccctacggacgactccgcccccctgccagcaggcacacttgaccaacctctcttcgaggttatccaggaagccatgcagaaacacatgcaggggattcagtttcgcgagcggaacgctggtcctcaaattgatcgcaacatgaaggacgagggtttcaatataaccgcgggggttgacgaggaaactgggttcgtttatggggggaaccgctttaactgtggtacttggatggacaagatgggtgagagcgacagagctcgaaaccgaggcattccagctacacctcgggatggcagcgccgtggaaatcgtgggcctgtctaagagtgccgtcaggtggctcctggagcttagtaaaaagaacatcttcccgtaccatgaagtcacagtgaaacggcacggtaaagctatcaaagtctcatatgacgaatggaataggaaaattcaggacaatttcgaaaagctattccacgtcagcgaggaccccagcgatctgaacgagaagcatccgaatcttgtgcataaaagggggatttataaggactcctatggtgctagcagcccttggtgtgactatcagcttaggcccaactttactattgcgatggtcgtcgcaccagagttgtttactactgagaaggcctggaaagcactggagatcgcggaaaaaaaactgcttggacccctcgggatgaaaaccctggacccggatgatatggtgtattgcggcatctatgacaacgccctggacaatgataactacaacttggcaaaaggatttaactatcatcagggcccggaatggttgtggcctatcggctatttccttcgcgccaaactctatttctctcggctcatggggccagaaaccacagcaaagacaattgtcttggtgaaaaatgtgctgtctcgacactatgtacacctagagaggagcccttggaagggactccccgaattgacaaatgagaacgcccagtattgtccctttagctgcgagacccaagcatggagcatcgcaacaatcctagagaccttgtacgatctg

SEQ ID NO: 6043 - DNA, 4596 bp, Artificial Sequence
  Description of Artificial Sequence: Synthetic coding sequence
atgggacactccaagcagattcgtatcctgctgctgaatgaaatggaaaagctggagaaaaccctgttccggctggaacagggatacgaactccaatttaggctgggaccgactcttcaaggcaaagcggtgactgtctacaccaactatccgtttccgggtgaaacgttcaatcgggaaaagtttcggagcctggactgggaaaacccaacggaacgcgaggacgactccgataagtattgtaagctcaacctgcagcagagcggctcgttccagtactactttctccagggtaacgagaagtccggaggaggatacatcgtggtggacccgatcctccgcgtgggtgccgataatcacgtcctgccactcgactgtgtgactctccaaaccttcctcgccaaatgcctgggaccgttcgatgagtgggagagccggctgcgcgtcgccaaggagtcggggtacaacatgattcatttcactcctctgcagaccttggggctcagccggtcctgctactccctcgcaaaccagctggaactgaacccggatttttcccgcccaaacagaaaatacacgtggaacgatgtcggtcagctcgtggagaaactgaagaaggaatggaatgtgatctgcatcaccgacgtggtctacaatcacaccgcggcaaattcaaagtggatccaagaacacccggagtgcgcgtacaacctcgtcaactcacctcacctcaagccagcttgggtgctcgatcgggcactgtggaggttctcgtgtgatgtggcagaagggaagtataaggagaaagggattcctgcactgatcgaaaatgaccatcacatgaattcaatcaggaaaatcatctgggaggacatttttccaaagctgaagctgtgggaattctttcaggtcgatgtgaacaaggctgtggagcaattcaggcgactgcttacccaggaaaatcggcgggtcaccaagtcggatccaaaccaacacctgaccatcatccaggacccggagtaccggcgatttggttgcaccgttgacatgaatatcgcgcttactacttttatcccccatgataaggggcctgcggcgatcgaagaatgctgcaactggtttcataagcgcatggaggaactgaactcggaaaaacatcggctcatcaactaccatcaggagcaggcggtcaactgtctgctgggaaatgtgttttatgagcggttggccggacatggtccgaaacttggaccggtgactaggaagcaccctctggtgacccgctactttaccttccccttcgaggaaattgatttttccatggaagagagcatgatccacctccctaataaggcgtgttttctgatggcccacaacgggtgggtgatgggagacgaccctctgcgcaatttcgcagaacctggtagcgaggtctacctccggcgggagctgatctgttggggggattcggtgaaactccgctacggcaacaagccggaggactgcccgtacttgtgggcacatatgaagaaatacaccgaaataaccgcgacttactttcagggggtgaggctggacaactgccactccactcctttgcatgtggccgagtacatgctggacgcggcacgcaacctgcagccgaatctctacgtggtggccgaacttttcaccggttccgaagatctggacaatgtgttcgtgaccagactgggcatcagctcactcatccgggaggctatgagcgcctataactcgcacgaggagggaaggctggtctatcggtacggcggagagccagtgggatccttcgtgcaaccgtgccttcggccgctgatgccagcaatcgcccacgcactctttatggacatcacccatgataacgaatgcccaatcgtccatcgcagcgcatatgacgcactgccgtctactaccattgtctccatggcgtgttgtgcatctgggtcgactcgggggtacgacgaactcgtcccccaccaaatctccgtcgtgagcgaagagcggttttacaccaaatggaacccagaagcgctcccgtcgaataccggtgaggtgaacttccaatcaggcatcatcgccgctcgctgtgccatcagcaagctgcatcaggaactgggagcaaaaggattcatccaggtgtacgtggaccaggtggatgaggacattgtggctgtgactcgccattccccgagtattcaccaatccgtagtggcagtgtcgcgcactgccttccggaacccgaaaacctcattttactcaaaggaggtcccgcaaatgtgcatccctggaaagatcgaggaggtggttctggaagcccgaactatcgagcggaacaccaagccgtaccgtaaggatgaaaattcgattaacggcactccggacatcaccgtggagattcgggagcatatccaactcaatgaatcaaagatcgttaagcaagccggagtggcaactaaaggaccgaatgagtacatccaagagattgaattcgaaaacctgtccccgggttccgtgatcatctttagggtgtcactggacccacacgcccaagtggcggtcggaatcctgcggaaccatctgactcagttctcgccgcacttcaagtcaggatcactcgccgtggacaacgccgaccccattctgaagatcccgttcgcgagcctcgcctcacggttgactctcgccgaacttaaccagatcctgtaccgctgcgaatcggaggagaaggaggatggcggaggatgctacgacatccctaactggagcgccctgaaatacgctggtctgcagggactcatgagcgttctggctgaaatccgccccaagaacgacctgggacacccattctgtaataacctgcgttcgggagactggatgatcgattacgtgtccaatcggctgatctcccgctctggcaccattgctgaggtgggcaaatggctgcaggctatgttcttttaccttaagcagatcccgcgctatctgattccgtgttacttcgatgcgatcctgatcggagcttacactaccctgctggacactgcgtggaagcagatgtcatcgttcgtccagaacgggtccacttttgtgaagcacctctccctgggttccgttcagctttgcggagtcggcaagttcccgagcctgcctatactttcaccagccctgatggacgtaccttatcgcctgaacgaaatcactaaggagaaggaacaatgctgcgtgtcactggctgccgggctgccacatttcagctcgggaatcttccggtgttggggccgagacacctttatcgctctgcggggcatccttctcattactggtcggtacgtggaagcccgcaacatcatcctcgccttcgccggaaccctcagacatggcctgatcccaaacctcctcggtgaagggatctacgcacgctacaactgtcgggatgctgtctggtggtggctgcaatgcatccaagattactgcaagatggtgccgaatggactggatatcttgaagtgcccggtgtcccggatgtacccaacggatgactcagctccgctgcctgctggaaccctcgatcagccgttgttcgaagtgatccaggaagccatgcaaaagcacatgcagggaatccaattcagagagaggaacgccggcccacaaatcgaccgcaatatgaaggacgagggcttcaacattaccgctggagtagatgaggaaactgggttcgtctatggaggcaaccggtttaactgtggaacttggatggacaaaatgggggagtccgatagagcacgcaaccggggaatccctgctaccccgcgcgacggatcggcagtggaaatcgtgggactctccaagtccgcagttcgctggctgctggagctgtccaagaagaacattttcccttaccatgaagtgacggtgaagagacatggaaaggccattaaagtctcgtacgatgaatggaaccgcaaaattcaggacaatttcgaaaagctcttccacgtgtcagaagatccatccgaccttaatgagaagcatccgaacctggtgcacaaaagaggaatctacaaggactcctacggagccagctccccctggtgcgattaccagctgaggccgaatttcacgatcgcgatggtggtcgcccctgaacttttcacgaccgagaaggcctggaaggccctggaaattgcagagaagaagctgctcggaccccttggaatgaaaactctcgaccctgatgatatggtttactgcggtatctacgacaacgccctggacaacgacaactacaacctcgccaagggcttcaactaccaccaaggaccggagtggctttggccgatcggttacttcctgagagctaagctgtacttttcccggttgatgggacccgagactactgccaagacgatcgttctggtgaaaaacgtgctgtcaagacactatgtccatctggaaagatcaccgtggaaagggctgcccgagctgactaatgagaatgcccagtactgcccattctcgtgcgaaacccaggcttggtccatcgcgacgatcctggagacgctctacgacctg

SEQ ID NO: 6044 - DNA, 4596 bp, Artificial Sequence
  Description of Artificial Sequence: Synthetic coding sequence
atgggccattccaaacagatacgtatcctgctactgaacgaaatggagaagcttgaaaagactctcttccgactggaacaaggctatgagctgcagttccgtctgggccctacgcttcagggcaaggcggtcacagtctatacgaactaccccttccccggagagacattcaatcgtgagaaatttcggagcctagattgggagaacccgacagaacgtgaagatgactctgacaaatactgcaagttgaatctgcagcagagtggctcatttcagtactatttcctgcaggggaatgaaaagagtggaggaggctacatcgtggttgacccaatcttacgcgtgggtgccgacaaccacgtactgcctctggactgcgtgactcttcagacatttttggccaaatgcctgggcccctttgatgagtgggaatccaggctgagagtggcaaaggaatctggttacaacatgatccattttacaccattgcagacactcgggttgagtcggtcttgttattcactcgcaaaccaactcgaactgaaccccgacttttcacgccctaacagaaaatacacctggaatgatgtgggacaactagttgagaagctgaagaaggagtggaatgtcatctgtataacagatgtggtgtataaccatacagccgctaacagcaagtggatccaggagcatcctgaatgtgcatacaacctcgtgaattcgccacatctgaagccagcctgggtccttgatcgcgccttgtggcggttctcttgtgatgttgccgaaggaaagtataaagaaaaaggaattcctgccctcatcgagaatgaccatcatatgaacagcattagaaaaataatttgggaagatatcttcccgaagctgaaattatgggaattcttccaggtggacgtcaacaaagccgtggaacaattcagacgattgttgacccaggaaaacaggcgcgtgacaaagtctgaccctaaccagcacctcaccattatccaggatcctgagtacaggcggttcggctgtaccgtagatatgaacattgcactgacaactttcatcccacacgacaagggccccgctgccattgaggagtgctgtaattggttccataagaggatggaagagctgaatagcgagaaacaccgtctcataaactaccaccaggagcaggcggtcaactgcctactcggcaacgtcttctatgagcggttggcggggcacggcccgaagctgggtcctgtgactcgaaaacacccgctggtgacaagatacttcaccttcccttttgaggagattgacttttcaatggaggaaagcatgattcacttgccaaataaagcctgcttccttatggcacataacggatgggtgatgggggatgacccgctacggaacttcgcggagcctggatcagaggtgtatctgcgaagggagctaatatgctggggtgacagtgtgaagctgaggtacggtaataagcccgaagactgtccctatctgtgggctcacatgaagaaatataccgagatcaccgccacttatttccaaggagtgcggctggataactgccactctacccctctacacgtcgcagagtacatgcttgacgcagctaggaacctccaaccaaatctgtacgtggtggccgagctgtttaccggatctgaagacctggataacgtgttcgttacacgcctgggcatttcaagtttgatccgggaagcgatgtcagcatataactcacatgaggagggacgccttgtgtaccggtacggcggtgagcctgttggaagctttgttcagccgtgtctcaggccattgatgcctgccatcgctcacgcactcttcatggatataacccacgacaacgaatgtcctatcgtgcaccgttcagcttacgatgcactgccaagtaccacaattgtctcgatggcttgttgcgccagcgggagtactagagggtacgacgaacttgtgccccatcagatttctgtggtgtctgaggaaaggttttacacaaagtggaatcccgaggccttgccaagtaacaccggcgaggtgaattttcaatctggcattattgccgcgcgttgtgcgatcagcaaattgcatcaagaactgggcgcgaagggtttcatccaggtttacgtcgaccaggttgatgaggatatcgtagctgttacccggcactctccctctatacaccagtcagtcgtggcggtatcaaggactgctttcagaaacccaaagacttctttctacagcaaagaagtgccccagatgtgtatccccggcaagattgaagaggtcgtgctcgaggccagaaccatagaaagaaataccaagccttatcgaaaggatgaaaattccatcaacggcacaccagacattacagtggaaattagagagcacatccagctgaacgagtccaagattgtgaagcaggcaggcgtcgctaccaaggggccgaacgagtacattcaagagatagagttcgagaacctttctcccggttctgttattatattccgtgtgtcgctagacccacacgcacaggtggccgtgggcatcctgcgtaaccacctgacacaattctccccccatttcaaaagtggctccctggcagtggataatgcagaccccatcctgaagattcctttcgcaagtctggcttctaggctcactctggcggagctaaatcagatactgtatcggtgtgaaagcgaggagaaagaggacggcggagggtgttacgacatcccgaattggtccgctttgaagtacgccggattgcaaggattgatgtccgtcttagccgagattcgacccaaaaacgacctgggccatcccttctgcaataatctgagatcgggagactggatgatcgattacgtctctaacaggttgatctcccggagcggtactattgcagaggtgggaaagtggctccaggccatgttcttttacctgaaacagattccccgctacctcatcccatgctacttcgatgctatattaatcggcgcctatacaaccctgttagatacagcctggaaacaaatgtcctccttcgtgcaaaacggatcgacattcgtcaaacacctgtctctggggtccgtgcaactgtgcggggtgggaaagttcccaagtctacccatactgtctcccgctttgatggacgtcccgtaccgcctcaacgaaattacgaaggagaaagagcagtgttgcgtgagcctggctgccgggctgcctcacttcagttccgggatctttcgctgctggggacgtgacacttttatcgcactgagggggatcctgttaatcaccggtaggtacgtagaagcccgcaatataattcttgctttcgcaggtaccctcaggcacggactgataccgaatttgctgggcgagggtatttatgcccggtataattgccgcgacgctgtgtggtggtggcttcaatgcatccaggattattgcaaaatggtgcccaacgggctggatatactcaagtgtccagtgagccgtatgtatcccacggatgactcagctccgttgcccgccgggaccctggatcagccgctcttcgaagtgatccaggaagctatgcaaaaacatatgcagggcatacagttcagagagcgcaatgccgggccgcagattgatcgaaacatgaaagacgaaggtttcaacattaccgctggagttgatgaagaaacaggcttcgtctatggcgggaaccggtttaactgtgggacttggatggataaaatgggcgaaagcgaccgcgcacgaaatagaggcatccccgccacaccacgcgatgggtcagccgtagaaatcgtcgggctgtcaaaaagcgctgtgagatggctgctggagcttagcaagaagaatatattcccataccacgaggtaaccgttaaaagacacggtaaggcaatcaaagtctcatatgacgagtggaatcgaaagatccaagacaatttcgaaaagctattccacgtgtccgaggatccttccgacctcaatgaaaaacacccgaacctcgtgcacaaaagggggatttataaagacagctacggagctagcagcccatggtgcgactatcagttaaggccaaacttcactattgctatggtagtggcaccagaactattcactacagagaaagcctggaaggcactggagattgccgagaagaagctactgggcccgctaggcatgaagacccttgatcccgatgatatggtgtattgtggcatctatgacaatgcattggacaacgacaactataacctggctaaaggattcaactatcatcagggccctgaatggctttggccaatcggctacttcctgagagccaaactctatttttcacgcttgatgggacctgaaacaaccgctaaaactatcgttctggtgaagaatgtgctgtctaggcattacgttcatcttgaaaggtcaccatggaaaggcctgcccgagctgactaatgaaaacgcccagtactgcccattctcctgcgagacacaggcgtggtcgatcgcgactattctggaaactctttacgatctg

SEQ ID NO: 6045 - DNA, 4596 bp, Artificial Sequence
  Description of Artificial Sequence: Synthetic coding sequence
atgggacacagtaagcagattagaatcctgctgctcaatgaaatggaaaagctagagaagactctctttcggctcgaacagggttatgaattgcagttccgactgggacccacactgcagggtaaagcagttactgtatatacaaactatcctttccccggagaaacctttaatagagaaaagttcagatcactcgactgggagaaccctacagaacgtgaggatgactccgacaaatactgtaagttaaacctccagcagtctggcagtttccagtactactttctgcaggggaatgagaagagcgggggtgggtacatcgttgttgatcccattctgagggtgggagccgataaccatgtgctgcctcttgactgcgtaactttacaaaccttcctggcaaagtgtctgggcccatttgacgaatgggaatccagattgagagtggcaaaggaaagcgggtacaacatgattcacttcactccgttgcagaccctcggtctttccaggagctgctattccctggcaaaccagctggaacttaatcctgactttagtagaccgaataggaagtatacatggaatgacgtgggacagctcgttgagaagcttaaaaaggagtggaacgtcatatgcattacggatgtggtgtacaaccataccgctgccaactccaaatggatccaggagcatccggagtgtgcctacaatctggtgaattctcctcatctgaagcctgcatgggtgctggaccgcgctctttggcgcttcagctgcgacgtggctgaggggaaatataaagagaagggcatcccagcactgatcgaaaatgaccatcatatgaattcaattcgcaaaatcatctgggaggacatctttcccaagctgaagttgtgggaatttttccaggtagatgttaataaagcagtggaacagttccgccggttgttgactcaggaaaataggcgcgtgacgaagtccgaccccaaccaacacctgacaataatacaagatcccgagtaccggcgtttcggttgcacggttgatatgaacatagcactcaccacttttattccgcacgacaaggggcctgcagcaattgaggagtgctgtaactggtttcataaacgcatggaagaactgaactctgagaagcaccgtctcatcaactaccatcaggagcaggccgtgaattgtctgcttggcaatgtgttctatgagcgactggcgggacacggcccgaaactgggccccgtcactcggaagcatccactggtcacaagatatttcacatttccgtttgaggagatcgacttcagtatggaggagagcatgattcatctccccaacaaggcctgtttccttatggcgcataacgggtgggtgatgggagacgacccactgcgtaacttcgctgagccggggtccgaagtttacctcagacgagagcttatttgctggggggactccgttaagttgaggtatggcaacaaaccagaagactgtccctacctgtgggctcacatgaaaaaatatactgaaattacagcaacatattttcagggtgtccggctggataattgccactcaacacccctccacgtagccgagtacatgctggatgcagccagaaaccttcaacctaacttatacgtggttgccgagctctttacgggaagtgaggacctggataacgtgttcgtcactcgacttggcatctctagcttgattcgcgaggctatgtccgcctacaacagccatgaggagggccggctcgtgtaccggtacggcggagagcccgttggctcatttgtccagccctgtctcaggccactgatgcctgcaatagcccacgccctgttcatggatatcacccatgacaacgagtgcccaattgttcaccggagtgcctatgatgccctgcctagtacaacaattgtttccatggcatgttgtgcctcaggtagcactagagggtacgacgagctggtgccacaccagattagcgtggtatcggaggagaggttctacactaagtggaaccccgaggctctgccatctaacacgggagaagttaactttcagtccggaatcatcgccgcaaggtgtgccatatctaagctgcaccaggagctgggcgcaaagggcttcatccaagtgtatgttgatcaggttgacgaggacatcgtagccgtaactcggcactccccctcaattcaccagagtgtggtggcggtttctcgaacagccttccggaaccctaaaacctccttctacagcaaggaggtcccgcagatgtgtataccaggcaagattgaagaagttgtgctcgaggcccggaccattgagcgaaatacaaagccctatcgaaaggatgaaaacagtataaacggcaccccggatatcaccgtggagatccgtgagcacatccagctgaacgaatcaaagatcgtgaaacaggccggcgtggctactaaggggccgaacgaatatattcaggagattgaattcgagaacctgagtccgggctctgtgatcatctttcgggtctccctcgacccccacgcccaagtggctgtcggtatcctacgcaatcatcttacacagttctccccacactttaagtcaggatccctggccgtcgacaatgccgatcccattttgaaaattcctttcgcgtccttggcctcacggctgacactggcggagctgaatcagatcctgtaccgctgtgagagcgaggaaaaagaagatggcggaggatgctacgatatccctaattggagtgcactcaagtacgccgggcttcagggactgatgagcgtgctggccgaaatacgcccgaaaaatgatctaggtcatcccttctgcaataatttgcggtcgggtgattggatgatcgattacgtcagcaaccggctgatttctcggagcggaacaatcgccgaagtagggaaatggctgcaggctatgtttttctacctcaagcagatcccccgttatctgatcccttgctactttgacgccattctgatcggggcctacacaacactgctcgacacagcttggaaacagatgagcagtttcgttcagaacgggtcgactttcgttaagcatctctctctgggatcggtgcagctatgtggcgttggaaaatttccatcactacccatcctgagcccagctcttatggatgttccttatcgactgaatgaaataacaaaggagaaggagcagtgctgcgtcagtctagccgccggccttcctcacttcagcagcggtatctttcgatgctgggggagggacacgtttatcgccttaagggggatcctactgatcaccggaaggtacgtggaggctagaaacatcatactggccttcgcaggcaccctacggcacgggctgattcctaacctgctcggcgagggtatctatgctcggtacaactgcagagacgccgtctggtggtggcttcagtgcattcaggattattgtaaaatggtgcccaacggcctggacattttgaaatgccctgtatcaaggatgtacccaaccgacgactccgcccccttgccggcaggaacattagatcagcctttgtttgaggtgatacaggaggccatgcagaaacacatgcagggaattcagtttcgggaaaggaacgccggccctcagatcgatagaaatatgaaggatgagggcttcaacatcaccgccggtgttgatgaggagacagggttcgtttatggggggaataggtttaattgcgggacctggatggataaaatgggcgagagcgaccgcgcaaggaatcgcggaatacctgcgacacctagggacggtagtgcggtcgagatcgtcggcctgtcaaaaagcgccgtcaggtggctgctggaactcagcaaaaagaatatatttccttaccatgaagtaacggtgaaacgccacgggaaggcaattaaggtgtcctacgatgagtggaacaggaagattcaggacaacttcgaaaaactgttccatgtatctgaggatccaagcgatctcaacgagaagcatcctaaccttgtccacaagaggggcatttacaaggatagctatggcgcctctagtccctggtgcgattaccagcttagacccaacttcacaatcgcaatggtggtggcaccggaacttttcaccaccgagaaggcgtggaaggccctcgagatcgccgagaaaaagctcttaggtcctctgggcatgaagactctggacccagatgacatggtgtactgcgggatttacgataacgcactggacaacgacaattacaacttagccaagggattcaactatcatcagggccccgaatggttgtggcccataggctatttcctcagggccaagctctacttcagcagactgatgggaccagaaacaaccgctaagactatcgtgctagtcaagaatgttctgagtcggcactatgtgcatctggagcgatctccgtggaaagggcttcctgagctgactaacgagaatgcacaatactgcccattttcatgtgaaacacaggcctggtcaatcgcaactattctggagaccctctatgatctg

SEQ ID NO: 6046 - DNA, 4596 bp, Artificial Sequence
  Description of Artificial Sequence: Synthetic coding sequence
atgggccattccaagcaaattcgcatcctcctgttgaatgagatggaaaaactggagaagaccctgtttcgcttggagcagggttatgaactgcagttcagattagggcccactttacagggaaaagcggtcactgtatacacgaactacccttttccaggggagacttttaaccgggagaaattcagatcccttgattgggagaaccccacagaaagagaggacgactcagataagtattgcaaactgaacttacaacagtcgggatcattccagtattacttcctgcaaggaaacgagaagtcggggggaggctacatagtcgtagatcccatccttcgtgtaggggctgataaccatgtgttgccgttggattgtgtgactcttcagacattcttagccaaatgtctaggcccctttgatgaatgggagagcagacttagagttgcgaaagagtctgggtacaacatgatacattttacacctcttcagaccctgggcttaagtagatcctgctactctctggcgaaccagcttgagctgaaccctgacttcagccggccaaataggaagtatacgtggaacgacgttggccagcttgtggaaaaactgaagaaagaatggaatgtgatatgtataaccgacgtggtgtacaaccacaccgcagcaaactccaagtggattcaggagcaccctgagtgcgcttacaatttagtcaactccccccacttgaaaccggcctgggtcttagacagagctctgtggagattcagttgcgatgtagccgagggcaagtataaggagaaaggcatccccgcccttatcgagaacgaccaccacatgaattctattcggaagatcatatgggaagacatattccccaaactcaagctgtgggagttcttccaggtcgacgtaaacaaggctgtcgaacagttcaggcggcttctaacccaggaaaatagaagagtgacgaaatctgacccaaatcagcatttaacgattatacaagaccccgagtatcggcgctttggctgcaccgtggacatgaatatagctttgactacattcatcccccatgacaagggccccgcagccatagaggaatgctgcaactggttccacaagcgaatggaagaattgaatagcgaaaagcatagactgatcaactaccatcaagagcaggccgtgaactgtctactaggcaatgttttctacgagcggctcgctggacatggccccaaactcggtcctgtcacacgtaagcaccccctggtaacgcgttacttcactttccccttcgaagaaatagacttcagcatggaagaatctatgattcatctgcccaacaaggcctgtttcttgatggctcataatgggtgggtgatgggagacgaccctttgcgtaacttcgccgagcctgggtccgaagtgtaccttcgtagggaactcatttgctggggtgattcagtaaagttgagatacggaaacaagcctgaagactgcccgtatctgtgggcccacatgaagaagtacacggagatcaccgcaacatatttccagggcgtccgtctcgacaattgtcattccacccctctgcacgtggcagaatacatgttagacgcagccaggaacctccagcctaacctgtacgtcgtcgctgagctctttactggtagtgaagatttggataatgtgtttgttactagattgggcatcagctccctgattcgagaggccatgagtgcctataactcacacgaggagggaagactggtgtatagatacggtggcgaacccgtgggttcattcgtgcagccatgcctcagaccacttatgccagcaatcgcccatgcgctgttcatggatatcactcacgacaatgaatgtccaattgtgcaccggtccgcgtacgacgcattaccctcgaccacaatcgtttctatggcctgttgtgcttccggtagtactaggggttatgatgagctagtgccccaccagatttccgtggtctctgaagaaagattctataccaagtggaaccccgaggcacttcctagtaataccggagaagttaatttccagagcggaattatcgcagcccgatgtgcgatctcaaaactgcatcaggagcttggagccaagggcttcatacaagtctatgtggaccaggttgatgaggatattgtcgctgtgaccaggcatagcccctccatccaccagtccgtggtcgcggtcagccggacagcattcaggaaccccaagacgtccttttacagcaaagaagtcccacaaatgtgcatccccggcaaaattgaagaagttgtattggaggcccggacaatcgagcgaaacacaaaaccgtacaggaaagacgagaactcaatcaatggcacacccgatataaccgtggaaatacgcgaacatattcagctgaacgagtctaaaattgtcaagcaggccggtgtcgcaaccaagggacctaacgagtacatccaggaaatagaattcgagaatctttctcctggctccgtcatcattttcagggtgagtctggaccctcacgcccaggtagccgtgggcatcttacggaaccaccttacgcagtttagcccccattttaagagtggatcgcttgccgtggataacgccgatcccattctaaaaattccattcgcatccctggcgtctagactcactttggcagaattgaaccagatcctctacaggtgcgaatctgaggaaaaggaagatggtggcggctgctacgacataccaaattggagcgcgctgaagtatgctgggctgcagggcctgatgtctgttctcgcagaaatacgcccaaaaaatgatctgggtcaccctttctgtaataatctgcggagcggtgattggatgatcgactacgtttctaatcgcctgatatctcgatcaggaacaatcgccgaggtcggtaagtggctccaagccatgtttttctacctgaagcagattccccgctacctcataccatgctatttcgatgccattctgatcggagcatacacaacactactggacaccgcatggaagcagatgtcatcattcgtgcagaacggcagcacgtttgttaagcatctgagcctggggagtgtgcagttatgcggagttggaaaatttcccagtcttccaattctcagtcccgccttgatggatgtgccttataggctgaatgaaataacaaaagaaaaggagcagtgttgtgtttccctggctgctggcttgccccatttcagcagtggaatcttccgttgttgggggagggacacctttatcgccctgcgcggtattttgctcattactggtcgctatgttgaggccagaaacataattctagccttcgcgggaactcttaggcacggtttgatcccaaacttgttgggcgagggaatttatgctaggtataattgtagggacgcagtgtggtggtggctccaatgcattcaagattactgtaagatggttccaaatggtttggacatcctaaagtgtcccgtttcgagaatgtaccctacagatgatagcgcccccctccccgctggcaccctggatcagcctttattcgaagtgatccaggaagctatgcagaagcacatgcagggcatccagttcagggagcggaacgcaggaccccagatcgacagaaacatgaaagatgagggtttcaatatcactgccggggtggacgaggagaccgggttcgtgtatggcgggaaccgcttcaactgcggcacctggatggataagatgggggagtcagatcgggcccgcaatcgaggcattccagccacaccgagagacgggagcgccgtagagattgtcggtttaagtaagtccgccgtacgctggctcttggagctttcgaagaaaaacatcttcccatatcacgaggtcactgtgaagagacatggtaaagctatcaaggtttcttatgacgagtggaatcggaaaattcaggacaatttcgaaaagctgttccatgtatccgaggacccctctgatcttaatgagaagcatcccaacctggttcacaagcgaggcatctacaaagacagctacggcgcgtcatctccttggtgcgactatcagcttcgtccaaacttcacaattgctatggtagtcgcacctgagctgttcaccactgagaaggcatggaaggcattagaaatcgcggaaaagaaattgctcggtcccttgggcatgaagacgctggatcctgacgatatggtatactgtggaatatacgataacgcgctggataacgacaactacaatctggctaagggattcaactatcaccaggggccagagtggctttggcctattgggtacttcttgagagcgaagttatatttttccagactcatgggtcccgagacaacagctaagacaatagttctggttaaaaacgtcctctctcggcactatgtgcaccttgagaggtctccatggaaaggtctccccgaactgacaaatgagaacgctcaatactgtccgtttagctgcgagacccaggcttggtcgatagcgactatcctcgagactctctatgacttg

SEQ ID NO: 6047 - DNA, 4596 bp, Artificial Sequence
  Description of Artificial Sequence: Synthetic coding sequence
atgggccactccaaacaaatccggattctgcttctgaacgagatggaaaagttggaaaagactctgttccggctcgaacagggatacgaactgcagtttcgactcggtcccacgttgcagggaaaagcagtgaccgtctacaccaattaccctttcccgggtgaaacgtttaaccgagaaaagtttcgatccttggactgggagaaccctactgagcgggaagatgattccgacaagtactgtaaactcaacctccagcaatccggttcgttccagtactacttcctccaaggcaacgaaaaatcgggagggggctacatagtcgtggatccaatccttcgcgtgggagcagacaaccatgtgcttccgcttgactgtgtcactctgcagacgttccttgctaagtgtctcgggcccttcgacgagtgggaatcgcgtcttagagtggcaaaggagtcaggctacaacatgattcactttaccccgctgcagaccctcggactttcgcgcagctgttactcgctggcaaatcaactggaactgaaccccgattttagcagacctaaccgcaagtatacctggaacgatgtggggcaactggtggaaaagttgaagaaagaatggaacgtgatctgtattaccgatgtggtgtacaatcatactgctgccaacagcaagtggattcaggagcatcctgagtgtgcatacaaccttgtgaatagcccacatctcaagcctgcgtgggtcctggaccgtgcactctggcggttctcctgtgatgtggccgaaggaaagtacaaggagaagggaataccagcactgattgagaatgatcaccatatgaattcgatccgaaagattatctgggaagatatctttccaaagctgaaactgtgggagttttttcaagtggatgtgaataaggcagtggaacagtttaggcgactgctcacccaggaaaatcggagggtgactaagtcagacccgaatcagcatctgaccataattcaggaccctgaatacaggcggtttggatgcaccgtggacatgaatatcgcattgaccactttcatcccccatgataagggtcctgcggctatagaagaatgttgcaactggttccacaagcgcatggaggaactcaattcggaaaaacatcgtctgatcaattaccatcaagagcaagccgtcaattgccttctggggaatgtcttttatgaaagactcgccggacacggaccaaaactcggaccggtgacgagaaagcatccactcgttactagatacttcaccttccccttcgaagaaatcgactttagcatggaagagagcatgattcacctgcctaacaaggcctgttttctgatggcacataacggctgggtgatgggagacgacccactgcggaactttgcagaaccaggctcggaagtgtacctccgacgtgaactgatctgttggggagatagcgtgaaactcagatatggaaataagccagaagattgtccgtatctgtgggcgcatatgaagaagtacactgagattaccgctacctactttcaaggtgtgcgacttgataactgccatagcacccccctgcatgtggcagaatacatgctcgatgcagcgagaaatcttcagccaaatctttacgtcgtggctgaactctttaccggttcggaggacctcgataatgtgttcgtcaccagactcggaatttcctctttgattcgggaggcgatgtccgcctacaactcgcatgaggaaggacggcttgtgtacagatacggtggtgaaccagtcggctcatttgtgcaaccctgcctccgacctctgatgcccgcgatagcgcatgcacttttcatggatatcacccacgataacgaatgtccaattgtccaccggtcagcatacgacgcactgccatctacgactattgtctcaatggcctgttgtgccagcggtagcactcgaggctacgatgagttggtgccacatcagatatcggtcgtctcagaagaaaggttctacactaagtggaaccctgaggccttgccatccaacaccggagaggtgaattttcaaagcggtattatcgcggccagatgcgccatttcaaaactgcaccaagaacttggggcaaaggggtttatccaagtctatgtggaccaagttgatgaagatattgtggcagtgactagacactccccttcaatccatcaatcggtggtggcagtctcgaggaccgcctttcgcaaccccaaaacttccttttactcaaaagaagtgcctcaaatgtgcattcctggcaaaatcgaagaagtcgtgctggaggcaagaactattgaacgcaacacgaagccttaccgcaaagacgaaaattccatcaatggtactcctgatattactgtggaaattagagagcatattcaacttaatgagtcgaaaatcgtgaaacaggcaggggtggccacgaagggacctaacgagtacattcaagaaatcgaatttgaaaacttgtcccctggatccgtgatcatctttcgcgtgtcattggacccacacgcccaagtggccgtgggtattctgcggaatcaccttacccagttttccccacatttcaaatcaggttcactggccgtggataatgcggaccctatacttaagattccatttgcctcccttgcatcccggcttacccttgcagaactcaaccagatattgtacagatgcgagtccgaggagaaggaggacgggggaggatgctacgatattcctaattggtcagcactgaagtacgcagggcttcaaggattgatgagcgtgttggcggagatcaggcctaaaaacgatcttggtcatccattctgtaacaatcttcggtcgggcgattggatgatagattacgtctcgaacagactgatttcgcggtccggtactatcgcagaggtgggaaagtggctgcaggcaatgtttttctacctgaagcagatccccagataccttattccgtgctactttgacgctattctcattggtgcatataccaccctgctggataccgcgtggaagcagatgagctcgtttgtgcaaaatggctccacctttgtgaaacatctgtcgctgggctcggtgcaactttgtggagtggggaagtttccaagccttccaatcctgagcccagcccttatggacgtgccgtacaggcttaacgaaatcaccaaggaaaaagagcagtgctgtgtcagccttgccgctggactcccgcacttttcgtcgggaatctttcgttgttggggtagagacacttttatcgcactgagagggatactgctcatcactggccggtatgtggaagcaagaaacataatcctggcatttgcggggaccctgcggcatggactcattcctaatcttctgggcgaggggatatacgcccggtacaactgtagggacgcagtgtggtggtggctgcagtgtatccaagactactgtaagatggtgcccaatggtttggatatacttaagtgtcctgtctcgcggatgtatcctactgatgactcggcaccccttcctgctgggactctggatcagcctctcttcgaggtgatacaggaggcaatgcagaagcatatgcaaggaattcagttccgtgaaagaaatgctggacctcaaattgatcgcaacatgaaggatgaaggatttaacatcaccgcgggggttgatgaggaaaccggatttgtgtacggaggtaaccggttcaactgtggtacctggatggataagatgggagaatcggaccgtgcgcgaaaccgaggaattccggctactcctagagatgggagcgccgtggaaattgtgggtctgtcaaagtcggcagtgcgttggctgctggagctcagcaaaaagaacatcttcccttatcacgaagtgaccgtgaagagacatggcaaggcgataaaggtgagctacgacgagtggaatcggaaaattcaggataactttgagaaactgttccatgtctcggaggacccttcggatttgaacgaaaaacacccaaacctcgtgcataagcgcggtatttacaaggactcgtacggagcttcctcgccctggtgcgactaccaactcagacccaatttcactattgcgatggtggtggcccctgagttgtttaccactgagaaggcatggaaagcacttgagattgcagaaaagaaacttctcggaccactgggtatgaaaactctcgaccctgacgacatggtctactgtgggatttacgataacgcactggataatgataactacaacctggccaagggtttcaattatcaccagggacccgaatggctttggcctattggatactttctgcgcgcgaaactgtacttttcaagacttatgggacctgagacgactgcaaagactattgtcctcgtgaaaaatgtcctgtcccgacattacgtccatctggagcgctccccgtggaagggcctgcccgagctcaccaacgagaacgcacagtactgtccattttcgtgtgaaacgcaagcatggtcaatcgcaactatccttgaaactctctacgatctg

SEQ ID NO: 6048 - DNA, 4596 bp, Artificial Sequence
  Description of Artificial Sequence: Synthetic coding sequence
atggggcactcgaagcagatccgcattctcctacttaacgagatggagaaacttgagaaaacattgttccgtctcgagcagggctacgagcttcagttcagattaggtcccaccctgcagggaaaggccgtgaccgtgtacactaactaccctttccccggagagaccttcaatcgtgagaagtttaggtcccttgactgggagaaccccacagaacgtgaagacgattcggacaagtactgtaagctgaacctgcagcaatccggctctttccaatactactttttacagggcaacgagaagtccgggggtggttatatcgtcgttgaccccattcttcgtgttggtgcggataaccatgtcttgccgctcgattgcgtcaccctgcagacatttttggctaagtgcctgggcccctttgatgagtgggagagccgcctgcgcgtcgccaaggagtccggttataacatgattcacttcactccgctgcaaacactaggtctgagccgcagttgctattccttggcgaatcagttggagctgaaccccgacttcagcaggcctaaccgtaagtatacttggaacgacgtgggtcagctggtggagaagttgaagaaggagtggaatgttatctgcataacggacgtcgtttacaaccatacggcagcaaattccaagtggatccaagagcatcccgagtgcgcatacaacctcgtcaactctcctcaccttaagcccgcgtgggtcctcgatcgggccctttggcgtttcagctgcgatgtcgctgaaggcaagtataaagagaagggcatccccgccctgatcgagaatgaccaccacatgaacagcattcgcaagatcatatgggaggatatcttccccaaactcaagctctgggagttcttccaagttgatgtcaataaggcggtcgaacagttcagacgcctcctaacgcaggaaaatcggcgcgtgaccaagtccgacccgaaccagcaccttactatcattcaggacccggaatatcgtcgattcggatgtactgtggacatgaacattgccctcacaaccttcatccctcatgacaagggccccgccgccatcgaggagtgctgtaactggttccataaacgtatggaagagttgaattctgagaagcaccgccttatcaattaccaccaggagcaggctgttaactgcctgctgggcaacgttttctacgagagactggccgggcacggccccaagttgggtcccgtcacccgcaagcacccactggttacccgttacttcacattccccttcgaggagatcgacttctcgatggaagaatcgatgattcacctgccgaacaaggcttgtttcctgatggcccacaatggctgggtcatgggtgatgatccgctgcgaaactttgctgagcccggttcggaggtctatctccgtcgtgagctgatttgctggggtgactcggtcaagctccggtacggtaacaagcccgaggactgcccgtacttgtgggctcacatgaagaagtacaccgagatcacggccacctatttccagggagtgcgcctggacaattgtcattccacccctctgcatgttgccgagtacatgctggatgcggcgcgcaacctgcagccgaacctctacgtggtggccgagttgtttaccggctctgaggacctggacaatgtcttcgtgacccgtctgggcatatcctccctgatccgcgaggctatgagtgcctacaactcccacgaggagggccgcctcgtctatcgttatggcggtgaacccgtaggttcctttgtacagccgtgtctgcgtcctttgatgcccgcgatcgcccacgctctttttatggatatcacgcacgacaacgaatgccccatcgtgcataggtcagcgtacgatgccctgccctccaccaccatcgtctcaatggcctgttgtgcctcaggctcaacacgcggctacgacgagctcgtcccccaccaaatttccgtggtttccgaggagcgcttctataccaagtggaacccggaggcgcttccgtccaatactggcgaggtcaacttccaatccggtatcattgcggctcggtgcgccatttccaagctccaccaggaactgggcgccaagggctttatccaggtctacgtggatcaggtcgacgaggacattgtggctgtcacacgccacagcccctcgatccaccagtccgttgtcgccgtgtcccgtacggcgtttcgcaatcccaagacttccttttactctaaggaggtgcctcaaatgtgcatccccggtaaaattgaggaggtggtcctggaagcccggacaatcgagcgtaacacgaagccttaccgcaaggacgagaactccattaatgggacgcctgacatcaccgtggagatccgtgagcacatccagcttaacgagtcgaagatcgtcaagcaagctggtgtcgccaccaagggtcccaacgagtacatccaagagattgagttcgagaacttgtccccgggatcggtgatcatctttagagtgtccctggaccctcatgcacaggtcgctgttggaatcctccgaaatcacctcacccagttctcgccgcatttcaagtctggatccttggctgtggacaatgctgatccgatcctgaagatcccgttcgcctccctcgctagtcggcttacgctggcagaactcaatcaaatcttgtaccgctgcgagagtgaggagaaggaggacggtggcggatgctacgatatccctaactggtcggccttgaagtacgcaggactgcagggcttgatgagcgtactcgctgagatccggcctaagaacgacctcggccaccccttctgtaacaacctgaggtcgggcgactggatgatcgattatgtatccaatcgtctgataagccgcagtggcacgattgctgaagtcggtaagtggctgcaggccatgttcttctacctcaagcagatcccgcgctacctcataccgtgttatttcgatgccatcctcattggagcctacaccactctccttgacaccgcttggaagcagatgagctctttcgtgcaaaacggcagcacgttcgtcaagcatctatctctgggatctgtccaactttgtggagtgggaaagtttccgtctctccccatcctctcgcccgccttgatggatgttccctaccgcctgaacgaaatcacgaaggaaaaggaacagtgttgtgtctctcttgcggccggcctcccccatttcagcagcggcattttccgatgctggggtcgtgacacgttcattgcgttgcgcggcatcctgctcatcaccggccgctacgtggaggctcgcaacatcattctcgcgttcgctggtacactgcgtcacggcttgattcccaaccttcttggcgagggaatatatgcacgctacaattgtcgcgacgccgtctggtggtggctgcagtgcatccaggactactgcaagatggtgccaaacggccttgatatcctgaaatgccccgtctccagaatgtatcctactgacgacagtgccccgttgccagccgggaccctcgatcagcctttgttcgaggtcattcaagaggccatgcagaagcacatgcagggtattcagttccgcgagcgcaatgcgggcccccagatcgataggaatatgaaagatgagggctttaacattaccgctggcgtggacgaggagaccggcttcgtctacggagggaatcgttttaattgtggtacctggatggacaagatgggcgagagtgacagggcccggaatcgcggcatcccagctacacctcgggacggctcggccgttgagattgtggggttgagcaagagtgccgttcgctggttgctggagctcagcaaaaagaacattttcccctaccacgaggtgacggtcaagaggcacggtaaggccatcaaggtttcctatgacgagtggaatcggaaaatccaggataacttcgaaaagctgttccacgtttccgaggatcccagcgacctcaacgaaaagcatccaaatctcgttcacaaacgtggcatttataaggactcctatggagcgagtagcccctggtgtgattatcagttgcgccctaactttaccatcgctatggtcgttgcccccgagttgttcaccaccgaaaaggcctggaaggccctggagattgcagaaaagaagttattggggcctctcggaatgaagacgttggaccctgacgacatggtctactgcggcatctacgacaacgccctcgacaacgacaactataacctggcgaagggttttaactaccatcaaggtcccgagtggctgtggcccatcggatattttctccgggcgaagctgtatttcagtaggttgatgggcccggagacaaccgccaagaccatcgtcctggtgaaaaacgttttgtccaggcactatgttcacctcgagcggtctccctggaagggcctacccgaactgacgaacgagaacgcccaatattgtcccttcagctgcgagacgcaagcatggtctattgctaccatcctggagacattgtacgacctg

SEQ ID NO: 6049 - DNA, 4596 bp, Artificial Sequence
  Description of Artificial Sequence: Synthetic coding sequence
atgggacactcgaagcagattcgaattctcctgttgaatgaaatggagaagctcgagaaaaccctcttcagactcgaacaaggctacgagctgcagttccggctcggcccgaccctccagggtaaggcggtcactgtgtacactaactacccgttcccgggtgaaacctttaatcgagaaaagtttcggtcgttggactgggaaaatccaacggagagagaggacgactcggacaaatactgcaagctgaacctgcagcagtcaggatcgttccagtactacttcctccagggaaatgaaaaaagcgggggaggatacatcgtagtggatccaatcctgcgggtgggggccgacaatcacgtccttccgctggactgcgtgaccctccaaacgtttctcgccaagtgcctgggccccttcgatgagtgggaatcacggctgcgagtggccaaagagtctggatacaatatgatccattttacccccctgcaaactctgggactctcgcggtcgtgctactcacttgcgaaccaactggaattgaacccggatttctcgcgcccaaatcgcaagtacacctggaatgacgtcggccagctcgtggagaaactgaagaaagaatggaacgtgatctgcatcaccgacgtcgtctacaaccacacggccgccaactcaaaatggatccaagagcacccggaatgtgcatacaacttggtgaacagcccgcacttgaaacctgcctgggtcctggatcgggctctctggcgcttctcatgcgacgtcgcggagggtaagtataaggagaagggcatcccggctctcatcgagaacgaccaccatatgaattcgatccggaagataatctgggaggatatcttcccaaagctgaagctgtgggagtttttccaagtggacgtgaataaggcggtcgaacagttcagacgcctgcttacccaggaaaatcgccgcgtgaccaagtcagacccgaatcagcacctgacgatcatccaagaccctgaataccggcgcttcgggtgcacggttgacatgaatatcgcgctcactactttcatcccgcacgataagggacccgccgctatcgaagaatgctgtaactggttccacaagagaatggaggagctgaatagcgagaaacaccgcctcatcaattaccatcaagagcaagcggtgaattgcttgctcggtaacgtgttttacgagagactggccgggcacggcccaaagctgggaccggtgactcgcaaacaccctctggtgacccgctacttcactttcccgttcgaagagattgacttctccatggaagaatcaatgatccacctgccgaacaaggcgtgcttcctgatggctcataacggctgggtcatgggagacgacccgttgagaaacttcgctgagcctgggagcgaagtgtaccttcgccgagagctcatatgttggggcgacagcgtcaaattgcgttacggaaataagccagaagattgtccctacctgtgggcacacatgaagaagtacaccgagattactgccacctacttccagggagtgcggctggacaattgccattccaccccgctgcacgtggccgaatacatgctcgacgcggcccggaacctccagcctaacctttacgtggtggcggagctgttcactgggagtgaagatctggacaacgtctttgtgaccaggttgggaatctcaagcctgattcgcgaagccatgtcagcgtacaactcacacgaagaaggacgcctggtgtaccgctacggcggagaaccagtgggatcattcgtgcagccgtgtctcagaccccttatgcccgccatcgcccacgcgctctttatggacatcacgcatgacaacgaatgcccgatcgtgcatagaagcgcctacgacgcgttgccgtccactactatcgttagcatggcatgttgcgcgtcgggcagcacccggggttacgatgaattggtcccacaccagatctcggtcgtctcggaggaacggttctacactaagtggaacccggaggccctcccgtctaacaccggagaggtgaatttccaatcaggcatcattgccgcccgctgcgccatttccaagctccaccaggagttgggcgccaaggggtttatccaggtgtatgtggatcaggtagatgaagatatagtggcggtgaccagacattccccatccatccatcagtcggtggtggctgtatcgaggaccgctttcagaaaccctaagacttcgttctactcgaaagaagtgcctcaaatgtgtatccctggcaaaatcgaggaagtcgtgttggaagcgcgcaccatcgagcggaatactaagccctataggaaggatgagaattcgatcaacgggaccccagatatcaccgtggaaatcagagaacacattcaactcaacgagtccaaaatcgtgaaacaggccggagtggctaccaaaggcccgaacgagtacatccaagagatcgaattcgagaacctgtcgccgggtagcgtgatcatcttccgcgtgtccttggacccacatgcgcaggtggctgttgggatcctgagaaatcacctgacccagttttccccgcatttcaaatccggaagcctcgccgtggataacgcagacccgatcctgaagatcccattcgcctcactcgcctcgcggctgaccctggctgagttgaaccaaatcctgtaccggtgtgagtcagaagaaaaggaggatggcggtggatgctacgacattccaaactggtcagcattgaagtacgcgggactgcagggattgatgtccgtgctcgcggagatccggccgaaaaacgacctcggacacccgttctgcaacaatctcagatctggcgactggatgatcgactacgtatccaaccggcttattagcaggtctggtaccatcgcagaggtcgggaagtggctccaagccatgttcttttacctgaagcagatcccccgctacttgatcccgtgctacttcgacgctatcctgatcggtgcctacacgaccctgcttgacactgcctggaagcaaatgtccagcttcgtgcagaatggttccaccttcgtgaagcacctttcactcggatccgttcagttgtgcggcgtgggaaagttcccgtcgctgccgattctttcacccgctctgatggacgtcccgtatagactcaacgaaattaccaaggaaaaagaacagtgctgcgtgtcgctggcagccggactgcctcatttctcctccgggatcttccggtgttggggtcgcgatacctttatagccctgagagggatcctcttgatcactgggaggtatgtggaagctcggaacattattctcgcgtttgccggtacccttagacatggactgattcctaacctcctgggagaaggcatctacgcccggtacaattgcagggacgcagtgtggtggtggctccagtgcatccaggattactgcaagatggttccaaacggactcgacatcctcaagtgccctgtcagccggatgtacccgactgatgactcggctccactcccggcaggcacgctggatcagccgctgttcgaggtcattcaagaggccatgcagaaacatatgcagggaatccaattcagggaaagaaacgccggcccgcagattgatcgcaatatgaaggatgagggattcaatatcactgccggagtggatgaggaaactggattcgtctatggcggaaatcgttttaactgcggaacctggatggacaagatgggagaatctgatagagccagaaacagaggaatcccggccaccccgagggacggatcggcagtggaaatcgttggcctgagcaagagcgccgtgcgatggcttcttgaacttagcaagaagaacatctttccctaccatgaggtgaccgtgaaaagacacggcaaagcaatcaaggtgtcctacgatgaatggaatcggaagatccaagacaactttgagaagctctttcatgtgtccgaggatccgtcggacctgaatgaaaaacatcctaatcttgtccataaacgcggcatctacaaggatagttacggcgcctcgtcgccgtggtgcgactatcagctcaggccaaacttcaccatagccatggtggtggcaccggagttgtttaccaccgagaaggcgtggaaggcactcgaaatcgcagagaagaaactgctcggaccgctgggtatgaaaacgctggacccggatgacatggtgtactgtggaatttacgataacgcgctggataacgacaattacaacctcgctaaaggtttcaattaccaccaagggcctgagtggctttggccgatcggctacttcctgcgcgcaaagctgtacttctcacggctgatgggaccagagactaccgccaagactatcgtcctggtgaagaacgtcctgtccagacactacgtgcacctcgaaagatcgccgtggaagggactgcctgaattgactaacgagaatgcccaatactgcccattctcatgtgaaactcaggcgtggtcgatcgccactatcctggaaaccctctacgatctg

SEQ ID NO: 6050 - DNA, 4596 bp, Artificial Sequence
  Description of Artificial Sequence: Synthetic coding sequence
atggggcactctaaacagatccggattctgcttctgaacgagatggagaaacttgagaagacgctgttccgcttggagcagggatatgagctccagtttagactggggcccaccctccagggtaaggctgttacagtgtataccaactacccttttcctggcgagacatttaacagggagaaatttcgctcgctagactgggagaacccaaccgaacgggaagacgacagcgataagtattgcaagctgaacctccagcagagcgggtcttttcaatactacttcctccaggggaacgaaaagtctggcgggggatatatcgtggtggatcccatcctgcgggtgggagctgataatcatgtgctccctttggactgtgtgaccctgcaaacatttttagcaaagtgccttggaccttttgacgagtgggaaagcaggctgagagtggcgaaggagtctggctacaacatgatacattttacgcctctccagactctcggcttaagccgctcttgctactctctcgctaatcaactggaactgaacccggacttcagtcggcccaaccgcaagtacacttggaacgatgttgggcaactcgtggagaagttaaagaaagaatggaacgtaatctgcattacagatgtggtctacaaccacacagcagctaacagcaaatggatccaggagcaccccgagtgtgcatataacctggtgaattcccctcacctgaagccggcttgggtgctcgacagagctctatggaggttcagctgcgacgtggcggagggcaagtacaaggagaaaggaattcccgcactaatcgaaaacgaccaccacatgaacagcatcagaaagataatttgggaggacattttcccaaagctgaagctttgggagttcttccaagtggacgtgaacaaggccgtcgaacagtttcgaaggctacttacacaggaaaacagaagggtaaccaagagcgatcccaatcagcatttaacaatcattcaggatccagagtaccgcaggtttggatgtaccgtcgatatgaacatcgccctgacaacatttatacctcacgacaaaggtcctgccgcgattgaggaatgttgcaattggtttcacaaaaggatggaagagttgaattctgaaaaacaccggttaatcaactatcaccaagaacaggctgttaattgcttgctggggaacgtgttctacgaaaggctggctggacacggacctaagctcgggccagtgactcgcaagcatcccctggtgacccgatattttacctttccttttgaggagattgacttttctatggaggaaagcatgatccaccttccgaacaaagcttgtttcctgatggcacataatggttgggtcatgggcgatgacccccttcgcaatttcgctgaacctggaagcgaagtgtatctgaggagagaattgatttgctggggcgattctgtgaagttgcgctacggaaacaaacccgaggattgcccatacctgtgggcacatatgaagaagtatacagagatcaccgcaacatacttccagggggtcaggctggacaattgccatagcactcccctgcatgtcgccgaatacatgctggacgccgcaagaaatctgcagcctaatctgtacgtggtagcagaactgttcactggaagtgaggacttagacaacgtatttgtaaccaggctcggcattagttcccttatccgggaagctatgagtgcttataattctcacgaggaggggcgccttgtttaccggtatggcggtgaaccagtgggcagctttgtccaaccttgtttaaggccactcatgccggcaatcgcacatgccctgttcatggatatcacccatgataatgagtgccccatagtgcaccgcagtgcatacgacgctctcccttccaccactatcgtgagcatggcctgctgcgcctcaggaagtacaaggggatacgatgaactggtgccccaccagatctctgtggtgtcagaagaaagattttatacaaagtggaatccagaagcgctgcctagcaacacaggggaagtcaactttcagtctggcatcatagccgcacggtgcgcgatctcaaagctgcaccaagagttgggcgctaaaggatttatccaggtgtatgtggatcaggtcgatgaagacatcgtcgcagtgacccggcattctccttcaatacaccaatcagtggtagcagtgtcacgcacagcgttccgaaaccccaagactagcttttactctaaggaggttccccagatgtgcataccaggaaagatagaggaggtggtactggaagccagaacaattgagaggaacactaagccttaccggaaagatgaaaatagcattaacgggacaccagacatcaccgtggagatcagggagcacattcagctcaacgaatccaaaatcgttaagcaggctggagtggctaccaaggggcctaacgagtacatccaggaaattgagttcgaaaatctcagtcccgggtctgttattatcttccgagtatccctggacccccatgctcaggtcgctgtgggaatactgcggaatcatttgacccagttttcaccgcacttcaaatcaggctccctggcagtcgacaatgctgaccctatcctgaaaattccttttgcaagcctggctagccggctgaccttggctgagctgaaccagatactgtataggtgcgagtcagaggaaaaggaagatggtggcggatgctacgacatcccaaactggtcagcactgaagtatgcggggctgcagggtttgatgtcagtcctggcagagattcgccccaagaacgaccttggacaccctttctgtaacaatctccgttctggggattggatgattgattacgtatctaacaggttgatttcccgctcaggcaccattgcagaagtcggcaaatggctgcaggccatgtttttctatctgaagcaaatcccacgatacctcatcccatgctatttcgacgcaatcttaatcggcgcctacacgacactgctggatactgcctggaagcagatgagctctttcgttcagaacggctctacatttgtgaagcacttgagccttggcagcgtgcagttgtgcggtgtggggaaattcccctctctcccgatactttctccagcactgatggatgtcccttataggttgaacgagatcactaaagagaaagaacagtgttgcgttagtctggctgccggcttaccccacttcagctccggcatcttcaggtgttggggccgggatacatttatagccctcaggggtatattgctaatcacgggcagatatgtggaagcccgcaacattatactggcttttgcaggcactttgcgacacgggcttatccctaacctgctgggcgaaggaatctacgctcggtataactgcagggatgcagtctggtggtggcttcaatgtatccaggattattgtaagatggtgcccaatggcctggatatcctgaagtgccctgtgagcaggatgtaccccactgacgacagcgcgccgctgccagctgggacactggaccaaccactgttcgaagtgatccaagaggcaatgcaaaagcatatgcaaggaatccaattcagggagagaaacgcagggcctcagatagacaggaatatgaaagatgagggattcaacataacagcaggggtggatgaagaaaccggcttcgtttatggcggcaatcggttcaactgcggaacatggatggataagatgggcgagtctgacagagctcgaaacagaggaatccctgccaccccacgcgacggtagcgccgttgaaatcgttgggctctccaaaagcgctgtgaggtggctgctggagctgagcaagaaaaatatctttccttaccatgaagtcactgtgaagcgacatggcaaggcaatcaaggtctcctatgatgagtggaatcggaaaatccaagataactttgaaaagctgtttcatgtttctgaagatcctagcgatctgaacgaaaagcaccctaatctggtgcataagcgtggcatctacaaggattcttatggagcgagcagcccctggtgcgattaccagcttagaccgaatttcaccatagccatggtcgtcgcccccgaactgttcactaccgagaaagcatggaaggcgcttgaaattgccgagaagaaactcctcggacctctgggcatgaaaacccttgatccagatgatatggtctactgtggcatctatgataacgctttggataatgataactacaacctggctaagggctttaactatcaccagggtcccgaatggctgtggccaattggctacttcctgagagccaagttgtattttagtagactgatgggaccagaaacaaccgctaagaccatagttctggtgaagaatgttctcagtcgccactatgtgcatctggaacgcagcccttggaagggcttgccagagctcacaaacgagaacgcgcagtattgcccttttagttgcgaaacacaagcatggagtatcgctaccatcctggaaacgctttacgacctc

SEQ ID NO: 6051 - DNA, 4596 bp, Artificial Sequence
  Description of Artificial Sequence: Synthetic coding sequence
atgggacactcaaagcagattaggattctgctcctgaacgagatggaaaagctggagaagacccttttcagactggaacaggggtatgagctccaattcaggctggggcctacactgcagggcaaggccgtgaccgtgtacactaactacccattcccaggcgagactttcaatagagaaaagtttcgaagcttggactgggaaaatcccaccgagcgggaggatgattctgataagtattgcaaattgaacctccaacagtccgggtccttccagtattacttcctgcaggggaatgaaaagtccgggggcggatatatcgtagtcgatccgatcctcagagtgggcgctgataaccacgttctccctctcgattgtgttactcttcaaacctttctggctaagtgcctgggaccctttgatgagtgggagtccaggttgagagtggccaaagagtccggatataacatgatccactttacaccactgcagacactggggctgagtcgatcctgctactcactggccaaccaactggaactgaacccagacttcagcaggcccaaccgcaagtacacctggaacgatgttggtcaactggtggaaaagctcaaaaaggagtggaacgttatctgcattactgatgtcgtgtacaaccacacggctgccaactccaaatggatccaggaacacccagaatgtgcgtacaacctggtgaacagcccacaccttaagccagcctgggtgctcgaccgggctctctggcggttttcctgcgacgtcgccgaggggaaatataaggaaaagggcattcccgctttgatcgaaaacgatcaccacatgaatagcattcggaaaattatttgggaggacatcttccctaaactcaagctctgggaattctttcaggtcgatgttaataaggctgtggagcagttccgcagactgctcacacaggaaaataggagagtgactaaatcagatcctaatcagcacctgacaattattcaggatcccgagtaccggcggttcggatgtaccgtggacatgaacatcgcccttactaccttcattccccacgacaaggggcccgccgctatagaggaatgttgcaactggttccataagcgcatggaagagctgaacagtgagaaacaccgccttatcaattatcaccaggaacaagccgtcaactgcctcttggggaacgtgttttatgagcgcctggccggtcacggacctaagctcgggccagtgacccgaaaacatcctctggtgacgagatacttcacgttccccttcgaggagatcgatttctccatggaagagagtatgatccatcttcccaacaaggcttgcttcctgatggctcacaacggctgggtgatgggcgacgatcccttgaggaactttgccgagcccggctctgaggtgtatcttaggcgggaactgatttgctggggtgactcagtaaagcttcgatacggcaataaacccgaagattgcccctacctttgggctcacatgaaaaagtacaccgagatcacagctacgtattttcaaggggtgagactggacaactgccattctactccgttgcacgtggctgaatatatgcttgacgccgcacgcaacctccaacccaacctttatgtggtggctgagctctttactggatctgaggatttggacaacgtgttcgtaacccggttgggaatcagcagtctgatccgagaggccatgagtgcctacaactcccacgaagagggtcggctcgtataccgatatggcggagaacctgtggggagctttgtccagccctgtctgcgcccattgatgcccgccatcgctcacgctctctttatggatatcacccatgataacgagtgccccattgtgcacaggtccgcttatgatgctcttccttcaaccaccatcgtttccatggcctgctgtgcatccggcagcacacggggctacgatgagttggttcctcatcagatatcagttgtatccgaggagagattttacacaaaatggaaccctgaggccctgccctccaatactggcgaagtcaattttcagtccgggattatcgctgccaggtgcgccatcagtaagctccaccaagagctcggcgctaagggattcattcaggtctatgtggatcaggtagacgaggacatcgtggcggtaaccaggcactctccgagcatccatcagagcgtagtcgctgtcagtaggactgctttcagaaatcccaagacctccttctacagcaaagaggtccctcagatgtgtatccccggcaagatagaggaagtggtgctcgaagccaggacaatcgagcggaatacgaaaccatatcggaaagatgaaaattccatcaatgggacccccgatataactgtggagattagggagcacatccagctgaacgagagtaagatcgtgaagcaggcaggggttgcaacaaagggtcctaacgagtacatccaggagatcgagttcgagaacctgagtcctggatccgtaattatatttagggtgtctttggacccccatgcccaggtggccgtggggatactgagaaatcatctgacccaattctccccacatttcaaaagtggttctctcgccgttgacaacgccgatccaatcctgaaaatcccattcgcaagcctcgcctctagactgaccctggccgagctgaatcagattctctatcgctgcgagagtgaagagaaggaagatgggggagggtgttatgacataccaaattggtccgcccttaaatacgccggcctgcaggggctcatgagtgttctcgctgagataaggcctaagaacgatttgggacatccattttgcaacaacctgcgatctggcgattggatgatcgattacgtttccaaccggctcattagtcggtccgggaccattgccgaagttggcaagtggctccaggcgatgtttttttatctcaaacaaatcccgcgatatctcattccatgctacttcgacgccatcctcattggagcctatactacactgttggatactgcttggaagcagatgtcatccttcgtacagaatggatccacattcgtcaagcatctctctctggggtctgtccagctttgtggggttggtaaatttccaagtcttcctattctgtccccggcccttatggatgtgccctacagactgaacgagattacaaaagaaaaggaacagtgctgcgtctcacttgcggccggcctgccccatttttccagcggtatcttccgatgttgggggagggacacctttatcgccttgcggggtatcttgctgattacaggcaggtacgtggaggcccgaaacatcatcctggcctttgccggcacgcttaggcacggactgattcctaatttgctgggcgaggggatctacgcgaggtacaactgccgagatgctgtttggtggtggcttcagtgtatccaggactactgcaaaatggttccgaacgggctggacatcttgaaatgtcctgtatcaagaatgtatcccactgacgattctgctcccctgcccgcaggaacgttggatcagccactcttcgaggtaatccaagaagccatgcagaaacacatgcaagggatccagtttagggagcgaaacgctgggccgcagatcgaccgaaacatgaaggatgagggcttcaacattacagccggcgtcgacgaagagacaggcttcgtgtacggcggcaatagattcaattgcggaacctggatggacaaaatgggtgaaagcgatagggcacgcaaccgcggaattccagcgacccccagggacggctccgccgtggaaatcgtgggcctgagcaaatccgcagtgcggtggttgttggaactgtctaagaaaaacattttcccctaccatgaagtcacggtgaaacggcatggaaaagccatcaaggttagttacgacgagtggaaccggaagattcaggacaactttgagaagctgtttcacgtctccgaggaccccagtgacttgaatgaaaaacaccctaatcttgtgcataagcgggggatatacaaggactcttacggcgctagcagtccctggtgcgactatcaattgcgccccaatttcactattgcaatggtggttgctccagagttgttcacaacagagaaagcatggaaagcccttgaaattgccgagaagaaactcttgggacctctcggcatgaagaccctggaccctgacgacatggtatactgcgggatctatgataacgccttggacaacgataactacaaccttgctaagggattcaactaccaccagggcccagaatggctgtggcccatcggatatttcctccgggctaagctgtacttctctaggttgatgggtcctgaaactacggcgaaaacaatcgtgctcgtcaaaaacgtgctctccagacactacgttcatttggagcggagcccctggaaaggtctcccagagctgacaaacgaaaacgcccagtattgtcctttttcctgcgagacgcaggcttggtccatcgccacaatcctggagaccctgtacgacttg

SEQ ID NO: 6052 - DNA, 4596 bp, Artificial Sequence
  Description of Artificial Sequence: Synthetic coding sequence
atgggccattcgaagcagatccgaattctgcttttgaacgagatggaaaagttggaaaaaactttgtttcgactggagcaggggtatgagctacagttccgactgggcccgacgttgcaaggcaaggctgtgacggtttacacaaattacccctttcccggcgagacgtttaaccgcgaaaagttccgctcgctggactgggagaaccctacggagcgcgaggacgatagcgacaagtattgcaaattgaacctccaacagagtggctcgtttcagtactacttcttacagggaaatgagaagtctggcggaggatacatcgtcgttgaccccatcttgcgcgtcggtgccgacaaccatgtcctccccctggactgcgtgaccttacagaccttccttgcgaagtgcttgggtccgttcgatgagtgggaatcgcgcctgcgtgttgctaaggagagtggctacaatatgatccactttaccccactgcaaactttgggcctcagccgctcatgttattccctggcaaaccagctcgagcttaaccccgattttagccgccccaatagaaagtacacctggaacgatgtgggtcagctggtggaaaagttgaagaaggagtggaacgttatttgcatcaccgatgtggtgtacaatcacacggcggccaactctaagtggattcaggagcaccctgaatgtgcctataacttggtcaattccccccacctcaagcccgcatgggtgctggaccgtgccctttggcgattctcttgcgatgtggcagagggcaagtataaagagaagggaatcccagcccttattgagaatgatcatcacatgaattccataaggaagattatttgggaggacatttttcccaaattaaagctgtgggagttcttccaggtggacgtgaataaagctgttgagcagttcagacggctcctgacccaggaaaatcgccgtgtgaccaagagtgaccccaatcagcacctgacaatcattcaggaccccgaatacaggcgttttggctgtaccgtggatatgaacattgccctcacaacgtttattccacacgacaaaggccccgcggccatcgaagagtgctgcaattggttccataagaggatggaggagctcaattccgaaaagcatcggctgatcaactaccaccaggagcaggccgtgaactgcctactcggaaatgtgttttacgagcgcttggccggccacggtcccaagctggggccggtcactaggaagcacccgctcgtaacccgctatttcacgtttccgttcgaggaaatcgacttctcgatggaggagagcatgattcatctgcctaataaggcttgctttctgatggcgcacaacggctgggtgatgggggatgacccattgcgcaactttgccgagccgggctcagaggtttatctgcgccgcgagctgatctgctggggtgatagcgtgaagttacgttacggcaacaagcctgaggattgtccctacctatgggcgcatatgaagaagtacacagaaattaccgccacatactttcagggcgtgaggttagacaactgccactcgaccccactgcatgtggccgaatatatgttagacgctgccagaaacctgcaacctaacctgtacgtcgtggcggaactgttcaccggatctgaagatctagataatgtcttcgtgactcggctgggaatctcgtcgctgatccgcgaggcgatgtccgcctacaactcccacgaggaaggccgcttagtttaccgatatggaggcgaacccgtgggatcatttgtccagccatgcctgcggccgttgatgcccgccatcgcgcacgcattgtttatggatataactcacgacaatgagtgtccgatagtgcatagaagtgcctatgacgcccttccgagtactactatcgtctctatggcatgctgtgcgtccggatccacccgcggatacgatgagctcgtgccacaccagatcagtgttgtgagcgaagagcggttctacacgaaatggaatcccgaggcgttgccgtcgaatacgggcgaagtcaatttccagtccggcataattgcagcccgctgcgcaatcagcaagctacaccaagagttgggagccaaaggatttatccaagtgtatgtggatcaggtggatgaagacattgtagctgttaccaggcattctccctctatccaccagtctgttgtggcggtgtcccgcacggcgttcagaaacccaaagacgtctttctattccaaggaggtgccgcagatgtgcattcccggcaagatcgaggaagtggtgttggaggcccggacaatcgagcggaatactaaaccgtaccggaaggatgaaaattcgatcaacggtacccccgacataacggttgagatccgcgagcatatacagttgaatgagagtaaaattgtgaaacaagccggcgtggctaccaaggggcccaatgagtacatccaggagatagagttcgagaacctatcccccggctcggtgataattttcagggtgagtctggatccccacgcccaggttgctgtgggcatcctaaggaaccaccttacgcagttctctccgcacttcaagagtggttcgctggcagttgataatgccgatccaatcctaaagattcccttcgctagccttgcgtctcgcctgaccttagccgagctgaatcagatcttgtatagatgcgaaagcgaagagaaagaggatggcgggggctgttacgacatccccaattggagcgcactgaagtatgccggacttcagggcctcatgtccgtactggcagagatccgtcccaagaatgacctgggtcacccattctgcaataacttgcgctcaggcgattggatgattgactatgtgtccaaccgcttgatctcacgatcgggtacaattgctgaggttggtaaatggctgcaggcaatgttcttttatctgaagcaaatcccaaggtacctgattccctgctattttgacgcaattttgataggtgcctataccacgctcctcgacacagcctggaagcagatgtcctcatttgtgcagaacggctcaacattcgtgaagcacctctccctgggcagcgttcagctgtgcggagtggggaagtttccctccctgccaatcctgtctcccgccctgatggacgttccctaccgtcttaacgagattactaaggaaaaggagcagtgctgtgtgtcactcgcggctggtctgccgcatttctcgagtggcatcttccgttgctgggggcgagacacattcattgctcttcgtggaattcttttaatcaccggcaggtatgtggaggcgcgcaacatcatcctagcctttgccggaaccttgcggcatggccttataccgaatctcctaggggaaggcatttatgcacgttacaattgccgagatgccgtttggtggtggttacagtgcatccaggattactgcaagatggtgccgaatggcctcgatattttgaagtgcccggtgtcccgcatgtaccccaccgacgattcagccccactgcccgcaggtactctcgatcagcccctatttgaggttatacaagaggctatgcagaagcacatgcagggaatccagttcagggaaagaaacgctggtccacagatcgaccgcaatatgaaggacgaaggatttaacataaccgcaggtgtggacgaggaaacaggcttcgtatacggcggaaaccgcttcaactgcggcacgtggatggacaaaatgggagaatctgaccgtgcaagaaatcgcggtattccggccaccccacgggacggtagcgccgtggagatcgtgggtctgagtaaatccgcagtcaggtggttgctggagttgtcgaagaagaacatctttccgtatcacgaagtaactgttaagcggcacggcaaggcaattaaagtctcatatgatgaatggaatcgaaagattcaggataacttcgaaaagctgttccacgttagcgaagatccctctgacctgaacgaaaagcacccgaacctggtgcacaagcgcggcatttacaaagattcgtacggtgcgtccagtccgtggtgcgactaccagctgcggccaaatttcaccatcgcaatggtcgtggcccccgagctctttacgacggagaaggcctggaaggctctggagatagccgagaaaaagctgctgggaccattgggaatgaaaaccctcgatccagacgatatggtgtattgcggaatctatgacaacgcgctagacaatgacaattacaatcttgccaaggggtttaactaccaccaaggtcctgagtggctctggcccattggatacttccttcgcgcaaaattgtacttcagccgcttgatgggacctgaaaccactgcaaagaccatcgttctagttaagaatgtgctaagccggcactacgtgcacctcgaaagatccccgtggaagggtttgcccgagctaaccaacgagaatgcccagtactgccccttttcttgcgagactcaggcctggagcattgccacgatcctggagaccctctacgacctc

SEQ ID NO: 6053 - DNA, 4596 bp, Artificial Sequence
  Description of Artificial Sequence: Synthetic coding sequence
atggggcacagcaagcaaattagaattctgctgctgaacgaaatggaaaaactggaaaagactctttttagacttgaacaaggatacgagctccaatttcgcctgggtccaactcttcaaggtaaagcagtgaccgtgtacaccaattacccctttcctggcgaaaccttcaatagagaaaagttcaggagtcttgattgggagaatccaactgaacgggaagatgattcggacaaatactgcaagctcaacctgcaacaatccgggtcgttccagtactacttcctccaagggaacgagaaatcaggtggtggctacatcgttgtggatcctatccttagagtcggggccgataatcatgtgctcccgttggattgtgtcaccctccagacttttcttgcaaagtgtcttggaccgtttgatgagtgggaatcacggctcagagtggccaaggaaagcgggtacaacatgatccatttcactccgctccagaccctcggtctttcgcgtagctgttactccctcgcgaaccaacttgagcttaaccccgatttttcacgccctaacagaaaatacacctggaatgatgtgggccagctggtagaaaagctgaagaaggaatggaacgttatatgtataactgacgttgtgtacaaccacactgcagcaaattcgaagtggattcaagagcatcccgaatgtgcatacaatcttgtcaacagcccgcatcttaagcccgcttgggtgcttgacagggcgctgtggcgattttcgtgtgatgtcgccgaaggcaagtacaaagagaagggtatccccgcactgattgagaacgatcatcatatgaactccataagaaagatcatttgggaggacatcttccctaagctcaaactttgggaattcttccaagtggatgtcaataaggcggtcgaacaattccgcagactgctgacccaggaaaatcggcgggtgacgaagtcggatcccaaccaacacctgaccattattcaggacccagagtacagaagattcggatgcactgtggatatgaacatcgcactgactactttcattccacatgacaaaggaccagcagcaatcgaggagtgctgcaactggtttcacaagcgtatggaagagctgaacagcgagaaacatcggctgattaactaccaccaggaacaagcagtcaactgtctccttggaaacgtgttctacgaacgccttgctggccacggacctaaactcggccccgtgacccggaaacacccactggtcactcgttactttacctttccttttgaagagattgatttctcgatggaagagagcatgatccaccttcccaataaggcctgttttcttatggcgcataatggctgggtgatgggagacgatccactgcggaacttcgcagaacccggttccgaagtgtaccttaggcgtgagcttatctgttggggcgattcagtcaagctgagatacggtaacaaacctgaagattgcccttacttgtgggcgcatatgaagaagtacaccgaaataaccgcaacctactttcagggtgtgagactggacaattgtcattcgaccccacttcatgtggcagagtacatgctcgacgcagcgcgtaaccttcagccgaatctctatgtggtggcagagctttttaccgggtccgaagatcttgacaacgtgttcgtgacgagacttggcatatcctccctgattcgggaggccatgagcgcttacaattcgcatgaggaaggtcgcctggtgtatagatacggtggagaacctgtgggctccttcgtccagccgtgccttcggccacttatgcccgccattgcacatgctcttttcatggatatcacccacgacaacgaatgtcccattgtgcatcgttccgcatacgatgcgcttccctcaaccaccatcgtgtccatggcttgttgcgcgagcggttcgaccaggggttacgatgagcttgtgccccaccaaatatctgtcgtctccgaggaacgtttttacacgaaatggaatccagaagcacttccttctaacaccggtgaggttaactttcaatccggtattatcgccgccaggtgtgcaatatccaagctgcatcaagaactgggagccaagggatttatccaggtgtacgtcgaccaggtggacgaggatatagtggctgtcactcgccatagtccttctattcatcaatcggtggtggcagtgtctaggaccgcgttcagaaaccctaagacgtcattctactcaaaagaagtccctcaaatgtgtatccctggaaaaatcgaggaggtggtacttgaggcaagaactattgaacggaataccaagccttacagaaaagatgaaaactcaatcaacgggacccctgatattactgttgagatcagagaacatattcagctgaacgaatccaaaattgttaagcaagcaggagtggcaactaaggggcccaatgaatacatccaggagatcgagtttgagaacctgagccctgggtcagtgattatcttccgcgtgtccctcgatcctcacgcgcaggttgcggtgggtatccttcgcaaccacctgacgcagtttagtccacacttcaaatccggatcgctggccgttgataacgccgatccgattctgaagatcccctttgcgtctttggcaagcaggctgaccctcgcagagctgaaccaaattctttacaggtgtgaatccgaagagaaagaagatggtggcggttgttatgacatccctaactggagcgcactgaaatacgcaggtctgcagggcctgatgtccgtgcttgccgagattcgtcctaagaacgacctcggccatccgttctgcaacaatctcagatcgggagattggatgattgattacgtgagcaaccgtctgatctcccgctcgggaaccattgctgaggtcggaaagtggctccaggccatgtttttctacctgaagcagataccacggtaccttatcccctgctactttgacgccattcttattggtgcgtacactactctgctggatacggcttggaagcaaatgtcctcgttcgtccagaacggaagcactttcgtgaagcatctctcccttgggtcggtccaactgtgcggagtggggaaattcccttcactgcctattttgagccctgcactcatggacgtgccctaccgcctcaatgaaatcactaaggaaaaagagcagtgttgcgtctcgctcgcagcagggctccctcatttttcgtcaggtatctttagatgctggggaagagatacctttattgcccttcgcggtattcttttgattacgggaaggtacgtggaggcccgtaatatcatattggcgtttgccggaaccctgagacatgggctcatccctaacctgctcggtgaaggtatttacgcaagatacaactgccgagacgcggtctggtggtggctccagtgtatccaggattactgtaagatggtgccaaacggactggacatccttaagtgcccagtctccaggatgtacccaacggatgatagcgcaccacttcccgcgggtactttggaccaaccactctttgaagtgattcaggaggcgatgcaaaaacatatgcaaggtatacagttccgagaaaggaatgctgggccccaaatcgatagaaacatgaaggatgagggcttcaatatcaccgcaggagttgatgaggaaactggatttgtgtacgggggaaatcgctttaactgtgggacctggatggacaaaatgggtgagtcggatagagcacggaaccgcggtattcctgctaccccacgcgatggatcggccgtggaaatcgtgggcctgtccaaatcggccgtcagatggctccttgaactttcgaagaagaacatattcccataccatgaagtgaccgtgaagcgccatggaaaagcaatcaaggtgtcgtacgacgaatggaacaggaaaattcaagacaattttgaaaagctgttccatgtgtcggaagatccatcggatttgaacgaaaagcacccgaatctcgtccacaagcggggtatatacaaggactcatatggcgcatcgtcgccgtggtgtgactaccaactgcggccgaatttcaccatagcgatggtggtggccccagaacttttcaccactgaaaaggcatggaaggcgcttgaaattgcggagaagaagctgctcggtccacttggtatgaaaacgcttgatcctgatgacatggtgtattgtggtatctacgacaatgctctggataacgataactataatctcgcaaaaggttttaactatcaccagggaccagaatggctgtggcctatcggttactttcttcgggcaaagctgtatttctcgcggctcatgggacctgagactactgcaaagaccatagtgctcgtgaagaacgtcctgagcaggcactacgtgcatcttgaaagatccccatggaaggggctgcctgagcttactaatgaaaatgcacagtactgtcctttttcctgtgaaactcaagcatggagcattgctacgattctcgaaactctgtatgacctg

SEQ ID NO: 6054 - DNA, 4596 bp, Artificial Sequence
  Description of Artificial Sequence: Synthetic coding sequence
atgggacattcaaagcagattcgtatcctccttttaaacgagatggagaagctggagaagaccctttttaggctggagcagggatatgagttgcaatttcggctggggccgacgctccagggaaaggctgtgactgtttatacaaactacccctttccaggggaaaccttcaatcgggagaagtttcggtcactcgattgggagaaccccaccgagcgggaagatgacagcgacaagtattgcaagctaaacttgcagcagtcagggtcgttccagtactattttttgcaaggcaatgaaaaatctggcggggggtacatcgtggtggatcccatcctgagagttggcgctgataaccacgtactcccgctggactgtgtgaccctgcagactttcctggccaagtgcctgggtccttttgacgagtgggaaagccggctgcgggtggccaaggagagtggatataacatgatccattttacaccccttcagaccttgggcttatctagatcttgctactcccttgccaatcaactcgaactcaaccctgattttagtcgccctaaccgtaagtatacatggaacgatgtggggcagttggttgagaaactcaaaaaagaatggaatgtgatttgcataaccgatgtcgtctataatcacacggctgcaaatagcaaatggatccaggaacatcccgaatgcgcttataacttagtaaacagtccacatctcaaacccgcctgggttttggatagggctctgtggagattcagctgcgatgttgcagaaggcaaatataaagaaaaagggatccctgctttgatcgagaatgaccaccatatgaattcaattcggaaaatcatctgggaagacatattcccaaagctcaagctgtgggagtttttccaggtggatgtgaacaaggctgtggagcagttcagacgcctgctgacacaagagaatcggcgggtgacaaaaagcgaccctaaccaacatttaaccattattcaggaccctgagtacaggcgattcggctgtactgtggacatgaatatcgccctgacaaccttcatcccacatgataaaggtcctgccgccatcgaggagtgctgcaattggtttcacaagaggatggaggagttgaattccgaaaagcatcgactgatcaactaccatcaagagcaggctgtcaactgcctgcttggtaatgtgttttatgagcgcctggcggggcatggccccaagctgggtcctgtcactaggaaacatcctcttgtgaccaggtattttacattcccatttgaagaaatcgattttagcatggaggagagcatgattcacttgccgaacaaggcatgtttccttatggctcataatgggtgggtgatgggagatgaccctctccgcaatttcgccgagcccggaagcgaggtataccttagacgtgaactaatctgctggggggattccgttaaattgagatatgggaataaacccgaagattgtccttatctctgggcacacatgaaaaaatacacagaaatcacagctacttatttccagggtgtgagattggacaactgccactccactcctctgcatgtggcggagtatatgcttgacgccgcacggaatctccagccgaatttgtacgtagtggcagaactgttcaccggctccgaggatctggacaacgtgtttgttacaagactgggtatttccagtctaattcgggaagcaatgagtgcctataattcacacgaagaggggcgtctcgtctacagatatggaggcgaacccgttggtagcttcgtccagccatgtctgagacccctgatgcctgcaatcgctcatgctctgttcatggatatcacacatgacaatgaatgtccgattgtgcatcgatccgcatacgacgctctgccctcgacaactatcgtgtctatggcctgttgtgcctccggaagcacacgcggctatgacgagcttgttccgcaccagatatctgtagtctcggaggagaggttttataccaaatggaatcctgaggcactccccagcaacacaggggaggtaaattttcagtccggcataatcgctgcccggtgcgctatctctaagctccatcaggagctgggggctaaagggtttatccaggtgtacgtggaccaagttgacgaggacatcgtggctgttacccgacactcgccttccattcaccagagtgtggtggcagtgtccaggacagcttttaggaacccaaagacttcattctattccaaggaagtgccccagatgtgcatacctggaaagatcgaagaggtggtcctggaagctcgtactattgaacgcaacactaagccgtacaggaaggacgaaaattccatcaatggaacccctgatatcactgtcgagattcgtgaacacatccagctgaatgagtcgaagattgtcaagcaggcaggcgtggccaccaagggaccaaatgagtatatccaggagattgaatttgagaatttatccccaggcagtgtcatcatatttcgcgtttcgctggatcctcatgctcaggtggctgtcgggatattgcgaaaccacctgacccaattcagcccccatttcaaatctgggtccctggcagtggataacgcagatccaatcctcaagatcccctttgcttcccttgccagtcgcctcactctggctgagctgaaccagatattataccggtgcgagtcagaagaaaaggaagatggaggcgggtgttatgatatccctaattggtcagccctcaagtacgccggactgcaagggctaatgagcgtgttggctgagatccggccaaagaatgatctggggcaccccttctgtaacaacctcagatccggggactggatgattgactacgtgtcaaaccggttgatctccagaagcgggacaattgccgaagtgggcaaatggctccaggctatgtttttttacctgaaacagattccgagatacctcatcccctgctattttgacgcaatattgattggagcctatactaccttattggacaccgcatggaagcagatgtcttctttcgtgcaaaacggctctacctttgtcaagcatcttagtcttggcagcgtccagctgtgtggcgtaggcaaattcccatcgctgccaattctcagtcccgcactaatggatgtgccctatcggttaaatgaaatcacaaaagagaaggagcagtgttgcgttagccttgccgccggcctgccacactttagctccggtattttccgttgctggggccgggatacatttatagccctcagaggcatccttctgatcaccgggagatatgtcgaggcccgaaatattattctggcgttcgccggtacattacggcacggcttaatacctaacctcctgggggagggcatttacgcgaggtacaactgccgagacgccgtctggtggtggctgcagtgtattcaggattattgtaaaatggtgcccaatggtctggacatcctgaaatgtccggtttctaggatgtacccaactgacgattctgcacctctgccagcgggaaccctggaccaacccctctttgaagtgattcaagaggcgatgcagaaacatatgcagggtatccagttcagggagagaaacgcaggtcctcagatcgatcgtaatatgaaggatgaaggatttaacattactgcaggagtcgacgaagagactggattcgtctacgggggcaataggttcaactgtggcacctggatggacaagatgggtgagagcgacagggcccgcaaccggggaatacctgcgacaccccgcgatggatccgctgtcgagattgtgggattgtccaaaagcgctgtgcggtggctgttggaactgagcaagaaaaacatttttccttaccacgaagtgaccgtgaaaagacacggaaaggcgataaaagttagttatgatgaatggaatcgtaagattcaggacaatttcgagaagctatttcacgtgagcgaagaccccagcgacttgaatgagaaacatccaaatctggtccacaagcgagggatatataaggacagctacggggctagcagtccgtggtgcgactatcaacttcgcccaaactttaccattgcgatggtggtcgctcctgaactgtttaccacagagaaagcgtggaaggccttagaaatcgcagaaaaaaagctgctgggaccactggggatgaagaccctggaccctgacgatatggtgtattgtggaatttacgacaacgcccttgacaatgataattataatctggctaaagggttcaattatcatcagggccccgaatggctatggcccatcggatactttctgcgtgcaaaactttacttctcccgccttatgggacctgaaaccacggccaagactattgtgttggtcaagaacgtgctgagtaggcactacgttcacctggaacgctcaccctggaagggactccccgaactaacaaatgaaaatgctcagtattgccccttctcatgtgaaactcaggcatggtccatcgctacgatccttgagaccctctacgatctg

SEQ ID NO: 6055 - DNA, 4596 bp, Artificial Sequence
  Description of Artificial Sequence: Synthetic coding sequence
atgggacattccaagcaaattcggatccttctgctgaatgaaatggagaagctggagaaaactctgttccgcctcgaacagggctatgagttgcagttccgcctgggtcccactttgcagggaaaggcggtgacggtgtacaccaattaccccttcccgggggaaactttcaaccgcgagaagtttcgctcgcttgactgggaaaatccgaccgaaagggaggacgatagcgacaaatactgtaaacttaaccttcaacagtcaggatcattccaatactacttcctccaaggtaacgaaaagtcgggaggaggatatatcgtggtggatcctatcttgcgggttggtgctgacaaccacgtgctccccctggattgtgtgactctgcaaacgttcttggctaagtgcctgggcccctttgatgagtgggaatcaaggctgcgtgtggcaaaggaatccggctacaatatgatccattttaccccgctgcagacgctgggactttcccggtcgtgctacagcctggccaatcagctggaattgaatccagacttctcgcgccctaatcggaagtacacctggaacgatgttggacagctcgtggaaaaactgaagaaggagtggaacgttatttgcattaccgacgtggtttacaatcatacggccgccaactcaaagtggattcaggaacacccagaatgtgcttacaaccttgtaaatagtcctcacctgaagccagcctgggtgcttgatagagcgctctggagattttcctgtgacgtggcagagggtaagtataaagagaagggaattccagcgctgatcgagaatgaccaccatatgaatagcatccgtaagatcatctgggaggacatcttcccgaagctgaagctgtgggagttttttcaggtggatgttaacaaggcagtggaacaattccgtcgcctgctcactcaggaaaatcgccgcgtcacgaaatccgacccgaaccaacatctgactatcatccaagacccagagtaccgacggttcggatgcactgtcgacatgaacatcgcattgaccacctttattccgcatgacaagggaccagcagcgattgaggaatgctgcaactggttccataagcggatggaggaactgaactcagaaaagcatcgattgatcaactaccaccaggagcaagcggtgaactgtctgttgggcaacgtgttctacgagagactcgccggacacgggcctaagttgggcccggtgactaggaagcacccgcttgtcacccgctacttcactttcccgttcgaagaaatagattttagcatggaagaatcgatgattcaccttccgaacaaggcttgctttcttatggcacataatggctgggtcatgggagacgacccgctgcggaatttcgccgaaccggggagcgaagtgtacctccggagagaactcatctgctggggagatagtgtcaagctgaggtacggaaacaagccggaggactgtccgtacctctgggctcacatgaaaaagtacaccgagatcactgcgacctacttccaaggagtgagactggataactgccactcaaccccactgcacgtcgctgaatacatgctcgatgcggccagaaacctgcagccaaacctctacgtggtggccgaactgttcaccggatcggaggaccttgataacgtgtttgtcaccagactcggaattagctcgctgatcagggaagccatgtcggcctacaactcccacgaagaggggcgtctcgtgtaccggtacggtggagaacctgtggggagcttcgtccaaccttgccttagaccgcttatgcccgctatcgcacatgcgctgttcatggatatcacccatgataatgaatgcccgatcgtccaccggagcgcctacgatgcattgccgtcgaccaccatcgtgtctatggcatgctgcgcatcggggagcactagagggtatgatgaactggtgccgcaccagatctcggtggtttcggaggagcgcttctacaccaaatggaatccggaggccctgccctccaacactggtgaagtcaacttccagtcgggaatcatcgccgcccgctgtgcaatctcgaaactgcatcaagagctgggggcaaagggattcatccaggtctacgtggaccaggtggacgaggacatcgtggccgtgactcgccacagccctagtattcatcagtcggttgtcgccgtgtccagaactgcgttccgcaaccccaagacgtccttctacagcaaggaggtgccacaaatgtgcatccctggaaagattgaggaagtggtgctcgaggccagaaccatcgaacggaacactaagccataccgcaaggatgaaaactcgatcaacggaacccctgacatcaccgtcgagatccgggaacacatccagctcaatgagagcaaaatcgtgaagcaagccggggtggcgactaagggacctaacgaatacatccaggagatcgagtttgaaaatctgtccccagggtctgttatcattttcagggtgtcactggacccacacgcccaggtagctgtggggatcctccggaatcatctgacccagttctcaccgcatttcaagtcggggtcactcgccgtggacaacgccgacccaattctcaagatcccgttcgcgtccctggcttcccgactgacccttgcggagctgaaccaaattctgtacagatgcgagagcgaggagaaagaggatggcggaggctgttacgacatcccaaactggtcagcgctgaagtacgccggactccagggactgatgagcgtgttggcggaaatccggccaaagaatgacttgggccacccattttgcaataatctgagaagcggagattggatgatcgattacgtctccaaccgtctgatctccagatccggtactattgctgaagtcggaaagtggctgcaagctatgttcttttacctcaagcagattccgagatacctgatcccatgctactttgacgcaatcctcatcggagcttacactactctgctggatactgcctggaagcaaatgtcgtcgttcgtgcagaacggatcaactttcgtcaaacacctgtccctcggctcggtgcagctgtgcggcgtgggaaagttcccgagcctgccgatcctgtctccagcgttgatggacgtcccgtatcgcctcaacgaaatcactaaggagaaagaacagtgctgcgtatcgttggcggcaggactgcctcacttctcttccgggatttttcggtgctggggccgggacacctttatcgccctgcgcggcatcctgcttatcaccggacgctacgttgaagccagaaacatcatcctggcttttgccgggaccttgcggcacggattgatcccgaacctgctgggcgaaggcatctacgctagatataactgtagggacgccgtctggtggtggctccaatgtatccaagactactgcaagatggtgcccaacggtctggatatcctcaagtgtccagtgtcgcggatgtacccgaccgacgactccgctcctttgcctgccggaactcttgatcaacccctcttcgaggtaattcaggaagcgatgcaaaaacacatgcagggcatacagtttcgcgaacggaacgctggcccccagatcgacaggaacatgaaggatgaaggcttcaacatcaccgcgggagtcgatgaggagactggtttcgtgtacggagggaatcgattcaattgcggtacctggatggacaagatgggagaatcggaccgggcccgcaatcggggaatccccgcgactccgcgcgacggttcagctgtggaaatcgtgggactctcgaagtccgcggtgagatggttgctggaactgtcaaagaaaaacatcttcccttaccacgaagtgactgttaagcggcatggcaaggctatcaaagtctcgtacgacgagtggaatcgcaaaatccaggacaatttcgaaaagctgttccacgtctcggaggatccgtcggacctcaatgagaaacacccaaatctcgtccataagagaggcatctataaggattcatacggagcgagctcgccatggtgcgactatcagctgcgaccaaacttcaccatcgccatggtggtggccccagaactcttcaccaccgaaaaagcctggaaggcactggagatcgccgagaagaaactcctcggccccctgggaatgaaaaccctggacccagatgatatggtgtactgcggcatatacgacaacgccctggataatgacaattacaatcttgccaaaggattcaactaccatcaaggaccggagtggctttggccaatcggctacttcctgagggcaaaactctacttttcacggctcatggggcctgaaacgaccgctaaaaccatcgtgttggtgaagaatgttctgagccggcactacgtgcacctggagcgatccccttggaagggactgccggaattgaccaacgaaaacgcgcagtactgcccgttctcctgcgagactcaggcatggtcgatcgcaactatcctcgaaaccctgtacgacctc

SEQ ID NO: 6056 - DNA, 4596 bp, Artificial Sequence
  Description of Artificial Sequence: Synthetic coding sequence
atgggacacagtaagcaaatccgcatcctcctcctcaacgaaatggagaagctggaaaagaccctgttccggctcgaacaagggtacgagctccagttcaggctgggaccgacccttcagggaaaggccgtgactgtgtacaccaattacccgttcccaggagaaactttcaaccgggagaaattcagatcgctcgattgggagaatccgaccgaacgcgaagatgactcggacaaatactgtaagctcaacctgcaacagagcggctcgttccaatactacttcctgcagggcaatgaaaagtcgggaggtgggtacatcgtcgtcgacccgatccttcgggtcggcgcggacaaccacgtgctcccgctcgattgcgtgaccctgcaaacttttttggccaagtgcctcggacccttcgatgaatgggaaagcaggcttcgcgtggccaaggagagcggctataacatgatccactttaccccgctgcagaccctcggactctcgcgctcgtgctatagcctcgcgaaccaactcgaactcaacccagacttcagccgaccgaatcgcaagtacacctggaacgatgtggggcaactggtggagaagctgaagaaggaatggaacgtcatctgcatcaccgatgtggtgtacaaccataccgctgctaactccaagtggattcaggagcatccagaatgcgcatacaacctggtgaacagcccacacctgaagcctgcctgggtgctcgacagagccctgtggcgcttctcatgcgatgtggctgaaggaaagtacaaagagaagggaatccccgccctcatcgaaaacgaccaccatatgaactccattcgcaagatcatctgggaggatatcttccctaagttgaagctgtgggagttcttccaagtcgacgtgaacaaggcagtggaacaattccgcagacttttgacgcaagagaatcgccgcgtgaccaagtcggacccgaaccagcacctgaccatcattcaagaccctgaatatcgcaggttcggatgtactgtcgatatgaatatcgccctgactaccttcatcccacacgacaagggaccggcggctatcgaggagtgttgtaactggttccacaaaagaatggaggagctgaactccgaaaagcaccgtctgatcaactaccatcaggaacaggcggtgaactgcctcttgggcaatgtcttttacgagcgcctggcgggccacggcccgaaacttggtccagtgacgcggaaacaccccctggtcacccgctacttcaccttcccgttcgaggaaatcgacttctccatggaggaatctatgatccatctgccgaacaaggcttgcttcctgatggcacacaatggctgggttatgggagacgatccgctccgcaacttcgccgagccaggatcagaggtctacctgcggcgggaactcatttgctggggtgactcggtcaaactgcggtacggtaacaagcccgaagattgtccctatctgtgggcacatatgaaaaagtacaccgagatcactgcaacctattttcaaggcgtgcggctggacaattgtcactcaacgccactgcatgtcgcagagtacatgctcgatgccgcgcgaaatctccagccaaacttgtacgtggtggccgaactctttaccggaagcgaagatcttgacaacgtgttcgtcactcgcctcggaatctcaagccttattagagaggcgatgtcagcgtacaattcgcatgaagaaggccggctggtgtaccgctatggaggtgagccagtcggtagctttgtgcaaccgtgcttgcggccactcatgcctgcaatcgctcacgccctgttcatggacatcacccatgacaacgagtgcccaatcgtgcaccggtcggcttatgacgccctgcctagtaccactatcgtgtcgatggcatgctgtgctagcggaagcactcgcgggtacgacgaattggtcccgcatcaaatcagcgtcgtgtccgaggagagattctatactaagtggaacccggaagcccttcctagcaacactggggaagtgaatttccagtcgggcatcatcgcggcccgctgcgcgatttcgaagctccaccaggagctcggcgcgaaaggctttattcaggtctacgtggaccaggtggacgaggacatcgtggccgtgacccgccactcgccgtctatccatcagagcgtggtggcagtgtcccggaccgctttcagaaacccaaagacttctttctacagcaaggaagtgccgcagatgtgcattccgggaaagatcgaagaagtcgtcctcgaggctcggactatcgaaagaaacaccaagccgtacagaaaagacgagaactccatcaatggaaccccggatatcacggtcgagatcagagagcacatccagcttaacgaatcgaagattgtgaaacaagccggagtggccaccaagggcccgaacgagtacatccaggagatcgaattcgagaacctctcaccgggatcggtgatcatcttcagggtgtcgctcgatccacacgcgcaagtggccgtcggcatcctgcggaatcacctgacgcagttctccccccatttcaaatccggaagcctggctgtggacaatgctgatccaatcctgaaaatcccgttcgcatccctcgcctctaggctgaccctcgcggagctgaaccaaattctctaccgctgtgaatcagaggagaaggaagatggcgggggctgctacgatatccctaattggtctgcactgaagtacgcgggtctgcagggacttatgtcagtactggcagagatccgccctaagaacgacctggggcaccctttttgtaacaatctgcggagcggcgattggatgatcgattacgtgtcgaaccggctcatctcccggtcgggcaccatcgcagaagtgggaaagtggcttcaagccatgttcttctacttgaaacagatcccacgctacctgatcccatgttacttcgatgccattctcataggggcatacactaccctgctggacactgcgtggaagcagatgtcgtcctttgtccagaatggaagcacctttgtgaagcacctctcgctggggtccgtgcagctgtgcggagttggcaaatttccatccctgccaatcctctcaccggccttgatggacgttccttatcggcttaatgaaatcactaaggaaaaggagcaatgctgcgtgtcactggctgcaggactgcctcactttagctccggcattttcaggtgctggggccgggataccttcatcgccctgcgcgggatcctgctgatcaccggacgatatgtcgaggcccggaatatcatcctcgccttcgctgggacgctcagacacggactcatccccaacctgctcggagaaggtatctacgcgagatacaattgccgcgacgccgtgtggtggtggctgcagtgcatccaggactactgcaagatggtgcctaatggtctggatatcctcaagtgtccggtgtcgagaatgtacccaactgacgattctgccccgctgccggctggcaccctggaccaaccgctcttcgaggtcatccaggaggccatgcagaaacacatgcaaggcatccagtttcgggaacgcaacgctggcccgcaaatcgaccggaatatgaaggatgaaggattcaacatcactgcaggcgtggatgaagagactggattcgtgtacggaggaaaccgcttcaattgcggaacttggatggacaaaatgggcgaatcggaccgcgcgaggaaccggggcatccctgccactccgcgggatggatcggctgtggagattgtggggctgtccaaaagcgccgtccgctggctgcttgagctgtcaaagaagaatatcttcccgtaccacgaagtcaccgtgaagagacatggcaaagctatcaaggtttcgtacgacgagtggaacaggaaaattcaggataacttcgaaaagctgttccacgtgagcgaggatccgtcggacctgaacgagaagcatcccaacctcgtgcacaaaaggggaatctacaaagactcctacggggcatcaagcccgtggtgcgactaccaactgcggccgaacttcactatcgctatggtcgtcgcgccggaactgttcaccactgagaaagcctggaaggctctcgagattgcggaaaagaagctgttgggtcctttgggaatgaaaaccctcgatccagatgacatggtgtactgtggaatctacgacaatgccctggacaacgacaactacaatctcgccaaaggcttcaattaccaccagggaccggagtggttgtggccaatcgggtacttcctgcgtgctaagctctatttcagccggcttatgggacctgagactactgcaaagaccatcgtcctggttaagaacgtcctcagcagacattacgtgcacctggaacgctcaccgtggaagggtttgcctgaactgactaatgaaaacgcccagtattgtccgtttagctgcgaaacccaagcatggtctatcgccacgatcctcgaaaccctctacgacttg

SEQ ID NO: 6057 - DNA, 4596 bp, Artificial Sequence
  Description of Artificial Sequence: Synthetic coding sequence
atgggccatagcaagcagattcgcatactgctgctcaacgaaatggaaaaactcgaaaagaccctcttccgtcttgaacaagggtacgagctgcaatttaggctcggtcccactctgcaggggaaggccgtcactgtctacacgaactacccgttccctggggaaacttttaaccgcgaaaagtttcggtcccttgattgggagaaccctaccgagagagaagatgactcagacaagtactgtaaacttaacctgcaacaatccggcagcttccagtactactttcttcaaggtaatgaaaaatccggcggcggttacatcgtcgtggacccaatcctgcgtgtgggagcggataatcatgtgttgccacttgactgtgtcacgctccagaccttccttgccaagtgcctcggcccatttgatgaatgggaatcaaggttgagagtggcaaaggagagcgggtacaacatgatccattttactccattgcaaactctgggactttcgaggtcgtgctacagcctggccaatcagctggaacttaaccctgatttctccaggccaaaccgcaaatacacgtggaatgatgtcgggcaacttgtggaaaaactgaagaaggagtggaacgtgatctgtattaccgatgtggtctacaatcataccgcagccaactccaagtggatccaagaacatcctgagtgtgcatacaacctggtcaatagcccacaccttaagccagcctgggtgcttgatagggcactctggcggttctcatgtgatgtggcggagggtaagtacaaggagaaggggatcccagcgcttatcgaaaatgaccaccacatgaattcgatacgtaagatcatttgggaggacattttcccaaagctgaaactttgggaattctttcaggttgacgtgaacaaagcagtcgaacagtttagacgcctgctgacccaagaaaaccggagagtcaccaaatcggatcctaatcagcatctgactatcattcaagatccagaatacagacgcttcggctgtaccgtcgacatgaacatagccctgactactttcattcctcacgacaagggtccggccgccatcgaggagtgttgtaactggttccataaaaggatggaagagcttaactcggagaagcatcgcctgattaactatcatcaagaacaggcagtcaactgcctccttggtaacgtgttctatgaaagattggcagggcacggtcccaaactgggacccgtgactcggaagcaccctctcgtcacccgatactttacctttccatttgaggagattgatttttccatggaggaatcgatgatccatctgcccaataaggcatgtttcctcatggcccataacgggtgggttatgggagatgatcctctgaggaactttgcagaacctgggtcagaagtgtaccttcgcagagaactgatctgctggggggattccgtcaagctgcgctacggaaacaagcctgaagattgtccatacctttgggcacacatgaagaaatacactgagattaccgcaacctactttcaaggagtcaggctggacaactgccactccacccctctgcacgtcgcagagtatatgctggatgccgcaagaaacctgcagcctaatctgtacgtggtggcggagctctttaccggttccgaagatcttgataatgtgtttgtgactcgcttgggaatctccagcctgatccgtgaggcaatgtccgcatacaattctcatgaagaaggtcgccttgtgtacagatatggaggagagcctgtcggatcattcgtgcaaccttgtctccggcccctgatgccggcgatagcacatgcgctgtttatggatattacccacgataacgagtgtcctattgtgcatcgctctgcatacgacgcacttccttccaccactatagtcagcatggcctgttgtgcgtcgggcagcacccggggttacgacgaacttgtgccgcatcagatttcggtggtgagcgaagaaagattttacaccaagtggaatcctgaggcccttccttcgaacactggagaggtcaatttccagtcggggataattgctgcgcggtgcgcgatctccaaacttcaccaggaactgggtgcaaagggattcatccaggtgtacgtggatcaggtggacgaggatatcgtggccgtgacccggcattccccaagcatacatcaaagcgttgttgcagtctcacgtactgcatttcgcaaccctaagacctcgttctactcgaaagaggtgcctcagatgtgcattcccgggaaaatcgaagaggtggtgcttgaagcacgcactatcgaacgcaatacgaagccataccggaaggatgaaaactcgattaatggaacgccggatataaccgtcgaaatccgggaacatattcaactgaacgaatccaagattgtcaagcaggcaggggtggcaactaagggaccgaacgaatacattcaggaaatcgaattcgaaaatctttcacccgggagcgtaatcatctttagggtgtccctggacccccatgcacaggtcgccgtggggatcctgcgtaatcaccttactcaattctcacctcactttaagtcaggatctcttgctgttgacaacgcagatccgatccttaagattcccttcgcatcacttgcatcccgcctgaccttggcggagctgaaccagattctttatcggtgtgaatccgaagaaaaggaagatggaggtggttgttatgacattcctaattggtccgccctgaaatacgcaggtctgcaggggctgatgtctgtgctggccgagataagaccgaagaatgatctgggtcatcctttttgtaacaatctgcgttcgggagattggatgattgactacgtctcaaaccgtcttatttcgcggtcaggaaccattgccgaagtgggaaaatggcttcaggctatgttcttctaccttaaacaaattccaagatacctcatcccctgctattttgatgctattctgattggcgcatacactaccctcctggataccgcttggaagcaaatgtcctccttcgtccaaaatggtagtactttcgtgaagcatttgtcgctcggatcagtccaactgtgtggcgtgggcaagtttccatcgctgcccatcctgtcgcccgcattgatggacgtgccgtatagactcaatgaaattaccaaggaaaaggagcagtgttgtgtctcgctcgcagcagggctgccacatttcagctcaggaatattcaggtgttgggggcgagacactttcattgccctgagaggaattctgcttattaccggacgctatgtggaagccaggaacattattctcgcattcgcaggaactttgcgccatgggctgattccaaacctccttggtgagggaatttacgcaagatacaactgccgcgacgccgtgtggtggtggctgcaatgcattcaggattactgcaagatggtgcccaacggtctggacattctgaagtgtccggtgtcacggatgtaccctactgatgattccgcaccactcccggccggaactctggaccagccactgttcgaagtgatccaagaagcaatgcagaaacacatgcaaggtattcagtttagagagcgcaatgcaggaccgcagattgatcgcaacatgaaggatgaaggctttaacattaccgccggggtggacgaagagactggattcgtgtacggagggaaccgattcaattgcgggacctggatggataagatgggcgaatcagaccgcgcccgcaatcgaggcatcccggccacccctagagatggttcggccgtcgaaattgtgggcctcagcaaatccgcggtgcggtggctcctggaactttcgaagaagaacatttttccttaccacgaagtgactgtgaagcgacatggaaaggcgattaaggtttcctacgacgaatggaatcgtaagattcaggacaacttcgagaaactctttcatgtctccgaagatccatcggatctgaatgagaaacacccaaaccttgtgcacaaacggggaatctataaggactcttacggcgcatcgagcccatggtgtgattaccagcttcggcccaacttcactattgcaatggtggtcgcccccgagttgtttaccacggaaaaggcgtggaaggctctggaaattgcagagaaaaaacttctgggtcctctcggaatgaaaacgcttgatccagacgacatggtgtactgtggaatttacgacaacgcgctcgataacgacaactacaacctggcgaaggggtttaactaccatcaggggcctgaatggctgtggccgattggatactttttgagagcaaagctctacttttccagactgatgggaccagaaaccactgccaagaccattgtgctggtgaagaacgtgcttagccgtcactacgtgcatcttgaacgctcgccctggaaaggactgcctgagctcaccaacgagaatgcgcaatactgtcctttcagctgtgaaactcaggcgtggtccattgccaccatcctcgaaacgttgtacgacctg

SEQ ID NO: 6058 - DNA, 4596 bp, Artificial Sequence
  Description of Artificial Sequence: Synthetic coding sequence
atggggcacagcaagcagatcaggatcctcctgctgaacgaaatggaaaaattagagaaaacattattccgtctggagcaaggatacgaactccagttccgcctcggacctacgctccaagggaaggctgtgactgtctacactaattacccattccccggagaaacattcaatcgggagaagtttcggtcattagattgggagaaccctactgagagggaggatgatagtgacaagtactgtaagcttaatttgcaacagagcgggagctttcagtattacttccttcaggggaacgagaaaagtgggggtggctatattgtggtcgatcctatcctccgggtcggtgctgataaccacgttctgccactcgactgtgtcaccctgcagacctttttggctaaatgcttgggcccattcgatgagtgggaatccagactgcgcgtggccaaggagagcgggtacaacatgatccatttcacgcccctgcagacactgggtctgtcgaggtcttgttatagtctggccaaccagcttgaactaaacccagatttctcaaggccaaaccggaagtacacttggaacgacgttggacagttggtggaaaagcttaagaaggaatggaatgttatctgcatcacagatgtcgtatataatcacacagccgctaactccaagtggatccaagagcaccctgaatgcgcgtataatttggtcaactcaccccacctgaaacctgcatgggtactggaccgcgccctttggcggttcagctgtgacgtagcggaaggaaagtacaaggaaaagggaatcccagcactgatcgaaaatgatcaccacatgaacagcattcggaaaataatctgggaagacatttttccaaaacttaagctgtgggaattcttccaggtcgacgtcaacaaagccgtcgaacagttcagacgcctactcactcaggagaaccgccgggtcaccaagtctgatcccaatcagcacctgaccattatccaagatccggaataccgccggttcgggtgtacagtagacatgaacattgctctgactacattcatccctcatgacaaggggcctgccgccatcgaggagtgctgcaactggttccataaaagaatggaggagctgaactctgagaaacatcgcctcattaattaccaccaggagcaggctgtgaactgtttgctggggaatgtgttttacgaaagactggccggccacggccccaagttgggccccgttactcgtaagcacccacttgtgactcggtatttcacctttccgttcgaggaaatagatttttccatggaggaatcaatgatccaccttcccaataaagcctgtttcctgatggcccataacggctgggtgatgggcgacgacccgctccgaaatttcgccgaacccggctctgaagtctaccttcgacgcgagctgatttgttggggagacagcgtaaaattacggtacggcaataagccagaggactgtccttatctgtgggcgcacatgaagaagtataccgagatcacggcgacttatttccagggtgtccggttagacaattgtcatagtactcctctgcacgtggccgagtacatgctggacgccgccaggaatctgcaaccgaacctgtatgtggtggcagagcttttcacaggctcagaggacttagacaatgtcttcgtgacacgcttgggaatcagctccctcatccgcgaagcaatgtctgcatacaactcacatgaggaggggagattagtatacaggtatggaggcgagcccgtggggagctttgttcagccatgcctcaggcccttaatgcccgcaatagcccacgccctgtttatggacatcacgcacgataatgagtgccccattgttcaccggagcgcttatgacgctctgcccagtaccactatcgtgtctatggcctgctgtgcttcagggtccaccagagggtatgatgagctggtccctcaccaaatcagcgttgtgagcgaagaacgcttctacactaagtggaatccagaagccctgccgtctaatacgggcgaagtcaacttccagagcggaattatcgccgcccgttgcgcgatatctaaattgcatcaggagcttggagctaaaggtttcatccaggtttacgtagatcaggtcgatgaggacatagttgcagtgactcgacacagccccagcattcaccagtcagttgtcgcagtctcccgcacagcatttagaaatccaaaaacgtccttctactcaaaggaggtcccacagatgtgtatccccggcaaaattgaggaagttgttctggaggctcggacgatagagcggaacacaaagccatatagaaaggatgaaaactccatcaacggtacaccagacataaccgtggaaatccgggaacacatccagctcaatgaatccaagatagtaaagcaggccggagtcgcgactaagggacccaacgagtacatccaggagattgagtttgagaacctctcgccaggctcggtaataattttccgagtctccttggacccgcatgctcaggtggccgtggggatcctcagaaaccatctgactcagttctcgccccatttcaaatccgggtctcttgccgtggacaatgcagaccccatcttaaagattccatttgcctccctcgccagtcgactgacccttgcggaactaaatcagatcctgtaccggtgcgaaagcgaggagaaggaggacggtggcggatgctatgatatacccaactggtccgctctcaaatatgcaggactccaggggttaatgagtgtcttggccgagattagaccaaagaacgatctggggcacccattttgcaacaatctgaggtctggagactggatgatcgactacgtaagcaaccgtctgatcagtagatccggtacaatcgcagaagttggaaagtggttgcaggccatgttcttctatttgaagcaaattccaaggtacttaatcccttgctactttgatgcgatcttgatcggagcctacaccaccctactggacaccgcttggaaacagatgtcctcattcgtgcagaacggcagcacttttgtgaagcacctttcactcgggtctgttcagctctgtggtgttggaaaatttccttcgctgcctatcttatcccctgctctcatggacgtcccatatcgtctgaacgagatcaccaaggaaaaggaacagtgctgcgtgtccctggccgctggactaccccatttttcatccgggatattccggtgttggggtagggatactttcatagccctgcgtggcatcctgctcataactggccggtacgtcgaagctcggaatataattcttgccttcgccggtactctaagacacggactcatcccaaacctgttaggcgaggggatttatgctcgttacaactgtagagacgctgtgtggtggtggttacagtgcattcaggactactgcaaaatggtgcctaacgggctggacattttgaagtgccccgtgtcccgcatgtaccctaccgatgattctgctcccttaccagccggcaccctggaccaacctctttttgaagtgatccaggaagctatgcagaagcacatgcagggcatccaatttcgcgaaagaaatgccggcccccagatcgacaggaatatgaaggacgagggctttaacataacagctggtgttgatgaggagactgggtttgtttatggggggaacagatttaattgtgggacttggatggacaaaatgggggagagtgaccgagctcgaaaccgaggtattcccgccacccccagagatggatcagccgttgagatagtggggttatccaagtcggccgttcgatggctgttggaacttagcaagaaaaacatctttccctaccatgaggtgacagtcaaaaggcacgggaaggccattaaagtcagctacgatgagtggaatcgaaaaatccaagataatttcgagaaactatttcacgttagtgaggacccctctgaccttaatgagaagcatccgaacctcgttcataagagaggcatttacaaggattcttacggcgcatcttcaccatggtgcgactatcagctgcgaccaaattttactattgccatggttgtggcaccagagctctttaccaccgaaaaagcttggaaggccttggagatcgctgagaaaaaactcctcgggcctttgggaatgaagaccctggatcccgacgatatggtctattgtggaatctacgataatgcattggacaatgacaattacaacctggctaaaggctttaattaccaccagggcccagagtggctgtggcctatagggtactttttaagggccaagctgtactttagcagactaatggggccggagactacagctaaaaccattgttttggtaaagaatgtgctttcaagacactacgtacatctggagagatctccctggaaagggctgcccgaactgacaaacgaaaatgcgcagtactgcccttttagttgtgagacccaggcttggagtatcgcaaccatccttgaaactctctatgatctt

SEQ ID NO: 6059 - DNA, 4596 bp, Artificial Sequence
  Description of Artificial Sequence: Synthetic coding sequence
atgggccatagtaagcaaataagaattcttctccttaatgagatggaaaagctcgagaaaactctttttagactggaacaagggtacgagctgcaattccgcctggggcctactcttcaagggaaggcagtcaccgtgtacactaactacccttttcccggtgaaacttttaaccgagaaaagtttcggtcgttggattgggaaaatccaaccgaaagagaggacgactcggacaaatactgcaaacttaacctccagcagtcagggtccttccagtattactttctgcaagggaacgagaagtcgggaggagggtacattgtcgtggatcctatattgcgagtcggcgcagataaccacgtgttgcctctggattgtgtgactctccagactttcctcgcaaagtgcctggggccttttgatgaatgggagtcgcggcttcgggtggccaaggagagcggctacaatatgattcatttcaccccccttcaaactctcggcctttcacgatcatgttactcgctggcaaaccaactcgagctgaacccagatttttccaggcctaaccgcaagtacacctggaacgacgttggacaactggtcgaaaagttgaagaaagaatggaatgtcatatgtattactgacgtcgtgtacaaccataccgcagccaattcaaagtggattcaagaacatccagaatgcgcctacaacctggtgaactcaccacacctcaaaccggcgtgggtcttggaccgcgcgttgtggcgcttttcgtgcgacgtcgccgaagggaaatacaaggaaaagggtatccctgcacttatcgaaaacgatcaccatatgaattcgatccgaaagatcatttgggaggacatctttccaaagctcaagctgtgggagtttttccaggtcgacgtgaacaaagctgtggagcaattccggcgcctgctcactcaggagaaccgacgcgtcaccaaaagcgacccaaaccaacacctgactattatccaagatccggaatacagaaggttcgggtgtaccgtggatatgaacatcgcacttactacctttatcccacatgataagggcccagccgccattgaggagtgctgtaactggttccataagcggatggaagaactgaacagcgagaagcaccgactcattaactatcatcaggaacaagctgttaattgtttgcttggaaacgtgttttatgaacgccttgcaggccacggtccgaaacttggtcccgttacgcgcaagcaccccctggtgacgcgctactttaccttcccattcgaagaaattgactttagcatggaggaatcaatgatacacctgcccaacaaggcatgctttctgatggcccataacggatgggtgatgggtgatgatcctctgcgcaactttgcggaaccaggttcggaagtctaccttcgccgcgaacttatctgctggggtgattcagtcaagctgagatacggcaacaagcccgaagattgcccttacctgtgggcccatatgaagaaatacaccgaaattaccgcaacctactttcagggagtccgactggacaactgccatagtactcctctgcacgtggctgagtacatgctggacgcagcacggaatttgcaacctaacctctacgtcgtcgccgagctgtttactggatccgaggatctggataacgtgtttgtcactagactcggaattagctcactgatccgtgaagcaatgagcgcttacaattcacatgaagaaggacgtcttgtgtacagatacggcggtgaacctgtgggctcattcgtccagccatgcctccgccctctgatgcccgcaatagcacacgcgcttttcatggatattactcacgacaatgagtgtcccattgtccatagaagcgcatacgacgcacttccatcgaccaccatcgtgtccatggcatgttgtgcttcgggatcgacccgcggatacgatgaactggtgcctcatcagatatccgtggtgagcgaggagcgcttctatactaagtggaatccggaagctctcccttcgaatacgggtgaggtgaatttccaatccggtattatcgcagcaagatgtgccatctccaagctgcaccaggagcttggcgcgaaaggttttatccaggtgtacgtcgaccaagtcgatgaagatattgtggcagtgacccgccattcaccaagcattcatcagagcgtggtggcagtgtctcgaaccgcattccggaaccccaaaacttcgttttactccaaagaggtgccccagatgtgcatcccgggaaagattgaagaggtcgttctggaagcacggaccattgaacgaaacactaagccataccgtaaggatgaaaactcaattaacggtacccctgatataacggtggaaattcgcgagcatattcaattgaacgaatccaagatcgtgaaacaagcgggcgtggccactaagggccctaacgagtatattcaggaaatcgagtttgaaaatctttcgccaggtagcgtgatcattttcagagtgtcacttgatccacacgcacaggttgccgtgggaattctcagaaaccacctgacccaattctcgccccatttcaagagcggatcacttgcagtggataatgccgatccaattctcaaaattccattcgcatcgcttgcatcaaggctgaccttggcagagctgaaccagattctgtaccggtgtgaaagcgaggaaaaggaagatggaggcggttgttacgacatccctaattggtccgcgctgaagtacgcaggactgcaaggccttatgtcggttcttgctgagattaggcctaagaacgatctcggacatcctttctgtaacaatttgagatccggcgattggatgattgactacgtgtccaaccggctgatttctcggagcggaaccatagcggaagtcggaaagtggctgcaggcaatgtttttctacctgaaacagatccccaggtacctgattccatgttactttgacgccatcctgatcggggcctacacgactcttctggataccgcgtggaaacaaatgtcctcctttgtgcagaacggatcgacttttgtgaagcacctttcactcggaagcgtccaactgtgtggagtcggaaagtttcccagccttccaatcctctccccagctcttatggatgtcccctaccgattgaacgagattactaaagagaaggagcagtgctgtgtgtccctggccgctggcctgccacatttctcgtcaggcattttcaggtgctggggccgcgatactttcatcgcactcagagggatactcctcatcacgggacggtacgtcgaggctcgtaacattatcttggcctttgcaggtaccttgcgccacggacttatccctaatctgcttggagaaggtatttacgcgagatataactgtcgtgacgcagtctggtggtggctgcagtgtattcaagactactgtaaaatggtcccaaatggacttgatatccttaaatgcccggtgtcgcggatgtatccgaccgatgactcggcgccactgccagcgggaactctggatcagcctctttttgaagtcattcaagaagcaatgcagaaacatatgcaagggatacaattccgtgaaagaaacgcgggaccccagatagatcgcaacatgaaggatgaaggcttcaacattaccgcaggtgtggatgaagagactggatttgtgtacggtgggaacagattcaactgtggtacctggatggataagatgggcgaaagcgatcgggcccggaatagaggtatcccggcgaccccgagggatggcagcgccgtggaaatagtcggccttagcaagtcagcagtgagatggcttcttgaactgagcaagaagaacatcttcccctaccatgaggtgaccgtgaagcggcacggtaaggccataaaagtgtcctacgatgaatggaaccggaagattcaggacaattttgagaaactgtttcatgtctccgaggacccatctgatctcaacgaaaagcaccctaacttggtgcacaagagaggtatttacaaggacagctacggcgcttcgtcgccttggtgcgattaccaacttagaccaaacttcaccatagcaatggtggtcgcacctgagcttttcactactgaaaaggcctggaaagcactcgaaattgctgagaagaaacttttgggaccactcggtatgaaaacgctcgaccccgacgatatggtgtattgcgggatttatgacaatgccctggataacgacaactataatctcgctaagggcttcaattaccaccaggggcctgagtggctttggccgattggatactttctgagagcgaagctgtacttttcgcgactcatgggtcctgaaaccaccgcaaagaccatagtgcttgtaaagaacgttctgtcgcgccactacgtgcatctggaaagatcgccatggaaaggccttccggagttgacgaatgagaatgcgcaatactgtcctttttcttgtgaaacccaagcatggtcaattgccactatcctcgagactctttacgatctt

SEQ ID NO: 6060 - DNA, 4596 bp, Artificial Sequence
  Description of Artificial Sequence: Synthetic coding sequence
atgggccactccaagcaaattaggatccttcttctcaacgaaatggaaaagctggaaaagaccttgtttcgacttgagcaagggtacgaacttcagttcagactgggacctacccttcagggtaaagcggtgaccgtgtacacgaactacccgttcccaggagaaaccttcaatcgcgagaaatttcggagcctcgactgggaaaacccaaccgaaagggaggacgattcggacaagtactgcaaacttaaccttcaacagagcggatccttccaatactattttctccaaggcaatgaaaaatcgggagggggatacattgtggtggatccgattttgcgtgtcggagccgataaccatgtgctgccactggactgtgttaccttgcagactttcctcgcaaaatgtctgggaccatttgatgaatgggagagccggctcagggtggcgaaggaatccggatacaatatgatccacttcacgccgctccaaacccttggactcagccggtcttgttactcgctcgcaaaccaattggagctgaatcctgacttttccagacccaataggaagtacacgtggaacgatgtcggacaactggtcgagaagctcaagaaggagtggaacgtcatttgtataactgatgtggtgtacaatcacactgcagcaaactcaaagtggatccaagagcacccagagtgtgcctataacctggtgaactccccccatctcaagcctgcgtgggtcttggatcgagcgctgtggcgctttagctgtgacgtcgcggagggaaagtataaagaaaagggcattccagcacttatcgagaacgaccatcatatgaactcgatccgcaagatcatctgggaggatatcttcccaaagttgaagctgtgggaattcttccaggtggatgtgaataaggcagtggaacaatttcgacgactgcttactcaggagaacagaagagtcactaagtctgatccaaaccaacatctcaccataatccaagatcctgaatatagacggtttggatgtactgttgatatgaacatcgcgctcaccacctttattccccatgataagggtccagcagcgattgaagaatgctgcaactggtttcataaacggatggaagaacttaactcagaaaaacatcgcctgataaactaccatcaagaacaagcagtcaattgcctgctcggcaatgtgttttacgagagactcgctgggcacggacctaagttgggacccgtgacccgaaaacatcctcttgttacccggtacttcactttcccttttgaagaaatcgacttttccatggaagaatctatgatccaccttccgaacaaggcatgctttctgatggcacataacggctgggtgatgggtgacgacccgctgcggaactttgcagagccagggtcggaagtgtacctgcgccgtgaactgatatgttggggcgactctgtgaagctgagatacggtaataagccagaggactgtccttacctgtgggcacatatgaaaaagtacactgaaattacggctacttactttcagggtgtcagacttgataactgccactcaacgccacttcacgtcgcagaatacatgctcgacgcagcaagaaacctgcagccaaacttgtatgtggtcgccgaactctttactggttcggaagatctggataacgtgtttgtgaccagattgggaattagctcgttgattagagaagcaatgtcggcctacaactcacacgaggaaggaaggctggtttaccgctacggtggggaacctgtcgggtccttcgtgcaaccttgccttagacctttgatgcctgcaatagctcatgccttgtttatggacattactcatgataacgaatgtcccatcgtgcaccggtccgcatacgatgccctgccttcgactaccatagtctccatggcatgctgcgcatcggggtcgacccgagggtacgatgaactggtgcctcatcaaatctctgtcgtgtcggaggaacgcttctacactaaatggaacccagaggcactcccatccaatacgggggaggtgaattttcagtcaggaatcattgcagctaggtgcgcgatctcgaagctgcatcaggaacttggtgcaaagggttttatccaggtgtacgtggaccaagtggatgaggatattgttgcagttacccgacattcaccttcaatccatcaatccgtggtggctgtgtcgaggacggccttcagaaaccctaaaacttcgttttactcgaaggaagtgccacaaatgtgcattcctgggaagatcgaggaagtggtcctggaggcgcgcactattgaacgcaatactaagccgtaccgcaaagatgaaaattccattaatgggaccccggacattaccgtggaaattcgggaacacatacaactcaacgaaagcaagattgtgaaacaggcaggcgtcgcaactaaggggcccaacgaatacattcaagagatcgaattcgaaaacctttcgccagggtcggtgattatcttccgtgtgtcgctggaccctcacgcccaggtcgcggtgggaattttgagaaaccatttgactcaattttcaccacactttaagagcggttccctcgcagtggacaacgccgatccaatactgaagatcccctttgcgtcactggcatcgaggcttaccttggcagaactgaaccagatcctttacagatgtgagtcggaggaaaaagaggacgggggtggctgctacgacatacctaattggtcggcgctcaagtacgcagggcttcagggcctgatgagcgttcttgctgaaatccgcccgaaaaacgatcttggacatccattttgtaacaacctcaggtcgggcgactggatgattgactacgtttctaaccggcttatctcccggtccggaactattgcggaagtgggaaaatggctccaagcaatgttcttttaccttaaacagatccctaggtacctgattccatgttactttgatgccattttgattggagcatacactactcttcttgataccgcttggaagcaaatgtcatcgtttgtgcaaaatggcagcacctttgtcaagcatctgagcctgggctctgtgcagctgtgcggtgtgggtaagtttccatccctgcctatcctctcgcctgcattgatggatgtcccttaccggcttaacgaaatcaccaaggaaaaggagcagtgttgcgtgtcactggccgcaggtctgccccacttttcctccggaatattcagatgctggggacgggacaccttcattgcccttaggggaattctgctgattaccgggaggtatgtggaggcaagaaacattattctggcatttgcaggaaccctgagacacggcctgattccgaaccttctcggagaaggaatttacgctagatacaattgcagagatgcagtgtggtggtggcttcaatgtatccaagattactgtaagatggtgcctaacgggttggatatactgaagtgccccgtgtcgcggatgtacccaactgacgatagcgcgcctcttcctgcaggtactctggatcaacctctgttcgaagtgatccaggaagcaatgcaaaaacacatgcagggcatacagttccgggagagaaacgcaggcccacaaatagatagaaacatgaaagacgagggcttcaacataactgcaggtgtggacgaggaaaccggctttgtgtacggggggaaccgttttaactgcggtacctggatggataagatgggtgaatcagatcgggctaggaatcgcggtataccggcaaccccccgtgacggtagcgcagtggaaattgtcggactcagcaaatcagcagtgcggtggcttttggagctctcgaaaaagaacatatttccttaccatgaagtcaccgtcaaaagacatggaaaggccataaaggtgtcgtacgatgaatggaatcgcaagatccaggacaattttgagaagctctttcacgtcagtgaagatccctcggacctgaatgaaaaacatcctaatcttgtgcataaacggggtatttacaaggactcctacggagcaagctcgccatggtgtgattatcagctgcggccaaatttcactattgcaatggtcgtggcacccgagctgtttaccactgaaaaggcctggaaggcactggaaattgcagagaaaaagctcctgggaccactgggaatgaaaactcttgatccagatgatatggtctattgtgggatttacgacaacgctctcgataacgataactacaacctggcaaaaggctttaactaccaccagggacctgagtggctgtggcctattggctactttctgagggccaagctgtactttagcagacttatgggacctgaaactacggcgaaaactatcgtgttggtgaagaatgtgctgtccagacattacgtgcatctggaaagatcgccttggaagggtctgcctgaacttaccaatgaaaatgcacagtattgccctttctcatgcgaaactcaagcatggtcaatcgcgaccattcttgaaaccctgtacgatctc

SEQ ID NO: 6061 - DNA, 4596 bp, Artificial Sequence
  Description of Artificial Sequence: Synthetic coding sequence
atgggccacagcaagcagatccgcatcttgctcctcaacgaaatggaaaagctcgagaagaccctgttccggctcgagcagggatatgaattgcaatttcggctgggacccactctccagggaaaagcagttaccgtgtacactaactaccccttcccgggtgaaacgttcaacagagagaaattcaggtcgctcgactgggaaaatccgaccgaacgcgaagacgactctgacaagtactgtaagctgaacctccagcagtcgggctctttccaatactatttcctccaaggaaacgaaaagtcgggagggggatacatcgtggtggatccaatcctgagggtgggggcagacaatcacgtgctcccgctggactgcgtgactctgcagaccttcttggcaaagtgcctcggaccgttcgatgaatgggagtcacgactcagagtggcgaaggaatcaggctacaacatgatccacttcaccccgctgcaaaccttgggactgtcacgatcgtgctactcgctcgcgaatcaactggaactgaatccggatttctcccgccccaatcggaaatatacgtggaatgatgtcggacaactcgttgagaaacttaagaaagaatggaatgtgatctgtatcactgatgtcgtctacaaccacaccgcagcaaacagcaagtggatccaggagcatccggaatgtgcctacaacctggtaaattccccgcacctgaaacctgcatgggtccttgacagagccctgtggcggttcagctgcgacgtggcggaaggcaaatacaaagagaaaggaattcctgcgttgatagagaacgatcatcatatgaattccataagaaagatcatctgggaggatatattcccaaagctgaaactgtgggagttttttcaggtggatgtgaataaggccgtggaacagttccgccggcttctgactcaggagaaccgccgggtgaccaagtcagatcccaaccaacatctgaccatcattcaggacccggaatacagaaggttcggatgtaccgtcgacatgaacatagcgctgaccacctttatcccgcacgacaaaggacctgccgctatcgaagaatgctgcaactggttccacaagcggatggaggagttgaactccgaaaagcacagattgatcaactaccaccaggaacaggctgtgaactgtctcctggggaatgtcttttacgagaggttggcgggacacggacctaagctgggccccgtcactcggaagcatccccttgtgacgcgctacttcactttcccgtttgaagagatcgatttttccatggaagaatcgatgatccacctgcctaataaggcttgctttctgatggcccacaatgggtgggtgatgggggatgatcctctccgcaacttcgccgagccaggaagcgaggtgtacctgcgccgcgaattgatctgctggggtgattcggtcaaactgcggtacgggaataagcctgaggactgcccgtacctctgggcccatatgaagaagtacaccgaaatcactgctacctacttccagggtgtaaggctcgacaattgccattcaactccactgcacgtggcagaatacatgctggacgccgcacgcaatctgcagcctaacctctacgtcgtggctgaactctttaccggttcggaagacctggataacgtcttcgtgacgcgcctgggaatctcatcactgattcgggaggccatgtcagcctacaactcacatgaagaggggcgtctggtctacagatatggcggagaacccgtgggctcgttcgtgcagccttgcctccgcccgctcatgccggcgattgcgcacgccctgttcatggacatcactcatgataacgaatgtccaattgtgcaccggtccgcgtacgacgcgctgccatcgacgacgatcgtgtctatggcttgctgcgcgtcgggtagcactaggggatatgacgagttggtgccgcaccagatctccgtggtgagcgaagagcggttctatactaagtggaaccctgaagccttgccatctaacactggcgaagtgaacttccaaagcgggatcatcgctgccagatgcgccatctcgaagttgcatcaggaactgggcgccaagggtttcatccaggtttacgtggatcaagtcgacgaagacatcgtggcagtgacgaggcactcaccctccatccatcagagcgtggtggccgtgagccgcaccgcctttcgcaaccccaagacctctttctacagtaaggaggtgccgcagatgtgcatcccgggaaagatcgaagaggtggtgttggaggcccgcactattgaacgaaacacgaaaccttatcgcaaggatgagaacagtattaacgggaccccggatatcactgtggagatccgcgagcatattcaactcaatgagtcgaaaatcgtcaagcaggcaggagttgctactaagggcccaaacgaatacatccaggagatcgaatttgaaaacctgtcccccgggtcggtcatcatctttagagtctcactcgacccacacgctcaggtggccgtgggcatcctcaggaaccacctgacccagttctcgccgcacttcaagagtggctcgctcgcagttgataatgctgacccgatcctcaaaatcccattcgcctcccttgcctcacgactcactctggcggaactgaaccaaattctctacagatgcgagtcagaagaaaaggaagacggaggcggatgttacgacatcccgaactggtcggcgctgaagtacgccggacttcagggtctgatgagcgtgcttgccgaaatccgcccaaagaacgacttgggacacccgttttgcaacaatctgagatcaggggactggatgattgactacgtgtcaaacagactgataagcagatccggaactattgcagaggtcggaaagtggctgcaagcaatgttcttctaccttaaacaaatcccacgctacctcatcccttgttacttcgacgcaattcttatcggggcctacactactctgctggacaccgcctggaaacagatgagcagcttcgtccaaaatggaagcacctttgtcaagcacctgtcgctgggaagcgtgcagctttgcggagtcggaaaattcccatcactgccgatactctccccggcgctgatggatgtgccttacagattgaacgagatcactaaggagaaagaacagtgttgcgtgtccctcgctgcaggcctgccccactttagcagtggtatctttagatgttggggccgggataccttcatcgcgctgcgcggaatcctgctgatcaccggaaggtacgttgaagcgcggaatatcatcctggcattcgcaggaacgctccgccatggacttatcccaaatctcctgggagagggtatctacgctcggtacaactgccgggatgcagtctggtggtggctccaatgcattcaagattactgtaagatggtgcctaatggcctggacattctgaaatgcccggtttcgcggatgtaccctactgacgattctgccccgctgccagctggtaccctggatcagccgctgttcgaggtcatccaggaagcaatgcagaagcatatgcaaggaattcaattccgggaacgcaatgccggtccgcagatcgatcggaatatgaaggacgaaggattcaacatcactgctggagtggacgaggaaacgggctttgtctacggcggaaaccgttttaactgcggcacgtggatggacaagatgggcgagtccgaccgcgcccggaatcgcggaatcccggcgactcctcgggatggatccgccgtagagatcgtcggtctttcgaagtcggcggtgcgctggctgcttgagctgagcaagaagaacattttcccgtatcatgaggtcaccgtgaaacggcacggaaaggcaatcaaagtctcatacgacgaatggaacagaaaaatccaagataacttcgaaaagctgttccacgtgtctgaagacccgtcagacctgaacgaaaaacatccaaacttggtgcataagagaggcatatacaaagattcgtacggggcctccagcccatggtgcgactaccagcttcggccgaattttacgatcgcgatggttgtggccccggagctgttcaccaccgaaaaagcgtggaaggctctggagatcgcggagaagaagctcttgggacctcttggaatgaagactctcgacccagacgatatggtttactgcgggatctacgacaacgcactcgataatgacaactacaacctggccaagggattcaattaccaccagggcccggagtggctgtggcctattggttactttctcagggccaaactctacttctcccgcctcatggggccggaaactaccgccaagaccattgtgctggtgaagaacgtgttgtcgaggcattacgtccaccttgagcgaagcccatggaaagggctcccggagttgaccaacgagaacgcgcaatactgcccgttctcgtgcgagactcaagcctggtcgatcgctaccatcctggagactctctacgacttg

SEQ ID NO: 6062 - DNA, 4596 bp, Artificial Sequence
  Description of Artificial Sequence: Synthetic coding sequence
atgggacactctaagcagatcagaatcctgcttctgaatgagatggagaagctcgagaaaacgctgttccggctggagcagggatatgaactccagtttcggctgggtcctactctgcaagggaaggcagtcaccgtgtacacgaattacccatttccgggggaaaccttcaatcgggagaaatttcgctctctggactgggagaacccaacggagcgggaagatgattccgataagtactgcaaattgaatctgcagcagtccgggagcttccagtactacttcctgcagggaaacgagaaatctggtggtggatacatcgtggtggatccgattctgcgggtgggagccgacaatcacgtcctcccgttggactgcgtcactttgcagactttcttggctaaatgcctgggacccttcgatgaatgggagtcgaggctccgcgtggccaaggagagcggttacaacatgattcacttcactcctctgcagaccctgggactgagtcgtagctgctactcactggccaatcaactcgaactcaacccggacttcagcaggccgaaccggaagtacacctggaatgacgtggggcagctggtcgagaaactgaagaaggaatggaacgtgatttgcatcaccgacgtggtgtacaatcacactgccgctaactccaagtggattcaagaacacccggagtgtgcatacaacctcgtcaattccccacacttgaagcctgcctgggtgctggacagggctttgtggaggttctcgtgtgatgtggcggagggcaagtacaaagaaaagggtatccccgcactcatcgagaatgaccatcacatgaactccattcgtaagattatctgggaggacatttttccaaagctgaagctgtgggaattctttcaagtggacgtcaataaagcggtggagcagtttcggcggctgctcactcaagaaaacagacgcgtgactaagtccgacccgaaccaacacctgaccatcatccaagacccggaatacaggcgctttggatgcaccgtcgacatgaacattgccctgacgaccttcattccgcacgataagggcccggcggccatcgaagaatgttgcaattggttccataaacggatggaggaacttaactcggaaaagcatcgcctgatcaactatcatcaagaacaggcagtgaactgtctgcttggaaacgttttctacgaaaggctcgctggacacggaccgaagctggggccggtcacccggaaacacccgctggtgactagatacttcactttccccttcgaagaaatcgacttttccatggaggaatcgatgattcatctcccgaataaggcgtgctttctgatggcacataacgggtgggtgatgggcgacgacccgctccgcaactttgcggagccaggaagcgaagtttacctgcggagagaactgatctgctggggagactccgtaaagttgagatacggaaataagccggaggactgcccatacctctgggcacacatgaagaagtacaccgagataaccgccacgtacttccaaggagtgagactcgataactgccacagcactccactccatgtcgcagagtacatgttggatgccgcgaggaatctgcaaccgaatctttacgtggtggccgaactgttcacgggatccgaggacctggacaacgtgttcgtcaccagattggggattagcagcctcatccgggaagctatgtcagcatacaattcccacgaggaggggcgcctggtgtaccgctacgggggagagcccgtggggtcattcgtccagccatgtttgcgcccactgatgccagccattgcacatgcactcttcatggatatcacccatgataatgagtgcccgattgtgcaccggtcggcgtacgatgctcttccatcgacgactatcgtctcaatggcgtgctgcgcatcgggatccacccgaggatacgacgagctggtcccgcaccagatctctgtggtttccgaagaacggttctacaccaaatggaatccggaagccctgccatcaaacaccggcgaagtgaacttccagtcaggaatcattgcggccagatgcgcgatctccaagctccaccaggaactgggtgctaaggggtttatccaggtgtatgtggaccaagtggatgaggacattgtggccgtgacccgccacagtccatccattcatcagtcagtggtggcggtgtccaggaccgcctttaggaaccctaagaccagcttctactcgaaagaagtcccgcaaatgtgcatcccaggtaagatcgaagaggtggtcctggaggcccgcaccattgagaggaacaccaagccgtacagaaaggatgaaaacagtatcaatgggaccccggatataaccgtggagatccgcgaacacatccagctcaacgagtcaaagatcgtgaaacaagccggagtggccactaaaggcccaaacgaatacatccaggaaatcgaatttgagaacttgtcgcccggatccgtgatcatcttccgcgtatccctggacccgcacgctcaggtggctgtgggcatcctgcgaaatcatctgacccagttttccccgcatttcaagtcgggctctttggccgtggataacgccgacccgatcctgaaaattccatttgcgtcactggcatcacgcctcactctcgcggagctgaatcaaatcctctacagatgcgaaagcgaggaaaaggaggatgggggcggatgctacgatatccctaactggagcgccctgaaatacgcgggattgcaaggcctcatgtcagtgcttgctgaaatccgccctaaaaacgatctgggtcaccctttctgtaacaacctgcggtcgggagattggatgatcgattatgtgtcgaaccgtcttatcagcagatcaggcactatcgcagaagtgggaaagtggctgcaggccatgtttttctacctgaagcagatcccgcggtacctcatcccgtgctacttcgacgccattctgatcggcgcctatactacgttgcttgacaccgcctggaagcaaatgagttcgttcgtccaaaatggttcgacgttcgtgaagcatcttagcctgggttcggtgcaattgtgcggagtggggaagttcccctcactgcccatcctgagccccgccctgatggatgtcccttaccgcctgaatgagatcactaaagaaaaagaacagtgttgtgtctcactggctgccggactgccgcacttctcgtccggcatcttccgatgttggggtcgcgacacctttatcgccctcaggggaatcctcctgatcaccggtcggtacgtcgaagccaggaacattatactcgctttcgccggaactctccgccatgggctcatccctaacctgttgggagaaggcatatacgcccggtataactgtagagacgcggtgtggtggtggttgcagtgcatccaggactactgcaaaatggtgccaaacggactggacatcctcaaatgcccggtgagccggatgtacccgactgatgactctgctccgcttccagcaggaactctcgatcaaccgttgttcgaagtcatccaggaggcaatgcagaaacacatgcagggaatacagttccgcgaacggaatgcgggaccacaaatcgacagaaacatgaaagatgaaggattcaacatcactgccggcgtggacgaggaaaccggattcgtgtacgggggaaatcgctttaactgcgggacttggatggataagatgggagaatcggaccgggcccggaatcgcggcatccccgctacccctagagatggctcggccgtggaaatcgtcggactgtcaaaatccgcggtacgctggcttctcgagctttcgaaaaagaacatcttcccataccatgaggtcaccgtgaagcggcacggcaaggcaatcaaggtgtcatatgacgagtggaataggaagatccaagacaacttcgaaaagctgttccatgtgtcggaagatccatcggacctgaacgagaaacacccgaatctggtccacaagaggggaatatacaaagattcgtacggtgctagctccccctggtgcgactaccagctgcgacctaactttaccatcgccatggtcgtcgcacccgagctctttactaccgaaaaagcgtggaaagcgttggaaatcgccgagaagaagctgctcggcccacttggaatgaaaactctcgacccggatgacatggtctactgtggaatctatgacaatgccctcgacaacgacaattacaacctggcgaagggattcaattaccaccagggtcctgaatggctttggcccatcggctacttcctgcgggccaagctgtacttctcacgcctgatggggcccgagactacggcaaagaccatcgtgctcgtcaagaatgtcctgagccgccattatgtccatctcgagcggtcgccttggaaggggctgcccgaactcactaacgaaaacgcacagtactgcccgttcagctgcgaaactcaggcttggtcaatcgcgaccatcttggaaactctttacgacctg

SEQ ID NO: 6063 - DNA, 4596 bp, Artificial Sequence
  Description of Artificial Sequence: Synthetic coding sequence
atgggacactccaagcaaataaggatccttcttctgaacgaaatggaaaagttggaaaagacgctgtttagacttgaacagggttacgagttgcagtttcgtctcggtccgaccctgcaagggaaggcagtgactgtgtacactaactacccgttcccaggagagacgttcaatcgcgaaaagtttaggtcacttgattgggaaaacccgaccgaaagagaagatgattccgataagtactgtaaactgaatcttcaacaatcgggctcgtttcaatactacttccttcagggaaatgagaagtcaggagggggttacattgtcgtggacccaatactgagagtcggagcggataaccatgtgctgcctcttgattgcgtcactctccagacttttctggccaagtgcctcggtccatttgatgagtgggaatcgcgcctccgtgtggccaaggagtcaggctacaacatgatccattttactcctctgcagaccctgggcctgagcagatcatgctactcgctggctaaccaactggaactgaacccagacttttccagacccaaccggaaatacacttggaatgatgtggggcagctggtggaaaagttgaaaaaggaatggaacgtgatctgcattaccgacgtcgtgtacaatcataccgcagcaaattcaaagtggattcaggaacatcccgaatgtgcctacaacctcgttaactcgccgcatctgaagccagcgtgggtgctggacagagccctgtggcggttttcctgtgatgtggctgagggtaagtacaaggagaagggtattcctgccttgatagaaaatgaccatcacatgaactcaatccgcaagatcatctgggaggacatattccccaagttgaaactttgggaattctttcaagtcgacgtcaataaggcagtggaacaatttcggcgtctgcttacccaagaaaatcggcgggttaccaagtcagatcctaaccagcacctgactatcatacaggatccagaataccgccggtttggttgtaccgtcgacatgaacattgccctgaccacctttattcctcacgacaaaggtccagcggcaattgaggaatgctgcaactggttccacaagcggatggaggaacttaactcagaaaagcatagactgattaactatcatcaggaacaagccgtgaactgcctgcttggtaatgtcttttacgagcggctcgctggccatggcccaaagctgggcccagtgactcgtaagcatccacttgtcaccagatactttacttttccgtttgaggagatcgatttctccatggaagaaagcatgattcatttgcctaacaaggcttgttttctgatggcccataatggatgggtgatgggagatgacccacttcgcaactttgcagagccggggagcgaagtctaccttcgtagagaactgatatgttggggtgactcagtgaaactccgctacggcaataagcccgaggactgtccttacctttgggcccatatgaagaaatacactgaaatcactgcgacctattttcagggcgttcgtctggacaattgccactccacgccactccacgtggcggaatacatgttggatgccgcccggaatctgcaacctaacctgtacgttgtggctgagctctttaccggtagtgaagatctggataatgtgtttgttaccagactgggtatctcgtcacttattagggaggcaatgagcgcgtacaactcacatgaagagggacggcttgtgtataggtacggaggcgagccggtggggtcattcgtgcaaccctgcctgcgccccctgatgcctgcgattgcacatgccctgtttatggacatcactcacgataatgaatgtcccatcgttcatcgatcagcgtatgatgcgctcccttccaccaccattgtcagcatggcctgttgtgcctcgggatcaaccagaggatacgacgagctcgtgccacaccaaatttccgtcgtgtccgaggaacgcttttacaccaagtggaacccagaagcactcccaagcaacaccggggaggtgaacttccagtcgggaatcattgctgccagatgtgccataagcaagctgcaccaggaattgggtgcaaagggttttatccaagtgtacgtggaccaagtcgatgaggacatcgtcgcagtgacccgtcattcaccttcgatccaccagtcagtcgttgcagtgagcagaaccgcattcagaaacccaaaaacttccttttactcaaaggaggtccctcagatgtgtattcctggaaagatagaggaagtcgtccttgaagcaaggactatcgaacgtaatactaagccatacagaaaggatgaaaactccattaacggtactcccgatatcactgtggagattagagagcacatccagctgaacgagagcaagattgtgaaacaagccggcgtggcaaccaaaggacctaatgaatacattcaggagatcgagtttgaaaatctctcgccgggatccgtgatcatcttccgggtgtcgttggatccacacgcccaagtggcagtgggaatcctgagaaatcatcttactcagttttcgccgcatttcaagtcgggatcccttgcagtcgataatgccgacccgattctgaagattccatttgctagcttggcatcaagacttacccttgcggaacttaaccagattctctacagatgtgaatcagaagaaaaggaggacggtggaggttgttacgatattccaaactggtcggcgctcaagtacgcggggcttcagggccttatgtcggtccttgctgagattcggcctaaaaacgacctggggcaccctttttgtaacaatcttagatcgggggattggatgatagactacgtcagtaaccgattgatctcccgctcaggaactatcgcagaagtggggaagtggcttcaagccatgttcttttacctgaagcagatacctagatatctgattccttgctatttcgatgcaatactgataggcgcatacactacgctgctggacactgcatggaagcaaatgtcatcctttgtgcaaaacggatcgacgtttgtgaagcacctctcgttgggctcagtccaactgtgcggagtcggaaaattccctagcctgcctatcctgagccctgcactgatggatgtcccctaccgacttaatgaaattaccaaagaaaaggaacagtgttgtgtcagccttgccgctggcctccctcattttagctcgggtattttcaggtgctggggacgagacactttcatcgcacttcgggggatccttctcattactggtcgatacgtcgaggcaagaaacattatcctggcttttgccgggactcttaggcatggccttatcccgaacctgcttggagaaggaatatacgcacggtacaactgccgggatgcagtctggtggtggctgcagtgtattcaagactactgtaaaatggtgcctaacggactcgacattcttaagtgtcctgtgagcaggatgtacccgactgatgattcggcgccattgcctgctggtactcttgatcagccactgtttgaagttatacaggaggcaatgcaaaagcatatgcaaggtattcagtttcgcgagcggaacgccggtccacagattgatcgcaacatgaaggatgagggtttcaacattaccgccggagtggatgaagaaaccggctttgtctacgggggaaatcgctttaactgtggtacttggatggataagatgggagaatcagaccgcgcccgcaatcggggcattcccgcaactccgcgagacggatctgcagtcgaaattgtgggcctttccaaaagcgcagtgcgttggttgctggagctcagcaagaagaacattttcccataccacgaagtgacggtgaaacgccatggaaaggccatcaaagtctcgtacgatgagtggaacagaaagattcaagataactttgaaaagctgtttcacgtgagcgaggacccttccgatttgaacgaaaagcacccaaacctcgtccataagaggggtatctataaggattcgtacggggccagctcgccatggtgcgattatcagctcagaccgaactttacgattgcgatggtggtggcgcctgaacttttcaccaccgagaaggcgtggaaggcactcgaaattgcagagaagaaactgctgggacctttgggtatgaaaaccctggatcctgatgacatggtgtattgtggaatttacgataatgcgctcgacaacgataactacaacttggcaaaaggctttaactaccatcagggtcctgaatggctctggcctattggatacttcttgcgcgcaaaactgtacttctccaggctgatgggaccagaaactactgcgaaaaccatcgttctggtgaaaaacgtcctctcgaggcattacgtgcacctggaacgctcaccttggaagggtttgcctgaacttactaatgaaaacgcgcagtactgccctttttcctgtgagactcaagcgtggtccattgcaacgattcttgaaaccctgtacgatctg

SEQ ID NO: 6064 - DNA, 4596 bp, Artificial Sequence
  Description of Artificial Sequence: Synthetic coding sequence
atgggacactcaaagcaaatccgcatcctgctgcttaatgagatggagaagctcgaaaagactttgttccggttggagcagggatacgaactgcagtttcgactggggcccaccctccagggaaaggcagtgaccgtgtacactaactacccgttcccaggggaaacctttaaccgcgaaaagtttagatcgcttgactgggaaaacccaactgagcgcgaggacgactcagataagtactgcaagctgaacctgcaacagtccggctcattccagtactacttcctgcaaggaaatgagaaaagcggtggtggatacatcgtggtggacccgatcctcagagtcggggcagacaatcatgtgctgcctttggattgtgtgaccctgcagacgttcctcgcaaaatgtctgggaccgttcgatgaatgggagagccgcctgcgcgtcgcgaaggagtccggctacaacatgatacacttcaccccactccagactcttggcctctcccgcagctgctactccctcgcgaaccaactggagctgaacccagatttctctcggcccaatcgaaagtacacttggaatgatgtcgggcagctggtggagaaactcaagaaggagtggaacgtcatatgcatcactgacgtggtctacaaccacaccgccgctaattcaaagtggatccaggagcaccctgagtgcgcatacaacttggtcaactccccacacctgaagccggcatgggtgttggacagagccctttggcgcttttcatgtgacgtcgccgaaggaaagtacaaggaaaagggcatcccggcactgatcgaaaacgaccaccacatgaactcaatcagaaagatcatatgggaggatatcttcccaaaactgaaattgtgggaattcttccaggtcgacgtgaacaaagcagtggaacagtttcgccgccttctcactcaggagaatcgccgtgtgactaagtccgaccccaaccaacacttgaccattatccaggacccagaatacagacggttcggatgcactgtcgacatgaacattgctttgactaccttcattccgcacgacaaaggcccagctgccatcgaagaatgttgcaactggttccacaaacggatggaagaattgaactcggagaaacatcggctcatcaactaccatcaggaacaagcagtgaactgcctccttgggaatgtcttttacgaacggttggccggccacggaccaaaactgggaccggtgactagaaagcatcccctggtgactaggtacttcacctttcctttcgaagaaattgatttctcgatggaggaatctatgatccatctccccaataaggcctgctttctgatggcccacaatggatgggtcatgggagacgatccgctgagaaacttcgcagagccagggagcgaggtctacctcaggcgcgagctgatttgctggggtgattccgtgaagctgcgctacggaaacaaaccggaggactgtccttacctctgggcgcacatgaagaagtacaccgagatcacggctacctacttccaaggggtgagactggacaactgtcactctacccccctccacgtcgccgaatacatgcttgacgcggcccggaatctccaaccgaacttgtacgtggtggccgagctgttcaccggatccgaggacttggataacgtgttcgtcactagactgggaatctcctcgctcatccgggaagcaatgtcggcgtacaactcgcacgaggaaggccgcctggtgtacagatacggcggcgaaccagtgggttcctttgtgcaaccatgtctgcggccactcatgccggcaatcgcccacgccctgttcatggacatcacgcatgacaacgaatgcccgatcgtccacaggtcggcttacgatgcgctgccgagcaccaccatcgtgtcgatggcctgttgcgcctcgggttcaacccgcggatacgacgagttggtgcctcaccaaattagcgtcgtgtccgaggaacggttctacactaaatggaatccagaggctctcccttccaacactggagaagtgaacttccaaagcgggattatcgccgctcggtgtgccatttcaaagctgcaccaggaactcggggcaaagggattcatccaggtctacgtcgaccaggtggacgaggacatcgtagccgtgacccgccactcaccctcgatccaccaatctgttgtggcggtgtcgcgcacggctttccgcaacccaaagacttcgttctactctaaggaagtgccgcagatgtgcattcctggaaagattgaggaagtggtgctcgaagctagaaccatcgaaagaaacaccaagccgtacaggaaggacgaaaattccatcaatggaactcctgacattacggtggagatcagggagcatatccaactcaatgagtcaaagatcgtgaagcaggccggtgtcgcaactaagggcccgaacgagtacatccaggaaatcgaattcgagaacctgtcgcctgggtcagtcatcattttcagagtttcactcgatccgcacgcccaggtggccgtggggattctgaggaatcatctgactcagttctccccgcacttcaagtcgggatccctggcagtggacaacgccgacccgatcttgaaaatcccgttcgcatcgctggctagcagactgactctcgcagagctgaatcagatcctgtacagatgcgaatcagaagagaaggaagatggaggcggatgctacgatatcccgaactggagcgctcttaagtacgccggactgcaaggactcatgtcagtgctggcggaaatcagaccgaagaatgacctgggacatccgttttgcaataacctgcgctcgggagactggatgatcgattacgtgtcaaaccggctgatctcgcggtcgggaaccatcgctgaagtcggaaaatggctgcaggcgatgtttttctacctgaaacagattccccgctacttgattccttgttacttcgatgcgatcctgatcggggcctatactactctgctggacaccgcgtggaagcagatgtcatccttcgtgcagaatggttccacttttgtgaagcacctgagcctcggatctgtgcagctgtgcggagtgggaaaattcccgtcattgccaatcctgtcgccagcccttatggatgtgccttacagattgaacgagatcaccaaggaaaaggaacaatgctgtgtctccttggctgccggactgccgcatttcagcagcggaatcttcagatgttggggtcgcgacactttcatcgccctgaggggcatcctcctgatcactggacgctatgtggaggccagaaatatcatcctggcattcgctggaactctgcggcatggattgatcccaaacctgctcggagaaggaatttacgccaggtacaactgcagggacgccgtgtggtggtggctccagtgtattcaagactactgcaagatggtgccaaatgggctggacatccttaaatgcccggtgtccaggatgtacccaaccgatgacagcgctccacttcctgccggtaccctcgaccagccgttgtttgaagtgatccaggaagccatgcagaaacatatgcaaggtatccaatttagggagcgaaacgcgggaccacagatcgaccggaatatgaaggatgagggattcaatatcaccgccggagtcgacgaggaaaccggattcgtgtacgggggaaaccgcttcaattgcggcacctggatggataagatgggtgaatccgaccgggcccgcaacagaggtatcccagccactcccagggatggatcagcggtggagatcgtcggattgtcgaaatctgcggttcgctggctgctggagctttccaagaagaacatcttcccataccatgaagtgaccgtgaagaggcatggcaaggcgattaaagtctcgtacgatgagtggaaccggaaaatccaagacaacttcgagaagctgtttcatgtgtcggaggacccgagcgacctgaacgaaaagcatccgaacctggtccataagagaggaatctacaaggactcctatggcgcatcatcaccctggtgcgactaccagttgcgcccaaatttcaccatagccatggttgtggccccggagctgtttactaccgaaaaggcttggaaggccctcgagatcgccgagaaaaagctcttgggcccgctcggcatgaaaacgctggacccggatgacatggtgtactgcgggatctatgacaatgctctggataatgacaattacaacctcgccaagggattcaactaccaccagggaccagaatggctgtggcctatcggatactttctgcgggccaagttgtatttctctcgcctcatgggtccggaaaccacggcaaagactatcgtgctcgtcaaaaacgtcctgagccggcactacgtccacttggaaagaagcccgtggaagggactcccagaactcacgaacgaaaacgcgcagtactgcccgttctcctgcgaaactcaggcttggtccatcgcaactatcctggaaaccctgtacgacctg

SEQ ID NO: 6065 - DNA, 4596 bp, Artificial Sequence
  Description of Artificial Sequence: Synthetic coding sequence
atggggcattcgaagcaaattcggattcttctgctgaacgagatggagaaactggaaaaaaccttgtttaggctggaacagggttacgaattgcaatttcgtttgggacctactcttcagggaaaagcagtcaccgtctacaccaactacccatttcccggcgaaactttcaatcgcgaaaagtttcgaagcctcgattgggaaaatccaactgagcgcgaagatgattcggataagtattgtaaacttaatcttcaacaaagcggctcatttcaatactacttcctgcagggaaacgaaaaatcgggagggggctacattgtggtagatcctattttgagagtgggagcagacaaccacgtgctccccctggattgtgtcacccttcaaacctttctggctaagtgtctgggtccctttgacgaatgggagtcacgtctgagggtcgcaaaggagagcggttataacatgattcattttacccctcttcaaaccctcggcctttcacgcagttgctattcgctggcgaatcagcttgagcttaaccctgacttctcgcgaccaaatagaaaatacacctggaacgacgtgggtcaactggtggaaaagctcaagaaagagtggaacgtgatctgcattaccgatgtcgtctacaaccataccgcagccaacagtaagtggattcaggaacatcccgaatgtgcatacaatctggtgaatagcccccacctgaaacctgcctgggtgttggatagagctttgtggcgtttttcttgtgacgtcgcggaaggaaagtacaaggaaaagggtattcctgcactcattgagaacgaccatcacatgaactccattcgcaagattatctgggaggacatttttccgaaacttaaactttgggagttttttcaagtggatgtgaacaaggcagtggaacaattcagacgtttgctcacccaggagaatagaagagtgactaagtccgaccccaaccagcatctgacgattatacaagatccagagtaccgtaggttcggctgtactgtggatatgaacatcgcgcttaccaccttcatccctcatgataagggtcccgcggcaattgaggagtgttgtaactggtttcacaagaggatggaagaactgaactccgagaagcaccggttgatcaactatcaccaagagcaggcagtcaattgtctgctgggaaacgtgttctacgaaagactcgcaggacatggcccaaagctcggaccagtcacgaggaagcatcctctcgtgactaggtactttactttcccctttgaagaaatcgacttttcaatggaagaatcgatgatccacctccctaacaaagcatgtttcttgatggctcacaatggatgggtgatgggtgacgatccactgaggaactttgccgaacctggctcggaagtctacctgcgaagagagttgatttgttggggtgattctgtcaaactgcgctacggaaataagcctgaagattgcccatacctgtgggcgcatatgaagaagtatactgaaataaccgcaacctacttccaaggagtgagactcgataactgtcattcaacccctctgcatgtcgccgaatacatgcttgacgcggcacgcaaccttcaacctaatctctacgtggtcgcggagttgtttactggttctgaggatcttgacaacgtgtttgtgacccggcttggtattagctcgctgatacgggaagcaatgtcggcatacaactcgcatgaagaaggtcgactcgtctacagatacggcggggaacccgtggggtccttcgttcagccctgcctgcgaccacttatgcctgctattgcacatgcgttgtttatggacataacccacgataacgagtgccctattgtgcatcgaagcgcctacgacgcccttccatccactaccatcgtgtccatggcatgttgcgcctcaggctcgacgagaggatacgatgaactcgtcccacatcagatttcggttgtgtcggaagaaaggttctacaccaagtggaatccggaggcacttcctagcaataccggtgaagtgaatttccagtccggtattatcgcagccagatgtgccatttcgaaacttcaccaggaactcggcgccaagggattcattcaggtctacgtggaccaagtggatgaggatattgttgccgtgacgagacatagcccctcgatccaccagtcagttgtcgccgtctcacgaactgcattccggaatcccaagacctccttttactctaaggaggtaccccaaatgtgtatcccagggaagatcgaagaggtggtgttggaggcacgcaccattgagcggaacacgaagccttacagaaaggatgagaatagcataaatggtactcctgatatcacggtggagattcgtgagcatatccagctcaatgaatcgaaaatcgtgaagcaagcgggagtggctacgaaaggaccaaacgaatacatacaggagattgagtttgaaaatctctctccaggttcagtgataatcttccgtgtgtccttggatccccatgcgcaagtcgcagtgggaattcttcggaaccaccttactcaattctcaccacatttcaaatcgggatccctggccgtggacaatgcagacccaatcctgaagatcccatttgcttctcttgccagccggcttaccttggccgaactgaatcagatcctctaccgctgtgagagcgaagaaaaggaagatggtgggggatgttacgatattccaaactggtccgccctgaaatacgccggactgcaaggactcatgtctgtgcttgccgaaattcggcctaaaaacgaccttggacacccattttgcaacaaccttcgatcaggagactggatgattgattacgtgtcgaatcgtttgatttcaaggtccggtaccatcgccgaagtgggaaagtggctgcaagctatgtttttctatctcaaacaaatcccgcgttaccttatcccttgctacttcgatgctatattgataggagcttacactactctcctcgacactgcatggaagcagatgtcatcgtttgtgcagaacggatccacctttgtgaagcatctttccctcggctcggtgcaactgtgcggggtgggaaagttcccctccctgcctatcctctcaccggcacttatggacgtgccttaccgtctgaacgaaattacgaaggaaaaggaacaatgctgcgtgtccctggcggcaggacttcctcatttcagctccggtatctttagatgttggggaagagacacgtttatcgcactcaggggaattctcctgatcaccggccgatatgtcgaggcacggaacatcatcttggcctttgccggcaccctgagacatggtcttataccaaaccttttgggcgaaggcatctacgcacggtacaactgtcgagatgcagtctggtggtggctgcagtgcattcaagattactgtaagatggtgcccaatggccttgatattctgaagtgtccagtctccagaatgtatccgactgatgacagcgcccctctgcctgccggaacgctcgatcagccattgttcgaagtcatccaagaggcaatgcagaaacacatgcaaggcatccaatttagagaacgcaacgcaggtccgcaaattgacagaaatatgaaggatgaaggttttaacattaccgcaggagtcgatgaggagactgggtttgtgtacggaggcaatcggttcaattgtgggacttggatggataagatgggtgagtcggacagggcacggaatcgcgggattccagcgaccccccgagatgggtccgccgtggagatagtgggtctgtccaaatcagccgttcggtggctcctggaactctccaaaaagaacatctttccttaccacgaggtgactgtcaagcgtcatgggaaagcgattaaggtgtcttacgatgaatggaacagaaaaatccaagacaacttcgaaaagctgtttcacgtgagcgaagatcctagcgacctgaacgaaaagcatcctaacctggtgcacaaacggggaatttacaaagattcatacggcgcctcatccccatggtgcgattaccagctcagaccgaatttcaccatcgcaatggttgtcgctcctgaactttttacgactgaaaaggcatggaaggctctggaaatagcagagaagaagttgctggggcccctgggcatgaaaaccctggatccagatgacatggtctactgtggtatttacgacaacgcattggataatgacaattacaacctggcaaagggattcaattatcatcaaggacctgaatggctttggccgatcggttactttctgagggcaaaactttacttttcaaggctgatggggccggaaaccactgccaaaaccattgtccttgtcaagaatgtactgtcgagacattacgtgcaccttgagagatcgccatggaagggattgcccgaactgactaacgagaatgcgcagtactgccctttttcatgtgaaactcaggcatggtccatcgcaacgatactcgagactctctatgatctc

SEQ ID NO: 6066 - DNA, 4596 bp, Artificial Sequence
  Description of Artificial Sequence: Synthetic coding sequence
atggggcattccaagcaaatcagaatccttctgttgaatgaaatggaaaaactcgaaaagacgctctttagacttgaacagggttacgagctgcagtttagactgggacctactctgcagggcaaagcagtgactgtctacactaattacccatttcccggcgaaacctttaaccgtgagaagtttcgcagcctggactgggaaaatcccactgaaagagaggatgattcggataagtattgtaagctgaacctgcaacaatccggcagctttcagtactactttctgcaaggtaatgaaaagagcggtggagggtacattgtggtcgatcctatacttcgggtgggtgcagataatcatgtgctcccgttggattgcgtcacgctgcaaacttttttggcaaagtgcctgggaccttttgatgaatgggagtcaaggctgagggtggctaaggagtcaggatacaacatgatccacttcactccactccaaactctggggctctcccgatcctgctactcccttgctaaccagctggaacttaaccctgacttctcaaggcctaatagaaagtacacttggaacgacgttggccaactggtggaaaagctcaagaaggagtggaacgtgatttgtataaccgatgtcgtgtacaaccatacggcggcaaatagcaaatggatacaagagcatccggaatgcgcgtacaaccttgtgaattcgcctcatttgaagcctgcatgggtgctggatcgggcgctgtggagattcagctgtgacgtggccgaaggcaagtataaagaaaagggaattcctgcccttatcgaaaacgatcatcatatgaactctattaggaagattatctgggaggatatctttccaaaacttaaactctgggaattctttcaggtcgacgtgaacaaggctgtggaacaatttcgtcgcctgctgactcaggaaaatcgcagagtgacgaaatcagatccgaaccaacaccttaccattattcaagatccagaatacaggcgatttgggtgtaccgtcgacatgaacattgcactgaccactttcattccacatgataagggcccagcagcaattgaggaatgctgtaactggtttcacaaacgaatggaagagctgaactcggaaaagcatcgactgataaactaccaccaagagcaagcagtgaattgtctgctgggcaacgtcttttacgaaagactcgcaggacatggaccaaagctgggacctgttacccgcaaacatcctctggtgacccggtactttactttcccctttgaagagattgacttctcgatggaggaatccatgattcatttgcctaacaaggcatgctttctgatggcacataacggatgggtgatgggagacgatccgttgagaaactttgccgagcctggttccgaggtgtacctgcggagggagctgatatgttggggtgattcagtgaagctcagatacggaaacaaaccggaagattgtccctatctgtgggcacacatgaagaagtacaccgaaatcactgcgacgtacttccagggggtgaggctcgacaactgtcactctacgcctcttcatgttgctgaatacatgcttgatgcagccagaaacctgcagccaaatctgtacgtagtggccgaactgtttaccggctccgaggaccttgataatgtgttcgtgaccagacttggcatctcgtccctgattcgcgaagcaatgtcggcatacaactctcacgaggagggtcggctggtctatcgctatggaggagaacctgtgggttcgtttgtccagccttgtctgcgcccactcatgcctgccatagcgcatgcattgttcatggatattactcacgacaacgaatgtccaatcgtccatcgctctgcatacgacgcacttccctcgacgaccattgtctcaatggcgtgttgtgcatccgggtccacccgtggatatgacgagctggtgccgcatcaaatttctgtggtgtccgaggagagattctacaccaaatggaatcctgaagcgctgcccagcaacactggtgaggtgaacttccagagcgggatcatcgcagcaagatgcgcaatctcaaaactgcaccaagaacttggagccaagggttttatccaagtgtacgtggaccaggtcgatgaggacattgtggccgtgacgaggcacagcccttcgattcatcagtcggtcgtcgcggtcagccgtaccgcctttcgcaacccaaagacttccttttactccaaagaggtgcctcaaatgtgcatccctggaaagattgaagaagtggtccttgaggccaggaccatcgaacgcaacaccaagccttaccgaaaggatgaaaattctataaacggaactcccgacatcactgtggaaattcgtgagcacattcaattgaacgaatcaaagatagtgaaacaggcaggtgtcgcgaccaaaggcccaaacgaatacattcaggagattgaatttgaaaatctgtcgccaggatcagtgatcattttccgggtcagcctggatcctcacgcgcaggtggctgttggcattctcaggaaccatcttactcaattctcccctcactttaagtcggggtccctggcggtggataatgccgacccgatcctgaagatcccatttgcatccctggcatccagacttacgcttgcagaacttaatcaaatcctttaccgttgtgaaagcgaagagaaggaggacgggggcgggtgttacgatattcctaattggtcggcattgaagtacgcgggacttcagggacttatgagcgtgctggcagaaatccgaccaaagaatgatctcggccacccattctgtaataacctgaggtcgggggattggatgattgattacgtgtccaaccggctgattagccgttccggtaccattgccgaagtgggaaaatggctgcaggccatgtttttctatctcaagcagataccgcgctaccttattccatgttacttcgacgccattctcatcggtgcctacaccactttgctcgatactgcatggaagcaaatgagctcgtttgttcaaaatggatccacgttcgttaagcatctgtcgctgggcagcgtgcagctgtgcggggtcggaaaattcccaagccttcctattctttcgccagcacttatggatgtgccctacagactgaatgaaatcacgaaggaaaaagagcaatgttgtgtgtccctcgccgccggattgccccatttctcctcgggaatctttaggtgctggggtcgtgacacttttatcgccctgaggggaattctgctgattactggaagatacgtcgaggcccgtaacatcatacttgcgtttgccggcacccttaggcacggtctgattcccaacttgcttggcgagggtatctacgcgcgctacaattgtcgggacgcagtctggtggtggctccagtgcatccaggattactgtaagatggtgcccaacggtctggatattctcaagtgcccagtgtcgcggatgtaccctaccgatgactcagcaccccttccggcaggaaccctcgatcagcctttgtttgaggtgattcaggaagctatgcaaaagcatatgcagggtattcaatttagagaaagaaacgcaggaccacaaattgacaggaacatgaaagatgaaggtttcaacattaccgcaggagtggatgaagagactggatttgtgtacggcggcaatagattcaattgtggaacctggatggacaagatgggtgaatcggatagagcaagaaaccgaggcattccggcaacccctagagacggatctgccgttgaaatcgtgggcctgagcaaatccgcggtccgctggctgctggaattgtcgaaaaagaacatcttcccgtatcatgaggtgacggtgaaaaggcacgggaaagcaattaaggtgtcctacgatgaatggaatcggaagatccaagacaattttgagaagctgtttcatgtctcggaggacccttcggatctgaacgaaaagcaccccaatctcgtccacaagcgaggaatatacaaagactcgtacggggcgtcctcaccatggtgcgattaccaattgcggccaaatttcacgatagctatggtagtggctcctgaactgttcaccacggagaaggcctggaaggcactggaaatagctgaaaagaagctgctgggaccactgggtatgaaaacgctggatcctgatgatatggtttactgcggtatttacgataatgcacttgacaacgacaattacaaccttgcaaaggggttcaattaccatcagggtccagagtggctgtggccaataggctacttcctgagggcaaaactttacttctcgcggctgatgggtcctgagactaccgcaaaaaccatcgtgctggtcaaaaacgtgctgtcgaggcactatgtccatttggagagatcgccttggaagggactccctgagctcactaacgaaaacgcccaatactgtccctttagctgcgaaacccaagcatggtccatagctactatactcgagactctgtacgatctc

SEQ ID NO: 6067 - DNA, 4596 bp, Artificial Sequence
  Description of Artificial Sequence: Synthetic coding sequence
atgggacactccaagcagattagaatcctgctgctcaacgagatggagaagcttgagaaaaccctcttcagactggagcagggctacgagctgcagtttagactgggtcctactttgcaaggaaaggccgtgaccgtctacaccaactaccccttccctggtgaaacgttcaaccgcgagaagttcaggtcccttgactgggaaaatccgacagagcgcgaagatgattccgacaaatattgcaagcttaatcttcagcagagtggttcatttcagtactatttcctgcagggaaacgagaaatccggaggcggatacatagttgttgaccccattctgcgcgtgggcgcggataaccacgtcctgcctctggattgtgtcacacttcagacattcctcgctaaatgtctgggaccgtttgacgagtgggaaagtagactcagggtggccaaggagtccggttacaatatgatccatttcacacccctgcagacactgggtctctccaggagttgttactccttggccaaccagctggaacttaaccccgacttctcaaggcctaataggaagtatacgtggaatgacgtgggtcaactggtcgaaaagctcaagaaggaatggaacgttatctgcataacagatgtagtttacaatcacacagctgctaatagtaaatggatccaagagcacccagaatgcgcgtacaacctggttaactcccctcacctgaagccggcctgggttctggatagagccttgtggcgcttctcttgtgacgttgctgagggtaagtacaaagaaaaaggaatcccagcactgatagagaacgaccatcacatgaacagtattaggaaaattatctgggaggatatatttcctaaactgaagctctgggaattctttcaggtggacgtgaataaggcagtcgaacaatttagacgccttttgacacaggagaataggcgcgttaccaagagcgacccgaatcagcatctgacgataatccaggaccctgaatataggaggttcggttgtaccgttgacatgaacatcgccctcaccacttttatccctcacgataagggccccgcggctattgaggagtgctgtaattggttccataagagaatggaggagctcaactctgaaaaacaccgccttattaattaccatcaggaacaagctgtcaattgtctgctcggcaacgtcttctacgagcgcctggctggacacggtcctaagttgggtcccgtgacccgcaagcacccacttgtgaccagatacttcaccttccctttcgaggaaatcgatttcagtatggaggagagcatgattcaccttcccaacaaagcctgctttctcatggcacataatggatgggtgatgggagatgaccccttgcgcaatttcgcagagccaggttccgaggtgtatcttcgcagagagctcatatgttggggagatagcgtcaagctgagatacggaaacaaaccagaggactgcccctacctctgggcccatatgaaaaagtatactgaaatcaccgcaacgtactttcagggcgttagactggataactgtcatagtactccattgcatgtggctgagtatatgctggacgccgcaaggaacctgcagccaaacctctatgtggttgccgagcttttcacaggaagtgaagacctcgacaacgttttcgtgaccaggctgggcatcagctcactgatcagggaggccatgtctgcctacaacagccacgaagagggacgcctggtgtaccgctatggcggtgagccagtcggctccttcgtgcagccttgcttgaggcccctgatgcccgctatagcccacgcccttttcatggacataactcacgataacgaatgccctatagttcataggtccgcctatgacgcactgccaagcacaaccatcgtaagtatggcctgttgtgcttctggatcaacccgcggttacgacgagctcgtgccccatcagatttccgtggtgagtgaggaaagattttataccaaatggaatcctgaggccttgccttcaaacactggtgaagtcaactttcaatctggtatcatcgcggccagatgtgctatcagcaagctccatcaggagttgggagcaaagggcttcatacaggtctacgtagaccaagtagatgaagacattgttgcagtaacacgccacagtccatctatccaccagtctgtggttgccgtttctagaactgcttttcgcaatcctaaaacgagcttctactcaaaggaagtaccccagatgtgtatccccggaaaaattgaggaggtggtgctggaggcaagaaccatcgagagaaacacaaaaccgtaccgcaaggacgagaatagcatcaacggaacccccgatatcacagtcgaaatcagagagcacatccagctgaatgagtccaaaatagttaagcaggccggcgtggccacaaagggcccgaacgagtacatccaagaaatcgaattcgagaatctttccccgggctcagtcataatattccgcgtgtctctggacccacatgcccaggtggccgtgggtattctgagaaaccacctcactcagttcagcccccacttcaaatctggatccttggcggtggataatgctgacccaattttgaagatcccattcgcgagcctcgcgagccgcctgacactggcggaactgaaccagattctgtataggtgcgagagcgaagaaaaggaggatggtggcggctgttatgatatccctaattggtctgcactgaaatatgcgggcctccaaggactcatgagcgtgttggctgagattagaccaaagaacgatctgggccaccccttctgcaacaatctccgctccggagactggatgatcgattacgtatctaaccgcctgataagccgcagcggtacaattgcagaggtgggtaagtggctgcaggccatgttcttttatttgaaacagatccctagatacctcatcccatgctacttcgatgccatactcattggtgcttacaccaccctgctcgatactgcctggaagcagatgtcctctttcgtgcagaacggtagtactttcgtgaagcatcttagtctgggctcagtccagttgtgcggtgtcggcaaatttccttccctccccatcttgtcacctgcattgatggacgtaccttacagactcaatgagatcacaaaggagaaggaacaatgctgcgtttcactcgcagcaggactgccgcacttttcatctggtatctttaggtgctggggcagagacaccttcatcgccctcaggggcatcctcctgatcacaggtcgctatgtcgaagccagaaacatcattctcgcatttgccggtaccctgaggcacggtctcattccaaacctgctgggcgagggtatctacgcgagatataattgcagggatgctgtctggtggtggttgcagtgcatccaggactattgtaagatggtccccaatggtttggatatcctgaaatgtcctgtgtctaggatgtatccaactgatgactctgctcctctgcccgccggaactctggatcagcctctctttgaagtaattcaagaggccatgcaaaagcacatgcagggtattcaatttcgcgagaggaatgctggcccccaaattgacaggaacatgaaagatgagggatttaacattactgccggtgtggatgaggagaccggtttcgtctacggaggcaataggttcaactgtggcacttggatggacaaaatgggtgagtctgacagggcaaggaataggggaatccctgctaccccgagagacggaagcgccgtggagatcgttggtttgtcaaagagcgcagtgagatggctgttggaattgtctaaaaaaaacatcttcccctatcacgaagtcaccgtgaagcgccacggaaaggcaattaaagtgtcttatgatgagtggaacaggaaaatacaggataacttcgaaaaactgttccacgtgtccgaagacccctcagacctcaatgagaagcatccaaatctcgttcataagcgcggcatctacaaagattcttacggagctagctccccgtggtgtgactatcagttgaggccaaacttcactattgctatggtcgttgcgccagagttgttcactactgagaaagcctggaaggcactggaaatcgccgagaaaaaactgctgggcccacttggcatgaagacgctggaccccgacgatatggtgtattgtggtatctacgataacgctctcgataatgataactataaccttgcaaaaggtttcaattaccaccagggccccgagtggttgtggcccatcggttacttcctgcgcgcgaagctctatttttctagactgatgggacccgagactactgcgaaaacaatcgttttggttaaaaatgtgctcagtaggcattacgtccacctcgagagaagtccttggaagggcctgccagaactgaccaacgaaaacgcgcagtactgcccattttcttgcgaaactcaggcatggagcattgctactatcctcgagaccctgtacgacctg

SEQ ID NO: 6068 - DNA, 4596 bp, Artificial Sequence
  Description of Artificial Sequence: Synthetic coding sequence
atgggccattctaaacagatcaggattctgcttcttaatgagatggagaaattggaaaagacactgttcagactggagcagggctacgagctccaattcaggctgggacccacactgcagggcaaagcagtgacggtctataccaactacccattcccaggggagacttttaacagggagaagttccgaagcctcgattgggaaaacccaacggagagagaagacgattccgacaaatactgcaagcttaacctccaacagagtggcagttttcagtattacttcctccagggcaatgagaaaagcggcggagggtacatcgttgtggatcctattttgcgagtcggcgcggacaaccatgtactgccattagattgcgtgactctgcagacctttctggctaagtgtctaggcccctttgacgagtgggaaagcaggttgcgcgtcgccaaagaatcagggtataacatgatccatttcacgccccttcagacacttggtctgagcagatcttgctactctcttgccaatcagctcgaacttaaccctgatttttcccgccctaacaggaagtatacatggaatgacgtcggtcagttggtagaaaaactaaagaaagagtggaacgtcatttgcataacagacgtggtttataatcataccgccgcaaattcaaagtggattcaagagcaccctgaatgcgcatacaatctggttaactcgccccaccttaagccggcatgggttcttgaccgggcattgtggagattctcttgtgatgtcgcggaagggaaatacaaggagaaagggatcccagccctgattgaaaatgaccatcacatgaactccatcagaaagattatctgggaagacatattcccaaaattgaagctatgggagtttttccaggtggatgtgaataaggcagtcgagcagtttcgacggctgttgacacaagaaaatagacgagtgactaagtccgaccccaaccaacatctcaccattatccaggaccctgagtacagaagattcgggtgcaccgtcgacatgaatatcgctttgacaacctttatcccccatgataagggccctgctgccattgaggagtgctgcaattggttccataagagaatggaggagctgaacagtgaaaagcatagattaatcaactaccaccaggaacaagcggttaactgcctcctggggaacgtcttctatgagcggctggccggacatggacctaaacttggtcctgtgaccagaaagcatcctctagtcaccagatatttcacctttccttttgaggaaattgacttctccatggaggaatctatgattcacctgcctaacaaggcgtgcttcttgatggcccataacgggtgggttatgggggatgaccctctgaggaactttgccgaaccaggatctgaggtgtatctgcgacgagaattgatatgctggggcgactctgtgaagctccgatacgggaacaaacccgaagactgcccctacctttgggcccacatgaagaaatatacagagatcacagcaacttattttcagggcgtgaggctggacaactgccacagcacccctctgcacgtggctgagtacatgttggacgcagccaggaacttacagcccaacttgtacgtcgtagccgagctctttactggctctgaggacttagacaacgttttcgtgactcgtctgggtatcagttctttaatacgcgaagcaatgagcgcctataactctcacgaagaggggcgtctagtatacagatacggcggcgagccagtcggctcctttgtccagccctgcctccgacctctcatgcctgccatcgcccacgctctgttcatggacattacccacgacaacgagtgtccaattgtacataggagtgcctacgatgccctgcctagcaccacaatcgtttcaatggcttgctgcgcttcagggtctactagaggctatgatgaactggtgccgcaccagattagcgtggtgtctgaagagaggttttacaccaaatggaatcctgaagcgctgccatcaaacacaggggaggttaatttccagtctggcatcatcgccgctcgttgcgcaatcagcaagcttcatcaagaactcggggccaaaggcttcatacaggtgtacgtagaccaggtagatgaagacatcgtcgctgtgactcggcactcaccaagcattcaccagtccgtcgtggcggttagtaggacagcttttcgaaacccaaagaccagtttctactctaaggaggtgccacagatgtgcatccccgggaagattgaagaggtggtgcttgaggcaaggacgatagaacgaaatactaagccctaccggaaagacgaaaattcgataaacgggacaccagatattaccgtggagatcagagagcatattcaactaaatgaaagtaaaatcgtgaagcaggccggcgttgcaacaaagggccccaatgaatacatccaggaaattgagttcgaaaatctgtcccccggtagcgtgataatttttagggtctcactagaccctcacgctcaggtcgccgtaggcatcctgcgaaatcatttaacccagttcagcccgcattttaagagcggcagcctcgccgtggacaatgcagatcctatactgaaaattcctttcgcatcgctcgcatcccgattaacattggcagaactcaaccaaatactctaccgatgcgaaagcgaggaaaaggaagacggggggggttgttatgatatcccgaactggtctgccctgaagtacgctggcttgcaagggctgatgagcgttctggcggaaataaggccaaagaatgacttgggccatccgttctgtaacaacctgagatcaggcgattggatgatcgactacgtgagtaatcgactgatttcacgaagcggtacaatcgcggaagtcggaaaatggctacaggcaatgtttttttatctaaagcagatcccacgatatctcattccctgttacttcgacgcaattctcatcggggcgtacaccactctgctggacacggcctggaaacaaatgagtagtttcgtgcagaacggatcgaccttcgtgaaacatctttctctgggctcggttcagttgtgtggtgtgggcaaatttccaagcctgccaatcctctcgccagctttaatggatgtgccataccgattgaatgaaatcacaaaagagaaagaacagtgctgtgtttccctcgcagccggtctccctcattttagcagcggcatcttccgatgctgggggagggatactttcatcgccctgaggggtattctgctcataaccgggagatacgttgaggctcgaaatattatcttggctttcgctggcacgttacggcatggcctgatacccaatttgcttggagaaggaatttatgccaggtataactgccgagatgctgtctggtggtggcttcagtgcatccaggattactgcaagatggttccaaatgggctggatatcctgaagtgcccagtaagccgaatgtaccccaccgacgacagcgcccccctcccagccggtaccctcgaccagcctttgttcgaagtgatacaggaggcaatgcagaaacacatgcagggaatccagttccgtgaaagaaacgctggacctcagatagaccgtaacatgaaggatgaaggattcaacatcacggccggggttgacgaagagaccgggttcgtctacgggggtaatagattcaattgtgggacctggatggataagatgggagagtctgacagagctcgcaacagaggcattccagctactcctcgagacggctctgcagttgagatcgtggggctgagcaagtctgccgtcagatggctccttgagctgtccaaaaagaatattttcccctatcatgaggtgactgtgaagcggcatgggaaggcaattaaagtctcttacgatgaatggaaccggaagatccaggacaactttgagaaactcttccatgtgagtgaggatcctagcgacctcaatgaaaagcacccgaacttggtgcacaaaagagggatttacaaggattcatacggagccagctcaccctggtgcgactaccagttaaggcctaacttcaccattgccatggtggtggccccggaactatttacaacagagaaggcttggaaggccctcgagattgccgaaaagaagctcctcgggcctcttggcatgaagaccctcgacccagacgatatggtgtattgcgggatctatgacaacgcacttgacaacgataattataacttggccaagggctttaattaccatcagggacctgagtggctgtggcctatcggttacttcctacgggccaaactgtatttctcacggcttatgggtccagaaaccactgctaagaccattgttctagtaaagaatgtcttgtctaggcactatgtccacctggaacgatccccatggaaaggcttgccagaactgacaaacgagaacgctcagtactgccccttctcatgcgagacacaagcatggtctatagccaccattcttgagacactgtacgacctg

SEQ ID NO: 6069 - DNA, 4596 bp, Artificial Sequence
  Description of Artificial Sequence: Synthetic coding sequence
atgggacacagcaagcagattcggattctgctgctgaatgagatggaaaagttggaaaagaccctctttcgcttggagcagggatacgaattgcaattcaggctcggtcccacactgcagggaaaggccgtgactgtgtacacgaactatccattcccaggtgagactttcaacagggagaaatttaggtccctggactgggagaaccctaccgagagagaagatgactctgataagtactgcaagctgaatctccaacagtcaggctcgtttcagtactactttcttcagggcaacgaaaaaagcggtggcgggtatatcgtggtggaccccattcttagggttggagcagacaatcatgtactgccgctcgactgtgtcactcttcaaactttcctcgctaagtgcctcgggcctttcgacgagtgggaaagtagactcagggtggctaaggaatctgggtataatatgattcacttcaccccactccaaacactgggcctatcgcggtcatgttattcgctggccaaccagctagaactcaacccagattttagtagacccaaccggaagtacacatggaacgacgtggggcaacttgtcgagaagctgaaaaaggaatggaacgtgatctgcatcacagacgtggtctataaccacaccgcggcaaattctaagtggatccaggagcaccccgaatgtgcctacaatctggtcaactccccccatctcaaacccgcctgggtgcttgacagagcactctggcgattctcctgtgatgtggctgagggcaagtacaaagaaaaaggtatcccagccctgattgagaatgaccatcatatgaattctattcggaagatcatatgggaagacattttccctaagttaaaactgtgggagtttttccaggtggatgttaataaagctgtcgagcagtttcgccgtctattgacgcaggagaaccggcgagtcactaagtccgaccctaaccagcaccttacaatcattcaggacccggaatatcggcgcttcggatgtaccgtggatatgaacatcgccctaactactttcattcctcatgataagggaccagcggctatcgaagaatgctgcaactggttccacaagaggatggaagaattaaatagcgagaaacatcgtcttattaactaccaccaggaacaggccgtgaattgcctgttgggaaatgtgttctatgaacgcctcgcgggacatgggccaaaactggggcctgtcacacggaagcaccccctggtgactaggtattttacttttccctttgaggagatagatttttcaatggaggaatcaatgatccacttgcctaataaagcttgcttcttgatggctcataatggctgggtgatgggcgacgaccccttacgcaacttcgctgagcccgggtccgaagtgtacctgagacgtgaactaatatgctggggagactccgtgaagcttcggtatggcaacaagcctgaggattgtccctatctgtgggctcacatgaagaagtatacggaaatcaccgcaacatacttccagggcgtcagactggacaattgtcattccacgccgctccatgtcgccgagtacatgctagacgctgcgaggaatctccagccaaacctctacgtggtcgccgagcttttcacaggatccgaagacctcgacaacgtgttcgtgactcggctcgggattagtagccttattcgggaagcaatgtctgcttacaattcccacgaggaggggcgactagtttataggtacggtggtgaacccgtcgggtcttttgtccaaccatgtttaagaccccttatgcctgctattgctcacgccttgttcatggatattacccacgacaatgaatgccccatagtgcatcggtcagcttacgatgcattgccttctactacaattgtgtcaatggcgtgttgtgcgagcgggtcaaccagaggctacgatgagctcgtaccacaccagattagcgtggtgtctgaagagcgcttttatacaaaatggaatcccgaagctctccctagtaacactggggaggtgaactttcagtctggcatcatcgctgcccggtgtgctatctctaaactccaccaagagttaggggctaaaggctttatccaggtgtacgttgatcaggtagacgaggacatcgtggctgtgacacggcactctccctcaatccatcagtccgtcgtcgcagtgtctcgcaccgccttccgaaatccgaagacgagtttctacagcaaggaagtgccccagatgtgtattcctgggaaaatagaggaagtagtgcttgaagctagaacgatagagcggaatacgaagccttatcggaaagatgagaactccatcaacggcacacctgatatcactgtggaaatccgggagcatatacaactgaacgagtctaagatcgtgaagcaggctggggtcgcgacaaagggccccaatgagtatatccaggagatagaattcgaaaatctgagcccaggctccgtgatcatcttccgggtatcgctagacccccacgcccaggttgctgtgggcatcctgagaaatcatctcacgcagtttagccctcattttaagagcggatctttggcagtggataacgctgaccccattctcaagattccctttgcgtcactggccagccggttaaccctggctgaactgaaccagatattatatcggtgcgagtctgaggaaaaagaagacgggggtgggtgttatgatatccctaattggagcgcactgaagtatgcagggctgcaaggactgatgagcgttcttgccgaaataaggcctaagaacgatctgggtcatccgttttgtaataacttgcggtccggagattggatgatcgactatgtcagcaatcgactaatatcgcgatccggaaccatcgctgaggtcgggaaatggcttcaggccatgttcttctacctcaagcagatcccccggtacctgattccttgttattttgatgcaatactcattggggcatacacgaccttactggacacagcgtggaagcagatgtctagtttcgtccagaacggctccactttcgtgaaacatttgagcttgggaagcgtgcagctatgtggtgtgggcaaatttccaagccttcctatcctaagcccagcgctgatggacgttccataccgactaaatgaaatcaccaaagagaaggaacagtgctgcgtgagcctggctgccgggctgccccacttcagctctgggattttccggtgctggggcagagatacgttcatcgctctccggggcatactgttaattactgggcgctacgtggaggctagaaacatcatcctggccttcgccggaactctaaggcacgggctgatccctaatttactgggcgagggcatatatgccagatataactgccgggatgcggtctggtggtggctgcagtgtatccaggactactgtaagatggtacccaatggactcgacatactgaagtgtccagtctcacgcatgtaccctacagacgatagtgccccattacctgccggcacactggaccagccccttttcgaggtgatacaggaagccatgcaaaagcacatgcaggggattcagttcagagaacggaacgcagggccccagatcgatcgcaatatgaaagatgagggattcaatattacagccggcgtggacgaagaaaccggattcgtttatggcggcaataggtttaactgtggcacgtggatggacaagatgggagaaagcgacagagcgcgcaatcgagggataccagctacaccaagggacggaagtgctgtagagattgtgggccttagtaaatccgctgtgaggtggctgctcgagttgagcaagaagaatatcttcccgtatcacgaagtgacagtgaaaaggcacggaaaggccattaaggtgagctatgatgaatggaatcgaaagattcaggacaattttgagaaactgttccacgtgtctgaggatcccagcgacctcaatgagaaacacccgaatctggtgcataagcgtggcatctacaaggatagctacggagccagctccccttggtgtgactaccagttgcgcccgaacttcactattgcgatggtcgtcgctcctgaactgttcacgaccgagaaggcatggaaggccttggagatagcggagaagaagctccttggcccactagggatgaagacgctcgatcctgatgacatggtatactgtggcatctacgacaatgcgctggataacgataactacaaccttgctaagggatttaactaccaccaggggcctgagtggctgtggcccataggatattttctacgggccaagttgtactttagccgtctcatgggacccgagactaccgctaaaacgatcgttcttgtcaaaaacgtactgtcccgacactacgtgcacctggaacggtcaccatggaagggcctgcccgagctcacaaatgagaatgcccagtactgtcctttctcttgtgagacacaagcatggtccatcgccaccatcctcgaaaccttgtacgatctt

SEQ ID NO: 6070 - DNA, 4596 bp, Artificial Sequence
  Description of Artificial Sequence: Synthetic coding sequence
atgggccattcgaaacaaattcggatcctacttctcaatgaaatggagaaattagaaaagaccttattccgactagagcaaggctatgaactgcagttccggctcgggccaactttgcaaggtaaggccgttaccgtgtacacaaattacccatttccaggagagactttcaatcgtgaaaaatttcgatcacttgattgggagaatccaacagaacgcgaagatgattccgacaagtactgtaagctgaatcttcaacaatcgggatctttccagtactactttttacagggaaatgagaagagtggaggcggatatatagttgtagatccaattctccgtgttggagcggacaatcatgtacttccacttgattgcgttacattgcaaacatttttggcaaagtgtctaggaccatttgatgaatgggagtcgcggctccgcgtggccaaagaatcgggatataatatgatacacttcaccccactccaaacacttggtttgagccgcagttgttattcgcttgcaaaccaattggaactcaatcccgacttctctcgaccaaatagaaaatatacatggaatgatgttggtcaactcgtcgaaaagttgaagaaggagtggaacgtcatttgtattacagacgttgtctataatcataccgctgcaaactctaagtggattcaagagcatccagaatgcgcgtacaatttggttaactccccacatttgaaaccagcatgggttttagaccgcgcactttggagattttcatgtgatgttgctgaaggtaaatacaaagaaaagggtataccagctctgattgaaaatgatcatcatatgaattcaatcaggaaaattatttgggaagatatttttccaaaattgaagttgtgggaatttttccaagtagatgttaataaagctgtggaacagttccgaagacttctcacgcaagaaaaccgtagagttactaagtctgatccaaaccaacacttgacaatcatacaggatccagaatatcgtcgattcggctgtaccgtggatatgaatattgctttaactaccttcattccacatgataaagggccagcagccattgaggaatgttgcaactggttccataaacgcatggaggagctaaatagcgagaaacacaggttgataaattaccaccaggaacaggcggttaactgtcttcttggtaacgttttctatgagagactcgcaggtcatggaccaaaattgggaccggtcacgcgaaaacaccctcttgttacacgatacttcacatttccattcgaagagattgactttagtatggaggagagtatgatacaccttcctaacaaagcttgctttttgatggcgcataatggatgggtaatgggagatgatcctctacgaaattttgccgaaccaggctctgaagtctacctgagaagagaattgatttgctggggagattcggtaaaattacgctatggaaataaaccagaagattgcccgtatctctgggcgcatatgaaaaagtacacggagattacagcaacttattttcagggagttagacttgataattgtcactcaactcctctccatgttgcagaatatatgctcgatgccgctcgaaacctccaacctaatctctatgtagtagctgaactttttacaggatcagaggatctcgataatgtgtttgttactcgactcgggatctcctccttgatcagagaagctatgtcagcttataacagtcatgaggaaggaagactagtttatagatacggtggagaaccagttggatctttcgttcagccgtgcctccgtcctctcatgccggctatcgcccatgccttgtttatggacattacacacgacaatgagtgtccgattgtgcaccgatcagcatatgatgcattgccatccactacaattgtttccatggcctgctgcgcatcaggatctactagaggatacgatgagctggttcctcatcaaatttcggtggtttcagaagagagattttatacgaaatggaatccagaagctctaccgtctaatactggtgaagtcaattttcaatccggtataattgccgctaggtgtgctatttctaaattgcaccaagagttgggagctaaagggtttatccaagtttatgtcgatcaggtagacgaggacatcgtcgctgttacaagacattctccgtccattcatcaatcagttgttgctgtttcacgaacggctttcagaaatccaaagacatcgttctactcgaaagaggtgccgcaaatgtgtatcccaggtaagatagaagaagttgtcctggaagctagaactattgagcgaaatacaaaaccatatagaaaagatgagaattctattaacgggaccccagatatcactgtggaaatacgagaacacatacagttgaatgaatcgaaaattgttaagcaagcaggcgtcgctacaaaaggaccgaatgagtatatccaagaaatcgaatttgaaaatcttagtccaggaagcgtcatcattttcagagtttcacttgacccgcatgctcaagtcgcggttgggattctccggaatcaccttacacaattttcaccacactttaaatctggaagtctagcagttgacaatgctgatccaatcctgaagatacctttcgctagtctagcatcacgtctaacattggcagaattgaaccagattctttacagatgtgagtccgaagagaaggaagatggaggtggatgctatgatattccaaactggtctgctctaaaatatgcaggattgcagggtctcatgtcagttctcgctgagatcagacccaagaatgatcttggacatccgttttgtaataatctgcgctccggagactggatgattgattatgttagtaatcgattaattagtagaagtggaaccattgcagaggttggcaagtggctacaggccatgttcttttaccttaagcaaattccaagatatttgatcccctgttactttgacgctatcttgatcggcgcttacacgactttgctcgacacagcgtggaagcagatgtcttcttttgttcaaaacggatcgaccttcgttaaacatctcagtttgggaagcgttcagttatgtggtgtagggaaattcccgtcacttccaatcctttctcctgctctgatggatgttccatatcgattaaacgagattactaaggagaaagagcaatgctgtgtgtcattagcagccggactaccacacttttcctctggcatattcagatgctggggtagagatacgtttattgcactacgtggtattctcttaattacgggccgttacgtagaagcccgaaatatcatccttgcgttcgcggggacactccgccatggacttatccctaatttgcttggagagggaatttatgctcgatacaattgtagagatgctgtatggtggtggcttcaatgtatacaggactactgtaagatggtccctaatggtctagatattttgaaatgtccggtttcaagaatgtatccgactgatgattcggctccattgccagctggaactctcgaccagcccctatttgaagtcattcaggaggcgatgcagaagcacatgcagggcatccaatttagggaaagaaatgcagggcctcaaatagaccggaacatgaaagatgagggcttcaatattactgcaggtgtggatgaagagactggattcgtctatggaggcaaccgttttaattgcggaacgtggatggataaaatgggcgagtcagaccgcgcgaggaaccgaggaattcctgcgacacccagagatggctcagctgtggaaatcgtcggtctatcaaaatcggccgtgagatggttgctggagctaagtaagaaaaatattttcccttatcatgaagtgaccgttaagagacacggcaaggcaatcaaggttagttatgatgaatggaatcgaaaaatccaagataattttgagaagcttttccacgtctcagaggacccctcggatctgaatgagaaacatccaaatttggttcacaaaagaggaatctataaggattcgtacggtgcctcttcaccatggtgtgattatcaattgagaccaaactttactatagcaatggtagttgctccggaattgttcacaacggagaaagcatggaaggctttggaaatcgctgaaaagaaacttcttggacctctcggcatgaaaacgctagacccagatgatatggtttattgcggcatctatgacaatgctcttgataatgacaattataatcttgctaagggttttaattatcatcagggtcctgaatggctatggccaatcggatattttttgcgggctaaactatacttttcacgattgatgggaccagagacgacagctaaaactattgttctggtcaaaaacgttctatcgcgacactacgtgcatctagagcgcagcccatggaaaggactgcctgagttaacgaatgaaaacgcccagtattgcccattcagctgtgagacacaagcatggtctattgccacaattttagaaaccctttacgatctg

SEQ ID NO: 6071 - DNA, 4596 bp, Artificial Sequence
  Description of Artificial Sequence: Synthetic coding sequence
atgggacactccaagcagatccggattctgttgcttaacgagatggagaagctggagaaaacgctttttcgactggaacagggctacgagctgcaatttagactgggaccgacgctgcaggggaaggcagttaccgtctacaccaattatccattccccggcgagactttcaaccgggagaagttcaggtccctggactgggaaaatccaactgagcgcgaggacgactcagacaagtactgtaagctcaatctgcaacaatccggctccttccagtattactttctgcaaggaaacgagaaaagcggaggtggatatatcgttgtggacccgatcctccgcgtgggagctgacaaccacgtccttccgctggactgcgtcactttgcagacttttctcgctaagtgccttggacctttcgatgaatgggaatcgaggctgagggtggcgaaggagtcgggatataacatgatccacttcactccgttgcagactttgggtctgtctcgatcgtgctactcgttggcaaatcagcttgaactcaacccagacttctcccgcccaaaccggaagtacacttggaacgatgtcgggcaactggtcgagaaactgaagaaggagtggaacgtgatttgcatcaccgacgttgtgtataatcacaccgccgccaattcgaagtggatccaagaacacccagaatgcgcgtacaacctggtgaatagcccacatttgaagccggcatgggtccttgaccgcgctttgtggagattctcctgcgacgtcgcggagggcaagtataaagaaaaagggatccccgccctgattgagaatgaccaccacatgaactcgatcaggaaaatcatctgggaggatatcttcccaaagctgaagctctgggaattcttccaagtcgacgtgaacaaagcggtggaacaattcaggcgccttctgacgcaggaaaatagacgcgttacgaagagcgacccaaaccaacacctgaccatcatccaggacccggaatacagacggttcggatgcaccgtggatatgaacatcgccctgaccaccttcataccgcatgataaaggacccgccgcgatcgaggaatgctgcaactggtttcacaagagaatggaagaactgaatagcgaaaagcacaggctgatcaactatcatcaagagcaggcggtgaactgccttctcggaaacgtcttttacgaacgcctggcaggacatggcccaaaactcgggcctgtgacgcgcaagcatccccttgtgaccagatacttcacctttcctttcgaagaaatcgacttctcgatggaggaatctatgatccatctcccaaacaaagcatgcttcctgatggcccataacgggtgggtgatgggagacgatccgttgcgtaacttcgcagagccaggatccgaggtctacctcagacgcgagctgatctgttggggagatagcgtgaagttgcggtacgggaacaagccagaggattgcccgtacctctgggcgcacatgaaaaagtacacggagatcaccgccacttacttccaaggtgtgcgactggacaattgccactcaactcctctgcatgttgctgaatacatgctggacgcagcccggaatctgcagcctaacctgtacgtggtggccgaactctttacgggcagcgaagatcttgataatgtgttcgtgacgcgcctcggaatctcctccctgatccgcgaagcaatgtccgcgtacaattcgcatgaggaagggagactggtgtaccggtacggcggagagcccgtgggatctttcgtgcagccatgcctcagaccacttatgcctgcgatcgctcatgccttgtttatggatatcacccacgataacgagtgtccgatcgttcacagaagcgcctacgacgcactcccatcaactaccatcgtcagcatggcctgttgcgcttccggctcgactagaggctatgacgagctggtcccccatcagattagcgttgtctccgaggagcggttttacactaagtggaacccggaagcccttccgtccaacactggagaggtcaatttccagtcaggcattatcgcggcgcggtgcgctatttcgaaactccatcaggagctgggtgccaagggattcatccaagtctacgtggatcaagtcgatgaagatattgttgcggtgacccgccattcgccttcaatccaccagtccgtggtggccgtgagccggaccgccttccggaaccctaaaacctccttctacagcaaggaagtgccgcaaatgtgcatcccgggaaaaatcgaggaagtggtgctcgaggcccggacgatcgagagaaatactaagccgtacaggaaggacgagaattccatcaacggcacccccgacattactgtggaaattagagaacacattcagctcaatgagtcaaagattgtgaagcaggcaggtgtggcaaccaaaggtccaaatgagtacatccaggaaatcgaattcgaaaacctctcacccggatcagtcattatcttccgcgtctcattggatccgcacgcgcaggtggcagtcggaatcctgcgtaaccacctgacccagttctcaccgcacttcaagtcgggcagcctggcggtggacaatgcggacccgatactgaagatcccttttgcatcgctcgcctctcggctcactctggctgaactcaatcaaatcctgtaccgctgtgagtcagaggaaaaggaagatggtgggggttgttacgacatcccaaattggtcggcgcttaagtacgccggcctccaagggctgatgtcagtcctggccgaaattcgccctaaaaacgacctgggacatccattctgcaataatcttcggagcggcgactggatgatcgattacgtctccaatcgcttgatctcacgcagcggaactatcgcagaggtgggaaaatggctccaagcaatgttcttttacctgaagcagatcccgagatacctgatcccgtgctacttcgacgcgatcctgattggagcctacaccaccctgctggacactgcgtggaagcagatgagctcgttcgttcagaacggaagcaccttcgtcaagcatctgtctctgggaagcgtgcaactgtgcggagtgggcaaatttccgtcgctgccgatactgtccccggctctgatggacgtcccataccgcctcaatgagatcactaaggaaaaggagcagtgttgtgtgtccctcgcggcgggactgccgcacttctcatcgggaatcttccgttgctggggtcgagacaccttcatcgcccttcgcggtatcctgctcatcacgggccgatacgtggaagctcggaacatcattctcgccttcgccggcaccttgcgccacggtctgatccccaatttgctgggtgaaggaatctacgccagatacaactgccgcgacgccgtttggtggtggctgcagtgcatccaggattactgtaagatggtcccgaatggactcgacatcctgaagtgcccagtctcgcgcatgtaccccactgatgattccgcaccgctcccggccggcaccctcgaccaacctctgttcgaggtgattcaagaagcgatgcagaagcacatgcaaggaatccagtttcgcgagcgtaacgccggaccgcagatcgatcggaacatgaaggatgaaggcttcaacatcactgccggggtggatgaggaaaccggatttgtgtatggcggaaaccgcttcaactgcggtacctggatggacaagatgggggaatcagatagggccagaaatcggggcatccccgcaaccccccgcgacggaagcgccgtggagatcgtcggcctctcaaaatcggcagtgcgctggctgctcgaactgtcaaagaagaacatattcccgtatcatgaagtgaccgtgaaacgccacggtaaggccatcaaggtgtcttacgacgagtggaatcgcaagatccaggacaatttcgagaagttgtttcatgtgtctgaagatccgtccgacctgaacgaaaaacaccctaacctggtccacaaacggggaatctacaaggattcgtacggagcctcttcaccgtggtgcgactaccagcttcgcccgaactttaccattgctatggtggtcgcacctgaactgttcacgaccgagaaagcgtggaaggccctcgaaatcgctgagaagaagctccttgggccgctggggatgaaaactttggaccctgacgatatggtgtactgtggaatctacgacaacgctctggacaacgacaactacaacctcgccaagggctttaactatcatcagggaccggaatggctctggccgatcgggtactttctgagggccaagctctacttctcgcggctgatggggccggaaaccactgcaaaaaccatcgtcttggtgaagaacgtgttgtctcggcactacgtgcatctggagcgaagcccgtggaagggattgcctgaactgaccaacgagaatgctcagtactgccccttctcgtgtgaaactcaggcgtggtcgattgctaccatccttgaaacgctgtacgatctc

SEQ ID NO: 6072 - DNA, 4596 bp, Artificial Sequence
  Description of Artificial Sequence: Synthetic coding sequence
atgggtcactcaaagcagatccggatactcctgctgaacgaaatggagaagctcgaaaagaccctgttccggttggaacagggatacgagctgcagttcaggctgggaccgacgttgcagggcaaggccgtcactgtctacaccaactacccttttccaggcgagactttcaatcgcgagaagttccggtccttggactgggaaaatcccacggagcgcgaggacgatagcgataagtactgtaagctcaatttgcagcagtcgggttcctttcagtattactttctgcaagggaacgaaaaaagcggcggaggatatatcgtggtggatccaatcctgcgggtgggcgctgacaaccacgtcctgcctctggactgtgtcaccctccaaacctttttggcaaagtgtctcgggccttttgacgagtgggagtccaggctgcgggtggcgaaggaaagcggatacaatatgattcacttcacccctctgcagactctgggtctgtccagatcatgctactcgctcgccaaccagctggagctcaatccggacttctcaaggcctaatcggaagtacacctggaatgatgtgggccagctggtggaaaagctcaaaaaagaatggaatgtgatctgcatcaccgacgtagtctacaaccacactgctgcgaattccaagtggattcaggaacacccggagtgtgcctacaacctcgttaactcgccgcatctgaaacccgcctgggtcctggatcgcgccctgtggcgcttcagttgcgacgtggcagaaggtaaatacaaggaaaagggaatcccggcactgattgagaatgatcatcacatgaactcaatccggaagatcatctgggaggatatcttccccaaattgaagttgtgggagttcttccaagtggacgtgaataaagcagtcgagcaatttagacggctgctcacccaagagaatcgtagagtgactaaaagcgacccgaatcaacacctgacgataatccaagaccctgagtatcggcggttcgggtgcaccgtagatatgaacatcgccctcaccactttcatcccgcacgataaggggcctgctgcaatcgaggaatgttgtaattggttccacaagagaatggaagaactgaactcggaaaagcacagacttatcaattaccaccaagaacaggcggtgaattgcctgctgggcaacgtcttttacgagagactggcaggccatggcccaaagctcggtccggtgaccaggaagcacccattggtgaccagatacttcacgttccctttcgaggaaatcgacttttcgatggaggagtcgatgattcatctgccaaacaaggcctgcttcctgatggcccacaacggctgggtgatgggggacgatcctcttagaaacttcgcagaaccgggctcagaagtgtatctccgaagagaactcatctgctggggtgactccgtgaaactccgttatggcaacaagccagaagattgtccatacctgtgggcgcatatgaaaaagtacactgaaattactgctacttacttccaaggggtgcggctggacaattgccattccacgccgctgcatgtggctgagtacatgcttgatgcggccagaaacctccagccgaatctgtacgtcgtcgccgaacttttcactgggagtgaggacctggacaacgtctttgtgactcggctcggaatctcatcgctgatccgggaagcaatgagcgcttacaattcccacgaggaaggaaggctggtgtaccggtacggaggagaacctgtgggctcgtttgttcagccttgcctcaggccactgatgccagccatcgcccatgcgctgttcatggatattactcacgacaacgaatgtccgatcgttcaccgatcggcttacgatgcattgccgagcactaccatcgtctccatggcgtgctgtgcaagcggatccacccggggatacgatgagctggtaccgcaccagatatcggtcgtgtcggaggaacgcttctacaccaagtggaacccggaagccctgccttcgaacaccggcgaggtgaacttccaatcgggaattatcgctgcacgctgcgccatctccaagctccaccaggaactgggagccaagggctttatccaagtctatgttgatcaggtcgatgaagatatcgtggccgtcactcgccactcaccgtctattcatcagtcggtcgtggctgtgtcgagaactgcctttcggaaccctaagacctcattctactccaaggaggtgccgcagatgtgcatcccggggaagatcgaggaagtggtgttggaggcccgcaccattgagcggaatacgaaaccgtatcggaaggatgaaaattcaatcaatggaactccggatatcacggtggaaatcagggaacatatccagcttaacgagtccaagattgtcaagcaagcgggagtggccactaagggcccgaacgaatacatccaagagattgagtttgaaaatctttcaccaggatcggttatcatcttccgggtgtcactggatccacacgcacaagtcgcggtgggaatcctgcgtaaccacctgacccagttctcgcctcatttcaagtcaggctcgctggccgtggataacgctgatccgattctcaaaatcccatttgccagtctggcatcgaggctgacgctcgccgaactgaatcagatcctgtacagatgcgaatccgaagagaaagaggacggaggcggatgctacgacattccaaactggtccgcacttaagtatgccgggctgcagggactgatgtcagtcttggcagagatccggcccaagaatgacctcggtcatccgttctgcaacaacctccggagcggagactggatgattgattacgtgtcaaatcggctcatttccaggtccggaacgatcgcagaagtgggcaaatggctgcaggccatgtttttctacctgaaacaaatccctcggtacttgatcccgtgctacttcgatgcaatcctcataggtgcgtacactacccttctggataccgcatggaagcagatgtcctcgttcgtccagaacggctccacttttgttaaacacctgtccctgggatcggtgcaactgtgcggggtggggaagttcccgtcgttgccgatcctgtctccggccctcatggacgtgccctaccgcctgaatgagatcaccaaggaaaaggagcagtgctgcgtgtcactcgcggcagggctcccccacttctcatcgggaatctttaggtgctggggacgtgacaccttcattgcactcagagggatcttgctgatcactggccgctacgtggaagcgcggaatatcatcctcgctttcgccggcaccctgcgccatggactcatcccgaacctgctgggagagggtatatacgcccggtacaactgcagagatgcggtctggtggtggctccagtgcatccaagactactgtaagatggtgccaaacggactggacatcctcaagtgtcctgtgtcccgcatgtacccaactgacgacagcgctccgctgccggccggtacgctcgaccaacccctgttcgaagtcatccaagaggccatgcaaaaacacatgcagggtatccaatttagagaaaggaacgccggcccccagattgacagaaatatgaaagacgaaggattcaacatcactgcgggagttgacgaagaaactggcttcgtctacggagggaatcgctttaactgcggcacctggatggacaaaatgggggagagcgatagagcccgcaaccgggggatacccgccaccccgagggacggcagcgccgtggaaatcgtgggactgtcgaagtctgctgtgcgctggctgctcgaactgtcgaaaaagaacatcttcccctaccacgaagtgaccgtgaaaagacatggtaaagccatcaaggtcagctacgacgagtggaaccgcaagatccaggacaatttcgaaaaactcttccatgtgagcgaagatccaagcgacctcaatgaaaagcatccgaatttggtgcacaagcgcggcatctataaggactcgtacggagcctccagcccctggtgcgattaccagctgaggccaaactttaccatcgcaatggtggttgcgccagaactgttcaccacggaaaaggcttggaaggcgctcgagatcgcagagaagaaattgctcggacctctgggaatgaaaaccctggacccggatgacatggtgtattgcggaatctacgacaacgccctcgacaacgataactataatctggcgaaagggttcaactaccaccagggaccggagtggctctggccaatcggatactttctgcgcgccaagctgtacttctcacggctcatgggacctgagactactgctaagaccatcgtgctggtgaaaaatgtcctgtcaagacactacgtgcatctcgagcgcagcccgtggaaggggctgccggaactcaccaacgaaaatgcccagtactgccctttctcgtgcgaaacccaggcgtggtccatcgcaaccatcctggaaaccctttacgacctt

SEQ ID NO: 6073 - DNA, 4596 bp, Artificial Sequence
  Description of Artificial Sequence: Synthetic coding sequence
atgggacattcaaaacagatcagaatcctgctcttgaatgagatggagaagttggagaaaactctcttcagattggaacagggatacgaacttcaattccggctgggcccgaccctgcagggcaaggcagtgaccgtttacactaactacccgtttcctggagaaactttcaaccgggagaaattccgctcactggattgggagaacccgactgagcgagaagatgactcagacaaatactgcaagttgaacctgcagcaatcggggtcgttccagtactacttcctccaagggaacgaaaagtccggcggcggatacattgtggtggacccgatcctccgggtgggagctgacaaccatgtgctgccactggattgcgtgaccctgcagacttttctcgcaaagtgtctggggccattcgacgaatgggaatcaagactgcgggtcgccaaggaatccgggtacaatatgattcactttactcctctgcaaaccctggggctctcgcgctcgtgttactcgctggctaatcagctggaactgaaccccgatttcagccgcccaaatcgtaagtacacttggaatgacgtcgggcaactggtggagaagctgaagaaagagtggaacgtgatctgcatcaccgacgtggtgtacaatcacactgcggccaatagcaagtggatccaagaacaccccgaatgcgcctacaatctggtgaattcccctcacttgaagcctgcctgggttctggacagagccctgtggagattctcctgcgatgtggcagaaggaaagtataaggagaaaggcatcccagcactgatcgagaatgaccaccacatgaattcgatacgcaagatcatctgggaagatatctttcctaagctgaaactctgggaattcttccaagtggacgtcaacaaagccgtcgaacagttccggcggctcctgactcaggaaaacagaagggtgactaagtcggaccctaaccagcatctcaccatcattcaggatccagaataccgcagattcggctgtacggtggatatgaacattgccctgaccactttcatcccacatgataaaggtcctgcagcgatcgaggaatgctgtaattggttccataagagaatggaagagctgaattcggaaaagcatcgcctcatcaattaccaccaggaacaggcagtgaactgcctcctgggtaatgtattctacgagaggctggctggacatggacctaaacttggccccgtcactcggaagcacccgctggttaccagatacttcaccttcccgttcgaggagatcgacttctcgatggaggaatcgatgattcatctccctaacaaggcctgctttctgatggcgcacaacgggtgggtgatgggagacgacccgcttcggaacttcgcggaaccgggatcagaagtttacctgcgccgggaactcatttgctggggagactcggtgaaacttaggtacgggaacaaaccagaagattgcccatacctgtgggctcatatgaaaaagtacactgaaatcactgctacctactttcagggggtccgcctggacaactgccactccaccccgctgcacgtggccgagtacatgctggacgcggctcgaaacctgcagccgaacctctacgtcgtcgcggagttgtttactggttcggaagatttggacaatgtctttgtcactcgccttgggatcagctcattgatacgcgaggccatgtccgcatacaattcgcacgaagaaggccgcctcgtgtaccggtacggaggagaaccggtgggttcgttcgttcaaccgtgtctgcggccactgatgcctgctatcgcacacgccctgttcatggatatcacccatgataacgaatgcccgattgttcaccggagcgcgtacgatgccctgccatcgactactatcgtctcaatggcctgctgtgcctctgggagcacccgcggctacgatgaactcgtgccacaccagatctcagtggtgagcgaagaacgtttttacactaaatggaacccggaggccctgccttccaacaccggtgaggttaacttccaatccggaatcatcgccgcaagatgcgcaatctccaagctgcatcaggagctcggagcgaagggattcatccaggtgtacgtcgatcaggtggatgaggatattgtggcggtcacgagacactcaccgtccatccaccagtcagtcgtggctgtgagccggaccgcattccgcaacccaaaaacgtccttttactcgaaggaagtcccacagatgtgcatcccaggaaaaatcgaggaagtggtcctcgaagcgcgcaccatcgagcgtaatactaagccatacagaaaggacgaaaattccatcaatggaaccccggacatcaccgtggagattcgggagcacatccagctgaacgaatcaaagatcgtgaaacaggccggtgtggcgacgaaaggaccgaacgagtacatccaggagatcgagtttgaaaacttgtcgccagggtcagtgatcatcttccgggtgagcctcgaccctcatgctcaggtagccgtcggcattctccgcaatcacttgactcagttctcaccacatttcaagtccggctccctggctgtcgataacgcggatccgatcctcaagatcccgttcgcgtcgttggcgtccagattgacccttgcggaactgaaccaaattctgtacagatgtgaatcagaagagaaggaggacggcggtggatgttacgacatcccaaactggtccgctcttaagtacgctggactccaaggactcatgtcggtacttgcagaaatccggcctaagaatgatctgggacacccgttttgtaacaatctgcggtcgggtgactggatgatcgactacgtctcgaaccgattgatctctaggagcggaactatcgccgaagtgggaaagtggctgcaggctatgttcttttacctcaaacagatcccgcgctacctgatcccgtgctactttgacgcgatcctcatcggggcatacaccactcttctcgacactgcgtggaaacagatgtcatcattcgtgcagaacggtagcacctttgtcaagcatctctccctggggtccgtgcagctgtgtggcgtgggcaagtttcccagcctccctattcttagcccggcgctcatggacgtgccatacagactgaatgagatcactaaggaaaaagaacagtgctgcgtctctctggccgcaggactgcctcattttagctccggaatctttaggtgttggggacgggacactttcattgcgctgaggggaatcttgttgattaccgggagatacgtggaggcccggaacattatcctggccttcgcagggactctcagacacggactcatccccaatttgctgggtgaaggaatctatgcaagatacaattgtcgggacgccgtgtggtggtggctccagtgcatccaggactactgcaagatggtgccgaacgggctcgacattctcaagtgcccagtgtcgcggatgtaccccactgacgactcggcgcctcttccggcaggcacccttgaccaacctctgtttgaagtgatacaggaggcaatgcagaagcacatgcagggaatccagttcagagagcgcaacgctggccctcaaattgataggaacatgaaagacgagggatttaacatcaccgccggagtggacgaagaaaccggcttcgtctacggaggcaaccggttcaattgcggaacctggatggacaaaatgggagagtcggaccgggccagaaatcgggggatccccgcaaccccgagagacggctccgctgtcgaaatcgtcggactgtcaaaatcggccgtgaggtggttgctcgagctttccaagaagaatatcttcccataccacgaagtgacggtgaagaggcacggaaaggccatcaaagtctcttacgacgaatggaaccgcaagattcaagacaacttcgaaaagttgttccatgtgagcgaggatcctagcgacctgaacgaaaagcatccgaacctggtccataagcggggaatctacaaagactcatacggcgcatcatcaccatggtgcgattaccagctgcgtccgaacttcacgatcgcgatggtggtggcgcccgaactgttcactacggagaaggcgtggaaagcgctcgaaattgcagaaaagaagctgctcggaccattgggcatgaaaaccctggacccggacgacatggtttactgcggcatttacgacaacgcgctggataacgacaactacaaccttgccaagggattcaactaccaccaaggacctgaatggctttggccaatcggctacttcctcagagcgaagctgtatttctctcgcttgatgggaccagagactactgccaaaactatcgtcctcgtgaagaacgtcctgagcaggcactacgtgcatctggaaagatcgccgtggaagggcctgcccgaactgactaatgagaacgcgcagtattgccccttctcctgcgagactcaagcatggtccatcgcgactatcctggagactctgtacgatctt

SEQ ID NO: 6074 - DNA, 4596 bp, Artificial Sequence
  Description of Artificial Sequence: Synthetic coding sequence
atggggcattcaaagcagatccgcatcctgttacttaacgaaatggagaaactggaaaaaactctgtttcggctcgagcagggctatgaactgcagtttcgattagggcccactttgcagggtaaggcagttaccgtatacacaaattacccgttccctggcgagacatttaaccgcgaaaagttccgaagcctagactgggagaatcctacagaacgagaggatgatagtgataagtactgtaagttgaacttgcaacagtctggatcctttcaatactattttctccagggcaacgaaaaaagtggtggcggttacatcgtggtggatccaattctgcgcgtgggggccgacaatcatgtgctgccattagattgtgtgacattacagacatttctcgctaaatgcttaggcccgtttgacgagtgggagtctaggctgagagttgcaaaagaatccggttacaacatgatccatttcacccctttacaaaccttaggcctgagccggagttgttactctctggccaaccagctggagctcaatccagactttagcagacctaacagaaagtacacttggaatgacgtaggacagctggtagagaaacttaaaaaagaatggaatgttatttgcatcaccgacgtggtgtataatcatactgcagccaatagcaagtggatccaggagcatccggagtgtgcatataacctcgtgaactctccccacttgaaacccgcttgggtgttagacagggcactgtggaggttctcatgcgacgtagcagagggcaaatataaagagaaagggattccggccctaatagaaaatgatcaccacatgaacagcatccgcaaaattatatgggaagacatcttccccaaactcaaactgtgggaattctttcaggtcgacgtgaacaaggccgtggagcagtttcgtcggttgctcacgcaggagaaccgacgcgtgacaaagtccgatcccaaccagcacctgacgatcattcaggacccagagtatcgccggttcggatgtactgtcgacatgaatattgcactcactactttcataccccacgataagggccctgccgctatcgaggagtgctgtaactggttccataagcgaatggaggagctcaattctgagaagcaccgcctgattaactatcatcaggaacaggctgtaaattgcctactcggcaatgtattctatgagcggctagccggacacggacccaagctgggacctgtgactagaaaacacccattagtcacaaggtacttcacttttccttttgaggagatagacttctcgatggaggagagtatgattcacctgcctaacaaggcctgctttctaatggcacataatggatgggtgatgggcgacgacccgcttcgcaatttcgcggagccaggcagtgaggtgtatctgcggcgagaacttatttgttggggcgactccgttaaacttcggtacggtaacaaacctgaagactgtccttacctatgggcccacatgaaaaaatacaccgagatcacagcaacatatttccagggagtgcgcctggataactgccacagcaccccattacatgtggccgaatatatgttagacgctgcacggaacctgcaacctaatctgtatgttgtggcagagctctttacagggagcgaggacctagataatgtgttcgtgacccgactcggtatttccagcctgatccgggaggctatgagtgcctacaacagtcatgaagagggtcgactcgtgtacagatatggcggggaacctgttggttcttttgtgcagccctgcttgcggcccttgatgcctgcgattgctcacgcactcttcatggatataacacacgacaatgagtgccctattgtgcacaggtccgcttacgatgcgctcccctccactacgatcgtcagcatggcctgctgtgcctctggcagtacccgagggtatgatgaactagtccctcaccagatttcggtggtctccgaagagagattttacacaaagtggaatccagaagcgttaccgagcaatacaggcgaagtgaattttcagagcggaattatagcggccaggtgcgcaatctctaagctacatcaggagctgggcgccaaaggattcatacaggtgtatgtcgatcaggtcgatgaagacattgtagctgtaaccagacactcccctagcatccaccaatctgtggttgccgtctcaagaacagcgttccgaaaccctaagacaagtttttatagcaaagaagtgccacagatgtgcatccccggtaaaatcgaagaggtagtgctggaggcccgaacaatcgagcgcaataccaaaccttaccggaaagatgagaattccataaacgggacccctgatatcactgtggaaatcagggagcatatccaactgaacgaatcgaagatcgtcaagcaggccggcgtcgctactaagggacctaacgaatatatacaggaaatcgaattcgaaaatctgagtccaggctccgttatcatctttcgtgtctctctggaccctcatgctcaagtcgcggttgggatcctgagaaatcacctgactcagttcagtccacatttcaagtcagggtcgcttgccgtcgacaatgcggacccgatcctaaaaatcccattcgctagcctcgcatcccggctcactcttgctgagctcaaccagatcctatacagatgtgaatcagaggaaaaggaggatggaggcggatgctacgacattccaaattggagcgccttgaagtacgctggcttacagggcttgatgagcgtcctggcggaaatacggcccaagaacgacctcggccaccctttctgcaacaacttgcgctcgggggattggatgatagattatgtgtcaaataggctgatcagtcggtcagggacgatcgcagaggtgggaaagtggttgcaggccatgttcttctacctgaagcagattcctagataccttatcccctgctacttcgacgcaatattgataggggcctatactacactgcttgacacagcttggaagcagatgtcaagtttcgtgcagaatggcagcaccttcgtcaaacacctctccctaggcagtgtccaactttgcggggtcggtaaattcccctccctgccaatattatcgccagcccttatggatgttccatatcggttgaacgagattactaaggagaaggagcagtgctgcgtgagcttagctgccggactcccacatttctctagcggtatctttcggtgttggggacgagacaccttcatcgccctccgtggaatattgctgatcacgggtcgctatgtggaggcaagaaatattatccttgcttttgctggcaccctgcgtcatggattgatccctaatctcctcggagaggggatctatgcacgctataactgccgtgatgccgtgtggtggtggttacagtgcatccaggattactgtaaaatggtgcctaacgggttggatatcctgaaatgtcctgtgtctcggatgtatcctaccgacgattcggccccccttcccgccggtacactcgatcaacctttatttgaggttattcaggaagcaatgcagaaacacatgcaggggatccaatttagagagcgaaacgctggcccacagatcgaccggaatatgaaagatgaaggcttcaacatcaccgcaggggttgacgaggaaaccggtttcgtttacggaggcaatagatttaactgcgggacttggatggataagatgggagaatctgaccgggctagaaacaggggcatccctgccacaccccgcgacggctctgcggtggaaatagtgggtttgtccaagtcagccgttcgttggcttctcgagctttcaaaaaagaatattttcccgtaccatgaggtcactgtgaaacggcatgggaaggcgatcaaagtgagctacgacgagtggaaccgcaagatacaggacaactttgaaaaattgttccacgtgtccgaggatcctagtgaccttaatgaaaaacatcccaatctggtgcacaagagagggatttacaaggattcctacggggcttcttctccctggtgtgactaccagctgcgccccaattttacgattgctatggttgtggctcctgaactctttaccactgagaaagcctggaaagcattggagatcgccgaaaagaagttactggggcccttaggaatgaagacactggatccagacgacatggtgtattgcggcatatatgacaatgcgttggataacgacaactacaacctggccaaggggttcaattaccaccagggaccagagtggctgtggccgattggctattttctgcgggcaaagctgtatttttcccgcctcatgggcccagagaccaccgccaagaccatcgttctggtaaaaaacgtgctatcacgccattacgttcacctggaacgctcgccctggaaaggactccccgagctaacaaacgagaacgcccagtactgcccatttagttgtgaaacccaggcgtggtcaatagctaccatcctcgaaaccctgtacgacctc

SEQ ID NO: 6075 - DNA, 4596 bp, Artificial Sequence
  Description of Artificial Sequence: Synthetic coding sequence
atgggtcattcaaagcagattaggattctgttgctcaacgagatggaaaaactcgaaaagaccctttttcgcttggagcaaggatacgaacttcagtttagactcggcccgaccctgcagggcaaggccgtcaccgtgtacaccaactacccttttcccggagaaacttttaacagagaaaagtttcgctccctggattgggagaaccctaccgagagggaagatgatagcgataagtactgtaagctgaacctccagcagtccggatcgtttcagtactacttcctccaaggaaatgagaagtcagggggaggatacattgtggtggacccaatccttagggtgggagcagataaccacgtccttccgcttgactgcgtcaccctccaaacgttccttgcaaagtgtctgggaccatttgatgaatgggaatcccgtctgagagtggcgaaggagagtgggtacaatatgatacacttcaccccgcttcagactctgggactctcacgttcctgctactccctggccaaccagctggagctcaatcctgatttttccaggcccaacagaaaatacacctggaacgacgtgggacagctcgtcgaaaagctcaagaaggagtggaacgtgatctgtattaccgatgtggtctacaatcataccgcagccaactccaagtggatccaggaacatcctgagtgcgcatacaacttggtgaattccccacatctgaagcctgcatgggtgctggacagagccctgtggagattctcgtgcgatgtcgcggagggcaaatacaaggagaaaggaattcctgcactgatagaaaatgatcatcatatgaactctattcgcaagatcatttgggaggacatttttcctaaactcaagctgtgggagttcttccaagtcgatgttaacaaggcagtcgaacaatttcgtcggctgcttactcaggagaacaggcgggttaccaagtcggacccaaaccaacatttgaccattatccaggacccagagtatcgcagatttggctgtaccgtcgacatgaacattgcgcttactacctttattccacacgataagggtcctgcagccatagaggagtgctgtaactggtttcacaaacggatggaagagctgaatagcgaaaagcacagacttatcaattatcaccaagaacaagcagtaaactgtctgcttggtaacgtcttttacgaacggctcgcgggccacggtccaaaactgggtccggtgactcgcaagcatcctcttgtgaccaggtatttcacctttccttttgaagaaatagatttttccatggaagagtcgatgatccatcttcctaacaaggcatgcttcctgatggcacataacgggtgggtgatgggagacgatcctctgcgcaactttgcagaacctggatcggaagtgtacctgagacgcgaactcatttgttggggagatagcgttaaacttcgatacggcaacaagcccgaagattgtccatacctctgggcccatatgaaaaagtatactgaaattactgcaacctactttcagggcgtgcggcttgataattgccactcaacgccccttcatgtggcagaatacatgttggatgcagcccgtaacttgcagcctaatttgtacgtggtggccgagcttttcaccggctccgaggatctggataacgtgttcgtgaccagacttggtatctcctcactgattcgtgaggctatgtcggcctacaatagccatgaagagggacggcttgtgtaccgatacggcggggaaccagtgggatcctttgtccagccttgtctgcggcccctcatgccagctatcgcacacgcactcttcatggatataactcacgataacgaatgcccaatcgtccatcggagcgcgtacgatgcgttgccttcaacgaccattgtcagcatggcatgctgtgcaagcggctcgacccggggatacgatgaacttgttcctcatcaaataagcgtcgtgtctgaagaacgcttttacaccaagtggaatcctgaagcactcccttcgaacactggggaagtcaattttcaatccggtataatcgcagcaaggtgcgcaatctccaagttgcatcaggaactgggtgccaagggtttcatccaagtgtatgtcgatcaagtcgacgaggatattgtggccgtgactaggcattccccatcgatccatcaaagtgtcgtcgcagtgtcgcgcaccgcgttccgtaacccgaaaacctccttctactcgaaagaggtgccgcagatgtgtatcccaggcaagattgaagaggtcgtgctggaggcaagaaccattgagcggaacaccaaaccttacagaaaggatgaaaattccattaacggaactcccgatattaccgtcgaaatccgagaacacattcaactcaacgaatccaagattgtgaagcaggcgggggtggcaacgaaggggcccaacgagtacattcaggagattgagtttgaaaacctgagcccgggatcagtcatcatctttagagtgagtctcgacccacatgcacaggtggcagtgggcatcctgaggaaccatctgacccagttctctcctcactttaagtcaggttcccttgcagtggataacgccgatcctatcctgaagatcccgtttgcgtcgcttgcatcacgactcactctggctgagctgaaccaaatcctgtatagatgtgaatcggaggagaaggaagatgggggcgggtgttacgatatccccaattggtccgccctgaagtacgcaggactgcaaggactgatgtcagtgctggctgagattcggcctaagaacgatcttggacaccctttctgtaataacctccggtcgggagactggatgatcgattatgtttccaacagattgatctcccgttcggggaccattgccgaggtcggaaagtggctccaagccatgttcttttacctcaaacagatacctcggtacttgattccatgctacttcgatgctattctgattggagcatacactactcttcttgatactgcctggaagcaaatgtcgagctttgtgcaaaacggatccacttttgtcaagcatctgtctctgggctcggtgcagctctgtggcgtgggtaagttcccatcactccccatcctttcgccggcccttatggatgtgccctaccggcttaacgaaataactaaagagaaggaacaatgttgcgtgagcctggcagccggtctgccacactttagcagcggtatctttcgatgttggggccgcgatactttcatcgctctccgtggcatcctgctgattaccgggaggtacgtggaggcccgaaatatcatacttgccttcgctggcactcttcgacatggtctgatccctaatctgctgggagaaggaatctacgcaagatacaactgtcgggacgctgtgtggtggtggctccaatgcatccaagattactgtaaaatggtgcccaatggtcttgatattctgaaatgtcccgtttcgcgcatgtatccaaccgatgattccgcacctctcccagcaggtactctggaccagcctctttttgaagtgatacaggaggcaatgcagaagcatatgcaaggaatccaattcagggaaagaaatgcagggcctcagatcgatcgcaacatgaaggatgagggctttaacattacggcaggtgtggatgaggaaacgggatttgtgtacggaggaaacaggtttaactgcgggacctggatggataagatgggggagtcggatcgtgcccgtaatagagggatcccggcgactccccgtgacggttcggcagtggaaattgtcgggttgtcgaagtccgcggtcagatggcttctcgagctttccaagaagaacatttttccgtaccatgaggtgactgtcaagaggcacggaaaagctataaaggtttcgtatgatgagtggaacagaaagattcaagataactttgaaaagctctttcacgtgtcagaagatccctccgatttgaacgaaaagcacccaaaccttgtgcataagagaggaatttacaaggattcttacggcgctagcagcccttggtgtgattatcagctgcggcctaacttcactatcgccatggtggtcgcaccagaactgtttactactgaaaaagcctggaaagcgctcgagatcgcagaaaagaagctcctcggtccactcggcatgaaaaccctggacccggatgacatggtgtactgtggaatttacgacaacgcactggataacgataactacaatctcgcaaaaggatttaactaccatcaaggaccagagtggctttggcctatcggctactttcttagagcaaaactttacttttcgagactgatggggcctgagactaccgccaagactatcgtgctggtgaaaaacgtgttgtcgcgccattacgttcacctggaacgctccccctggaaggggctccccgaacttaccaacgaaaatgcacagtactgccccttttcatgtgaaactcaagcatggtctattgctacgatcctcgaaaccctttacgatctg

SEQ ID NO: 6076 - DNA, 4596 bp, Artificial Sequence
  Description of Artificial Sequence: Synthetic coding sequence
atgggtcactccaaacaaatccgtatcttgctcctcaatgagatggagaagctcgaaaaaaccctctttaggcttgagcagggttatgagctacagtttagactaggtccaacactgcaaggtaaagctgtgacagtttacaccaactaccccttccccggcgagactttcaatagagaaaagtttaggtcacttgattgggagaaccctacggagagagaagatgactccgataagtattgcaaattaaatttgcaacagtctggcagctttcagtattactttctccaaggtaacgagaaaagcggaggaggatatattgttgtagatcccattctccgtgttggggctgataatcatgtccttcccctggattgtgtgaccttgcagacttttctcgccaaatgcttgggtccattcgatgaatgggagtcacgattgagagttgccaaagaaagtggatataatatgattcattttacaccattgcaaactcttggtttaagtagatcttgttacagtcttgcgaaccagttggaactcaaccccgacttcagtaggcccaataggaagtatacctggaacgatgtgggccagcttgttgagaagttaaagaaggagtggaatgttatatgtattactgatgtggtttataaccatactgctgctaattccaagtggatccaagagcatccagaatgcgcttacaatcttgttaattctccacaccttaagcccgcttgggttcttgacagagccttatggcgcttctcatgtgatgttgccgaggggaaatacaaggaaaagggaatccccgcattgattgaaaacgaccaccacatgaattctattcgaaaaatcatttgggaagatatttttccgaaactcaaattgtgggaatttttccaagtcgacgtgaataaggcagtggaacagtttagacggctgcttacacaagagaaccgtagagttacgaaaagtgatcctaatcaacatttgacaattattcaagatcctgaataccgcagatttggttgtacagttgatatgaacatcgcactcactacatttattccacatgataagggacccgcagccattgaggaatgttgtaattggtttcataaacgaatggaagaactgaacagtgaaaagcatcgattgataaactaccaccaagagcaggccgttaactgccttttgggaaatgttttttacgagcggcttgcaggacatggtcctaagcttggtccagtgacaagaaagcatcctctggtcacacgatatttcacctttccgtttgaagagatagatttttcaatggaggagtctatgattcatcttcctaacaaggcttgttttttaatggctcataatgggtgggttatgggggatgatccattgagaaatttcgccgaaccagggtccgaagtctatttgaggagggaattaatatgctggggagactcagttaagcttcgctacggcaataaacctgaggattgcccatacttgtgggctcacatgaaaaagtacacagagattacggcaacttacttccaaggggtcaggcttgacaattgccacagcactccacttcacgtggctgaatacatgctggacgccgctaggaatttacaacccaatctttatgtggtcgcagagctgtttacggggtcggaagatctagataacgtattcgtgacaaggttgggtatttcttcgttaataagagaggcaatgagtgcatataatagtcatgaagagggaaggctggtctatcggtacggcggagaacctgttggatcatttgttcaaccctgtctgcgaccattaatgcctgccattgcgcatgccttgttcatggacatcacccatgataacgagtgtccaattgttcatagaagtgcttacgatgcactgccctctacaacgattgtatctatggcatgttgcgcttccggttcgacccgtggttatgatgagctagtgccacatcagatcagtgttgtttcggaagaacgattttacacaaagtggaaccccgaggcactcccgtcgaacaccggtgaggtcaattttcagtccgggattatcgcagccaggtgtgccatttctaaacttcatcaagagttgggtgctaaagggttcatccaagtttacgtggatcaggttgacgaggatattgtggctgttactcgtcattcgccatctatccaccagtctgtggtagctgttagtagaacggcgttcagaaaccccaaaactagcttttatagtaaagaagtaccccagatgtgtatacctgggaagatcgaggaggttgtgcttgaagctagaacaattgaaagaaacacaaaaccttaccgtaaagacgagaactctatcaatgggaccccagacataacggtcgaaatacgcgaacacatacaacttaacgaatcgaagatagtgaagcaggcaggggtcgccaccaagggtcccaatgaatatattcaggagatcgaatttgaaaacctctcaccaggtagcgtgattatcttcagggtttcactcgatcctcatgctcaagttgctgtgggtatcttacgcaatcatctcactcagttttcacctcattttaaatcagggtctctcgcagtagataatgcagatcctatccttaagattccttttgcttcacttgcatcaagactaacgcttgcagagctcaatcaaatactttacagatgtgagtctgaagagaaagaagacggcggcgggtgttatgatattccaaactggtccgctcttaagtacgccggtctccaaggtttgatgtccgttctcgctgagatacgtcccaaaaacgacctcggacacccattttgcaacaatctgcgttccggtgattggatgattgactacgtaagtaacaggctcattagccgttcgggaaccattgcagaggttgggaagtggctgcaagcaatgtttttctatcttaagcaaattccaagatatttgatcccttgttattttgatgcaattttgattggtgcttataccacattactagatacagcttggaagcagatgagctcgttcgttcaaaacggctccactttcgtgaagcatttgagcttgggttccgttcagttgtgtggtgtgggtaagttcccatctctccccatcctctcgccagctctgatggatgtcccttaccggttgaatgagatcaccaaggagaaggagcagtgttgtgtatcacttgctgcaggtttaccccacttctcctctggaatttttagatgctggggacgtgacaccttcattgcgctcaggggcattcttttgataactggcaggtacgtggaggccaggaatattattctcgcattcgccgggacccttcgtcatggtcttattccaaacttgctaggggagggcatctacgcacggtataattgcagggacgctgtttggtggtggctgcagtgtattcaggattattgtaaaatggttccaaacggtctggatattcttaagtgcccggtgtcccgaatgtatcctaccgatgactccgcgccattaccagcaggaacactagatcagccactgtttgaagttatacaagaagccatgcaaaaacatatgcagggaatacaattccgtgagagaaatgcgggacctcagattgatagaaacatgaaagatgaaggattcaatatcaccgccggagtcgatgaagagactggattcgtctatggaggtaatcgcttcaattgcgggacctggatggataaaatgggagaatctgatagagcgagaaatcgaggaattccagcaacccctcgggacggatcggccgtggagatagtcggcttgtctaaatctgcagttcgatggctacttgagcttagtaaaaagaatatattcccttatcatgaagtcactgttaagcgtcatggtaaggcaattaaagtttcctacgacgaatggaacagaaagatccaggataatttcgaaaagcttttccacgtaagtgaagatccttccgacttaaatgaaaagcatccaaacttggttcataagaggggtatctacaaggattcctatggtgccagctccccatggtgcgactatcaattgaggcctaactttacaatcgctatggttgtggcacccgagctcttcactacggaaaaagcctggaaggccctggagattgccgagaagaagttgcttggtcctcttggaatgaaaacgctggacccggacgacatggtttattgcggtatttacgataacgcgctcgataatgacaattacaatcttgccaagggctttaattatcatcaaggaccagagtggctttggcctatcgggtacttccttagggctaagctttacttctctcgtttgatgggtccggagaccaccgcaaaaactatcgtattagtgaaaaacgtgttgtcccgtcattatgtgcatctcgagcggtccccctggaaagggttgccagaactgaccaatgaaaacgcccagtattgtcctttttcctgtgagacacaagcttggagtatcgccactattctcgagaccttgtatgacctt

SEQ ID NO: 6077 - DNA, 4596 bp, Artificial Sequence
  Description of Artificial Sequence: Synthetic coding sequence
atgggacactcgaagcaaattcgcattctcctgctcaacgaaatggagaagctggaaaaaaccctgtttagacttgaacagggatacgagctgcagtttcgtcttgggccgactctgcaaggtaaagcagtgactgtctacaccaattatccttttcctggcgagactttcaacagggagaagtttagatccttggactgggagaatcccaccgagcgtgaagatgatagcgacaagtactgtaaattgaaccttcaacaaagcggttccttccagtactactttctgcaaggcaacgaaaaatccggcggaggatacatcgtggtggaccctattctgcgggtcggggccgataaccacgtccttcctctggactgtgtcacgcttcaaacctttttggccaaatgtcttggaccttttgatgaatgggaatcacgcctccgggtggcaaaggaaagcggttacaacatgatccatttcacccctctccaaaccctggggctctcgagatcctgctacagcctggcaaaccagcttgagcttaacccggacttttctcggccgaaccgcaaatacacgtggaatgacgtgggacaactggtcgaaaaacttaagaaagaatggaacgtcatttgtattaccgatgtggtgtacaaccataccgcagcaaattcaaagtggatacaagaacacccagaatgtgcatacaaccttgtgaatagccctcatctgaagcctgcctgggtccttgacagagcgctgtggagattctcttgcgatgttgcggaaggtaaatacaaggagaagggaattcccgcgctgattgagaacgaccatcacatgaactccattcgaaagattatctgggaggacatattcccaaagctgaagttgtgggagttttttcaagtggatgtgaacaaagccgtcgagcagttcagaagattgcttactcaagaaaaccgtcgagtcactaaatcggatcctaaccaacacctgactatcatccaagatccagagtacagacgttttggatgtactgtggatatgaacattgcgctgacgacctttatccctcatgataagggtcctgctgcgatagaagaatgctgcaactggtttcacaagcggatggaagaactgaacagcgagaagcatcgcctcattaactaccatcaggagcaggccgttaactgtctgcttggaaacgtcttttatgaacgacttgcgggtcatggaccaaagttgggtcccgtgaccagaaagcacccactggtgacccggtacttcacctttccattcgaagagatcgatttctcaatggaagaatcaatgattcatcttcccaataaggcatgttttcttatggcccacaatggctgggtgatgggggatgaccctctgaggaattttgcagaaccagggtcggaagtctatctccggcgtgagcttatatgctggggagattcagtgaaactgaggtacggtaataagccagaggactgtccctatctctgggcacatatgaaaaagtacaccgaaatcactgcaacttactttcaaggtgtgagacttgataattgtcattccactccccttcatgtggcagagtacatgttggatgcggctagaaacctccagcctaacttgtacgtcgtggctgaactttttaccggctcagaagatctggataatgtgtttgttactcgcttggggatctcctcgcttattcgcgaagcaatgtctgcatacaacagccatgaagaaggaagattggtgtaccggtacggtggggaaccagtgggtagctttgtgcaaccttgtttgcgccctctgatgccagcaattgcgcacgcacttttcatggatattactcatgacaacgaatgccctatcgtgcatcgttcagcgtacgatgctctgccttctactaccatagtctcaatggcctgttgcgccagcgggtccactcgcggctacgatgaactggtgccgcatcagatttctgtcgtgagcgaggagcgattttacacgaagtggaatcctgaagctcttccttcgaacaccggagaagtcaattttcaaagcggcattatcgcagcccgatgtgcaatctcgaaacttcatcaagaactgggggccaaggggtttatccaggtctacgtggaccaggtcgacgaagatatagtggccgtgactagacattcaccttcgatccatcagtctgtcgtggccgtgtccagaaccgcattccgcaaccctaagactagcttctactcgaaggaggtcccacaaatgtgtatcccaggtaagattgaagaagtggttcttgaggcaagaacgattgagagaaacaccaaaccataccggaaagacgagaactccataaatggcaccccagacataaccgttgagataagggagcatattcagcttaatgagtcgaagatagtgaaacaagcaggggtggccacgaagggaccgaacgaatacatccaggaaattgaattcgaaaacttgagcccgggatcggtgattatctttagagtgtcgcttgatccacatgctcaagtggcagtgggaattctgcggaaccatctgacccagttcagcccccacttcaaatcagggtcgctggcagtggataacgcagatcccatactgaaaattccattcgcgtcccttgcatcccggctgaccctggccgagctcaatcaaatcctgtaccgttgcgaatccgaagagaaggaagatgggggaggatgctacgatataccaaactggagcgcactcaaatacgcaggtctgcaaggactcatgagcgtccttgcagagatccgaccaaaaaacgatcttggccacccattctgcaataatctgcgcagcggggattggatgatagactacgtgtcgaacaggctgatatcccggtcgggcaccattgcggaagtggggaagtggcttcaggcaatgttcttttaccttaaacaaattccacgctatcttatcccctgttactttgacgccattcttattggggcctatactactctgctcgataccgcatggaagcaaatgtcctcatttgtgcagaacggatcgactttcgttaagcaccttagcctcggcagcgtgcagttgtgtggcgtcggaaagttcccctccctgcctatcctgtcccctgctcttatggatgtgccatatcggctcaacgagattactaaagaaaaggaacaatgctgcgtctcacttgcagcagggcttccccacttttcttccgggatttttcggtgttggggaagggacacctttatcgccttgcgaggcatactcctcatcaccggacgctacgtggaagcccggaacattattcttgcttttgctggaactctgaggcacggtcttatcccaaacctgctgggtgaaggtatttacgctagatacaattgccgcgacgccgtttggtggtggctccaatgtattcaggattattgcaagatggtgccgaacgggctggatattcttaagtgtcctgtcagccggatgtaccccaccgacgattcggcacctctcccagcaggcaccctggatcaaccactgtttgaggtgatacaagaggcaatgcagaaacatatgcaagggatacaatttagagaacgcaatgcaggcccccagattgatagaaacatgaaggatgaaggatttaacattactgccggtgtggatgaggaaaccggttttgtgtacggtggcaacagattcaactgtggaacctggatggataagatgggagagtccgatcgcgcacggaatagaggaatcccagcaacgcctcgtgatggaagcgcagtggagatcgtcggactctctaagtcagccgtgagatggctgttggagctttcaaagaagaacattttcccataccatgaggtcaccgtcaagagacatggtaaggcaatcaaggtgtcatacgacgaatggaacagaaagattcaggacaactttgaaaagctgtttcacgtctcggaagatcctagcgacttgaatgagaagcatcctaatctcgtccataagaggggcatttacaaggactcatacggagcatcatcgccttggtgtgactaccagctccgacccaatttcacgattgcgatggtggtggcacccgagttgttcaccactgaaaaggcgtggaaggcacttgaaattgcagagaaaaagctgcttggtcctctgggtatgaaaactctcgatccggatgacatggtttactgtggaatatacgataatgcactggacaacgataactacaacctggcaaaggggtttaactaccaccaaggacccgaatggctttggcccatcggatatttcctcagagctaagctgtactttagccgcctgatgggtcctgaaaccactgcaaagacgattgtcctggtcaagaatgtcctctcgcgtcactacgtgcatctcgaaagatcaccttggaagggtctgccggaactgaccaacgaaaatgcccagtactgtccattttcgtgcgagactcaggcatggagcattgctactattcttgagacgctgtacgatctt

SEQ ID NO: 6078 - DNA, 4596 bp, Artificial Sequence
  Description of Artificial Sequence: Synthetic coding sequence
atgggacattcgaaacagatcaggatcttactgctaaatgaaatggaaaaactggaaaagacactgtttcggttggaacaggggtatgaactgcagttcagactaggacccacactccaggggaaagctgtaactgtctacacaaattatccattccctggggagacatttaaccgggaaaaattccgaagtctggattgggaaaaccctactgaaagggaagatgacagtgataagtattgtaaattaaaccttcagcagtcagggtccttccagtactacttcctccaggggaacgaaaaatctggaggggggtatatcgtggtcgatcccatactccgggtgggagccgataatcatgtacttcctcttgattgtgttacactccagacatttctggcaaagtgcttgggaccctttgatgaatgggagtccaggctgcgggttgcaaaagagagtggatataatatgatacacttcactcccctccagacactgggactaagtcgctcctgctattccctcgcaaatcagctagaactcaaccctgatttctcgcggcctaataggaaatatacttggaacgatgtggggcagctcgtagaaaagctaaagaaagaatggaacgtgatatgcattactgatgtggtctataatcacactgctgctaactctaaatggatacaggaacatccagaatgtgcctacaatcttgtaaattctccccatctaaaacctgcatgggtgctcgatagagcactatggcggttttcgtgcgatgtagctgaagggaaatacaaagaaaaagggattccagcgctgatcgagaatgaccatcatatgaattccataaggaaaataatctgggaagatatattcccaaaactaaaactctgggagtttttccaggtcgatgtgaataaagctgtcgaacagttccgccgtctgctaactcaggaaaaccggcgggtcacaaaaagtgaccctaaccagcatctgacaataatacaggatccagaatatagacgatttgggtgtactgtcgatatgaacatagccctgactactttcattccccatgataaaggacccgctgctatcgaagaatgttgcaactggttccacaaaaggatggaagaactgaattccgaaaaacatcgacttatcaattatcaccaggaacaggccgttaattgtctgctcgggaatgtcttttatgaaagactcgctgggcatgggcctaagttagggccagtcacaagaaagcatcctctggtgactcgctattttacattcccattcgaggagatcgatttttctatggaagaatcaatgatacacctacccaataaagcttgttttctcatggctcacaatggatgggtcatgggggacgacccccttagaaattttgcagaacccggatctgaagtgtatctacggagggaactcatttgctggggagactccgtgaaattaagatatggaaataaaccggaagattgcccatatctgtgggcccacatgaaaaaatacacagaaatcacagcaacatattttcagggggtcagacttgataattgtcattcaactccactgcacgtcgccgaatacatgctcgatgccgccaggaatctacagcccaacctctacgtggtagcagaactgttcacagggtctgaagatctcgataatgtatttgtgactcgactcggaatctcttcccttatcagggaagctatgtccgcatacaatagtcatgaggaagggcgactcgtgtataggtatgggggggaacccgtcggatctttcgtacagccatgtctgagaccactgatgcccgctatcgcccacgcccttttcatggatatcacacacgataacgaatgtcccatcgtacatcggtccgcatacgatgccctgccctcaacaacaatcgtttctatggcttgctgcgcttctggatctactcgcggatacgatgagcttgtgcctcatcagattagtgttgtgtctgaagaacggttctatacaaaatggaaccccgaagcgctcccctccaacacaggagaagtgaattttcagtctgggatcatagccgctcggtgcgcaatatcaaaactgcatcaggaacttggggccaaagggttcatccaggtgtacgttgatcaggtggatgaagatatcgtggccgttacacgacattctccatccatacatcaaagtgtggtggcagtgagtagaactgcctttcggaacccaaaaacatcattctattctaaagaggtccctcagatgtgcatcccagggaaaatagaggaagtagtgcttgaagctagaacaatagaacggaacacaaaaccgtacagaaaagatgaaaacagtatcaatggaactcccgatattacagtcgaaattcgggaacatatacagttaaatgagtccaagattgttaaacaggcaggggttgccacaaaagggccaaatgaatacatacaggaaattgaattcgaaaatctttcacccgggtccgttataatatttagggtgtccctggatccacacgcccaggtggccgtcggaatactccgcaaccacctgactcagttctctccccattttaaatcggggtcattggcagtggataacgcagatcctatactgaagattccattcgcctcactcgcttcccgattgacattggccgaactgaaccagatactctacagatgcgaatccgaagaaaaagaagatggagggggatgttatgatatacccaactggtctgcactcaaatatgcagggctgcaggggctcatgtcagtgttagcagaaatccgacccaaaaatgatctggggcatccattttgtaataatctgaggagtggggattggatgattgattatgtatctaaccggctgataagtaggtctgggacaatcgctgaagtggggaaatggctgcaggcaatgtttttttatctcaaacagattccccgctatctcatcccatgttattttgatgccatcttgattggggcatacactacactactcgatacagcctggaaacagatgtcttcgtttgtgcagaatgggtctacattcgtcaaacatctcagtctcgggtcagtgcagctgtgcggggttgggaagtttccatctctgcccatcctctcacccgcccttatggatgtgccttataggctcaacgagatcacgaaggaaaaagaacagtgctgcgtgtccctggcagctgggctacctcacttctcttccggaatatttcgctgctggggacgtgacacattcatagctctcagagggatactgctaatcactggacgctatgttgaagctaggaacatcatccttgctttcgctgggactctgaggcatggacttatccctaatcttctaggggaagggatttacgccagatataattgtcgggatgccgtgtggtggtggctgcaatgtatccaggactactgcaaaatggtccccaatgggcttgatatactgaaatgtcctgtgtccaggatgtatcccacagatgactctgcccccctgcccgccggaacactagatcagcccttattcgaggtcatacaggaggcaatgcagaagcatatgcagggaatccagttcagggaacgcaatgcaggaccacagattgatcgaaatatgaaagatgaaggattcaatatcacagccggggtcgacgaagaaactgggttcgtttacggagggaataggtttaattgcggaacttggatggacaaaatgggggagagtgatagggcccgaaacaggggaatcccagccacacccagagatggatctgctgtggaaatagtcggactttccaaatccgcagtgcgatggcttcttgaattgtcaaaaaaaaacatcttcccctaccacgaagtcactgtaaagcgacacggaaaggcaatcaaagttagttacgatgaatggaatcggaaaatccaggataacttcgagaagttgttccatgtgagtgaagacccgtctgatttaaatgaaaaacaccccaacctcgtgcacaaacggggaatatacaaggattcttatggagcatcttctccttggtgtgattaccagctgcggccaaatttcacaattgccatggtggtagcccctgagctgtttactactgaaaaagcctggaaagccctcgaaattgcagaaaaaaaattactggggccactcggaatgaagactctcgatccagatgatatggtctattgtgggatatatgataacgcgctcgataacgataactataacctggcgaaaggattcaattatcatcaggggcccgagtggctatggcctatcgggtactttctgagagcgaaactgtattttagtcgcctgatggggcctgaaacaacagccaaaacaatagtcttagttaaaaacgtgttatctaggcactacgtgcacctcgagagaagtccatggaagggacttcccgaactgacaaatgaaaatgcccagtactgtccctttagttgtgaaacacaggcttggagtatcgccactatcctagagactctgtacgatcta

SEQ ID NO: 6079 - DNA, 4596 bp, Artificial Sequence
  Description of Artificial Sequence: Synthetic coding sequence
atgggacattcgaagcaaattagaattctccttctgaatgaaatggagaaacttgaaaagactctctttaggttggaacaagggtacgagttgcagttccggctcggtccgacgcttcaaggcaaggcagtgactgtctacaccaattaccctttcccaggagaaacctttaacagagagaagtttcgtagcctggattgggaaaatcctaccgagagagaagatgactccgataagtactgtaagctcaaccttcagcagagcggatcattccagtactatttcctgcaagggaacgagaagagcggcggtggctacattgtggtcgatcctattctgagggtgggggcagataatcatgttctgcccctcgattgtgtcacgctgcaaacttttttggccaagtgtctgggtccatttgacgaatgggagtcaagacttcgcgtggccaaggaatccgggtacaacatgattcattttaccccactgcagaccctgggtcttagcaggtcctgttactcacttgcaaatcaactggaactcaatcccgatttttcgcgacccaaccgcaagtacacctggaatgatgtcggacaacttgtggaaaaactgaagaaagaatggaacgttatctgcattactgatgtggtctataaccacactgcagcgaactcgaagtggatacaggaacaccccgaatgcgcatacaatcttgtgaattccccccaccttaagcctgcctgggtgttggatagggcgctgtggaggtttagctgtgatgtggcggaaggaaagtacaaagaaaagggaattccggcattgatcgaaaacgatcatcatatgaactctatcagaaagatcatatgggaggacatatttccaaagctgaagctgtgggagttttttcaggtggatgtgaataaggcagtggagcaatttcggaggctgctgactcaggaaaatcgtcgggtgaccaaatcggatccaaaccaacatctgactattatccaagacccagagtacagaagatttggatgcactgttgatatgaatattgctttgaccaccttcattcctcatgataagggacctgcagcaatcgaggagtgctgtaattggttccataagagaatggaggagttgaactcagaaaagcaccgtctgataaactaccaccaggaacaagcggtgaactgcttgcttggcaatgtattctatgaaagacttgccgggcatggccctaaacttggtccagtcaccaggaagcacccactcgtcacccgatacttcacttttccctttgaggaaattgatttctctatggaagaatccatgattcatctgccgaacaaagcctgctttctgatggcacataatgggtgggtgatgggcgacgatcccctgaggaacttcgcagagccaggttccgaggtttaccttcgtcgggagctgatttgctggggagattccgttaaacttcgatacggcaataagccagaggattgtccctacctttgggcgcatatgaagaagtacactgaaatcaccgcaacctatttccagggtgtgagattggataactgccacagcactccactccatgtcgcagaatacatgctggatgccgccagaaaccttcaacctaatctgtacgtggtggcagaactctttactgggtccgaggaccttgacaacgtgtttgtcaccagacttgggatttcgtcgcttattagagaggcaatgtctgcatacaattcacatgaagaaggacggcttgtgtaccgatatggtggagaacccgtgggatcatttgttcagccctgtcttaggccacttatgccagctattgctcatgcgctgtttatggacattacgcacgataacgaatgtcctatcgtgcatcgctccgcctacgacgctctcccatccactactattgtctcaatggcatgttgtgccagcgggagcaccagagggtacgatgaactggtgcctcatcaaataagcgtcgtgagcgaggagaggttttacactaaatggaaccctgaagcacttccatccaataccggcgaggtcaactttcagtcggggattattgccgcacgctgcgcgatatcaaagctgcaccaggaacttggagccaagggattcatccaggtgtacgtcgatcaagtggacgaagatatcgtggcggtgacgcggcattctcctagcatccatcaatccgtggtcgcagtgagcagaaccgctttccgcaaccctaagacctccttctactctaaggaggtcccccaaatgtgtatcccaggcaagatcgaagaggtcgtgctggaagcccgtaccattgaacgaaatactaagccctacagaaaggatgaaaactcgatcaatgggacccctgacatcacggtggaaatccgagaacacatccaactcaacgaatccaagatcgtgaaacaggcaggtgtcgccaccaagggtcctaatgaatacatccaggaaattgaatttgaaaacctgtccccaggctccgtgatcatattccgtgtctccctcgacccccatgcacaggttgcagtggggatcctgaggaaccaccttacccaattttccccacacttcaaatcgggatcccttgcagtggataacgccgacccaatacttaagatccctttcgcatcactggcctctcgactcactctggcagagttgaaccaaattctgtaccggtgtgaatcagaagaaaaagaagatgggggagggtgctacgacattcctaattggtcggccctgaaatacgcaggccttcagggacttatgtcagttttggcggaaatccggcctaagaatgatctggggcacccattttgcaataacctcaggtccggagattggatgatagattacgtctcgaatcgccttatttcgagatcaggcactattgcagaagtgggtaagtggctgcaagcaatgttcttttacctgaagcaaattccacgttatcttattccatgttactttgacgcaattcttattggagcttacacgactctcctggacactgcatggaagcagatgtcctcctttgtgcagaacggttccacctttgtgaaacacttgtcactgggttccgtacaattgtgtggggtcggtaagtttccaagcctgccaatcctctcgcccgcgcttatggatgtgccctatagactgaacgaaattactaaggaaaaggaacaatgttgcgtgtcgcttgcagcaggactgcctcattttagctcaggcattttcagatgttggggaagagataccttcatcgctctgaggggtattcttcttattaccggacggtacgtggaggcacgcaacattattcttgcatttgcaggtactcttagacatggacttattccaaatctgctcggagagggtatttacgcacgctacaattgccgagatgcagtgtggtggtggctccaatgcattcaggactattgtaagatggttcctaatggactggacattctcaagtgccctgtctcccgtatgtaccctactgacgattcggcccccctgcctgccggcactcttgatcaacctcttttcgaggtgatccaggaagccatgcagaagcatatgcagggtattcagtttcgagagagaaacgcaggaccgcaaattgatagaaacatgaaagatgagggcttcaacatcaccgcaggcgtggacgaggaaaccggctttgtctacggcggtaaccgtttcaattgtgggacctggatggacaaaatgggggagtcggatagggcgcgcaaccgtggcatacctgccactcctcgcgacggtagcgctgtcgagattgtgggattgtccaagtcagcagtgcgatggctcctggaactcagcaagaagaacatcttcccataccatgaggtgaccgtgaaacggcatgggaaggccattaaagtgagctacgatgaatggaaccgaaagattcaagataactttgaaaagctcttccatgtctccgaggatccatccgatctcaatgaaaagcatcctaatctggtccacaagcggggaatatacaaggatagctacggagcaagctcaccttggtgtgattatcagctgcgtcccaactttactattgcaatggtcgtcgcaccagaactgtttactaccgagaaggcatggaaagcactcgagattgcagaaaagaagctccttgggccgctgggaatgaaaaccctcgatcctgacgatatggtgtactgtggcatttacgataatgccctcgacaacgacaattacaaccttgctaagggatttaactaccatcaaggtcctgagtggctgtggccaatcggttactttcttcgcgcaaaactttacttcagccgcctgatgggcccagagactactgcaaagactattgtgcttgtgaaaaatgtgctttcacgccactacgtccatcttgagagatcgccgtggaagggacttcctgaacttacgaatgaaaatgcacaatactgtccttttagctgcgagactcaagcatggagcattgctactattctggagactctttacgacctg

SEQ ID NO: 6080 - DNA, 4596 bp, Artificial Sequence
  Description of Artificial Sequence: Synthetic coding sequence
atgggacactccaaacagatccggattctgcttctaaacgagatggaaaagttagagaagaccctgtttcggttggagcagggctacgaactccagttccgtctggggcccacactccagggaaaagccgtgactgtctataccaattatccttttcccggagagacttttaatcgcgagaaattcaggtctcttgattgggagaacccaactgagcgcgaagacgactctgataagtactgcaaactcaatctgcagcagtcgggaagcttccagtattacttcctccagggaaacgagaagagtggcggaggatacatcgtcgttgatcctattctacgggttggggcagataaccacgtgttgccactcgactgtgttacactgcagacttttctggctaaatgtttgggcccattcgatgagtgggagagtcgcctcagagttgctaaggaaagcggatataacatgatccactttacgccactccagactcttggcctaagtcgatcttgctactcgctagctaatcagcttgagcttaatcctgactttagtcggcctaaccgaaaatacacatggaacgatgtggggcagctggtcgagaaattgaaaaaggagtggaacgtgatttgcattacagacgtagtctataaccataccgccgctaacagcaagtggatacaggagcaccctgaatgtgcctacaaccttgtgaatagcccccacttgaagcctgcttgggtcctcgacagagcactgtggcgattttcttgcgacgtcgctgaaggtaagtataaagaaaagggaattcccgcactaattgagaacgatcatcacatgaattccatacgaaaaattatttgggaagatatcttcccaaaattaaagctgtgggagtttttccaggttgacgtgaacaaagctgttgagcagtttcgcagacttctgactcaggagaatcgtcgagtgaccaagagcgatcccaatcaacaccttactattattcaggacccggaatataggaggtttggctgcacagtagatatgaatattgcactgactacgtttatcccccacgataagggccccgcagccattgaggagtgctgtaattggtttcacaaacgcatggaagagctcaactcggaaaaacacaggctcataaattatcatcaggagcaggccgtaaattgcctgctggggaacgtcttctacgaaagacttgctggtcatgggcctaaactcggccctgttacacgcaagcatcctctcgtgacgaggtacttcacgtttccatttgaagagatcgacttctcaatggaggagtcaatgatacatctgcctaacaaggcatgctttcttatggcacataatgggtgggttatgggcgatgacccactgcggaacttcgccgaaccgggctctgaggtttacctcagacgggaattgatctgctggggggatagtgtaaaactgcggtacggcaacaaacccgaggactgcccatacttgtgggcgcacatgaaaaagtataccgagataacagccacctacttccagggagtcagattggacaattgtcactccactcccctgcatgtcgccgagtacatgcttgatgctgccagaaatctccaacctaacctgtatgtcgttgcagaactgtttaccggttccgaagacctggataatgtgttcgtgaccaggctaggaataagtagtctcatccgtgaggccatgtctgcctataacagccatgaagagggaaggctggtctacagatacggcggggaacccgtgggatcatttgtgcaaccatgtctccgtccattgatgcccgcaatcgcccacgcactgttcatggacatcacacatgataacgaatgtccaatagtgcacagatcagcctatgacgccctgccctcaacgactatcgtctcgatggcatgttgcgcatcaggaagtactagaggttatgacgagctggtgccccaccagatcagcgtcgttagcgaggagaggttctataccaagtggaacccggaagcactacctagtaacaccggcgaggtgaactttcaatctggaattattgctgcaaggtgcgccataagcaaattacaccaggagttgggggccaagggcttcatacaagtatatgtggatcaggtggacgaggacatcgtcgccgtgacgcggcattctcctagcatccaccagtccgttgttgccgtcagcagaaccgctttcaggaaccccaaaaccagtttttactctaaagaggtgccccagatgtgcatccccggcaagatcgaagaggttgtgcttgaggcccgtactatagagcggaacaccaagccttaccggaaggatgagaattccatcaacggaactcccgacatcactgtagagatcagggagcatattcagctaaacgaatcaaagatcgtgaaacaagccggtgtcgccactaaggggccaaacgagtatatccaggagattgaatttgaaaacttgtcgccgggatctgtaatcatcttccgggtttctctggaccctcatgcccaggtggccgttggcatactccgcaatcatctgacccagtttagcccacatttcaagtccggatccctggctgtggacaatgccgatcccattctgaagatcccgtttgccagcctggcttcccggctgaccctggctgagctgaatcagattctctaccgatgtgaatcagaagaaaaagaagacggcggcggttgttatgacatcccaaattggagcgctttaaagtacgccggcctgcagggcctcatgtctgtgctcgccgaaatccgacctaaaaacgacctgggtcatccattttgtaacaatttgagatccggcgactggatgatcgactatgtgtccaaccgtctaatctccaggtctggcacaatcgctgaggtgggaaaatggctacaggccatgtttttctacctgaaacagatccctcgatacctgataccgtgctacttcgacgcaatcctgataggagcctacactacgttactcgacactgcatggaagcagatgagctcatttgtgcaaaatggatccactttcgtaaaacatctgtctttaggctctgtacagctttgtggggtggggaaatttcccagcctccccattttgtcacccgcccttatggacgtaccctacagacttaacgaaattacaaaagagaaagaacagtgctgtgtctcccttgcggccgggttgccccacttctctagtgggatttttaggtgctggggcagggacacatttatagcccttcgggggatcctcttgattactgggaggtacgttgaggccagaaacattattttggcttttgccgggactctccggcacggcctcattccgaatttgcttggcgagggcatttacgcccggtacaactgtcgggacgccgtgtggtggtggctgcagtgcatccaggattattgtaagatggtgcctaacggactcgatattctgaagtgccctgtttcccggatgtatccgaccgatgatagcgcaccactccctgccggcaccctggaccagcccctgtttgaggtgatccaggaggcaatgcagaaacacatgcagggcatccagttccgggaaaggaacgcagggccacagatagaccggaatatgaaggatgagggattcaacattactgccggagttgacgaggagaccgggttcgtgtatggtggcaataggttcaactgtggtacatggatggacaagatgggagagtccgatagggcccgcaaccgaggaatcccagcaactccccgagacggatcagcagtagaaatagtcggcctctccaagtctgccgtccgttggctcctggaactgagcaaaaaaaatatatttccatatcacgaggtgacagtcaagagacacgggaaggctattaaagtttcctatgatgagtggaataggaagatacaggataatttcgagaagctttttcacgtgtctgaggacccaagtgacttgaatgaaaagcaccccaatctcgtgcataagcgcgggatctacaaggatagctacggcgcctctagcccttggtgcgattatcagttgcgaccaaatttcaccatcgctatggttgtggcacccgagctatttaccaccgaaaaggcctggaaagccctagagatcgcagagaaaaaattgctgggccccctcggaatgaagacactggaccccgacgatatggtttattgcggcatctatgacaacgcactcgacaacgacaactacaacctggcaaaggggttcaactaccatcaggggcccgaatggctctggcccatcggatacttccttcgggccaaattgtattttagtcggctgatgggccctgagaccacagccaagactatcgtgctcgtgaagaatgtgctgtcaaggcattacgttcacctggagaggtctccctggaagggattgcccgagctaactaatgagaacgctcagtactgccccttttcctgtgagacgcaggcatggtcgatcgccaccattctggagaccctgtatgacctt

SEQ ID NO: 6081 - DNA, 4596 bp, Artificial Sequence
  Description of Artificial Sequence: Synthetic coding sequence
atgggccactccaagcaaatcagaatactattgctgaatgagatggagaagctggaaaagacactgtttagactcgagcagggctatgagttgcagttccgtctgggacccacgctccagggaaaggccgtcaccgtgtacacgaactacccatttcccggagaaacttttaaccgcgaaaaattccgcagcctcgattgggagaatcctactgagcgggaggatgattcggataagtattgcaaactcaacttacagcagagcggttcattccagtactatttcctacaagggaacgagaagtcaggcggtgggtacatcgtcgtcgatcctatcctcagggtgggggccgacaaccacgtgctcccacttgattgcgtaactctgcaaaccttcctcgctaagtgcctggggcccttcgacgaatgggagagcagattacgggtggcaaaagaatccgggtataacatgattcacttcacaccacttcagaccctggggctctcccggtcatgctattcccttgctaaccaactggaactgaatcctgacttcagcagacctaatagaaaatacacgtggaacgatgtcggtcagcttgtcgagaaactcaagaaagagtggaacgtgatatgcatcaccgacgtagtctacaaccacaccgcagccaatagtaagtggatccaagaacatccggagtgtgcttataatctggtgaatagcccccatttgaagcctgcttgggtgctcgaccgggccttgtggcggttctcttgcgacgtggcagagggaaagtataaggagaagggaataccggccctgatcgagaatgatcatcatatgaactccattagaaagataatctgggaggacatttttccaaagctaaagttgtgggaattcttccaagtggatgtgaacaaggccgtggagcagtttcgtcggttgttgacacaggagaatcgtcgtgtgacgaagagcgatcctaatcagcatttgaccataatccaggatcccgagtatcgtaggttcggatgcactgttgacatgaatattgccttaactacttttattcctcatgacaagggaccggcagccattgaggaatgctgcaactggtttcacaaacggatggaagaacttaattccgagaaacaccggctgatcaattatcaccaggaacaggccgtgaattgcctactcgggaatgtgttttacgagaggctcgcggggcacggaccaaagctgggtccagtgacacgaaaacaccctcttgtgacacgatactttacctttccattcgaggaaatcgactttagcatggaggaatccatgatccaccttcccaacaaagcctgcttcctaatggcgcacaatggttgggtgatgggagacgatcctctccgcaacttcgcagagcccggatcggaggtgtacctgcgtcgagaactgatttgttggggcgattcagtaaagctgcggtacggaaacaaaccagaggactgtccctatctgtgggcacatatgaaaaagtatactgaaatcaccgcaacctacttccaaggcgtgcgcttggacaactgccactctacgccactgcatgtggccgagtatatgctcgacgctgcaaggaacctccagcccaatctctatgtagtggctgagctctttaccgggtctgaagacctggacaatgtatttgtcacccgcctaggaattagctctctaatccgtgaagcgatgtctgcatataatagtcacgaagagggccgcctggtgtaccgctatggcggcgagccggtgggcagtttcgtgcaaccatgcctacgacccttgatgcctgctatcgctcacgctttgttcatggatatcacccacgacaatgaatgccctatcgttcataggtcggcatacgacgctctaccttcgacaaccatagtgagcatggcctgttgcgcaagtggatcaacgcgaggttacgacgaactggtcccacaccagatctctgtggtgagcgaggaaaggttctacaccaagtggaacccagaggccttaccttcaaacactggggaagtcaatttccagagtggaatcattgctgctcgttgtgccatatcaaagctgcaccaggagctcggagccaaaggctttattcaggtgtacgtcgatcaggtcgacgaggacatcgttgctgtgactaggcacagccctagcatacatcagagtgtggtggcagtctctcggaccgctttccggaatcccaaaacatccttttatagcaaggaggtgccacagatgtgcatacccggaaaaatcgaggaggtcgttctcgaggccagaactatcgagaggaatacaaaaccataccgaaaggatgagaattcaattaatggcactcctgatatcacagtcgaaattcgggaacatatccaactgaatgaatcaaagatcgtgaagcaggcgggggtagccactaaaggcccaaatgagtatattcaggaaatcgagttcgagaacctgtctcccggctctgtgattatcttccgggtgtcccttgacccgcacgcacaggtggccgtgggcattcttcgtaaccacctcacacaattctctccccactttaagtcgggctcgctggccgtcgacaacgctgatcccattctgaaaattccatttgcctcacttgcgagccgcctcaccctggccgaattgaaccagatattgtacagatgcgagagtgaggagaaggaggacggcggcggctgctacgatattccaaattggtccgccttaaaatatgctgggctgcagggtttgatgtcggtgttggctgaaataagacctaaaaacgatctgggacatcctttttgtaataacctgagatccggcgattggatgattgactacgtgagtaacagattgatatcccgctctgggactattgccgaagtgggaaaatggctgcaggcaatgtttttctatctcaagcagatccctaggtatctcatcccatgttacttcgatgccatattgattggagcctataccacactcttggataccgcttggaagcagatgtcatcgtttgtgcagaacggttcgacttttgtgaaacacctcagcttggggagtgtgcagctgtgcggggtcggcaagttcccaagcctgcctatactaagtccagctcttatggatgtgccataccgactaaacgaaatcaccaaggaaaaggagcagtgctgtgttagcctggctgccggcctcccccatttcagcagtgggatcttccgctgttggggacgagataccttcatcgccctgagagggattttactgattacaggacggtacgtcgaagcaagaaatatcattctggccttcgccgggacattgcgtcacggactcatacctaacttgctgggtgaaggcatttacgcccgttataactgtcgggacgccgtttggtggtggctgcaatgcattcaagactattgcaagatggtacctaacggactggatatactgaagtgccccgtgtctagaatgtatcctaccgacgactccgcccctctgccggcagggacactggaccaacctctgtttgaggtgattcaggaggctatgcagaagcacatgcagggaattcagtttcgggagcggaacgcaggcccacagatagaccggaacatgaaggatgagggcttcaatattactgccggcgtggacgaagaaacagggtttgtatacggcgggaaccgcttcaactgtggcacctggatggacaaaatgggagaaagtgatagagccaggaaccgtggcatccccgccactcctagagacggttcagccgtggaaatcgtaggacttagtaaaagcgccgtaagatggctgctggagctcagtaagaaaaatattttcccataccacgaggtgactgtcaagcggcacgggaaagcaatcaaggtgtcttacgatgaatggaatcggaagattcaggataattttgaaaaattgttccacgtgtctgaggatcccagtgacctgaatgagaaacatcccaatctggtccataagcgtgggatttataaggactcatacggcgcctcttctccttggtgcgattaccaactccgtcctaacttcacaatcgcaatggtggtagcaccagagttgttcacaaccgaaaaggcgtggaaggccctagagatcgccgaaaaaaaactgctgggaccactcggaatgaaaacacttgatccagatgatatggtttactgcggtatctacgacaatgctttagacaacgacaactataacctggcgaaaggtttcaactatcatcaaggacctgaatggctttggccaattggttatttccttagagccaaattatattttagccggctcatgggtcccgaaacaactgcaaagacaatcgttctcgtaaagaacgtgctgtcccggcattacgtgcatctggagcggtccccctggaaagggttgcctgaactgacaaacgaaaacgcccaatattgccccttctcctgtgaaacacaggcatggtcaatcgccactattttggagaccctctacgacctg

SEQ ID NO: 6082 - DNA, 4596 bp, Artificial Sequence
  Description of Artificial Sequence: Synthetic coding sequence
atgggacactcaaagcagatccgcattttgctgctcaacgaaatggagaaacttgagaaaactctgtttcgtctggagcagggctacgaactccagtttcggcttggccccacactgcagggtaaggcggtgactgtttatacaaactacccttttccaggcgaaaccttcaacagagaaaaattccggtccctcgattgggagaacccaaccgaacgagaggacgactctgataaatactgtaagctgaacttacaacaatctggaagcttccagtactactttctgcaaggcaacgaaaagtcaggcgggggatacatcgtagtggaccccatactgcgggtgggtgccgacaaccacgtgttgcctctggattgtgtgaccctgcagacttttctggctaaatgccttggacccttcgatgagtgggagtcacgactgagggtggcgaaagaaagtggctacaatatgatccattttactccactgcagacactgggactatctcggtcatgttattcgttggccaatcagttggagctgaatcctgactttagcaggcccaatcggaaatacacctggaatgacgtcgggcagcttgtcgaaaagctgaaaaaagaatggaatgtcatttgcattaccgatgttgtgtacaaccacacagccgctaactccaaatggatacaggagcaccctgagtgcgcctacaatctagtcaactctccccacttgaaacctgcatgggtcctcgatagagccctgtggcgcttctcttgcgatgtggcagaagggaaatataaggaaaaggggattcccgctctaatcgagaacgatcatcatatgaacagcatacgcaaaattatatgggaggatattttcccgaagctgaaactgtgggagttctttcaggttgatgttaacaaagcagtggagcagttcaggcgactgctgacccaggagaacaggagagtgacaaagagcgatcccaatcagcacttgacaataattcaggatcctgagtacaggaggtttggctgtaccgtcgacatgaacatcgccttgactacatttatcccccacgacaaaggtcccgccgctatcgaagaatgctgtaactggtttcacaagcggatggaagaactgaatagcgaaaaacacaggctaataaattatcaccaggagcaggcagttaattgcttgttgggaaatgtattctacgagcgtcttgctggacatggtcctaagttaggacccgtaacacgtaagcacccgttggtcacaaggtactttactttcccctttgaggagatcgacttctcaatggaagagtctatgattcacctgcctaacaaggcatgctttcttatggcacataacgggtgggtaatgggagatgacccgctgcgaaatttcgcagagccggggagcgaagtttatctgcgccgcgaacttatctgttggggagatagcgtgaagctgcgctatgggaataaaccagaagattgcccctacctgtgggcacatatgaaaaagtatacagagattacagcaacatatttccagggcgtacggctagataattgtcattccacaccccttcacgtagcagagtacatgcttgacgccgccagaaacctgcagcctaatttatacgtggtcgcagaactcttcaccggatccgaggacctagacaacgtgtttgtgactaggctgggaattagctcactaataagagaggcaatgagtgcatacaatagtcacgaggagggacgcctggtatataggtatgggggtgagcccgttggctcattcgtccaaccttgcctgagacccttaatgccagcgattgcccatgctctttttatggacattacccatgataacgagtgtcccattgtgcatcgaagcgcttatgacgcccttccctcaacaaccatcgtgagtatggcctgttgcgcatctggatctacacgcggttacgatgagcttgtgcctcaccagatttccgtggtttccgaggagagattttatacaaagtggaacccagaggccctgcctagtaacactggcgaggtgaattttcaatctggaatcatagccgcccggtgtgctatctctaaattacaccaggaattgggagctaagggattcatccaggtgtatgtagatcaagtcgacgaggatatcgtcgccgttacaagacatagcccgtctatacatcagtctgtggtggcagtgtctagaactgccttccgaaaccccaaaactagtttctacagcaaagaagtaccacaaatgtgtattccgggcaagattgaagaggtggtcctggaggccagaacgatagagagaaatacaaagccctacaggaaagacgaaaattccattaatgggaccccggacatcacagttgaaattagagaacatattcaattgaatgagtccaagatcgtgaagcaggccggggttgccactaaagggccaaacgaatatatccaagagattgaattcgagaacctgtctcctgggtcagtgataatctttcgggtgagcttagacccacatgcacaagttgctgtggggatactgcgcaatcacttgacccaatttagtccccactttaagagtgggagtttggccgtggataatgccgaccctatcctgaagataccctttgcaagtctcgcttccagactgacgctcgctgagttgaaccaaatcctctaccggtgtgagtcggaagaaaaggaggatgggggaggctgctatgatatcccaaactggagtgcgctgaaatatgcaggcctgcaaggcctgatgagcgtgctggcagaaatacggcctaagaatgacctaggccatccattttgtaataacctgaggtccggcgattggatgatcgattacgtttccaaccgactcatatccagatccggaacgatagccgaagtggggaagtggctacaggccatgttcttctacctcaaacagatcccccggtacttgatcccctgctactttgatgccatcctgattggcgcctacaccacgcttttggacacagcatggaagcagatgtcaagttttgtgcagaacggatccaccttcgtcaagcacctgtctctgggcagcgtccagctgtgcggcgtgggcaagtttccaagcttaccgattctgagtccagcactcatggacgtgccctatcgcctcaatgagattaccaaagagaaggaacagtgctgcgtttcactggccgcaggtctgccacactttagttctggtatcttcagatgctgggggagggacacatttattgccctgcgcggcatcctgctgattactggccgctatgtggaggccaggaacattatcctagccttcgcgggaacgctgcgccatggcctgatcccaaatctcctgggggaggggatatatgcacggtataattgtagagacgccgtgtggtggtggcttcagtgtatccaagattattgtaagatggtcccgaatggcctcgatatacttaaatgcccggtgagtaggatgtacccaactgatgactccgcgccccttccagccgggacactggaccagcctctctttgaggtgattcaggaagccatgcagaaacatatgcagggcattcagttcagagagaggaacgcggggccacagatagaccgtaatatgaaagatgaaggatttaatattaccgctggcgtggatgaagagactgggttcgtgtacggcggtaaccgctttaattgcggcacctggatggataaaatgggtgaaagtgacagggctcgtaacagggggatacctgcaacgcccagggatggatccgccgtcgagatagtcggcctctcaaagtccgcggtgcggtggttgctggagctgtcaaagaaaaacatttttccataccacgaggtgacggtcaagaggcacgggaaggcaataaaggtgtcctacgacgaatggaaccgaaaaatccaggacaacttcgagaaactgtttcacgtgtcagaggatccctcagacctcaacgagaagcaccctaatctcgtgcataaacgggggatatacaaggatagctacggagcctctagcccatggtgtgactaccagctgagaccgaacttcacaattgctatggtcgttgcccctgagctgttcactaccgaaaaagcatggaaagccctcgaaatcgcagaaaaaaagctactgggccccttgggtatgaagacactagatcctgacgacatggtgtattgtggtatctacgataatgccctggacaatgacaactataacctcgcaaagggtttcaattatcatcagggaccagaatggctgtggcctatcggctacttcctgagagccaagctgtatttctcacggctcatggggccagagaccactgccaaaactattgtgttagtgaaaaatgtcctctcccgacactatgtccacctcgagaggtctccctggaagggactgcctgagctaacaaacgaaaacgcccagtattgccccttctcctgtgaaacacaggcatggtctatcgcgacaatcctggaaactctctacgacctg

SEQ ID NO: 6083 - DNA, 4596 bp, Artificial Sequence
  Description of Artificial Sequence: Synthetic coding sequence
atgggacacagcaagcagatcagaatcctgctgctcaatgagatggagaagctcgagaaaactttgttccggctggaacagggatacgagctccagtttcgcctgggtcccactctgcaggggaaggccgtgactgtctataccaactaccccttcccgggtgaaacctttaacagggagaaattccgcagcctcgattgggagaacccgaccgagcgcgaggatgattcggataagtactgcaaacttaacctgcagcagtcggggtcctttcaatactatttcctgcagggtaacgaaaagtccggcggcggttacatcgtggtcgatccgatcctcagggttggtgcggacaaccacgtgctgccgctggactgcgtgaccctccaaaccttcctggccaagtgcctgggaccgttcgacgaatgggaatcaagactgagagtagccaaggaatcgggctacaatatgatccatttcacgccgcttcaaaccctcggcctgtcccgctcctgttactccttggcgaaccaactggagctcaatccagacttctcacgccccaatcgcaagtacacctggaatgacgtgggccagctcgtggaaaagctgaaaaaagaatggaacgtcatctgcatcactgacgtcgtgtacaaccataccgcggccaattcgaagtggattcaggaacatcctgagtgcgcttacaacctggtgaactcaccacatctgaagccagcatgggtgttggatcgcgcgttgtggcgcttttcgtgcgacgtggccgagggcaagtataaggagaagggaattccagccctgatagagaatgaccaccatatgaactccatccggaagatcatctgggaggacatcttcccgaagctgaaattgtgggagttttttcaagtcgacgtcaacaaagctgtcgagcagtttaggcggctgctcacgcaggaaaaccggcgcgttaccaagtcggatcccaaccagcacctgactatcatccaggacccagaatatcgacgatttggatgtaccgtggacatgaacattgccctcaccaccttcattccacacgataaagggccggcggccatcgaagagtgctgcaactggtttcacaaacgcatggaagagttgaattcggaaaaacaccggctgatcaactaccaccaggaacaagccgtgaattgcctgctggggaacgtgttctacgaaagactggcggggcacgggccaaagctgggaccggtgacgcgcaagcatcccctcgtgaccagatacttcactttcccattcgaagagatcgacttctccatggaagaaagtatgatccacctgcctaacaaggcgtgctttctgatggcgcacaatggatgggtcatgggcgacgatccactgcggaactttgccgaaccgggatccgaagtgtatcttcgccgcgagctgatctgctggggagattcggtgaaactgcgatacggcaacaagccggaagattgtccctacctctgggcacatatgaagaagtacacggaaatcacggcgacctacttccaaggcgtccgactggacaattgccattccactcctctgcatgtggcggaatacatgcttgatgctgctagaaatcttcaaccaaatctgtacgtcgtcgcggaactcttcaccgggagcgaagatctcgacaatgtgttcgtcacgcgactgggaatctcctcgctcatccgcgaagccatgtcggcatacaattcccacgaggaagggcgccttgtgtacaggtacggcggtgagccggtgggctccttcgtgcagccttgtctgcgccccctgatgccggctatcgcccatgcactctttatggatatcacccatgataacgaatgtccgatcgtccatcgtagcgcgtacgatgcccttcctagcactaccatcgtgagcatggcctgttgcgcttccggatcaaccaggggttacgacgaactggttccgcatcagatctcggtggtgtcggaagaacgcttttacactaaatggaaccccgaagccctgccatccaacactggagaggtgaattttcagtcaggaatcatcgcagctagatgtgcaatctccaagctccaccaggagctgggagccaagggatttatccaggtgtacgtggatcaggtggatgaggacatcgtggcagtcaccagacatagcccgtcaatccaccagtcggtggtggcggtgtcgaggactgccttccgcaatccgaaaacctcgttctactccaaagaggtgccgcagatgtgtatcccgggtaagatcgaggaggtcgtgctggaggccagaaccatcgagaggaatactaaaccgtaccggaaagacgaaaactccatcaacggcactccggacatcacggtggagatccgggagcatatccagctgaacgaaagcaagatcgtgaaacaggctggcgtggccactaagggtcctaatgagtacatccaggagattgagttcgaaaatctctcgccaggctcagttatcatcttccgagtcagcctggacccgcacgcccaggtggcagtcggtatcctcagaaatcatttgacccagttttccccgcacttcaagtcgggatcgctggcggtcgataatgctgatcctatcctgaagatcccttttgcaagcctggcatccagactcactctggcggaactcaaccagatcttgtacagatgcgaaagcgaggagaaggaagatggaggaggatgctacgatatcccgaactggagcgcgttgaagtatgccggtctgcagggcttgatgtccgtgctggcagaaataaggccaaagaacgaccttggacaccctttctgtaacaatctgagatccggagattggatgatcgactacgtgtcgaaccggctcatctccaggtctggaactatcgcggaagtcggaaaatggctccaggccatgttcttctatctcaaacaaatcccgagataccttatcccgtgttacttcgatgccatcctcattggagcctacactacccttctcgataccgcctggaagcagatgtcgagctttgtgcaaaacggatccactttcgtgaaacacctgtcgctgggtagcgtgcagctttgcggcgtgggaaagtttccgagcctgccaattctctccccggcgctcatggacgtgccgtacagactcaacgaaatcaccaaggagaaggagcaatgctgcgtgtccctggccgcaggactgccgcacttctcctccggaatctttcggtgttggggacgcgacaccttcattgctttgcgcgggattcttctgatcaccggacggtatgtggaggctcgcaatatcatcttggcgtttgcgggcaccctgagacacggcctgatccctaatctcctgggggaaggaatctacgcacgctacaactgccgcgacgccgtgtggtggtggctgcaatgtattcaggactactgcaagatggtgccaaatggactggatatcctcaagtgcccagttagccggatgtatccgactgacgattcagcacctctcccggctgggactcttgaccagccgctcttcgaggttatccaggaagccatgcagaaacacatgcaaggaatccagtttcgcgaacggaatgccggacctcagattgaccgaaacatgaaggacgagggattcaacattaccgcgggcgtggacgaagaaaccggcttcgtgtatggtggtaatagattcaattgcggcacctggatggacaagatgggagagtcagacagagccagaaaccggggaatcccggccaccccaagggatggctcagcggtcgagatcgtgggactgagcaagtcggctgtgcggtggcttctcgaattgtcaaaaaagaacatctttccgtaccatgaagtgaccgtgaagcggcacggcaaggccatcaaagtgtcatacgatgaatggaacaggaaaatccaggacaacttcgagaagctgtttcacgtgtcggaagatccatcagacctgaacgagaaacacccaaacctggtgcataagcgcggtatctacaaagactcatacggcgcatcttcgccctggtgcgattaccagctgcggcccaatttcactatcgcgatggtggtggcgccggaattgttcacgacggagaaggcgtggaaagccctcgagattgcggagaaaaagctgttgggaccgctgggaatgaaaacccttgacccagatgacatggtgtattgtggaatctacgataatgccctcgacaacgacaattacaacctcgccaaagggtttaactaccatcaaggccctgaatggctctggcccatcggttactttctgagagcaaagctctatttctcgcgcctcatgggaccggagactacggcaaagactattgtgctggtgaagaacgtcctctccagacattacgtgcatcttgaacgctccccatggaagggactccccgagctcaccaatgaaaatgcgcaatactgcccgttctcctgcgaaacccaggcttggtcgatcgccaccatccttgaaactctctacgacctc

SEQ ID NO: 6084 - DNA, 4596 bp, Artificial Sequence
  Description of Artificial Sequence: Synthetic coding sequence
atgggtcacagcaagcaaattcgcatactactgctgaacgagatggagaaactggaaaaaacgttgttccgcttggagcagggttacgagctgcagtttaggctaggcccaacgctacaggggaaggcggtgaccgtgtatactaactacccttttccaggcgagacctttaaccgcgagaagtttcggtccttagattgggaaaaccccactgagagggaagacgactccgacaagtactgcaagctgaatctacagcagtctggatccttccaatactatttcttgcagggtaacgagaagtcaggcggcgggtacatagtggtcgatccgattctgcgagtcggagctgataaccatgtgctgcccctggactgcgtgacccttcagactttcctggctaaatgcctgggacccttcgacgaatgggagagcagacttagagttgctaaggaaagtggttacaacatgattcattttacaccgctgcagactctcgggctgtccagatcctgctattctctggccaatcagctcgaactgaatcctgacttctcaagaccaaatcgaaaatacacatggaacgatgtgggacagctggtcgagaaactcaagaaagaatggaacgtcatttgcatcaccgacgttgtctacaatcacacagctgccaattccaaatggattcaggaacacccagagtgcgcctataacctcgtgaatagccctcacctgaagccagcctgggtgctggaccgtgctctgtggagattctcatgcgatgtggctgagggaaagtacaaagaaaaaggcatcccagcgctgattgaaaacgatcaccacatgaattctataaggaagattatttgggaggatatcttcccaaaactcaagttgtgggagttcttccaggtggatgttaacaaagctgttgaacagtttcggcggctcctgacccaggagaacaggcgagtgaccaagtctgaccccaaccagcatctcactattatacaggaccccgaataccgccgcttcgggtgcactgtggatatgaacatcgctcttaccactttcattccacacgataaagggcccgcagcgatcgaggagtgttgtaattggttccacaaaagaatggaggaactgaattcagaaaaacaccggttgataaattaccaccaggagcaggccgtgaattgcctgttaggaaacgtgttttatgagcggctggctggccatggtcccaagttaggtcctgtgacaagaaagcatcctctggttactagatacttcacgttcccattcgaggaaatagattttagtatggaggaatccatgatacacctccccaacaaagcctgcttccttatggcgcataatgggtgggtaatgggcgacgatccccttagaaacttcgctgaacccggctccgaagtgtaccttcggcgggaactgatctgttggggggattccgtgaaattgaggtacggcaataagcccgaagactgtccatatctgtgggcccatatgaagaaatacaccgagatcacggctacttatttccagggagtaaggctggataactgtcacagtacccctctgcacgtggcagagtatatgctagacgctgcacgaaacctgcagcccaacctctacgtagttgccgagctgttcactggcagtgaagatctggataatgtcttcgtgactcgcctgggaatctcatctctgataagagaagcgatgtcagcctacaacagtcacgaagaaggccgtctggtatatagatatggcggtgaacctgttggatcctttgttcagccatgcctgcgcccgctaatgcctgctatcgcccacgcgctcttcatggacattacccatgataatgagtgccctatcgtgcatcggagcgcatacgacgccctgccttctacaacaatcgtgtcaatggcttgctgtgcatcgggatctactaggggttatgatgaactggttccccaccagatatccgtggtgtccgaagagcggttttatacaaaatggaacccagaagcactcccctctaatactggggaagtgaacttccagtccggtattattgccgcacggtgcgctattagcaagctgcatcaggagctgggcgcaaaaggattcatccaggtgtacgtagatcaggtcgatgaagacatcgtggccgttactcgtcattctccatcgatccaccaaagcgtggtggctgtgagccggaccgctttcagaaacccgaagacctctttctattctaaggaagtgccccagatgtgcatcccaggaaagattgaggaggtagtcctcgaggcacgcacgattgaacgaaatactaaaccatacaggaaggatgagaacagtatcaacggcactccagatattacagtcgaaattcgcgaacacatacaactgaacgagtccaagatagtcaagcaagccggagtggctactaaggggcccaacgagtacatccaggagatcgagtttgagaacttgtcgcctgggtctgtgattatttttcgtgtgtctcttgacccgcacgctcaagtggctgtcgggattttaaggaatcatctaactcagtttagtcctcatttcaaatcgggctctttggccgtggataatgcagatccgattctgaagatcccttttgcctctttagcctcacgtctcacactggcagagcttaaccagattctgtacaggtgtgagtcagaagagaaggaggatggagggggttgttatgatattcccaattggtccgcactgaaatacgccggtctgcagggattgatgtctgttctcgcggagattcggccgaagaacgaccttggccatcctttttgtaataatttgaggtctggtgattggatgatagactatgtttctaaccgacttatctctcgaagcgggaccatcgccgaggtgggcaaatggctgcaggcaatgtttttttatctgaaacagattcctcgctatcttatcccttgttatttcgacgccatccttattggggcatatactacactacttgatactgcatggaaacagatgagcagctttgtccagaacgggagcacctttgttaaacatctgagtctggggtctgtgcagctgtgtggtgtcggcaagtttccatctcttcccattctcagtcccgcgcttatggacgtgccttaccgcctgaatgagatcaccaaggagaaggaacagtgttgtgtgtccctagccgcaggcctgccacacttctccagtggaatcttccgctgttggggtagggacacatttatcgccctgcgcggcatccttcttataactgggcgctacgtggaggctaggaacataattttggcatttgccggaactctcagacacggacttatccccaatctactgggcgagggaatctatgcacgctataactgcagagatgccgtgtggtggtggctgcagtgcatccaggattactgcaaaatggtccccaacggccttgacattcttaagtgccctgtgtcccggatgtaccccacagacgacagcgcccccctgccagctgggactctggatcagcctctgtttgaagtgattcaggaggcgatgcaaaaacatatgcagggcattcagtttagagagcgcaatgccggcccgcagattgatcgcaacatgaaagatgaaggcttcaacatcacggcgggggtggatgaagaaactggcttcgtctatggaggcaataggttcaactgtgggacgtggatggacaaaatgggggaatcagatagggctcgaaaccgcggaattccggcaactccccgcgatggctccgcagtggaaatagttgggctgagtaagtcggcagtaaggtggttgctcgagctttccaagaaaaacatattcccttaccacgaggtcactgtgaagagacacggaaaggccatcaaggtgtcctacgatgagtggaaccgaaaaattcaagacaatttcgagaaactgtttcacgtaagtgaagacccatccgatcttaatgagaagcacccaaacctggtccacaaacgaggaatctacaaggactcgtacggagccagcagtccttggtgtgattatcaactgagaccaaacttcacaatcgccatggtggtggcccccgaattatttaccactgagaaagcctggaaggcccttgagatcgcagaaaagaagttgctggggccattaggcatgaagactcttgaccccgacgacatggtctactgtgggatttatgataacgccctcgataatgacaattacaacttggccaaaggtttcaactatcaccagggacccgaatggctgtggcctatcgggtatttcctgcgagcaaagctctatttttcacgcttgatgggccctgaaaccaccgcgaagaccattgtcctggtgaagaatgtgctcagtagacattacgtgcacctcgagaggtccccatggaagggccttcctgagctaaccaacgaaaacgctcagtattgtcccttcagttgtgaaactcaagcctggagtatagcgacaatcctggagactctttacgactta

SEQ ID NO: 6085 - DNA, 4596 bp, Artificial Sequence
  Description of Artificial Sequence: Synthetic coding sequence
atgggtcattcgaaacaaatacgaatactattactaaatgaaatggaaaaattagaaaaaacgctatttcgattagaacaaggttatgaattacaatttcgattaggtccgacgctacaaggtaaagcggttacggtatatacgaattatccgtttccgggtgaaacgtttaatcgagaaaaatttcgatcgttagattgggaaaatccgacggaacgagaagatgattcggataaatattgtaaattaaatttacaacaatcgggttcgtttcaatattattttctacaaggtaatgaaaaatcgggtggtggttatatagtagtagatccgatattacgagttggtgcggataatcatgtactaccgttagattgtgttacgctacaaacgtttttagcgaaatgtttaggtccgtttgatgaatgggaatcgcgattacgtgtagcgaaagaatcgggttataatatgatacattttacgccgctacaaacgttaggtttatcgcgttcgtgttattcgctagcgaatcaattagaactaaatccggatttttcgcgaccgaatcgaaaatatacgtggaatgatgttggtcaactagtagaaaaattaaaaaaagaatggaatgtaatatgtataacggatgtagtatataatcatacggcggcgaattcgaaatggatacaagaacatccggaatgtgcgtataatttagtaaattcgccgcatctaaaaccggcgtgggtattagatcgagcgttatggcgtttttcgtgtgatgttgcggaaggtaaatataaagaaaaaggtataccggcgttaatagaaaatgatcatcatatgaattcgatacgtaaaataatatgggaagatatatttccgaaactaaaactatgggaattttttcaagttgatgtaaataaagcggttgaacaatttcgtcgtctattaacgcaagaaaatcgtcgtgtaacgaaatcggatccgaatcaacatttaacgataatacaagatccggaatatcgtcgttttggttgtacggtagatatgaatatagcgttaacgacgtttataccgcatgataaaggtccggcggcgatagaagaatgttgtaattggtttcataaacgaatggaagaactaaattcggaaaaacatcgtctaataaattatcatcaagaacaagcggtaaattgtctactaggtaatgtattttatgaacgactagcgggtcatggtccgaaattaggtccggtaacgcgtaaacatccgctagtaacgcgatattttacgtttccgtttgaagaaatagatttttcgatggaagaatcgatgatacatctaccgaataaagcgtgttttttaatggcgcataatggttgggtaatgggtgatgatccgctacgaaattttgcggaaccgggttcggaagtatatctacgacgagaactaatatgttggggtgattcggtaaaactacgttatggtaataaaccggaagattgtccgtatctatgggcgcatatgaaaaaatatacggaaataacggcgacgtattttcaaggtgtacgtttagataattgtcattcgacgccgctacatgttgcggaatatatgttagatgcggcgcgaaatttacaaccgaatctatatgttgttgcggaactatttacgggttcggaagatctagataatgtatttgttacgcgactaggtatatcgtcgctaatacgagaagcgatgtcggcgtataattcgcatgaagaaggtcgattagtatatcgatatggtggtgaaccggtaggttcgtttgtacaaccgtgtttacgtccgctaatgccggcgatagcgcatgcgttatttatggatataacgcatgataatgaatgtccgatagtacatcgatcggcgtatgatgcgctaccgtcgacgacgatagtatcgatggcgtgttgtgcgtcgggttcgacgcgaggttatgatgaactagtaccgcatcaaatatcggttgtttcggaagaacgtttttatacgaaatggaatccggaagcgttaccgtcgaatacgggtgaagttaattttcaatcgggtataatagcggcgcgatgtgcgatatcgaaattacatcaagaactaggtgcgaaaggttttatacaagtatatgtagatcaagtagatgaagatatagttgcggttacgcgtcattcgccgtcgatacatcaatcggtagtagcggtttcgcgaacggcgtttcgtaatccgaaaacgtcgttttattcgaaagaagttccgcaaatgtgtataccgggtaaaatagaagaagtagtactagaagcgcgaacgatagaacgtaatacgaaaccgtatcgtaaagatgaaaattcgataaatggtacgccggatataacggttgaaatacgtgaacatatacaattaaatgaatcgaaaatagtaaaacaagcgggtgttgcgacgaaaggtccgaatgaatatatacaagaaatagaatttgaaaatctatcgccgggttcggtaataatatttcgtgtttcgttagatccgcatgcgcaagttgcggtaggtatactacgaaatcatctaacgcaattttcgccgcattttaaatcgggttcgttagcggttgataatgcggatccgatattaaaaataccgtttgcgtcgctagcgtcgcgattaacgctagcggaattaaatcaaatactatatcgatgtgaatcggaagaaaaagaagatggtggtggttgttatgatataccgaattggtcggcgctaaaatatgcgggtctacaaggtttaatgtcggtattagcggaaatacgtccgaaaaatgatttaggtcatccgttttgtaataatctacgttcgggtgattggatgatagattatgtatcgaatcgtctaatatcgcgatcgggtacgatagcggaagtaggtaaatggctacaagcgatgtttttttatttaaaacaaataccgcgttatctaataccgtgttattttgatgcgatactaataggtgcgtatacgacgctattagatacggcgtggaaacaaatgtcgtcgtttgttcaaaatggttcgacgtttgttaaacatctatcgttaggttcggttcaattatgtggtgttggtaaatttccgtcgctaccgatactatcgccggcgttaatggatgttccgtatcgtctaaatgaaataacgaaagaaaaagaacaatgttgtgtttcgttagcggcgggtttaccgcatttttcgtcgggtatatttcgttgttggggtcgagatacgtttatagcgttacgtggtatattactaataacgggtcgttatgtagaagcgcgtaatataatattagcgtttgcgggtacgctacgtcatggtctaataccgaatttattaggtgaaggtatatatgcgcgttataattgtcgagatgcggtatggtggtggttacaatgtatacaagattattgtaaaatggtaccgaatggtttagatatattaaaatgtccggtatcgcgtatgtatccgacggatgattcggcgccgttaccggcgggtacgctagatcaaccgctatttgaagttatacaagaagcgatgcaaaaacatatgcaaggtatacaatttcgagaacgtaatgcgggtccgcaaatagatcgtaatatgaaagatgaaggttttaatataacggcgggtgtagatgaagaaacgggttttgtttatggtggtaatcgttttaattgtggtacgtggatggataaaatgggtgaatcggatcgtgcgcgaaatcgaggtataccggcgacgccgcgtgatggttcggcggttgaaatagttggtttatcgaaatcggcggttcgatggctattagaactatcgaaaaaaaatatatttccgtatcatgaagtaacggtaaaacgacatggtaaagcgataaaagtatcgtatgatgaatggaatcgtaaaatacaagataattttgaaaaattatttcatgtttcggaagatccgtcggatttaaatgaaaaacatccgaatctagtacataaacgaggtatatataaagattcgtatggtgcgtcgtcgccgtggtgtgattatcaactacgtccgaattttacgatagcgatggtagttgcgccggaattatttacgacggaaaaagcgtggaaagcgctagaaatagcggaaaaaaaactactaggtccgctaggtatgaaaacgctagatccggatgatatggtatattgtggtatatatgataatgcgctagataatgataattataatctagcgaaaggttttaattatcatcaaggtccggaatggttatggccgataggttattttctacgagcgaaattatatttttcgcgattaatgggtccggaaacgacggcgaaaacgatagtattagttaaaaatgttttatcgcgtcattatgtacatttagaacgttcgccgtggaaaggtctaccggaattaacgaatgaaaatgcgcaatattgtccgttttcgtgtgaaacgcaagcgtggtcgatagcgacgatattagaaacgctatatgattta

SEQ ID NO: 6086 - DNA, 4596 bp, Artificial Sequence
  Description of Artificial Sequence: Synthetic coding sequence
atgggacattccaaacaaatccggatccttctgctcaacgagatggagaagctcgagaaaacacttttcagacttgaacagggctacgagttacagtttaggttgggcccaacccttcaaggaaaagctgtgaccgtttacaccaactacccattccccggagagactttcaacagagagaaatttaggtctctggactgggaaaaccctacagaacgtgaagatgacagtgacaaatactgtaaattgaatctgcagcaaagcgggtcattccaatattactttctgcaggggaacgagaaaagcggaggaggatatatcgtggttgaccccatcctgagagttggcgcagacaaccatgtcctccccctggactgtgtgactctgcaaacttttttagcgaagtgcctgggaccatttgatgagtgggagagcaggcttagagtcgcgaaggaatctggctacaacatgatccatttcacccctctgcaaaccctgggacttagtcggtcttgttacagcctggctaaccaacttgagctcaacccagattttagtcgtccaaacaggaagtacacatggaacgatgtcggacagctagtggagaagttgaaaaaggaatggaacgtgatctgtatcacagatgttgtttacaaccatactgctgcgaactctaaatggattcaggaacacccggaatgtgcttataatcttgttaacagcccacacctgaagcctgcttgggtgctggatagagcactgtggaggttttcctgcgacgtggccgagggaaaatataaagaaaagggcatacccgccttgatagagaatgatcaccatatgaacagtatcaggaaaataatctgggaagatatcttccccaagttgaagctgtgggagttttttcaggtggatgtcaataaagcagtggaacagttccggaggctccttacacaagagaatcgcagggtcactaagagcgaccccaatcaacatctcacaattatccaggatccagaataccgccgctttggctgcactgtggacatgaacatcgccctgacgactttcatccctcatgacaaaggacctgctgccattgaagagtgctgcaactggtttcataagcgaatggaggagctcaacagcgagaaacaccgcctgattaactatcatcaagaacaggcagtcaactgccttcttgggaacgttttctacgaaaggttggctggacacggccccaaactggggccagtgacaaggaagcaccctctcgtcacaaggtactttacctttccatttgaggaaatcgacttctctatggaagaatctatgattcaccttcccaataaagcctgctttctgatggctcataacggatgggtgatgggcgacgatcctcttcgtaattttgcagaacccggcagcgaggtctacctgagacgggaacttatctgttggggcgattcagtgaagctgagatatgggaacaagccagaagactgcccatacctgtgggcacatatgaagaaatacaccgagattaccgcaacctatttccaaggagttaggctggataactgccattctacccccctccatgtcgccgagtatatgctcgacgcagctagaaatctgcagcccaacctttacgttgtggccgagctgttcacaggatctgaagacctcgataacgttttcgttactcgacttggcatctctagcctgatcagggaagcaatgtccgcttacaacagtcatgaggagggaaggcttgtgtatcgctatggcggagaaccagtgggcagctttgtccagccttgcctgaggcccctgatgccggcaattgcccatgctctgttcatggatatcacacatgacaacgagtgcccaatagtgcataggtccgcttacgatgccctgccgtcgacaaccattgtctcaatggcttgctgcgcgtctggaagtacgaggggttacgacgaactcgtgccccaccaaattagcgtggtgagtgaggagaggttttacactaaatggaatccagaggctctcccgagtaatacgggcgaagtcaacttccagagtgggattatagccgcgagatgcgcaattagcaagctgcatcaggagttgggtgccaagggctttattcaggtgtatgtcgaccaggtcgacgaagacatcgtggctgtgacacgccatagcccctcgatccaccagagtgtggtagccgtatcaagaacagcattccgaaaccctaagacatctttttactcaaaagaagttcctcagatgtgcatacctggcaagatcgaagaggtggtgcttgaggctcgcaccattgagaggaataccaagccatacagaaaggacgagaatagcattaatggtacaccagatatcaccgtcgaaataagggaacatatccagctgaatgagtccaaaatcgtaaaacaggccggagtcgcaactaagggccccaacgaatacatccaggagatagagttcgaaaacctgtctcctggaagtgtcattattttcagggtgagccttgacccacatgctcaggttgctgttggaatccttcgcaaccacttgacgcagttttctccacattttaaatccggatctctcgccgttgacaatgctgacccaatcctgaaaattccttttgcctctctggcatctaggctcaccttggccgaactgaatcagattctgtatagatgtgaaagtgaagaaaaggaagacggaggaggctgctatgacatccccaactggtccgcgcttaaatatgcaggacttcaagggctgatgtccgtactggccgagatcaggcctaaaaatgatcttgggcacccattctgcaataacctgaggagcggagattggatgattgactatgtttccaacaggctcattagccgcagcggcaccatcgctgaggtgggaaaatggttgcaagccatgtttttctacctgaagcagattcccaggtatctcatcccctgttattttgatgcgatcctgatcggtgcttacaccacactgctggatacagcttggaaacagatgagtagctttgtccagaacggctctacatttgtgaagcacttgagcctgggctctgtccaactctgcggggtcggcaagtttccaagtctgccgatcctcagtcctgcactcatggacgttccgtaccgtctgaacgaaatcaccaaggaaaaagaacagtgttgcgtttcattagcagctggattgccccatttttccagcggcatctttcgttgctgggggcgggatacatttatcgcccttcgcggaattcttcttatcacagggcgctacgttgaagcccggaacatcattctcgccttcgctgggaccctcagacacggactgatcccaaacctgcttggcgaggggatatatgctagatacaactgtcgcgatgctgtctggtggtggctgcagtgtatccaagattactgcaagatggtacctaacggattagatatcctgaaatgtccagtgagcagaatgtacccaaccgatgactcggctccactgcctgcaggtacactcgaccagccgctctttgaggtaatccaagaagcgatgcagaagcatatgcagggtattcagtttagggagcgcaatgctgggccgcagatcgacagaaacatgaaggacgagggtttcaacataaccgccggtgttgatgaggaaactggatttgtgtacgggggaaacaggttcaactgcggcacctggatggataagatgggcgaatccgacagagccagaaaccggggcatccctgctactcccagagacggcagtgctgtggagattgtgggcctgtccaaatcagcggtgcgctggctcttggaactctcaaagaaaaacatattcccctaccacgaggttacagttaagcggcatggaaaagcgataaaggtcagctacgatgagtggaacaggaaaatacaggacaacttcgaaaaactttttcacgtgtccgaagatccttctgaccttaacgaaaagcatcccaacctcgtgcacaaaaggggcatttataaggattcttacggggctagctccccttggtgtgattaccagctgcggccaaacttcactatcgccatggtagtggctcctgagctgtttactacagaaaaggcttggaaggccttggagattgcagaaaaaaaacttctgggacctcttggaatgaaaactttagaccccgatgatatggtgtactgcggcatctacgacaatgcactcgacaacgacaactacaaccttgcgaagggctttaactaccaccagggcccagagtggctttggccgattggatacttcttgcgcgcaaagctgtactttagcagactgatgggccctgaaaccaccgccaagacaattgtgctggtcaaaaacgtccttagtagacactatgtgcatttggaacggagcccttggaagggtttgcccgagctgacaaatgagaacgcccagtattgcccattcagctgcgagacccaagcgtggtcaatagcaaccatccttgagactttgtacgacctg

SEQ ID NO: 6087 - DNA, 4596 bp, Artificial Sequence
  Description of Artificial Sequence: Synthetic coding sequence
atgggccacagcaagcagatccgaatcctgctgctcaacgaaatggaaaagctggaaaagactctcttccgcctggaacagggatacgaactccagttccggctcgggcctactctccaggggaaggcagtgaccgtgtatactaattaccctttcccgggcgagacgttcaatagagagaagttcaggtcgttggactgggaaaacccaactgagcgcgaggatgattcggacaaatactgtaagctgaacctgcagcagtctggctcgttccagtactacttcctgcaaggcaatgagaagagcggagggggatacatcgtcgtggatcccatcctgcgcgttggcgcggacaatcacgtactcccgctcgactgcgtcactctgcagactttcttggccaagtgtctggggccgttcgacgagtgggaatcacgcttgcgcgtggcgaaggaatccgggtacaatatgatccatttcactcctctccaaactctcggactgagcaggtcgtgctactcacttgccaaccagctggaactgaacccggacttctcgcgcccgaacaggaagtatacctggaacgacgtcggtcaacttgtagagaagttgaaaaaagagtggaatgtgatctgcatcaccgacgttgtgtacaatcataccgcggcgaattctaaatggatccaagaacaccctgagtgcgcctacaacctcgtaaactcaccgcatcttaagccggcgtgggtccttgacagagctctctggcgcttcagctgcgacgtggccgagggaaagtacaaagagaaaggcatcccggccctcatcgaaaatgatcaccacatgaactcaatccgcaaaatcatctgggaggacattttcccaaagctcaagctgtgggagttcttccaggtcgatgtcaataaagccgtggaacaattccggcggctcctgacccaggaaaaccggcgagtcaccaaatccgacccaaaccagcaccttactattatccaggatcccgaataccgccggttcgggtgcaccgtggacatgaacatcgccctgactacctttatccctcatgataagggaccggcggcgatagaggaatgctgcaattggttccacaagcggatggaggagctgaactcagagaagcaccgcttgatcaactatcaccaagagcaagccgtaaattgcctgctgggaaacgttttctacgaaagactggcaggccacgggccaaaacttggccccgtcacgcgtaaacaccccctggtgacgagatatttcacctttccgttcgaggaaatcgacttttctatggaggaatcgatgatccatcttcccaataaggcgtgcttcctgatggcgcacaatggatgggtgatgggtgatgacccgctgaggaacttcgcggaaccaggatccgaagtgtacctgcgccgggaactcatctgttggggggacagcgtcaagctgagatacggcaataagccggaggactgcccgtatctgtgggcccatatgaaaaagtacactgaaatcaccgcaacttacttccagggtgtgcggctggacaactgtcactcgaccccactgcacgtggctgagtatatgctggatgccgccagaaatctccaaccgaatttgtacgtggtggccgaacttttcaccggaagcgaggacctggacaacgtgttcgtgactagacttggaatctcgagccttatccgcgaggcgatgtccgcgtacaattcccatgaggaaggtcgcctggtgtaccgctacggaggtgaacctgtcggatcgttcgtgcaaccttgcttgcggcccctgatgccggccattgcgcacgcactcttcatggatattacccacgacaacgaatgcccgatcgttcaccggtcagcctacgatgccctgccatcgaccactatcgtgagcatggcttgttgtgcgagcggatccacccgcggatacgatgaactggtgccacaccagatctcggtggtgtctgaagagagattctacaccaagtggaaccccgaagcactcccctcaaacaccggcgaagtcaactttcagtcaggaatcatagcggcgcgctgtgcgatctccaagctgcatcaagaactgggagcgaagggatttatccaagtgtacgtggaccaggtggacgaggatatcgtcgccgtgactaggcattcaccgagcatccatcagagcgtggtagcggtgtcccggaccgctttccgcaacccaaagacctcgttctattccaaggaggtcccacaaatgtgtatccccggcaagatagaagaggtggtgctggaggccaggactatcgagcgcaacaccaaaccgtacaggaaggatgaaaactcaatcaacggaaccccggatatcaccgtggagattagagaacatatccaactgaacgagtccaagatcgtgaagcaagcaggagtggcaaccaaagggccaaatgaatacatccaagagatcgagtttgaaaatctgtctccaggtagcgtgataatcttccgggtgagccttgatccacacgcgcaggtcgccgtgggtatcctgcgcaaccacctgacccagttttcgccacatttcaaatccggatctctcgcggtcgacaatgcggaccctattctgaagatcccttttgcttcactggcttcgcgtcttacccttgcagaactcaatcagatcctgtaccgctgtgagtccgaagaaaaagaggacggaggaggatgctacgacatacccaactggtcggccctgaagtacgcaggactccagggactcatgtcagtgctggccgagattcgcccaaagaacgacttgggtcatccattctgcaataacttgaggagcggcgattggatgatcgattacgtgtcgaaccgcctgatctccaggtccggaaccatcgctgaggtcggaaaatggctgcaggctatgtttttctacctgaagcaaatcccgcgatacctgatcccatgctactttgatgcaatcctcattggcgcctacaccaccctgctggacactgcctggaagcaaatgagctcgttcgtccagaatggaagcacttttgtgaaacacctgagcttgggatcggtgcaactctgcggagtgggaaaattcccgtcacttccgatcctgtcccctgccttgatggatgtgccgtatagattgaatgaaatcacgaaggagaaggaacagtgctgcgtctccctcgcggctggcttgccacatttctcgtccggcattttccgctgctggggaagggatactttcattgcgctcaggggaattttgcttatcaccgggcggtacgtggaggcacggaacatcattctggcctttgccggaactctgcgccatggactcatccccaatctgctgggagaaggcatctacgcacgctacaactgccgtgatgccgtgtggtggtggctccaatgcatccaggattactgcaagatggttccgaatggtctggacattctgaaatgccccgtgtcgcgcatgtatccgaccgatgatagcgcccctctgcctgccggcactctcgaccagccactgttcgaggtgatccaggaagcaatgcaaaagcatatgcagggcattcagtttcgcgaacgcaacgctggaccgcaaatcgaccggaacatgaaggacgaggggttcaacattaccgcaggagtcgacgaagagactgggtttgtctacggaggaaacagatttaactgcggaacgtggatggacaaaatgggtgagtccgaccgggcccgcaaccggggaatccctgccactcctcgagacggatccgctgtggaaatcgtgggtctgtccaagtcggctgtgcgttggttgcttgagctgtctaagaaaaacatcttcccgtaccacgaagtcactgtcaagcgccacggcaaggccattaaggtttcatacgacgaatggaacagaaagattcaggacaacttcgaaaaactcttccacgtgtcagaagatccatccgacctcaacgagaagcacccaaatctcgtgcataagcggggcatttacaaagacagttacggcgcatcgtccccgtggtgcgactatcagctcagaccgaatttcactatcgccatggtggtcgcaccagaactgttcacgactgaaaaggcctggaaggcactcgaaatcgccgagaagaaacttctcgggcccctggggatgaaaacgctcgacccggatgacatggtgtactgtggaatttacgataacgcacttgataatgacaactacaatctcgccaagggcttcaattaccaccagggtccagaatggctgtggcctatcggatactttctgagagcgaaactctacttctcgagactgatgggccctgaaaccactgcaaagactattgtgctggtcaagaatgtcctctcgaggcattacgtgcacctcgaacgctcgccttggaagggtctgccagagcttaccaacgaaaacgctcagtactgcccgttttcctgtgagactcaggcgtggtccattgcgacgatcctggagactctgtacgatctg

SEQ ID NO: 6088 - DNA, 4596 bp, Artificial Sequence
  Description of Artificial Sequence: Synthetic coding sequence
atgggtcacagcaaacagatccggatcctccttctgaatgagatggaaaagctggaaaagacgctgtttagactcgagcagggatacgagcttcaatttcggctcggaccaaccctgcagggcaaagcagtcaccgtgtacactaactacccgttcccgggtgaaacttttaaccgcgaaaagttccgctcgctcgactgggaaaacccgactgaacgggaggacgattcagataagtactgcaaactcaaccttcagcagagcggttccttccaatactacttcctccagggaaacgaaaagtcaggtggaggatacatcgtggtggaccccatcctccgcgtcggcgcggataaccacgtgctcccactggattgcgtcactctgcagaccttcctggcgaagtgcctcggaccgtttgatgagtgggaatcccgcctgcgggtggcgaaggaatcaggctacaacatgattcatttcactccgctccaaaccctgggactgtcgcgctcgtgctactcgctggcaaatcaactcgaactgaacccggacttcagccgcccgaacagaaagtacacctggaacgacgtgggacaactcgtggaaaaactgaagaaggagtggaatgtgatctgcatcaccgacgtggtctacaaccatactgccgccaattcaaagtggatccaagaacatccggaatgcgcctataatctggtcaactcgccccacctgaagcccgcctgggtcctggatcgcgctctgtggcggttctcctgtgacgtggccgagggcaaatacaaggaaaagggaatcccagccctgatcgaaaacgatcaccacatgaattccatcagaaagatcatctgggaggacatctttccaaagttgaagctgtgggaattctttcaggtcgacgtcaacaaagctgtggaacagttcaggagactgctcacgcaggaaaatcggcgggtgaccaagtcagatcctaaccaacacttgacgatcattcaggacccggagtaccggagattcggctgtactgtcgacatgaacattgcgctgactaccttcatcccgcacgataagggaccggcggcaatcgaggaatgctgcaactggttccataaaagaatggaggagttgaactccgaaaagcatcgtctgatcaactatcaccaggaacaggcagtcaactgcctgctgggaaacgtcttttacgaaagactcgcgggacacggcccgaaactgggacctgtgacccgtaaacacccgctggtgacccgctacttcaccttccctttcgaggagatcgacttctcaatggaagagtctatgattcatctcccaaataaggcgtgtttcctgatggcgcataacgggtgggtgatgggtgatgacccactgaggaactttgccgaacctgggtccgaagtgtacctgcgccgggaactgatctgttggggcgacagcgtgaagctccgctacggaaacaagcccgaagattgcccttacctgtgggctcatatgaagaagtacactgaaatcactgcgacctactttcaaggtgtgcggctggacaactgccattccaccccactgcacgtggccgaatacatgctggacgccgcccggaatctgcagccgaacctttacgtcgtcgcggagctgttcaccggcagcgaagatctggacaatgttttcgtgaccagactgggcatcagctcgctgatccgggaggcaatgtcagcttacaattcgcacgaagaaggtagacttgtctacagatacggaggggaaccggtgggctcgttcgtgcagccgtgcctgcgcccgctcatgccggcgatcgcgcacgccctgttcatggacattacccacgacaatgagtgcccgatcgtgcataggtcggcctacgatgcactcccaagcactactatcgtctcaatggcctgctgtgcgtcggggtcgactagaggctatgacgaactggtgccacaccaaatttctgtcgtgtcggaagaaagattttacaccaagtggaacccggaggctctgccatctaataccggcgaagtcaacttccaatcagggatcatcgcggcacgctgcgcaatctccaagctgcaccaagaactgggagctaagggattcatccaggtgtacgtggatcaggttgatgaggatatcgtggcggtgacccggcatagcccttccatccatcagtcggtcgtggcagtgagcagaaccgcatttcgcaatcctaagacctcgttctattcaaaggaggtgccgcagatgtgtatcccgggcaagattgaggaagtggtcttggaggcccggactatcgaaaggaacaccaagccgtacagaaaagacgaaaattcaatcaacggcactccagacatcaccgtcgagatccgcgaacatatccaactgaacgagtccaagattgtgaagcaggctggtgtcgcaaccaaaggacctaacgagtacatccaggagatcgaattcgaaaacctgtctcccggatccgtgatcatattccgcgtgtcacttgacccgcacgctcaagtggccgtgggtatcttgcgcaaccacctgacccagttctcaccgcacttcaagtcgggatcactcgcggtggacaatgcggacccgatcctcaagattccgttcgctagcctcgcttctaggctcacgcttgcggaactcaatcaaatcctgtaccgctgcgagtcggaggagaaagaggacggaggaggatgctatgatattcccaactggtccgcccttaagtacgccgggctgcagggactgatgtcagtgctggctgagatccggcccaagaacgacttgggacacccattttgcaacaacctgcgctccggggactggatgatcgactacgtgagcaatcgcctcatctcgagatctggcaccatcgccgaagtgggcaaatggctgcaggccatgttcttttatctcaaacagattcctcgctacttgatcccgtgctactttgacgccattctcatcggagcttacaccactctgttggacaccgcgtggaagcagatgtcatccttcgtccagaatggcagcacgtttgtgaagcacctttcactgggctcagtgcaactgtgcggtgtggggaagtttccgtcgctcccaatcttgtccccggcactgatggacgtcccctatcgattgaacgagatcaccaaggaaaaggaacagtgttgcgtctcgctggcggccggacttccacacttctcgtcgggtatctttaggtgttggggacgcgacactttcatcgccctgagagggattctgctgattactggccgctacgtcgaagcacggaacattattctggcgttcgctgggacgctccggcatggactgatcccgaacctcttgggagagggcatctacgctagatacaattgccgcgatgcggtgtggtggtggctccaatgcatccaggattactgtaagatggtcccgaacggactggacatactgaaatgcccggtcagcagaatgtacccgaccgatgattccgcgccgctgccagctggtaccttggaccagccactgttcgaagtcatccaggaagcgatgcagaaacatatgcaggggatccaatttcgggaacgcaacgcgggaccgcagatcgaccgcaacatgaaggatgaaggctttaacatcaccgccggagtggatgaggagacgggattcgtgtacggaggaaatcggttcaactgcgggacctggatggataagatgggagagagcgaccgggcgcggaacagagggatcccggccacgccccgtgacgggtccgccgtggagatcgtcgggctgtcaaagtccgccgtcagatggctcctggaactgtcgaagaaaaacatttttccataccatgaagtcaccgttaaacgccatggaaaagccatcaaagtgagctacgacgagtggaaccgcaagatccaggacaacttcgaaaaactgttccacgtctcagaagatccatccgatctgaatgaaaagcatcctaacctggtgcacaaacgcggaatctacaaggatagctacggggccagctccccatggtgtgattaccaactgcgcccgaatttcaccatcgccatggtggtggcaccggaattgttcaccaccgaaaaagcctggaaggccctcgagatcgccgagaagaagttgcttggcccactcggaatgaaaacgctcgacccggatgacatggtgtactgtgggatctacgataatgcattggacaacgacaattacaatctcgcgaaaggcttcaactaccatcaggggcctgagtggctgtggcctatcggttacttcctccgcgccaagctctacttctcccggctgatgggtcctgaaaccaccgccaaaacgatcgtcctggtcaaaaatgtgttgagccggcactacgtgcacctcgagcgctcaccgtggaagggactgcccgaacttactaatgaaaatgcccagtactgcccgttttcgtgcgaaacccaggcctggtccatcgcaactatcttggaaaccctgtacgatctg

SEQ ID NO: 6089 - DNA, 4596 bp, Artificial Sequence
  Description of Artificial Sequence: Synthetic coding sequence
atgggacattcaaagcagatccgcatcctactactgaacgaaatggaaaagctggaaaagacactgttccgactggagcagggatatgagctccagtttagactgggaccgaccttacagggaaaagctgttactgtctacactaactatccatttcctggtgagacatttaatagggaaaagtttagatcgctggactgggagaatcctactgagagggaggacgattcagacaagtattgtaagctgaatctgcagcaaagtggctcattccagtattactttttgcagggaaacgagaaatctgggggtggttacattgtagtggatcctattctgagggtaggcgctgacaaccatgtcctgcccttagattgcgtcacgcttcagacattcctcgctaaatgtctggggcccttcgatgagtgggagtcaaggctacgggtagcaaaggaaagcggatacaacatgatccactttaccccactccagacccttggcttatctagaagctgctactctcttgccaaccagctggagctgaacccagattttagcagacctaaccggaagtatacttggaacgatgtcgggcaacttgtcgaaaagctcaaaaaagaatggaacgtcatttgtatcacagatgtggtctacaatcatactgcagccaactcgaagtggatacaggagcacccagaatgtgcctataatctcgtcaactcacctcacttaaagcccgcctgggtgcttgacagggcattatggaggtttagctgtgacgtggcagaaggcaagtataaggagaaagggattccagcccttattgagaatgaccatcacatgaactccataagaaagatcatatgggaggacatctttccaaaactgaagctttgggagtttttccaggtagacgtgaacaaggcagtcgagcaattccgcaggctgctgacccaagagaatcggagagttaccaaatctgacccaaatcagcacctgacaatcattcaggacccggagtaccgacggttcgggtgcaccgttgacatgaatatagctctaaccacattcatccctcacgacaagggcccggccgctatcgaggagtgctgtaattggttccataaacggatggaagagttgaacagcgaaaagcatcgtctaatcaactaccaccaggaacaagccgttaactgtctcttgggaaatgtgttctacgagcgactagccggccacggcccaaaactggggcccgtgacccgcaaacacccactcgtcacccgctactttacatttccttttgaggagatagacttttcgatggaagaaagcatgatccacctccccaacaaagcatgctttctgatggcgcacaacggatgggtcatgggcgatgatccccttagaaattttgccgagccggggtcagaggtgtatctgcgccgggagctcatttgttggggcgactccgttaaattgaggtatgggaataagcccgaggattgtccttatctctgggctcacatgaaaaaatatacagaaattactgccacttacttccagggcgtgcggcttgataactgccatagcacccctctccacgtagccgaatatatgcttgatgcagcaaggaacttgcagccaaacctctacgtggtcgcggaactgtttacagggtctgaagacctggataacgtctttgtaacgaggcttggcattagcagtcttattcgcgaagcaatgtctgcgtacaactctcacgaagagggaaggctggtgtatcggtacggaggagaacctgtgggttcctttgtgcagccttgcctgcgacccttgatgccggctattgctcacgctctgttcatggatataacacacgataatgagtgtcctattgtgcaccggagtgcgtacgacgcacttcccagtacaaccattgtgagcatggcctgttgtgcaagtgggagcacaagaggatacgacgaattagtgccccaccagatatcagtcgtttcagaggagagattctataccaagtggaatcctgaagcgctacccagcaatacaggcgaagttaactttcagtccggaatcatcgccgccagatgcgctatctcgaaactccaccaagaactgggggcaaaaggtttcattcaggtgtatgtagatcaggtcgacgaggacattgtcgcagttacaaggcacagcccgagcatccaccagtccgtcgtggcagtctctaggaccgctttccggaacccgaagacttcattctacagtaaagaggtcccccagatgtgtatcccgggaaaaattgaggaagtggtgctggaagctcggaccatcgagcggaacaccaaaccatacagaaaggacgagaattctatcaacggtacccctgacatcacagtggagatcagagaacacatccagttgaacgagagcaagatagtgaagcaagccggggttgccacaaagggccctaacgaatatatacaagagatcgagtttgaaaatctgtccccgggatccgtgataatattccgggtgagcctggacccccatgcccaggttgcggtcggaattttacgcaaccacctgacccaattttccccccactttaaaagtggatccctggcggtcgataatgcagaccctatcctcaagataccattcgcatccttggcctcccggctgactttagcggagctgaatcagatcctgtatagatgtgaatcagaggagaaagaagatggcggcgggtgttatgacataccgaattggtccgctttaaaatatgccgggctacaggggctgatgtctgtcctggctgaaattcgacctaaaaatgatcttggccatcccttctgtaataacctgagatctggagactggatgattgattatgtgtcaaaccgcctcatctctcgatctggaacaattgccgaagtcgggaagtggctccaggcaatgtttttttaccttaagcaaatccctcgatatttgatcccttgctattttgatgcaattttaatcggtgcttatacaacgctcctggacacagcctggaagcaaatgtcttcgtttgtccagaacggaagcaccttcgtgaagcaccttagtctgggctccgtgcagctgtgcggtgtagggaaattcccatccctcccaatcctctctccagctctcatggacgttccttacagactgaatgagatcacaaaggaaaaagagcaatgctgcgttagcctggccgcagggctgccccacttttcgtcaggaatcttccgctgctggggcagggatacatttatcgctctgaggggaattttgctcataaccggacgttacgtagaggcacgcaacatcattctggcttttgctgggacgcttcggcacggactgatcccaaaccttctcggagagggcatctacgcacgttacaattgtagggacgcagtgtggtggtggctgcagtgtatccaggactactgcaagatggtccccaatggtctcgacatcctcaagtgtccggtttcgcggatgtacccaactgatgactcggcacccctccctgccggcacattggaccagcccttgtttgaggtgattcaagaagccatgcagaaacacatgcaggggatccagttccgggagaggaacgccggcccccagatcgatagaaacatgaaagacgaaggtttcaacatcacagcgggcgttgacgaggagaccggtttcgtttacggcgggaacagatttaactgcggcacttggatggataaaatgggagaaagcgacagggcccgtaataggggcatccctgccacccctcgcgatgggtcagccgttgagattgttggtttgagcaagtctgccgtgcgctggctgcttgaactttctaagaagaatatttttccttatcatgaggtgacggtaaagagacacggcaaggccattaaggtttcctacgacgagtggaaccggaagatccaggacaattttgagaagctctttcatgtgtccgaagatccgtccgatctgaacgaaaaacatccaaatttggtgcacaagcgagggatctataaggattcgtacggtgccagcagcccctggtgtgattaccaactgcggccaaatttcaccatcgctatggtagtcgccccagagctcttcaccacagaaaaggcatggaaagcactcgaaattgcagaaaaaaaactgctgggaccactgggtatgaaaactctggatcccgacgatatggtctattgcggcatctatgacaacgccctggataacgataactacaacctggcgaagggcttcaattaccatcagggcccagagtggctctggccaattggctatttcctgcgggccaaactgtacttctcacgtctgatggggccggaaacgacagctaaaaccatcgtcctagtcaaaaacgtgctgtcaagacactacgtgcacctggagaggagcccttggaaagggttgcccgaactaaccaatgaaaacgcacaatattgtcccttcagctgtgaaacacaagcctggtccatcgctactattttggaaaccttgtacgacctt

SEQ ID NO: 6090 - DNA, 4596 bp, Artificial Sequence
  Description of Artificial Sequence: Synthetic coding sequence
atgggccattccaaacaaattagaatcctactcctgaacgaaatggaaaagttagagaagacgttgtttcgtctggagcagggttatgaactccaattccgactcggcccaactctgcagggcaaagctgttaccgtatacacaaactacccatttccaggcgagacttttaacagagaaaagttcaggtcactagactgggaaaacccaaccgagagggaggacgattccgacaagtactgcaagctaaacctccagcaatccgggtcctttcagtactacttcctgcagggaaacgaaaagtcagggggcggctacatcgtcgtagatccgatcttacgagttggtgcagacaatcacgttctcccgctggattgtgttacacttcagaccttcctggcaaaatgcctgggccccttcgacgagtgggaatcgcgattgagagttgctaaagaatccggctacaacatgatccactttaccccattgcagactctgggattatccagatcatgttatagtctggccaaccagttggaactgaaccctgactttagcaggccaaacaggaagtacacctggaacgacgttgggcagctcgtcgagaaactcaaaaaggagtggaatgtaatttgtatcaccgacgtcgtctacaaccatacagccgctaattcaaagtggattcaggaacatcctgaatgtgcatataatctggtgaactccccacatcttaaacctgcttgggtgttggaccgtgcgctttggcgattcagctgtgatgtagcagagggcaaatacaaggaaaaggggatacctgcattgatcgagaacgatcaccacatgaatagcatccgaaagatcatctgggaagacatttttccgaaactcaaactctgggagtttttccaggttgacgtgaataaagccgtggaacaatttcgcagactgctgacacaggagaaccgaagagtgacaaagtcagacccaaaccagcacttaacgattatccaggatcctgaatatagaagattcggctgtactgtggacatgaatatagccctgacgactttcatcccacacgacaaaggccccgccgccatcgaagaatgttgcaattggttccataagaggatggaggagctgaacagtgagaagcacaggctgattaactatcaccaggagcaggctgtgaattgtttattggggaatgtgttctatgaacgactagctgggcacgggcccaagctgggacctgtgactcgaaaacaccccctcgtgacccgttactttaccttcccgtttgaggaaattgatttctctatggaagaaagtatgattcacctgccaaataaagcttgctttctgatggcacacaacggctgggttatgggtgatgatcctctaaggaacttcgccgagcctggttctgaggtctatcttcgcagggaattaatttgttggggggattcagtaaagctccgctacggaaataagcccgaagactgcccctacctatgggctcacatgaagaaatacacagaaattacagcaacctacttccagggcgtgcgtttggataattgtcattctacaccgctccacgtcgctgagtatatgctcgatgctgcgagaaatctgcaaccaaatctttatgttgttgctgaattgtttaccggctctgaagatctcgataatgtcttcgtcacacgtctcggaataagttcattaatccgagaagctatgtccgcgtataatagccacgaagaggggcggctcgtgtaccggtatggcggcgaacctgtaggaagttttgtgcagccctgtttgagacccttgatgccggccatcgcccacgccctattcatggatattacccacgacaacgaatgcccaatcgtgcatcgctccgcttatgatgcattgccgtctacgacaatcgtatctatggcctgttgcgcgtctggctctacccgagggtacgatgagcttgtgccccatcagattagcgtagtgagcgaagaacgattctacactaagtggaacccagaagctctacctagtaataccggagaagtgaacttccagtccggaatcatcgccgctcgatgtgccatttccaagctgcaccaggagttgggtgccaagggcttcatacaggtatatgtggatcaggttgatgaagacatcgtcgcggttacccgacacagtccttcaatccaccaatcagtagtggcggtgagcaggaccgccttcagaaatccaaagacaagtttttattccaaggaggtgccgcagatgtgcattccagggaagatcgaggaggtagtattggaggcacgaacaatcgagagaaatacgaaaccctatcgaaaggatgagaacagcataaacggaacacctgacattaccgttgaaatcagggagcacatccagctaaacgagtctaaaattgttaaacaagcgggtgtagctacaaaaggacccaatgagtatattcaggagatagagtttgaaaacctgtcacccgggtctgtgatcatttttagagtcagtcttgacccgcatgcacaagtggccgtcgggattttgagaaatcacctcacgcagttttcccctcattttaagagtggctccctggccgtggataacgccgacccaatcctgaagattccgttcgcttcactcgcatctcgactgacactagctgaactgaatcagatactctatagatgtgagagcgaagagaaggaagacggcggagggtgctatgacatacctaattggtcggcgcttaagtatgccgggctgcaagggctcatgagcgtactagccgaaatccgtcctaagaacgatctggggcatccattctgtaataacttgagaagcggcgattggatgattgactacgtcagcaaccgactgatcagtaggagcgggacaattgctgaagttgggaaatggttgcaggctatgttcttctaccttaagcaaatccctaggtatttgatcccatgctactttgacgccattctgatcggcgcatacacaactctcctggacaccgcttggaagcaaatgagttcattcgtacaaaatgggtcgacatttgtaaaacatctgtcattagggtccgttcaactgtgtggcgtcgggaaatttccatctctaccgatattaagcccggctctcatggacgttccttatcggctgaatgaaatcacgaaggagaaggaacaatgttgtgtatcccttgccgcaggacttccccacttttcgtccggaatctttagatgttggggtagggatacattcatcgccctaagaggtatccttctcatcactggtaggtatgttgaggcccgaaatatcatcttagcatttgcaggtactctgcgacacgggctgatccccaatctccttggggagggtatctatgcacgctataactgcagggatgccgtgtggtggtggctgcaatgtattcaagactactgcaagatggttcctaatggactagatatattgaaatgtcccgtcagccgcatgtaccctaccgatgactcagcacctctcccagctggaacactggaccagccactgtttgaagtcatccaggaagccatgcagaaacatatgcagggcattcagttccgagagagaaatgcagggccccagatcgatcgaaacatgaaggacgagggatttaacattaccgccggcgtcgatgaggaaacagggttcgtgtatggcggaaacaggttcaactgtggcacctggatggataagatgggggagtctgaccgagcaagaaacagaggaattcccgccactcctagagatggatctgcagtggagattgtggggctcagcaagagtgccgttaggtggctcctggagctgagtaaaaagaacatcttcccgtatcacgaggtcaccgtaaagagacatggtaaggcaatcaaggtgagttacgatgaatggaatagaaagattcaagataactttgagaaattgttccacgtgtccgaagaccccagtgacctgaatgaaaaacacccgaatcttgtccacaaaagaggaatctacaaagattcctatggagcctcctcaccctggtgcgactaccagttgaggcctaacttcaccattgctatggtggtggcgcctgagctctttacgacagagaaggcgtggaaagccctggaaatcgccgagaaaaagctgttgggtcccctagggatgaaaacactggatcccgatgacatggtatactgcggaatttacgacaacgctttggataatgacaattacaatcttgccaaggggttcaattatcaccagggccccgaatggctctggcctatcggctattttttgagagcaaaactgtacttttccaggctgatgggccccgaaactaccgccaagacaatcgtcctggttaaaaacgtgttgagccgtcactacgtccaccttgagagatccccctggaaaggcttgcccgaacttactaacgaaaacgcgcagtactgtcctttcagctgtgaaacacaggcttggtcgatcgctaccatactcgagacactctacgacctg

SEQ ID NO: 6091 - DNA, 4596 bp, Artificial Sequence
  Description of Artificial Sequence: Synthetic coding sequence
atgggacattccaagcagattagaatccttctccttaacgaaatggagaaactggaaaaaacactcttccgcttggagcagggatatgaactacagttcagactcggacctactcttcagggaaaagcagtgactgtgtatactaactatccttttcccggagagacattcaatagggaaaaattcagaagtctcgattgggagaaccctacagaacgggaagatgatagtgacaaatattgcaaacttaatctccagcagtctgggtcattccagtattatttcttgcagggaaacgagaaatccggaggaggatatattgttgtcgaccctatcctgcgcgtaggagccgataaccacgtcttacccctggactgcgtgacactgcagacttttctagccaagtgcctcgggccatttgatgaatgggaatcacgcctccgggtcgccaaggaaagtggatataatatgatccacttcacaccactccagacacttggactatcccgcagttgttattctctcgcaaatcagctagaactcaacccagatttctctaggcctaacaggaaatatacttggaacgatgttggacagctcgttgaaaaactaaagaaagaatggaacgtaatctgtatcactgatgtagtgtacaatcacacagccgctaattctaaatggatacaggaacatcctgaatgcgcctataatctcgtgaattctccccatctgaaacctgcctgggtgctcgacagggcactctggaggttctcttgcgatgtagcagaaggaaagtataaagagaaagggatacccgctttaatcgaaaatgatcatcatatgaactccattcggaaaatcatctgggaagacatatttcccaagcttaaactctgggagttttttcaggtcgatgtgaacaaagcagtagaacagtttcggcggctactgacacaggaaaacagacgagtgactaagtctgatcccaaccagcacttaactatcatccaggatcctgaatatagacgcttcgggtgtactgtggatatgaacatcgcactcactacttttataccacatgataaagggccagccgctatcgaggaatgctgtaattggttccataaaaggatggaagaattaaactccgaaaaacaccggttgatcaattaccaccaggaacaggcagtgaattgtctgctggggaacgtgttttacgaaagactagctggacatgggcccaaacttggacccgtaacaagaaagcacccactggtgactaggtattttactttcccctttgaagaaatcgatttttctatggaagaatctatgatacatctcccaaacaaagcttgctttctcatggctcacaacgggtgggttatgggggatgatccactcaggaatttcgccgaacctgggtccgaagtttatctaagacgggagctgatctgttggggagattctgtgaaactacgctacggaaataaacccgaagattgcccatatctgtgggcacatatgaaaaaatatacagaaattacagcaacatatttccaaggagtgcggctcgacaactgtcatagtacaccccttcatgtggccgaatatatgctagatgccgcccgcaacttacagccaaatctgtatgtagtcgcagaactcttcactgggagtgaagatttagataacgtcttcgttacaagactgggaatctcatcattgataagggaagcaatgtctgcttataactcacatgaggaaggacggctagtctatcgctatgggggagaacccgtcggatctttcgtgcagccttgtttaagacccctaatgcccgctatcgctcacgctctcttcatggatataacacacgacaacgaatgcccaattgtgcacaggtcggcctacgatgctctgccaagtacaacaatcgtgtccatggcttgctgtgcatccgggtccactcgaggatatgatgaactcgtgcctcatcagataagtgtggtgtctgaagaacggttttatactaaatggaaccctgaagcactaccctctaacactggagaagtgaattttcagagtggaatcatcgctgctaggtgtgctatatcaaaactacatcaggaactgggagccaagggatttatccaggtctacgtggatcaggtagatgaagatatcgttgcagtgactaggcattccccttctatacatcagagtgtcgtggccgtgtcacgcactgcatttcggaaccccaaaacatcgttctattctaaggaagttccccagatgtgtattcccggaaaaattgaggaagtggtgctagaagcacggactattgaaaggaatactaagccttatcggaaagatgaaaattccataaacgggacaccagatataacagtggaaataagggagcatatccaactcaatgaatccaaaatcgtgaaacaggctggagttgccacaaaggggccaaacgagtatattcaggaaatagagttcgaaaatctgtcccccggatctgtaattatatttcgcgtcagtctagatccacatgcgcaggtcgctgtggggatcctgagaaatcatctcactcagtttagtccccacttcaaatccggatccttggccgttgacaacgctgaccctatacttaaaatacctttcgcctccctggcatctcgattgacactagcagaactcaaccagatcttgtataggtgcgaatctgaagaaaaggaagatggggggggatgttatgatatccccaactggtctgctctcaaatatgcggggctgcaggggctaatgtctgtactggctgaaatccgccctaagaacgatctagggcatcccttctgtaacaatctacggtcaggggattggatgatcgactacgtgtccaaccggctgatatccaggagtgggacaatcgccgaagtcggaaaatggctgcaggccatgtttttctatttaaaacagatacctcggtatcttataccttgttacttcgatgccattctgataggggcttatactactcttcttgatactgcttggaaacagatgagttcttttgtgcagaatgggtcgacatttgtcaagcatctctctctggggagtgtgcagttgtgcggggtgggaaagttcccttcgcttcctatccttagtcccgccttgatggatgttccttaccgccttaatgaaatcacaaaagaaaaggaacagtgttgtgtgtcactcgctgctggactgccccatttcagtagtggaatctttcggtgttggggacgagatacttttattgcccttagggggattctactcataactggaagatatgtagaagccaggaatataatacttgcctttgccggaactcttagacacggactgatcccaaacctactgggagaaggaatatatgcccgctataactgtcgggatgcagtgtggtggtggttacagtgtatacaggattattgtaagatggtccccaatggactcgatatcctcaaatgtcccgtgagtcgaatgtaccctacagatgatagtgcaccactgcctgcaggaactttagatcaaccactctttgaggtgattcaggaggcaatgcagaagcacatgcagggaatccagtttcgagaacgaaacgccggacctcagatcgatcgcaatatgaaggatgagggattcaatattacggccggagtcgatgaggaaactgggttcgtgtatgggggaaacaggttcaattgtggaacttggatggataaaatgggggaatctgatcgcgctcggaacagggggattccagccactccaagggatgggtccgccgttgaaatcgtaggactcagtaaatctgccgtaagatggctcctcgagctctctaaaaaaaacatcttcccctatcatgaagtgactgtgaaacggcatggaaaagcaatcaaagtaagttacgatgaatggaataggaagatccaggataacttcgagaaactgtttcatgtgtctgaagatccttctgatctcaacgaaaagcacccgaacctcgtgcataaaagggggatatataaagattcatatggggcctcttccccatggtgtgattatcagctccgccccaatttcacaattgcaatggtggtggctccagaactgttcactactgagaaagcctggaaagcattggaaatcgcagaaaaaaaactgctggggcccctgggaatgaaaactctggatcctgacgatatggtatactgcggaatctatgataacgccctcgataacgataattataatctagcaaaagggttcaattatcaccaggggcccgaatggttgtggcccatcgggtacttcttgagggcaaaactctatttttctcgacttatggggcccgaaactacagccaaaacaatcgtgcttgtcaaaaacgttctgtctcgccactatgtgcatctggagaggtcaccttggaagggactcccagaactaactaatgaaaatgctcagtactgtcctttctcttgcgaaacacaggcttggtccatagcaactatccttgaaacattatacgatctt

SEQ ID NO: 6092 - DNA, 4596 bp, Artificial Sequence
  Description of Artificial Sequence: Synthetic coding sequence
atgggtcattcaaagcagatcagaattctgttgctgaacgagatggagaagctcgaaaagaccttgttccgcctggaacagggatacgagttgcagtttcgcttgggaccaaccctgcaaggtaaagctgtgaccgtttacactaattaccccttccctggagagactttcaacagagagaagttccgttccctcgattgggagaatcctactgaaagggaggatgacagtgataagtattgcaaactgaacttgcagcaatccggttccttccaatactattttcttcagggaaatgagaaatcaggaggaggatatatcgttgtagaccctattcttcgtgttggtgctgacaaccacgttctcccattggattgtgtgactcttcagaccttcctggctaaatgcctgggccctttcgatgagtgggaaagcaggctccgtgtggcaaaggagagcggttacaatatgattcatttcacacctctgcagaccctgggccttagccgttcatgctactcccttgccaaccagctggagctcaaccctgacttcagcagacccaatcgcaaatacacttggaacgacgttggacagctggtcgagaagctgaagaaagagtggaacgtaatctgtattacagatgttgtttacaaccatactgccgcaaattccaagtggatccaggagcatcctgagtgcgcctacaacctggtgaactctcctcaccttaagccagcatgggtgctggatagagccctttggaggttctcctgcgacgtggctgaaggaaagtacaaagagaagggaatacctgcactgattgagaacgaccaccacatgaattccataaggaaaatcatctgggaagacatcttccccaaactcaagctttgggaatttttccaggtggacgtgaacaaggccgtggagcaatttaggcgcttgttgactcaggagaaccgccgcgttaccaagagcgaccctaatcaacatctcaccattatccaggatcctgaatacagaaggttcggatgcactgtcgatatgaacatagcactgaccactttcatcccacatgacaagggtcctgctgccatcgaggagtgttgcaactggttccataagcgcatggaggagttgaatagtgagaagcataggctgatcaactatcaccaagagcaggctgtcaactgcctcttgggaaacgttttctatgagcgcctcgctggccatggccccaagctgggacctgtgacacgcaagcatcctctcgtgaccagatatttcacttttccttttgaggaaattgatttcagtatggaggagtcaatgatacatttgcctaataaggcctgtttcctcatggctcacaatggatgggtaatgggcgacgaccccctgcgtaacttcgccgaaccaggctccgaggtgtatctgaggagagaactcatttgctggggagactccgtaaagcttcgttatggtaacaagcccgaggattgtccctacttgtgggctcacatgaaaaaatataccgagatcaccgccacatatttccagggagtcagactggacaattgccactccactcctttgcacgttgccgaatacatgcttgacgccgctagaaatctgcagcccaatctgtatgtggtcgccgagctgttcaccggctccgaggacctcgataatgtgttcgtcactagacttggtatcagctccttgataagggaggcaatgtccgcctacaactcccacgaggaaggccgcttggtgtaccgctacggaggcgaaccagttggatcttttgttcaaccctgcctgcgtccactgatgcccgctatcgcccacgctttgttcatggacatcacccacgataacgagtgccctatcgtgcataggagtgcatacgacgctcttccatcaaccaccattgtcagcatggcatgttgtgcatctggctctactagaggctatgatgagctggtaccccatcaaatctctgttgtttccgaagagcgtttctatacaaagtggaaccctgaagcactcccctcaaacacaggcgaagtaaattttcaatctggcattatcgcagctagatgcgctatctccaagctgcaccaagagcttggcgccaagggcttcatccaagtctacgttgatcaggtcgacgaggatatcgtcgctgtcacacgccattcacctagcattcatcagtcagtggtggccgtttctaggactgcttttcgcaatccaaagacttcattttactctaaggaggtacctcagatgtgtatcccaggtaaaatcgaggaagtggtgctggaagcacgtacaatcgagagaaataccaaaccctacaggaaagatgagaacagcatcaacggcacaccagatatcaccgttgagataagagaacacatccagcttaacgaatctaagatagtcaagcaagcaggtgtcgcaaccaagggtcctaacgagtacatccaggagatcgagttcgagaatctgtctcctggttcagtaatcatattcagggtctcacttgaccctcatgctcaagtcgccgtaggcatcttgagaaatcatcttacacaattcagcccccacttcaagagcggtagcctggccgttgataacgccgaccctattctgaagataccatttgctagcttggcttctagactgactctggccgaactcaaccagatcctctatcgctgcgaatcagaggaaaaagaagacggcggaggatgctatgatatcccaaattggtctgctctgaagtacgctggcctgcagggactgatgtccgtgctggctgaaatccgtccaaagaacgaccttggacatccattctgtaataacctgagatctggagactggatgattgactacgtcagcaaccgtctgataagtaggagcggcactattgccgaggtgggcaagtggctccaggcaatgtttttctacctgaagcagatcccaagatacctcattccatgctatttcgacgctatcctgataggtgcctacactactctcctcgacactgcatggaagcaaatgtctagttttgttcagaatggctcaacattcgtcaaacacctttctttgggtagtgtccagctttgtggagtgggaaaatttccttccctgccaatcctgagtcctgccttgatggacgtgccctacagattgaacgagattaccaaggaaaaggaacagtgctgcgtgtcactggccgctggcctgccccacttcagtagcggcattttccgttgctggggaagggatacattcatcgccctgcgcggaatactgctgatcacaggcaggtatgtcgaagctaggaacattatactcgcctttgcaggcactctgcgccacggtttgatccctaacctcctgggagagggtatctacgcccgctacaactgcagagacgcagtctggtggtggttgcagtgtatacaagactattgcaagatggtccccaatggattggacattcttaaatgtcctgtctcaaggatgtaccctacagatgattccgctcctcttcctgccggcaccctggatcagcctttgtttgaggtcatccaagaagctatgcagaaacacatgcaaggtatccaattcagagagcgtaatgcaggacctcagatcgaccgtaatatgaaggatgagggattcaacatcacagcaggtgttgacgaagagactggatttgtctacggcggtaacagattcaactgtggtacatggatggataagatgggagagtccgaccgtgctaggaatcgtggtattcccgctaccccaagggacggatccgctgtcgagattgtgggtctttccaaatctgctgtgcgctggcttctggaactgagtaagaagaacattttcccataccatgaggtcactgttaaacgccatggcaaagccatcaaagtctcttacgatgaatggaaccgtaagatacaggacaatttcgaaaaattgttccacgtatctgaagatccaagcgacctcaatgaaaagcaccccaacctcgttcacaagaggggcatctacaaggatagttacggagcctcatctccatggtgcgactatcagctgcgccccaattttaccatcgccatggtggtcgctcctgaactttttacaacagagaaagcctggaaggcacttgaaattgctgagaagaagttgcttggtccacttggtatgaaaaccttggaccccgatgacatggtatactgtggcatctacgacaatgctcttgacaacgacaattataatcttgctaagggcttcaactatcaccaaggtcctgaatggctgtggcctattggatacttcttgagagctaagctgtacttctccagactgatgggtcccgagactactgccaagactatcgtcctggtgaagaacgttcttagtcgccattatgtacatctcgaacgctctccctggaaaggtctgccagagcttacaaacgagaacgctcaatactgcccattcagctgcgagacacaggcatggagcatcgctactatcctcgaaaccctgtacgatctg

SEQ ID NO: 6093 - DNA, 4596 bp, Artificial Sequence
  Description of Artificial Sequence: Synthetic coding sequence
atgggacattcaaagcagatacgaatccttctcctgaacgaaatggaaaagctggaaaagactctgttcagactggaacagggctacgaactccagtttcgcctggggcctactctgcaagggaaggcagtgactgtgtatactaactacccttttcctggagaaacttttaaccgcgaaaagtttcggagcctggattgggagaacccaactgagagggaagatgactcggacaaatactgtaaacttaatctgcagcagtcgggaagtttccaatactattttcttcaagggaacgaaaagtctggaggcggatacattgtcgtggatcctattttgcgcgtgggagcggacaaccatgtgttgcctctggattgtgtgaccctgcagacttttcttgcaaaatgtctcggaccctttgacgagtgggaatcccggcttcgggtcgcaaaggagtcgggttataacatgatccacttcactccccttcagacccttggattgtcgcgcagctgttactccctggcaaatcaactcgagctcaatcctgatttttcgaggcctaacagaaagtacacctggaacgatgtgggacaacttgtggaaaagctgaaaaaggaatggaacgtgatttgtatcaccgatgtcgtctataatcacaccgcagccaacagcaagtggattcaggaacatccagaatgtgcgtacaacctcgtgaacagcccacacctgaagcccgcttgggtcttggatcgtgcactctggcgattttcctgcgacgtcgccgagggtaagtacaaggagaagggaattcctgcactcattgaaaacgaccaccatatgaactccattcgaaagatcatatgggaagatatctttcctaagctcaaactgtgggagtttttccaggtggatgtcaataaggcagtcgaacagttccgccgtctgttgactcaagagaatcggcgggtcactaaatcggacccaaaccaacatcttaccattattcaagacccagaataccgccgattcggttgtaccgtcgacatgaacattgcattgactaccttcattccgcatgacaaaggacctgccgcaattgaagaatgttgcaactggtttcataaacgaatggaagaattgaattcagaaaagcaccgacttatcaattatcatcaggaacaagccgtaaactgtctgcttggcaatgtgttctacgagcgcctggcgggccacggtccaaagctgggtcccgtgactcgaaagcaccccctggtgacgagatacttcaccttcccatttgaagagatagactttagcatggaagaatcgatgattcacctgccaaataaggcatgttttctgatggcacataacggatgggtgatgggagatgatcctctgcgtaactttgccgaacctggcagcgaggtgtaccttagaagggagctgatctgttggggagattccgttaagctgcgttacggaaacaaacccgaggactgtccatacctctgggcacatatgaagaaatacactgagatcacggccacctacttccaaggggtgagactggataattgtcattcaacccctctgcatgtcgccgaatacatgctggatgccgcaagaaatcttcagcccaatctttacgtggtggcagagctgtttaccggatcggaggaccttgataacgtttttgtgacgcggctgggtatttcatccctcatccgcgaagcaatgagcgcctacaactcccacgaagaaggtaggctggtctaccggtacggaggggaaccagtgggatcgtttgtgcaaccgtgcctgcgcccacttatgcctgccatcgcacatgctcttttcatggatattactcatgacaatgaatgccccatcgtgcatagatcagcatacgacgctctgccttccaccaccatcgtgtccatggcttgttgcgcttctggatcaacgagagggtacgacgagttggtgccccaccagatttctgtggtgtcggaagaaagattttacaccaagtggaacccagaagcgcttccttcgaataccggtgaggtgaatttccaaagcggaattatcgcggcgagatgtgccatatcgaagctgcaccaagaactgggagcgaaaggcttcatccaagtgtacgtcgatcaagtggatgaggacatcgtggcagtgactagacattcgcctagcatccatcagagcgtggtggcagtgtcgcggaccgcattcagaaacccgaaaactagcttttactcgaaagaagtccctcaaatgtgtattccgggaaagatagaagaggtggtccttgaagctagaactattgaacgaaacaccaagccctacaggaaggatgaaaatagcatcaatggaacccccgatattaccgtggaaattagagaacacatccagcttaacgaaagcaagattgtgaagcaagctggcgtggcaacgaaaggacctaacgagtacatccaagaaatagagtttgaaaacctgtccccgggctccgttatcatttttcgcgtaagtcttgatccccacgcgcaagtcgccgtcggtattcttcgcaatcatctgacccagttttcccctcatttcaaaagcggttcattggccgtggataacgcagaccctattctcaaaattccgtttgcatcccttgcatcacgtctgacccttgcagagctgaaccaaatcctttaccggtgtgaatccgaagagaaggaagatggcggcggttgctacgatatccctaattggtcggctctcaagtacgcaggactgcaaggactgatgtccgtgctggccgagattaggccaaagaacgatctggggcatccattttgtaacaatcttaggtccggagattggatgattgattacgtgtccaacaggttgatcagtagatctggtaccatagccgaagtggggaagtggcttcaggcaatgtttttctatcttaagcagattccacgctacctgatcccctgttactttgatgcgatactgataggtgcatacactaccctgcttgataccgcgtggaagcaaatgtcctcctttgtgcagaatggttctacctttgtgaaacatctttcgttgggtagcgtgcaactgtgcggtgttggcaagtttccctctctgcctatccttagccctgcactgatggacgtgccatacaggcttaatgagattactaaagaaaaggagcaatgttgtgtctcattggccgcaggcctcccacacttttctagcgggatctttcgttgttggggaagggatacgttcattgcactgcgcggaattctgcttataacgggtcggtacgtcgaagctcgcaacattattcttgccttcgcaggcactctcagacatggactgataccaaaccttctgggggagggcatatacgcaagatacaactgccgggacgcagtgtggtggtggcttcagtgtattcaagattactgtaagatggtgccaaacggacttgatatcttgaaatgtcctgtgagcagaatgtaccctaccgacgattcagcgccacttccagcaggaacgctggatcaacctctgtttgaagtgattcaggaagcaatgcagaagcatatgcagggtattcaatttcgggagcgcaacgccggaccgcaaattgatcgaaatatgaaagacgaaggattcaacatcacggcaggagtcgatgaggaaactggatttgtgtacggtggaaacaggtttaactgtggaacctggatggacaagatgggagagtccgatcgggcacgaaatcggggcatcccagctacccctagggacggatccgctgtcgaaatcgtcggtttgagcaagtcagcagtgagatggctgcttgaattgagcaaaaagaacattttcccataccatgaagtgacggtcaagcgccacggtaaggccatcaaggtgagctacgatgagtggaacagaaagattcaagataactttgaaaagctctttcatgtctctgaggatccttccgatctgaacgaaaagcaccctaacctggtgcataagcgcggcatctacaaagattcatacggtgcctcgtccccttggtgtgactaccagcttcggcctaatttcaccattgccatggtggtggcaccagagctttttaccaccgaaaaggcgtggaaggccctcgagattgcggaaaagaagctgcttggtcctctcggaatgaaaaccctggatccagatgacatggtgtactgcgggatctacgataatgctctggataacgataactacaacctggccaaaggtttcaactaccaccaggggcctgagtggctctggccgatagggtactttctgcgggcgaagctctacttttccaggctgatgggtcccgagactacggccaagaccatcgtgcttgtgaagaatgtgctctcccggcattacgtgcaccttgagcggtcgccatggaagggtctgccagaacttaccaacgaaaatgctcaatactgcccattcagctgcgaaacccaagcctggtcaatcgccaccatacttgagactctgtacgacctt

SEQ ID NO: 6094 - DNA, 4596 bp, Artificial Sequence
  Description of Artificial Sequence: Synthetic coding sequence
atgggccactccaagcaaattagaatccttctcttgaatgaaatggaaaagctggagaaaacgctgttcaggctcgaacaaggatacgagctgcagtttcgccttggaccaacccttcaaggaaaggcggtcaccgtctacactaactacccttttcctggggaaacctttaacagggaaaagtttagatccttggactgggaaaacccgaccgaacgtgaagatgattcggacaaatactgtaagctcaacctgcaacagtcgggatcctttcaatactacttcctgcagggaaacgagaagtccgggggtggctacatcgtggtggaccccatactgcgcgttggtgcagacaatcacgtcttgcccctggattgtgtcacccttcagacgttccttgcaaagtgtctggggccttttgatgaatgggaatcgaggcttcgggtggctaaggagtcaggttacaatatgattcattttacccccctgcaaactctgggccttagcaggtcctgttacagcctcgcaaatcagctggaactgaacccggatttttcccggccaaatagaaaatacacttggaacgatgtgggtcagctcgtcgaaaagctcaagaaggaatggaacgtgatctgtattactgacgtggtgtacaaccataccgcagctaacagcaaatggatccaagagcatccagaatgtgcatacaacctggttaattcgcctcatctcaagcctgcctgggtcctcgatagagcgctgtggcgattttcgtgcgatgtggcagagggtaaatacaaggagaagggaattccagcactgattgaaaacgaccatcatatgaactcgataagaaaaatcatttgggaggatatcttccctaaattgaagctgtgggagttcttccaggtggatgtgaataaggcggtggaacagttcagacggctgttgactcaggaaaacaggagggtgaccaaatcggatcccaatcagcatctcactattatccaagatcctgagtaccggaggtttggttgtacggtcgacatgaatatcgcacttaccacctttattcctcatgacaagggccctgccgcaatcgaagagtgctgtaattggttccacaaaagaatggaagagctgaattcggaaaaacacagactgatcaactaccatcaagagcaggcagtgaattgccttctgggaaacgtgttttatgagcgcctggcaggacatggccctaagctcggtcctgtcactcgaaagcaccctcttgtgaccagatacttcacttttccgtttgaagaaatcgatttttcgatggaggagtcaatgattcatctgccaaacaaggcctgttttctgatggcacataatggctgggtgatgggagatgatcctctgagaaatttcgccgaacctggatccgaagtctaccttcgcagagaactgatctgctggggtgacagcgtcaagctgaggtacggtaacaagcctgaagattgcccatacctttgggctcacatgaagaagtacactgagatcactgcaacgtatttccaaggagtgcggctcgataattgtcatagcactccactccacgtggcagagtacatgctggatgcagcacgaaacctgcaaccaaatctgtacgtcgtggcagagctcttcactggttcagaggatctggataacgtgttcgtgacgaggcttggtatctcctcactgattagagaggctatgtcagcatacaactcacacgaagaaggaaggcttgtgtacagatacgggggagagcctgtgggatcctttgtccagccttgcctgcgacccttgatgcctgcaattgcgcatgcgctgtttatggatatcactcatgataacgaatgccctatcgtgcaccgatccgcctacgatgcactcccttcgactaccattgtgtcaatggcctgttgtgcatctgggtccaccagggggtatgatgagcttgtcccacatcaaattagcgtcgtgtcagaagagcggttttacacgaaatggaatccggaagcacttccgtcaaacaccggagaagtgaactttcaatcgggtattatcgcggcacgatgtgccatttccaaacttcatcaagaactgggcgcgaaaggctttattcaggtttatgtggaccaggttgatgaagatattgtcgcagtcactcgccattcaccatcgatccatcaaagcgtggtcgcggtttcaaggacggcatttcgaaaccctaaaacctcattctactccaaagaggttccccagatgtgcatccccggaaagattgaggaggtggtgcttgaagcaaggaccattgagagaaacaccaagccttacagaaaggacgaaaactcgatcaatggtaccccggatatcacggtggagatccgagaacacatccagttgaatgaatccaagattgtgaagcaggcaggggtggctaccaagggaccaaacgagtatattcaggaaatcgaatttgaaaacctttctccgggttcggtgatcatattccgcgtttccttggatccacacgcccaagtcgccgttggaattctgcggaatcatctgacccaattttccccgcacttcaagtcaggatcccttgcagtggataacgccgatcctattttgaagattccgttcgcatcgctggcaagccggctgactctcgccgaattgaatcagatcctttacaggtgtgagagcgaggaaaaagaggatggcggaggttgctacgatattcctaattggtcagcacttaagtacgctggacttcagggtttgatgtcagtgctggcggaaatccgccctaaaaacgaccttggacacccattttgcaacaatttgagaagcggtgattggatgatcgattacgtgtcaaaccggctcatttccagatccgggactattgccgaggtggggaagtggctgcaagctatgtttttctacctcaagcaaataccaaggtacctgatcccctgttactttgatgccattttgatcggggcgtacaccactcttcttgataccgcgtggaagcaaatgagctcgttcgtgcaaaacggctccacctttgtcaagcacctgtcccttgggtctgtgcaactgtgtggagtgggaaagttcccaagccttccaattttgtcccctgctctcatggatgtcccctacaggctgaacgaaattactaaggaaaaggaacagtgttgtgtgtcactggcagcaggactccctcatttttcgagcggaatcttcagatgttggggtcgggacacctttattgcactccgtggcatcctgctgatcaccggacggtacgtggaagcaagaaacatcattcttgcatttgccggaaccctccgacacggactcattcctaatcttcttggtgagggaatctacgcccgttacaactgtcgcgatgcagtgtggtggtggctgcagtgcattcaagactactgcaaaatggtccctaacggtctggatattctgaagtgtcccgtgtcgcgtatgtaccctactgatgacagcgcccctttgcctgccggcactctggatcaacccctgtttgaagtcatacaggaagcaatgcaaaagcacatgcaaggaattcagttccgagaacgcaacgcaggcccacaaatcgaccggaacatgaaggacgaaggctttaacattactgccggggtggacgaagaaaccggctttgtgtacggaggcaatagattcaactgcggaacgtggatggataagatgggagaaagcgatcgggccagaaatcggggtattccagcaacccctcgtgacgggtctgcagtggaaatagtgggcctgtccaaatcggcagtgcgctggttgctcgagctgtcgaaaaagaacatttttccgtaccacgaagtgaccgttaagaggcacggtaaggccattaaagtctcgtacgacgagtggaaccgcaaaattcaggacaactttgagaagctgtttcacgtgtccgaggacccgtccgatctgaacgagaagcatcctaatttggtccataaaaggggcatttacaaagactcctacggcgcctccagcccatggtgtgactaccagcttagacctaactttactatagcaatggtagtggcaccagaattgtttactactgaaaaggcatggaaggcactggaaattgcagagaaaaagctcctcgggccgcttggaatgaaaacgctggaccctgatgacatggtgtattgtggtatttacgataacgcgctggataatgacaattacaaccttgcaaagggctttaactaccaccagggaccggagtggctttggccgattggttatttccttcgagccaagttgtactttagccgccttatggggcctgaaaccactgcaaagaccatcgtgctggtgaaaaatgtgctgtcgcgacattacgttcaccttgaacggtccccttggaagggacttcctgaactgacgaacgaaaatgcccagtactgtccattctcgtgtgaaacccaagcatggagcattgcaactattctggagactctctacgacttg

SEQ ID NO: 6095 - DNA, 4596 bp, Artificial Sequence
  Description of Artificial Sequence: Synthetic coding sequence
atggggcatagcaaacagatccgtatattgcttcttaatgaaatggagaagctggaaaaaaccctgtttagactcgaacagggatatgaacttcagtttcgtctgggtccaaccctgcaagggaaggccgtgaccgtctacaccaactacccatttcccggtgagacttttaacagagagaaattcaggtcattggattgggagaacccaaccgagagggaagatgacagcgacaagtactgcaaacttaaccttcaacaatccggatcgttccaatactattttctgcaaggtaacgaaaagtccggaggggggtatattgtggtcgatccaatactgcgggtgggtgccgataaccatgtgcttcccctggactgcgttactcttcaaacctttcttgcaaaatgccttggacctttcgatgagtgggaatcccgacttagagtggcaaaggagagcggatacaatatgatacatttcacccctctccagacgctgggcctcagcaggtcatgttactcacttgcaaatcaactcgagcttaaccccgattttagccgtcctaatcgcaagtacacgtggaatgatgtgggccaactcgtggagaagctcaagaaggagtggaacgtgatctgtattaccgacgtggtttacaaccacaccgccgctaactcaaaatggatacaagagcaccccgagtgtgcatacaaccttgtgaacagcccccaccttaagccggcatgggtgctcgatcgcgcactttggaggttcagctgtgatgtcgcggaaggaaagtataaagaaaaaggaattccagcactgatcgagaatgaccatcacatgaacagcattcggaagatcatatgggaggacatttttcccaagctgaaactctgggaattcttccaagtggacgtcaataaggcagtcgagcaattcaggagactgctcactcaggagaacaggcgagtgactaagtctgacccaaatcaacacctgactatcattcaggatccagagtaccgccgtttcgggtgcactgtggatatgaacattgcccttactacctttataccccacgacaaggggcccgcagcaatcgaagagtgctgtaattggtttcataagaggatggaagagctgaacagcgagaaacaccgcctgataaactaccatcaggaacaagctgtgaactgcctgctcggaaacgtgttttacgaaagactggcagggcatggaccaaagctgggtcctgtcaccaggaaacatcctcttgtgactagatacttcacctttccgtttgaggagattgacttttcaatggaagagagcatgattcatctccccaacaaagcgtgttttcttatggcacacaatggatgggtgatgggtgatgatcccctgcgtaacttcgcagaaccaggcagcgaagtgtatctgcgcagggaactgatctgctggggggactcggtcaagctgcgctatgggaacaagccagaagattgtccatacctctgggcccatatgaagaagtacaccgagataactgccacttacttccagggagttaggctggataactgccattccaccccacttcatgtggcggaatacatgcttgatgccgcaagaaatctgcaacccaatttgtacgtcgttgccgaactgtttacgggttccgaagatcttgataacgtgttcgtgacgagacttggtatctcatcactgattagagaagcgatgtcggcatataactcgcatgaagaaggaaggcttgtctacaggtacggaggagagcccgtgggttccttcgtgcagccatgcctgcgtcccttgatgccggcaatagcacacgcacttttcatggacatcactcacgacaacgaatgtcctatagtgcaccgctcggcctacgacgcactcccaagcactaccatcgtgtcaatggcatgctgcgcttccggttcaactagggggtacgatgaactggttccacaccaaatctccgtggtttccgaggaaagattctatacgaagtggaaccctgaggcactgccctcaaacaccggcgaagtgaactttcagagcggaatcatcgcggcccgatgtgcaattagcaagctgcaccaggaactcggagctaagggattcattcaagtgtacgtggatcaggtggacgaagatattgtggcggtgactcgtcattcaccaagcatacatcagagcgtcgtggccgtctcgagaaccgcatttcgtaatcccaagacgagcttttacagcaaggaggtgccccagatgtgcatcccaggaaaaatcgaagaagttgtgcttgaagccagaaccatcgaaaggaacactaagccttaccggaaagacgagaattcgattaacggtactccggatatcactgtcgaaataagagaacatattcagctcaacgaatccaaaatcgtgaagcaagcaggtgtggcaactaaaggcccaaacgagtacattcaagaaattgagttcgaaaacctcagccctggctcagtcattatctttagagtctccctcgacccgcatgctcaggtggccgtgggcattctgcgcaaccatctgacccaattttcacctcactttaagtccggatcgctggcagtggataatgcagaccctattcttaagatacccttcgcatcactcgcatcgcgactgactttggcagagcttaaccaaattctgtaccggtgtgaatccgaagaaaaggaggacggtggagggtgttacgacattcctaactggtcggcgctgaaatacgcaggcctccagggactgatgagcgtgttggccgaaattcggcctaaaaacgatcttggccatccattctgcaacaacctgcggtcaggggactggatgattgattacgtgtccaatagactgatttctaggtctggcaccattgcagaagtcggcaaatggctgcaagccatgtttttctacctgaagcagattcctagatacctcatcccatgttacttcgatgcgattctgattggagcgtataccactctgttggatacggcatggaagcagatgtcctcgtttgtgcaaaacggctccacctttgtgaagcatctgtccttgggcagcgtgcagctttgtggagtgggcaaatttccatcacttccaattctttcgcctgcattgatggatgtcccctataggctgaacgaaatcaccaaggaaaaggaacaatgttgtgtgagcctcgcagccggactcccgcatttttcatcaggcattttccgctgttggggccgtgacacctttattgcacttagaggaattctgttgattaccgggaggtacgtggaagcgagaaacatcatcctggcttttgcaggaaccctgagacatggacttattcctaaccttcttggtgaaggaatttacgcccgctataactgtagggacgcagtctggtggtggcttcaatgcatccaagattactgtaaaatggtgccaaacggtttggatattctgaaatgtcccgtgtcgaggatgtatcctacggacgactctgcccctcttcccgctggaaccctcgatcagccactttttgaagtgatacaagaagccatgcagaagcatatgcagggaattcagttcagagaaagaaatgctggccctcagattgatcgaaatatgaaagatgaaggctttaacatcaccgccggagtcgatgaagaaactggttttgtgtacggaggtaaccgcttcaactgcggcacctggatggataagatgggcgaatcggatcgggcaagaaaccggggtatccctgcaactcctcgcgatggttccgcagtggaaattgtgggattgagtaagtccgccgtgcggtggctgcttgaacttagcaaaaagaatatctttccttaccacgaagtcaccgtgaagcgacatggaaaggcaatcaaggtgtcatacgatgagtggaatcggaagatccaagataacttcgaaaaactgtttcatgtctccgaagatccgtcggatctgaatgaaaagcatcctaaccttgtccacaagagggggatttacaaggattcctacggagcatcttcaccttggtgcgattaccagcttagacctaactttactatcgccatggtcgtcgcacctgaacttttcactaccgaaaaggcatggaaggcgctcgaaattgcagagaagaagctgctcggccccctcggaatgaaaactcttgatccagatgatatggtgtactgtggaatttacgacaacgccctcgacaacgataactataaccttgcaaagggatttaactaccaccaagggcccgagtggctctggcccattggttacttccttcgggcaaagttgtacttttcccgcctgatgggacctgaaaccaccgcaaagactatcgtgctggtaaagaacgtgctttccaggcattacgtacatcttgaacgatcaccctggaaaggcctccctgaacttaccaatgagaatgcccagtactgtcccttttcatgcgagactcaagcatggtcgattgcgaccatactggagactctctacgacctg

SEQ ID NO: 6096 - DNA, 4596 bp, Artificial Sequence
  Description of Artificial Sequence: Synthetic coding sequence
atggggcatagcaaacagattaggatacttctgctcaatgagatggagaagctcgagaagactctgtttcgattggaacagggctacgagttgcagttcagattgggcccaactctgcagggaaaagctgtgacagtgtacacaaactaccccttccccggcgaaacattcaatcgggaaaaatttcggtccctggactgggaaaacccgaccgagagagaagatgacagcgacaaatattgcaaacttaacctgcagcaaagcgggagcttccagtattatttcctgcagggcaatgagaagagcggcggcggatatattgttgtggatcccatccttcgcgtcggcgccgacaaccacgttcttcccttggattgtgtgactcttcaaaccttcctcgccaagtgtctcggacctttcgatgagtgggagtcccgactccgcgtggccaaggagagcgggtataatatgatccactttacccctctccagaccctgggcctgtcacggtcctgttacagcctcgccaaccagctggagctcaaccccgacttcagcagacctaatagaaagtatacttggaatgacgttggacagttggtcgagaagctgaagaaagaatggaacgttatatgtattaccgatgttgtctataaccacacggcggccaactcaaaatggatccaggagcacccggagtgcgcctacaacctcgtcaatagcccacatctgaaaccagcctgggtattggacagagctctgtggcgcttcagctgcgacgtcgccgagggcaagtacaaagagaaaggtattcccgccctgattgagaatgaccaccacatgaacagtattagaaagattatatgggaggatatttttccaaagctgaagctgtgggagttttttcaggtggatgtgaacaaggcagtggaacagttcagaaggctgctcacacaggaaaataggcgggttaccaaaagtgacccgaatcagcatttgaccattatacaggacccagaatacaggcgattcggatgcactgtcgatatgaacattgcacttactacatttataccccacgataagggcccagctgccattgaggagtgctgtaattggttccataaaagaatggaggaactgaacagtgaaaaacaccgactgatcaactaccatcaggaacaagccgtaaattgtctgcttggcaatgttttttacgagagactggctggacacggaccgaagctgggtcctgtgacgagaaagcatccactggtcacgaggtacttcaccttccccttcgaggagatcgacttctccatggaggaatcaatgattcacctgcctaataaggcttgtttcctgatggctcataatggatgggttatgggcgacgatccactgcgcaactttgcagagccaggttctgaggtgtacctgagacgggaactcatctgctggggagattctgtaaaacttaggtatggaaataagcccgaggactgcccgtacctgtgggcccacatgaaaaaatacactgaaataaccgccacctatttccagggggttaggctggataattgccacagcacgccgctccacgtggctgaatatatgctggatgccgcccggaacctgcagcccaacctgtacgtagtcgctgagctcttcactggctctgaggatctcgataatgtgtttgtcacgaggcttggaataagctctcttatccgggaggctatgtcagcttacaacagtcatgaagagggtcgcctggtgtataggtacggtggtgaaccagtgggtagttttgttcagccttgcttgaggccccttatgcctgcaatcgcacacgcactcttcatggacattactcatgataatgaatgcccaatcgtgcacaggagcgcatacgatgccctcccatccaccaccatcgtgtccatggcgtgctgcgcctctggctctacccgcgggtacgatgagctggtcccccaccagatctccgtggtttcagaggagaggttttacaccaaatggaatccagaagctttgccgtctaacacaggggaggtgaactttcaatccgggattatcgctgcacggtgtgctatcagtaagctgcaccaggagttgggagccaagggcttcatccaggtgtatgttgaccaagtggatgaggatattgtggctgtcacgcggcattcaccctccattcatcagtccgtggtggccgtgtctcggacagcctttagaaatccaaaaacaagtttttactccaaagaagtccctcagatgtgtattcccgggaagatcgaggaggtagtgctggaggcacggactatagaaaggaacaccaagccctataggaaagacgaaaatagtattaatggaacgccagatatcactgtggagatccgagagcacattcagctgaatgaatccaagatcgtgaagcaggctggagtggcaactaaaggacccaacgagtatattcaggaaattgaattcgaaaatctgtcaccaggaagtgtgattatcttccgcgtatccctcgatccccacgcacaagtggccgtgggcatcctcagaaaccacttgacgcaattttcaccccactttaagtccggttcattggctgtagacaatgcagatccgatccttaagatcccttttgccagcctcgcaagtaggctgaccctggctgagcttaatcaaatcctgtataggtgtgagagcgaagagaaggaagatggcggaggttgctatgatatccctaattggagcgccctgaaatacgccgggctccagggtctcatgtccgttctcgcggagatcaggcccaaaaacgatctgggacaccctttttgcaacaacctgcgatccggagactggatgatcgactacgtttctaatcggctgataagccggagtgggaccattgcagaggttgggaagtggctccaggccatgttcttttacctgaaacagattccgagatacctgatcccctgctactttgatgccattctgataggcgcgtacacaactctcctcgacacagcgtggaagcaaatgtcatcttttgtgcagaacggtagtaccttcgtgaaacacctctcattgggcagcgttcaactgtgtggggtgggtaagttcccctctttgcccattctgtcaccagccctcatggacgtgccatatcgactgaatgaaataaccaaagagaaagaacagtgttgcgtttctctggcggctggactgccccacttcagctctgggatcttccgctgctgggggcgggacacgttcattgccctgaggggaatcttgctcatcacaggcagatacgtcgaagcacgcaacatcatcctggcttttgcagggaccttgaggcatgggctgattccaaatcttttgggcgaggggatttatgccagatacaactgtagagacgcagtgtggtggtggcttcagtgtatccaggactattgtaagatggtaccaaatggtttggacatcctgaagtgccctgtgagccgaatgtacccaacagacgactctgcccccctgcctgcaggaaccctggatcagcctctgtttgaagtcattcaagaggctatgcagaaacacatgcagggtatacagttccgagaaaggaacgcgggccctcagattgaccggaatatgaaagatgaagggtttaacattaccgcaggagtcgatgaagagaccggctttgtttacggaggaaatcggtttaactgtggaacttggatggacaagatgggggaatccgatagggctcgcaatagaggaatccctgccacccctcgggacgggtctgctgtggagatcgttggccttagtaaatccgccgtcagatggctccttgagctgagcaagaagaacatttttccataccacgaggtgacagtgaaaagacatgggaaggctattaaggtgagttacgatgaatggaaccgaaagattcaggacaacttcgaaaagctgtttcatgtcagtgaagatccgtccgacttgaacgagaagcacccaaatctggtgcataagaggggtatatataaagacagttatggggcgtcttctccgtggtgcgactaccagttgcgacctaatttcactattgccatggtcgtggcaccggaactgtttacaactgaaaaggcgtggaaggcgctggagatcgccgagaagaagctcctggggccactgggcatgaaaacattggacccagatgatatggtgtactgcggaatctacgacaatgcacttgataacgacaattacaaccttgcaaaagggttcaattaccaccaggggccagagtggctgtggcctatcggttacttcctcagagcaaagctctactttagtaggttgatgggccccgaaacaaccgccaaaacaattgtcctggtgaaaaacgtgctttcaaggcactatgtccatctggagaggagcccttggaagggacttcccgagctcactaacgagaatgctcagtattgtccattcagctgcgaaactcaggcctggtctatagcaacgatcctcgagacattgtacgacctg

SEQ ID NO: 6097 - DNA, 4596 bp, Artificial Sequence
  Description of Artificial Sequence: Synthetic coding sequence
atgggtcattccaagcaaatccgcattctgctgcttaatgagatggagaagcttgaaaaaacactgttccggttggaacaaggatacgagctacagttccggctgggtcctacactgcaaggcaaagctgtcacggtgtataccaattaccccttccctggcgaaacttttaaccgggaaaagtttagaagtctggattgggaaaaccccaccgaaagagaagatgactctgacaaatactgtaaactgaacctgcaacagtccggttcatttcagtattatttccttcaggggaacgaaaagtccggcgggggttacatagtagtggaccctattctgcgggtcggcgctgacaatcacgtcttgcctctggattgtgttaccctgcagacattcttggcaaagtgtctcgggccattcgacgagtgggagtcgagactgcgggtagcgaaagagagtggctataatatgatccatttcacccctctgcaaaccttgggtttatcaaggtcctgttactctttggccaaccagttggaattgaatcccgacttttcccgtccaaacaggaagtacacgtggaacgatgtaggccagctggtggagaagctgaaaaaggagtggaatgtaatttgcatcacagacgtggtgtataaccataccgcagcaaattctaaatggatacaagagcacccagagtgcgcatataacctggtaaactctccacacctgaagcctgcctgggtactcgaccgcgccttgtggaggttttcctgtgacgtggcagaaggtaaatacaaggagaagggcatccccgccctcatagaaaacgatcatcacatgaatagcatccgcaaaatcatctgggaagatatcttccccaaacttaagttgtgggaatttttccaggttgatgtgaacaaagctgtggaacagttccgcaggttgttaacccaggaaaaccggcgggtgacaaaaagcgatcctaatcagcacctaacgatcatacaggatccggagtataggcgcttcggttgtacagtggacatgaatatagctctgacgacgttcataccacacgacaaaggccctgcagctattgaggaatgttgcaattggttccataagcgcatggaggagttaaactcagaaaaacaccggctgatcaattaccaccaagaacaggcggtgaactgcctcctggggaacgtgttttatgaacgactggccggccatgggcccaaactgggtccagtaacacggaaacatcccttggtgacgcgctactttaccttccctttcgaggagattgattttagcatggaagagtcaatgatccacctaccgaataaggcctgcttcctcatggctcacaatggctgggtaatgggcgacgacccccttcggaacttcgcggagccagggagtgaggtatatttgagacgcgagctcatttgttggggcgattcagtcaagttgcgctacggcaataagcccgaggactgtccatacctgtgggcacacatgaaaaagtatactgaaatcacagccacttattttcagggggtccgcctggataattgtcactctacgcctctgcacgtggctgagtacatgctggacgccgctcgaaacctgcagcctaacctgtatgtcgtggccgagttgtttaccggctctgaagacctcgataacgtgttcgttacgaggttaggaatctcttcactcatcagggaggccatgagtgcctacaattcccacgaggaaggccggctcgtttataggtatggcggagagcctgtgggcagttttgtccagccctgcctgcgaccactgatgcccgccatagctcatgctctgttcatggacatcacacacgataatgaatgcccaatcgttcaccgctccgcttatgatgccttgccctcgactaccatcgtgtctatggcatgctgcgctagcgggtctactcggggttatgatgagttagtgccccatcagatctctgtcgtctccgaagaacggttttatacgaagtggaaccctgaagccctgccatctaataccggcgaagttaatttccagtcaggaattattgcggcccggtgcgcgattagtaagctgcaccaagaacttggagctaaagggttcatacaggtttacgtggatcaggtggacgaggatatcgtggcagtcacccggcacagtccttcaattcaccagagtgttgttgctgtgagccgcaccgcctttcgaaatccgaaaacaagcttttacagcaaggaagtcccgcagatgtgtattccgggcaagatcgaagaggtggtcctggaagccagaacaatagagcggaatactaaaccttatcgtaaagatgagaattctattaacggcaccccggacatcaccgttgagattcgcgaacatattcagcttaatgagagcaaaattgtgaagcaggccggagtggctacaaagggccctaacgagtacattcaagaaattgagttcgagaatctgagtcccgggagcgtgatcatattccgggtgagcctggatccacacgcacaggtggcagtcggcatattgagaaaccatctgactcagttttctccccacttcaagagcgggtcccttgcggtcgataatgccgacccgatcctgaaaataccgttcgctagcctcgcttccagactcactctggccgaactgaatcagattctttaccggtgcgaatccgaggagaaggaggacggcggtgggtgctacgatattcccaattggagcgcactgaagtacgccggactgcaggggctgatgagcgtgctcgccgagattagaccaaagaatgacctcgggcatcctttctgtaacaacctgcggtcaggagactggatgattgactacgtgtccaatcgcctgatttcaaggtccgggacaatagccgaggttgggaaatggcttcaggccatgttcttttatctgaaacagatccctagatatctaatcccatgttactttgatgccatcctgatcggagcctacactactctcctagataccgcatggaagcagatgagcagctttgtgcagaatggatcgaccttcgtgaagcacctgtcactgggctctgtccagctatgtggtgtcgggaagttccctagcttacctatactgtctcctgcgctcatggacgtaccttaccgactgaatgagatcactaaagaaaaggaacagtgttgcgttagtctggcggccggtctgcctcatttttccagtgggatcttccggtgttggggccgggacaccttcattgccctgcggggcattttacttatcacgggccgatacgtggaggcccgaaatatcatccttgccttcgctggtacactgcgccacggcctaatacctaatttgctgggcgaaggaatctacgctcggtacaactgtagagacgcagtctggtggtggcttcaatgcatacaggactactgtaagatggtacccaatggactcgacatcctgaagtgccctgttagccggatgtatccaactgatgattccgcgccccttcccgccgggaccctggatcagccactgttcgaagttatccaggaagccatgcagaaacacatgcagggcatacaattccgtgaacggaatgccggaccccagatagacagaaacatgaaagacgagggatttaatatcacggcaggggtcgacgaggagaccggctttgtgtacggcggcaaccggttcaattgcggtacctggatggacaagatgggcgagtcggatagggcaaggaatcgcgggattccggccaccccgcgagatggctctgccgtggagatcgtgggcctgtccaaatctgcggttaggtggcttctcgagttgtccaaaaaaaatatttttccatatcacgaagttaccgtgaaacgccacggaaaggctattaaggtgtcctatgatgagtggaatagaaagatccaggacaacttcgagaagctattccacgtctctgaggacccaagcgaccttaacgagaaacatccaaaccttgtgcataagcgcggcatctacaaagatagttatggagcatctagtccttggtgtgattatcagttgcggcccaatttcacaattgctatggtcgtcgcacccgagctcttcacgaccgaaaaagcttggaaggcgcttgaaatagcggaaaagaaactgctgggcccgctggggatgaaaacattagaccctgatgatatggtgtattgtggaatttatgataacgcgctggacaatgacaactataacctggctaaaggattcaattaccatcagggcccggaatggctctggcctattggctacttcctgagagccaaactctatttctcccggcttatggggccagaaaccaccgccaagaccatcgtcctcgtgaaaaatgtcctgtcaaggcattatgtgcatttagaacgtagcccctggaaggggttaccagagttgaccaacgagaatgctcagtactgtccattttcatgtgagactcaggcctggagcattgctaccatcctggaaacactgtatgaccta

SEQ ID NO: 6098 - DNA, 4596 bp, Artificial Sequence; identical to SEQ ID NO: 6097
  Description of Artificial Sequence: Synthetic coding sequence

SEQ ID NO: 6099 - DNA, 4596 bp, Artificial Sequence
  Description of Artificial Sequence: Synthetic coding sequence
atgggacactcgaaacagatcagaattcttctgctcaacgaaatggagaagctggaaaagactctgttcagactcgaacaaggctacgaattgcaatttcgcctggggccaacgttgcaaggaaaagccgtgactgtgtacactaactacccatttcccggggagactttcaaccgcgaaaagttccgctcactggactgggagaacccaaccgaaagggaggacgacagcgacaagtactgcaagttgaacctccagcagtcgggatccttccaatactactttctgcaaggcaacgaaaaaagcggtggcggatacatcgtggtcgacccaatcctcagagtcggagcggacaatcacgtcctcccgttggattgcgtgactctgcagaccttcctggccaaatgccttggcccgttcgatgagtgggagtcgcggctcagggtcgcgaaggagtcaggatacaatatgatccacttcactcctttgcaaactctgggactgtcgcgctcctgctactccctggctaaccagctggaactgaatccggacttctcccgtccgaatcgcaagtatacctggaatgacgtgggtcagctggtcgaaaagctgaagaaggaatggaacgtgatctgcatcactgatgtggtgtacaatcacaccgccgcaaactcaaagtggatccaggaacacccggagtgtgcttacaacctggtgaactccccacacctgaaaccggcatgggtgcttgaccgtgcactgtggcgcttttcgtgcgacgtggccgaaggcaagtataaggagaaggggatcccagccctgatcgaaaacgatcatcatatgaattccattcggaagatcatctgggaggacatcttccccaagctgaagctctgggagtttttccaagtggacgtgaacaaagccgtggagcagttccgacggcttctgactcaagaaaacagaagggtgactaagtccgaccccaatcagcacctcacgatcatccaggacccggagtaccgcaggttcggctgtaccgtggatatgaacatcgccctgaccaccttcatcccccacgataagggacccgccgcaatcgaagaatgctgcaactggtttcataagcgcatggaggagctcaacagcgagaagcaccgcctgatcaactaccatcaggaacaggccgtgaattgcctgctgggaaacgttttctacgagcgcctggccggacacggacccaagctcggtcctgtcactcggaaacacccgcttgtcacccgctacttcacctttccgtttgaggagatcgatttttcaatggaagaatccatgatccatctccctaataaggcttgcttcctcatggcacacaatggatgggtgatgggagacgatccactgcggaactttgcggagccaggttcggaggtgtacctgcggcgggaacttatctgttggggtgactcagtcaagctgcgatacggtaacaagccggaggactgcccgtatctctgggcacatatgaagaagtacaccgagatcactgcgacctatttccaaggcgtgcgcctcgataactgccacagcactcccctccatgtggcggagtacatgctggacgctgctcgcaatctgcagccaaatctgtacgtggtggcagaactttttacgggaagcgaagatctggacaacgtgttcgtcaccagactgggcatctcctccttgatccgcgaggccatgtccgcctacaactcgcatgaggaagggagactggtgtacagatacggtggagaaccggtcgggagcttcgtgcagccgtgcttgaggccgttgatgccggccatcgcccacgctctcttcatggacatcactcatgacaacgagtgccccatcgtccaccgctcggcatacgatgccctgccgtcgaccaccatagtctcaatggcctgttgcgcttcaggatccactcgggggtacgacgaacttgtgccgcaccagatctcagtggtgtccgaagaaagattctacacgaagtggaaccctgaagcacttccgtcaaacactggcgaagtgaacttccaaagcggcatcatcgccgctagatgcgcgatcagcaaactccatcaagaactcggagccaagggcttcatacaggtttacgtcgaccaggtcgacgaggacattgtggccgtcactcgccattccccaagcatccaccaaagcgtggtcgcggtgagccggaccgcgttccggaatcctaaaacttcgttttactctaaagaagtgccacagatgtgcatcccgggtaagattgaagaggtggtgctggaggcgagaaccatcgaacgaaacaccaagccctaccgcaaggatgagaattcgatcaatgggacgccagatatcacggtggaaatccgggagcacatccagcttaacgaatcgaagatcgtcaagcaagcaggagtggccaccaagggacctaacgaatacattcaggagattgagttcgagaacctgtcaccggggtcggtgatcatctttcgggtgtcgcttgacccccatgcgcaggttgcagtgggaatactgcggaatcacctcactcagttctctccacatttcaaatcgggctcactcgctgttgataacgcagacccgatactgaaaatcccgttcgcttcactggcctctcgcctcactttggccgaactgaaccagatcctttacagatgcgagtccgaagagaaggaagatggcggagggtgctacgatatcccgaattggagcgctttgaagtacgctgggctgcaggggctgatgtcggtgctcgcagaaatcagacctaagaatgatctgggacatcctttctgcaataacctgcgctccggcgattggatgatcgactacgtgtcgaatcgcctcatctcgaggtccggcaccattgcggaagtcggcaagtggctccaagccatgttcttctatctgaagcaaataccacggtacctcatcccatgttacttcgacgcaatactcatcggagcgtacaccactcttctggacaccgcttggaaacaaatgtcctcctttgtgcagaatggatcaactttcgtgaaacatctgtccctcggaagcgtgcagttgtgcggagttggaaagttcccctcccttccgatcctctccccggctctgatggacgtcccgtaccgcctgaacgagattacgaaagagaaggagcagtgttgtgtgagcctggcggccggactcccgcatttttcgtcagggatttttcggtgctggggacgggacacgtttatcgcactgaggggtatcctccttatcaccggacgctacgtcgaagcgaggaacattattctcgccttcgcgggcacgctccggcacggtttgatccctaacctgctcggcgaagggatttacgccagatacaattgcagagatgcagtgtggtggtggctccagtgtatccaggactactgtaagatggtgccaaatgggctcgatatcctgaagtgcccggtgagcaggatgtatccaaccgatgactcggccccgttgccggcaggcacgcttgatcaaccgctgttcgaagtgattcaggaagcgatgcagaagcatatgcaaggaatccagttccgcgagcgaaatgcgggtccccagatagatcggaatatgaaggacgaaggatttaacatcactgcgggagtggacgaagaaaccggcttcgtgtacggaggcaaccggttcaactgcggcacgtggatggacaagatgggggaatccgaccgggccaggaatagaggtatcccagcaaccccaagagatggatcggctgtcgaaatcgttggactctcaaagtcagcggtcagatggctgctggaactgagcaagaaaaacatcttcccataccacgaggtcaccgttaaacgacatgggaaagccatcaaggtcagctacgacgagtggaaccggaaaatccaagacaacttcgagaaattgttccacgtgtccgaagatccgtctgatctgaacgagaaacaccctaaccttgtgcataaaagaggaatttacaaggactcctacggagcatcttcaccctggtgtgactaccaactgcgcccgaacttcactatcgctatggtggtggccccggagctgtttactactgaaaaagcgtggaaagcgctggagattgcagaaaagaagctcctcggcccactggggatgaaaaccctcgatcctgacgatatggtgtactgcggcatctacgacaacgccctggataacgataactacaacctggccaagggattcaattatcaccaggggccagaatggctgtggcccatcggatatttccttcgggccaaactgtacttcagccgcctgatgggcccggagactaccgcaaagaccattgtcctggtgaagaatgtgctgtcacggcactatgtccacctcgaacggtccccgtggaaggggcttcctgaattgaccaatgagaacgcccagtactgtcccttctcgtgcgagacgcaggcctggagcattgcgactatcctcgaaaccctttacgacctg

SEQ ID NO: 6100 - DNA, 4596 bp, Artificial Sequence
  Description of Artificial Sequence: Synthetic coding sequence
atgggccatagtaagcaaatcagaattcttctgcttaatgagatggagaaactggaaaagacacttttcagactggagcaggggtatgaactgcagttccgtctgggtcctacgttgcaggggaaagcagtcacagtatacaccaactacccgttcccaggtgaaactttcaaccgcgaaaaatttcgatcactcgattgggagaaccccacagagcgtgaggacgactccgataagtattgtaagctgaatcttcaacagtctggctctttccagtattacttcctacaaggaaatgaaaagtccgggggcggctacattgttgtggaccctattcttcgggtaggtgcagataatcacgtcctgcctctggattgtgtgacgttgcagacgttcctagcaaaatgcctaggacctttcgacgagtgggagtcaaggctcagagtggcaaaggagtctgggtacaacatgatccacttcacaccacttcagacactcgggctcagtcgtagctgttactcgctggcaaaccaacttgaactgaaccccgacttctcccgcccgaatcgaaagtacacgtggaatgatgtgggtcagctggtggaaaaactgaagaaggaatggaatgttatctgtatcaccgatgtcgtctataatcacacggcggcgaattcgaaatggatacaagagcatcctgagtgcgcctacaacctcgtcaactccccccacctgaagccagcatgggtgcttgaccgcgcattgtggagattctcatgcgacgtggcagagggaaagtacaaggaaaaagggatcccagcccttattgaaaacgatcaccacatgaattccatcagaaagattatctgggaagatatctttcccaaattaaagctgtgggaattctttcaggtcgacgtcaacaaagcagttgagcagttccgccgccttcttacccaagaaaaccgacgcgtcacaaagtctgatcccaaccagcatttaacaatcattcaggaccccgagtatcggcgttttggatgcacagtcgacatgaatatcgcacttacaaccttcattcctcacgataaaggtcctgccgccatcgaggaatgctgcaactggttccacaagcgaatggaggagttgaatagtgaaaagcatcgcttgataaattaccaccaggagcaggcagtcaactgccttttgggcaatgtgttttacgagcgtctcgcaggccatgggccgaaactaggaccagtgactaggaaacatcctctagtgacccggtacttcacgtttccattcgaagaaattgacttcagcatggaggagagcatgatccacctccctaataaagcatgttttctcatggctcacaatgggtgggtaatgggagatgatccgttgcgtaactttgccgagccgggcagcgaagtgtacttgcgccgtgaacttatttgctggggtgattcagtcaaactacgctatggtaataagcccgaggactgtccgtatttatgggctcacatgaaaaagtacacggagattactgctacttatttccaaggggtcagacttgataattgccattctacgccgctccacgttgcggaatacatgcttgatgccgctcgtaatctgcagccgaacctgtacgttgttgcggagttgttcacgggctctgaagatcttgataatgtttttgtcacacgactcggcatatctagccttatacgagaggctatgtcagcttacaatagtcatgaggagggacggctggtgtatcggtacggtggggaaccagtcggaagctttgtgcagccttgcttgcgtcctctgatgccggcgatcgcccatgcgcttttcatggatatcacccacgacaacgagtgcccgatagtccatcgtagtgcttacgacgctctcccttctaccaccatcgtatccatggcatgctgcgcaagcggatccactcgcggttacgatgagcttgtcccgcaccagatcagcgtcgtgagcgaagagaggttttacacaaagtggaacccagaggcattgcccagcaacaccggtgaggtcaattttcaatcaggtattatcgccgctcgatgtgccatcagcaaactacatcaggaactgggcgcgaagggctttatccaggtctacgttgatcaggtcgatgaggacatcgtggccgttacacgtcatagtccttccattcatcagtctgtggtggcggtgagccggaccgcttttaggaatcctaagacatctttctattcgaaggaagtcccccagatgtgcatcccaggcaaaattgaagaagtcgttctcgaagcaaggacaatcgaacggaacacgaagccctaccgcaaggatgagaactcgatcaacggaacgcctgacattacagtggaaatcagagaacatattcagcttaatgaatcaaagatcgttaagcaagcaggagttgccactaaaggtccaaacgagtatattcaggaaattgaattcgagaatctgagccccggatctgtaattatcttcagggtcagccttgacccgcatgcacaggtcgccgtgggaatactccggaatcatttgacccaattctctccacatttcaagtcgggttctcttgccgtagataacgcggacccgatcctgaagattccattcgcaagcttggcctctcgcctcactctcgccgagttaaatcaaatcctgtaccgctgcgaaagcgaggagaaagaagacggtggcggatgctacgatatacctaactggtctgcgcttaaatacgcagggctgcagggtttgatgtccgtcttggcggaaatccggccaaaaaacgatctcggtcatccattctgtaacaacctgcgttccggagactggatgatcgactatgtgtctaaccgactaatcagccgatccgggactatcgctgaggttggaaaatggctgcaagccatgtttttctatttgaaacaaatccccaggtatcttattccttgctattttgatgccatacttatcggggcgtatactacattgctggatacagcttggaagcagatgtcgtccttcgtgcagaacggttccaccttcgtgaaacatctgagcttgggctcagtacagctgtgtggggtcggaaagttcccaagtttgcctatactatcacccgcactgatggatgtgccgtatcgcttaaacgagatcacgaaggaaaaggaacagtgctgcgtgtcgctggccgccggtttgcctcattttagttcagggattttcagatgttgggggcgtgatacctttatcgcacttcgaggtatcctactgataactggacgatacgtcgaggcacgcaatattatccttgccttcgcaggaaccctacgacacggactgatacccaatcttctgggcgaaggtatctacgcacgttacaattgtcgagatgcggtgtggtggtggcttcaatgtatccaggactactgcaagatggttcctaacggactcgatattcttaagtgtccagttagccggatgtatccgacggacgacagcgcaccccttcctgcgggaacgctggaccagcccctcttcgaggtgatccaggaggccatgcaaaagcacatgcaggggatacagttccgggagcgaaatgctggcccacaaatcgaccgcaatatgaaggatgaaggattcaatataaccgcgggggtggacgaggaaaccggtttcgtttatggagggaatcgcttcaattgcggaacctggatggataaaatgggcgaatctgatcgagcccgtaaccgagggattccagcgacgcccagagatggcagtgcggtcgagattgtcggactcagtaagtccgcagtacgatggctgttggaacttagtaagaagaatatcttcccatatcatgaggtcacagtaaaacggcacggaaaggccattaaagtcagctacgacgaatggaatcgcaaaattcaagacaacttcgaaaagctgttccacgtctccgaggacccttccgacctaaacgaaaagcaccctaatttggttcataagcgtggaatctataaggattcttacggggcctccagcccatggtgcgactaccaactgcgacccaatttcaccattgcaatggtagtcgcccctgaattgtttacaaccgaaaaggcttggaaagctctcgagatcgctgaaaagaaactgttaggacccctcggtatgaagaccctggatcctgacgacatggtttactgtggcatttacgataacgcgctggataacgataattataacttggccaaaggttttaactatcatcaaggacccgaatggttatggcctattggatattttctcagggcgaagctctacttttcacgccttatgggtccggagaccaccgcaaagaccattgtgctggtgaaaaacgtcctgtcacgccattacgtacacctcgaaaggtctccctggaaaggactccctgagttgaccaacgaaaacgctcagtactgtcccttctcatgcgagacccaggcgtggtctattgctacaatcctcgagaccttgtatgatcta

SEQ ID NO: 6101 - DNA, 4596 bp, Artificial Sequence
  Description of Artificial Sequence: Synthetic coding sequence
atgggacattcgaagcagatacggatccttctcctgaatgaaatggagaagcttgaaaagactttattccgactggaacaaggatatgagttgcagtttcggcttggacctaccctccaaggcaaggccgtgacggtttataccaattatcctttcccaggggagacatttaatcgggaaaagttccggtctctggactgggagaaccccacagaaagggaggacgattcagataagtactgtaagctgaacctccagcagtccgggtctttccaatattactttctacaaggaaatgagaagtcagggggcggttatatcgttgtggatccaatcctcagagtgggcgcggataaccacgtgctgcctctggattgtgtgaccctgcaaacattcctagccaaatgcttaggcccctttgacgagtgggagagtcgcctgcgtgtcgccaaggagtcaggctacaacatgatccactttactccccttcagacactcggattgtctcgcagctgctactcgcttgccaaccagctggagctgaacccagacttctcccgaccaaatcgcaaatatacatggaacgatgttgggcagctcgttgaaaaactgaaaaaggagtggaatgtcatatgtatcactgatgtggtttataatcacaccgcagccaattccaagtggatccaggagcaccccgagtgcgcctataatctcgtgaatagccctcacctgaagcccgcatgggtacttgaccgcgccctgtggcggtttagctgcgatgttgctgaggggaagtacaaagaaaaggggatccccgccctgatcgaaaatgaccatcacatgaattctataagaaagatcatctgggaagatatctttcccaagcttaaactgtgggaattttttcaagtggatgtgaataaagccgtggagcagtttaggcgtctcctgactcaggaaaatcgccgcgtgacaaagtccgaccccaaccagcacttgacgattatccaagacccagagtaccggcggtttgggtgcacagtcgacatgaacatagctcttaccacattcatacctcatgacaaaggccccgcagccattgaggagtgctgtaactggttccataagaggatggaagaactgaactcagaaaaacatcggcttattaattaccaccaagagcaggccgttaattgcctcctgggcaacgtattttacgagaggctggctggccacggtccgaaactggggccggttactcggaaacacccccttgtaacgcgctatttcacctttcccttcgaagagatcgattttagtatggaggaaagtatgatccacctgccaaacaaggcgtgctttctgatggcgcacaatggatgggtcatgggtgatgatccactacgcaacttcgctgagccaggaagtgaagtgtacctgcggagagaactcatctgttggggtgacagcgtcaagctgcggtacggcaacaaacccgaggattgcccctacctgtgggcccacatgaaaaagtacactgagattaccgccacatacttccagggcgtgagattggataattgccactccaccccattgcacgtcgccgagtatatgctcgatgctgctcggaatctgcagcctaacctgtatgtggtcgcggagctgtttactgggtcagaggatctcgataatgtatttgtgactaggctgggaataagcagtctgatcagggaagccatgtcagcatataactcccatgaggaaggcagactcgtttatcgatatggaggggaaccagttggatcctttgtacaaccgtgtctacggcctctcatgcctgccattgcacacgctctgtttatggatatcacacacgacaacgaatgtcccatcgtgcatcgttcagcctacgatgcgctccctagcaccaccattgtgagtatggcgtgctgtgcttcaggctctacacgaggttacgacgagcttgtgccgcaccagataagcgtcgtgagcgaggaaagattttatactaaatggaacccggaagctctgccttctaacaccggagaggtgaactttcagtctggaatcatcgcagcacgctgtgccatatccaagctgcaccaagagctaggcgccaaggggttcattcaggtctatgtggaccaggtggacgaggacatcgtggccgtgactagacactctccatcaatccaccaatccgtggtggccgtgagccggacggcatttagaaatcccaaaacttctttttacagtaaggaagtgccgcagatgtgtatccccgggaagattgaggaggtagtgctggaggcccgcactatcgagcgaaatactaagccttacaggaaggacgaaaactctattaatggcaccccggacatcacagtggaaatacgagaacacatccaactgaacgagtccaagatcgtgaaacaggctggggtggccacaaaaggcccaaatgagtatattcaggagatcgagttcgagaatctgtcacccggctccgttattatcttcagggtgtccctggatccccacgctcaggtggccgtcggcattttaaggaatcacctgacccagtttagtccacatttcaaatcgggctctcttgcagttgacaatgccgacccaattcttaaaattccttttgcttctttggcgtcgcggctgacactcgcagaattgaatcagatactgtaccggtgcgagagcgaagaaaaggaagacggaggtggatgttacgacattcctaattggtcggccttgaagtatgctggccttcagggcctgatgagcgtactcgccgagataagacctaagaatgatctcgggcatcccttttgcaacaatttgaggtctggtgattggatgatcgattacgttagcaacaggctgatcagcagatccggtaccattgcagaagtcggaaaatggttgcaggccatgttcttctacctaaagcagattcctagatatctgatcccttgttatttcgatgctattctcataggagcctatactaccctgctggataccgcctggaaacagatgagctcctttgtccagaacggaagtacatttgtgaagcatctgtcactgggcagcgtccagctgtgtggcgtgggcaagttcccgtccctgcccatcctgagccctgctctgatggatgtgccctatcggctgaacgagatcacgaaggaaaaagagcaatgctgcgtctccctggcggcgggcctgccccacttctccagcggaatcttccgctgttggggtcgggacacctttattgcgttgaggggaattctgctgataaccggaagatatgtggaggcgcgcaatatcattctggcttttgcaggcacactgaggcacggcctgatccccaatttactgggcgagggaatctatgcccgctataattgccgggatgcggtatggtggtggctccagtgcatccaagactactgcaagatggttcccaacggcttagatatcttgaaatgcccagtgtcacggatgtatcctaccgacgattctgccccattgcctgcagggacattagatcagcccctgtttgaggttatccaagaagccatgcagaagcacatgcaaggaatccagtttcgtgaaagaaacgcgggaccccagatcgaccgaaacatgaaggatgagggcttcaacatcactgccggcgttgacgaagaaacaggcttcgtgtacggaggcaacaggtttaactgcgggacttggatggataagatgggggaatcagaccgggcacggaatcgcggcattcccgcaacgccgcgcgacgggtctgcggttgagattgtaggactgtccaagtctgcagtgcgttggcttttggagctgtccaagaagaatatattcccttatcacgaggtgactgtgaagagacacgggaaggccatcaaagtgtcctatgacgagtggaaccgcaaaattcaagacaatttcgaaaagctgttccatgtcagcgaagatcccagcgacctgaatgaaaaacatcccaacctagtccataaaagggggatctacaaggattcctacggggcatcttctccctggtgcgactaccagctgcgacccaatttcaccatagccatggtcgtagctcccgagctcttcacaactgagaaggcctggaaggctttggagatcgccgagaagaaacttttgggcccactcggcatgaaaacactggatcccgatgacatggtttactgtgggatctacgataatgctctggacaatgacaattacaatctggcaaaggggtttaattaccaccagggaccagagtggttgtggccaattggatatttcttgagagccaaactttacttctctagactcatggggccagagacgaccgcaaagaccattgtcctcgtcaagaacgtcttatctaggcactacgttcacctggagcgtagcccctggaagggactgccagagctcactaacgaaaacgctcagtattgcccgttctcttgcgagactcaggcctggtcgattgcaacgattctggaaactctctatgatttg

SEQ ID NO: 6102 - DNA, 4596 bp, Artificial Sequence
  Description of Artificial Sequence: Synthetic coding sequence
atgggacattccaaacagatccgtatcttgttgctcaatgaaatggagaagctggaaaagaccctgttccgcctcgaacagggctacgagttgcaattccgcctgggtccaaccctgcaaggcaaagcggtgactgtctacactaattacccgtttcctggagagactttcaaccgggaaaagtttaggagcctcgactgggaaaaccctactgagcgagaagatgacagcgacaaatactgtaagctcaatctccagcaatcgggctcatttcagtactactttctccagggcaacgaaaagtcgggcggaggatacatcgtagtcgatcctatcctccgggtgggagccgacaaccacgtgctgccgctcgattgcgtgacgctccagacgttcctggcgaaatgcctgggacctttcgacgaatgggaatcccggctgagggtcgctaaagaatccggatacaatatgattcatttcaccccgctgcagacgctgggactcagccggtcctgttactcactggccaatcagctggaactgaacccggattttagccggccgaatcggaagtacacttggaacgacgtcggacaactggtcgagaaactcaagaaggaatggaacgtcatctgtatcactgatgtggtgtataatcacactgctgccaacagcaagtggatccaagagcatcccgaatgcgcctacaaccttgtgaacagcccgcacctgaaaccggcctgggtgctcgaccgcgcactgtggcgattctcctgcgacgtggcagaaggaaaatacaaggaaaagggaatcccagccctgatcgaaaacgaccatcatatgaactcgatcagaaagatcatctgggaagatatctttccaaagctgaagttgtgggagttcttccaagtggatgtgaacaaggccgtcgaacagttccggcgcctgcttacccaggagaaccgaagagtgaccaaatccgacccgaatcaacacctcactatcatacaagatcctgaatatagacgcttcggatgcactgtggacatgaacatcgccctgaccaccttcatacctcacgataagggaccagccgcgatcgaagaatgctgtaactggttccacaaacggatggaggaactcaactccgagaagcaccggctcataaactaccatcaagaacaggcggtcaactgcctcctgggcaatgtgttttacgaacgcttggccggccatgggccaaaactgggaccagtgacccggaagcacccgctggtcacccgctacttcaccttccctttcgaagagatagatttcagcatggaagaaagcatgatccatttgccgaacaaggcctgcttcctgatggcgcacaacggatgggtgatgggcgacgacccgctgaggaacttcgcggagccaggtagcgaagtgtaccttagacgcgaattgatctgttggggagactcggtcaagctgcggtacgggaataaaccggaggattgcccgtacctgtgggcccatatgaagaagtacactgagatcaccgcgacgtacttccaaggagtgaggctcgacaattgccattcgacgcccctccacgtcgctgaatacatgcttgatgccgccagaaacctgcaaccgaatctgtacgtggtggccgagctgttcaccggatccgaggacctggacaatgtgttcgttactaggctgggcatctcatcacttatccgcgaagcgatgtcggcctacaattcacatgaggagggtcggctcgtctaccggtacggaggcgaacctgtgggctcatttgtccagccatgcttgcgcccactgatgccagccatcgcgcatgcccttttcatggatattacccacgacaacgagtgcccgatcgtgcaccgcagcgcgtacgatgcattgccttcaacgaccatcgtgagcatggcatgctgcgcctcgggatccactcgcggatacgacgaactggtgcctcatcagatctcggtggtgtcagaagaaaggttctacactaagtggaatcccgaagcactgccttcgaatactggagaagtgaatttccagtccggcattattgctgcgagatgtgccatctccaaattgcaccaggagttgggggctaagggcttcatccaggtgtacgtagaccaggttgacgaagatatcgtagcggtgacccgccattcgccatcgatccaccagtctgtggtggctgtgtcgagaaccgcctttcgcaatccgaaaacctcgttctacagcaaggaagtgcctcaaatgtgcattcccggaaaaatcgaggaggtggtgctcgaagcacgcaccatcgagcggaacaccaaaccataccgcaaagatgagaacagcatcaacggaaccccggacatcactgtggagatccgggagcacattcagctcaatgagtcaaagatcgtcaagcaggcgggagtcgcaaccaagggcccgaacgaatacatccaagaaatcgagtttgagaacctcagccccggatcagtgatcatctttcgggtgtcgttggacccacatgctcaagtggccgtggggatcctgcggaaccacctgacccagttctcgccgcactttaagtcgggatcgctggcggtggacaacgccgatcccattttgaagatcccgtttgcctcactcgcgtcgcggctcactctcgccgagctcaaccaaatcctctatcgatgcgagtcggaagaaaaagaggacggaggcggatgctacgatatccctaattggtcggcactcaagtacgccggactccagggactcatgtcggtgctggctgagatcaggcctaagaacgaccttgggcatccattctgcaataatctccggtctggagattggatgatcgactacgtgtccaatcggctgatttcccggtcgggcactatcgcggaagttggaaaatggctgcaggctatgtttttctacctgaaacagatcccgagatacctcatcccgtgctactttgacgcaattctcatcggagcttacactactctcctggatactgcctggaaacaaatgtcatccttcgttcagaatggcagcactttcgtgaaacacttgtcactgggtagtgtccagctgtgtggggtcggaaagtttccatcactgccgatcttgtcgcccgcgctcatggatgtgccatatcgcttgaatgagatcacgaaggagaaggaacagtgctgcgtatccctggccgccggactcccacacttcagctcgggaatctttcgctgctggggtagggacacgtttattgcacttcgcggaatccttctgatcaccggaaggtacgtggaagctcgtaacatcattttggccttcgccggcaccctgagacacggcctgatcccaaacttgctcggagaaggcatctacgcccgctacaattgccgcgacgcggtgtggtggtggctccaatgtatacaggactactgcaagatggtgccgaatggcctggacatcctgaagtgcccagtgagccggatgtatccaaccgacgattccgcccccctcccagccgggactttggaccagccgctgttcgaggtgatccaagaagccatgcagaagcacatgcagggtattcagttccgggagcgcaatgccggtccgcagatcgacagaaacatgaaggacgaaggatttaacatcactgcaggcgtggatgaagagactggcttcgtgtacggaggaaaccgattcaattgtggaacctggatggataagatgggcgaatccgaccgggcaagaaaccgcggaatcccggcaaccccgcgcgatggatccgcagtggaaatcgtggggctgtcaaagtcagctgtgaggtggctcctggagctgtcgaagaaaaacatattcccataccacgaagttaccgtgaaacgtcatggaaaggccattaaggtgtcctacgatgagtggaacagaaagattcaagacaatttcgaaaaactcttccacgtctcggaagatccgtctgatctcaacgaaaaacacccgaacctggtgcataaaagaggaatctataaagactcctacggcgcttcatcaccgtggtgcgattaccagcttagaccgaacttcacgatcgctatggtggtggccccagaactgttcaccactgaaaaggcatggaaggcgctcgagatcgctgagaagaagctgcttggcccactgggaatgaaaactctggacccggatgacatggtgtactgcggaatctacgacaacgcactggacaacgataactacaacctggccaaggggttcaattaccaccaagggccggagtggctgtggccgatcggctacttcctgcgcgcaaagctgtacttctcccgcctgatgggacccgaaaccaccgcgaaaaccatcgtgctcgtgaagaacgtgctctcgagacactatgtgcacctggagcggtccccgtggaaagggcttccagaactgaccaatgagaacgctcagtattgccccttctcctgcgagactcaggcgtggtcaatcgcaaccattctcgaaaccctgtacgacctc

SEQ ID NO: 6103 - DNA, 4596 bp, Artificial Sequence
  Description of Artificial Sequence: Synthetic coding sequence
atgggacactctaagcagatcaggattttgctgctgaacgagatggagaagctggagaagaccctatttcgtcttgaacagggctatgaactccaattccgcttaggacccacgctgcaggggaaagcagtgaccgtctataccaattatccttttcctggggagactttcaatagggaaaagtttaggtccctcgattgggagaatccaacagagagggaagacgactcggacaaatattgtaagctgaatctgcagcagtccggctccttccagtactatttcttgcaggggaatgagaagtctggtggcggatatattgtcgtggacccaatccttcgcgtgggggcggacaaccatgtactgcctcttgactgtgtgaccctccagacctttctggccaagtgtctgggaccattcgacgagtgggaatcgcgcttgcgggtggccaaagagagcggttataatatgatccacttcacaccccttcaaaccctggggctctctagatcttgctatagcctagctaatcagctggagttaaatcccgatttcagtcggcctaatcgaaagtatacctggaatgacgttggccagttggttgagaaactcaagaaagagtggaatgttatctgcattactgatgtcgtatacaaccacactgccgccaacagcaaatggatccaggaacaccccgagtgtgcctacaatctggtcaactccccacatctcaaaccagcttgggtcctcgaccgcgctttgtggcggttttcctgtgacgtggctgaaggtaagtacaaggagaagggtatccccgcactcatagaaaatgaccaccatatgaacagtattcggaagatcatttgggaggatatttttcccaagctgaagctctgggagttcttccaggtggacgtaaacaaagcagtcgagcaatttaggaggttgctgactcaggagaacagacgggtgaccaagtctgatcccaaccagcacctgaccataattcaggaccccgagtatcgtaggttcggatgtaccgttgatatgaacatcgcgctgaccacatttatcccacacgataaaggcccagctgccatagaggagtgctgtaactggtttcacaagagaatggaggagttgaactctgagaagcataggctgataaactaccatcaggagcaagctgtgaattgcttgctggggaacgtgttctatgaacgactggcagggcatgggcccaaactgggacctgtaactcgcaaacaccctttggtaactcggtatttcacatttcctttcgaggaaatagacttttctatggaagaatcaatgattcatttacctaataaagcctgtttcttgatggcccacaatggatgggtgatgggtgacgatccactccggaactttgccgagcccggtagtgaggtatacctgcgcagggaattaatatgttggggtgacagtgtaaaacttcgctacggcaataagcccgaagattgcccctacctgtgggcacacatgaagaagtataccgaaatcaccgccacctacttccagggggtccggttggataattgtcattctaccccactgcatgttgctgaatatatgctggacgccgccagaaacctgcagcctaatctgtatgtcgtggctgagctcttcactggctccgaagacttggacaacgtgtttgtgactcggctaggcatatcaagcctcatcagggaggccatgagcgcttataatagccatgaggagggccgtctcgtttatcgctacggcggggagcccgtgggctccttcgtgcagccctgtctgcgaccattaatgccggccatagctcacgccctcttcatggacatcacacatgataacgaatgtcctatcgtccaccggagtgcatacgacgcgctgccttcaacaacaattgtaagtatggcatgttgtgcgtccggcagcactcggggatacgacgagcttgtgcctcatcaaattagcgtcgtgtctgaagagaggttctatactaagtggaaccccgaggccttgcccagtaacacgggcgaagtgaactttcagtctggaattatcgccgctagatgcgccatcagtaagctgcaccaggagctgggagctaagggattcatacaggtgtatgtggaccaggtggatgaggacatcgttgccgtgacccggcactctccatcaatacatcaatccgtggtggccgtcagtaggacagcgttccgtaacccaaagacttcattttatagtaaggaagtgcctcagatgtgcatccccggaaaaattgaggaagtggtgttagaagcccggactatagaacgtaacactaaaccctacagaaaggatgagaatagcataaacggcactcccgatataacggtcgaaattagggagcacattcaactaaatgaaagtaaaatcgtgaagcaggcaggtgtggcaacaaaaggaccaaacgaatatatccaggaaatcgaatttgaaaacctttcaccaggatcagtaatcatctttagagtgtccttggacccacatgctcaagtggcggtggggatactgcggaatcatcttactcagttctccccccactttaagtccggcagcctggccgtagacaatgcagatcccatccttaaaatccctttcgcttcgctggccagtcgacttacactggccgagctgaaccaaatcctgtacaggtgcgaatccgaagagaaggaggacggcggtgggtgttacgatatccccaattggagcgccctgaagtatgcaggtctacaaggcctgatgagtgtccttgccgagataaggccaaagaatgacttggggcatcccttttgcaacaatctgcgttcgggggactggatgatcgactacgtttccaatcgcctgatctccaggtctggtacaattgccgaggtgggcaagtggctccaggccatgtttttttacctcaagcagattcccagatacctgattccctgctattttgacgccatacttatcggggcctacactacactgttggatactgcctggaagcagatgagctcctttgttcagaatggctctaccttcgttaaacatttatccctgggatcggtccagctatgcggggtgggtaagttcccgtccttacctatcctgtccccagctctcatggacgtaccttatcgactgaatgaaatcactaaggaaaaagaacagtgttgcgtgagtctagcggcggggttgccccacttttcatcagggattttcagatgctggggccgggacaccttcatagccctgcgggggatacttctgattactggaaggtacgtcgaggccaggaatattattttagcatttgccggaactttgcggcacggattaatccccaacttgctcggcgagggcatctacgccagatacaattgcagagacgctgtttggtggtggctccaatgtatccaagactactgtaagatggtccctaatggcttggacatcctcaaatgccctgttagtcgtatgtaccctacagacgactccgctccccttcctgcggggaccctggatcagccgttattcgaagtcattcaagaggctatgcagaaacatatgcaaggcattcaatttcgggaaagaaacgccgggccgcaaattgatagaaatatgaaggacgagggctttaacatcaccgccggcgttgatgaggagactggcttcgtgtacggaggcaaccggtttaattgcggaacttggatggataagatgggggagtcagacagggcacgtaacagaggcatccccgcgacacctagagacggctccgctgttgaaattgttggcctttccaagtctgccgtaagatggctccttgagctgagtaagaaaaatatatttccgtaccacgaagtcactgtgaagcggcacggcaaggctattaaagtttcatatgatgagtggaacaggaagattcaggacaacttcgaaaagctgttccacgtgagtgaggacccctcggacctcaacgagaaacacccgaaccttgtgcacaagaggggaatctataaagactcctacggcgcgagttccccatggtgtgattaccagcttagacctaacttcactattgccatggttgtcgcgccagaactgtttactacagagaaggcgtggaaagcactggagattgccgaaaaaaagcttttgggaccccttggcatgaaaaccctcgatccagacgacatggtatactgtggaatctacgacaatgccctggataatgacaactataacttagccaaagggtttaactaccaccaggggcctgagtggctatggccaatcgggtatttcctgagagcgaagctgtacttctcaagactgatggggcccgagacgaccgcaaaaactatcgtgctcgtgaagaacgtcctttcccggcactacgtgcatcttgaacgctccccctggaagggattaccagagctgaccaacgagaacgcccaatattgcccctttagctgcgagacgcaggcttggtctatcgccactatcctcgagaccctgtacgacctc

SEQ ID NO: 6104 - DNA, 4596 bp, Artificial Sequence
  Description of Artificial Sequence: Synthetic coding sequence
atgggccactctaagcagattagaatcctccttctgaacgagatggagaagctggagaaaactctgtttagactggagcagggctacgaacttcagttccgcctcggtcctacgctgcagggaaaggcggtgacggtctacactaactacccattccccggtgagacgttcaaccgcgagaagttcaggtcgcttgactgggaaaaccctactgaaagggaagatgatagcgacaagtactgtaaactcaacctgcagcagtcgggttcatttcagtattactttttgcagggcaatgagaagtccggaggaggttacatcgtggtggaccccatcctcagagtcggagcggataatcacgtattgccgctggactgcgtgaccctccagacttttttggcaaagtgcctgggaccgttcgacgaatgggaatcccgcttgcgggtcgctaaggaatcgggatacaacatgatacactttaccccgttgcagaccctggggctgtcgagatcgtgctactcgctcgctaatcaactggaactgaatccggacttcagccgcccgaatcggaagtacacctggaacgatgttggacagctcgtggaaaaacttaagaaggagtggaatgtgatctgcatcaccgacgtggtgtacaatcacaccgctgcgaactcgaagtggattcaggaacacccagaatgtgcctacaatctggtgaacagcccgcacctgaaaccggcctgggtgctcgatcgggccttgtggcggttctcgtgcgatgtggctgagggcaagtacaaggaaaaaggcatccctgccctcatcgaaaacgatcatcacatgaacagcatccgcaaaatcatttgggaggacatttttccaaaactgaagctgtgggagtttttccaggtggacgtgaacaaggccgtggaacagtttagacgcctgctcactcaggaaaatcgccgcgtgaccaagtcggatccgaaccagcatctgaccatcatccaggacccggaataccggaggtttgggtgcactgtggacatgaacatcgctctgactacgttcattccacacgacaaggggccagctgcaatcgaggaatgctgcaactggttccacaagcggatggaagaactgaactcagaaaagcacagacttatcaactaccatcaagagcaagccgtgaattgcctgctgggaaatgtgttctacgagagactcgcaggacatggaccgaaacttggacccgtgacgcggaagcacccgctggtgacccgctactttactttcccgttcgaagagattgacttctcaatggaagaatcgatgatccacttgccaaataaggcttgcttccttatggctcacaacggttgggtgatgggcgacgaccctctgaggaacttcgctgaaccaggatcagaggtttacctccgtcgggaactgatctgttggggagactcggtgaagctgagatacggaaacaaaccggaggattgtccgtacctgtgggcccatatgaagaagtacactgagatcaccgccacctatttccaaggagtccggctggacaactgccactcaacccctctgcacgtggccgagtacatgctggacgcagcgagaaaccttcagcccaacctgtacgtcgtcgccgaactctttaccggctctgaggacctggacaatgtgttcgtgactagactcggaatcagctccctgatccgcgaagcgatgtcagcctacaacagccatgaggaaggtagactggtgtacagatacggaggcgagcccgtcggatcgttcgtgcagccgtgcctgcgcccgttgatgccggccattgcgcatgccctgtttatggacatcactcacgacaacgaatgtcccattgtgcatcgctccgcttacgatgccctcccatcgaccactatagtcagcatggcctgctgcgcgtcgggatcgaccaggggctacgatgaactggtgccgcatcaaatcagcgtcgtcagcgaggagaggttctacaccaagtggaacccagaagccctgccgtccaacaccggagaagtgaacttccagtcgggcatcattgcggcacggtgtgcaatctcgaaactgcaccaggaactgggagcaaagggctttatccaggtctacgtggatcaggtggatgaggacatcgtcgcggtgacccgccactcgccgtcaatccatcaatcggtggtggctgtctcgaggactgcattccgcaacccaaagacttctttctatagcaaagaggtgccgcaaatgtgcatcccaggaaagatcgaggaggtggtcctcgaagccagaacgatcgagcgcaacactaaaccgtaccggaaggacgagaactcaattaacgggactccagacatcaccgtcgagatcagagagcatatccaactcaacgagagcaagatagttaagcaggcgggagtcgcaactaagggaccaaatgaatacatccaagagatagaattcgagaatctgtccccggggagcgtgattatcttccgcgtgtcgcttgacccccacgcgcaggtcgcagtcggaatcctccggaaccaccttacccagttctccccgcacttcaagagcgggagtctggccgtcgataacgctgacccaatcttgaagatcccgttcgcctcgctggcctcgcggttgactttggccgaattgaatcaaatcctctacaggtgtgagagcgaggagaaggaagatggtggtggatgctatgatatccctaactggagcgctctcaaatacgccggattgcaaggactgatgtcggtgctggctgagatccggccgaaaaacgatctgggtcacccgttctgcaacaatctgagatcgggggattggatgatcgactacgtgtccaatagactcatctcaagatctggaaccatcgccgaagtgggaaagtggctgcaagccatgttcttttacctgaagcaaatccctcgatacctgataccttgttacttcgacgccattctgataggagcgtacactactctgctggatacggcatggaagcagatgagcagcttcgtgcagaatggctccactttcgtgaagcacctctcgctgggatcggtccaactgtgcggagtgggtaagttccctagcctcccgatcctgtcaccggctcttatggacgtcccctaccggcttaacgagatcactaaggaaaaggagcagtgctgcgtgtcgctcgcggccggattgcctcatttctcgtctggcatcttccgctgctggggacgcgataccttcattgcacttagagggattctccttatcactggccgctacgtggaggccaggaacattatcttggcgttcgcagggaccctgcggcacggcctgatccccaatctgctgggcgagggcatctacgcccgatacaactgtagggacgccgtctggtggtggcttcagtgcatccaggattattgcaagatggttccgaacggactcgacatcctcaagtgccctgtgagccgcatgtacccaaccgacgactcagccccgctcccagcaggaacgctggaccaaccgcttttcgaagtgattcaggaagcgatgcagaaacacatgcaaggaatccagttccgggaacggaacgccgggccgcagattgatagaaacatgaaggatgaaggcttcaacattaccgcgggtgtcgacgaggagacgggattcgtgtacggcggaaatcgctttaactgcggcacgtggatggacaagatgggcgaaagtgatagagcgaggaacaggggaatcccggccactccacgggatggctccgccgtggagatcgtcggcctgtcgaaatcggcagtccggtggctgctcgagctttcgaagaagaacatcttcccgtaccatgaagtcaccgtcaagcgccacggtaaggcaatcaaggtcagctacgacgagtggaacagaaaaatccaggataactttgaaaagctgttccacgtgtcagaggacccatcagatctgaacgaaaaacacccgaacttggttcataaacgtggaatctacaaggacagctatggtgccagctccccatggtgcgattaccagctgcggcccaactttactatcgccatggtggtcgcaccggagctgtttactaccgaaaaagcctggaaagcactggagattgccgaaaagaaactcttgggccccctgggaatgaaaactctcgatccggacgatatggtgtactgcggaatctacgacaacgctcttgacaacgacaattacaatctggccaagggtttcaattaccatcaaggaccggaatggctttggccaatcggctacttcctcagggccaagctgtacttctcaaggctgatgggacctgaaaccaccgcaaaaaccatcgtgctcgtgaagaacgtgctctccagacactacgtccatttggaacgttcaccatggaagggactgcctgagctcaccaacgagaacgcccagtactgcccgttcagctgtgaaacccaggcatggtccatcgcgaccatcctcgaaacgctgtatgatctg

SEQ ID NO: 6105 - DNA, 4596 bp, Artificial Sequence
  Description of Artificial Sequence: Synthetic coding sequence
atgggacattctaaacaaattaggatcttactgcttaatgagatggagaaactcgagaagaccttgttcaggttggagcagggatacgaacttcagtttcgtcttggcccaacactgcagggaaaggccgtcacagtgtacacaaactacccgttcccaggggagactttcaacagagagaagttcagatctttagattgggagaaccccacagaaagggaggacgactctgataagtattgcaaactgaacctacagcagtccggttcctttcagtactattttttgcaggggaacgaaaaatccgggggaggttatatcgtcgttgatccaattctccgggtcggggctgacaaccacgtgcttcctctcgattgcgtaacactgcagacatttctagctaagtgtttggggccattcgatgaatgggagagccggctgcgcgtggccaaagagtctgggtataatatgatccactttacccctctgcagaccctggggctgagtcggagctgttactctctggccaatcagctcgaactgaaccccgatttcagtcgcccaaatagaaaatacacgtggaatgacgtcggccagcttgtagaaaagctgaagaaagaatggaatgtgatatgtattaccgacgtggtatacaaccatactgccgcaaactccaaatggatacaggaacaccctgaatgtgcctataacctcgtgaactcgccacatctaaagcccgcttgggtattagatcgcgccctgtggagatttagctgtgacgtggctgaaggcaagtacaaagagaaaggaattcccgccctgattgagaatgatcatcatatgaatagcatacgcaaaataatctgggaagacatctttcctaaactgaaactgtgggaatttttccaagtagatgtgaacaaagcggtggagcagtttcgcaggttgttaactcaggagaatcgcagggtcacaaagtcggacccgaatcagcacttgactatcatacaggatccagaatacagaagatttgggtgcacagtggatatgaacatcgctctgacgactttcataccacacgacaagggaccagcagccatagaggagtgttgcaactggttccacaaaagaatggaggagctgaactctgaaaaacaccggttgataaactatcatcaggaacaggcggtaaattgtctactcggtaacgtattctacgaaaggctcgccggacacggccctaagctcgggccagtaacaagaaagcacccccttgtaacgagatattttaccttcccattcgaggagatcgacttttcgatggaggaatccatgattcacctgccaaataaggcatgtttcttgatggcccacaatggctgggtgatgggggacgacccactcagaaacttcgccgaacccggatcagaagtgtacctgagaagagagctgatttgctggggggatagcgttaaactgcgctatggtaacaaacctgaagactgcccgtacctgtgggctcatatgaagaagtacacagagattacggcgacctactttcaaggtgtgaggctggataattgtcattccactcctctccatgtggccgagtatatgctagatgccgctcgcaatttgcaaccgaatctgtacgttgtggcagagctgtttaccgggagtgaggatctggataacgtgtttgtgacccggctgggcatctcctccctgattagggaggctatgtctgcttataacagccacgaagagggccggctagtctacagatacggcggcgagccagtcggttctttcgtccagccctgtctacggcctctgatgcctgcaatagctcacgctttgtttatggacattacacatgataacgagtgtccaatcgtgcacagatccgcgtacgatgccctgccaagcacaactattgttagcatggcctgttgtgcatcagggagcactaggggttatgatgagctggtcccacaccagatcagcgtagtctccgaagaacggttttataccaagtggaacccagaggcactgccctctaatactggtgaggtgaacttccagagcggcattattgctgcacgttgcgccatcagcaagcttcatcaggaacttggggcaaaaggcttcattcaggtatatgtggaccaggtcgacgaagacatagtggccgtgacgcgacactcaccatctatccaccagtcagtggtagcggtttcaaggacagctttcaggaacccaaaaacctctttttactccaaagaagtgccacagatgtgcatccccggtaagatagaagaggtggttttggaggccaggaccattgagaggaacactaagccgtataggaaagacgaaaactctattaacgggacccctgacatcaccgtggagatccgagagcatattcagctcaacgaaagtaaaattgtcaaacaagccggagtggctaccaaaggccctaatgaatacattcaggagattgaattcgagaacctgtcccctggctctgtaatcatattcagggtgtcgcttgatcctcatgctcaagtagccgtcggtatcctgcgtaaccacctgacacagttctcacctcactttaagtctggcagcctggccgtggacaatgcagaccccattctcaaaatcccgttcgcctccctagcctcccgtctcaccttggcggaactgaatcagatcctgtaccggtgcgaaagcgaggagaaggaggatggaggcgggtgttatgacattccaaattggtctgctctgaagtatgcggggctgcagggtctgatgtcagtgctggccgaaatccgtcccaaaaatgatctaggtcatccattctgcaacaacctgcgctccggtgactggatgatagactacgtgagtaacaggttgatttctcgatcaggaaccattgccgaggtgggaaagtggctccaggccatgttcttctatttaaagcagatcccgaggtatctgataccctgctattttgacgccattctcataggtgcctacaccaccttgttggacactgcctggaaacagatgagttctttcgttcaaaacgggtcaactttcgttaagcacctgtccctcgggtctgtacagctgtgcggggttggaaagtttcccagtctgccaattttgtccccggccctgatggacgtcccatatcgactgaacgagatcactaaggagaaggagcagtgttgtgtctctctggctgcgggtcttcctcatttcagtagtggtatttttcggtgctgggggcgagatactttcatcgcgctcagaggaatcctgctcataaccgggagatatgtagaggcacgaaacatcatcttagcttttgctggcacactcagacacggcctgatacccaatttactgggcgagggcatctatgctcgatacaattgtcgggatgcagtgtggtggtggcttcaatgtatccaagactattgtaagatggtgcctaacggactggacatactgaaatgtccggtgtcaagaatgtatccaacagacgattccgctcccctccccgctggcactctggaccagccactgttcgaggtgattcaggaagctatgcaaaaacacatgcaggggatacagtttcgggagcgcaatgccggcccacagattgaccgaaacatgaaggacgaaggatttaatatcacagctggcgttgatgaggagacagggtttgtgtatggggggaatcggttcaactgcgggacttggatggacaagatgggagaatccgacagggcccgcaaccggggcattccagctacccccagggatgggtcggcagtagagatcgttgggctgagcaaaagcgcggtacggtggctattagagttatctaagaagaacatctttccatatcacgaagttacggtgaagcggcacggcaaggctatcaaggtctcctacgacgaatggaacagaaagatacaggacaattttgaaaaactgttccatgtatctgaagacccctctgatttgaacgaaaaacaccctaaccttgtgcacaagcggggaatttacaaagactcgtacggggcctctagtccctggtgcgactaccagctgagaccgaatttcactatcgctatggtcgtagcacccgaactttttaccacagagaaggcttggaaagccttggagatcgcagaaaaaaagttgcttggacccctggggatgaagaccctggacccggatgatatggtgtactgcgggatttacgacaatgccttggataatgataactataaccttgcgaagggtttcaactaccatcaggggccggagtggctctggcctattggctacttccttagagctaagctgtacttctcgcggctcatgggtcccgaaacaaccgccaagacaatcgtcctggttaaaaatgtactaagtcgccattatgtgcacctagagaggtcaccctggaaaggtctccctgaactgactaatgagaacgcacagtattgtcccttctcttgtgaaacgcaggcctggtccattgccactatcttggaaaccctgtatgacttg

SEQ ID NO: 6106 - DNA, 4596 bp, Artificial Sequence
  Description of Artificial Sequence: Synthetic coding sequence
atgggtcattccaaacagatacgaatcctgcttcttaatgaaatggaaaagcttgaaaagacacttttcaggctggagcagggatatgaactccaatttaggcttggaccaaccttacaagggaaagcggtcaccgtgtatacaaactatcctttcccgggggagacattcaatagagaaaaattccgatcattggattgggagaatccgacagaacgagaagatgattctgacaagtattgcaagttaaacttacagcagtcaggatcctttcaatattatttcttacaaggcaatgaaaagagtggaggagggtacatagtggtagacccgatcctgcgagtcggggccgataatcacgttcttccgttagattgtgtgacactccaaacctttcttgcgaaatgtctgggaccgttcgatgaatgggaatcccgcctgcgggttgcaaaagaatcgggctacaacatgatccattttacaccactccaaacactgggccttagcagatcatgctattccctggcaaaccaattagaactgaacccagacttttcccgtccgaatcggaaatatacttggaatgacgtaggccagcttgtagaaaagctgaaaaaagaatggaacgtgatttgcattacagatgttgtttacaatcatacagctgccaactcgaagtggatacaggaacatccggaatgcgcatataatcttgtcaatagcccgcatctcaagccagcatgggtacttgatcgggcgctttggcgcttcagctgcgatgtagcagaaggaaaatataaagagaaaggtattccagcacttatcgaaaatgatcatcatatgaattccataagaaaaatcatctgggaagatatttttccgaagttaaaactctgggaatttttccaggtggatgttaataaagcagtggaacagtttaggagattacttacgcaagaaaatcgcagagtcactaagagcgaccctaatcaacatctcactatcattcaggatcctgaatatagaaggtttggatgcacagttgacatgaatattgcccttacaacattcattcctcatgataagggtcccgcggctattgaagagtgctgcaactggtttcataaacgtatggaagagttaaactcggaaaaacaccgactcattaattatcaccaagagcaggccgtcaactgcctgttaggtaacgtgttttatgagcggttggctggccacggaccgaaattggggcctgttacgagaaagcatccgcttgtgacacgttactttacgttcccgtttgaagaaattgatttttctatggaagaaagtatgatccacttgcctaataaagcatgttttctgatggcgcataacgggtgggtgatgggagacgatccgttacgaaacttcgcggaaccgggcagcgaagtttatctgcgccgggagcttatttgctggggcgatagtgtgaaactgaggtacggcaacaaaccagaagattgcccttacctgtgggcacacatgaagaagtatactgaaataacagctacatatttccagggcgttaggttagataattgccatagcaccccgttgcacgtggcggaatatatgttggatgctgccaggaatttgcagcctaatctctatgtagttgccgaactgtttacaggaagtgaagatctggataatgtatttgtgacgcggttaggcataagctccctgatcagagaagctatgagtgcgtacaattcacatgaggaaggccgccttgtgtatcgctatggtggcgagccggttggttcttttgtgcagccttgcttacgcccgttaatgccagccattgctcatgctctctttatggacattacgcatgataacgaatgcccgattgttcaccgaagcgcgtatgacgcacttccttctacaacaatcgtgtcaatggcttgctgtgctagcggatctacccgtggctatgatgaactggtcccacatcaaatctcagtggtaagcgaagagcgtttctacacaaaatggaaccctgaagcgcttccatctaacactggcgaggtcaattttcaaagtggtattatcgccgcccgttgtgcaatttctaaactgcatcaagaattaggcgctaagggttttattcaggtgtatgtagaccaagtggatgaagacattgtagccgttacgagacatagcccatcaatccaccagagcgtagtcgcggtgagtaggaccgcgtttcgtaacccaaaaacatcattttactctaaagaggttccgcagatgtgtattcctggaaaaattgaagaagtcgtgctggaagctaggacgattgagaggaataccaaaccttaccgcaaagacgagaattctataaatggtactccggacattacagttgagattcgcgaacatatacagttaaacgagtcaaagattgtgaagcaagcaggagtggctacaaaagggccgaatgaatatatccaggagattgagtttgaaaatctgtcaccgggttcagtgatcattttccgagtatctcttgatccgcatgcacaagtagcggttggcatccttcgtaaccatttgacgcaattttcacctcattttaaatcgggttctctggcggtcgataacgcggaccctattctaaaaattccgtttgcatctttggcaagccgactcaccttagctgagttaaatcagatactgtatcgatgcgaatcggaagagaaggaagacggcggcggatgctatgatattcctaattggtccgcgctcaaatacgccggtctgcagggccttatgtctgtgttggcagaaatccggccaaaaaatgaccttggacaccctttttgtaataatttaaggagtggtgattggatgattgactatgtgtctaatcgtttaatttcacgttctggaacaatcgcggaggtcgggaaatggttacaggccatgtttttctatctaaaacagattccaagatatttgatcccgtgctactttgatgcaatcttaataggggcgtatacgaccctgctagatacagcatggaaacaaatgtcctcatttgtccagaacggttcaacattcgtaaaacatttaagtttggggtctgtgcaactttgcggcgttggcaaatttccttctttgccaatattgtcacctgctttgatggatgtaccgtatcgcttaaacgaaattacaaaagagaaagaacagtgttgtgtatcattggctgcggggcttccacatttttctagcggcattttccgttgctggggacgagatacttttatcgcattacgtgggattttactaatcaccggtagatatgtcgaagctagaaatataattcttgcctttgcgggaacgcttcgacatggacttattcctaatttacttggcgagggtatatacgcaaggtacaactgtcgcgatgctgtttggtggtggctccagtgcatccaagattactgcaagatggtgccgaacgggctggacattttgaaatgcccggtctctcgcatgtacccaacagatgattcggctccgctgccagctggtacgttagaccaaccgctatttgaagtcattcaagaagctatgcagaaacatatgcagggcatccagtttagagaacgtaatgctggacctcagatcgacagaaacatgaaggacgaaggcttcaacattactgcaggagttgatgaagaaacgggctttgtctatggaggaaatcgctttaactgcggaacttggatggataaaatgggagaaagtgatagagctcgaaataggggcattccggccactccgcgtgacggttccgcggtggaaattgttggcctgtcgaagtctgccgtccgctggctgctggaactttcgaagaaaaatatttttccatatcacgaagtcaccgtaaaaagacacgggaaggctattaaagtgtcttatgatgagtggaaccgcaaaattcaagacaatttcgaaaaattgtttcatgtgtcagaagatccctcggacttgaatgagaagcatccgaatcttgtacataaacggggcatctataaagactcttacggcgcgtcaagcccgtggtgtgactaccaactgcgccctaactttacgatcgcaatggtcgtggcgcctgaattatttacaactgaaaaagcatggaaagcacttgaaattgccgaaaaaaagctgctgggaccacttgggatgaagacgttagacccggatgatatggtttattgcggaatttatgacaatgcgttggataatgataattacaaccttgcgaagggattcaattaccaccagggcccggaatggctgtggccgattggctactttctgagggcaaagctgtacttttcacgattaatgggaccagaaacgacggccaaaacgattgttttggtgaaaaatgtcttatcacgtcactatgtacatttggaacgtagcccatggaagggactcccggaacttaccaacgaaaatgcccagtattgcccattttcatgtgagacacaggcgtggagcatcgccacaattctggagaccttatacgactta

SEQ ID NO: 6107 - DNA, 4596 bp, Artificial Sequence
  Description of Artificial Sequence: Synthetic coding sequence
atgggccactcaaaacagatccgtattttgttgttgaacgagatggaaaagctggagaagaccttattcagattagagcaaggatacgagctgcagttcaggctggggcccaccctgcagggcaaagcagtcactgtgtatacaaactatccattcccaggggagacttttaaccgggagaagttccggtctctagactgggaaaaccccactgagagggaagacgatagcgacaagtactgcaagctaaacctccagcagtccggttctttccagtattacttcctgcaagggaatgagaaaagcggcggggggtatatcgtggttgatccaattcttagagtaggcgcagacaaccacgtgctgcctctggattgcgtgactctgcagacattcctcgcgaaatgcctgggtcctttcgatgagtgggagagccggttacgtgtcgcaaaggaatcaggctacaatatgattcattttactcctctgcagacactgggactcagcaggtcctgttatagtctggccaaccaattggagttaaaccccgacttcagccggcctaacaggaaatacacctggaacgacgtggggcaattggttgaaaagctgaaaaaagagtggaatgtgatctgcattaccgacgtcgtgtacaatcacacagcagcgaattccaagtggatccaagagcacccagagtgtgcctataatctcgtgaatagtccacacctgaaacccgcatgggtactcgaccgggctctgtggaggtttagctgtgatgtcgcggaaggaaagtacaaggagaaggggataccagctctgatcgaaaatgatcaccacatgaatagtatccgaaagatcatatgggaggatattttccctaagctgaaattgtgggaatttttccaggtcgatgtgaacaaggcggtcgaacagtttaggcggctgctcacacaggaaaatcgccgagtcactaagagtgatccaaaccagcatctcactattatacaagatcccgagtatagaaggttcggatgcacggtggacatgaacatagcattgacaacgttcatcccccatgataaaggacccgcagctatcgaggagtgttgcaattggttccataaacgcatggaagaactaaattcagagaagcaccgtctcatcaactatcatcaggagcaggccgtgaactgcctgctgggaaatgtgttctatgagaggctggcaggccacggcccaaagctcggacccgttacccgtaagcaccccttagtcactcgatactttaccttcccctttgaggagatcgatttttccatggaagagtctatgattcacttaccaaacaaagcgtgcttcctgatggcccacaacggatgggtaatgggagacgaccctctaagaaatttcgccgagccagggtccgaggtgtatctcaggcgcgaactaatttgctggggagattcggtaaagctccgatatgggaataaaccagaagactgtccctacctgtgggcgcacatgaagaagtacacggaaataactgcaacttactttcagggcgttcgccttgacaattgtcacagtacaccacttcacgttgctgagtatatgctggacgccgcacggaaccttcaacctaacctgtatgttgtggcggagctgttcaccggttctgaagacctcgataatgtgttcgttactcggttgggaattagcagtctgattagggaagcaatgtcagcatataattcccacgaggaaggtaggctggtctaccgctacggaggtgaacccgtcgggagttttgtacagccttgcttacggcctctaatgcctgccattgcacatgctctgtttatggacataacacatgacaatgagtgtcccattgtgcaccgctcggcatatgatgcactaccctccaccaccatagtatccatggcctgctgtgctagcgggtcaacccgcggctacgacgaattagtcccccaccaaatctcggtagtaagtgaagagaggttttacactaaatggaatccagaggcattgccttctaacactggggaggttaacttccagagcggcatcattgcagctcgttgcgcgatcagcaagctgcaccaggagctgggtgcaaaaggcttcatccaggtctacgtggatcaagttgacgaagacatagtcgcagtgacacggcactccccttccatccaccagtctgtcgttgccgtcagccggaccgccttccggaacccaaagacctccttctatagcaaggaggtcccgcaaatgtgtatacccggtaagatcgaggaagtggttctggaggcgaggactatcgagcggaacaccaagccctatcgtaaagatgagaactctataaatgggacaccagacattaccgtggaaatccgagaacacatccagctcaatgagtctaaaattgtcaaacaggcgggggtggccaccaaaggaccaaatgaatacattcaagagatcgagtttgaaaacctctctccaggctctgtcattatttttagagtctcactggatccgcacgctcaagtagctgtggggatccttaggaatcaccttacccaattctctcctcatttcaagtccgggtcactcgccgtggataatgcggacccaatcctgaagatcccgtttgcgtctcttgctagtaggttaactctggcggagttgaaccagatcctgtatagatgcgaatctgaagagaaggaggatggcgggggctgttacgacattccaaactggtcagcactgaagtacgccgggctacagggcctgatgagcgtacttgccgagatccgcccgaagaatgacctgggccacccattttgtaataacctccgatcaggggattggatgattgattatgtatccaacaggctaatctctcggtcaggaacaatcgcagaagtgggaaagtggttgcaagctatgttcttctacctcaagcagatccctagatacctaatcccgtgctacttcgatgccatcctcataggcgcatatactacccttcttgatacagcttggaagcagatgtcctcattcgtccagaatggcagcacttttgtcaaacatctgtcattaggatccgtccaactctgcggagtggggaaattcccaagtcttcccatcctgtcccccgccctgatggacgtaccctaccgccttaatgaaatcacaaaagaaaaggagcaatgttgtgtctctctggctgctgggttgccacacttttcttcagggattttccggtgctgggggagagacacattcatcgcacttaggggaatcctgctgataaccggaaggtatgttgaggcccggaatatcattcttgcgttcgccggtacgctgcgccatggcttgatccccaatctgctgggggaaggcatctacgcgagatacaattgccgtgacgccgtttggtggtggctgcagtgcattcaggactactgtaaaatggtaccaaatggcctggatattctgaagtgtcccgttagccgtatgtatcctacggacgattcagctccactgcctgccggaacccttgatcagccactgtttgaggtgatacaggaggcgatgcagaaacacatgcaggggatacaattccgggagagaaatgccggaccccaaattgataggaacatgaaagatgagggtttcaacattaccgctggcgtggacgaagagactggcttcgtgtatggagggaaccgtttcaactgtggcacatggatggataaaatgggagaatctgatcgggctcgcaatagaggcatccctgctactccacgggatggatctgcagtggagattgtcggactgagcaagtcggccgtgcgatggttgttagaactctctaaaaaaaacatttttccatatcatgaggtcactgtcaagagacatgggaaggccattaaagtgagctacgatgaatggaatcggaaaatccaggacaacttcgaaaagctttttcatgtttctgaggatcccagcgatctgaacgaaaaacaccctaacttggtacataaacgcgggatatacaaagacagctatggcgcctcatccccttggtgtgattatcaactccgaccgaactttacaatcgccatggtggttgctccggaactgttcacaaccgagaaggcgtggaaagccctggaaattgccgagaaaaaactactgggtccccttgggatgaaaacactcgaccctgacgacatggtttattgtggcatctatgataacgcgctggacaatgataactacaacttggccaagggatttaactatcatcagggacctgagtggctatggcctatcgggtattttctgagggcaaaactgtatttctcccgcctgatgggacctgagaccacggctaaaactattgtgttggtcaaaaacgtactgagtcggcattatgtccacttggaaagaagtccatggaaaggcttacctgagctcacgaacgagaatgcccagtattgtccgttttcctgtgagactcaggcatggtcgatcgcaaccatcttggagaccctctatgacctc

SEQ ID NO: 6108 - DNA, 4596 bp, Artificial Sequence
  Description of Artificial Sequence: Synthetic coding sequence
atgggccacagcaagcaaatcaggatccttcttctaaatgaaatggagaaactggaaaaaaccctttttagactcgagcagggatatgagctgcagtttaggctgggccctacgttacagggtaaggcagtgaccgtttatactaattacccctttccaggtgaaactttcaaccgcgaaaaattccgaagcctcgattgggagaacccaacagagagggaggacgactccgataagtactgtaaactgaacctgcagcagtcaggttcctttcagtattattttctgcagggcaacgaaaagtcgggcgggggctatatcgttgtagatccaatcctccgcgtgggagccgacaatcacgtgttgcccctggattgcgtgaccctccagacgttcttggcgaagtgtctgggacctttcgatgagtgggagtcaagactgcgcgtcgctaaagagagcggatacaacatgatccactttaccccactccagactctggggctgtccaggtcatgttactccctggctaaccagctggaactgaatcccgattttagtcggcctaatcgcaagtacacctggaatgatgtcgggcagttggtggaaaagcttaagaaagagtggaacgtaatttgtatcaccgatgtcgtgtacaatcacaccgctgcaaatagtaaatggatccaggagcacccggaatgcgcgtacaacctggtaaactcaccacatcttaaacccgcatgggtgttggatagagctctatggcggttctcctgtgacgttgcggaggggaaatacaaggaaaagggcattccggccctgattgaaaacgaccaccacatgaactccataaggaaaattatctgggaagacatctttccgaaactcaagttgtgggaatttttccaggtggacgtgaacaaggccgtggagcagttcaggcgactgctcacacaggagaaccgaagggtgactaagagcgaccccaatcagcatctgaccatcatacaggatcccgaataccgccgattcggctgcacggtggacatgaacatcgcacttactacttttattccccatgacaagggacccgccgcaatcgaagaatgctgtaattggttccacaagaggatggaggaacttaatagcgagaagcatcgcttgattaattaccaccaggaacaggccgtgaattgtctactgggaaatgtgttttatgaaagattggccggtcatggccctaagctggggcctgtgacacgcaaacatccccttgtaacaagatacttcacgtttcccttcgaggaaattgatttttctatggaggagtctatgatccacctgcccaataaggcctgtttcctcatggctcataatggttgggtgatgggcgacgatccactaaggaacttcgccgaaccgggatccgaggtttacctgcggagggagctgatctgttggggagatagtgtgaagctacgctatggcaacaaacccgaagactgtccctacctttgggctcatatgaagaagtatacagagattactgctacatattttcaaggagtcagattggataattgtcacagcacgccactccacgtagccgagtacatgctggacgcagctcgaaacctgcagcccaacttgtacgttgtggcagagctgtttaccggctccgaggatttggacaatgtctttgtgacccgcttaggaatttcctctctcatcagagaagcgatgtccgcgtataactcccacgaggaggggaggctggtgtaccggtacggtggggagcccgtggggtcctttgtccagccctgcctccggccactgatgccagcaatcgcacacgctctgtttatggacataacccatgacaacgaatgtccaatcgtgcacagatcggcgtacgatgccctgcccagtaccactatcgtgagtatggcctgctgtgcatccgggtctactcgcgggtacgatgaactcgtccctcaccagatcagtgtcgtgtcagaggagagattttatactaaatggaatcctgaggcactcccctcaaataccggcgaagtaaatttccagtcaggcatcatagcagctagatgtgccatcagcaagttgcatcaagaactgggcgcaaaaggcttcatccaggtttacgtggatcaagtagacgaggatattgtcgctgtaacccgacactcaccttctatccatcagagtgtagtggcagtatcacgaacagcttttagaaatcccaaaacctctttctattctaaagaagtgccccaaatgtgtatcccaggaaagatcgaggaagtggtcttggaggcccgaactatcgagaggaacacaaaaccgtaccggaaggacgagaacagtatcaacggtacccccgacataactgtggaaatccgggagcatattcagcttaacgaatctaagatagtgaagcaggcgggggtcgccaccaaggggccaaacgagtatatccaggagatcgagtttgaaaatttatcgccgggctccgtcattatattcagggtgtcattggatcctcatgcgcaggtggccgtaggaatccttaggaaccatctcacgcagttctcaccccatttcaaatccggaagtttggcggtggacaatgccgatcccatcctcaagataccgtttgctagtctggcgtcgaggcttactctcgccgaactgaatcaaatcttgtacaggtgtgaaagcgaggaaaaggaggatgggggcggttgttacgacattccaaactggagcgcgctcaagtacgcaggattgcagggcctcatgtcagtgctcgccgagatccgcccaaaaaatgatcttggtcatccattttgcaacaacctgcgaagtggagattggatgatcgattacgtgtccaaccgccttatcagccggagcgggacgatcgccgaggtaggaaagtggctgcaggccatgttcttctatcttaagcagattccgcgctatctgattccatgttatttcgatgcaatactgatcggagcatacactaccttgctggatactgcgtggaagcagatgagcagtttcgtgcagaacggctcgacctttgtgaaacacctgagcctggggagtgtccaactctgtggcgtcggaaagtttccttccctgccaatcctgtcacctgccctcatggatgtcccttatcggctgaatgaaataacaaaagagaaggagcagtgctgtgtcagcctggccgccgggcttcctcacttttcctccgggatatttcgatgctgggggcgagatactttcattgcactgagggggattctgctcataactggccgttacgttgaagcccgcaatattatcctggcatttgctggaacgctgagacacggccttatacctaatctgctcggtgaaggtatctatgctagatataactgtagggatgcagtatggtggtggctccagtgcattcaagattactgcaagatggttcctaacggcctcgatatcctcaagtgcccagtttctaggatgtaccctacagatgactccgctcccctgcctgcgggcacactagaccagccactcttcgaggtaattcaggaagcgatgcaaaagcatatgcaggggatccagttccgtgagagaaacgccgggcctcagatcgacagaaacatgaaggacgaaggatttaacattacggcaggagttgatgaagagacaggcttcgtttacgggggcaatagatttaactgcggtacatggatggataaaatgggagagtctgatagagctagaaacaggggaatccctgcaactccacgtgatggctccgccgtcgagatagtggggcttagtaagtctgcagtgagatggctcctcgagttgtctaaaaagaatatcttcccataccatgaagtaactgtcaaacgccacggcaaagccatcaaagtctcatatgacgaatggaatagaaagatccaggataatttcgagaaactgtttcacgtaagcgaggatccaagtgacctcaacgaaaaacaccctaacttagtgcacaagcggggcatctacaaggattcttacggggctagcagcccgtggtgtgattaccagttgcggccaaattttaccatagcaatggttgtcgcccctgaactgtttacgaccgagaaagcctggaaggccctcgaaatcgcagaaaagaagttactgggcccactgggtatgaagactctcgatccagacgacatggtgtattgcggaatctacgacaatgcactcgacaatgacaattataatctggctaaggggttcaactatcaccagggaccagaatggttgtggcccattggttactttctccgggctaagctgtacttcagcagattgatgggccctgagacgacggcgaagacaattgtactggtcaagaacgtgctctctcggcactatgtgcatcttgagcgctccccgtggaaagggctgcctgagctgacgaacgagaacgcacagtactgtccctttagttgtgagacacaggcctggtcaattgcgacaattctggagacactgtacgatctc

SEQ ID NO: 6109 - DNA, 4596 bp, Artificial Sequence
  Description of Artificial Sequence: Synthetic coding sequence
atgggccactccaaacagattaggattctcctcctgaatgagatggagaaactggagaagacgctctttagactggagcagggctatgaactccagtttcggctgggcccaacgctccagggcaaagccgtcaccgtatatacaaactacccgttcccgggcgagactttcaaccgggagaagttcagaagcctcgattgggagaacccgaccgagagggaagatgattctgataaatactgcaaacttaatctgcagcaatctgggtccttccaatactactttctccagggcaacgaaaagtctgggggcggctacatcgtggtggatcctatactcagagtgggagcagataatcacgtgctgccccttgattgtgtgaccctccagaccttccttgctaagtgcttgggaccgttcgatgaatgggaatcaaggcttagggtggccaaggagtcaggatataatatgattcactttacgccactgcagacactgggacttagcagatcttgctattctttggcaaaccagctggagttgaacccagattttagccggcccaatagaaaatatacctggaacgatgtgggccagctggtggagaagctgaaaaaagagtggaatgttatctgcatcactgacgtggtgtacaaccacaccgcagccaattctaagtggattcaggagcatccagaatgtgcctacaacctggtaaacagccctcacctcaaacctgcctgggtgttggacagggcgttgtggaggttcagctgcgacgtcgctgaaggcaaatacaaggagaaaggcatccctgcattgattgaaaatgaccatcatatgaactcaatcagaaaaatcatctgggaggatatcttcccaaagcttaaactgtgggagttcttccaggtcgatgtgaataaggcagtggagcagttccggagacttctgacccaggaaaatagacgcgtgaccaagagtgacccaaatcagcatctgaccatcattcaagatcctgaataccggcgatttggttgcaccgtggacatgaacatcgcccttacaacctttatcccgcatgataaaggacctgcagctattgaggagtgttgcaactggttccacaaacgcatggaagaactgaattccgagaagcatagacttattaactatcaccaggaacaagccgttaactgtttgctggggaacgtgttctacgagcggctggccggacacgggcccaaattgggaccagtgactaggaagcacccgctggtgacgaggtacttcacttttcctttcgaagagatcgacttttctatggaagaatccatgatccacctgcccaacaaggcctgctttcttatggcacataacggttgggtcatgggagacgatcccttgcgcaacttcgcagaacccggttccgaggtgtacctgagaagagaactgatttgttggggtgactctgtgaaactgcgatacggtaataaacctgaggattgcccctatctgtgggcccacatgaaaaagtacacagagattaccgcaacttacttccagggggtacgcctggacaattgtcacagtaccccgctgcacgtggcggagtatatgttggacgcggcgcgaaatctgcaaccaaatttgtatgttgttgccgagctcttcactgggtccgaagacctggataatgtcttcgtaacaaggttgggaattagctcacttatcagagaggctatgtccgcttataactctcacgaggagggtcggctggtgtatcgatacggcggcgagcctgttggtagcttcgtccaaccttgtcttcgcccacttatgcctgccatcgctcatgccctttttatggacatcacccacgacaacgaatgtcccatcgttcatagaagtgcatatgacgccctgccttccacgaccatagtgtctatggcgtgttgtgctagtgggtccacacggggctatgatgagctggtcccccatcagatttccgtggtgagtgaagagaggttttacacgaaatggaatcccgaagccttgccttcaaatacaggtgaggtgaactttcagtcaggtataattgcggcccgatgtgccattagcaagctccaccaagagctcggagccaaagggttcatccaggtatatgtggaccaagtggatgaggatattgtagccgtgaccaggcattctccatctatccatcagagtgtagtggccgtgagcaggaccgccttccgcaacccgaagacttcattttatagcaaggaagtgccacagatgtgtatcccaggtaaaattgaagaggtggtgttggaagcccgaaccatagagcgaaatactaaaccttacaggaaggatgagaactccatcaacggcactcctgatattactgttgaaatccgcgaacacatacagcttaatgaatccaaaatcgtcaagcaggctggagttgcaacaaaaggaccgaatgagtacattcaggagatcgagtttgaaaatcttagtcctgggtctgtcatcatcttccgcgtgtccctggacccacacgctcaggtggccgtaggaattctgcgcaaccacctgacgcaattcagccctcacttcaagagcggatcactggcagttgataatgctgacccaatcctgaagataccctttgctagcctggcctccagactgaccctggccgagctcaatcagatcttgtaccgctgtgaatcagaagagaaggaagatggtggcggctgttacgacattccgaactggagcgccctgaaatacgcagggctgcaaggactgatgtccgtcctcgcagaaattcgccccaagaacgacctgggccaccctttctgcaataatctccgcagtggcgattggatgatcgactacgtctccaatcggctcatttcccgatcaggcacaattgccgaagtagggaagtggctgcaagcgatgtttttctaccttaaacagataccgagatatctgatcccatgctatttcgatgctatactgatcggcgcctatacaacgctcctggacactgcatggaaacaaatgagttcatttgtgcagaacgggagcaccttcgtcaaacacctttctcttgggtctgtgcagctgtgcggtgtgggcaagttccctagcctcccaattctctcacctgcactcatggatgttccatacagattgaatgagataacaaaggagaaggaacaatgttgtgtatccctggcggctggcctgccacacttttcttctggcatttttcgctgttggggtagggacacatttattgcccttcggggaattctcctgatcaccggacgctacgttgaagcacgcaatataattttggctttcgccggaactctccggcatggactcattccaaacctgctgggagaaggaatttacgctcgatataattgccgcgacgccgtctggtggtggctccagtgcattcaggactattgtaagatggtccccaacggccttgacatcctgaagtgtcccgtgtcccggatgtatccaaccgatgactccgcccctctgcctgctggcacattggatcagcccctgttcgaagtgatacaggaggcgatgcagaagcacatgcagggtattcagtttagggagaggaacgccgggcctcagatcgataggaatatgaaagacgagggatttaacattacagccggggtagacgaggagacaggattcgtgtacgggggcaacaggttcaactgtggcacctggatggataaaatgggagagagtgaccgagctcgcaaccgcggtattccggcaactccaagagatggcagcgccgtcgagattgttggattgagcaagtcagctgtgcggtggctgctcgagctttctaagaagaacatattcccctatcatgaagttacagtgaaaagacacggaaaagctataaaggtctcttacgacgagtggaatagaaaaatccaggataatttcgaaaagctgtttcacgtctctgaggacccatctgacttgaacgaaaaacaccccaatctcgttcacaaacgcggcatctacaaggacagctacggagccagctctccctggtgcgattaccagctgcggcccaattttaccattgcaatggtggttgccccagaattgtttacaacagaaaaggcatggaaggctcttgagattgctgagaaaaaacttctgggcccgcttggtatgaagacgctcgacccagatgatatggtgtattgtggcatctatgataacgctttggataacgataactataatcttgctaagggctttaattatcaccaaggccccgagtggctgtggcccatcgggtatttcctgagggcaaagctctacttcagccgccttatggggcccgaaaccactgcaaagactatcgttctggtgaagaatgtgctgtccagacattatgttcacctcgagagatcaccttggaagggactccccgagcttactaacgagaatgcccagtactgtccattctcctgtgaaactcaggcgtggtctatcgccacaatcttggaaaccctgtacgatctg

SEQ ID NO: 6110 - DNA, 4596 bp, Artificial Sequence
  Description of Artificial Sequence: Synthetic coding sequence
atgggccatagcaaacagatccggatattgctgctcaatgagatggaaaagcttgagaagaccctttttcgactggagcaggggtacgagctgcagtttaggctgggtccaaccttgcagggtaaggcagtgactgtgtacaccaactaccctttcccgggtgagactttcaacagagaaaagtttcgctctcttgactgggagaaccctactgagagagaagatgacagcgacaagtactgcaagctgaacctccagcagtcaggctcttttcagtactattttctgcagggtaatgagaagtcaggaggaggctacatagtcgtggaccccatcctccgggttggcgccgataaccacgtactgccactagactgcgtcacacttcagaccttcctggcaaagtgtctgggccctttcgacgaatgggagagccgcctcagggtggctaaggaatctggatacaacatgatacattttacccccctgcagacactaggtctgtcccggagctgctactcattagccaatcagctcgagctgaaccccgacttcagtagaccgaatcgaaagtacacatggaacgacgtcggacagctcgttgagaaactgaagaaggagtggaatgtgatttgtatcactgacgtcgtttataaccacactgctgccaactccaaatggatccaagaacatcccgaatgcgcatataatctggtgaattcgccccacttaaaaccagcgtgggtgctggaccgcgccctttggcggttctcctgcgacgttgccgaggggaaatacaaggaaaaaggaatccctgctctcatagaaaatgaccaccacatgaattccatcaggaagataatctgggaggacatcttccccaaactcaagctatgggagtttttccaggtggatgtgaataaggctgtggaacagttccgccgactcttgactcaagaaaaccgcagagtgaccaagtccgatccaaaccagcatcttaccattattcaagatcctgaatatcgcaggttcgggtgtactgtggatatgaatatagcactcacaactttcattcctcacgacaagggaccggctgcaatcgaagaatgctgcaattggtttcacaaaagaatggaggagctgaatagtgagaagcatcgattaattaactaccatcaagagcaggccgtcaattgtctcctaggcaacgtgttttatgaacgacttgcgggccatggacctaagttaggaccggttacccgcaaacaccctttagtaacaagatactttaccttcccttttgaagagatcgacttttcgatggaagagtccatgatccaccttcccaataaggcatgtttcttaatggctcacaacggctgggtcatgggggacgatcccctgagaaacttcgcagaacccggatctgaagtgtaccttcggagagagttgatttgttggggggattcagtgaaactgaggtatggtaataagcctgaggattgtccttacttgtgggcacacatgaagaaatacactgagatcactgccacctatttccagggtgtcaggctggacaattgtcactcaacaccattacatgttgctgaatacatgctggatgcggctcgaaacctgcaacctaatctctacgttgtggcagagttgtttacagggagtgaagacctagataacgtttttgtgactagactaggtatctcatcactgatccgcgaggctatgtctgcctacaacagccacgaggaaggaaggttggtttaccggtatggtggggagcctgtgggctcctttgtgcagccatgcttacggccactgatgccggcgatagcgcacgccctgttcatggacattacacatgataacgaatgtcccatagtacatagaagtgcttatgacgctcttccctctaccaccatagtttccatggcttgttgtgcaagtgggagtacgagggggtacgatgagctcgtaccacaccagatatcagtcgttagcgaagaacgattttacaccaagtggaacccggaggctttgccaagtaacactggcgaggtgaattttcagtcgggcattatcgccgcacgatgtgccatttctaagctgcatcaggagttgggcgctaagggatttatccaggtgtatgttgatcaggtggacgaggacatcgtggccgtcacacgccacagcccgagcatccatcagagcgtggtggccgtatcccgtaccgccttccgaaacccgaaaacctctttctactctaaggaagtgcctcaaatgtgtatcccgggcaagatcgaagaagtggtcctggaggcccggacaattgaacgcaatacaaagccataccgaaaagacgaaaactcgattaacggcacgccggatatcaccgtggaaatacgagagcacatccagcttaacgagagtaaaattgtgaagcaagccggagtggcgactaaaggtcccaacgaatatatacaggagatagagttcgaaaatctgtccccgggcagtgtgataatctttagagtgtcactcgatccacacgcccaggtggccgtaggcatcctgagaaaccatcttactcagttttcccctcatttcaaaagcgggtcactggcagtggataatgcagaccccatccttaagatcccttttgcttcactggcgagccgcctgaccctcgccgaattgaatcagatcttgtatcgatgtgaatccgaagagaaagaggatggcggaggttgttatgacatccccaactggtctgcgctgaaatatgcagggctccaaggcttgatgtctgtcctggcagagatcagacccaaaaatgatctgggacatcctttctgcaataatttgagatccggagactggatgatagattatgtaagtaatagacttatcagccggtctggaacgatcgctgaggtaggaaagtggctgcaggctatgtttttttacttaaagcaaatcccccgttacttgatcccatgctattttgacgccatcctgataggcgcttataccactctgctggacacagcctggaaacagatgagctcctttgtgcagaatggaagtacctttgtcaagcacttgtcactgggttctgtgcagctttgcggggtgggcaagtttccctctttgcccattctgtccccggcattgatggacgttccctatcgcctcaacgagattacgaaggagaaagagcagtgctgcgtgtctttggcggctgggctgccccacttcagcagcggcatctttcgatgttggggcagagacacattcatcgctctcagggggatcctcctcattactggacgctatgtggaggcacgaaacatcatattggcgtttgcaggcacattgcgtcacggtctgatccctaacctgttgggcgaagggatttatgcccgctacaattgccgggacgcggtgtggtggtggctccagtgcatccaggactactgcaagatggtgccaaacggacttgacatccttaagtgcccagtgtcacgcatgtaccctaccgacgactccgcaccgctgcctgccggcactcttgaccagcctctgttcgaggtgatccaggaggcgatgcagaagcatatgcaggggattcaatttcgggaaaggaatgcaggtccccagatcgaccgcaacatgaaggacgaggggtttaacatcactgccggagtcgatgaggagacaggatttgtttatggggggaaccgctttaactgcggtacctggatggataaaatgggcgaaagtgacagagccagaaatagaggaattccagccacccctcgcgatggctcagccgttgagattgttggactatccaaaagcgccgtcaggtggttattagagctgagcaaaaaaaacatctttccctatcacgaagtgacagtcaaacggcacggtaaggctatcaaagtgtcctatgacgagtggaacagaaagattcaggacaatttcgagaaactgtttcacgtcagtgaggacccaagcgacttaaacgaaaaacatccaaatctggtccacaagcgtggaatctacaaggacagttacggcgctagtagcccctggtgtgactatcagctcagaccgaattttacaatcgccatggtggtggcccccgagctttttacgacagagaaggcttggaaagctctggagatcgcagaaaaaaagctcctgggtccactggggatgaaaacactagaccctgacgacatggtgtactgtggaatctacgacaacgcgcttgataatgataattacaacctggctaaggggtttaattaccaccagggcccggagtggctgtggcccatcggctacttcttgcgggccaagttatatttctctaggttgatgggtccagagactaccgccaaaacaatcgtgctagtcaagaacgttctgtcacgacactacgtccacttagagcggtccccctggaaaggcctccctgagttaaccaatgaaaacgcacagtattgtccattctcctgtgaaacccaggcctggtctattgccaccatcttggagacactgtacgatttg

SEQ ID NO: 6111 - DNA, 4596 bp, Artificial Sequence
  Description of Artificial Sequence: Synthetic coding sequence
atgggtcacagcaagcagatcagaatccttctgctgaacgagatggaaaagttggaaaagactctgttccgattggagcagggctacgagctgcaattccggctgggtccgaccctccaaggaaaggcggtcactgtgtacaccaattacccgtttccaggagaaactttcaacagagagaagttccgctccctggactgggaaaacccaactgaacgcgaggacgacagcgacaagtactgtaagctcaacctgcagcagtcaggttcgttccagtactacttcctgcaaggaaacgagaaaagcggcggaggctacatcgtggtggatccgatcctgcgagtgggagcagataaccacgtgctgccgctggactgtgtgacccttcagaccttcttggcgaagtgtttgggaccattcgatgaatgggaaagccgcctcagagtggccaaagaatccgggtacaacatgattcacttcactccgctgcaaaccctgggcctgtcgcgcagctgctactcactcgccaaccagttggaactcaatccggactttagccggccgaaccgcaagtacacctggaacgatgtgggacagttggtggagaagctgaagaaagagtggaatgtgatctgcatcactgacgtcgtgtacaaccatactgccgccaattcaaaatggatccaggaacaccctgaatgcgcatacaacctcgtcaacagcccacatctcaagccagcttgggtgctggatcgcgcgctttggaggttctcatgcgacgtggccgagggcaagtacaaggagaagggcattcctgctctgatcgaaaatgatcatcacatgaacagcattcgtaaaatcatctgggaggacatcttccctaagctgaagctctgggagttctttcaggtggacgtcaataaggctgtggaacaattccggcgcctgctgactcaggaaaaccgccgggtcactaagtccgacccgaaccagcatctgactataatccaggatcccgagtaccgcaggtttggttgcactgttgacatgaacattgcactcaccacttttatccctcacgacaaaggaccggccgcgatcgaagagtgttgcaattggttccataagcgcatggaggagctgaactcggagaagcaccgcctgatcaattaccatcaggagcaggccgtcaactgcctcctggggaacgtgttctacgagcgccttgccggtcatggaccgaagctgggcccggtgactcggaaacacccactggtgaccagatacttcactttccctttcgaggaaatcgacttttcgatggaggaatcgatgattcatctcccaaacaaggcgtgcttcctgatggctcacaacggatgggtgatgggagatgacccgctgagaaatttcgctgagccaggcagcgaagtgtacctgaggcgcgaattgatctgctggggagatagcgttaagctgaggtatggaaacaaaccggaggattgtccatacttgtgggcacacatgaagaagtacactgagatcactgcaacttacttccagggagtgcgcctggataattgccactcaactccgctccacgtcgcggaatacatgttggacgcggcgcgaaacctgcaaccgaacctctacgtggttgccgagctgttcaccggttcagaagatcttgataacgtgttcgtcactcgcctgggaatctcctcactcatcagagaggcaatgtcggcgtacaattcccacgaggaaggtagacttgtgtacagatatggcggagaaccggtgggttcgtttgtccagccgtgcctccggcctcttatgccagccatcgcacacgcacttttcatggatatcacccatgataatgaatgcccgatcgtgcatagatctgcgtatgatgcgctcccgtctaccaccatcgtgagcatggcgtgctgcgcgtcgggatccactagaggatacgacgaacttgtgccacaccaaatctccgtcgtgtccgaggaacgcttttacactaagtggaatcctgaggccctgccatccaataccggagaggtgaacttccaatcgggaatcattgcggcgcgttgcgcaatcagcaagctgcatcaggaactcggagccaagggattcatccaagtctacgtggatcaggttgatgaggacatcgtggcagtgactcgccactcaccatccatccaccagtccgttgtcgcagtcagtcgcaccgcgttccgcaatcctaaaacctcattctacagcaaggaagtgccccagatgtgcatcccaggaaagatcgaagaagtcgtgctcgaagctcgcactatcgaacggaacactaagccttatcgcaaggacgagaacagcatcaatggaacgccagacatcaccgtggaaatccgcgaacacatccaacttaacgagtcaaaaatcgttaagcaggcaggagtcgcgactaagggaccaaacgagtacatccaggagatcgagttcgaaaatctctcgccaggcagcgtcatcatcttccgggtatcgttggatccgcatgcccaagtggcagtcggtatcctgcgcaaccatctgacccaattctcgcctcatttcaaatcgggaagcctggcggtggataatgccgacccaattctgaagatcccgttcgcctccctggcgtcacgcctgactctggcggagttgaatcagatcctgtaccgctgtgagtccgaagaaaaggaggatggaggaggttgctatgacatcccgaactggagcgcactgaagtacgccggactgcagggcctgatgtccgtgctggccgagatccgaccaaagaacgacctggggcaccctttttgtaacaacctcaggtcaggcgattggatgatcgactacgtgtcgaatagactcatatcacgttccggaactatcgccgaggtgggtaaatggctccaggccatgttcttttacctcaaacagatcccgcgctaccttatcccatgttacttcgacgcgatcctcattggagcatacaccacgttgctcgacactgcatggaagcagatgtcctcgtttgtgcagaacggatcaaccttcgtgaagcacttgtcgttgggctcggtccaactctgcggcgtcggcaaattcccttccttgccgatcttgtcgcctgctctgatggatgtgccgtacaggctcaacgaaatcaccaaagagaaggagcagtgctgcgtgtccctcgcggccgggctgccacacttttcgagcgggatcttccgatgctggggaagagatacgtttattgctctgcgagggatcctcttgatcactggcagatacgtcgaggccagaaatatcatcctggccttcgcgggaaccctccgccacgggctgatcccaaatcttctcggcgagggaatctacgccagatacaactgccgcgatgccgtgtggtggtggctgcagtgcattcaggactactgtaagatggtccctaacggactcgacatcctgaagtgccccgtctcaaggatgtacccaactgacgactcggcaccactgcccgccggcaccctggaccaaccccttttcgaagtgatccaggaggctatgcaaaagcatatgcagggcattcagttccgggaacgcaacgcaggcccgcaaatcgatagaaacatgaaggacgagggattcaacatcactgctggagtggacgaagagactggctttgtgtacggaggcaacagattcaactgcggaacttggatggataagatgggcgaatccgatagagcccggaatagaggaattccggccaccccaagagacggaagcgccgtggaaatcgtaggcctctcgaagagcgcggtgcggtggctcctcgagcttagcaagaagaatatctttccgtaccatgaagtcacggtgaagcgccacggaaaggccatcaaggtgtcttacgacgaatggaatcgcaagatccaagataactttgaaaagctcttccatgtgtcggaggacccgtcggacctgaacgagaagcatccgaatcttgtccacaaacggggaatctacaaggacagctacggtgcgtcctcgccgtggtgcgattaccaactcagaccaaatttcacgatcgccatggtcgtggcgccggagctctttacgaccgagaaagcctggaaggccctggaaatcgccgaaaagaaactccttgggccactgggaatgaaaaccctggatccagatgacatggtgtactgcggtatctacgataatgctctcgataacgataactataacctggccaaggggttcaactatcatcagggtccagaatggctgtggccgatcggatatttcctgcgggctaagctgtacttttcgagactgatgggtcctgaaaccacggccaaaaccatcgtgctcgtcaaaaacgtcctgtcgcggcactacgtccacctggaacgctcgccatggaagggactccccgaactgactaacgaaaacgctcagtactgccccttttcctgcgaaacccaggcatggagcatcgccactatcctggaaactctctacgacttg

SEQ ID NO: 6112 - DNA, 4596 bp, Artificial Sequence
  Description of Artificial Sequence: Synthetic coding sequence
atgggtcactccaaacagattagaatcctgctgctcaacgaaatggagaagctggaaaaaaccctctttagactggagcagggatacgaactacagttccgcctgggccctaccctgcaaggcaaggccgttacagtgtacacaaactacccctttcccggcgagacatttaaccgcgagaagtttcggtctttggattgggagaaccctaccgagcgggaggacgatagcgacaagtactgtaagctgaacctgcagcagagtggctctttccagtactacttcctgcagggcaatgagaaaagcggcggtggctatatagtcgtggaccctatattgagagtcggcgccgacaatcacgtgctgcccttagactgtgtgactcttcaaacttttctggctaagtgcctggggcctttcgacgaatgggaaagccggctccgcgtcgccaaggaatctgggtataacatgattcacttcacaccattacagaccctcggcctgtctcgctcctgctattctttagctaaccaactggaattaaatcctgacttctcccggccaaaccgcaagtatacatggaacgacgtgggacaactagtggagaagctcaagaaggagtggaatgttatttgtattacagatgtcgtgtacaaccacacagccgccaattctaaatggatacaagagcatcccgagtgcgcttataatctggtgaattctccccacctgaagccagcatgggtcctggatcgcgcactttggaggttctcatgcgacgtggctgagggtaaatacaaagagaaaggcatccctgcactgatagagaatgatcatcacatgaactctatcaggaaaattatctgggaggatatctttccaaagctgaaactgtgggagttttttcaagtggatgtcaataaagccgtcgagcaatttagaagactgcttacccaggagaacaggcgagtcaccaagtccgatccaaaccagcatctgaccatcattcaggatccagagtaccggcgatttggctgtactgtggacatgaatatcgcactgaccacatttattccacacgataaaggcccagcagcaattgaagaatgctgtaactggtttcacaagcggatggaagagctaaacagtgagaaacacaggctgatcaactaccatcaggaacaagccgtgaactgcctcctcggcaacgtattctatgaacggcttgccggtcacggcccaaagttagggcccgtgactcgaaaacaccctttagttacacgctacttcacatttccttttgaagagatagatttctctatggaggagtctatgatccacctgcccaacaaggcttgcttccttatggcacataatgggtgggttatgggggacgaccccctgcgaaatttcgccgagcccgggagcgaagtgtatttgaggagagaactgatctgttggggtgactcagtcaaactacggtatgggaataagcccgaggactgcccttatctctgggcacacatgaagaaatatactgagattactgccacctatttccaaggcgtccggctggataactgccattcaaccccactacatgtagctgaatacatgctagacgccgccaggaatctgcagccaaatctctacgtggtagcagaactgttcactggctccgaagatcttgataatgttttcgttaccaggttaggaatatctagtttaatccgcgaagcaatgtccgcctataactctcacgaggagggaaggctggtttatcggtacggaggggagcctgtggggtccttcgtgcaaccatgtctgcggccgctgatgcctgccatagcccatgctctctttatggatataactcacgataatgagtgcccaatcgtgcacaggtctgcatatgatgctctcccctccaccaccattgtttccatggcctgttgtgcatctggttctacaagaggttacgatgagctcgttcctcatcagatttcagtggttagtgaagagcggttttacaccaaatggaatccagaagcactgccatccaacaccggcgaggttaattttcagagtggcatcatcgcagcacgatgcgccattagcaagctccaccaagagctcggcgcaaagggcttcattcaagtgtacgtggaccaggtcgacgaagacatcgttgcagttactcgccatagcccctccatccatcagagtgtggtggcagtgagccggaccgccttcagaaatcccaagaccagcttctatagtaaggaagtaccacaaatgtgtatccctggaaaaattgaagaggttgtgctggaggccaggactattgaaaggaacaccaagccataccggaaggacgagaattctatcaatgggactccagatattactgtagagattcgcgaacacattcagctgaacgagtcaaagatagtcaaacaggctggggtagccaccaaaggcccaaacgaatacatccaggagatcgagtttgagaacctgtctcctggttccgtcataatattcagagttagcctggacccccacgcccaagttgcagtcggaatcttacgtaatcacctgacacagttctcaccacacttcaagtctggaagtctggccgttgacaacgccgatccaatactgaaaataccctttgcttccctggccagcagactcacccttgcagagttaaatcaaatactgtacagatgcgaatccgaagaaaaagaggacggggggggatgttacgacatccctaactggtcagctctcaagtacgctggtcttcaaggactgatgtccgttctggccgagataaggccaaagaacgatcttggccaccctttttgcaataacctgagatctggcgattggatgatcgattacgtgagcaacagattgatttctcggtctgggaccatagccgaggtggggaagtggctccaggcaatgtttttttacttgaagcagattccaagatacttaataccatgttatttcgatgctattctcataggcgcttataccactctgctcgatacagcatggaagcaaatgagttctttcgtgcagaatggttccacctttgtcaaacacctgagcctgggcagcgttcaattgtgcggtgttggaaagttcccctctctgccaattctgtccccagcactgatggatgtgccttacaggctgaacgagataacaaaagaaaaggagcagtgctgcgttagcctagccgccggattaccacacttttcttcaggcatttttaggtgttggggcagggataccttcattgccctgcggggcattttactgatcacaggacgctatgtcgaagctcggaacattatcctggccttcgccggaacattaaggcacgggctaatacctaatctgctgggtgaggggatttatgcccgctacaattgtcgcgacgccgtctggtggtggttacagtgcatccaggactattgtaaaatggtgcccaacgggttggacatactaaagtgccccgtgagtagaatgtaccctacagacgacagcgcccctctgcctgcaggcactctggaccagccgttattcgaagttatccaagaggctatgcagaagcatatgcagggcattcagtttcgcgaacgcaacgccggacctcagatagatcggaacatgaaagacgagggcttcaacatcaccgctggggttgacgaagagaccgggtttgtgtatggagggaatcggtttaactgtggcacatggatggataagatgggcgagtccgatcgggcaaggaaccgaggcataccagctacccctagggacggaagcgctgtcgaaatagttgggctgtccaaatctgccgtaagatggctccttgagctgtctaagaaaaacatattcccataccacgaggtgacagttaaacgacatggtaaagccattaaggtatcttatgatgagtggaatcgcaagattcaagataacttcgagaaactattccacgttagcgaggaccccagtgatttaaacgagaagcatccaaatcttgtccacaagaggggcatttacaaagattcctacggggcatcttcaccctggtgcgattatcagctgcgccctaactttactattgcaatggtagttgcaccagagctctttacaacagagaaagcttggaaggccctggagatagctgagaagaagttactgggaccactgggaatgaagactctggacccagatgatatggtctattgcggcatctacgacaatgctctagacaatgataactacaacctggccaaaggcttcaactatcaccaaggccctgagtggctgtggcccataggctacttcctgagagccaagctgtactttagcaggctaatgggtccagagacaactgcaaagaccatagtgctcgtgaagaatgttctaagcagacattatgttcacctcgaaagaagtccttggaagggcctgccagagttaaccaacgaaaatgctcagtattgtccattttcttgtgaaactcaggcttggtccatcgccacaattctggaaaccctgtacgacctt

SEQ ID NO: 6113 - DNA, 4596 bp, Artificial Sequence
  Description of Artificial Sequence: Synthetic coding sequence
atgggtcacagtaagcaaattcgcattcttctgcttaatgagatggaaaaactggaaaaaaccctttttcggcttgaacaggggtacgagctgcaattcagacttggacccacgttgcagggaaaggcagtgactgtctacaccaattaccccttccctggagaaacgtttaatcgggagaagttccgctcacttgactgggaaaatccaaccgaaagggaagatgacagcgacaaatactgtaagctgaaccttcagcaatcggggtcctttcaatactactttcttcaaggaaacgaaaagtccggaggaggctacatcgtggtagatccgattcttagagtgggagcggataatcatgtcctgccacttgactgtgtgactctccaaaccttcttggcaaagtgtctgggcccctttgacgaatgggagagccgccttagagtggcaaaggaatcgggttacaatatgattcactttacccctttgcagactctcgggctgtcacggtcgtgttactccttggcgaaccaactggagcttaatcccgattttagccgcccaaataggaagtatacctggaacgatgtcgggcagttggtggaaaaacttaagaaagagtggaatgtgatctgcatcaccgacgtggtgtacaaccataccgccgcgaacagcaagtggatccaagaacatcctgaatgcgcatacaacctcgtcaatagccctcacctgaagcctgcatgggtcctcgatcgagcgctctggcgtttttcctgtgatgtcgcggaaggaaagtacaaggaaaagggtattccggcacttattgaaaacgaccatcatatgaattctatccgcaagattatctgggaggacatcttccccaaacttaagctgtgggaattcttccaagttgatgtgaataaggcagtggaacaatttcgccgccttttgacccaagaaaacaggcgcgtcacgaagagcgatcctaatcagcacctcactataatccaagaccccgagtaccgccgtttcggttgtactgtggatatgaacatcgctctgaccacctttattccacatgacaagggacctgcagcaatagaggaatgttgcaattggtttcataagcgcatggaggagcttaactctgaaaagcatcggctgatcaactaccaccaggagcaggccgttaactgccttctcggaaacgtgttttacgaacgcctggctggacacggacctaaattgggacctgtgactcggaagcaccctctcgtgaccagatactttactttcccattcgaggaaattgatttctctatggaagaatccatgatacatctcccaaacaaggcatgctttcttatggcgcacaacggatgggtgatgggcgatgatccactgcggaactttgcggagccaggatccgaagtgtatctgcgtcgtgaactcatttgctggggtgactcagtgaagctccgttacggcaacaagcccgaggactgtccgtacctttgggcccatatgaagaagtacactgagattaccgcaacctacttccaaggggtccggctggataactgtcattcaacccctctccatgtggcggagtatatgctggatgccgcaagaaacctccaacctaacctgtatgtggtcgcagaactttttactggatcggaagatctcgataacgtgttcgtcactagacttggtatttcaagtcttatccgggaagcaatgagcgcctacaacagccacgaggaagggcgactggtgtacagatatgggggtgagcctgtcggatcgtttgtgcaaccatgtctccgaccacttatgcctgcaatcgcccacgccttgtttatggatattacccacgataacgaatgcccaatcgtgcatcggtcagcctacgatgcgctgcctagcactaccattgtgtcgatggcatgctgtgcatcgggcagcactagaggctacgatgaacttgttccgcatcagatcagcgtggtgtccgaagaaagattttacactaaatggaacccagaagcactgccatcgaacacgggggaggtcaactttcaatcaggaatcattgccgctcgatgcgcaatctcgaaactccatcaggagcttggagcaaagggctttattcaagtctacgtggaccaagtggatgaagatattgtcgcggtcaccagacacagcccatccattcatcaatcagtggtggctgtctcgagaactgcatttcgaaaccctaagacttcattctattccaaggaagtccctcagatgtgtattcctggcaagatagaggaagtggtactcgaggcgaggaccattgagcgcaacaccaagccatatagaaaagacgaaaatagcattaacggaactccagatatcaccgtcgagattcgtgagcatatccagctcaacgaatctaagattgtgaagcaggcgggagtggcaactaagggccctaacgagtacattcaggaaatagaatttgaaaatctctcccctggatcggtgatcatatttcgggtgagcctcgatccccatgctcaagtggcagtgggtatcctcaggaatcacctgacccagttttccccccatttcaagtcaggcagcctggctgtggacaatgcagatccaatcctcaagataccatttgcaagtctggcgtcgagactgaccctggcagaactgaaccaaatcttgtataggtgtgaatcagaagaaaaagaagatggtggtggttgctacgatattcctaactggtcggcacttaagtacgcagggcttcagggattgatgtctgtccttgccgagattcggcctaagaatgatctgggccatcctttttgtaataacctgagatcaggggactggatgatagattacgtgtcaaacaggcttatctcacggtcaggaactatagcagaagtcggcaagtggttgcaggctatgtttttctaccttaagcaaatccccagatacctgattccatgttacttcgacgctatcctcattggcgcttacactaccctcctcgataccgcctggaaacagatgagttcgttcgttcagaatggcagcaccttcgtcaaacatctctcgctgggatcggtccagctctgcggagttggtaagttcccatccctgcctatactttcgccggcactcatggacgtgccataccggcttaatgaaatcactaaagaaaaggaacaatgttgtgttagccttgcagcaggtttgccccatttctcatcaggaatctttcgctgttggggtagagatactttcatcgcactcagaggcattctccttattactggacggtacgtggaagcaaggaatatcattttggcctttgccggtacgctccgacatggcctgattcctaacctcttgggtgagggaatctacgcacgctacaattgccgcgatgcagtgtggtggtggctccaatgtatccaggattactgtaaaatggtccctaatggactggatattctcaagtgtcctgtatcacgtatgtacccaaccgatgattccgcaccgcttccggcgggcacccttgatcaaccgcttttcgaagtgatccaagaagccatgcagaaacatatgcagggaatacaatttcgggaacgaaacgccggcccccagatagacagaaacatgaaggacgaaggctttaacattactgcaggtgtggatgaagagacgggttttgtgtacggggggaaccgtttcaattgcgggacctggatggacaaaatgggtgagagcgatagagcccgtaatcgcggaattccggcaacccctagggacggatccgcggtggagattgtgggactgtcaaagagcgcggtccgatggctgcttgagcttagcaagaagaacatttttccttaccacgaagtgacggtgaagaggcatggcaaagcaatcaaagtgtcctacgatgaatggaatcgcaagattcaggacaactttgaaaaactttttcatgtatcggaggatccatccgacctgaatgagaaacatcctaaccttgtgcataagagaggcatatacaaagattcctacggcgcgtcctcgccttggtgtgattaccagcttagacctaactttacgattgccatggtggtggcgccagaactgtttaccaccgaaaaagcatggaaagcactggaaatcgcagagaagaagctcctgggaccgcttggtatgaaaaccctggaccccgacgacatggtgtactgtggtatttacgacaatgcgctcgacaatgacaactacaacctggctaagggatttaactaccatcaaggacctgaatggttgtggccgatcggatactttctgagagctaagctgtactttagcaggcttatgggtcctgagactactgcaaagaccattgtgcttgtgaagaatgtgttgtctcgtcattatgtgcacctggagcgttctccgtggaaaggtctgccagagctcactaacgaaaacgcccaatactgcccattctcctgtgagactcaggcatggtcgattgccactatacttgaaaccctttacgatctt

SEQ ID NO: 6114 - DNA, 4596 bp, Artificial Sequence
  Description of Artificial Sequence: Synthetic coding sequence
atgggccacagcaaacaaatcagaatcttgttactaaatgaaatggagaaactggaaaagacgctgttcaggcttgagcaagggtacgaactgcagtttcgactgggacctacgctccagggaaaagcagtgaccgtgtataccaactatcccttcccgggagaaacttttaacagggagaaattccgctcgctggactgggaaaacccgaccgagagagaagatgactcggacaagtattgcaaactgaatctccagcagagcgggagctttcaatactactttctgcagggtaacgaaaagtcaggtggcggttacatcgtcgtcgatcctatcctgagagttggtgcggataaccacgtgctacctctcgattgtgttacactccagacctttttggccaagtgtctcggcccattcgacgagtgggagagtcgtctgcgcgttgctaaggagagcggatataacatgatccattttaccccgctccagacactggggctgtcgcgcagttgttattccctcgctaaccaactggaattaaacccagatttttctcgccctaacagaaaatacacctggaatgatgttggtcaactggtggagaaactcaagaaggagtggaatgtgatctgtattactgacgtcgtgtacaaccacactgctgctaatagcaagtggatccaggagcaccccgaatgcgcttataacctggttaattccccacacctgaagcccgcctgggtcctggatcgcgccctgtggaggttctcctgtgacgtggctgaaggaaagtataaggaaaaagggatcccagccctgattgagaatgatcaccatatgaacagtataagaaagatcatctgggaagatatattcccaaagctcaaactgtgggaatttttccaagtggacgttaacaaagccgtggaacagttccgaaggttacttacccaagagaaccggcgggttacaaagagcgaccccaatcagcacctgacgatcatacaggaccccgagtacaggcgattcggatgtacagttgatatgaatattgccctcactacctttattccccatgataaagggcctgcagccatcgaggaatgttgtaactggttccacaagaggatggaagaactgaacagtgaaaagcacaggctgattaattatcatcaggaacaggctgtcaactgtctcctgggcaatgtgttctatgagcgcttagccggccacgggcctaaattaggacctgtgacacgcaaacaccctctggtgacccgatactttacctttccgttcgaagagatcgacttttcgatggaagagtccatgatccacctgccgaacaaagcctgttttttgatggcgcataacgggtgggtgatgggggacgaccctttacgtaacttcgctgagccaggatccgaagtctacctgagaagggagctgatatgttggggcgactctgtgaagctccgctatgggaacaagcctgaggactgtccatacctgtgggctcatatgaaaaagtacacggaaatcacggccacttattttcagggcgtgaggctggataactgccactcaaccccgctgcacgtagccgaatacatgctcgatgccgctcggaatttgcaaccgaatctctatgtcgtggcagaattgttcaccggttccgaggatctggacaacgtgttcgttacccggctgggcatttcctcgctgatccgggaggcgatgtcagcctataacagtcacgaagaaggccgactggtttaccgatatggaggagaaccagtaggctccttcgttcagccctgtttgcgtccgctgatgcccgctatcgcacatgccctgttcatggatataacccacgacaatgagtgtcctatagtgcaccgttcggcctacgatgcgctgccttcaaccactatagtttctatggcctgctgcgcttccggtagcacccggggctacgatgaacttgttccacatcaaatatctgtggtgagcgaagagagattctatactaaatggaaccctgaagccctgccaagcaacactggggaagtcaattttcagtcaggcatcatcgcagcgaggtgtgctatatctaagctacaccaggagttgggggcaaagggttttattcaggtttacgtggaccaggtggacgaggacatcgtggccgtgacacgccacagcccttcgattcaccaaagcgtggtggctgtctctagaacagcattccgcaacccaaagacctctttttactcgaaagaggtgccgcaaatgtgtattcccgggaaaatcgaggaagtggtgttagaagcccggaccatcgaaaggaacactaaaccttaccgtaaagacgagaacagcattaacggtacccctgacatcacagttgaaattagagaacacatccagctcaatgagtccaagattgtcaaacaggccggggtcgcaacaaagggacccaatgagtatatccaggagatcgaattcgaaaacctgtctccaggctccgtgataatttttagagtgtctcttgacccacacgcccaggtggcggtgggcatcctccgcaatcatctgacacagttcagcccgcactttaaatctggctctttagctgtggataacgcagatccgatcctgaaaattcctttcgccagcttggcgtctcgcctgaccctagcagagctgaatcagatcctgtatagatgtgagtctgaggagaaagaagatggagggggctgctatgacattcccaattggtcagccctgaaatatgctggacttcagggactcatgtccgtgttagctgagatccggcccaagaacgatctgggacatcccttctgtaacaacctgagaagtggcgattggatgatcgattatgtgagcaaccgcctcattagtcggtccggaaccattgccgaagtggggaagtggctccaagcaatgttcttttacttgaagcagatccctcgttatctcataccctgttatttcgatgcaattcttattggagcttacacaacactgctggacactgcctggaagcagatgtcatctttcgtccaaaacggttcgacattcgttaaacacctctcgctggggagcgttcagttgtgcggcgtgggcaaatttccatccttgcccatcttatctcccgcccttatggacgtgccatatcggcttaatgagatcactaaggagaaagaacagtgttgtgtgtctcttgctgctggattgccacatttctcaagtgggatctttcgctgctggggacgggacacattcatagctctcagaggaatactactcatcactggcagatacgtggaagcaaggaatatcatcctggcatttgccgggactctgcgccatggtctaatccccaatctgctgggtgaaggcatttacgcccgctataactgtcgcgatgccgtatggtggtggttacagtgcatccaggactattgtaaaatggtgcctaacggactagacatactaaagtgtccagtgtctcgcatgtaccccaccgatgatagtgctccgctgcctgcaggtactcttgaccaacccctttttgaggtcattcaggaagccatgcagaagcatatgcaggggatacagtttcgggaaagaaatgctggcccccagatcgaccggaatatgaaagatgagggcttcaacatcactgcaggagtcgacgaggagaccgggttcgtctacggaggcaaccggttcaactgtggcacatggatggataaaatgggggaatcagaccgcgcccggaaccggggtatacctgctaccccgcgggacggtagcgcagtggaaattgtgggcttgagcaagtctgctgttaggtggctgcttgaactgtcaaaaaagaacatcttcccttatcacgaagtaacagtgaagagacacggcaaggccataaaagtgtcctatgatgaatggaacagaaagatccaagacaacttcgaaaagctcttccatgtgtccgaagacccaagtgatcttaacgaaaagcatcccaacctggtccataagaggggcatctacaaagatagctacggtgccagcagcccctggtgcgactaccagctgcggcctaatttcacgatagctatggtcgtggctccagagctcttcacgaccgagaaagcttggaaggcactcgaaatcgcggaaaaaaagctgttgggccccctcggcatgaagaccttggatccagacgacatggtgtactgcgggatctacgacaacgcactggacaatgataattacaacctggccaaggggttcaactatcatcagggtccagaatggctctggcccataggctacttccttagagcaaaactctacttctctaggctgatgggccctgaaaccacagctaagaccatcgtcctggttaaaaatgtactctcccgccactacgtgcatctggagcggtccccatggaaaggattacccgagctgacaaatgagaacgcccagtactgccctttctcctgtgagacgcaggcatggtccattgctacaattttggagaccctttatgacctt

SEQ ID NO: 6115 - DNA, 4596 bp, Artificial Sequence
  Description of Artificial Sequence: Synthetic coding sequence
atgggccacagcaagcaaattaggattttactgctgaatgagatggaaaagctggaaaaaaccctctttaggctcgagcaggggtacgagcttcaattcagacttggacccaccttgcaaggcaaggcggtgaccgtgtatacaaactatccgttcccaggggagacgttcaacagggagaaatttagatctctggattgggagaaccctaccgagcgtgaggacgattctgacaagtactgtaagctcaatttgcaacagtctgggagtttccagtactacttcctacaaggaaacgagaaatctggcggtggctacatcgtggtcgaccctatcctcagggtgggagccgataaccatgtgttgccgctcgactgcgttacgctgcagacctttctggctaaatgcctgggaccgtttgatgagtgggaaagcaggctgcgggtagccaaggagtctggatacaacatgattcatttcacaccactgcagactttgggcctctcgaggtcctgctactccctagctaaccagctcgaacttaaccccgacttcagccggccaaatcgcaagtacacctggaacgatgtggggcagcttgtcgagaagcttaagaaggaatggaacgttatatgtattacggatgtggtgtataatcatacggccgctaattctaagtggatccaagaacaccctgagtgtgcttataatttggttaactctcctcacctgaaacccgcatgggtccttgaccgggccctctggagatttagctgtgatgtggctgagggcaagtataaggaaaaaggaatcccagctctcatcgagaacgatcaccatatgaatagcatacgaaaaatcatctgggaggatatcttccctaagctgaaactatgggagttctttcaggttgacgtaaataaagcagtggaacaattcaggcggctgcttacccaggagaatcgacgggtgacgaagtccgaccccaaccaacacctgactatcatccaggaccctgagtacaggcggttcggctgcacagttgacatgaatatcgcacttactacgtttatcccacacgacaaggggccggctgctattgaagagtgttgtaattggtttcacaaaagaatggaagaactgaatagtgaaaaacacagactcatcaattatcatcaagaacaggcggtgaattgcctgttgggaaatgtattctatgagagacttgccgggcacggcccgaaactgggtcctgtcacccgcaagcacccacttgttacacgctattttacattcccttttgaagagattgacttctctatggaggagtccatgatacacttgccaaataaggcatgctttctgatggctcataacggttgggtaatgggggatgaccctttaagaaactttgcagagccaggctctgaggtgtatctgcgccgggaacttatctgttggggggattcagtaaaactgcggtatggaaacaagcctgaggactgcccctacttatgggcgcacatgaagaagtataccgaaatcaccgccacatactttcaaggcgtgcgcctggacaactgtcatagcactcccctccatgtcgccgaatacatgctggatgctgcacgtaacttacaacctaacttatacgtggtggctgagctgttcaccggtagtgaggaccttgataacgtctttgttacacgccttggtatctcctccctaatcagagaggcaatgagtgcctataacagtcacgaggaggggcgcctggtgtacaggtatggaggagagcctgtcgggtcctttgtgcagccttgcctccgcccactcatgcccgcaattgctcatgccctctttatggacatcacccatgacaacgaatgtcccatcgtgcaccgatcagcttacgatgcactgccaagtactacaattgtgtccatggcctgctgcgcctccgggtctactcgagggtacgacgaactagtgccacatcagattagcgtggtctccgaagaaagattttacacgaagtggaacccagaggccctgccttcaaatacaggcgaggtcaacttccaatcaggtataatagcagcgagatgtgccatttctaagctccaccaagaactgggcgccaaaggttttatacaggtatatgtagatcaggtcgatgaagacatagtggccgtgactcggcacagtccatctattcatcagtctgtggtggccgtgtcgaggacagctttccgaaaccccaaaaccagtttctactcgaaggaagtgccgcagatgtgtatcccaggcaaaatcgaggaggttgttcttgaagcgcgcaccattgagcgcaacacaaaaccgtaccgaaaagatgaaaacagtattaatggcacgcctgatatcacggtcgaaatccgagaacacattcaacttaatgagagtaaaatcgtgaagcaggcgggggtcgccacaaagggtccgaatgagtacattcaggagatcgaatttgagaacctcagccctgggagtgtcattatattcagagtgtctctcgacccacatgcacaggttgcagtgggcatccttaggaaccatctaacccagttttccccacacttcaaatccggcagcctggctgtggataacgccgatccaatactgaagatcccgttcgccagcctagcctccagactgactctggcagagctgaatcaaattctttaccgctgcgagagtgaagagaaagaggatggcggcggatgctatgatattccgaactggtctgcccttaagtatgcaggtctgcaagggctgatgtccgtgctggctgaaattcgacccaaaaatgacctgggacacccattttgtaacaacctgcggtctggagattggatgatcgactatgtgtctaatcgcctgatctcaaggtctggcacaatagcggaggtgggtaaatggctccaggcgatgttcttctacctgaagcagatcccgcggtacctgataccgtgttattttgacgccatcctaataggtgcctacaccacattgctagacaccgcctggaagcaaatgtcttctttcgtacagaacggcagtactttcgtcaagcacctatccctcggaagtgtccagctgtgcggtgtcggtaagttcccatctctgcccatcctcagtccggcccttatggacgtaccctacagactcaacgagatcactaaagagaaagagcagtgttgcgtgtctctggctgctggcctgccccacttttcgtccggcatatttaggtgctggggtagggatacatttatcgcactgcgtgggatcctgctgatcacgggcagatatgttgaggctcgaaacattattctggctttcgcaggaacccttcggcatggactgataccaaacctgctgggagaggggatctacgccaggtacaactgtagagatgcggtttggtggtggttgcagtgcatccaagactactgtaagatggtcccaaacggcctcgacatacttaagtgccctgtgtcccgaatgtacccaaccgatgactcagcacctctgccagccggtaccctcgatcagccattgttcgaagtgattcaagaggccatgcagaaacatatgcaggggatccagtttcgcgagcgaaatgccggcccacaaatcgaccgcaacatgaaggacgagggcttcaacatcactgccggagttgatgaggaaacaggcttcgtctatggaggaaaccggtttaactgcgggacttggatggacaaaatgggcgaatctgacagagcccggaaccgcggcatcccagccaccccccgagacggaagtgccgtggaaatcgtaggcctgtcgaagagcgcagttcggtggctgctggagttgagcaaaaaaaacatcttcccctatcatgaagtgaccgtgaagcgccatggcaaggccataaaagtgagttacgacgaatggaaccgaaaaattcaggacaatttcgaaaaactgttccacgtgtcggaagacccttccgatttaaacgagaaacatcctaatctggtgcataaaagagggatatataaagactcatacggggcgtcctcgccatggtgtgactaccagctcagaccaaactttacaattgccatggtggttgccccggagctgtttactacagagaaggcatggaaggctttggagatcgctgagaagaaactgctgggcccactgggcatgaagactttggacccagacgatatggtctattgcggtatctatgataatgccctggacaatgacaactacaatttagccaagggtttcaactaccatcaggggccagagtggctgtggccaattggctacttcttgcgcgcaaagctgtatttttctcgcctgatgggacccgaaaccaccgccaaaactatcgtgttggtgaagaatgtgctgagtcggcattacgtccatctggagaggagcccatggaagggcttgccggagttgaccaacgaaaatgctcagtattgtccgttctcctgcgaaacacaggcttggtccatagctaccatcctcgagaccctttatgacctt

SEQ ID NO: 6116 - DNA, 4596 bp, Artificial Sequence
  Description of Artificial Sequence: Synthetic coding sequence
atgggacactcaaaacaaattcgtatactgttgctgaacgagatggagaaactggaaaagacactgttcagactggaacagggctacgagctgcaattcaggttgggcccaacactccagggaaaggccgtaaccgtttacactaactatccttttcctggtgagacattcaatcgggaaaagttcaggagtctcgactgggagaaccctactgagagagaggatgatagcgacaaatattgtaagttaaatctacaacagagtggcagctttcaatattatttcctccagggcaatgaaaagtccggcggagggtatatcgttgtcgatcccattctgagggttggagcagataatcacgtacttcccctggattgtgtgaccctgcaaacattcctcgccaaatgcctggggccgtttgacgagtgggagtcgcggctgagggtggctaaagagtctggctacaatatgatacatttcaccccattacagactcttggattgtcccggagctgctatagtctcgccaatcagctcgagttgaatcccgacttttcccgacctaaccgaaagtatacctggaacgacgtgggccagctggtcgagaagcttaaaaaagagtggaacgtgatttgcatcactgatgtggtctataaccacacggccgctaacagtaagtggatacaagagcaccccgaatgcgcttacaatttggtaaattcaccccatctcaaacctgcttgggtactcgatagagcactgtggcgattttcctgcgacgtagccgagggcaagtataaggaaaagggcatcccggcccttatagagaacgaccaccacatgaactcaattagaaaaatcatatgggaggatatttttcctaagcttaagttatgggagttttttcaggtcgacgtgaacaaggcggtggagcaattcagacggctgctcacacaggagaatcgacgggtaacaaagtccgatcctaaccaacatttgacaatcatacaggaccccgagtacagaagatttggctgcacagttgatatgaacatcgctctgaccaccttcattccacacgacaaggggcccgcagctatcgaggaatgttgcaattggttccacaagcgaatggaagagcttaactcggagaagcatcgccttataaattatcatcaagagcaagccgtgaattgcctgctggggaatgtgttctatgaaaggctggcagggcacggccctaaactgggtcctgttaccagaaaacatccattggtaactcgctacttcacctttccctttgaggaaatcgacttttccatggaggagagcatgattcacctgccaaataaagcatgttttttgatggcccacaacgggtgggtgatgggggacgacccactacgcaattttgctgagcctggtagcgaagtttacctcagaagggagctgatctgttggggcgactctgtgaaattaagatacggcaataaaccagaggactgtccctatctgtgggcacacatgaaaaaatacaccgaaatcaccgccacgtacttccagggggtgaggttggataattgccattctacaccactgcacgtggccgaatacatgctggacgctgccagaaacctccagcctaacttatacgtggtagcagagctgttcaccgggagcgaggacctcgataacgtatttgtaacaaggctcggaatcagttccctcattcgggaagctatgtctgcttataacagccatgaggaggggcgtctagtgtacaggtacggcggagagccagtgggctccttcgtgcagccatgcctgcgcccgctcatgcccgccattgcccacgccctgtttatggatataacacatgacaacgaatgtcctattgtgcataggtctgcctacgacgcacttccctcaactaccatcgtgtcaatggcctgctgcgcaagtggttcaacaagaggctacgacgaactggtcccgcaccagatctctgtcgtgtccgaagagaggttctatacaaaatggaacccagaagccctgccctctaacacaggtgaagtcaatttccaatctggaattatcgcagccaggtgtgcaatttctaagcttcatcaggaactcggcgccaaagggttcatccaggtttacgtggatcaggttgacgaggatattgtcgccgtgacccggcactcaccaagtatccaccaatccgttgtggccgtctcgcgcacagccttcagaaatcctaaaacttcattttactcaaaggaggtgcctcagatgtgtattcctgggaaaatagaggaagtcgttctggaagcccgaaccatcgagagaaacaccaagccctatcgtaaagatgaaaactccattaatggcacccccgatatcaccgttgagatcagagaacatatacagctaaacgagtctaagatcgtaaagcaggccggcgttgctactaaaggcccaaacgagtatatccaagaaatagaatttgaaaatctgtcccctgggtcagttattattttcagagtgagtctcgatcctcacgctcaggtcgccgtcggcatcctcagaaatcaccttactcaattttcccctcactttaagagcggtagtctggccgttgacaatgccgatcctattctcaaaattcctttcgcttccctcgcttcccggcttaccctcgccgagctgaatcagattctttaccggtgcgaatctgaggagaaggaagatggaggaggttgctacgacatccccaattggtccgctctgaagtatgccggactgcagggcctgatgagcgtgcttgccgagatacgacctaagaacgatctgggccaccccttttgtaacaatctgagatcaggggactggatgatcgactacgtcagcaacaggttgatctccagatctgggacaatagcggaagtgggaaaatggttgcaggccatgtttttttacttaaaacagatcccacggtacctcattccttgctacttcgacgcaattttgattggagcttacactacacttcttgacaccgcgtggaaacagatgtccagctttgtgcagaatgggagcacttttgtgaagcatctctcacttggttccgttcaactgtgcggggtcggcaaattcccttcccttcccatcctgtcgcctgctttaatggacgttccttaccggctgaatgaaatcacaaaagaaaaggaacagtgctgtgttagtttggccgccggcctcccccatttctcctccggcatctttcgatgttggggaagagacacctttatcgcccttcgcggcattttactgatcactggtaggtatgtagaggcacggaatattattctcgcatttgccggcactctgcggcatggactgatccctaacctgctaggagaaggtatctacgcccggtacaattgtcgcgatgcagtgtggtggtggctgcagtgcatccaggactattgtaagatggtccctaacggactggacatactgaagtgcccagtgtctcggatgtaccccacggacgactccgccccacttccagcgggcacgctggaccagccactgttcgaggtaattcaggaagcaatgcagaagcatatgcaaggcattcagttcagagagcgaaacgctggccctcagatagatagaaatatgaaggacgagggttttaacattaccgcaggcgtggacgaagaaacaggttttgtttatggtggaaatcggttcaactgcggcacttggatggacaaaatgggcgagtcagatcgagctcgtaatcgcggtatcccggccacccctcgagatggctccgctgtggagattgtgggactgagcaagtctgccgtgaggtggttgctggagctgtctaagaaaaatattttcccctaccacgaggtgactgtgaagcgtcatgggaaggccattaaagtctcttatgacgaatggaacagaaagatccaggacaattttgagaagctgtttcacgtgtccgaggatccatctgacctcaatgaaaagcaccctaatttagtgcacaaaaggggcatttacaaggattcttacggagcaagcagcccctggtgtgattatcagttacgaccgaatttcacaatcgcaatggttgtggcccctgagctgtttacaacagagaaagcctggaaggccctggagatagccgaaaagaagctgcttgggccccttgggatgaagactctggatcccgacgatatggtgtattgcggcatatacgacaacgcactcgacaacgacaactataatctggccaaggggttcaactaccaccagggtccagagtggctatggcccataggatacttcctgcgggcaaaattgtacttttctaggctcatgggcccagagaccactgctaagacaattgtattagtcaagaacgtgctatcccgtcattacgtgcatctggagcggagtccctggaaaggactgccagaactgaccaatgaaaatgcccaatactgtcctttctcctgcgaaacacaagcctggtccatcgcaaccattctggaaacactttacgacttg

SEQ ID NO: 6117 - DNA, 4596 bp, Artificial Sequence
  Description of Artificial Sequence: Synthetic coding sequence
atgggtcatagtaaacaaattagaattcttcttttaaacgaaatggaaaaattagaaaaaacgttatttagattagaacaaggttatgaacttcaatttaggcttggaccaacattacaaggtaaagcagttacagtttatacaaattatccttttccaggagaaacattcaatagagaaaaattcaggtctcttgattgggaaaatccaactgaaagagaggatgattcagataaatattgtaaacttaatttacaacaaagtggatcttttcaatattattttttacaaggaaatgaaaagagtggaggaggatatattgttgttgatccaattttacgagttggagctgataatcatgttttacctcttgattgtgttactttgcaaacattccttgctaaatgtttaggaccatttgatgaatgggaatcaagacttagagttgcaaaagaatcaggatataatatgatccatttcactccattacaaactttaggactttctagatcatgttattctttggcaaatcagttggaacttaatcctgatttttctagacctaataggaaatatacatggaatgatgtaggacaacttgttgaaaagttgaagaaagaatggaatgttatttgtataactgatgttgtttataatcatacagcagcaaattctaaatggattcaagaacatccagaatgtgcatataatttagttaattcaccacatttaaaaccagcatgggtacttgatagagcattatggagattttcatgtgatgttgcagaaggtaaatataaggaaaaaggaataccagcattaattgaaaatgatcatcacatgaacagtattcgaaaaattatatgggaagatattttcccaaaattaaaattatgggagttttttcaagttgatgtaaataaagctgttgaacaattcagaagacttttaacacaagaaaacagaagagttacaaaatctgatccaaatcaacatttaacaattattcaagatccagaatatagacgatttggatgtacggttgatatgaatattgctcttactacatttattccacatgataaaggacctgctgctattgaagaatgttgtaattggtttcacaaaagaatggaagagcttaatagtgaaaaacatcgtctaattaattatcatcaagagcaagctgttaattgtttgttaggaaatgttttttatgaacgtttagcaggtcacggaccaaaattaggtccagttacacgaaaacatcctttagtaactcgttattttacattcccatttgaagaaattgatttcagtatggaagaatctatgattcatttaccaaataaagcttgttttttaatggctcataatggatgggttatgggagatgatcctcttagaaactttgctgaaccaggatcagaagtttatttaagaagagaattaatttgttggggagattcagttaaattaagatatggaaataagccagaagattgtccttacttatgggcacatatgaaaaaatatacagaaattactgctacatattttcaaggagtaagattagataattgtcattcaacaccattacatgttgctgaatatatgttagacgctgcaagaaatttacaaccaaatctttatgtagttgctgaactttttacaggttctgaagatcttgataatgtatttgttactcgtttaggtatatcttccttaattagagaagcaatgtcagcatataattctcatgaagaaggacgtttagtttatagatatggtggagaaccagttggatctttcgttcaaccatgtttgagaccattaatgccagctattgcacacgctcttttcatggacataactcatgataatgaatgtccaatagttcatagatccgcttatgatgctttaccaagtactactattgtttcaatggcatgttgtgcatcaggtagtactagaggttatgatgaacttgttccacatcaaatatctgtagtatcagaagaacgattttatactaaatggaatccagaagcattaccatcaaatactggtgaagttaattttcaaagtggtattatagcagcaagatgtgctatttcaaaattgcatcaagaattgggagcaaagggatttatacaagtttatgtagatcaagttgatgaagatattgttgctgttactagacattcaccatcaatacatcaatcagttgttgcagtttcacgaacagctttcagaaatccaaaaacatctttttattcaaaagaagttcctcaaatgtgtattccaggaaaaattgaagaggttgttttagaagctagaactattgaacgtaatactaaaccatatagaaaggatgaaaattctattaatggaacaccagatattacagtcgaaataagagaacatattcaacttaatgaaagtaaaattgttaaacaagcaggtgtcgcaacaaagggacctaacgaatatattcaagaaatcgaattcgaaaacttatctccaggatcagtaattatttttagagtttctttagatccacatgcacaagttgcagtgggaattttgagaaaccatttaactcaatttagtccacattttaaatctggatcattagctgttgataacgctgatccaattttaaagatacctttcgctagtttagcaagtcgattaacacttgctgaactcaatcaaattctttatagatgtgaaagtgaagaaaaagaagacggtggaggttgttatgatataccaaattggtctgccttaaaatatgcaggtttgcaaggtcttatgtctgttttagcagaaattagacctaaaaatgatctaggacatccattctgtaataatttaagatctggtgattggatgattgattatgtttctaatagacttatatctagaagtggtactattgcagaagttggaaaatggttacaagctatgtttttttacttaaaacaaattccaagatatcttatcccatgttattttgatgctattttaattggagcatatactacattacttgatactgcatggaaacaaatgagttcatttgtacaaaatggttcaacttttgtgaaacatttaagtttaggaagtgttcaattatgtggagtaggaaaatttccatcacttcctattttatcaccagcacttatggatgttccatacagattaaatgaaattacaaaagaaaaagaacaatgttgtgtctcacttgctgctggacttcctcatttctcttctggaatttttagatgttggggacgagatacatttattgcattaagaggtattcttctaattactggtagatatgtggaagcaaggaatattatattagcttttgctggaactcttagacatggattgataccaaatttattaggtgaaggaatttatgctagatataattgtcgtgatgcagtatggtggtggttacaatgtattcaagattattgtaagatggttcctaatggattagatattttaaagtgtcctgtaagtagaatgtatcctacagacgattctgcaccattaccagcaggaacattagatcaaccactttttgaagttattcaagaagcaatgcaaaaacatatgcaaggaattcaatttagagaaagaaatgctggacctcaaattgatagaaatatgaaggatgaaggatttaatattactgctggtgttgatgaagaaacaggatttgtttatggaggtaatagatttaattgtggtacttggatggacaaaatgggggaatcagatcgtgctcgaaatagaggaatcccagctactccaagagatggatccgcagtcgaaatagtgggtctttcaaaatctgctgtaaggtggcttcttgaattgtctaagaaaaatattttcccatatcatgaagttacagtaaaaagacatggaaaagctataaaagtatcttatgatgaatggaatcgtaaaattcaagataattttgaaaaacttttccatgtatctgaagatccatcagatttaaatgaaaaacatccaaatcttgttcataaaagaggtatttataaagattcttatggagcttccagtccttggtgtgattatcaattacgtccaaatttcacaattgcaatggttgttgctcctgaattatttactacagaaaaagcatggaaagctcttgagattgcagagaagaaattacttggtccattaggaatgaaaacattagacccagatgatatggtttattgtggtatttacgataacgcattagacaacgataattataatcttgctaaaggattcaattatcatcaaggaccagaatggttatggccaattggatattttttacgagctaaattatacttttctagacttatgggacctgaaacaactgctaaaactattgttcttgttaaaaatgtgttatcaagacattatgtacatttagaacgttctccatggaagggacttccagaattgactaacgaaaatgctcaatattgtccattttcttgtgagacacaagcttggtcaattgcaactattcttgaaacattatatgatctt

SEQ ID NO: 6118 - DNA, 4596 bp, Artificial Sequence
  Description of Artificial Sequence: Synthetic coding sequence
atgggtcattccaagcagatccgaatcctcctgctgaatgaaatggagaaactcgaaaaaactctttttcggctcgaacaaggatacgaactgcagtttcgccttggcccgaccttgcagggtaaggcagtgaccgtgtacaccaattacccttttcccggagaaacctttaatcgcgaaaagttccgcagcctggattgggaaaatccgactgagagggaggacgactcggataagtactgcaaactgaacctgcagcaatcagggtcctttcagtactactttctgcaaggaaacgaaaagtccggaggaggatacatcgtcgtggacccaatacttcgagtgggagctgataaccatgtgctccctcttgattgtgtcaccctccagacttttctcgctaagtgtcttgggccttttgacgaatgggaatctaggcttagagtggcaaaggagagcgggtataacatgatccatttcactcctctgcagacccttggcctcagccggagctgttactccctcgcaaatcagctggagcttaaccccgacttttcacggcctaacagaaagtacacgtggaacgatgtggggcagctggtcgaaaaactcaaaaaagaatggaatgtcatttgtattaccgatgtcgtctataaccatactgcagccaattctaaatggattcaggaacaccccgagtgcgcatacaatctcgtgaattccccacatcttaagccggcatgggtccttgacagggcactgtggcgcttctcctgtgacgtggcagaaggaaagtacaaggagaagggtattccagcgcttatcgaaaacgatcatcacatgaactcgatcagaaagatcatttgggaggatatctttcctaagctgaagctgtgggaattcttccaagtggacgtcaacaaggcagttgagcagttcagacggctcctgacgcaggaaaatcgacgagtcaccaagtcggaccctaaccaacatcttaccataatccaagacccagaatacagacgattcggatgcactgtggacatgaacatcgcgctgaccactttcattccgcatgataagggccctgctgctatagaagagtgctgtaactggtttcataaacggatggaagagttgaattccgaaaagcatcgactgattaactaccaccaggaacaagccgtcaattgccttctgggaaatgtgttctatgagaggctggcaggacatggtccaaagctgggtcctgtgactcgaaagcatccccttgtgacccgctactttaccttccccttcgaagaaatcgatttttccatggaagaatcaatgattcacttgcctaataaggcctgttttctcatggcacataatggatgggtgatgggtgacgacccgcttcggaacttcgctgagccaggatcagaagtgtaccttcggcgcgagcttatttgttggggtgactcagtgaaacttaggtacggtaacaaacccgaagattgtccctacctgtgggcccatatgaagaaatacacggagattacggcaacctactttcaaggagtcagactggataattgtcatagcactcccctgcatgtggcagagtacatgctcgatgcagcccgaaatctgcaacctaacctttacgtcgtggctgaactgttcaccggatcagaagatctcgataatgttttcgtgactagactgggcatttcctcgctcattagggaagccatgtccgcatataactcgcatgaagaaggacggcttgtgtaccgttacgggggagaacccgtcggatcattcgtccaaccctgcctccgcccactcatgcctgccattgcgcacgcattgtttatggacattacccatgataatgagtgtcccatcgtgcaccgatccgcttacgacgcactgcctagcaccaccatcgtctcgatggcatgttgcgcatcaggttcgactagaggatacgacgagctcgtgcctcatcagatttcggtcgtgtccgaggaacggttttacactaagtggaatcccgaagccctcccttcgaacactggtgaagtgaacttccaatccggtatcatagctgcaaggtgtgcaatctccaagctgcaccaggagcttggagcaaagggattcatccaggtctacgtagatcaggtggatgaagatatcgtggctgtgactcggcatagccccagcatccatcagtccgtcgttgcggtttcacgtactgcattccgcaacccaaagacttctttttacagcaaggaagtgcctcaaatgtgtattccaggaaagatagaggaggtggtgctggaagcccgcactattgaacgcaacacgaagccttaccgcaaggacgagaactccataaacgggactcctgacatcaccgtcgaaattcgcgaacacatccagcttaacgaatctaagattgtgaaacaggcgggagtggcaaccaaagggcctaacgaatacattcaagaaatcgagttcgagaacctttctcctggcagcgtgattatctttagagtgtcgctggaccctcacgcacaggtggcagtcggaatcctgcgaaaccaccttacccagttttcacctcatttcaaaagcgggtcacttgcagtggataacgcggaccccattctcaagatacctttcgcctcactggcttcgagacttacccttgcagaactgaaccaaattctttaccgctgcgagagcgaagagaaggaggacggaggcggttgttacgatatccctaactggtcagcactgaagtacgccggacttcaaggcctgatgtcggtgctcgcagaaattagaccaaagaatgatctgggacatcctttttgtaataacttgcgctccggcgattggatgatagactatgtcagcaatcgacttatttctcgctcgggcaccattgcggaggtgggcaagtggctccaagcaatgttcttctacttgaagcagatcccaagatatctgatcccttgttacttcgatgcgatcctgattggagcatacaccaccctcctggataccgcctggaaacagatgtcctcctttgtgcagaacggaagcactttcgtgaaacatctttcattgggatccgtccagctctgcggcgtgggaaagttccctagcctgccaattctttcgccagctcttatggatgtgccctaccgactgaacgaaatcacgaaagaaaaggagcagtgctgcgtgtcgctcgccgcaggattgccacactttagcagcggtatctttagatgctggggtcgcgatacgttcattgcactccgcgggatcctcctgatcaccggccgctacgtggaggctcggaacattatactggcattcgcaggcactctgagacatgggctcatccctaatcttcttggtgaaggaatctatgcacgatacaactgtagagatgcggtgtggtggtggctgcaatgcattcaagattactgcaaaatggtgccaaacggactggatattcttaagtgtcctgtgtcgcggatgtacccgaccgatgattcggcacctctccctgcggggaccctggatcagcctttgttcgaagtgattcaagaagcaatgcaaaaacacatgcagggcattcaatttagagagagaaacgcaggcccccaaattgatcgaaatatgaaggacgaaggatttaacattactgcaggcgttgacgaagaaactggcttcgtctacggaggaaaccggttcaactgcggtacctggatggataagatgggcgaaagcgatcgggcacgcaatcggggcataccagcaaccccacgggacggctcagccgtcgaaatcgtcgggctgtccaagtctgccgtcaggtggcttcttgaactttccaagaaaaacattttcccctaccacgaggtcactgtgaaaaggcatggaaaagccattaaggtgtcctacgatgaatggaacagaaagattcaagacaattttgaaaaactgtttcacgtgtcagaagatccgtccgatctgaacgaaaagcatcctaatcttgtgcataaacgcggtatttacaaggactcatacggagcatcgtctccatggtgtgattatcaacttcggccaaactttaccatagcaatggtggtggctcctgagctgtttacgaccgagaaagcgtggaaagcactcgaaattgcggaaaagaaacttctgggacctctcggtatgaaaaccctcgaccccgacgatatggtgtactgtgggatttacgacaacgcactggataacgacaattacaaccttgccaagggcttcaattatcatcagggcccagagtggctctggcccatcggttactttttgcgcgccaagttgtacttttccaggctcatgggtccagagacgaccgcaaaaaccatcgtcctcgtcaagaatgtgctgagcagacattacgtgcacctggaaaggtcgccttggaagggtctgccagaactcactaacgagaacgcacagtactgtcctttttcgtgtgagactcaagcctggtcaatcgcaactatccttgaaaccctctacgatctg

SEQ ID NO: 6119 - DNA, 4596 bp, Artificial Sequence
  Description of Artificial Sequence: Synthetic coding sequence
atgggtcactcaaagcagattcggatcctgctgctgaacgagatggaaaagctcgaaaagacattgtttaggttggagcaaggatatgagctgcaatttaggttggggcccaccttgcagggtaaagcagtgaccgtgtacacgaactatcccttcccaggagagacttttaacagagagaagttccgtagtctggactgggagaacccgactgaacgggaagatgatagtgataaatactgcaagctgaacttacaacaaagcgggtcatttcaatattatttcctccagggaaacgagaagtcgggaggcggatacattgttgtggatcctatcctgcgagtcggggccgataatcacgtgcttccgctggactgcgtaaccctacagacttttctagccaagtgcttgggcccattcgatgagtgggaaagccggctgagggtagcaaaggagtccgggtataatatgatccacttcacacccttgcaaacacttggactgagcagatcttgctactcactagccaatcagttagagctgaacccggacttcagtaggccaaatcgcaagtatacttggaacgatgtaggccagctggtcgagaagctgaaaaaggagtggaatgtcatttgcatcactgacgtagtctacaaccatacggctgctaacagtaaatggattcaggaacacccagagtgcgcttacaatcttgtgaatagtcctcatctgaaaccggcgtgggtcttggaccgcgcattatggaggttttcgtgcgacgtggccgagggcaagtataaggaaaagggaatcccggcattgatcgaaaacgatcatcacatgaatagtatccgaaagataatctgggaagacatctttccgaaactgaagctgtgggaattcttccaggtggacgtcaataaagctgtcgaacaatttaggaggctactgacccaggagaatcgccgggtcacaaagtcagatccaaatcagcatttgacaatcattcaagaccccgaataccgcagattcggctgtactgtggatatgaacatagccctgacaacgttcattccccacgacaaggggcccgctgcaattgaagaatgttgcaactggtttcataaaagaatggaagagctgaactctgagaagcatagattaatcaactatcaccaggagcaggccgtcaactgcctattgggaaacgtgttctacgaaaggttggctggtcatggccctaaacttggtcccgtcactcgaaagcatccactggtgacccgatacttcaccttcccattcgaagaaattgatttttcgatggaagagtccatgattcatttgcccaataaggcctgcttcctgatggcccacaacggctgggtgatgggcgatgatcccctgcgaaacttcgctgaacctgggtccgaggtgtatttgcggagggaacttatatgctggggtgatagcgtgaaattaaggtacggcaacaaacccgaagattgcccctacctgtgggcgcatatgaagaagtatacggaaataacggctacctattttcagggagtgcgcttggataactgccattcaacacccttgcacgtagctgaatacatgctggatgccgcaaggaatcttcagcctaatctttatgtggttgccgaactgttcactgggtccgaggatctggacaatgtgtttgtgacacggctgggaattagttctctcatcagagaggcgatgtctgcctacaacagccatgaggaaggcagactcgtctataggtatgggggggaacctgtgggtagcttcgtgcaaccctgcctgagaccactgatgcccgccattgcacatgcgctcttcatggacataactcacgacaacgagtgtccaattgttcacagaagcgcttacgacgccctcccctccactactatcgtgtcaatggcctgttgtgcgtccggctccactcgaggatatgatgaactggtgccgcaccagatctccgttgtctctgaggagaggttctacaccaagtggaaccccgaagccctgcctagcaataccggagaggtgaactttcaaagcggtataatcgccgcgcgatgtgccatatcaaagttgcaccaggagctgggcgcaaaaggttttatccaggtctatgtcgatcaggtggacgaggatattgtcgctgtcacgcggcattcaccatccattcaccagtctgtggtggctgtgtcccggacggccttccggaaccctaagacctctttttacagtaaggaggtgccgcaaatgtgtatccccggcaagatagaggaagttgtacttgaggccaggacaatcgaacgaaacaccaaaccataccggaaagacgaaaattccatcaatgggaccccagatattactgtggagattcgggagcatattcagctgaacgaaagcaagattgtgaagcaggcaggcgtagccaccaagggtccgaacgaatacatccaagaaatcgaattcgaaaatctttctccgggatccgttatcatcttccgggtgagtctggacccacacgcacaggtcgctgtgggaattttaagaaatcatttgacccaattctctccccatttcaagagcgggtcactcgccgtcgacaatgcagacccaatcctgaaaatcccattcgctagtctggcttctcgcctgacattggcagagctgaaccagatcctgtacaggtgcgaatccgaagagaaggaggatggtgggggttgttatgacatccccaactggagtgctcttaagtatgcaggactacagggtctgatgtcagtgctggctgagatcaggcctaaaaacgacctgggccaccctttctgcaataatctgcgctccggagattggatgatcgattatgtttctaatcgcctcatttccagaagcggcactattgcagaggtcggcaaatggctccaagccatgtttttctacctgaagcagattccaaggtatcttatcccctgttactttgacgcgattctgatcggagcatacacaaccctcttggacaccgcgtggaaacagatgtcaagctttgttcagaacggctccacattcgtgaaacacctgtctctgggaagcgtgcagctttgcggggttggcaagtttcccagcctgccaattctttcccccgctctcatggatgtgccttaccgcctgaatgaaattactaaagagaaggagcaatgttgcgtgagcctggctgctggcttaccacacttcagctcagggatcttccgctgttggggtagagacaccttcatcgcactgagagggatcctgttgatcaccgggcgatacgtggaggctaggaacattatcctggccttcgcaggtacattaagacatggcttgatcccaaacctcctgggtgaaggcatttatgcgcgttacaactgtcgggatgccgtgtggtggtggctccagtgcatacaggactattgtaaaatggtgcccaatggactagatattctgaaatgcccggtttcgcgaatgtatcctaccgacgattcagcccctctgcccgcgggtactctggaccagccccttttcgaggtgatccaagaagccatgcagaagcatatgcagggcatacaatttcgggagaggaacgctggcccacagattgatagaaacatgaaagacgagggctttaatattaccgcaggagtggatgaggagacaggctttgtgtacggtggaaacagatttaactgtggaacgtggatggataagatgggtgagtctgaccgcgctaggaatagaggcattcccgccacccccagggatggatccgccgtggagatcgttggtctgtctaaatccgcggtacgatggttactcgagctgtccaaaaaaaacatttttccctatcatgaagtgacagttaaacggcatggtaaagctattaaggtaagctacgacgagtggaacagaaagatccaggacaacttcgagaagctatttcacgtatctgaagatccatctgatttaaatgaaaagcatccaaatctagtgcataaaaggggaatttataaggattcatatggcgcttcttctccgtggtgcgattaccaacttcgaccaaattttaccattgcaatggtcgtggcaccagagttgtttaccacagagaaggcctggaaagctctggagatcgcagaaaagaaactgctcggcccgctgggtatgaagacactggacccagacgacatggtctattgcggaatatacgataacgctctcgacaacgataattataatttggccaagggcttcaattatcatcaggggcccgagtggctgtggcccattggctactttctgcgagctaaactgtatttcagcaggcttatgggacccgagacgaccgcgaagacaattgtactagtgaagaatgtcctgtcgcggcactatgtccacctcgaacgctcgccatggaagggactgccagagttaaccaatgagaacgcgcagtactgtccattctcgtgcgagacgcaggcatggtcaattgccacaatcctcgagacactgtatgacctg

SEQ ID NO: 6120 - DNA, 4596 bp, Artificial Sequence
  Description of Artificial Sequence: Synthetic coding sequence
atggggcacagcaaacagatccggatcttgctgctgaacgaaatggagaaattggaaaagaccttgttccgcctcgagcagggctacgagctgcagttccgattgggccctaccctacagggtaaggccgttacggtctataccaattacccattcccaggagagacgttcaatcgcgaaaagttccgctcactggactgggaaaaccccacggaacgcgaagacgacagcgataagtattgcaaattaaacctgcagcaaagcggttcatttcagtactactttctgcagggaaacgaaaaatcaggtggcggctacatagtcgttgacccaattctaagggttggtgcagataatcacgtgctgccgttggattgcgtcaccctgcagacctttctcgccaaatgtctgggtccgtttgatgaatgggaaagccgcctgcgcgtggctaaagaaagcggttataacatgatccatttcacccctctgcagactctcggtctgagccgctcctgctatagcctcgcgaatcagttggaactcaacccggacttcagcagaccgaaccggaaatacacctggaacgatgttggccagctggtcgaaaaactgaaaaaagagtggaatgtgatttgcatcacggacgttgtttataatcacaccgctgctaatagcaagtggatccaggaacacccagagtgtgcatacaatttggttaacagcccacacctgaaaccggcttgggttctggatcgcgccctgtggcggttctcctgcgatgttgctgaggggaaatacaaggaaaaaggtatccctgctctgattgagaacgatcaccacatgaactcgattcgcaaaatcatctgggaggatatcttcccgaagctgaaactgtgggaattcttccaagtcgatgtgaataaagctgtggaacaattccgacgattgctgactcaggaaaatcgcagagtcacgaagagtgatcctaatcagcatctgactattatccaggatccggagtacaggaggtttgggtgcactgtcgacatgaatattgcgctgactacttttattcctcacgacaaaggtccagctgccatcgaggagtgctgcaattggttccacaagagaatggaagagctgaattcagagaagcatcgcctgatcaattaccaccaggaacaagcagtcaattgtctattgggcaatgtgttctacgagcgcctcgccggtcacggccccaagctgggtcctgtgacacgcaaacacccgctggtcactcgctactttactttcccttttgaggagatcgatttctcaatggaggaatctatgatccatctgccgaataaggcttgttttttgatggcacataacggctgggtcatgggtgacgacccattgaggaacttcgcggagccaggtagcgaagtgtaccttcgccgcgagctaatctgctggggcgactctgtgaaacttagatatggtaacaagcccgaggactgcccatatctgtgggcgcatatgaaaaaatacacggaaatcaccgccacatattttcagggcgtccgcctggacaactgccactctaccccgctgcacgttgccgagtacatgctggatgccgcaagaaaccttcaaccaaacctttatgtggtcgccgagctctttactggtagcgaggatctggataacgttttcgtcacccgcctgggtatctccagccttatccgcgaagctatgtccgcgtacaattctcacgaagaaggtcgcctggtctatcgctatgggggggagccagtcgggagcttcgtccaaccttgcctaaggccgctgatgcctgctattgcacacgccctatttatggatattactcatgacaacgagtgcccgatcgttcaccgtagcgcctatgatgccctgccgagcaccaccattgtcagcatggcgtgttgtgcatctggttctactcgcggctatgatgagctagttcctcaccagatctctgtcgtgtcagaagagaggttctacacgaaatggaatccagaagcgctgcctagtaataccggcgaggttaattttcagagcggaataatcgcggcccgctgcgcaatttcaaaactgcatcaagaattgggcgctaaagggtttatccaggtgtacgttgatcaggttgatgaagatattgtcgcagtcacccgccacagcccttcaatccatcagagtgtggtggcggtgagccgtaccgcgttcaggaacccaaagaccagcttctatagcaaggaggtgccgcagatgtgcatccctggaaagatcgaagaagttgtcctggaggcacgtactatcgaacgaaacaccaagccttaccgcaaagacgagaatagcatcaacggtacaccagatatcaccgtcgaaatccgcgagcatatccagctgaacgagtccaagattgttaagcaggcaggagttgcgactaaaggacctaacgaatatattcaggaaattgaattcgaaaatctgagccctggtagcgtgattatcttccgcgtgtctttggatccacatgcacaggtggcggttggtattctgcgcaatcacctgacacagttcagccctcactttaagtccggttccctggcagtcgataatgcggacccgatcctaaagattccgttcgccagcctggcatctcgccttacgttagccgaactgaaccagatcctgtatcggtgcgagtcggaagagaaagaggatggtggagggtgctatgatatccctaattggtctgcgttaaaatatgcaggtctgcaaggtctgatgtccgttctggcggagatccgcccgaaaaatgatctcggccaccctttttgcaacaatctgcgctctggcgattggatgatagattacgtctctaaccgcctgatctctaggagcggcactatagccgaggtgggtaaatggctccaagcaatgttcttttatctgaagcagatcccacggtacctgataccatgttatttcgatgcaattctcattggtgcatacactaccctgttggacaccgcctggaaacagatgtccagcttcgtgcagaatggttcgaccttcgttaaacacctgagcctgggcagcgtccagctgtgcggcgttggaaagtttccgagcctccctattctgagcccggcgctgatggacgtcccatatcgcctgaacgaaattaccaaggagaaagaacagtgttgtgtcagcctcgcggctggcctgcctcacttttcttcgggcatctttcgatgctggggcagggacacgttcatagctctgcgcggtattcttctgatcactggcaggtacgtcgaggctcgtaacattattctggcgttcgccggcactctgcgccacggtctcatacctaacctgctgggggaaggaatctacgctcgatacaattgcagggatgctgtctggtggtggctgcagtgtattcaggattactgtaaaatggtgccaaatggtttagacatcctgaaatgcccagtttctaggatgtaccccactgatgattccgcgcctctgccggctggcaccctggaccaacctttattcgaggttattcaagaggctatgcaaaagcatatgcagggcatccaatttcgtgagcgcaatgctggtccacagattgatcgcaatatgaaggatgaagggtttaatatcacagcgggtgtcgatgaggagacgggctttgtgtacggtggcaatcggttcaactgcggcacgtggatggataagatgggcgaatccgatcgggcgcgcaaccgcggcattccagccaccccgcgcgatggtagcgcagtcgaaatcgtcggcctgtcgaaaagcgcggtccggtggcttctggagctttccaagaaaaacatatttccgtatcatgaggtcacggttaagcgccacggcaaggccatcaaagtgagctacgatgagtggaaccgcaaaatccaggataattttgaaaaactcttccatgtttctgaggaccctagtgacctgaacgaaaaacacccgaacctagtccacaaacgcggaatctacaaagacagctacggggcaagtagcccttggtgtgattaccagctgcgccctaattttacgattgctatggtggtggcacctgagctgttcacgactgagaaagcgtggaaggcactagaaatcgccgagaaaaaactgctgggcccgttgggcatgaaaacgttggacccggacgacatggtttactgcggtatctacgataatgcactggataacgacaattacaacctggcaaagggtttcaactatcatcagggccctgaatggctgtggccaatcggctacttcttgcgagcgaagctgtatttttctcgcctgatgggtcccgaaactacagcaaagaccattgttttggtgaaaaacgttctatcccgccactacgtgcaccttgaacggagcccttggaaggggctgccggagttgactaatgagaatgcccagtattgtccgttcagctgcgaaacacaagcatggagcatcgccaccatactagaaaccctgtacgacctg

SEQ ID NO: 6121 - DNA, 4596 bp, Artificial Sequence
  Description of Artificial Sequence: Synthetic coding sequence
atgggacacagcaagcagattcgaattctgctcctgaatgagatggaaaagctggagaagaccctgtttcggctcgagcagggttacgagctccaatttcggctcggcccgactctccagggtaaagccgtgactgtctacacaaactaccccttccccggcgagaccttcaaccgcgagaagttccgctccctggattgggaaaatccaactgagagggaagacgattccgataaatactgcaagctcaatctgcagcagtccggaagcttccagtactacttcttgcagggcaatgaaaaaagcggaggcggctacattgttgtcgacccgatactgagagtgggggctgacaatcatgttctacctcttgattgcgtcacattgcagacctttctggccaagtgcctgggcccatttgatgagtgggaatctaggctgcgcgtggccaaagagagcggctacaacatgatccacttcacacccctccaaactctgggcttgtccaggtcatgctatagccttgcgaatcagctagagttgaacccagatttctcccgccctaatcggaagtatacctggaatgacgtggggcagctcgtcgagaaactcaagaaggaatggaacgtcatctgcatcacggatgttgtgtacaaccacaccgccgcaaacagcaaatggatacaagagcaccccgaatgtgcgtacaatctggtaaactccccccatctcaagcctgcctgggtcctggaccgagccctgtggcggtttagctgcgatgtcgcggagggtaagtacaaagaaaaggggattcctgcactgatagaaaatgaccatcacatgaattctataagaaagattatttgggaggatatctttcctaaactgaagctgtgggaattttttcaggtggacgtaaataaggctgtagagcagttcagacggctcctgacacaggaaaaccgaagagtgacgaagagcgatcccaatcaacatttgaccatcatccaagatcccgagtaccgtaggtttggatgcacagtggatatgaacatcgctttaacaaccttcattcctcatgacaagggtcccgccgctatcgaggagtgttgcaactggtttcacaaacgcatggaggagttgaactcggaaaagcatcggctgatcaactaccaccaagagcaggccgttaattgtctgctgggcaacgtgttctatgaacgacttgccggtcatggaccgaaactcggaccggttaccaggaaacacccacttgtgacccggtattttacattcccatttgaagagattgatttttcaatggaagagtcaatgatccatcttcctaacaaggcttgcttcctgatggctcataacggttgggtaatgggagacgacccactgaggaattttgccgagcctggaagtgaggtgtacctacggcgagaactcatctgttggggcgacagtgttaagctccgatatggtaacaaaccagaagattgcccatacctctgggcgcacatgaagaaatacaccgagatcacagcgacctacttccagggggtgcggttggacaattgccactcaacaccattgcacgtggcggagtatatgttggacgcggccaggaacttacaacctaatctgtacgtcgttgctgagctgttcactggcagtgaggacttggacaatgtgttcgttacccggctcggtatctcttcattgatccgggaagctatgtctgcctataactcacacgaagagggacggcttgtgtatcggtatgggggggaacctgttgggtcgtttgtgcagccttgtctgaggcccctgatgcctgctatcgcgcatgctctgttcatggacatcactcatgataatgaatgccccattgtgcatcgatctgcctacgatgcccttccaagtacaaccatcgtgagcatggcctgttgtgcgtctggaagtacgcggggttatgatgaacttgtccctcaccaaatttcagtagtgtctgaagaaagattttacacaaagtggaaccctgaggcactacccagcaatactggcgaagtgaatttccaaagcggaataattgcagcccggtgtgcgatcagtaagcttcaccaggaactcggggcgaagggctttatccaggtctacgtcgaccaggtagacgaggatatcgtggccgtcacccgccattccccttctatccaccagtccgttgtcgccgtatcacggacagctttcaggaaccccaagaccagcttttattctaaggaggtgccccagatgtgtatccctgggaaaattgaggaagtggtcctcgaggccaggaccatagagagaaatactaagccgtacaggaaagatgagaactccataaacggaactccagacatcaccgtggaaattagagaacacatacagttaaatgagtctaaaatcgtcaaacaggctggggtggccaccaaaggcccaaatgagtatatccaggagattgaatttgaaaaccttagtcctggctccgtgattatcttcagggtttcactcgacccccacgctcaggtagccgtcggcattctgaggaaccatctcacgcagttttcccctcattttaaaagtgggagccttgcagtggacaatgctgacccaattctgaagatcccattcgcctcattggccagcaggctgacgttggccgaactaaaccagatactatacagatgtgaaagcgaagagaaagaggacggcggggggtgctatgacatccccaactggtcagctctaaaatacgcaggtctccagggactaatgtccgtcctggcggaaattcgccctaaaaatgatctggggcatcccttttgtaacaacctccgctctggggattggatgatcgattacgtaagtaatcggttgattagccgctcaggaacaattgcagaggtaggaaagtggctgcaggcgatgtttttttatctgaagcagatccccaggtacctgataccctgctatttcgacgccatccttattggtgcgtatacaacccttctggacacggcatggaaacagatgtcctccttcgttcaaaatggttcaacctttgtaaagcacctcagcttgggctctgtacagctctgcggtgtcggtaagttcccgagtctgcccatcctgagtcctgcccttatggacgtcccctaccgactgaacgagataactaaggagaaggaacagtgctgtgtatctctggctgctggattaccacattttagctccggaattttccgatgttgggggcgtgacacatttatagcattaagggggatccttctcatcaccggcaggtatgtcgaggcccggaacatcatcctcgcctttgccggaaccttgaggcacggtttaataccaaatctgctcggagagggaatctatgcacggtataactgtcgcgacgctgtttggtggtggctccagtgcatccaggattactgcaagatggtccccaacggcttggatatactgaaatgtccagtatcacgaatgtatcctaccgacgacagcgcccccctgccagccggcaccctggaccagccgctgttcgaggtcatccaggaagcgatgcagaagcacatgcaggggatccagttcagagagcgaaacgccggccctcagatagaccgcaacatgaaagacgaaggcttcaatatcacagccggagtggacgaggagactgggttcgtctatggcgggaataggttcaactgcggcacatggatggacaaaatgggggagtcagatagggcccgaaacagaggaataccagcgaccccgcgggacggcagcgccgtggagatcgtggggctctcgaagtccgctgtaaggtggctgttggagctcagcaagaagaacatcttcccctaccacgaggttacagttaagcgccatggcaaagctataaaagtctcatacgacgagtggaacagaaaaatccaggacaacttcgagaagctgttccacgtatctgaggatccaagtgatctgaacgagaaacaccccaatctggtgcacaaacgcggaatttacaaagattcatatggtgcttccagcccatggtgcgactatcagttacgtccaaatttcactatagcgatggtggtggcgccggagttatttacgactgagaaggcttggaaggctctggagattgcggaaaaaaaactgttggggccgctcggaatgaaaactctagatcccgatgacatggtgtactgcgggatctacgataatgccctggataacgacaactataatctagccaagggctttaattatcaccaggggcccgagtggctgtggcctatcggatactttctgagggccaagctgtacttctcgcgtctcatggggccggaaaccacagctaaaacaatagtgctcgtcaaaaatgtattgtcccgccactatgtccacctagagcggtctccttggaaggggctgcccgagctaaccaacgaaaatgcccagtattgtccgttttcctgtgagacccaggcttggtccatcgcgaccattttggagacgctttatgactta

SEQ ID NO: 6122 - DNA, 4596 bp, Artificial Sequence
  Description of Artificial Sequence: Synthetic coding sequence
atggggcacagcaagcagatcaggattctcctcctgaacgagatggagaagctagagaaaacgttgttccgcttggagcaggggtatgagttgcagttccgtctggggccgacgctccaaggtaaagccgtgaccgtgtatacgaattacccatttccgggcgagacatttaacagggaaaaattccgctccttagattgggagaatccaaccgagcgcgaggacgattcagacaagtactgcaagctgaatctgcaacagagtggctctttccagtattattttctccaggggaatgagaagtccggcggtggatacatcgtggtggacccaattcttcgagtgggtgcagataatcacgtcctccccctggactgcgtgacgctgcagacattcctggccaagtgcctcggcccgtttgatgagtgggagagcaggctgcgcgtagctaaggaatccggctataatatgattcacttcacccccctccagacattgggacttagtagatcgtgctattccctggccaatcagctcgagcttaaccctgatttcagtcggcctaatcggaaatacacgtggaatgacgtgggccaactggtggaaaagttaaaaaaggaatggaacgtgatttgcatcaccgacgtggtgtataaccataccgcggcgaactcaaagtggatacaggaacacccagagtgtgcgtacaatctggtcaacagcccccatttgaaacccgcctgggtactggaccgagccctctggcgcttttcctgtgacgtagcagaaggcaaatacaaggagaagggcattccagcactgatagaaaatgatcaccacatgaacagcattagaaaaatcatctgggaagacatctttcccaaactgaagttgtgggagttcttccaggtggatgtgaacaaagccgtggagcagttccgcaggcttctgactcaggagaacagaagagtgaccaaatcagaccccaatcagcatctcacaattatccaggacccagagtaccgaagatttgggtgcacggtggatatgaacatcgccctgacgaccttcatccctcatgacaaggggcctgccgccatcgaagagtgttgcaattggttccacaagaggatggaggaactgaactctgaaaaacatcggctgattaactatcatcaggagcaagccgtgaattgtctgctgggaaatgtattctatgaacgtctggcaggtcacggacccaaactgggccctgtcacccggaaacacccactggtcacacgctactttacttttccttttgaggagatcgacttttctatggaggagagcatgatacacctcccaaacaaagcctgttttctgatggctcacaacggttgggtgatgggagacgatcccctgagaaactttgccgaacccggaagcgaggtgtacctgcggcgcgagctgatatgctggggtgacagtgtgaaattgaggtacggaaacaagcctgaggattgcccctacctgtgggctcacatgaagaagtacactgagatcactgccacatacttccaaggggttcgtttggataactgtcatagtaccccacttcatgtggccgagtacatgctggacgctgcccgaaaccttcagcctaatctgtacgtggtggccgagctcttcaccgggagtgaggatctggacaacgtgttcgtgaccaggttgggtatcagcagcctgatccgggaagctatgtctgcttataatagccacgaagagggccggttggtataccgctacgggggcgaacccgtgggatcgtttgtgcagccatgcctgcgccctttgatgccggccattgcccatgcactgttcatggatattacccacgacaacgagtgcccgatcgtacacagaagcgcgtacgacgcactgcctagcacaaccatcgtatccatggcatgttgtgcctccgggagtacaaggggctatgatgaactggttcctcaccagatctcagtggtgtcagaggaacgattctacaccaaatggaaccccgaggcgttacccagcaacacgggggaggtcaattttcagtcaggcatcattgctgcccgatgtgccatttctaagttgcatcaggagttaggggcgaaagggtttatccaggtttatgtcgatcaagtcgacgaagatatcgtggccgttactcgccactccccatccattcaccagtccgtagtggctgtatcacgcaccgctttccggaatcccaagacgagtttttactcaaaagaggtgccccagatgtgtatcccaggcaaaatcgaggaagtggtattggaggcgcgaactatcgaaaggaacacaaagccctatagaaaggacgagaatagcattaacggaacccctgacatcacagtggaaatccgcgaacacatccagctgaacgaaagtaagatcgtcaaacaagccggcgtagctacgaagggccccaacgagtacatccaggagatcgagttcgagaacctttcacctggtagtgttatcatcttcagagtttcacttgaccctcacgcgcaggtcgcggtcggaattctaagaaaccacctcacccagttcagcccacactttaagtccgggagcctggcggtggataacgccgatcccatcctgaagatcccttttgcctccctggcttcacgcctaacactggccgaactcaatcagatcctctaccgttgtgagtccgaggagaaggaagacggtggcgggtgttacgatatacccaattggagcgctcttaagtatgccggtttgcaggggctgatgtccgtcctggccgagattcggcccaaaaatgacctcggccaccccttttgtaataacctccggagcggcgattggatgatcgactacgtctccaaccggttgataagccgaagcgggaccatcgctgaggttggaaaatggctgcaggccatgttcttttatctcaagcagattcccagatacctcatcccctgctatttcgatgccattctcattggagcatacaccacgctgctggacactgcgtggaagcagatgtcttctttcgtccaaaatggttcaacgtttgtgaaacatctgtccctcggcagcgtgcagctctgcggagtggggaagtttccgtctctgccgatcctttctcctgcccttatggacgtaccttaccgactgaatgaaataacgaaagaaaaagagcagtgctgcgtttccttagcagccggactgccacacttcagctccggtatttttcggtgttggggccgagataccttcattgccctgcgtggaattttactaattactggaagatacgtggaagcccggaacatcatcttggcattcgccggaaccttgcgacacgggctaatcccgaacctactcggcgaaggaatttacgctaggtacaactgccgggatgccgtgtggtggtggctgcagtgcattcaggattactgtaagatggttcccaacggcctggacatcttgaagtgtcccgtcagccggatgtatcccactgacgattcagcccccctacccgctggcacgctggaccagcccctgttcgaagtcattcaggaagcgatgcagaaacacatgcagggaattcagtttcgggaacgcaatgcagggccacagattgatcgcaatatgaaggacgaaggcttcaacattacagccggtgtggatgaagaaactggcttcgtttacgggggcaaccgttttaactgcgggacatggatggacaagatgggcgaatcagaccgagccagaaaccggggtattcctgcaacccccagggacgggtccgctgtcgaaatcgtaggactgtccaagtccgcagtacgatggcttcttgaattgtctaaaaagaacattttcccctatcacgaagtgaccgttaaacgtcatggcaaggccattaaggtgtcttatgacgagtggaaccggaaaattcaggataactttgagaaactcttccacgtgtctgaagacccgtccgacctgaacgaaaagcatcccaatctggtgcataagaggggtatctataaggacagctatggggcctccagtccatggtgcgattatcagctccgcccaaactttactattgcaatggtcgtagctccagagctgtttactaccgaaaaggcgtggaaggctctagaaattgccgagaaaaaactactcggcccgctgggaatgaagacgctggatcctgatgatatggtttactgtggaatttatgataacgcactcgataacgacaactacaacctcgctaagggctttaattatcatcagggcccagagtggctctggccaataggttattttctgagggcgaagctgtatttttctaggttgatggggcccgagactaccgctaaaacaatagtactggtcaagaatgtgttatcccgacattatgtccatttggaaaggtccccttggaagggcctaccagagttgaccaacgaaaacgcccagtattgccccttctcatgcgagactcaggcttggtctattgcaacaatccttgagacactgtatgacctt

SEQ ID NO: 6123 - DNA, 4596 bp, Artificial Sequence
  Description of Artificial Sequence: Synthetic coding sequence
atgggccattctaagcagattcgcatcctgctactgaacgagatggaaaaactggagaagacactgttccgccttgaacagggatatgaactgcagttcaggctgggcccaaccctccagggaaaggcagtgaccgtgtacactaattatccttttcctggagagacatttaatagggagaaatttcgctctctcgactgggagaaccctactgaacgggaggacgattcagacaaatattgcaagttgaatctacagcagtctggcagctttcagtattacttccttcagggcaatgagaagtccggcgggggatacatcgtagtggaccctattcttagagttggcgccgacaatcatgtcctgccactcgattgtgtgactttgcagacattccttgcaaagtgtctgggtcccttcgacgaatgggaatcacgcctgagagttgctaaagaatctgggtacaatatgattcacttcacccccctccagaccctgggtttaagtcgatcttgttacagcttagctaaccagctggaattgaaccctgattttagtaggccaaaccggaagtatacatggaacgacgtggggcaactggttgaaaaacttaagaaagaatggaatgtaatttgcatcacagacgtcgtctacaaccacaccgcagctaacagtaagtggatccaagaacaccctgaatgcgcctataatctcgtgaactccccccacctaaagcccgcctgggtgctggacagagctctgtggcgcttcagctgcgacgtcgctgaaggcaagtacaaagaaaagggtatccctgccctcatcgaaaacgatcaccatatgaactccatccggaaaatcatttgggaagacatatttccaaaactgaagctctgggaattttttcaggtggatgtcaataaagcggtcgagcagttccgccgcctactcacacaggaaaatcgcagggtgacgaaatccgatcctaatcagcacttaacgattattcaggacccagaatatcggcggtttggctgcacagtggacatgaacattgctttgaccaccttcattccgcatgacaagggacccgcagcaattgaagaatgttgcaattggtttcacaaaagaatggaggagctgaatagcgaaaagcatcgactcatcaattaccatcaagagcaggctgtcaattgtctgttgggtaatgtcttctacgagcggctggccgggcatgggccaaaactagggccagtgactagaaaacatccgctggtcacaaggtacttcacttttcccttcgaagaaatcgacttcagcatggaagagtctatgatccacctgccgaacaaggcttgttttcttatggctcacaacggctgggtgatgggtgatgatccccttcggaacttcgcagagcccggaagtgaggtgtatctgaggcgggagcttatctgctggggagactctgttaagttacgatatggaaacaaaccagaggactgtccttacctgtgggcacatatgaagaagtatacggaaattacagccacctacttccagggtgtacgactcgacaattgtcactcaacccccctgcacgtcgccgagtacatgctggatgcagctcgaaacctccagcctaacctttacgtcgtggccgaactttttactggatcagaggaccttgacaacgttttcgttacccgactgggcatcagttccctaatccgggaggcgatgtctgcgtacaactcacacgaggaaggacggctcgtgtacaggtacggcggagaaccagtcgggtcatttgtgcagccctgtctccgtccgctgatgcctgctattgcacacgcgctctttatggatattactcacgacaatgagtgtcctatcgttcatcgaagtgcctatgacgctttgcctagtaccacaatcgtaagcatggcttgctgtgcctctgggtctacccgcggctatgacgagttagtgcctcaccagatctctgtcgtctcagaggagcgcttttacactaagtggaatccggaagcactcccgtccaacaccggagaggtgaattttcaatctgggatcatcgctgccaggtgcgctatctcgaagctgcatcaggaactcggagccaaagggttcattcaggtatacgtggaccaggttgatgaagacatagttgcagtgacaagacatagcccgtcaatacaccagtccgtggtggctgtcagccgaacagcattccgtaatcctaagacctccttttatagcaaggaagtgcctcagatgtgtatcccaggaaaaattgaagaggtcgtgcttgaggctagaacaattgaaagaaacacaaagccttaccggaaggatgagaactctattaatggcactcctgatatcactgtggaaatccgtgagcatatccaattaaatgagagcaagattgtcaagcaggcaggcgtggcaacgaagggccctaatgagtacatccaggagattgaattcgaaaacctgagcccagggagtgttatcattttcagggtttcactcgatccccatgcacaggttgccgttggcatcctgcgaaaccatctgacccaattcagtccccatttcaagagcggctctcttgcagtggataatgctgatcctatcctgaaaataccctttgcctctcttgcgagccgtctgaccctagctgaactgaaccaaatcctctaccgctgcgagtccgaggaaaaggaagacggaggtggttgctatgacatcccgaattggtccgctctaaagtacgctggcctgcagggcctgatgagcgtcctcgccgaaatccgcccaaagaacgaccttgggcacccgttttgcaacaaccttcggtctggagattggatgatagattacgtcagcaatcggctgatctccaggtccggaactattgcagaagtgggcaagtggttacaggctatgtttttctacctcaagcagattcctaggtatctcattccctgctacttcgatgccattcttatcggcgcctatactacgctgctggacactgcctggaagcagatgtctagctttgtccaaaacggaagcactttcgtcaagcacctgagtttagggtcagtgcagctctgtggggtgggtaagtttcccagcctgcccatcctgagtcctgcactcatggatgtgccttaccgcttgaacgagattaccaaagagaaggagcaatgctgtgtgtctttggctgccggtctgccccatttttccagtggtatcttccgatgctggggacgtgatacttttatcgcccttagaggtatcctattgatcacagggcgttacgtcgaggctagaaacattattttagcctttgccgggacactgcggcatggcctgatccctaacttgctgggagagggtatctatgctaggtataattgtagggacgcagtatggtggtggttacagtgcatccaagattattgcaagatggtccccaacggacttgacatcttaaagtgccctgtctcccgcatgtaccctaccgacgactccgcccccctgccagctggaactctcgatcagccgcttttcgaggtgatacaagaggctatgcagaagcatatgcagggtatccagtttcgggagcgcaatgcaggcccacagatcgaccgcaatatgaaggacgaaggctttaacatcactgcaggcgttgatgaggagaccggattcgtgtacgggggtaatcgattcaactgcgggacctggatggataaaatgggggagagtgatcgggcgcggaatcgtggcataccggctaccccccgggacgggtcagctgtagagatagttggactgtctaaatcagctgtgaggtggctcttggaactgagtaaaaaaaatatattcccataccacgaggtcacagtcaaaaggcacggaaaggctatcaaggtgtcatacgatgagtggaatcgcaaaatccaagataatttcgagaaactgttccacgtgtccgaagatccttcagatctgaatgagaaacatccaaacctcgtccacaaacgggggatctataaggattcgtatggagcttcttccccctggtgcgattaccaactccggcccaatttcacaattgcaatggtggtggcccctgagctgtttactactgagaaagcttggaaggcactggagattgccgagaagaaactcttaggtcctctgggtatgaagacccttgatccagatgacatggtatactgcggcatctacgacaacgccctcgataatgataattataacctcgcaaagggttttaattaccatcaggggccagagtggctgtggcccatcggttacttcctccgggcaaagctgtacttcagtcgtctgatgggccccgagactacagccaagactatcgtgctcgtgaagaacgtgctttctcgccactacgtgcatctggagcgaagcccttggaaagggctaccagaattgaccaatgaaaatgcacagtactgtccattttcttgcgagactcaggcgtggtctatcgctaccatcttagagacactgtacgacctg

SEQ ID NO: 6124 - DNA, 4596 bp, Artificial Sequence
  Description of Artificial Sequence: Synthetic coding sequence
atgggacacagcaagcaaatacgcatactgttacttaacgaaatggagaagctcgagaaaaccctgttcaggctagagcaaggatacgaattacagtttagactgggccctactctgcaggggaaagccgttaccgtgtacacaaattatccttttccaggagaaacattcaaccgcgagaagtttagatctttggactgggagaatccaaccgaaagagaggatgatagtgacaagtattgcaagctgaacctgcagcagtctggctcgtttcagtactacttcctgcagggaaacgaaaaatcaggtggtgggtatatcgtggtggaccccatcctgcgggtgggcgccgataaccacgttttgcccttggactgcgttacactacagactttcctggcgaaatgtctcggacctttcgacgagtgggagtctcggttacgcgtggctaaggagtctggctataacatgattcattttacccccttgcagaccctaggactcagccgctcttgttattccttagcgaatcagctggagctgaatcctgacttctctaggcctaaccgcaaatatacatggaatgatgtgggccaactggttgagaagttgaagaaagagtggaacgtcatctgcatcaccgacgtcgtttacaaccacactgctgccaattcaaagtggatccaagagcacccagagtgcgcatacaatctggtcaactccccacacctgaagcccgcgtgggtgttggatagagccctatggcgcttcagctgcgatgtggcagagggaaagtacaaagaaaagggcatccccgcactgattgagaatgatcaccacatgaactctatccggaagatcatttgggaagatatattccctaaacttaaactgtgggagttcttccaggtcgacgtgaataaagcagtggaacagttcagacggctccttacacaggaaaatagacgcgtaactaagagcgacccaaatcagcacctcactattatccaggaccccgaataccggcggtttggctgcaccgtggatatgaacatcgcactgactactttcataccccatgataaggggcctgctgcaattgaggaatgctgtaattggttccataaaaggatggaggaactcaatagcgagaaacaccgtttaatcaattatcatcaagagcaggctgtaaattgccttctgggcaacgttttctatgagcggttggctgggcacggacctaaattgggtccagtcacccggaagcatccgcttgtgacaaggtactttacctttccattcgaggagatcgatttctccatggaagagtccatgatccacctaccaaacaaggcctgtttcctgatggcccataatgggtgggtgatgggggatgatccgttaagaaatttcgctgaaccgggctcagaggtgtacttacgccgtgagttgatctgctggggtgactcagtgaaactcaggtacggtaacaagcctgaagactgcccctacctgtgggcccacatgaagaaatacaccgagataaccgcaacatattttcaaggggtccgattagacaactgccatagcactcccttacacgtggcagagtacatgttggacgccgcccgtaacttgcagcctaatctgtacgtcgtggccgagctattcactggatctgaagacctcgacaacgtgttcgtcactagattgggaatcagctccttgattagggaggccatgagtgcctacaactcgcatgaggaggggcgtctggtgtatcggtatggcggggagcccgtgggctccttcgtccagccatgtctgaggcccttgatgcccgctattgcccatgctctgtttatggatattactcacgataatgagtgtcccattgtgcatcggtccgcctatgacgcccttccaagtaccactatcgtgtctatggcgtgctgcgccagcggttctacacggggatacgacgaactggtgccacaccaaatctcagtggtgtcagaagagaggttctacaccaagtggaaccccgaggcgctgccgtctaacactggggaggttaacttccagtccggcatcatagcagcgaggtgcgccatatccaagctccatcaagagctgggggctaaaggttttatacaggtctacgttgaccaggtagacgaagacattgtggcagttaccaggcattcaccaagtatccaccagtctgtggtggccgtgagtcgcactgctttccggaacccaaaaaccagcttttatagtaaggaggtgccacagatgtgtattcctgggaagatagaggaagttgttttagaagctaggactatcgaacgcaacaccaaaccttatagaaaagatgagaactccatcaacggaacacccgatataactgtcgagatcagggagcacattcagctgaatgagagcaaaatagtgaagcaggcgggcgtagccactaagggtccaaacgaatacatacaggaaattgagtttgaaaatttgtcgccaggatccgttataattttcagagtgtccttggatccgcacgcccaggtggcagtgggcattctgcgtaatcatctgacacagttctccccgcactttaagagcgggagcctggctgtcgacaacgccgacccaatcttaaaaattccatttgcttctctggctagcagactcacccttgccgaactcaatcagattctgtataggtgtgaatccgaagaaaaagaggatggagggggttgttacgatatccccaactggtcggcccttaagtacgccggacttcagggtttgatgtctgtgctggctgagatacggccgaaaaacgatttaggacaccccttttgtaataacttgcgtagcggggactggatgatcgactacgtctccaatcgactgatctcaaggtccggtacaattgccgaggtgggaaagtggctgcaagctatgtttttttatcttaagcagattcctaggtatttaattccgtgctattttgacgctatcttgatcggagcgtataccacacttctagacaccgcatggaaacagatgagcagttttgtccagaatggttcaacctttgtgaaacacttatcactgggatcggtgcagctgtgcggcgttgggaagttcccttcattgcctattctgtctccagcactaatggacgtcccgtaccgcctcaacgagatcacgaaggaaaaagaacagtgttgcgtctctctggctgctggcctccctcacttcagttcagggatttttcgctgctgggggcgggatactttcattgccctgcgcggcatccttctgatcactggccgctacgtggaggcccgaaacatcattctggcctttgccggtaccctgcgacatggactgattcccaatctcctgggcgaaggaatttacgcaaggtataactgcagagatgcagtgtggtggtggttgcagtgcatccaggattactgcaagatggttcctaacggcttagacattctcaagtgccccgtgtccaggatgtaccccactgacgattccgcccccctgccagccggaacactcgaccagcctctttttgaagtgattcaggaagccatgcagaagcatatgcagggcatacagttccgcgagcgaaacgccggccctcaaattgatcggaacatgaaagatgaaggattcaacatcactgcgggggtcgatgaggagactggtttcgtgtatggcgggaatagatttaactgtggaacttggatggacaaaatgggggagtctgacagagctcggaaccgagggataccggctacacctcgtgacggctctgctgtggagatcgtcgggctatctaaaagcgccgtgcggtggcttttagagctatctaaaaagaacatcttcccttaccatgaagtgaccgtgaaacgccatggaaaggcaattaaggtgagttacgatgaatggaatagaaagatccaggataattttgaaaaactgtttcacgtttcagaagacccaagtgatctcaatgaaaagcatccaaacttggtccataaaagaggaatttataaggactcatatggcgccagtagcccatggtgcgattaccagttacgccccaacttcacaattgcgatggttgtggcccctgagcttttcacaaccgagaaggcctggaaggcacttgagatcgccgagaaaaaactactcgggccgcttggcatgaagactctcgatccagacgatatggtatattgtggaatctatgacaatgcccttgataatgataactacaacttggccaagggattcaactatcatcagggcccagaatggctgtggcccattggatacttccttcgcgctaagctgtatttttcacgactgatgggtccagagaccacagccaaaaccatcgtactagtaaaaaatgtgctgtcacggcattacgtgcaccttgagcgcagtccttggaaaggcctgccagagctcacgaatgagaacgcacaatactgccccttcagttgtgaaacgcaagcatggtctatcgcgacaattctggaaacactgtacgatctc

SEQ ID NO: 6125 - DNA, 4596 bp, Artificial Sequence
  Description of Artificial Sequence: Synthetic coding sequence
atgggacactccaagcagataagaattctcctgttgaacgagatggagaaactcgagaaaaccctgttccggcttgaacagggatatgagcttcaatttcgactggggccaactctgcaggggaaggcagtgacagtttacacaaattatcctttccctggggagaccttcaacagagaaaagttccgatcgctggactgggaaaatccaactgagcgagaggatgattccgacaagtactgtaaattgaatctccagcagtcaggcagtttccagtactattttctacaagggaatgagaaatccggaggcggatatatcgtggtggatcctattcttcgcgtcggcgccgataaccatgtgctgcctttggactgcgttacgctgcagacattcctcgccaagtgtctgggtccttttgacgagtgggagtctcggctcagagtcgcaaaggaaagcgggtacaacatgatccatttcacaccacttcagaccttggggctttcaagaagctgctattcactggccaatcagctggagctgaaccccgacttctctaggccgaatcggaagtatacttggaatgatgttggacagctcgtcgagaagttgaagaaggagtggaacgtaatctgtatcaccgacgtggtttacaaccacactgccgctaattctaagtggatccaagagcacccggagtgcgcttataacctggtaaattctcctcacctgaagcctgcctgggttctggacagagctttatggaggttcagttgtgacgtcgcagagggcaagtacaaagagaagggcatcccagccttaatcgagaatgaccatcacatgaacagcatcagaaaaattatctgggaggatatttttcccaaactgaaactgtgggaattttttcaggtcgatgttaacaaggccgtggaacagtttagacgcttgttgacgcaggagaataggcgagtgacaaaatctgatccaaaccagcatctgaccatcattcaggatccagagtacaggaggtttggctgtactgtcgacatgaacatagccctcaccacttttattccccacgataaggggcctgccgcaattgaggagtgctgcaattggttccacaaaagaatggaagagctcaatagcgagaagcacagactgattaattatcatcaggagcaggctgtcaattgcctgctagggaatgtgttctacgagaggctggccggacacggtcctaaactcggacctgtcacacgtaagcatcctctggtgacccgctattttacctttcctttcgaggaaatagactttagcatggaggagagcatgatacacctaccaaataaagcctgctttttgatggctcataatggctgggtgatgggggatgaccctctgcggaactttgctgaaccagggagcgaggtatacctgaggcgggagcttatctgctggggggactcagttaagctgagatatgggaacaagcccgaggactgcccctacttgtgggcccatatgaaaaagtataccgaaatcacggctacctatttccagggggtgaggctcgacaattgtcacagcacaccactccacgtggcggaatatatgctagacgcagcacggaacttacagcccaacttgtacgtcgtggctgagctgtttaccggaagcgaggatctcgacaacgtgtttgtaactcgcctgggtatctcctcgctcatccgggaggcgatgagtgcgtacaacagccatgaggaggggagacttgtttatcgttatggaggtgagcccgtgggcagtttcgttcagccctgcctgcgcccacttatgccagcgattgctcatgccctgttcatggacattactcatgataatgagtgccccatcgtgcaccggagtgcgtacgatgcactgccgagcaccaccatcgtaagcatggcatgttgtgcatccggcagcacccgcgggtacgacgaacttgtcccgcaccagatcagcgtggtcagcgaagaacggttctacacaaaatggaaccctgaggcgctgccctccaacaccggcgaggtaaactttcaatccggcattattgcagcacggtgcgctatcagcaaactgcaccaggaactgggcgccaagggattcatacaggtttacgtagaccaagtggatgaagatatagtagctgttaccaggcacagcccttccatccaccagtcagtggtggcagtgtctaggactgccttccgaaaccccaagacctcattttatagcaaggaagtgccccagatgtgcatcccaggaaagattgaggaagtggtgctggaggctaggaccatcgaaagaaatacaaaaccgtatcggaaggatgaaaactccatcaacggtactccagatattaccgtggagatcagagagcacatccagctgaacgagtctaaaattgtcaaacaggccggagttgccactaaggggccaaacgagtatatacaagagattgaatttgagaatttatctccaggctccgttattatcttccgcgttagcttggacccccacgcccaggttgctgttggcatccttagaaatcatctgacacagttcagcccccacttcaaatcaggatctcttgccgtggataacgctgatccaattctcaagatccccttcgccagtctcgctagccgtctgactctggcagagttgaatcaaatattatatagatgtgagagcgaggaaaaggaggatggcggtggttgttacgatatccctaattggtcagctcttaaatatgccggattgcaaggtcttatgtcagtgctggccgaaatccgccccaagaacgacctcggtcacccgttttgtaacaatttacggtccggggactggatgatcgattatgtcagcaacaggcttatcagcagaagtggcaccatcgctgaagtcgggaagtggctccaggccatgtttttctatttgaagcagattccgagatacctcatcccctgttactttgatgctatcttaattggagcatacaccactcttctggataccgcttggaagcagatgtcctcctttgtgcagaatgggtctacctttgtgaagcatctatctctgggaagcgtgcaactctgtggggtggggaaattccccagtcttcctatcctcagcccggcactgatggacgtaccctaccggctcaacgagataactaaagaaaaggagcagtgctgcgtttctctggctgcagggctgccgcacttcagctccggcatcttccgatgctggggcagggacacttttatcgccctcaggggtatactgttaattaccgggaggtacgtggaagcccgaaacattatccttgctttcgccgggacactgagacacgggctcatccctaatctgctgggcgaggggatctatgcccggtacaactgccgggatgccgtttggtggtggctgcagtgtattcaggactactgtaaaatggttcccaatggcctcgatattctgaagtgtccagtttcgcggatgtaccctacagatgacagcgcacctctccccgccggtacactggaccagccactgtttgaggtcatccaggaggctatgcagaagcacatgcaggggatccagtttcgtgagcgaaatgctggaccgcaaatcgataggaacatgaaggatgaaggtttcaatatcaccgctggcgtggacgaggaaaccgggttcgtttatggagggaacaggttcaattgcggcacttggatggataaaatgggcgagagcgacagagcgaggaacaggggcattcctgccacccctagggatgggtcagctgtcgaaatcgttggactgtccaaaagcgccgtgaggtggttgctggaactgagtaaaaaaaatattttcccctatcatgaagttactgtgaagagacacgggaaggctatcaaagtgagttatgacgagtggaatcgtaagatccaggacaatttcgagaagctgtttcacgtgtctgaggatccgtccgatctgaacgaaaagcaccccaatctggtgcacaagcggggtatctataaggattcctatggtgccagcagcccttggtgtgattaccagctgcggccaaactttacaatagccatggtcgtggcgcctgaactcttcacgactgagaaagcctggaaggcgctggagatcgccgagaaaaaattgctgggccccctcggcatgaaaaccctggacccagacgatatggtttattgcggaatttacgacaatgcactggacaatgacaactataatcttgccaagggctttaattatcaccaaggacccgaatggctatggcccataggctatttcctgagggccaagctttacttctctcggttgatgggcccagagaccactgccaagaccattgtcctggtgaaaaacgtcctttcacgccattatgtacacctggaaaggtcaccctggaaaggcctccccgaattaaccaatgagaacgcacagtactgtccattcagctgtgagacccaggcttggagtattgcgaccattttggaaacactgtacgatctg

SEQ ID NO: 6126 - DNA, 4596 bp, Artificial Sequence
  Description of Artificial Sequence: Synthetic coding sequence
atgggacattcgaagcaaattaggatcttgcttctcaatgaaatggagaaacttgaaaagaccctgttcagacttgaacagggctacgagctccaatttcgcctcggaccaaccttgcaaggcaaggctgtgacggtgtacactaattacccttttccgggcgaaacctttaacagggaaaagttcagatctcttgactgggaaaaccctactgagcgagaggacgattcggacaaatactgtaagctgaatctgcaacaatccggctcgtttcagtactatttcctgcagggaaacgagaagtcgggaggcggctacatagtcgtggacccaattctgcgggtgggagcggacaaccatgtgctgccactcgactgtgttaccctgcaaaccttccttgcaaaatgcctcggacccttcgatgaatgggaatccaggctgagggtggccaaggaatcgggttacaatatgattcatttcacgccactgcagactctcgggctttcccgatcatgttactcactggccaatcaactggaactgaaccctgatttcagccgaccaaacaggaagtacacctggaatgatgtgggtcaacttgtggaaaaactgaagaaagaatggaatgtgatttgcatcactgatgtggtctacaaccatacggctgcaaactccaagtggattcaagaacatcccgagtgtgcatacaatctggtgaattcgccacatctgaaacccgcttgggtgctcgatagggcattgtggagattttcatgtgacgtggctgaggggaagtacaaggaaaagggaatcccggcactgattgagaacgatcaccatatgaacagcattcgcaaaatcatatgggaggatatcttcccaaaacttaaactgtgggaattcttccaagtcgatgtcaataaggcggtggaacaatttagaaggttgcttacgcaagaaaataggagagtcacgaagtcggatcctaatcaacacctcaccatcatccaggatcctgagtaccgccgcttcggatgtaccgtggatatgaatattgccctgactaccttcattcctcatgacaagggacctgctgccatcgaggagtgctgcaattggttccataagcgtatggaagagctgaattccgaaaaacatagacttatcaattatcaccaggaacaagcagtgaattgtctgttgggcaatgtgttttacgagagactcgcaggtcacggtcctaagctgggacccgtcacccgcaagcatccactcgtcacgcgttactttacctttccattcgaagaaatcgattttagcatggaggaatctatgatacatctccctaataaggcatgcttcctgatggcacacaacgggtgggtgatgggggatgaccctctcagaaactttgcagagccaggatccgaggtctacctgcgacgcgagcttatttgttggggtgacagtgtgaaacttagatacggaaacaaaccagaggactgtccatacctgtgggcacacatgaagaaatacaccgaaatcaccgcaacttactttcaaggtgtgagacttgacaattgccatagcactcccctccacgtggcggagtacatgcttgatgcagcccgaaacctgcaaccgaatctgtacgtggtcgcagaactttttaccggatcagaggaccttgataacgttttcgtgaccagacttgggatttcttcgcttattcgagaggcaatgagcgcctataactcccatgaggagggtcgccttgtctacagatacggcggagagccagtgggttcgttcgtgcaaccttgcctccggccccttatgcccgcaatagcacatgcgctctttatggacattactcatgataatgaatgtccaatcgtgcatcgctcagcctacgatgccctcccatcgactactattgtaagcatggcttgctgcgcgagtgggtcaactcgcggttacgacgaactggtcccacaccagatttcggttgtctcagaagaacggttttacaccaagtggaacccagaggcccttccatcaaatactggggaagtgaacttccaaagcggaatcattgcggcacgatgtgcgatctccaagctgcatcaggaacttggagcaaaaggattcatccaggtttacgtggatcaagtggacgaagatatagtggcagtgaccagacactcgccatcgattcatcagtcagtggtcgctgtctcccgcacggcgtttcggaaccctaagacctcattttactccaaggaggtgccacagatgtgcatccctgggaaaatcgaagaggtggtcctggaggcacgaacgattgagcggaacaccaagccttataggaaggatgaaaacagcattaatggaacccctgatatcactgtggaaattagagaacatatccagctcaacgaatccaaaatagtgaaacaggcaggagtcgcaactaaagggcccaacgagtacattcaagagattgaatttgagaacctttcgccgggctcggtcataatctttagagtcagcctggatccacacgcccaggtggcagtggggattcttcgcaaccaccttactcaattttccccccacttcaagtcgggatcgctggcggtcgacaatgcagatcccattttgaagatccctttcgcatcacttgcaagccgattgacgcttgcagaacttaaccagattctgtaccgttgtgaaagcgaagaaaaggaagatggaggagggtgttacgatattccgaattggagcgctttgaaatatgcgggacttcagggtcttatgtcagtcctcgcagagatccggccgaagaatgacttgggacatccattttgtaataacctgagaagcggcgattggatgatcgactacgtgtcaaatcggcttatctccagatctggcaccatcgcggaggtgggtaagtggctgcaggcgatgttcttctacctcaagcagataccgcgttatctgataccttgttacttcgacgcgattcttattggagcttatacgaccctgctggacaccgcatggaaacaaatgagctcgtttgtgcagaatggcagcacctttgtgaaacatctttccctcgggtcggtgcaactgtgcggcgtcggaaagtttccatcactgcctatactgtcgccagcacttatggatgttccttacagactcaacgagattaccaaagagaaggagcagtgctgtgtctcccttgccgcaggattgccacatttctcgagcggcatattcagatgttggggccgggatacctttattgcgctgcgcggaatactgcttatcaccggacgatacgtggaagcgcggaacattattcttgcatttgcaggcactctgagacatggacttattcctaatctgctcggtgaggggatttacgcacgatacaactgtcgcgatgcagtctggtggtggcttcagtgtattcaagactactgtaagatggtccccaacggactggacattctgaaatgcccagtgtcacgtatgtaccccactgatgactccgcaccactgccagccggtacgctggaccagcctctgtttgaagtgatacaagaagccatgcagaagcacatgcaaggaatccaattcagggaaaggaacgctggccctcaaattgatagaaacatgaaggatgaaggcttcaacattaccgccggagtggatgaagaaaccggttttgtctacggaggaaacagattcaactgtggtacgtggatggacaagatgggggaaagcgatagggcccgcaataggggaatacccgctactccccgtgatggctcagccgtcgaaatcgtgggactgtcgaagtcggcagtgcggtggttgcttgaactttcgaagaagaatatcttcccttaccatgaagtgaccgtgaagagacacggaaaggccattaaggtgtcatatgacgaatggaataggaaaatccaggataactttgaaaagctctttcatgtgtcggaggatccttcagacctgaatgaaaagcacccaaacctggtgcataagagagggatctacaaggactcatacggagcatcttccccatggtgtgactaccagctgcggccaaacttcaccatcgcaatggtggtggcaccagagctttttaccactgagaaggcatggaaggcgttggagatcgcggagaagaaactgcttggaccgctggggatgaaaacgctggatcccgatgatatggtgtactgtgggatctacgataacgcactggacaatgataactacaacttggcgaaaggctttaactaccaccaaggcccagaatggctgtggccaatcggttacttccttcgtgccaagctctatttctcccgcctcatgggcccagaaactactgccaaaactatcgtcctcgtcaaaaacgtgctgagtcgccattatgtgcatctcgaaagaagcccttggaaggggctgccagaactgaccaacgagaacgcacagtactgcccctttagctgtgaaactcaagcctggtcaatagcaactattctggaaaccctttacgatctg

SEQ ID NO: 6127 - DNA, 4596 bp, Artificial Sequence
  Description of Artificial Sequence: Synthetic coding sequence
atgggacacagcaagcagatcagaatcctgctgctcaacgaaatggagaagctggaaaaaacgctgttcaggcttgagcaaggctacgaactgcaatttcgccttgggccgaccctccaaggcaaggcagtgactgtctacactaattaccctttcccgggagaaaccttcaaccgggaaaagtttagaagcctggactgggagaatccgactgaacgcgaagatgattcagacaagtactgcaagctcaacctgcagcagtccggatcctttcagtactactttttgcagggaaacgaaaagagcggtggcgggtacattgtcgtcgaccctatcctccgggtgggagccgacaaccacgttctgccacttgactgtgtgacgctgcagaccttcctcgccaagtgcctggggcctttcgatgaatgggagtcgcgccttagagtcgctaaagaatcaggctacaacatgatccacttcaccccactgcaaactctcgggctgtcgcggagctgttattcgctggcaaatcagctcgaactcaacccagatttttccaggcccaatagaaaatacacttggaacgacgtcggtcaactggtggaaaaactcaagaaggaatggaacgtgatctgtatcaccgatgtggtgtacaatcataccgcggcgaactcgaagtggattcaggaacacccggaatgcgcgtataatcttgtgaattcgccccacctcaagcccgcttgggtgcttgatcgcgccctgtggagattctcctgtgatgtggcggagggaaagtacaaagaaaagggtatccctgccctgattgaaaatgaccaccacatgaattcaatccggaagatcatctgggaagatatttttccaaagttgaagctgtgggaattcttccaagtcgatgtcaataaagcagtggagcagttccgtcgcctccttactcaggaaaataggagagtgaccaaatccgatcctaaccagcacctcactatcatccaagacccagagtacagacgcttcggatgcactgtagacatgaacattgcactcactactttcatcccgcacgacaagggaccagccgccatcgaagagtgttgtaactggttccacaaacggatggaggaactcaatagcgaaaagcaccgactgatcaattaccaccaggagcaagccgtgaattgcctcctcggcaacgtgttctacgagaggctggctggccacggcccgaagctgggaccggtcactcggaagcaccccctcgtcaccagatacttcacgttcccttttgaagagatagatttcagcatggaagagagcatgatccatctgcctaacaaggcgtgcttcctcatggcccacaacggttgggtgatgggagacgatcctctgagaaatttcgccgaaccgggttcggaggtgtacttgcgccgcgaattgatctgctggggtgactcagtcaaactgagatacggcaataagccggaggactgcccgtacctctgggcccacatgaagaaatacaccgaaattaccgctacctattttcagggagtgagactggataactgccactcaactccgctgcatgtcgcagagtacatgctggacgcagcccgcaacctccaacccaacctctacgtggtcgcggaactgtttacgggctcggaagatctggacaacgtgtttgtgactcggttgggcatttcctcgctgatccgggaggccatgagcgcatataattcacacgaggagggacggttggtttatcgctacggcggagagcctgtcggatctttcgtgcagccatgccttaggccactgatgcctgcgatcgcccatgccctttttatggacatcactcatgacaacgagtgcccgattgtccataggagcgcctacgacgccctgcccagcaccaccatcgtgtcgatggcttgctgcgccagcggatcaaccagggggtacgacgaattggtgccgcatcagatctccgtggtgtcggaggaacggttctacaccaaatggaacccagaagcgctgccctccaacaccggggaggtgaacttccaatcgggtatcatcgcggccagatgtgccatctccaagctgcatcaagagcttggagccaaaggatttatccaggtttacgtcgatcaagtggacgaggatatagtggcagtgacccgccactccccgtccatccaccagagcgtggtggctgtgtcaagaaccgcattccgcaatcccaagactagcttctactcgaaggaggtcccgcagatgtgcatccctggcaaaatcgaagaggtggtcctcgaggcccgcactatcgaacggaacacgaagccataccgcaaggacgagaactcgatcaacggaactccagatattactgtggaaatccgcgaacacatccagctgaatgaatcaaaaatcgtgaagcaggcaggagttgccaccaagggaccgaacgagtacatccaagaaatcgagtttgagaacctgagtccgggaagcgtgatcatctttcgggtgtccctggacccgcacgcgcaggtcgccgtcggtattctccgaaaccatctgacccagttctcgccacatttcaagtcgggatcactggctgtcgacaatgcggacccgatcctgaagatcccgttcgcgtcgctggcctcgcggctcactctggcagagctcaatcagatcctctaccgttgcgagtccgaagaaaaggaagatgggggaggatgctacgacatccctaactggtcggccctgaagtacgcgggactccagggattgatgtccgtgctggccgagattaggccgaagaacgacctgggacatcccttctgcaacaacctccgctcaggcgactggatgatcgattacgtctccaatcggttgatctcgcgcagcggaaccatcgctgaagtgggaaagtggctgcaagctatgttcttctacctcaagcaaatcccacggtaccttatcccgtgttactttgacgcaatcctgatcggagcctacaccactctgcttgacactgcgtggaaacaaatgagctccttcgtgcaaaatggatccacgttcgtcaaacatctttcattgggctcagtccagctgtgcggagtgggcaagttcccgtcgcttcccattttgtcgcctgccctcatggacgtgccgtaccgcctgaacgaaatcaccaaggagaaagaacagtgctgcgtgtctctcgccgctgggctgccacacttctcatcgggaatttttcggtgctggggtcgcgataccttcatcgctctcaggggcattctgctgatcaccggtcgctacgtggaggcacgcaatatcatcctggccttcgcgggaacgctgcgacacgggttgatcccgaacctcctgggggagggaatttacgcacgctacaactgcagggacgcagtctggtggtggttgcagtgcatacaggattactgtaagatggtcccaaacggactggatatcctcaagtgcccagtctcccgcatgtacccgaccgatgacagcgcaccgcttcctgctggaactctcgatcagcctctcttcgaagttatccaagaagccatgcagaagcacatgcaaggaatccagttcagagaacggaacgccgggccgcagatcgaccgcaatatgaaagacgagggcttcaacatcactgctggagttgacgaagaaactggtttcgtgtacggtgggaatcggttcaactgtggaacctggatggacaagatgggtgaatcagaccgggcccgtaacagaggaatcccggctaccccacgcgatggctccgcggttgaaatcgtggggctctcgaaatcggctgtgcggtggctgctggagctgtccaagaaaaacattttcccataccatgaagtgaccgtgaagagacacggcaaggcaattaaggtcagctatgacgaatggaaccggaaaatccaagacaacttcgagaaactcttccacgtgtctgaggacccatccgacctgaatgagaagcatcctaacctggtgcataagcggggcatctacaaagactcatatggcgcgtcctccccctggtgtgattaccagctgcgaccgaacttcactatcgcaatggtggtggccccggaactctttaccaccgagaaggcgtggaaggcgctggagatcgccgaaaagaaactgctcggaccgctgggaatgaaaaccttggatccagacgatatggtgtactgcggcatttacgataatgcactggacaatgataactacaatctggccaaggggttcaactaccatcaaggaccggagtggctctggccgatcggatactttctgcgagcgaagctgtacttctcccgcctgatgggcccggaaacgaccgccaagaccatcgtgctggtgaagaatgtcttgagccggcattacgtgcatctggaacgcagtccctggaaaggcctgcctgagttgactaacgaaaacgcgcagtattgcccatttagctgcgagactcaggcttggtcgatcgcgactatcctcgagactctgtacgacctg

SEQ ID NO: 6128 - DNA, 4596 bp, Artificial Sequence
  Description of Artificial Sequence: Synthetic coding sequence
atgggacattctaaacaaatccgcattctgctcctgaatgaaatggaaaagctggaaaaaaccctgttccgcctggagcagggctacgagctgcagttccgtctcggtccgaccctccagggaaaggcagtgacggtctacaccaattaccccttccctggcgagactttcaaccgtgagaaatttcgatcgctcgactgggagaacccgactgaaagggaggatgattccgacaagtactgcaagctcaacctgcagcaatccgggtcttttcaatactacttcctccaaggaaatgaaaaatcggggggcggctacattgtcgtggaccctattctgcgcgtaggagcagacaatcatgtgctcccactcgattgtgtgactctgcaaaccttcctggcgaaatgcctcggaccgtttgatgaatgggaatcgcgcctccgcgtcgccaaggagagcggctacaacatgatccacttcaccccactgcagacgctgggattgtcgcggtcttgctactcgctggccaaccaactcgaactgaacccggacttctcacgccctaaccggaaatacacctggaacgacgttgggcaactcgtcgaaaagctgaagaaggaatggaatgtgatttgtataacggatgttgtgtataaccataccgctgccaactcgaagtggatccaggagcatcctgagtgcgcttacaatctggtgaactcgccacatctcaagccggcctgggtcttggatcgagcactctggcgcttctcgtgcgacgtcgccgaaggtaaatacaaggaaaaaggcatccccgctctgatcgaaaacgaccaccatatgaattccatccggaagataatctgggaggacatcttccctaaacttaagctctgggaattctttcaggtggacgtcaataaggcagtggagcagttccggcggctcctcactcaggagaacagacgggtcactaagtcagatcccaatcagcacttgaccatcattcaggacccggaatataggcggttcggatgcaccgtggacatgaatatcgccctgacgacctttattcctcacgataagggcccggctgcgatcgaagaatgctgtaactggtttcacaagagaatggaagaactgaattctgaaaaacaccgcctgatcaattaccaccaggagcaggccgtgaattgtcttttgggcaacgtcttttacgagagactcgcaggccacggaccgaagttgggaccagtgacccgcaagcacccactggtgacccgctacttcaccttcccttttgaggagatcgacttctcgatggaagagtccatgatccacctgccgaacaaggcctgctttctgatggcacataacgggtgggtgatgggagatgatcctctcaggaacttcgctgagccagggtccgaagtttacctccggcgcgagctcatttgctggggggattcagttaagctccgctacggaaacaaaccggaggattgtccctacctgtgggcgcatatgaagaagtacactgaaattactgccacctactttcagggcgtgagactggacaactgccattccaccccgctccacgttgcggaatacatgctggacgcagcaagaaacctgcagccaaacctttacgtggtggcagaactgttcactggatcagaggatctggataacgtgttcgtgacccgcctggggatctcgtccctgatcagagaagccatgtcagcttacaacagccacgaagagggacggctggtctaccggtatgggggagaaccggtgggcagcttcgtccagccgtgcttgcggccgttgatgccagctatcgcccatgccctgttcatggacattactcacgataatgaatgccccatcgtgcaccggtcggcctatgacgccctgccgagcactaccatcgtgtcaatggcctgctgcgcctccggaagcacccgcggatacgatgaactggtgccacaccagatctccgtggtcagcgaagaacggttctataccaagtggaatccagaagctctcccgtcgaacactggagaagtgaactttcagtcaggcattatcgcggctcgctgtgccatctctaagctgcaccaggaactcggtgccaaaggattcatccaggtctacgtggatcaggtggatgaggacatcgtggccgtgaccagacattccccgtctatccaccaatccgtggtggccgtgtccagaaccgcttttcgcaacccaaaaactagcttctactcaaaggaggtcccacagatgtgtatcccgggcaagatcgaggaagtggtcctcgaagctcggaccatcgagagaaacactaagccatatcgcaaagatgaaaactccatcaacggaactccggatatcaccgtggaaatccgcgagcatatccaattgaatgaatcgaaaatagtgaaacaagccggtgtcgctactaagggtcctaacgagtatatccaagagattgagtttgaaaatctgtcgcctggatccgtgatcatctttagggtttcccttgacccacacgcacaggtggctgtgggaattctccgtaaccacctgactcaattctcaccacatttcaagtcgggttccctggcagtcgacaacgccgatcctatcctgaagatccctttcgcgtcgctggcgtcaagactgaccctggctgagctgaaccaaatcctgtaccgctgcgaaagcgaagaaaaggaggacggaggaggctgctacgacatcccgaactggtcggccctgaagtacgccggactgcaaggactgatgtcggtgctcgcagagatcagaccgaaaaatgacctcggacacccattctgtaacaatttgagatcaggcgattggatgatcgattacgtgtcaaacagattgatctcacggtcgggtaccatcgctgaggtgggaaaatggctgcaggccatgttcttttacctgaaacagatacccaggtacctcatcccctgttacttcgacgccatcttgatcggagcgtacaccactttgctggacaccgcctggaagcagatgtcgtcatttgtccagaacgggagcacttttgtgaaacacctctccctggggagcgtgcagctgtgtggagtggggaaattcccgagcctgcctatcctgtcgccagcactgatggacgtgccgtaccggctcaacgagatcactaaggaaaaggaacaatgctgcgtgtcgctcgccgccggtttgccccacttctcgagcggtatcttccgttgctggggacgcgacaccttcatcgctctgcggggaatcctgctgattactggaaggtacgtggaagcaaggaatatcatactcgccttcgcaggaactctgcgacacggcctgatcccaaatctcctcggagaggggatctacgcccggtacaattgcagagacgccgtgtggtggtggctccaatgcatccaggactactgcaaaatggtgccaaatgggctcgacattctgaaatgtccagtgtccaggatgtacccgactgatgactcagccccgcttccagccgggaccctggaccagccgctcttcgaagtgatccaggaagccatgcagaagcatatgcagggcatccaatttcgcgaacggaatgcgggaccgcagatcgaccgaaatatgaaggatgagggcttcaacatcaccgcaggagtggatgaggagactggtttcgtctacggtggaaatcggttcaattgcggcacgtggatggacaagatgggcgaatccgatcgcgcccggaaccggggcatcccagcaactccgcgcgacggatcagccgtggagatcgttgggctctcaaagtccgccgtccgctggctgttggaattgagtaagaagaacattttcccataccatgaggtgaccgtgaagcgccacggaaaggcaatcaaagtgtcatacgacgaatggaacaggaaaatccaggacaacttcgaaaaacttttccatgtctccgaagatccctcggatctgaacgaaaagcacccgaatcttgtgcataagagaggcatttacaaggactcctatggcgcctcatcgccttggtgcgattaccagctgcgcccaaacttcactatcgccatggtggtcgcgcctgaactctttactacggagaaggcctggaaggccctcgagatcgcagaaaagaagctcttgggaccgctgggaatgaaaactctcgatccagacgacatggtgtactgcggcatctacgacaatgcgctggacaatgataactacaacctcgcgaaggggtttaactaccaccaaggtcctgaatggctctggccaattggatacttcctccgcgccaagctctatttctcccgcctcatggggccagagactacggctaagaccatcgtcctcgtcaaaaatgtgctctcgcggcattacgtgcaccttgaacggtcgccatggaaaggactgccggaactgacgaatgaaaatgcacagtattgcccattctcttgcgaaacccaggcctggtccatcgctaccatcttggagactctctatgacctc

SEQ ID NO: 6129 - DNA, 669 bp, Artificial Sequence
  Description of Artificial Sequence: Synthetic coding sequence
atgaacaagccactcttgtggatctcggtccttacttcgctccttgaggcattcgcacataccgatctctccggaaaggtctttgtgttcccacgagagtccgtgactgaccatgtcaatctgattacgcccctggagaaacccttgcaaaacttcaccctctgtttccgcgcctactcagatctgtcgcgggcctacagcctctttagctacaatactcagggtagagacaatgaactgcttgtgtacaaggaacgcgtgggagaatacagcctttacatcgggcgtcacaaggtaacctcaaaggtcatcgaaaagtttcctgcgccagtgcacatttgcgtttcatgggaaagttcctctgggattgccgagttttggataaatggaactcctcttgtgaagaaggggctgaggcagggctacttcgttgaagcacaacctaagatagtattgggacaggagcaagattcgtacggtggaaagtttgataggtcccaatcgtttgtcggtgaaattggcgatttgtatatgtgggactcagtgctcccgcctgagaacattttgtccgcataccaaggaactccgctgcccgcaaatatccttgactggcaggcccttaactacgaaattagaggctacgtgatcattaaacccctggtgtgggtg

SEQ ID NO: 6130 - DNA, 669 bp, Artificial Sequence
  Description of Artificial Sequence: Synthetic coding sequence
atgaataaaccactgctctggatttcagtgctcactagtctgctagaagcatttgctcatactgacctttcagggaaggtttttgtgttccctagggaaagtgttaccgaccacgtcaacctgattaccccgctcgagaagccgctgcagaacttcaccctgtgttttcgggcatactccgatttatccagagcctattcgctgttctcctataatactcaggggcgagacaatgagctgctcgtgtataaagaaagagtaggggagtactccctatacattggccggcataaagtgacatctaaggttatcgagaagtttcccgcacccgttcacatctgtgtatcatgggaatcgtcgtcaggaatagcagagttctggattaacggaaccccactagtcaaaaagggtttgaggcagggatacttcgtcgaagcccaaccaaagatagtgcttggacaggagcaagactcttatggaggaaagtttgatcggtcacagagcttcgtgggggagattggcgatttgtatatgtgggatagcgtattaccgccggaaaatattttgagcgcttatcagggaactcccctccccgctaacatcctggattggcaagcactcaattacgaaataagagggtacgttatcataaagccattggtctgggtc

SEQ ID NO: 6131 - DNA, 669 bp, Artificial Sequence
  Description of Artificial Sequence: Synthetic coding sequence
atgaacaaacccctgctctggatctccgtcctgacctccctgctggaagcattcgcccacaccgacctgtcgggcaaggtgttcgtgttccccagggaatcagtcaccgaccacgtcaacctcatcactccactggaaaagccgctgcaaaactttacgctttgctttcgggcatactcggatttgtcccgggcatattcactgttttcgtacaacactcagggaagagataatgaactcctggtctacaaggagcgggtcggagagtactcgctttacatcggacgacacaaggtgacgagcaaggtgatcgaaaagttcccggctccggtgcacatctgcgtgtcgtgggagtcgtcatcaggtatcgccgagttctggatcaatgggaccccactggtgaagaaggggctgcggcaaggctacttcgtcgaggcccagccaaagatcgtgctgggccaggaacaggattcgtacggaggaaagttcgaccggtcccaatccttcgtgggtgagatcggggacttgtacatgtgggactcggtgctgccgcctgaaaacattctctccgcttaccagggcaccccgctgccagcgaatatccttgattggcaggcactgaattacgagattcgaggctacgtgatcatcaaaccgctggtgtgggtc

SEQ ID NO: 6132 - DNA, 669 bp, Artificial Sequence
  Description of Artificial Sequence: Synthetic coding sequence
atgaacaaaccactactctggatcagcgtattaactagtttactggaagctttcgcccatacggacctttcaggcaaggtgtttgtattcccccgcgagagtgtcaccgaccatgttaatttgataactccgttagagaagccgctgcagaatttcacactgtgctttagagcctactctgacctcagccgggcttactctcttttttcatataatactcaaggtcgggataacgaattgctggtatacaaagaacgagtaggggagtattccttgtacataggtcgacataaagtgacatccaaggtgattgaaaagttccctgcgccagtgcacatctgtgtaagttgggagagcagctccggcatagctgagttttggatcaacggcacacccttggtgaagaaaggcctgagacaggggtatttcgtggaggcccagccaaagattgtcctgggtcaagagcaggactcatacggcggtaaattcgataggtcccaatcttttgtcggggaaattggagacctgtacatgtgggattctgtcttgccccccgaaaatatcctctccgcatatcagggcacaccccttcctgctaacattctggattggcaggcgttgaactatgagatacggggatatgtgataatcaaacctctggtgtgggtt

SEQ ID NO: 6133 - DNA, 669 bp, Artificial Sequence
  Description of Artificial Sequence: Synthetic coding sequence
atgaataagcctttgctctggattagcgtccttacctcactgctggaagcattcgcacatactgacctgtccggaaaggtgttcgtgtttccgcgggagtccgtcaccgaccatgtgaacctgatcacgccgttggaaaagccgcttcagaactttaccctgtgcttccgcgcgtactcggacctcagcagagcctactccctctttagctacaatactcaggggcgggataatgagcttctggtgtacaaggagcgcgtgggagagtactccctgtacattggacgccacaaggtcacttccaaggtgattgaaaagttccccgcaccggtgcatatctgcgtgtcgtgggagagcagctccggaatcgctgagttttggattaacgggaccccgctggtgaagaaaggactgcggcaaggatacttcgtggaagcccagccgaagatcgttctgggccaggaacaagattcgtacgggggcaagtttgaccgcagccagtctttcgtgggagaaatcggtgacctctacatgtgggacagcgtgttgccaccggagaacatcttgtccgcttatcagggcaccccgctgccggccaatatccttgattggcaggcgttgaactacgaaattagaggttacgtgatcatcaagcctctggtgtgggtc

SEQ ID NO: 6134 - DNA, 669 bp, Artificial Sequence
  Description of Artificial Sequence: Synthetic coding sequence
atgaacaagccgctcttgtggatctccgtcttgacctcgctgctggaggccttcgctcacacggacctctctggaaaggtgtttgtctttccgcgcgaatcggtgacggatcatgtgaatcttattactccgctcgagaagccccttcaaaactttaccctctgcttcagggcatacagcgatctgagtcgcgcgtactcgctcttctcgtacaatactcagggtagagacaatgaactgctggtctacaaagaacgggtgggagaatatagcctgtacattggacgccacaaggtgacctccaaggtgatcgagaagttcccagccccggtacatatatgtgtctcttgggaatcctcatcgggcatcgctgaattctggatcaacggaaccccgcttgtcaaaaagggcctccggcagggttacttcgtggaggcccagcccaaaatcgtgctcggacaagagcaagactcatacgggggcaaatttgatcgatcgcagtcgttcgtgggggaaattggagacttgtacatgtgggactccgtcctccccccggaaaacatactttcagcataccagggcactccactgcctgccaacatcctggattggcaggcgctgaattatgaaatcagaggttacgtgatcatcaaaccactggtgtgggtc

SEQ ID NO: 6135 - DNA, 669 bp, Artificial Sequence
  Description of Artificial Sequence: Synthetic coding sequence
atgaacaaaccgttattatggatcagtgttcttacatcactgttagaagcgtttgcccacactgatctttcggggaaagtgttcgtatttcctcgtgagtccgttacggaccatgtcaacctgattacccctcttgaaaaacctcttcagaatttcactttatgttttcgagcgtacagcgacctgtctagagcgtattccttgttctcttacaatacccaaggtcgcgataacgagctattagtttacaaagaacgcgtaggcgaatactcactttacattggacgacacaaagtcacgagcaaggtgatagaaaagttccctgctccagtgcatatatgcgtttcatgggaatcatctagtggcatagccgaattctggattaatggaacgccgttggtgaaaaaaggacttcgccaaggatattttgttgaagctcaacctaagattgtccttggccaggagcaagatagctatggcggcaaatttgatcgttctcaaagctttgtcggcgaaattggcgatctatatatgtgggactcagtgttgccgccggaaaatatcctctccgcttatcaaggcacccctctgccggctaatatcctagattggcaagctcttaattacgaaattcggggatatgtcattataaaaccgctggtgtgggtc

SEQ ID NO: 6136 - DNA, 669 bp, Artificial Sequence
  Description of Artificial Sequence: Synthetic coding sequence
atgaacaaaccactcctgtggatttctgtgctcacttccttgttggaggcattcgcccacactgacctgtctggtaaggtatttgtcttccctagggagtccgttacagatcacgtgaaccttatcacccctttggaaaagccactgcagaacttcaccctctgctttcgcgcctacagcgatctgtctcgcgcttacagcctgttttcctataatacacagggtcgcgacaacgagttgctggtatacaaggagcgcgtgggagagtattcactgtacattggaagacacaaagtcacttctaaagtaatagagaagtttcccgcccccgtgcacatctgcgtcagctgggagtcttcaagcggcatcgcagagttctggatcaatggaactcctttggtcaaaaagggccttcgccagggctactttgtcgaggcccagcctaagattgtgttgggacaagagcaggactcttacggtggtaagtttgacagaagtcaatcttttgttggtgagatcggagacttgtatatgtgggattcagtcctgccccctgagaatattctgagcgcctaccaaggaactcctttgcccgctaacatccttgactggcaggccctcaactacgagatccgcggctatgttataattaagcctttggtctgggtg

SEQ ID NO: 6137 - DNA, 669 bp, Artificial Sequence
  Description of Artificial Sequence: Synthetic coding sequence
atgaataaaccgctcttgtggatctcagtgctgaccagcctgcttgaagctttcgctcatacagacctgagcgggaaagtctttgtcttcccccgtgaatcagtgaccgaccacgtgaatttaattacacctcttgaaaaaccacttcagaattttacgctttgtttccgagcatacagcgacctttctcgtgcatactccctcttttcttacaatactcagggtcgtgataacgaactattggtttataaggaacgagtaggtgagtattcactttacataggaagacataaggtcacctcgaaagttatcgagaagtttccagcccctgttcatatctgcgtcagctgggagtctagctctggcattgcggaattttggattaatggtaccccgcttgtgaagaaaggcttgcgccagggttacttcgttgaggcgcaacccaaaatcgtgctgggtcaggaacaggactcttacggcggtaaattcgatcggtctcaatccttcgtcggcgagattggcgacctttacatgtgggactcggttctgcctccagagaacattctctcagcgtaccagggcacccctcttcctgcaaacatcttagactggcaagccttgaactatgagatcaggggctacgttattattaagccacttgtatgggtc

SEQ ID NO: 6138 - DNA, 669 bp, Artificial Sequence
  Description of Artificial Sequence: Synthetic coding sequence
atgaacaaaccgctcttgtggatttcggtgctaacgtccctgcttgaggcgtttgctcacacagatctgtcaggcaaagtgtttgtctttccacgagaaagtgtgactgaccatgtgaatttaataacacctctggaaaaacctctacagaacttcacactttgtttccgcgcgtatagcgacttatcacgtgcctatagtctcttttcttataacacacaaggaagggataacgagctcctcgtgtataaagagagggtcggcgagtacagcctgtacatcggcaggcataaggttacgtccaaggttattgaaaagtttccagcacctgtccacatctgcgtcagctgggagtcaagttccggcatcgccgaattctggatcaatggcacccccctcgtgaaaaaaggcctgaggcagggttatttcgtagaagctcagccaaaaattgtgctggggcaggaacaggacagttacggagggaaatttgaccgaagccagagcttcgtcggagaaatcggcgatctctacatgtgggacagtgtgctgcctcctgagaatatcctctcagcatatcaaggcacacctcttcccgctaatatccttgactggcaggctctcaactacgagataagaggatacgttatcattaaaccgctggtctgggtt

SEQ ID NO: 6139 - DNA, 669 bp, Artificial Sequence
  Description of Artificial Sequence: Synthetic coding sequence
atgaataaacccctgctttggatcagcgtgcttacctccctgctggaagcatttgcacacaccgatctgtcaggaaaggtgttcgtgtttccgcgcgagagcgtcacggatcacgtgaacctcatcactcctctcgaaaagcctttgcaaaacttcacgctttgcttccgggcctacagcgacctgtcccgagcatactcgctgttctcatataacacccaggggcgcgataacgagctgcttgtctacaaggaaagggtgggggaatacagtctgtacatagggcggcataaagtcacctccaaggtgatcgagaagttccccgcgccagtgcatatttgcgtgtcttgggaatcatcaagtggaatcgctgaattttggatcaatggaaccccgctggtcaagaagggactgcggcagggttatttcgtggaagcccagccgaaaattgtcctgggacaagaacaggattcttacggaggcaagttcgaccgtagccagtcctttgtgggagaaattggcgacctttacatgtgggactcggtgttgccaccggagaatatcctgtcagcctaccagggaactccgcttccggctaacatccttgactggcaagcgttgaattacgagatcagagggtacgtgattatcaaaccactggtttgggtc

SEQ ID NO: 6140 - DNA, 669 bp, Artificial Sequence
  Description of Artificial Sequence: Synthetic coding sequence
atgaacaaaccattgctttggatctcggtgctgacatctctgcttgaagcattcgctcatactgatctgagcgggaaggtattcgtcttcccgagggagtctgtgacggatcacgtgaacctcataacccctctcgaaaagccgcttcagaactttacactgtgcttcagggcttactccgatctctcaagggcctacagcctgttcagctacaatacacagggtcgggataacgaactgcttgtgtataaggagcgagtgggcgaatattcactgtatattgggaggcacaaggttaccagcaaggtcatcgaaaagttcccagccccagtccacatatgtgtgtcttgggagagctcttctggtattgcagaattttggatcaatggaacacccctcgtcaaaaaagggctgcggcaaggttacttcgtggaagcacaacccaagattgtgctgggccaagagcaggactcatacggaggcaagtttgaccggagccagtcttttgtgggagagatcggcgacctttacatgtgggatagtgtcttgccacctgagaatattctctctgcatatcaaggcacccccctgcccgccaatatcctggactggcaagcactgaactacgagatcaggggatatgtaatcatcaagccccttgtgtgggtg

SEQ ID NO: 6141 - DNA, 669 bp, Artificial Sequence
  Description of Artificial Sequence: Synthetic coding sequence
atgaataagccactgctctggatatcggtcctgacttcattgctcgaggcctttgcacataccgacctgtccgggaaagtctttgtctttcccagggaatcagtgactgatcacgtcaatctgattacccctctggagaagcccctgcaaaacttcacgctttgctttagagcatactccgatctgtcccgggcctattcacttttttcgtacaatactcaaggtagagataacgagctcctcgtgtacaaggaacgggtgggtgaatactcgctttacattggtcgccataaggtgaccagcaaggtgattgaaaagttccccgcacctgtccatatttgtgtcagctgggagtcgtcgtccgggatcgcagaattttggattaacggaaccccgctggtgaagaaaggactgcgccagggatacttcgtggaagcacaacccaaaatagtgcttgggcaagaacaagactcctatggcggtaagttcgacagatcacagtcatttgtgggcgagatcggggacctgtacatgtgggattccgtccttccgcccgaaaacatcctctcggcatatcagggcaccccgctgccggcaaacattctggattggcaggccctcaattacgagattcgtggttacgtgatcatcaaacctctggtctgggtc

SEQ ID NO: 6142 - DNA, 669 bp, Artificial Sequence
  Description of Artificial Sequence: Synthetic coding sequence
atgaacaagcctctgctctggatctcggtgctgaccagccttctggaggcctttgctcataccgatctgtcaggaaaagttttcgtgtttcccagggaatccgttacagaccacgtgaacctcattacccccttagaaaagcccctccagaactttaccttgtgcttcagagcttactcagacctatctagagcctactctctcttcagctacaacacccagggcagagacaatgaacttctcgtatataaagaaagagtcggcgagtactccctctacattggcaggcacaaggttacatccaaggtgatagagaaatttccagccccagtccacatctgcgtgtcatgggagtcaagtagtggcattgcagaattctggatcaatggaacccccctcgttaagaagggacttcgtcaaggttacttcgtcgaggcccagcccaaaatcgtcttagggcaggagcaggattcgtacggaggaaaatttgacagatctcaaagctttgtcggggagattggcgatttgtatatgtgggattctgtgcttccccctgaaaacatcttgtccgcatatcaagggacccctttgccagccaacatcctggactggcaagctctgaactatgaaatcaggggatatgtgattattaaaccactggtgtgggtg

SEQ ID NO: 6143 - DNA, 669 bp, Artificial Sequence
  Description of Artificial Sequence: Synthetic coding sequence
atgaacaaacctctactgtggatttccgttctgacaagtttactggaggcctttgctcatactgacctgtcaggcaaggttttcgtgttcccacgggaatctgttacggatcacgtgaacctcatcactccacttgagaagcccttgcagaactttaccctttgctttagagcctactctgacctcagccgtgcatattccctgttttcctacaatacacagggcagagacaatgagcttctcgtttacaaagagcgcgttggagagtactccctgtatattgggcggcataaggtcacctcgaaggtgattgaaaaatttccagcacccgtgcacatatgtgtgtcttgggaatcatctagcggcatagccgagttttggataaacgggacaccactcgtgaagaaggggttgagacagggctactttgtggaagcccagcccaagatcgtcttgggtcaagaacaggactcatacgggggaaaattcgacagatcacagtcttttgttggggagattggagatttatatatgtgggattccgtgctgcctcctgaaaacatcctgagtgcctaccagggcacccctctccctgccaacatattggattggcaggctctcaattacgaaattagggggtatgtcatcataaaacccctggtttgggtt

SEQ ID NO: 6144 - DNA, 669 bp, Artificial Sequence
  Description of Artificial Sequence: Synthetic coding sequence
atgaataagcccctcctttggatctccgtgttgacaagtctcctagaagcctttgcccatactgacctctcaggaaaggtgtttgtattcccacgcgaatctgtgacagatcacgtgaatctcatcacacccctcgaaaaaccactgcagaacttcacactctgctttcgggcctattcagatctctcacgcgcttactcgctcttttcgtataacacacaggggcgggacaatgaactgctcgtgtataaagaaagggtaggggaatacagtctatatatagggcggcacaaagttacttctaaagttatcgaaaagttccctgcacccgtgcatatctgcgtgtcttgggaatcctccagtggaatagccgaattttggattaatggaactccgctcgtaaagaaaggactccggcagggatattttgtcgaggctcagcctaaaatcgttctgggacaggaacaggattcttatgggggaaagttcgacaggtctcagtccttcgtgggagaaatcggagatctatatatgtgggattctgtgctcccacctgaaaatattctcagtgcctaccaggggacacccctccctgctaacatacttgattggcaggctctgaattatgaaatacgggggtatgtgatcataaaacccctggtttgggtt

SEQ ID NO: 6145 - DNA, 669 bp, Artificial Sequence
  Description of Artificial Sequence: Synthetic coding sequence
atgaacaaacctctgctttggatttctgttctgacatctttgttggaggctttcgctcatactgatttgtctggtaaagtttttgttttcccaagggaaagcgttactgatcatgttaatttaattactcctttagagaagccactacaaaattttacattgtgtttccgagcttactcggatttgtccagagcttacagtttgttcagctacaacactcaaggacgagataatgagcttcttgtatataaggaaagggttggtgagtattcattatacattggtaggcataaagttacatcaaaggtgatagagaaattccctgctcccgtgcatatctgtgtttcttgggaatcgtcttcgggtatcgctgagttctggattaatggaactcctttagtcaaaaaagggttaaggcaaggctattttgtggaggcacagccaaagatagttctaggtcaagagcaagattcgtacggcgggaaattcgatcgctcacagtcattcgtgggggaaataggggatctttacatgtgggattcagtactccctcccgaaaacatactcagcgcttatcagggaactcccttgcctgcaaacattttggattggcaggctctcaactacgagattaggggttatgtaatcataaagccattggtttgggtg

SEQ ID NO: 6146 - DNA, 669 bp, Artificial Sequence
  Description of Artificial Sequence: Synthetic coding sequence
atgaataagcccctcctatggatatctgtcctaacttccctcctcgaagcttttgctcacactgatctgtccgggaaagtgttcgtttttccccgcgaatccgtgacagatcatgtaaatttgataactccactggaaaaaccactccagaacttcacactctgctttagggcttacagtgatctcagtagggcgtattccctcttctcttataacacacaggggagagacaacgagctgcttgtgtataaagaacgtgttggagaatattctctgtatatcgggaggcataaagtgacatcaaaggtgatcgaaaaatttcccgctcccgtgcatatatgtgtatcttgggagagtagttcagggatagcagaattttggattaacggaacaccactggtgaagaaaggactcaggcaggggtacttcgtggaagctcagccaaaaatcgtcctggggcaggaacaggattcttatggagggaaatttgatcgctcacagtcgtttgtcggagaaataggagatctgtacatgtgggactccgtgcttcctcccgaaaacatcctttctgcttatcaaggaactcccctacccgctaacattctggattggcaggctctcaactacgaaataagaggatacgttattattaaacccctggtatgggtt

SEQ ID NO: 6147 - DNA, 669 bp, Artificial Sequence
  Description of Artificial Sequence: Synthetic coding sequence
atgaacaagcctctcttatggatctctgtgctgacgagccttctggaagcattcgcccacactgatctgtcaggcaaggtattcgttttcccccgagagtctgttactgatcacgtcaatctgataacacctctagaaaaaccgctgcagaattttacattgtgtttccgggcatacagcgatctctcacgggcctactccctgttcagctataatacccagggcagggacaatgagctactcgtgtataaggagcgtgtgggcgagtattcactctacatcggcaggcataaggtaacgagcaaggttattgagaagttccccgcacctgtgcatatctgtgtgagctgggaatccagctccggcattgcagagttctggattaatgggactcccctggtgaaaaaaggtctgcggcaggggtatttcgtggaagcacagcccaagattgtgctcggacaagagcaggattcctatggtggcaaatttgaccggtcccagagcttcgtgggagaaatcggcgacctgtatatgtgggatagtgtcctgccaccagagaacatcctgtccgcctaccagggaacccctttgcccgctaacatattggattggcaagctttgaactacgagatcagggggtatgtcattatcaaaccattggtgtgggta

SEQ ID NO: 6148 - DNA, 669 bp, Artificial Sequence
  Description of Artificial Sequence: Synthetic coding sequence
atgaacaagcctttactgtggatcagtgtgctcacttctctgctcgaggcatttgcgcacaccgacctttcggggaaagtgtttgttttccctcgggaatcagtcacggatcacgtgaacctcattacccccttagagaaacctctccagaatttcaccctgtgctttcgggcttactcggacctgtccagggcctacagcctgttctcttataacacccagggcagggacaacgaactcctggtgtataaggagagagtcggagaatattctctgtacattgggaggcataaggtaacatctaaggtgattgagaaattccccgctcctgtccatatctgtgtttcctgggaaagcagcagtggtatcgcagaattctggatcaacggcacccctctggtcaagaaggggcttagacagggttatttcgtggaggctcaacccaaaatcgtcctcggccaggagcaggatagctatggtggtaaatttgacaggagtcagtcctttgtaggggaaattggtgacctgtacatgtgggactcagtactcccacctgaaaacatcttgagcgcttatcaaggaactcctctgccagccaacattctggactggcaggctctaaactatgagatccggggatacgtgatcatcaagccattagtgtgggtc

SEQ ID NO: 6149 - DNA, 669 bp, Artificial Sequence
  Description of Artificial Sequence: Synthetic coding sequence
atgaataagcctctgctttggatttctgtgcttaccagcctcctggaagcctttgcacacacggatctctccgggaaagtttttgtctttccacgggagtcagttactgatcatgtcaacctgatcaccccactcgagaagccattgcaaaacttcactttgtgttttagggcctattccgatttgtccagagcatactcgctcttctcatacaatactcagggacgagataacgaacttctcgtgtacaaagaacgggttggcgagtacagcctgtacatcggtaggcacaaggtcacctctaaggtcattgaaaagtttcctgccccggtgcatatttgcgtgtcttgggaaagtagttccggtattgcagagttttggataaatgggactcccctcgtgaagaaaggccttaggcaaggatacttcgtcgaagctcagcctaagatcgtccttggtcaagaacaggactcgtacggagggaagttcgacagatcgcaatccttcgtcggtgagattggtgatctgtacatgtgggatagcgtgttgcctcctgaaaacatcctgagcgcgtaccaaggaacccctctgcccgcaaacatattggattggcaggcgcttaactacgagatccgaggctatgtgatcatcaaaccgctggtgtgggtg

SEQ ID NO: 6150 - DNA, 669 bp, Artificial Sequence
  Description of Artificial Sequence: Synthetic coding sequence
atgaacaagcctctcctctggattagcgtgctgactagtctgctagaggcctttgctcataccgacttaagcggtaaggtgttcgtatttccacgggagtccgttacagaccatgtgaacttaatcaccccgctcgaaaaaccactccagaattttaccctgtgtttcagagcatactcagatctgagtagggcttactctttgttctcttataatacgcagggtagggataatgaactgctggtgtataaggagcgggtgggggagtactctctgtacatcggcaggcataaggtcacctccaaagtcatcgagaagtttcctgcacccgttcacatttgtgtttcatgggagagctcctcaggaatcgcggaattttggataaatgggacgccactggttaagaagggcttgcggcagggttactttgtggaggctcaacccaaaatcgtcctgggccaggagcaggactcttacggcggaaagttcgatcggagtcagtcgtttgttggagagatcggagatctatatatgtgggatagtgtcttgcccccggagaacatcctatcagcgtaccaagggacgcccctcccggcgaacatcctggattggcaggctctgaactacgaaatccgaggctacgtgatcatcaagcccctcgtatgggtg

SEQ ID NO: 6151 - DNA, 669 bp, Artificial Sequence
  Description of Artificial Sequence: Synthetic coding sequence
atgaataaaccactcctgtggatctccgtgctgacctccttgctggaagcatttgctcacaccgacctcagcgggaaagtgtttgtgtttccccgcgagtccgtgactgaccatgttaacctcataactcctctcgaaaaacctcttcaaaacttcacgctttgttttagagcatactcggacctctcacgcgcatattctcttttctcctacaatacccagggtagagataacgaactgcttgtctacaaggagagggtgggagagtacagcctctacatcggccgccataaagtcactagcaaggtgatagaaaagttccctgcaccagtgcacatttgcgtgtcgtgggagagcagcagcggaatcgcggagttttggatcaacgggacgcctcttgtcaagaagggtctgagacagggatactttgtcgaagcacagccaaaaatcgttctgggacaggagcaagactcctatgggggaaagttcgacaggtcgcaatcgtttgtgggggagattggggatctttacatgtgggattccgtattgccccctgaaaacattctgtccgcataccagggaacccctctgccggcgaacatactggattggcaagcactgaactatgagattcgcggttacgtgattatcaagcctcttgtgtgggtg

SEQ ID NO: 6152 - DNA, 669 bp, Artificial Sequence
  Description of Artificial Sequence: Synthetic coding sequence
atgaacaaaccattactgtggatcagtgtgttgacaagcttgctggaggcattcgcacatacagatttgtcgggtaaggtgtttgttttcccaagagagagcgtgaccgatcatgtgaatctgatcacgcccctagagaagccattacaaaactttaccctctgtttccgagcgtattctgacctgtcgagagcctatagtttgttctcatacaacactcagggtagggataacgagctgctcgtatataaggagagggtcggagaatatagcctgtacataggccgccataaggtcacttccaaggtcatcgagaagttcccagcccccgtgcacatttgcgttagctgggagtcctcgtcgggaatagccgagttctggatcaatggcaccccccttgtgaagaagggactgcgacagggctattttgtggaagcccagcccaaaatcgtgctgggccaggaacaggatagttacggcggaaagtttgatcgcagccaaagttttgttggtgagatcggcgatctctatatgtgggactcggtacttccaccggagaatattttgtccgcttaccagggaactcccctgcctgcaaatatactggactggcaggcactgaactacgagatccgaggttacgtcattatcaagcccctcgtgtgggtg

SEQ ID NO: 6153 - DNA, 669 bp, Artificial Sequence
  Description of Artificial Sequence: Synthetic coding sequence
atgaacaagcctctcctctggatctccgtgctgacgagccttctcgaggctttcgctcacaccgatctatccggaaaggtcttcgtcttcccgcgtgagagtgttactgaccacgtgaatctcatcacgccgctcgaaaaacccctacagaactttaccttgtgttttcgggcctactcggacctctcccgtgcgtatagcctattcagttacaacacgcagggccgcgacaacgagttactggtttataaggagcgtgtcggcgagtactctctctacattggccgtcacaaggtgacctccaaggttattgagaagttcccagcccctgttcacatctgtgtctcctgggagagttcgagcggtatcgctgagttttggatcaacggtacacccttggtcaagaagggacttcgtcagggttattttgtagaggcccagcccaagatagtactaggacaggagcaggactcttatggcggtaagttcgatcgttcccaatccttcgttggtgagatcggcgacctctacatgtgggatagtgtgctccctccggaaaacattctgtccgcatatcagggcacacccctccctgccaacattctagactggcaggcgctgaactatgaaattcgtggctatgtgatcattaagcctctcgtatgggtg

SEQ ID NO: 6154 - DNA, 669 bp, Artificial Sequence
  Description of Artificial Sequence: Synthetic coding sequence
atgaacaaacctctgctgtggatcagcgtgcttactagcctgctggaggccttcgcgcataccgacttgagcggaaaggtatttgtctttccgcgagagtcagtgaccgaccacgtcaatctcatcactccgctcgaaaagccactgcagaatttcaccctgtgctttagggcctactccgatttgagccgggcctactccctgttctcatataacacgcaaggacgcgacaatgagttgcttgtgtacaaagagagagtgggtgaatacagcctctacatcggcagacacaaggtgacttcgaaagtgatagagaaattccccgctccagtgcatatttgtgtgtcctgggagagctcctccggaatcgcggagttctggatcaacggaactccactcgtcaagaagggactcagacagggctatttcgtggaagcccagccgaagatcgtgcttggccaggaacaggactcatacggcgggaagttcgatcgctcgcagtcgttcgtaggtgaaattggagatctgtacatgtgggactctgtcctgcccccagagaatatcctgtccgcctaccaggggactcctctcccggccaacatcctcgactggcaggcattgaattatgaaatcagagggtacgtcattatcaaaccactcgtgtgggtc

SEQ ID NO: 6155 - DNA, 669 bp, Artificial Sequence
  Description of Artificial Sequence: Synthetic coding sequence
atgaataagcccttgctctggatcagtgtattgacaagcctccttgaagccttcgctcataccgacctgtccggtaaagtatttgtcttcccccgagagtccgttaccgatcacgtgaacctcataaccccactggaaaaacccctgcaaaacttcacactctgctttcgcgcctactctgacctgtcccgcgcctattctttgttttcatataatacacagggccgagacaacgagctcctggtttacaaagaaagggtaggagaatattccctgtacatagggcggcacaaagtcacttccaaggttattgagaaattccccgcgccagtccacatctgcgtgagctgggagtcaagttctggaattgcagagttttggattaatggtactccgttggtcaagaagggtctgagacagggttacttcgtggaggctcaacctaagatagtgctcggacaagagcaggactcatatggcggcaagttcgacaggtcccagtcatttgtcggagaaataggagatctctacatgtgggatagcgtactcccccctgagaacattctgagtgcataccagggcaccccactgcccgcgaacatactggactggcaggctctcaattatgagatcagggggtatgtgatcattaagcctctggtgtgggtc

SEQ ID NO: 6156 - DNA, 669 bp, Artificial Sequence
  Description of Artificial Sequence: Synthetic coding sequence
atgaacaagccactgctctggatttccgtgctcacgtctctgttggaggcgttcgcccatactgacttgtctggcaaggtgttcgtcttcccacgagagagcgtcaccgatcacgtgaacctcattacacccctcgaaaaacccctgcagaattttacactctgctttcgagcgtacagtgacttgagcagagcatatagtctgttttcatataacacacagggtcgcgacaacgagctattggtttataaagaacgagtgggcgaatatagcctttacatcgggcgccacaaagttacaagtaaggtcatcgaaaagttcccggctccagtacatatttgtgtctcttgggagagttcctctggaatcgcagagttctggatcaatggtacaccactcgtgaaaaagggactgaggcagggatactttgtcgaggcccaacctaagatcgtgttgggccaggagcaagactcgtacggcgggaagtttgacagaagtcagagttttgtgggcgaaattggcgacctgtatatgtgggacagtgtgttgccccctgagaatatcttatccgcctaccaaggtactccactccctgctaacatcttagattggcaagcacttaactacgaaatcaggggatatgtgatcattaaacctttggtctgggtt

SEQ ID NO: 6157 - DNA, 669 bp, Artificial Sequence
  Description of Artificial Sequence: Synthetic coding sequence
atgaacaagcctctcctgtggatctctgtgctcaccagcctgctggaagccttcgcgcataccgaccttagtggaaaagtgtttgtcttccccagggaatccgtaactgatcacgtcaacttaataacccctctggagaagcctctccagaacttcacactctgtttcagagcctattctgatttgagcagggcatattctctattctcctataacactcaggggcgagataacgagttgctcgtgtataaagagagagtcggagaatacagcctctacatcggacgccacaaggttactagcaaggtgatcgaaaagttccccgcccctgtacatatctgcgtgtcttgggagtcttctagcggaattgcagaattctggatcaatgggacgcctttagtgaagaaggggctcagacagggctacttcgtggaggcccagcccaaaatcgtgttaggacaagagcaggactcatatggcggtaagttcgaccgaagccagtccttcgttggcgaaatcggcgacctctacatgtgggactctgtgttgccgccagagaacattctctcagcataccaggggacacctctgcccgctaacatcctcgattggcaagccctcaactatgagattaggggatatgtaattattaagcctctggtttgggtt

SEQ ID NO: 6158 - DNA, 669 bp, Artificial Sequence
  Description of Artificial Sequence: Synthetic coding sequence
atgaataagcccctgttgtggatttcagttctgacatcgttactcgaggccttcgctcataccgacctttctggaaaggtgttcgtttttccaagagagtccgtcactgatcacgtgaaccttatcacacctctggagaaacctttgcaaaatttcaccttgtgttttcgcgcgtactccgatctatctagagcgtattctctattctcttataacacacagggtagagacaatgaactgcttgtgtataaagagcgtgttggcgagtactctctttacatcggcagacacaaggtgacttcaaaagtcatcgaaaagtttcccgcaccggtccacatttgcgtctcgtgggagagcagctctggtatcgctgagttttggatcaacggaacccctctggtcaagaaaggtctaagacaaggttattttgtggaggctcaacctaagatagtgctgggacaggaacaggattcttatggcgggaagtttgaccggtcccagtctttcgtgggagagatcggagatttgtacatgtgggactcagttttgccacctgagaacatcctgagtgcatatcaaggcacaccactgcccgcaaatatcctggactggcaggccttgaattatgaaataaggggctatgtgattatcaaacctctggtctgggta

SEQ ID NO: 6159 - DNA, 669 bp, Artificial Sequence
  Description of Artificial Sequence: Synthetic coding sequence
atgaataagcccctcctgtggatcagcgtcttgacgtccctcctggaagcgttcgcccataccgacttgtcaggaaaagtgttcgtgtttccgcgggaatcagtgactgatcacgtgaacctcatcaccccgctggagaagccactgcaaaatttcactctttgtttcagggcctattcggacctgtcgcgggcgtacagcctcttttcgtacaacacccaaggacgcgataacgaactcctggtctacaaggagagagtcggagaatactccctttacattggccgccataaggtcaccagtaaggtgatcgaaaagtttccagcacctgtccacatctgcgtgagctgggaatcttcgtcagggatcgctgaattctggatcaacggaactcctctggtgaaaaagggattgagacaaggatacttcgttgaggcccagccaaagatcgtgctcggtcaggaacaggatagctacggcggcaaattcgaccgctcccagtccttcgtcggagagattggtgacctgtacatgtgggattcggtgctgcctccggagaatatcctgtccgcataccaggggactccgctgccggctaacatcctggactggcaggccctcaactacgagatccggggctacgtgatcattaaacccctggtgtgggtg

SEQ ID NO: 6160 - DNA, 669 bp, Artificial Sequence
  Description of Artificial Sequence: Synthetic coding sequence
atgaacaagcccctcttgtggatctcagttcttacctccctgcttgaggccttcgcccacacggacctctcgggaaaggtctttgtctttccaagggagtcggtgactgatcatgtgaatctgatcaccccgctggaaaaacctctgcagaactttactctgtgttttcgcgcatactcagatctgtcccgggcctactcgctgttctcctacaacacgcagggacgcgacaacgaactgttggtctacaaggagagggtgggagaatacagtctgtacatcggccggcataaggtcacctcaaaagtgattgaaaagttccccgctcctgtgcacatttgcgtgtcatgggagagctcatcaggcatcgctgaattctggatcaatggtaccccgttggtgaagaaaggtctgaggcaaggatatttcgtggaagcccagccaaaaatcgtgctcggacaagaacaggactcctacggcgggaaattcgacagatcccagtctttcgtgggcgaaatcggagatctgtacatgtgggactccgtgttgcccccggagaacatcctgtcagcgtaccagggaactccactcccggccaatatccttgattggcaggccctgaactacgaaatcagagggtacgtgattatcaagcccctggtgtgggtc

SEQ ID NO: 6161 - DNA, 669 bp, Artificial Sequence
  Description of Artificial Sequence: Synthetic coding sequence
atgaataaaccactcctgtggatttcagtactgacatcattactcgaggcttttgcacataccgatttgagtggcaaagtctttgtcttcccgcgcgagtccgttactgatcacgtgaatctgatcacacctcttgagaagcctctccaaaactttacactgtgctttcgggcttattccgacctgagtagggcgtattcactgttctcttataatacccagggtcgggacaatgagctactcgtgtacaaagagcgggttggggagtattcgctgtatataggaagacacaaagtgactagtaaggtgatcgagaaatttccagccccagtgcacatctgtgtaagttgggagagctcatccggcatcgcagaattttggatcaatggaacaccgctcgtcaagaagggcctccggcaggggtacttcgtggaggcgcagcccaagatcgtgctgggtcaggaacaggattcctatgggggcaaattcgatcggtcccaaagctttgtgggggaaatcggggatctatatatgtgggattccgttctaccccctgaaaatatcctgtcagcgtaccagggtaccccgctccctgctaacatactggattggcaggcgctgaactatgagattagggggtacgtgattattaaaccactggtgtgggtg

SEQ ID NO: 6162 - DNA, 669 bp, Artificial Sequence
  Description of Artificial Sequence: Synthetic coding sequence
atgaataaacccctgctgtggatctctgtgctgactagcctgctggaggcattcgctcacaccgaccttagtggtaaagtattcgtcttccccagggaaagcgtgacggatcacgtcaatctcatcactcctctggagaaacctttgcaaaacttcaccctttgtttcagggcttattccgacttgagccgcgcatacagcctcttttcctacaacacccagggacgcgacaacgagctcctggtttacaaggagagggtgggcgaatatagcctgtacattggccgccataaagtgacgagtaaggttatcgagaaattccccgcgcccgttcacatttgcgtgtcttgggagtctagctcaggcatcgccgagttttggatcaatggtacccctttggtgaaaaagggtttgagacaaggttacttcgtcgaagcacagccaaagatcgtcctcggccaggagcaagattcttatggaggtaagttcgaccgctctcagagcttcgttggagagataggtgacctgtacatgtgggactcagtgctcccccccgagaacattctgtctgcgtatcagggtaccccattgccagccaatatccttgactggcaggctctgaactacgaaattagaggatacgtaattattaagccactcgtctgggtg

SEQ ID NO: 6163 - DNA, 669 bp, Artificial Sequence
  Description of Artificial Sequence: Synthetic coding sequence
atgaacaaaccattgctgtggatatccgtgttgaccagcctgctggaggcgtttgcccacaccgatttgtcgggcaaggtgttcgtgttcccgagggaatcggtcactgatcacgtgaatcttatcactcctctcgaaaaaccgctccagaatttcaccctgtgtttccgggcctactcggacctgtcgcgcgcatactcactcttctcgtataacacgcagggcagagacaatgagcttcttgtctacaaggaacgcgtgggtgaatattccctctacatcggcagacataaggtgacctcaaaagtgatcgaaaagttcccggcaccagtgcacatttgcgtcagctgggaatcctcgtcagggatcgcggagttttggatcaacggaacccctcttgtgaagaaggggctgagacaaggctacttcgtggaagcccaaccgaagatcgttctcggacaagagcaggactcgtacggaggaaagttcgatcggagccagtcctttgtcggagagatcggagatctgtacatgtgggactccgtgctccccccagagaacattctgtccgcctatcaggggacgcctcttcctgctaacatcctggactggcaagcgctcaactacgagatccggggttacgtgatcataaagccactggtgtgggtg

SEQ ID NO: 6164 - DNA, 669 bp, Artificial Sequence
  Description of Artificial Sequence: Synthetic coding sequence
atgaacaagccgctcctttggatctctgtgctcacctccctcctcgaagcgttcgcgcacaccgatttgtcgggaaaggtgtttgttttcccacgcgaaagcgtgactgaccacgtgaatcttatcacgccgctcgagaagccgctgcagaactttaccctctgttttcgcgcctattccgatctttcccgggcctactcactgttctcgtacaatacccaaggccgtgataacgagctgctggtctataaggagcgggtcggggagtacagtctttacatcggacgccacaaagtgacgtccaaagtgatcgaaaagttccctgctcccgtccatatctgtgtgtcatgggagagctcctccggaatcgcagagttttggatcaacggcactccgctggtgaaaaagggcctgaggcaaggatacttcgtcgaagcccagcctaagatcgtcctggggcaggagcaggactcatatggcggcaagtttgacagatcacaatcattcgttggcgaaattggagatctctacatgtgggacagcgtgcttccgccggagaacatcttgtccgcataccaggggactcccctgcctgcaaatatcctggattggcaagcactgaactacgaaatccggggatacgtgatcattaaacccctggtctgggtg

SEQ ID NO: 6165 - DNA, 669 bp, Artificial Sequence
  Description of Artificial Sequence: Synthetic coding sequence
atgaacaaaccgctcttgtggatctcggtcctgactagccttcttgaggccttcgcgcacactgacctgtctgggaaggttttcgtgttcccgcgcgaatctgtgacggatcacgtgaacctgattacccccctcgagaagcctctccaaaactttaccctttgcttcagagcctacagcgacctgtcccgggcctactccctcttctcgtataacactcagggaagagataacgaactcctggtctacaaggaacgggtcggagaatattcgctctacatcggacggcataaggtaacctcgaaggtaatcgagaagttcccagcaccggtccatatctgtgtgagctgggaatcgagctccggaatcgctgaattttggatcaatggaaccccgctggtcaagaaaggattgcgtcaaggttacttcgtggaggcgcagcctaagattgtgttggggcaggaacaggactcctacggagggaaattcgacaggtcgcagtcgtttgtgggcgagattggcgatctctacatgtgggatagtgtgctgccgcccgagaatatcctctctgcgtaccagggcacgccactgccagccaatatcctggactggcaagcactcaactatgaaattcgcggttacgtgatcatcaaaccacttgtgtgggtg

SEQ ID NO: 6166 - DNA, 669 bp, Artificial Sequence
  Description of Artificial Sequence: Synthetic coding sequence
atgaacaaacctctcctgtggattagcgtgttgacgtctctgctggaggccttcgcacatacagacctcagtgggaaagtattcgtgttccctcgggagagcgtgaccgaccacgtaaatctgataacgccacttgagaagccactgcagaacttcaccctgtgctttcgcgcatactctgacctctcaagagcatattcattgttctcctataacactcagggcagagacaacgagctcctggtgtataaagagcgagtgggagaatacagcctttacatcggcaggcacaaggttacctccaaggtcatcgagaagtttccggccccggtgcacatctgtgtttcctgggaatcgagcagtggaatagcggagttctggataaacggaaccccacttgtgaagaaaggcttgcgtcaaggctatttcgttgaagctcagcctaagattgtcttagggcaggaacaggatagctacggcggcaagtttgacaggagtcaatcctttgtaggtgagatcggtgacctgtatatgtgggactcagtgctcccaccagagaatatcctgagtgcatatcaggggacacctcttcccgccaacattctggattggcaggcgcttaattacgagatacggggatatgtgataatcaagcccttagtctgggtc

SEQ ID NO: 6167 - DNA, 669 bp, Artificial Sequence
  Description of Artificial Sequence: Synthetic coding sequence
atgaacaaaccactcctgtggatttccgttctcacatccctgctagaggctttcgcgcatactgacttgagcggaaaagtgtttgtattcccgcgcgagtccgtcaccgaccatgtcaaccttatcacgccgctggagaagccactgcaaaatttcacactttgttttcgagcatactccgacctcagtcgggcttacagtttgttctcttataatacccaaggacgagacaacgagctgcttgtatacaaggaacgagtgggagaatattccttatacatcggtcgccacaaagtgacgtctaaagtgattgagaaatttcctgcaccagttcatatttgtgtatcgtgggagtcttccagtggtatcgcagagttctggattaacgggactcctctggtgaaaaagggcctgaggcagggatatttcgtggaggctcagccgaaaatcgtactgggacaggaacaggattcatacggaggtaagtttgacaggagccaatcattcgtgggcgaaattggcgacttgtacatgtgggacagcgtgctacctccggaaaatatccttagcgcttaccaggggactcctctgccagctaacatattggactggcaagcgctgaattacgaaatcaggggctatgtcatcatcaagccactagtctgggtg

SEQ ID NO: 6168 - DNA, 669 bp, Artificial Sequence
  Description of Artificial Sequence: Synthetic coding sequence
atgaataagccccttctgtggatcagtgtgctcacctctttgctggaggctttcgctcacaccgatctctccggaaaggtcttcgtcttcccgagagaaagcgtcaccgaccacgtaaatttgatcacccctctcgagaaaccactacagaattttaccctatgcttcagggcctatagcgatctatccagggcctactccctgttcagctacaatactcaaggaagggacaacgagctgctggtgtataaagagcgtgtcggcgagtatagtctgtatatcgggaggcataaagtgacatctaaagtgattgagaaattcccggcaccggtccatatttgcgttagctgggaatcttcctctggaatcgcggagttttggatcaacggcactccgctggtgaagaagggtctgcgtcaaggttacttcgtcgaggcgcagcctaagattgtgctggggcaggaacaggacagttatggcgggaagtttgatcgctcacaaagcttcgtcggcgagatcggcgatctctacatgtgggacagcgtcctgcctcccgagaacatcctgtccgcataccaggggacacccctgcccgctaatattctagactggcaggccctgaattatgaaatccgtggttatgtgattattaaaccacttgtgtgggtt

SEQ ID NO: 6169 - DNA, 669 bp, Artificial Sequence
  Description of Artificial Sequence: Synthetic coding sequence
atgaacaaacccctgctttggatttcggtcctgacctcactgctcgaagccttcgcacacactgatcttagcggaaaggtgtttgtgttcccaagagaaagcgtgactgaccacgtgaacctgatcactccactcgagaagccactgcaaaactttactctgtgtttccgcgcttattcggatctttcccgcgcatactcgctgttttcgtacaacacccaaggacgtgataacgaacttctcgtctacaaggaacgggtgggagagtactcgctgtacattggcagacataaagtcacgtccaaggtgatcgaaaagttcccggcgccagtccatatatgcgtgtcgtgggagtcatcatccggaatcgcagagttctggatcaatggtactccacttgttaagaaggggctccggcaaggatactttgtggaagcacaaccgaagattgtccttggacaggaacaggactcgtacgggggcaaatttgataggtcccagtcctttgtgggcgaaatcggggatctttacatgtgggacagcgtgttgcctccggagaacatcctgtcggcgtaccaaggcacgcctctgcctgccaacattctcgattggcaggcattgaactacgaaatccgaggctatgttatcataaaaccacttgtctgggtg

SEQ ID NO: 6170 - DNA, 669 bp, Artificial Sequence
  Description of Artificial Sequence: Synthetic coding sequence
atgaacaaaccgcttctctggatttcagttcttacatccctcttggaggcatttgcacatactgatttgtcgggaaaagtcttcgtctttccaagagaatctgttaccgaccatgtaaaccttatcacccctcttgagaagccgctgcaaaactttactctgtgtttccgagcttactcggatctgtcacgcgcctacagccttttctcatacaacactcaaggacgcgacaacgagcttttggtgtataaggagcgtgttggggagtattcgttatatattggtcgccataaagttacttcaaaggttattgaaaaatttccagcccctgttcatatatgtgtctcttgggaatcgtcctcaggaatagcagagttttggatcaatggaacaccattggtaaaaaagggtcttagacagggatactttgtagaagcgcagccgaaaattgtcctgggacaggaacaagactcgtacggcggtaagttcgataggtcccaatcattcgtgggagaaattggagatctctatatgtgggacagtgtgctaccgccagaaaatatcttgagcgcttaccaaggaactccattgcctgccaatattcttgattggcaagcactaaactatgagatacggggttacgttataataaagccattggtgtgggtt

SEQ ID NO: 6171 - DNA, 669 bp, Artificial Sequence
  Description of Artificial Sequence: Synthetic coding sequence
atgaataaacccctgttatggatctctgtcttaacttccctgctggaggctttcgctcataccgatctgagcggcaaagtattcgtatttccacgggagagcgtgacagaccacgtgaacctgataacacctctggagaagcccctgcagaactttactctctgctttagggcttattccgacctgtcccgcgcttactcacttttttcttacaatacacagggcagagataatgaactgctggtgtacaaggaaagagtgggggaatattcactatatattggcaggcacaaagtgacatccaaagtaatagagaagttccccgcaccagttcatatctgtgtgtcctgggagagtagctccggaattgcagaattttggattaatggaacacctctagtgaagaaggggttaaggcaaggctacttcgtcgaggcgcagcccaagatcgtattgggacaggaacaagatagttatgggggaaagttcgaccgctcccagtcattcgtgggagagatcggagatctgtacatgtgggattccgtgctgcctccagagaatatcctgagtgcataccagggaactccgctccccgccaacattctggactggcaggctcttaattatgaaatacgggggtatgttattatcaagcccttggtctgggtg

SEQ ID NO: 6172 - DNA, 669 bp, Artificial Sequence
  Description of Artificial Sequence: Synthetic coding sequence
atgaataagccccttttatggatttccgttctgaccagcctcctcgaggccttcgcacacactgacctttccggaaaggtctttgtgttccctcgcgaaagtgtgaccgaccacgtgaatctgatcaccccattggaaaagccccttcaaaatttcactctgtgcttcagagcctacagcgatcttagccgagcatacagcttattctcatataacactcaagggagggacaacgagctcctagtttacaaggagcgggtcggggaatactcactctatatcggcagacataaagtgacctcaaaggtgatcgaaaagttccctgcgcccgtgcacatttgtgtttcgtgggaatcgtccagcgggatagctgagttctggattaacggcaccccgttagtgaagaagggattgcgtcagggctattttgtggaagcgcaaccaaagatcgtgctaggacaagaacaggatagctacgggggtaaatttgacaggagccagagctttgtgggcgaaattggtgatctctatatgtgggattccgtccttcctccagaaaacatcttatccgcctaccaaggcacgccactgcccgcaaatatacttgattggcaggccctgaactatgaaatccgggggtatgtgattatcaagccgctggtgtgggtc

SEQ ID NO: 6173 - DNA, 669 bp, Artificial Sequence
  Description of Artificial Sequence: Synthetic coding sequence
atgaataaaccgctgctgtggatctccgtgctgactagcctcctggaggccttcgctcacactgacctctccggaaaggtgttcgtttttcctagagagtcggtcactgaccatgtgaatcttatcaccccattggaaaagccgctgcagaacttcactctgtgcttccgcgcgtatagcgacctgtcaagagcgtactcgctgttttcgtacaacacccaaggccgcgacaatgaactgttggtgtacaaagagcgcgtcggagaatattcattgtacattggtcggcacaaggtgaccagcaaggtgatcgaaaagttcccagcccccgtgcacatctgcgtgtcgtgggaatcctcatccggtatagctgaattctggatcaacgggaccccactcgtgaagaaggggctccgccagggatactttgtggaggcgcaacctaagatcgtgctgggtcaagaacaggactcctacggcggaaagttcgatcgctctcaatcgttcgtgggagaaataggagatctgtacatgtgggatagcgtcctcccaccggagaacattcttagcgcctaccaggggacgccactgccggcgaatatcctggattggcaggccctcaactacgagattaggggatacgtcatcattaagcccttggtgtgggtc

SEQ ID NO: 6174 - DNA, 669 bp, Artificial Sequence
  Description of Artificial Sequence: Synthetic coding sequence
atgaacaaaccgctcttgtggatctccgtgctcacgtctctgttggaagcttttgctcacaccgatctgagcgggaaagtctttgtcttccctagagaatccgtcacggaccatgtaaatctaatcactccgctcgagaaaccattacagaatttcaccctttgtttccgggcttatagcgacctgagccgcgcgtacagtctgtttagctataatactcagggacgcgataacgagcttctggtctataaggaacgggtgggggagtattctctgtacattggaagacacaaagttactagcaaggttatcgagaagtttccagctcctgttcatatctgtgtgagttgggagtcctcttccgggattgcagaattctggataaatggcactcctcttgtgaaaaagggattgagacagggctacttcgtagaagctcaaccgaaaatcgtgctgggtcaagagcaggactcctatggaggaaaattcgaccgctcccagtccttcgtcggcgagattggagacctatatatgtgggactccgttcttccccctgaaaacatcctgtctgcatatcaggggacgccactgccagccaacatccttgattggcaagcactgaactatgagataaggggatacgtgatcataaaaccgttggtgtgggtg

SEQ ID NO: 6175 - DNA, 669 bp, Artificial Sequence
  Description of Artificial Sequence: Synthetic coding sequence
atgaataagccactgctgtggatcagcgtactgacctccctgcttgaagccttcgctcacaccgacctgtcaggaaaggtgttcgtgtttccgcgagagagcgtgacggatcatgtcaatctgatcacccctctggaaaagcccctgcagaacttcactctctgcttccgggcctactcggacctgtcccgagcttattcactgttctcgtacaacacccagggcagagataacgaactcctcgtgtacaaggagcgcgtgggtgagtatagcctttacattgggcggcacaaggtcacttcgaaagtcatcgagaagtttcccgctccagtgcacatctgcgtctcgtgggagtcgtcctccggaatcgccgaattctggatcaacggtaccccgctggtgaagaagggactcaggcagggatatttcgtggaagcgcaaccgaagatcgtgctgggtcaggaacaagactcgtacgggggaaagtttgaccgctcacagtcgttcgtgggcgagatcggagatctgtacatgtgggattccgttctgccgcctgagaacatcctgagcgcctaccaggggaccccactcccggcgaacatcctggattggcaggctcttaactacgagatccgcggatacgtgatcattaagccactcgtgtgggtc

SEQ ID NO: 6176 - DNA, 669 bp, Artificial Sequence
  Description of Artificial Sequence: Synthetic coding sequence
atgaataaacccttgctgtggatcagtgtcctgacttctttgttagaggcctttgcgcacaccgatttgtctggcaaagttttcgtttttcctcgcgagtccgttacggatcatgtgaaccttatcaccccattggaaaaaccattgcagaacttcaccttgtgctttagagcatactcggatctgtcacgcgcgtacagcctctttagctacaatacccagggacgcgataacgagttgcttgtatacaaggaacgggtgggtgagtatagcttgtacattggccggcacaaggttacctctaaggtgatcgagaagtttccagctcccgtgcacatctgtgtcagctgggaaagctcatctggaatcgcagagttttggatcaacggcacaccactcgtcaaaaagggcctacggcagggctattttgtcgaggcccagccaaagatagtgctgggacaggagcaagattcttatggcggtaaatttgacagaagccagagctttgtgggcgagatcggtgatttgtacatgtgggactcagtcctgcctccagaaaacatcttatcggcataccagggcactcctcttccagccaacattctggactggcaggccctcaattacgagatcaggggctacgtgatcataaaacctctggtgtgggtc

SEQ ID NO: 6177 - DNA, 669 bp, Artificial Sequence
  Description of Artificial Sequence: Synthetic coding sequence
atgaataagccgctgctctggatctcggtgctgacgtcgctcctggaggcctttgcccatactgacctgtctggcaaagtgttcgtgttcccgcgcgagtccgtgaccgaccacgttaatctgatcaccccgctcgaaaaaccactgcagaatttcactctctgttttcgcgcctattcggacctgtcgcgggcatacagcctgttctcctacaacactcaggggcgggacaacgaactgcttgtgtacaaggaacgcgtgggtgaatacagcctctacatcggtcgccataaggttacttccaaggtgattgagaaattccctgcgcccgtccacatctgcgtgtcctgggagtcatcctcaggaatcgccgagttctggattaacggcaccccgctggtcaagaaaggactgcggcagggatactttgtggaggcgcagcctaagatcgtgctgggccaggagcaggattcctacgggggcaagtttgaccgcagccagtcctttgtgggagagatcggagacttgtacatgtgggattccgtcctccctccggagaacatcctctcagcgtaccaaggaacgccgctgccggccaatatcctggactggcaggccctcaactacgagatcagggggtacgtcatcatcaagccgttggtgtgggtg

SEQ ID NO: 6178 - DNA, 669 bp, Artificial Sequence
  Description of Artificial Sequence: Synthetic coding sequence
atgaacaaaccgctgctctggatttcggtgcttacctccctcctggaggcatttgcacatactgacctgtcgggcaaggtattcgtctttcctcgggagtcggtgactgaccacgttaatctgatcacccccttggaaaaacccctccagaatttcacgctgtgttttcgcgcttactccgacctgagccgggcctatagtctcttcagctacaatacccagggacgggacaacgaactcctcgtgtacaaagaaagagtgggagaatactccctgtacatcggtcgccacaaggttacttccaaggtcatagagaagttcccagcgcctgtgcacatatgcgtctcgtgggagagctcctcaggaatcgctgagttttggatcaacggtaccccgttggtcaaaaaggggcttagacaaggctatttcgtcgaagcccaaccgaagattgtgctggggcaggagcaagactcgtacggtggaaaattcgatcggagccagtcgttcgtgggggagatcggagatctctacatgtgggactccgtgctccctcctgagaatatcctgtcagcgtaccagggcaccccactgcctgccaacatcctggattggcaagctctcaactacgaaatccgtggatacgtcatcattaagccattggtttgggtg

SEQ ID NO: 6179 - DNA, 669 bp, Artificial Sequence
  Description of Artificial Sequence: Synthetic coding sequence
atgaataaacctctgctttggattagcgtgttaacaagtctgctcgaggccttcgcacataccgacctgtcaggaaaggtgtttgtgttcccgcgggaatcagtgactgaccacgtaaacctgattactccgttagaaaagcccttgcagaatttcacattgtgttttcgcgcgtactcagacctttctagagcctatagtctgttctcctataacactcagggtcgggacaacgagcttctcgtatataaagaaagggtgggtgagtattcgctctacataggtcgacacaaagtgactagtaaggtgatcgagaaattcccagcaccagtgcatatctgtgtgagttgggaaagcagcagtggcattgcagagttctggatcaacggcacccccctggtcaaaaagggactcagacaggggtacttcgtggaggctcagcccaaaatcgtgctgggacaggagcaggattcttatggcgggaaattcgatagaagtcaatcctttgttggggaaattggagatctttacatgtgggacagcgttttgccccccgaaaacatcctctcggcctatcaagggacgccgttaccagcaaatatcctggactggcaggccttgaattacgagattcgtgggtacgttattataaaaccgctcgtctgggtc

SEQ ID NO: 6180 - DNA, 669 bp, Artificial Sequence
  Description of Artificial Sequence: Synthetic coding sequence
atgaataaaccattgttgtggatatcagttttaacttctttacttgaagcatttgctcatactgatttatctggaaaggtttttgtttttccacgtgaatcagtaactgaccatgttaatttaattactccacttgaaaaaccattacaaaattttactttatgttttagagcatattctgatttaagtagagcctattcattatttagttataatacacaaggaagagataatgaacttcttgtatataaagaaagagttggagaatattcattatatattgggaggcataaagtaacaagtaaagttatagagaaatttccagcaccagttcatatttgtgtttcatgggaatcatcatcaggtattgcagaattttggattaatggaacacctttagtaaaaaaaggtttgcgtcaaggatattttgttgaagctcaaccaaaaattgttcttggacaagaacaagatagttatggtggtaaatttgatagatcacaatcatttgttggagaaattggagatctttatatgtgggattccgtacttccaccagaaaatatcctttctgcttatcaaggaactcctttgccagctaatattcttgattggcaagctttaaactatgaaatacgtggatatgttattattaaaccattagtttgggtt

SEQ ID NO: 6181 - DNA, 669 bp, Artificial Sequence
  Description of Artificial Sequence: Synthetic coding sequence
atgaacaagcccctcctttggatttccgtcctgaccagtctgcttgaggcatttgcacacaccgacctttccgggaaggtctttgtgtttccccgggagtccgtgactgatcacgtgaacctgatcactccgctggagaagccccttcagaatttcacgctgtgcttccgcgcctacagcgacctctcaagagcatacagcttgttcagctacaatacccaaggacgagacaatgaacttcttgtctacaaggagagggtcggagaatactcgctgtatattggacgccataaagtcacttcaaaggttatcgaaaagtttccagctccagtacatatatgtgtctcatgggagtcgtcgtcgggtattgccgaattttggataaacggaacccctttggttaagaaaggactgaggcagggatacttcgtggaagcacaacccaaaattgtgctgggtcaggaacaagattcctacgggggaaaattcgatagatcgcaatcgttcgttggcgagataggcgacctttacatgtgggacagtgttctgccacctgaaaacatcctctccgcataccaggggacccccctcccagcaaacattcttgattggcaagctctcaattatgaaatccgtggctacgtgatcattaagccactggtgtgggtg

SEQ ID NO: 6182 - DNA, 669 bp, Artificial Sequence
  Description of Artificial Sequence: Synthetic coding sequence
atgaacaagcctttgctctggatcagcgtactgacttcattgctcgaagctttcgcgcacacggatctgagtggaaaggtctttgtgtttcctagagaatccgtgacagaccatgtgaatctcatcacgccgctggagaagcctttgcagaactttaccctctgcttcagagcttacagcgatctcagccgagcctacagcctcttctcttacaacacccagggacgagataacgaacttctagtctataaggagagggtgggggagtactctttatacatcgggcgccacaaggttacatccaaagtgattgagaagttcccagccccggtacatatttgtgtatcttgggagagttcttccggaattgctgaattctggattaacggcacccctctggtgaagaaagggttgcggcaggggtacttcgtcgaggcacaacctaaaatcgtgctaggtcaggaacaggattcatatggagggaagttcgacagaagtcagagctttgtcggagagatcggcgacctatatatgtgggactccgtcctccctcctgagaacattctgagtgcgtatcagggaacccccctaccggccaacattctggactggcaggctctgaactatgagatacggggatacgtcataattaagccgcttgtgtgggtc

SEQ ID NO: 6183 - DNA, 669 bp, Artificial Sequence
  Description of Artificial Sequence: Synthetic coding sequence
atgaataaaccgctactatggatatcggtattaacgtcgttattagaagcgtttgcgcatacggatttatcgggtaaagtatttgtatttccgcgtgaatcggttacggatcatgtaaatttaataacgccgttagaaaaaccgttacaaaattttacgttatgttttcgtgcgtattcggatttatcgcgtgcgtattcgttattttcgtataatacgcaaggtcgagataatgaattattagtatataaagaacgagtaggtgaatattcgctatatataggtcgacataaagttacgtcgaaagtaatagaaaaatttccggcgccggtacatatatgtgtttcgtgggaatcgtcgtcgggtatagcggaattttggataaatggtacgccgttagtaaaaaaaggtttacgtcaaggttattttgtagaagcgcaaccgaaaatagttctaggtcaagaacaagattcgtatggtggtaaatttgatcgatcgcaatcgtttgtaggtgaaataggtgatctatatatgtgggattcggtactaccgccggaaaatatattatcggcgtatcaaggtacgccgttaccggcgaatatattagattggcaagcgctaaattatgaaatacgtggttatgtaataataaaaccgctagtatgggta

SEQ ID NO: 6184 - DNA, 669 bp, Artificial Sequence
  Description of Artificial Sequence: Synthetic coding sequence
atgaacaagccgctgctttggatctctgtgttgactagcttgctggaggcgttcgcccatacggatctgtcaggcaaggtgttcgtgttcccccgcgaatcagtgactgaccacgtgaatctgatcaccccactggaaaagcctctgcaaaacttcactctttgttttcgcgcctactcggatctgtcaagagcttactccctgttttcctacaacacccagggacgcgacaacgaactgctcgtgtacaaggaaagagttggggaatactcactgtacattggtcgccacaaggtcacttcaaaagtgatcgaaaagtttccggccccggtgcacatctgcgtcagctgggagtcatcatccggtatcgcagaattctggatcaacggaacccccctcgtcaagaaggggctgcggcagggatacttcgttgaagcccagccaaaaatcgtgctgggacaggagcaagattcgtacggcggcaagttcgacagaagccagtcctttgtcggagagattggagacttgtacatgtgggactcggtgctgccaccggagaatatccttagcgcataccaaggtaccccgctgccggccaacatcctggactggcaggccctgaactacgagatccgcggttacgtgatcattaaaccgcttgtgtgggtt

SEQ ID NO: 6185 - DNA, 669 bp, Artificial Sequence
  Description of Artificial Sequence: Synthetic coding sequence
atgaacaagcccctcctttggatcagcgtactgacatccctgctggaggccttcgcccacaccgacttatcaggaaaggttttcgtttttcctcgggagtctgtgacggatcacgtgaacctgatcacccctcttgagaagccgctgcagaactttaccctgtgtttccgcgcctattccgacctcagtcgcgcatacagcctgttttcctacaacacccaggggagggataatgaacttctggtgtataaggaacgcgtcggggagtactctctgtatatcggccgccataaggtcacatcaaaggtcatcgagaagttccctgctcccgtgcacatctgcgtttcgtgggagtctagctcaggaatcgccgaattttggataaacggcacccccctagtgaaaaagggactaagacaagggtactttgtcgaggctcagccaaaaatagtgcttggacaggagcaggatagctatggaggcaaattcgatcgatcccagagctttgtgggagaaatcggcgacctgtacatgtgggactccgttttgccgccagagaacattctgagcgcctaccaggggacccccctccccgccaatatcctggattggcaagcacttaactacgagataagaggatacgttattatcaagcctttggtctgggtg

SEQ ID NO: 6186 - DNA, 669 bp, Artificial Sequence
  Description of Artificial Sequence: Synthetic coding sequence
atgaacaagccactcctctggatttcagtgctgacctctcttttggaggcattcgctcatacagacctgtccggtaaggtctttgtcttcccgcgggaaagcgtgaccgaccacgttaatctgattactccccttgaaaaacccttgcaaaatttcaccctctgcttccgtgcgtattctgatctcagcagggcatactctctgttctcatataatactcagggccgcgataacgaactcctggtttataaagagcgggtaggcgaatatagtctttatatagggaggcataaagtcacgtcgaaagtaatcgagaaatttcccgcacctgtgcacatctgcgtttcttgggagagtagttctgggatcgcggagttttggataaacggcacacccttggttaagaaaggcctgaggcaggggtattttgtggaagctcagcccaagatcgttctcggccaggagcaggatagctatggagggaagttcgatcgatcccagtcttttgttggggagatcggtgacctatatatgtgggactcagtgcttccacccgaaaatattctgagcgcataccagggaacacctttgcctgccaatatcctggactggcaggcgcttaactacgagatccgtggatacgttattatcaagccccttgtctgggta

SEQ ID NO: 6187 - DNA, 669 bp, Artificial Sequence
  Description of Artificial Sequence: Synthetic coding sequence
atgaataagcccctgctgtggatcagcgtgctgacttccttgctcgaggcgttcgcccacaccgacctctctggcaaagtgttcgtgttcccgcgtgaatcagtgaccgatcacgtgaacctcatcaccccgctggaaaagcctctgcagaacttcacgctttgcttcagggcatactctgatctgtcgcgcgcatacagcctgttcagctataacacccagggcagggacaacgagctgctcgtgtacaaggagcgagtgggagaatactcgctgtacatcggccgccataaagtcacttcgaaggtgatcgaaaagttccctgccccggtgcatatctgcgtgtcctgggaatcatcctcagggatcgcggaattctggatcaatggtaccccgctcgtgaaaaagggcctccggcagggttactttgtggaagcgcagccgaagatcgtcctgggccaggaacaagatagctacggtggaaaattcgaccggagtcaatccttcgtgggcgagatcggagatctttacatgtgggattccgttctccctccggaaaacatcttgtcagcttaccagggcacccccctgccagcaaatatcctcgactggcaagcccttaactacgagatccggggatacgtcatcatcaagccgctggtgtgggtt

SEQ ID NO: 6188 - DNA, 669 bp, Artificial Sequence
  Description of Artificial Sequence: Synthetic coding sequence
atgaataagcccttgctttggatctccgtgctgacgtcacttcttgaggcgttcgcacataccgacctctccggaaaggtctttgtgtttccgcgggaatcagtcaccgaccatgtcaacctgatcacgccgctggagaagccactccaaaacttcaccctgtgctttcgcgcatactctgatctgtcacgggcgtactcacttttttcgtacaacactcagggacgtgataatgaactgctggtgtacaaagaacgggtaggagaatattcgctgtacattggcagacacaaggtgaccagcaaagtgatagaaaagtttcccgctcctgtgcacatttgtgtgagctgggagtccagcagcggtatcgcagaattctggattaacggcacccctctcgtcaagaagggcctgcgccaaggttactttgtcgaggcacaaccaaaaatcgtgcttgggcaagagcaggatagctacggaggaaagtttgacagatcccagtcattcgtgggcgaaattggtgatctttacatgtgggattcggtcctgccccccgaaaacattctgtcagcataccagggtacgcccctgccagccaatatcctcgattggcaagcacttaactatgagattcggggatacgtgatcattaagccccttgtgtgggtg

SEQ ID NO: 6189 - DNA, 669 bp, Artificial Sequence
  Description of Artificial Sequence: Synthetic coding sequence
atgaacaaaccgctgttgtggatctccgtgttgacttctctgcttgaagcctttgctcacacagatctttctgggaaagtgtttgttttccctagagagtccgttacagaccacgtgaatttgataactcccctcgagaagcctctgcagaatttcacactttgttttcgggcttactccgacttgtcaagagcatatagcctgttctcttataacactcagggccgcgacaacgaactgctggtctataaagagcgggttggtgagtacagtctttatatcggaagacataaagtcacgagtaaagtgattgagaagttccccgcaccagtgcatatttgcgtgagctgggagtcatccagcggaatcgccgaattttggattaacggtacccccctggtcaaaaaaggtttgaggcaggggtatttcgtcgaagctcagcccaagatcgttctgggccaggaacaggattcatacggaggcaagtttgataggtctcagagctttgtcggggagatcggagacctttatatgtgggactccgttctgccaccagagaacatcctttctgcctatcaggggacaccgctgcctgcgaatattctggactggcaggctctcaactacgaaatcagaggttatgtgattattaaacccttggtttgggtg

SEQ ID NO: 6190 - DNA, 669 bp, Artificial Sequence
  Description of Artificial Sequence: Synthetic coding sequence
atgaacaagccactgctatggatctctgtattgacttccctgctggaggccttcgcacacacagacctgtctggaaaggtgttcgtgttcccgagggagtccgtcaccgaccacgtcaatttgatcactcctttggagaaacccctgcagaactttaccctttgttttagggcgtatagtgacctgagtagagcatacagcctgttttcctacaacacccagggacgggacaacgagctactagtgtacaaggagcgggtgggggaatactcactttatatcggacgccacaaagtgacatctaaggtcatcgaaaagtttcccgcccccgttcatatttgtgtgtcttgggagagttcttcaggaattgcagaattttggatcaatgggacacccctagtgaaaaaaggcctccgacaaggttatttcgtcgaagcccagcccaaaatcgttttgggacaggaacaggactcttacggggggaaatttgatcgttcgcagagttttgtgggggaaattggggacctatatatgtgggattcggttttaccccccgagaatattctgtcagcctatcagggcacccctctgcccgcaaatattctcgactggcaggctttgaactatgagatacgcggatacgtgatcatcaagccgctggtgtgggtt

SEQ ID NO: 6191 - DNA, 669 bp, Artificial Sequence
  Description of Artificial Sequence: Synthetic coding sequence
atgaataaacctctgctttggatatctgttctaacctcgcttcttgaagcttttgcccataccgatcttagcgggaaggtgttcgtgttcccacgggaatccgttaccgaccacgtaaatctgattacaccactagaaaaaccacttcagaacttcacactatgttttagagcttacagtgacctgagcagagcttacagtctcttctcttacaacacccagggcagggacaatgagctgcttgtatacaaggaacgagtaggtgagtactctctctatatcggtcgccataaagtgaccagtaaggtcattgaaaaattccctgcgcccgtgcacatatgtgtcagttgggagtcgtcaagtggtattgcagaattttggatcaatggcacgcctttagtgaagaagggcctgagacagggatactttgtcgaggcccagccaaaaatagtcctaggtcaagagcaggactcttacggaggcaagttcgatagatcccagtcttttgttggcgagattggcgacctttacatgtgggatagcgtgctcccgcctgagaatattctgtcagcttaccaaggcacgccactgccagccaatattttggactggcaggccttaaactacgaaattcggggctacgtcattatcaaaccactggtttgggtg

SEQ ID NO: 6192 - DNA, 669 bp, Artificial Sequence
  Description of Artificial Sequence: Synthetic coding sequence
atgaataagccacttctttggatatcggtgcttacctccctccttgaagcatttgcacatacggatctgagtggaaaggtgtttgtgtttccacgagagtccgttactgatcacgtgaatctcatcactcccctcgaaaagccgcttcagaactttaccctgtgctttcgcgcatactccgatctgtcgcgggcatactcccttttctcgtataacactcagggccgggataacgaacttctggtgtacaaggagcgtgttggagagtactcgctgtacataggaaggcacaaggtcacttcgaaagtgattgaaaagtttccagcacctgtgcacatctgtgtgtcctgggaaagcagctcaggcattgccgaattctggatcaacggcacccctcttgtgaaaaagggtctgcgacagggatacttcgtggaagcccaacctaagattgtgttgggccaagaacaagactcgtacgggggtaaattcgatcggtcccagtcctttgtgggagagatcggtgatctgtacatgtgggattcggtgttgccaccagagaacattcttagcgcatatcaaggcactccgctcccagccaacatactggattggcaggcactgaattacgaaattcgggggtacgtcatcatcaagcctctcgtctgggtt

SEQ ID NO: 6193 - DNA, 669 bp, Artificial Sequence
  Description of Artificial Sequence: Synthetic coding sequence
atgaacaagccactcctgtggatctcggtcttgaccagcttgcttgaggcctttgcgcatactgacctttccggtaaggtgtttgtgtttcctagagagagcgtgaccgatcatgtcaatttgataaccccacttgagaaacctcttcagaatttcaccctgtgcttcagggcatactccgacttgagcagagcgtattcgctgttttcgtacaatacccaaggtcgcgacaatgaacttctcgtctataaggaacgtgtgggagaatactccctgtacatcggtagacataaggttacctccaaggtcattgaaaagtttcccgctccggtgcatatatgcgtcagctgggaatcctcgtctggaattgccgagttctggataaacggaacccctctggtcaagaagggactgcggcaaggatactttgttgaagcgcaacctaagatcgtgctcgggcaagaacaggattcatacggtggaaagttcgataggtcgcagagcttcgtgggagagattggggatctttacatgtgggatagcgtgctcccaccagaaaacattctgtcggcataccaggggactcctctccccgccaacattctggattggcaggcgctcaactatgaaattagagggtacgtgattatcaaacccctggtgtgggtg

SEQ ID NO: 6194 - DNA, 669 bp, Artificial Sequence
  Description of Artificial Sequence: Synthetic coding sequence
atgaataaaccgttgctctggatctccgtgctgacttctctgctggaagcattcgctcataccgacttgtccggcaaggtttttgtcttcccgcgggaaagcgtaactgaccacgtaaatctcattacaccactcgaaaagccactccagaatttcacgttgtgtttcagggcctattccgatcttagcagagcctatagtctgttctcttacaatacacaggggagagataacgaactgctggtttataaagagagagtgggcgaatattccctttacatagggcggcataaggttacttccaaggtaatagagaagttcccagcgccggtgcacatttgtgtgagctgggagagctctagtgggattgcagagttctggatcaacggaactcctctggtgaaaaaaggccttagacaggggtacttcgtggaagctcagccaaagatcgtgttggggcaggagcaggactcctatggggggaagtttgaccgctcacagtcatttgtcggtgagataggtgatttgtatatgtgggattccgttcttcctcctgaaaatattctgtccgcttatcaggggacgccattgcctgccaacatcctggactggcaggctctgaactacgaaatacgaggatacgtcattattaaaccgctggtgtgggtg

SEQ ID NO: 6195 - DNA, 669 bp, Artificial Sequence
  Description of Artificial Sequence: Synthetic coding sequence
atgaacaagcccctgttgtggatatctgtgctcacctctctgcttgaggcttttgcccatacagatctgagtggcaaagtatttgtcttccctagggagtcagtcacagaccacgtgaacctcatcacaccgctagagaagcccctgcagaacttcaccctgtgctttcgagcctattctgacctatcacgagcttactccctcttcagttacaacacccagggtagggataacgagctgctggtatataaggaaagagtcggcgaatacagtctttatattggtcgccataaggtgactagtaaagtgatcgagaagtttcctgctccggtgcatatctgtgtgagctgggagtccagctccgggatcgccgaattctggattaatggcacccccttggttaaaaaaggtttgaggcaggggtacttcgtcgaggctcagcctaaaattgttctcggacaggagcaagattcctatggcgggaagttcgataggagtcaatcttttgtgggcgaaattggggatctttacatgtgggattcggtgctcccgccggaaaacattttgtcagcgtaccagggcacacctcttcctgccaacattctggactggcaggccctaaactatgagattagaggctacgttatcatcaagccgttggtgtgggtc

SEQ ID NO: 6196 - DNA, 669 bp, Artificial Sequence
  Description of Artificial Sequence: Synthetic coding sequence
atgaacaagccacttctttggattagcgtcctcacttcgcttctcgaagccttcgctcatactgaccttagtggaaaagtctttgtctttcctcgcgagtcggtcaccgatcacgtcaatctgattacccctctggaaaagccactgcagaactttactctttgcttcagagcgtactcggacctgtcgagggcttactcactcttctcatacaatacccaaggacgtgataatgaacttctggtctacaaggaaagagtgggagaatacagcctttacattggacggcacaaagtgacttccaaggtgattgaaaagttccctgcaccagtccacatttgtgtgtcctgggaatcctcttcagggatagcagaattttggatcaatggaaccccgcttgtgaagaaaggccttagacagggatactttgttgaggcccaacctaagatcgtgctgggacaagagcaggattcgtacggagggaagttcgatcgaagccagtctttcgtcggagaaattggagacttgtacatgtgggacagcgtcctccctcccgaaaacattctctccgcctatcaaggtacgccccttcccgcgaacatccttgactggcaagcactgaattacgagatccggggttacgtcatcattaaaccccttgtgtgggtg

SEQ ID NO: 6197 - DNA, 669 bp, Artificial Sequence
  Description of Artificial Sequence: Synthetic coding sequence
atgaacaagcccctgctctggatttcagtcctgacgtcccttctggaggcttttgcacacactgatctctccggaaaggtctttgttttccctcgggagagcgtgaccgaccacgtgaatctgatcaccccccttgaaaagccactccagaatttcactttgtgtttcagagcatactctgatctgtcgagagcatactcgcttttttcctacaatacccaagggagagataatgaactgcttgtttacaaggagcgggtgggtgaatacagcctctacatcggacggcataaagtgaccagcaaggtcattgaaaagtttcctgcacccgtgcacatttgcgtgtcgtgggagagctcctcgggaattgctgagttttggatcaacggtacccctctcgtcaagaagggactgaggcaaggatactttgtggaagcacaacctaagattgtgctgggacaggaacaagactcgtacggagggaagttcgatcggtcgcagtcgttcgtcggtgaaattggtgacctctatatgtgggattcggtgctgccacctgagaacattctcagcgcataccaagggaccccattgcccgcaaacattctcgattggcaagccctgaattacgaaattcgtggatacgtcatcattaagccgcttgtctgggtg

SEQ ID NO: 6198 - DNA, 669 bp, Artificial Sequence
  Description of Artificial Sequence: Synthetic coding sequence
atgaacaagccactgctctggatctccgttctcacgtctctgcttgaagcatttgcacataccgatctttctggcaaggtgtttgtgtttccccgggagagcgtgactgatcacgtgaacctcatcaccccacttgagaagcctttgcaaaactttacgctttgtttccgagcctactcagacttgagccgggcttattcgcttttcagctacaacactcaaggcagagacaacgaattgctcgtgtacaaggagcgagtcggagaatactcgctgtacattgggagacataaggtcacctcaaaagtaattgaaaagtttcccgcacctgtgcatatctgcgtctcctgggaaagctcgtcaggaattgcggaattttggattaacggtactccattggtcaagaaaggacttcgacaagggtatttcgtcgaagcccaacctaagatagtccttggtcaggagcaggactcctacggtggaaagtttgataggagccagtcgttcgtgggagagattggcgatctttacatgtgggattcagtgctgcctcccgaaaacatacttagcgcctatcaaggaaccccattgccagctaacattctggattggcaggcacttaactacgaaattaggggttacgtgatcattaagccactggtgtgggtc

SEQ ID NO: 6199 - DNA, 669 bp, Artificial Sequence; identical to SEQ ID NO: 6168
  Description of Artificial Sequence: Synthetic coding sequence

SEQ ID NO: 6200 - DNA, 669 bp, Artificial Sequence
  Description of Artificial Sequence: Synthetic coding sequence
atgaataagccgctcctttggatctcggtcctgacctcactgctcgaggcatttgcccatactgatctctcaggaaaagtgttcgtgttccctcgcgaatccgtaactgatcacgtgaatctgataacgccactggaaaagccgctgcagaatttcactctgtgctttcgggcttactcagacctgtcccgcgcttattcactcttctcatacaacacccaaggacgcgacaacgagctcctggtgtacaaggaacgggtcggcgaatactcgttgtacattggtcgacacaaagtgactagcaaggtgatcgagaagttcccggcgcctgtgcatatatgtgtgagctgggagtccagctcggggatcgccgaattttggatcaacgggacccccctggtgaagaagggactcaggcagggctacttcgtcgaggcacagcctaagattgtgctgggacaggaacaagactcctacggcggaaaattcgacaggtcccaaagtttcgtgggagagatcggcgatctgtacatgtgggacagcgttcttccgccggagaacatcctgtcggcgtatcaaggaaccccattgccggccaatatactcgactggcaggcgctcaactacgaaatccggggctacgtcatcatcaagccacttgtctgggtc

SEQ ID NO: 6201 - DNA, 669 bp, Artificial Sequence
  Description of Artificial Sequence: Synthetic coding sequence
atgaacaaaccactgttgtggatttctgtcctcactagcctcctggaagcctttgcccacaccgacttatctgggaaagtgttcgtttttccgcgggagagtgtgaccgatcatgtgaatctcatcacccctttggagaagccattacaaaactttactctctgctttcgcgcttactccgacttgtcacgggcatacagtctattcagttacaacacccagggcagagacaatgagcttctcgtatataaggaaagggttggggaatactccttgtatatcgggcgccacaaggttacgagtaaggtgatcgaaaaattccctgctcccgtccacatatgcgtgtcctgggagtccagttctggaattgcggagttctggataaacggcacccctctcgttaagaaggggctccgacaggggtactttgttgaggctcagcctaagatcgtgttgggacaagagcaggactcctacgggggaaaatttgatcgatcacagagcttcgtgggagagataggggatctgtacatgtgggactccgtccttccgcccgagaacatccttagcgcatatcaaggtacccccctccctgccaacatcctcgattggcaggcactcaactacgagattcggggctacgtgattatcaagcccctggtctgggtg

SEQ ID NO: 6202 - DNA, 669 bp, Artificial Sequence
  Description of Artificial Sequence: Synthetic coding sequence
atgaacaaacctctgctttggataagcgttcttactagccttctggaagcgtttgcccataccgatctctctggaaaggtgttcgtgtttcccagagaaagcgtcactgatcatgtcaacctcattactccgcttgagaagcctttgcaaaacttcaccctttgttttcgcgcttactcagatctttcgcgtgcctattcccttttctcatacaacacgcaagggcgagataacgaactgctggtgtacaaagaacgagtcggagaatactccctttacattggtcgacataaagtgactagcaaggtgatcgaaaagtttcctgcacctgtccacatctgcgtcagctgggagtccagctcgggaattgctgagttttggatcaacggaacccccttggtcaagaaaggtttgagacaaggatacttcgttgaggcgcaacctaagattgtgctgggccaagagcaggattcatacggcggcaagttcgacagatcgcaatcctttgtgggagaaattggcgacctctacatgtgggactccgtgcttcctccggagaatatactttcagcataccaggggacccccctgcccgcaaatatcctggattggcaggccctgaattacgagatcaggggatacgtgatcattaaaccactcgtttgggtg

SEQ ID NO: 6203 - DNA, 669 bp, Artificial Sequence
  Description of Artificial Sequence: Synthetic coding sequence
atgaacaagcctctgctgtggatttccgttcttacgtcactgctggaagcatttgcgcacaccgatctgtccggaaaggtgtttgtgtttcctcgggagtcggtgaccgatcacgtgaatctcatcactccactggaaaagccactccagaactttactctttgtttcagggcctactcggacctttcccgcgcgtactccttgtttagctacaacacccaagggagagataacgaacttctggtctacaaagaacgggtgggcgaatactcgctttacattggtaggcataaagtgacttcaaaagtcattgaaaagtttccagcaccggtgcatatatgtgtctcatgggagagctcatccggaatcgcagaattttggattaacggtacccctcttgtgaagaagggactgagacagggatatttcgtcgaggctcaacctaagattgtgcttggacaggagcaagattcctacgggggaaagttcgatcggtcccaatcgtttgttggcgaaattggtgatctctacatgtgggattcagtgcttcccccagagaatatactttcagcataccagggcaccccactccctgcgaacatccttgattggcaggcactcaattacgagataagaggatacgtgataatcaaacccctggtgtgggtg

SEQ ID NO: 6204 - DNA, 669 bp, Artificial Sequence
  Description of Artificial Sequence: Synthetic coding sequence
atgaacaagcccctgttgtggatctcagttcttacaagcttgcttgaggcgttcgctcacacagatctgagtggaaaagtgttcgtgtttcctagagaatcggtgacagaccatgttaatctgatcactccactggaaaagcccctgcagaatttcacgctgtgttttcgcgcatattccgacttgagccgggcctattctctcttctcctacaatacccaaggaagggataatgaactgctagtctataaagagcgcgtgggtgaatatagcttgtacatcggacggcacaaagtgaccagtaaagtgatcgaaaagttcccagcgccagtgcacatttgcgtgagttgggaaagcagcagtggcattgctgaattctggataaacggcaccccactcgtcaaaaaggggctgcggcagggttacttcgtcgaagctcagcccaagatcgtgctcgggcaggaacaggacagttacggaggcaaattcgatcgcagccaaagcttcgtcggcgaaatcggggatttgtatatgtgggattctgtactaccccctgagaacattttatcagcctatcagggtacacctctgcctgcgaatattttggactggcaggcgctcaactatgagatcagagggtacgtcatcatcaaacctcttgtctgggtg

SEQ ID NO: 6205 - DNA, 669 bp, Artificial Sequence
  Description of Artificial Sequence: Synthetic coding sequence
atgaataaaccactgctgtggatttcagtgcttacctcgctgttggaagcgtttgcccataccgatctgtccgggaaggtgtttgtattcccgcgcgagagcgtgactgatcatgtgaatcttatcaccccactcgaaaagcctctgcaaaactttaccctctgcttccgcgcatatagtgatctgagccgagcctactcgctgttttcgtacaacacccaaggacgggataatgaattgttggtgtacaaagaacgcgtgggagaatactccttgtatattggtagacacaaggtcacttcaaaggtgatagaaaagttccccgcgcctgtgcacatttgtgtttcctgggagtcctcgagcggaatcgcggaattttggatcaacggaaccccgctggtcaaaaagggtcttagacaaggatacttcgtggaagcccagccgaaaatcgttctgggacaagaacaggatagctatggcggaaagtttgatcgctcccaatctttcgtgggtgaaatcggtgatctttacatgtgggatagcgtcctccctccggagaatatactctccgcataccagggtacgccccttccagcaaacattctggactggcaagctctcaactacgagattaggggctacgtcataatcaagcccctggtctgggtc

SEQ ID NO: 6206 - DNA, 669 bp, Artificial Sequence
  Description of Artificial Sequence: Synthetic coding sequence
atgaacaaaccattgctctggattagcgtgctgacatctctgttagaggccttcgcacatactgacctgtccggaaaagttttcgtttttccccgcgaaagcgtcaccgatcatgtaaacttgattactcctttggagaagcctctccagaattttactctgtgtttccgagcatatagtgacctgagccgcgcgtacagcctcttcagttataacacccagggtcgtgacaatgagctactggtatataaggagcgggttggagagtatagcctttacattggtcggcataaggtaacgtctaaggtgatcgagaaattccccgcgcccgtgcatatatgtgtctcttgggagagttcaagcggtattgccgaattttggattaatggtacccccctggtgaaaaaggggttgcgccagggttactttgtcgaggcgcagccgaagattgtcctgggccaggaacaggattcgtacgggggaaaatttgaccgctctcagtcattcgtgggagagatcggcgatctgtacatgtgggattccgttctgccgccagagaacatactatctgcctaccaaggaacccctcttcctgctaatatcctcgattggcaggcactaaactacgagattcgcggatacgttatcattaaacccctagtttgggtc

SEQ ID NO: 6207 - DNA, 669 bp, Artificial Sequence
  Description of Artificial Sequence: Synthetic coding sequence
atgaacaagccactgctttggatctcagttttgacttctctgctcgaggcctttgcgcacaccgacctctcgggcaaggtgttcgtgttcccccgagagtcggtgactgaccatgtgaatcttatcaccccactcgaaaaacctttgcagaactttacgctgtgttttagagcttatagcgatctctcccgggcgtactcgcttttctcgtataacactcaagggagagacaatgagctgctcgtctacaaggagcgggtgggagagtacagcctgtatatcggacgccataaggtgaccagcaaggttatcgagaaattccctgcgccggtgcacatctgcgtgtcgtgggagtcctcatcagggatcgcagaattctggatcaacggtaccccgctcgtgaagaagggactgaggcagggttactttgtggaagctcaaccgaagatcgtgctgggccaagaacaggatagctacgggggcaagtttgaccgtagccagtcattcgtgggcgaaattggagatctgtacatgtgggactccgtgctcccaccagagaacatcctcagcgcataccaaggcaccccgctgccagccaacatcctggactggcaggccctgaactacgagatccggggatacgtcatcattaagccgctcgtgtgggtc

SEQ ID NO: 6208 - DNA, 669 bp, Artificial Sequence
  Description of Artificial Sequence: Synthetic coding sequence
atgaacaagcccctgctgtggatctccgttctcaccagcttgctcgaggcgttcgcccatactgacctgtccgggaaagtgtttgtgttcccacgcgaatctgtgaccgaccacgttaatttgatcactcccctcgaaaaacctcttcaaaattttacgctgtgttttagggcatacagtgacctttcccgagcgtattcactgttctcctataatacgcagggccgggacaacgagctgctggtgtataaagagcgagtcggtgagtattcactgtatatcgggcgccataaggttacgtccaaagttatcgagaaattcccggccccggtacacatttgtgtgtcttgggagagcagctccgggattgctgaattctggattaatggtacacctctggttaaaaaggggctacggcaggggtatttcgttgaggcccagccaaagattgttcttgggcaagaacaagacagttatggaggaaaattcgaccggtcacaatcattcgttggggaaatcggggatttgtacatgtgggactccgtgctaccccccgaaaacatcctctctgcataccagggcacgccacttcctgcaaacattcttgactggcaggcgttgaactacgagatccggggttacgtcatcataaagcctttagtatgggta

SEQ ID NO: 6209 - DNA, 669 bp, Artificial Sequence
  Description of Artificial Sequence: Synthetic coding sequence
atgaacaaaccgctcttgtggatttctgtgctgactagcctcctggaggcgttcgcccatactgacctcagcgggaaagtgtttgtctttccacgggagtcggttaccgaccacgtgaacctcattacacctttggagaagcccctgcagaacttcacactatgtttccgggcttattctgacttgtcccgagcctactccctgttttcttacaacacccagggcagggacaacgaactcctggtctacaaagaacgcgtgggcgaatattcgttatatatcgggagacacaaggtcacctccaaagttatagagaagttcccagcacctgtccacatctgtgtttcttgggagagtagtagcgggatcgcagagttctggataaatggcaccccactcgttaaaaaagggctaagacagggctatttcgttgaggcacagcccaaaattgttctgggtcaagagcaagactcctatggcggaaaattcgaccggtcccagagctttgtgggtgagatcggagatctatacatgtgggatagcgtcctccctccggagaacatcctcagcgcatatcagggtacccccctgccagccaacatacttgattggcaggctctgaattatgagatcagggggtacgtcattattaagcccctggtttgggtt

SEQ ID NO: 6210 - DNA, 669 bp, Artificial Sequence
  Description of Artificial Sequence: Synthetic coding sequence
atgaacaagccgctcctgtggatctccgtactgactagcctacttgaggcttttgctcatactgacctctctggtaaggtctttgtctttcctagggaaagcgtcaccgatcacgtcaacctaataactcctctggagaaacccttacagaactttaccttgtgtttccgagcttatagcgatcttagccgggcttatagtctgttcagctataatacccagggtcgcgataacgagctgcttgtctataaggagagagtgggagagtatagcttatacatcggacgacacaaagtgacaagcaaggtcattgagaaattccccgccccggttcacatctgtgtgagctgggagagtagttccgggatcgcagagttttggataaacggtaccccacttgtgaaaaaaggcttgcggcagggttactttgtggaagcacagcccaaaatagtgttaggccaggagcaggattcatacgggggcaaattcgatcggagccaaagctttgtgggcgagataggcgatctgtatatgtgggactccgttctcccaccggaaaacatcctttccgcttaccagggtacacctctgccggccaatatcctagattggcaggctctgaattacgagatcagaggatacgtgatcatcaagcccctagtgtgggtg

SEQ ID NO: 6211 - DNA, 669 bp, Artificial Sequence
  Description of Artificial Sequence: Synthetic coding sequence
atgaataaacccctactgtggatatccgtgcttactagcctgctagaggctttcgcccataccgacctgtcaggcaaagttttcgtctttcccagggaatccgtcactgatcatgtgaacttgatcacacccctcgaaaaacccttgcagaacttcaccctctgctttcgggcatactcagatctgtctcgggcctatagcttgtttagttacaacacccaaggcagggacaacgagctgctagtgtacaaagagagggtcggcgagtactctctgtatatcggcagacataaggtcacctccaaagttatcgagaagttccctgctccagtgcacatatgtgtgtcttgggaaagctcctcaggaatagcagagttctggataaatggaaccccactggtcaagaagggtctgagacaggggtatttcgtggaagcacagcccaaaatagtcttgggccaggaacaggactcatacggaggcaagtttgaccgcagtcaaagcttcgttggggagataggtgacctgtacatgtgggacagcgtgttgcctcccgagaacatcctaagcgcctatcagggcaccccactgccagctaatatcctggattggcaagccctcaattatgaaattaggggctatgtcataatcaagcccctggtgtgggtc

SEQ ID NO: 6212 - DNA, 669 bp, Artificial Sequence
  Description of Artificial Sequence: Synthetic coding sequence
atgaacaaacctttgctttggatttccgtgctgacttcgcttctggaggcattcgcccacaccgacctctcaggcaaggtgtttgtgttcccacgggaaagcgtgaccgatcatgtaaacctcattaccccactggaaaagcctctgcagaactttacgctgtgttttagagcttactcggatttgtcccgggcatactctctgtttagctacaatactcagggcagagataacgaactgcttgtgtacaaggaacgtgtgggtgagtactccttgtacatcggtcgacacaaggtcacctcaaaagtcattgaaaagtttcctgccccagtccatatatgtgtgagctgggaaagcagcagtggcattgcggaattttggatcaatggaactccccttgtgaaaaagggcctgcgccaaggctactttgtggaagcccaacctaagatcgtgctcggtcaagaacaagattcctacggtgggaaattcgatcgatcacagtcgttcgtgggtgagatcggtgatctgtatatgtgggacagcgtgcttccaccggagaacattctttccgcgtatcaaggcacgcctcttccagctaacattctggattggcaggcgttgaattatgagatccgtggatacgtcatcattaagcccctcgtctgggtg

SEQ ID NO: 6213 - DNA, 669 bp, Artificial Sequence
  Description of Artificial Sequence: Synthetic coding sequence
atgaacaaacccctgctctggatttccgtgctgacgagcctactggaggcatttgcccataccgatctgagcggcaaagtctttgtttttccgagagagtctgtaaccgaccacgttaacctgatcactcccctggagaagcctctccaaaactttaccttgtgctttcgcgcctatagcgatttgagccgtgcctactctctgttcagctacaacacccagggacgtgacaacgagctgctggtgtataaagagcgcgtgggagaatacagcctctatatcggcaggcacaaggtgaccagtaaagtcattgagaagtttccggcccccgtgcatatttgcgtcagctgggagagctccagcggaatcgcggagttctggatcaacggtacgccgctggtaaagaaaggccttcgtcagggttattttgtggaagcccagccaaaaatcgtcttgggtcaggagcaggatagctatggcggcaaattcgatcgaagccagagctttgtgggcgagattggcgatttgtacatgtgggacagtgttcttccacctgaaaatatccttagcgcctaccagggcacgcctctcccggccaacatcttagactggcaggccctgaactatgagatcagggggtatgtcattatcaagccgcttgtgtgggtt

SEQ ID NO: 6214 - DNA, 669 bp, Artificial Sequence
  Description of Artificial Sequence: Synthetic coding sequence
atgaacaagccactcctttggatctccgtgctgacctcacttttggaggcatttgcgcataccgatctttcaggaaaagtttttgtttttccacgcgagtcggtgactgatcatgtgaatttgatcacccccctggagaaaccactgcaaaactttaccctgtgttttcgggcatactcagacctttcccgcgcatactcactgttctcctacaacacccagggaagggacaatgaactgttggtgtacaaagaaagagtgggtgaatacagcctctacattggcagacataaggtgacttccaaggtcatagagaaatttccagcccccgtccacatctgtgtctcgtgggagtcatcgtccggaatcgcagaattttggataaatggcacccctctcgtcaaaaagggattgaggcagggatacttcgtcgaagctcaaccgaagatcgtgcttggacaagagcaggactcctacggtggcaagtttgatagatcgcaatcatttgtgggagagattggcgatctgtatatgtgggattccgtgctgccaccagaaaacatcctttcggcatatcaaggtacgcctctgccagccaatattctcgattggcaagcattgaactacgaaattcgaggttacgtgatcattaagccgctggtgtgggtg

SEQ ID NO: 6215 - DNA, 669 bp, Artificial Sequence
  Description of Artificial Sequence: Synthetic coding sequence
atgaacaaaccgctcctgtggatttcggtgctgacttcactcctggaagcgttcgcccacaccgatctgtccggaaaagtgttcgtgttccctagagagtccgtcacggaccacgttaatctgatcactcctctggaaaagcccctgcagaactttactctgtgttttagggcttattcggacctttcaagagcttacagccttttctcgtacaacacccagggccgcgacaacgaactgctcgtctacaaagagagagtcggagagtacagcctttacatcggacggcacaaggtcacctcgaaggtgatcgagaagtttccagctccggtgcacatctgcgtgtcatgggaatcaagctccggcatcgctgagttctggattaatggaaccccgctggttaagaagggactccggcagggctacttcgtggaagctcagcctaagattgtcctcggtcaagaacaagactcctatggagggaaattcgatagatcccagtcgtttgtgggagaaatcggggacctctacatgtgggacagcgtgttgccaccagagaacatcttgtccgcttaccagggcacccctctgccagctaatatccttgattggcaggcactgaattacgagatccgcgggtacgtgatcatcaagccgctcgtctgggtc

SEQ ID NO: 6216 - DNA, 2415 bp, Artificial Sequence
  Description of Artificial Sequence: Synthetic coding sequence
atgtccagttcgagctggctgttgctttccctggttgcggtgaccgcagcacaatcgacaattgaggagcaagcgaagaccttcttagataaattcaatcatgaagccgaagaccttttctaccaatccagcttggcctcctggaattataatactaacatcaccgaggagaacgtgcagaacatgaataatgcaggcgataaatggagtgctttcctcaaagagcagtcaaccctggcacaaatgtatcccctgcaggagatccagaatctgacagtgaagctgcagctgcaggctctgcaacagaatggatctagcgtgctctccgaggataagtctaagcgtttgaacacaatcctgaataccatgtccacaatatacagcaccggaaaagtgtgtaaccccgataaccctcaggaatgtttgctgctggagccagggctcaacgaaattatggccaattctcttgattacaacgagcggctctgggcctgggagtcatggcgctctgaggtgggtaagcagctgcgacctctgtacgaagagtatgtcgttctgaaaaacgagatggcaagagccaatcactacgaggattacggcgactactggaggggagactacgaggtgaacggggtcgatggctatgactacagtcggggacaactgatcgaagacgtggagcacacctttgaagaaatcaagcccttgtatgagcacctgcacgcttatgttcgtgccaaacttatgaatgcctatcctagctatatcagtcctattggatgtctaccagcgcaccttctgggagatatgtggggtaggttctggactaacctgtatagcctgacggtgcctttcggacaaaagcctaacatcgacgtcacggatgctatggtagaccaggcctgggacgcccagcgaatctttaaggaggcggagaaattcttcgtatccgtggggttgccgaatatgactcagggcttttgggagaatagcatgctgacagatccaggcaacgttcagaaggccgtatgccacccaactgcatgggacctggggaaaggggatttccgtatcctgatgtgtactaaggtcacaatggacgactttctcacggcccatcacgagatgggtcacatccagtacgacatggcctacgcggcacaaccatttctgctgcggaatggcgctaacgaaggattccacgaggcagttggcgagataatgagcttgtccgccgcaactcctaagcacctaaagtctatcggtctgctgagccccgactttcaagaggacaacgagactgagatcaactttctgctcaagcaggctttaaccattgtgggcactctccccttcacatatatgctggagaaatggaggtggatggtcttcaaaggggagatcccgaaggatcagtggatgaaaaagtggtgggaaatgaaacgcgagattgtcggcgtagtcgagcctgtgcctcatgacgagacttactgcgatcccgcgtcattgttccacgtgtcaaacgactattctttcattagatactacacaagaacgctgtatcagtttcagtttcaggaggccctgtgtcaggctgctaagcacgaagggccactacacaaatgtgacatctctaactctaccgaggctggacaaaaactatttaatatgctgaggctcggcaaaagcgaaccttggaccctggccctggagaacgtcgtcggagcaaaaaacatgaacgtgcggcctcttttgaactactttgagcctctatttacatggctgaaagatcagaataagaatagctttgtcggatggtccaccgactggtccccctacgcggaccagtccattaaggtgagaatcagtctcaagtctgccttgggcgataaagcatacgagtggaatgacaatgagatgtacctcttcaggagctcagtcgcttatgccatgaggcagtacttccttaaggtgaagaatcaaatgatactctttggggaggaagatgtgagggtcgccaacctgaagccccgaatctcatttaatttctttgtcactgccccaaagaatgtgagtgatataataccccggactgaggtcgagaaggccatacgtatgagcagatccaggattaatgacgcatttaggctgaatgataatagcctggaatttctggggattcagcccacactcggtcctcccaaccagccgcctgtctccatctggttaattgttttcggggtggtaatgggtgtgatagtcgtgggaatagtgattcttatctttaccggtatcagagaccgcaaaaagaagaataaggcccgatcaggtgaaaatccctatgcctctatagatatcagtaaaggggaaaacaaccctggcttccagaataccgatgatgttcagacgtcattt

SEQ ID NO: 6217 - DNA, 2415 bp, Artificial Sequence
  Description of Artificial Sequence: Synthetic coding sequence
atgtcaagtagctcgtggctcctgttatctctagtcgcggtcactgcggcacagtccaccatcgaagagcaggctaaaacattcctggacaagttcaatcacgaagcagaggacctgttttatcagtcctccctggcttcctggaattataataccaacataactgaggagaatgtccagaatatgaacaacgcgggggataagtggtctgcctttttgaaggagcaatccacattggcgcagatgtaccctctgcaagagattcagaatctgaccgtcaagcttcagctgcaggctctgcagcagaatggatcttcagtcctctccgaagataaaagcaagcgcctcaacaccattctcaacaccatgagcacaatctatagtacagggaaggtctgcaatccagacaacccccaggaatgcctgttactggagcctggactcaacgagatcatggctaactccctagattataatgaacggctctgggcatgggagagttggaggagtgaggtggggaagcagctcaggcccctgtatgaggagtacgtcgtattgaagaacgagatggcccgggccaaccactacgaagattacggtgactattggcggggagactacgaggtcaacggcgtggacggatacgactacagtagagggcagctaatcgaggatgtcgagcatacgtttgaggaaattaaacccttgtacgaacatctccacgcctatgtccgggcaaagcttatgaacgcctacccatcttatatcagccctatcgggtgtctgccagcacatctcttgggcgacatgtgggggagattttggaccaatctctatagcctgacggtgccttttggccaaaagccgaatatcgacgtaaccgacgctatggtggatcaagcgtgggacgcgcagcggattttcaaagaagccgagaagttctttgttagcgtaggtctgcccaacatgacacagggattttgggaaaacagcatgctgacggatcctggaaacgtgcagaaggcagtttgccatcccacggcttgggacctgggtaaaggcgattttaggattctgatgtgtacgaaggtcacaatggatgattttctgacagcccatcatgagatggggcacatccagtacgacatggcctacgccgcacagccattcctattgcgcaatggcgccaacgaaggcttccatgaggctgttggcgagattatgtccttaagcgccgcaacgccgaagcatcttaaatccatcggtttactttcaccagattttcaagaggacaatgaaacggagattaattttctgctcaagcaggccctgaccatcgtgggaacgcttccctttacctacatgctggagaagtggcgctggatggtttttaagggcgagattcccaaggaccaatggatgaaaaaatggtgggaaatgaagcgcgaaatagtgggggtggtggagcccgtcccacatgatgagacctattgtgatccagcctcactcttccacgtatccaatgactactcctttattcgctactacactaggaccctttaccagttccagttccaggaggccctgtgccaggccgccaaacacgaggggccactccataagtgtgacatttccaattcaacggaagccgggcagaagttattcaatatgctgaggttggggaagtctgaaccctggaccctggctcttgaaaatgttgtcggggccaagaatatgaacgttagacccctcctgaactactttgagcccttatttacttggttgaaggatcaaaataagaactctttcgtcgggtggtccactgattggtcaccctatgccgaccagagcatcaaggtgagaatctctctgaagagcgcgttaggtgacaaagcatacgaatggaatgataatgagatgtatctgttccgttcttcagtcgcctacgccatgcggcagtattttctgaaagtgaagaatcagatgattttgttcggtgaggaggacgtgagggttgcaaacttaaagcccagaatctcatttaacttctttgttaccgccccgaaaaatgtatcggacataatccccagaactgaggtggagaaggcgatcagaatgtcccgctcaagaattaatgacgctttccgactgaatgacaattctctcgaatttttgggtatccaaccaacactgggccctcccaaccagccacccgtaagcatttggctgattgtgttcggcgttgtgatgggagtgattgtggtcgggatcgtgatcctgattttcacaggaatacgcgacaggaaaaaaaagaataaggcccggtcgggggagaacccttatgcctcgatagacatcagtaagggggagaacaaccctggcttccaaaacactgacgacgtgcaaactagtttt

SEQ ID NO: 6218 - DNA, 2415 bp, Artificial Sequence
  Description of Artificial Sequence: Synthetic coding sequence
atgtcatcatcatcttggctcttattgagtctcgtggccgtgacagccgctcagtcaactatcgaagaacaggccaaaacatttctggacaaatttaaccatgaagctgaagatttgttttatcaatcaagtctcgccagttggaattataatacaaacattactgaagagaacgtgcagaatatgaacaatgccggagataagtggagtgccttcctgaaagaacagagtactctggcccagatgtatcctcttcaggaaatccaaaatcttacagtcaagttacagttacaagctctccaacagaatgggtctagtgtgctctctgaggataaaagtaaaagacttaatactatattgaacacaatgtctacaatatattcaactggaaaagtttgtaaccccgataacccccaggaatgcctcctcctcgaaccaggattaaatgaaatcatggctaatagtctagattataatgaaaggctctgggcctgggaatcctggaggagtgaagtggggaagcagcttcgtcccctttatgaagagtatgtggtgttaaaaaacgaaatggctagagctaatcattacgaagattatggggattattggagaggagattatgaagtgaacggagtagatgggtatgattatagtagaggacagcttatcgaagacgtggagcatacatttgaggaaataaaacccctttatgaacatctccatgcatatgttcgcgcaaaactcatgaatgcatacccctcttacatatcacctatcgggtgccttcccgcccacttacttggagatatgtgggggaggttctggactaatctgtattctctgacagtaccatttggacagaaacccaatattgatgtgacagacgctatggttgatcaggcttgggacgctcagaggatctttaaagaggcagagaaatttttcgtttctgtagggctgccaaatatgacacaggggttctgggaaaattctatgctcactgaccctggaaacgtacagaaagcagtttgtcaccctactgcatgggacctagggaagggagacttccgaatacttatgtgcacaaaggtaactatggatgattttctcacggcacaccatgaaatggggcatatccagtatgatatggcatatgccgcacagccgttcctcctcaggaatggagcaaatgaagggtttcatgaagctgtcggagagattatgtcgctatctgcggctactcctaagcacctgaaatccatcgggctactcagtcccgattttcaagaagataacgaaacggaaattaactttttgctcaaacaggcgcttacaattgtaggaacactcccatttacttacatgctcgaaaagtggcggtggatggtatttaaaggggaaatcccaaaagaccagtggatgaaaaaatggtgggaaatgaagagggaaatcgttggggtggtggaacctgtaccacatgacgaaacatattgtgacccagcgtcgctgttccatgtatctaacgactattcctttatcagatattatactcgaacactttatcaatttcagttccaggaggcactgtgccaggcagctaaacacgaaggaccattgcataaatgtgatatcagtaactccactgaagccgggcagaaactgttcaatatgctgaggctaggaaaatcagaaccctggactctcgcattggaaaatgtggtaggggcaaaaaatatgaatgtgcggccactcctcaattattttgaacctctatttacatggctgaaagaccaaaacaaaaatagtttcgtcgggtggagtacagattggtcaccttatgccgaccagtcaatcaaagtgcgcatctctctgaagtctgccttgggagataaggcttatgaatggaatgataacgagatgtatctatttcggtcttcagtggcctatgctatgaggcagtattttctaaaagtaaagaaccagatgatactgttcggagaagaagatgtacgggtggctaatctaaaacctcgaatctctttcaatttttttgtaactgcccccaaaaatgtttctgatatcattcctcggacagaagtcgaaaaagctataaggatgtcacggtctaggatcaatgatgctttcagactcaatgacaattctctggaattcttggggatacagcctactttaggaccacccaatcagccccccgtatctatctggctaatagtgtttggagtcgtaatgggagttatagttgtgggaatcgttatcctaatcttcacagggattcgagatcgaaaaaaaaaaaacaaagcaagatccggagagaacccctatgcctccatcgacatatctaaaggagaaaacaaccccggattccagaatacagatgatgtccagacatcgttt

SEQ ID NO: 6219 - DNA, 2415 bp, Artificial Sequence
  Description of Artificial Sequence: Synthetic coding sequence
atgagtagctcttcatggctcctgttgagcctggtggcagttaccgctgctcaaagcactatcgaagaacaggctaaaactttcctagacaagttcaatcacgaggctgaggacctgttttatcagagcagtctcgcttcatggaactacaatactaacatcactgaggaaaatgtacagaatatgaataatgccggggataagtggtcagcattcctcaaagaacagagcacactagcccagatgtatcctctacaagagattcagaacctgaccgtgaaactacagctgcaggccctgcagcagaatgggtcttccgtcctaagtgaggacaagtccaaacggttgaacaccattctgaacaccatgagcaccatatattccaccggcaaggtgtgcaaccccgacaatccacaggagtgcctcctgctggaaccaggtctgaacgaaataatggctaatagcctcgactataacgagaggctttgggcttgggagtcttggcgatctgaagtgggtaagcagctgcgtccactgtatgaggagtacgttgtgctaaaaaatgagatggcccgggccaaccattatgaagactatggggattactggcgcggtgattatgaagtgaacggggttgatggctacgactacagtcgtggccagctgattgaggatgtggaacataccttcgaggagatcaagcccctctatgagcacctgcacgcctacgtgagggccaagctgatgaacgcttatccaagttacattagtccaattggctgcctacctgcccacctcttgggcgacatgtggggcagattctggaccaacctatattccctgactgtaccattcgggcagaaacctaacattgatgtgacagacgccatggtagatcaagcatgggacgcccagagaatcttcaaggaagccgagaaattctttgtctcagttgggttgccaaacatgacccagggcttttgggagaattctatgctcaccgaccctggcaacgtccagaaggccgtgtgccacccaactgcctgggacctcggcaagggcgatttccgtatcttgatgtgtacaaaagttaccatggacgattttctaactgcacaccacgaaatgggccacatacagtatgacatggcttacgccgcacagccatttcttctgcgaaacggggctaatgaagggttccacgaggctgtcggagagattatgtctctgtctgccgctacaccaaagcatttaaagagtattggtctgcttagccctgacttccaggaggataacgagacagagattaattttctactgaaacaggctctcactattgtgggcaccctcccttttacatacatgctggaaaaatggaggtggatggtgttcaagggagagattcccaaagatcagtggatgaaaaaatggtgggagatgaaacgagagattgtgggggttgtggaaccagtcccacacgatgagacttattgcgaccctgcttctctattccatgtgagcaacgactactcctttattcgctattatacaagaactctatatcagttccagttccaggaagccttgtgtcaggcagccaaacacgagggccctctgcataagtgtgatatttctaatagcacagaagctggtcaaaaactgttcaacatgctgcggctgggaaaatcagaaccatggaccctagctctggagaacgttgtcggcgcaaagaacatgaatgtgcgcccactgctgaattatttcgagccactgtttacatggctcaaggatcagaacaaaaacagttttgtgggctggtcaacagactggagtccttacgccgatcagtctattaaggtgcgcatcagtctgaagtctgctctaggtgataaagcttacgaatggaatgataatgagatgtacctgttccgctcctcagtcgcctatgcaatgcgacagtatttccttaaggtgaagaatcagatgatactgtttggcgaagaggatgtgagggtggctaacctgaaacctaggatttctttcaacttcttcgtgactgcacccaagaatgtgagtgacatcattcctcgcacagaggtcgagaaggctattaggatgagcaggagcagaatcaacgacgcctttcgactcaatgataatagcctggaattcctgggtatccaacccaccctgggaccacctaaccagccccctgttagtatttggctgattgtatttggggtggtgatgggcgtaattgtcgttggtattgtgattctgatctttaccggaattcgcgacaggaaaaaaaagaataaggcaaggtccggggaaaatccatacgcctcaatcgatataagcaagggagaaaacaatcctgggttccagaacacagacgatgttcagaccagtttt

SEQ ID NO: 6220 - DNA, 2415 bp, Artificial Sequence
  Description of Artificial Sequence: Synthetic coding sequence
atgtccagctcgtcatggctgttgctttcgcttgtcgcggtgactgctgctcagagcaccattgaggaacaggccaagacttttctcgacaagtttaaccacgaagcagaggatctcttttaccaatcttcgcttgcatcgtggaactataacaccaacattacggaagagaatgtccagaacatgaacaacgcaggcgataagtggtcggctttcctcaaggaacaatcgactttggcacaaatgtacccgcttcaagaaattcagaacctgaccgtgaagctgcagctgcaagccctgcagcaaaatggatcatccgtgctgtcggaggataaatccaagcgcctcaatacgatcctcaataccatgagcaccatttacagcaccggtaaggtttgtaatcccgataacccccaagaatgccttttgcttgagcctggattgaacgaaatcatggcgaattccctggattacaatgagagactgtgggcgtgggaaagctggcgaagcgaagtgggaaagcaattgcggcccctctacgaagaatacgtcgttctcaagaacgagatggcccgcgcaaatcattacgaagattacggtgactactggcgaggcgattatgaagtgaacggagttgacggttacgattattcacgaggccagctgatcgaagatgtcgagcatactttcgaggagattaagcctctttacgagcatctgcatgcatatgtgcgtgccaaacttatgaatgcttacccgtcatacatatcacctataggttgcctgcccgcacaccttcttggagacatgtggggtcggttttggaccaatctttactctctgacggtgccttttggacaaaaaccgaatatcgatgtgactgacgcgatggtcgaccaggcctgggatgctcagcgcatctttaaggaagcggaaaagttttttgtgagcgtgggactcccgaacatgactcaagggttctgggagaactccatgctgacggacccaggcaacgtccagaaagcagtctgccatccaactgcatgggacctcggcaagggagatttcagaattctcatgtgtaccaaggtgactatggatgattttctcaccgcacaccacgagatgggtcacattcaatacgacatggcatacgccgcacaaccattcctgcttagaaacggcgcaaacgaaggattccatgaagccgtcggcgaaatcatgtcactgtccgccgcgactccgaagcatctcaagtccatagggctgttgagccctgactttcaagaggataacgagactgaaatcaactttcttttgaaacaagcgctcacgatcgtggggaccctgccatttacctacatgctcgaaaagtggagatggatggtgtttaaaggagaaatccctaaggatcaatggatgaagaaatggtgggagatgaaaagggaaatcgtcggcgtggtggaacccgtgcctcatgacgagacttattgcgatcctgcctcactcttccacgtgtcaaacgattactcctttatccgctactacactagaactttgtatcagttccagtttcaggaagcgctttgtcaagccgcaaaacatgagggaccactgcacaagtgtgacatatccaattcgactgaagcagggcagaaactctttaacatgctgcggctcggcaagagcgaaccctggactctggcactcgagaatgtcgttggagcaaagaacatgaacgtgaggcctctgttgaactactttgaacctctctttacctggcttaaagatcagaacaagaatagctttgtgggatggtctacggactggtccccatacgcagatcagtcaatcaaggtgcgcatttcgctgaagtccgcactgggcgataaggcatatgaatggaacgataatgagatgtacctcttcagatcgtcagtggcatatgcaatgcggcagtactttcttaaggtgaagaaccaaatgatcctgtttggtgaagaggacgtccgtgtggccaatctgaagcctaggatctcgttcaacttttttgtgaccgcacccaaaaatgtgtccgacataattccacgaactgaagttgagaaggcaatccggatgtccaggagcaggattaatgatgcttttcgcctgaacgacaattcccttgaattcctcggtatacaaccaactctgggaccacctaaccaaccaccagtctccatatggctgatcgttttcggagtggtcatgggtgtgattgtggtcggcattgtgattttgatattcaccggcattcgagatagaaagaagaaaaacaaggcaagatcgggggagaacccatacgcaagcattgacatctcgaaaggtgagaataatccagggttccaaaacaccgatgatgtccaaactagcttt

SEQ ID NO: 6221 - DNA, 2415 bp, Artificial Sequence
  Description of Artificial Sequence: Synthetic coding sequence
atgtcgagctcgagctggctgttgctctccctggtggccgtgactgcagcacaatcgactatcgaagaacaagcaaagactttcctggataagtttaaccatgaagcagaagatctcttctaccagtcgagcctcgcttcgtggaactataacactaacattacggaagagaacgtgcaaaacatgaacaatgctggcgacaaatggtccgcctttttgaaggaacaaagcacccttgctcagatgtaccctctgcaggaaattcaaaatcttaccgtcaagttgcaactgcaagcactgcagcagaacggctcgtccgtgctttcggaagataaatccaaacggttgaacaccattttgaacaccatgtcgactatttactcaaccggaaaggtgtgtaaccccgacaatccgcaggagtgtctgctgcttgagcccgggctgaacgaaatcatggccaacagcctggattacaacgaaagactgtgggcatgggaaagctggagatcagaagtgggaaaacaacttcgtcctctgtacgaagaatacgtcgtccttaagaacgaaatggcaagggctaaccattacgaagattacggagattactggagaggggattacgaagttaatggcgtggacggttacgactactctcgcggacagttgattgaagatgtggaacacactttcgaagagattaagcctctttacgagcatcttcatgcctacgtgcgcgccaaacttatgaatgcatacccttcgtacatttcaccaattggttgccttccagcacaccttttgggagatatgtggggtcgcttctggaccaacctttactcccttaccgtcccttttggacaaaagccaaacatcgacgtgaccgatgcaatggtggatcaggcatgggatgctcaacgcattttcaaggaggcagagaagttttttgtgtccgtgggccttccgaatatgactcaaggattctgggaaaatagcatgctgaccgatccaggaaacgtgcagaaggcagtgtgccacccaacggcgtgggatcttggtaaaggagatttcagaatactgatgtgtaccaaggtcactatggacgactttctgaccgcacaccacgaaatggggcacatccaatacgatatggcctacgcagcgcaaccgtttcttcttcggaatggagcaaatgaaggcttccatgaagcagtcggagagataatgagcctgtcggccgccactccaaaacacctgaaatcaatcggcttgctgtccccggatttccaagaggataacgaaaccgaaatcaactttttgctcaagcaggcactgaccatcgttggaaccttgcctttcacttacatgctcgagaagtggcggtggatggtctttaagggtgaaataccgaaggatcagtggatgaaaaagtggtgggaaatgaaacgcgaaatagtcggtgttgtggagccagtccctcacgacgaaacctactgcgaccctgcatcgctgttccatgtgtcaaatgattactcctttatcaggtactacacgcgtactctctaccaattccaatttcaagaggcactttgtcaggcagctaagcatgaagggcccctccataaatgcgatatatcgaactcgaccgaggccgggcaaaaactgtttaacatgctgagacttgggaagagcgagccttggaccctcgcccttgagaacgttgtgggagcgaagaacatgaatgtccgacctcttctgaactacttcgagccgcttttcacttggctcaaggaccagaacaagaatagcttcgtgggttggagcaccgattggtcaccttacgcagatcaaagcattaaagtgcggattagcctgaagtctgcacttggcgataaggcatacgaatggaatgacaacgagatgtatctctttagatcctcggtggcctatgccatgaggcagtattttctcaaggtcaagaaccaaatgatcttgtttggagaggaagatgtgagggtggcgaacctcaaaccgcgcatctcattcaatttctttgtaacggctccgaaaaatgtgtccgacatcattccaagaaccgaagtcgagaaggcaattagaatgtccagatcaaggatcaacgacgcattccggcttaacgataacagccttgagtttttgggtatccaaccgactctcgggcctcccaaccaaccacctgtgtctatttggctcatcgtgttcggagtcgtgatgggggtgattgtcgtcggcatagtcattctgattttcactgggatccgagatcggaagaaaaagaacaaggcaaggtccggagaaaatccttacgcatccatcgatattagcaagggcgagaataatcctggattccagaacactgacgatgtgcaaacttccttc

SEQ ID NO: 6222 - DNA, 2415 bp, Artificial Sequence
  Description of Artificial Sequence: Synthetic coding sequence
atgtcatcctcttcctggcttctcctttctctggtggctgtaacagccgcgcagtctactatcgaggagcaggctaaaactttcctggacaaattcaatcacgaagctgaagatctgttttatcaaagttctctcgcatcatggaactataacactaacatcactgaggagaatgtacagaacatgaataatgcgggcgataagtggtctgcttttctgaaagagcagtctacgctcgctcaaatgtaccccctccaggaaatccaaaatttgacagtcaagctgcaactccaggcactgcaacaaaatggtagcagtgttctgtcagaagacaaatccaaaaggctcaacaccattctcaacacgatgagcacgatttatagtaccggcaaggtgtgcaatcccgataacccccaggaatgtttgctcctggaaccggggttgaacgagattatggccaacagcctcgattacaatgagcgactttgggcttgggaatcttggagatctgaagtggggaagcaactcagaccgttgtacgaggagtatgtagtgctgaaaaatgaaatggcaagagctaatcactatgaggattatggggactactggcggggtgattacgaggtcaacggggtagatggctacgattatagccgggggcagctcatcgaggacgtggagcacactttcgaggagatcaagcccctgtatgagcacctgcacgcctacgtcagggccaaattgatgaacgcctatccctcctacatttctcctattggctgtcttccagctcatctgcttggggatatgtggggacgattttggaccaatttgtattctctgacagtgcctttcggccagaaacctaatattgatgtgaccgacgcgatggtcgaccaggcctgggacgctcagaggattttcaaagaagccgagaagttctttgtgagcgtgggattgccgaacatgactcagggattctgggaaaatagtatgctcacggacccgggcaacgtccaaaaggcagtgtgccaccctactgcgtgggatctggggaagggcgatttcaggatacttatgtgcacgaaggtcactatggatgacttcttgacagcccatcacgaaatgggtcacatacagtacgacatggcctacgccgcccagcctttccttctgcggaacggggcgaacgagggtttccatgaggccgtcggagaaatcatgtccttgagcgcagcaaccccaaagcacctgaaatccattgggcttctgagccccgacttccaggaggacaatgagacagagatcaatttcctgctgaagcaggccctgacaatcgtcggtaccctgccttttacctatatgctggaaaagtggcgctggatggtattcaaaggagaaattcctaaggatcagtggatgaaaaaatggtgggagatgaagcgggaaatagtgggagttgtcgaacctgtccctcacgatgagacgtactgcgatcccgcgagcctcttccatgtgtccaacgattatagcttcatacggtactacacgcgaacattgtatcagttccagttccaagaggcgctgtgtcaggcagcaaaacacgaggggcctctgcataaatgtgacatcagcaattccactgaagcgggccagaaactgttcaacatgttgaggctggggaagtctgaaccttggaccttggccctcgagaatgttgtgggggccaagaacatgaatgtaaggccactgctcaactatttcgagccgctgttcacctggctcaaggatcagaacaaaaactcttttgtcggctggagcaccgactggagtccatacgctgaccagtctataaaagtacgcatctctcttaagagcgcacttggcgataaggcctatgaatggaatgacaatgagatgtacctgttcaggtcatctgtcgcctatgctatgagacagtatttcttgaaggtgaaaaaccagatgatcctgtttggggaagaagacgttcgggtggctaaccttaaaccccgcatatccttcaatttttttgtaaccgcgcctaaaaacgtcagcgatatcataccccggactgaggtcgagaaagcaataagaatgtctagatctaggatcaacgatgccttcaggctgaatgataactccctggaattcttgggcatacagcctactctgggccctccgaaccagccacctgtgagcatttggctcattgttttcggagtggtgatgggcgtcattgtggtggggatagtaatcctcatctttactggaatccgcgacagaaagaagaagaacaaggctaggagcggtgagaatccctacgcgtctatcgatatcagtaagggagaaaacaatcctggttttcagaataccgacgacgtccaaacctctttt

SEQ ID NO: 6223 - DNA, 2415 bp, Artificial Sequence
  Description of Artificial Sequence: Synthetic coding sequence
atgtcaagtagcagctggctactccttagtctggttgcagttacagccgctcaaagcactattgaggagcaggccaagacctttttggataagttcaaccatgaggccgaggatctgttttatcagtcatccctcgcttcttggaattacaacactaacattaccgaagagaatgtgcagaatatgaacaatgccggagacaagtggagtgcttttcttaaggagcaatctaccctggcacagatgtaccctctgcaggaaatacagaatctgactgtcaaactccaactccaagcactccagcagaacggctccagtgttctgagcgaggacaaatccaagaggcttaacactatacttaatactatgagcaccatatacagcacgggcaaagtctgcaatccagacaatcctcaagaatgcctgttattagagcccggattgaacgagattatggccaatagtctggattataacgagcgcctgtgggcctgggagagctggcgttctgaagtgggtaagcaactgaggcccttatatgaagagtatgtggtgctcaaaaatgaaatggccagggccaaccactatgaagactatggggactactggcgcggggactatgaagttaatggggttgacgggtatgattactcaagaggacaattgattgaggatgtggaacacactttcgaagagatcaagccactatacgaacacctgcatgcttatgtccgggccaagctgatgaatgcttacccttcttatatctcaccgatcggatgcctacccgcccacctcctgggagatatgtggggacgcttttggacaaacctgtattctctcactgtacccttcgggcagaaaccaaacatagatgtgactgatgctatggttgaccaagcatgggacgcccaaaggatctttaaagaggctgaaaaattttttgtgagtgtgggcctccctaacatgactcagggattttgggagaattctatgctcaccgatcccggtaacgtacagaaggctgtgtgccatcctacagcctgggatctggggaagggcgactttcgaatcctgatgtgcacaaaggtgacgatggacgatttcctgacggctcatcacgagatgggtcacatccaatacgacatggcatacgccgcccagccttttcttctccgaaacggagccaatgaagggttccacgaagctgttggcgagatcatgtcactgagcgctgccacacccaaacaccttaagtctattggccttctaagcccggacttccaggaggacaacgagactgaaatcaacttcctgttaaagcaagccttgacgatcgtgggaactctgccattcacctatatgctggaaaagtggagatggatggtgtttaagggtgaaataccaaaagatcagtggatgaagaaatggtgggagatgaagagagaaattgtgggcgtggtcgagccagtgccccatgatgagacctactgtgaccctgcctcactctttcacgtctccaacgactactcgtttatcagatattacaccaggactttgtaccagtttcaatttcaggaagcactgtgccaagcagccaaacatgagggccccctccataaatgcgacatctctaatagcacagaggcggggcagaaattgttcaatatgctgaggctgggcaaaagtgaaccatggaccctggctctcgagaatgtagtgggagctaagaatatgaatgtgcgcccgttattgaactattttgaaccactgtttacctggctcaaagaccagaacaagaattcgttcgtggggtggagcacagactggtccccctatgcagaccagtcaatcaaggtcaggatcagcctgaagtccgctttgggcgacaaagcatacgagtggaacgacaatgagatgtatctgtttaggtctagtgtggcttacgcgatgcggcagtattttctcaaagtcaaaaatcaaatgattctttttggtgaagaagacgttcgcgtggcaaatttaaaaccgcggatatctttcaatttctttgtgacagccccaaagaatgtttctgatatcatcccgcggacagaggtcgagaaggccattagaatgtctcgtagccgcattaacgatgcctttaggctgaacgataatagtctggagttcctgggcattcaacctacgcttggacctcccaaccagccccctgtctctatttggcttattgtgtttggggtcgtcatgggtgtcattgtcgtgggaatcgtgattctgatctttactggcattcgagatcgcaaaaaaaagaacaaagcccgctctggagaaaacccgtacgcatccattgacatttcaaaaggagagaacaacccaggcttccaaaacacagatgacgtacagacatctttc

SEQ ID NO: 6224 - DNA, 2415 bp, Artificial Sequence
  Description of Artificial Sequence: Synthetic coding sequence
atgtcttccagttcctggctcttgctgtcgctggtcgccgttactgcagcacagtcaactattgaggaacaggcaaagacttttctggacaagtttaaccacgaggcagaggatctgttctaccagtccagtttggctagctggaactacaacaccaacattacggaagagaatgtccagaacatgaacaatgccggcgacaagtggtccgcatttctgaaagagcagagcactctggcccagatgtatcccttgcaggagattcaaaatttaaccgtgaagcttcagctccaagccttgcagcaaaatgggtcgtccgtgctgtcagaagataagtcaaaaagactcaacacaattctcaacaccatgtctactatctacagcacaggtaaggtgtgtaaccctgacaatccccaggaatgcctgctgctggagccaggtcttaacgagatcatggccaactccttagattacaacgaacggctgtgggcttgggagagttggcgtagcgaggtggggaagcagctccggcccctgtatgaggagtacgtcgtcctgaaaaatgaaatggctcgcgctaatcactatgaggactatggagactattggcggggtgactacgaagtgaatggcgtcgacgggtacgattattcccgaggtcagttgatagaggatgtggagcatacatttgaggagattaaaccactctatgaacaccttcacgcatacgtcagggcaaagttgatgaatgcctatccaagctacatttctccaattggctgcttgcccgcccacctgctcggcgacatgtgggggagattttggaccaacctgtatagcctcactgtcccctttgggcagaagcctaatattgatgtaactgacgctatggtagatcaagcatgggacgcccagagaatcttcaaggaagctgaaaaattttttgtgtccgtgggcttacctaatatgacccaggggttctgggagaactcaatgctcacagatcccggtaatgtgcagaaagctgtgtgtcatccaacggcctgggatctaggaaagggtgatttcagaattctcatgtgtaccaaagtcactatggacgactttctcactgctcatcacgagatgggtcatatccagtatgatatggcttacgctgcccagccgtttctgctgcgaaatggcgcaaatgaaggtttccatgaagctgtaggggaaatcatgagcctgtcggcggctacccccaagcacctgaagagtattggcttgctgtctcctgacttccaggaagacaacgagaccgagattaatttcctgctcaagcaggctctgaccatcgtgggcactctacccttcacctatatgctggaaaagtggcgttggatggtcttcaaaggcgagatccccaaggaccaatggatgaaaaagtggtgggagatgaagcgcgagatcgtgggggtggtcgagccagtgccgcacgacgaaacctattgtgaccccgcctctctcttccatgtgtccaacgactattccttcatacggtactatactaggaccttgtatcagttccagtttcaggaggctctttgtcaggccgccaagcacgagggtcctcttcacaagtgcgatatctccaattccaccgaggctggtcaaaagctgttcaacatgctgaggcttggaaagtcagagccgtggacactcgctctcgaaaacgtggtgggagccaagaatatgaacgtgcgccccctcctgaactatttcgaacctctgttcacatggctgaaagatcagaataaaaattcctttgtgggttggtcaacggattggtcgccttacgctgaccaaagtatcaaagttcggataagcctcaaatctgccctgggagataaggcctacgaatggaatgacaatgagatgtatctgttccggagcagtgtggcttacgcgatgaggcaatacttcctgaaagtaaaaaatcagatgatactcttcggcgaagaagatgttcgcgtggcgaatctgaagccacgaatatcctttaacttctttgtgaccgcacccaagaacgtatccgatatcattcccaggaccgaggtagaaaaagctatcaggatgtcacgcagccggatcaacgatgccttccggctgaacgacaactccctcgagttcctgggaattcagcctacattgggtccccccaaccagcccccagtttccatctggctgatagtgtttggtgttgtgatgggagtcatcgtcgtggggatcgtcattctgatctttactggcatcagagataggaagaaaaagaataaggcacgcagcggcgagaatccttacgcctcaattgatatctcaaagggagagaacaacccaggtttccaaaacacagacgatgtgcagactagcttc

SEQ ID NO: 6225 - DNA, 2415 bp, Artificial Sequence
  Description of Artificial Sequence: Synthetic coding sequence
atgtcatccagctcatggctcctgctgtcgcttgtcgctgtgactgcagcccagtccacgatcgaggaacaagcaaagactttcctggataagttcaaccatgaagctgaagatctgttttaccagtcctcgctggcctcgtggaactataacaccaatatcacggaagaaaacgtgcaaaacatgaacaacgcgggcgataagtggtctgcttttttgaaagaacaatcgacgctggcacaaatgtatcctctgcaggagatccaaaacctgactgtcaagctccagctccaggccttgcagcaaaacggatcgtcggtgctgtcagaagataagtcaaagcgcctgaacaccatcctgaataccatgtcgacgatctactcaactgggaaggtctgcaatcccgacaaccctcaggaatgcctgctgctcgagccaggcctgaacgaaatcatggcaaactcgctcgattacaacgagcgattgtgggcctgggaatcatggcggtccgaagtcggaaaacagctccggcccctctacgaagaatacgtggtgttgaaaaacgaaatggcgcgggctaaccactatgaagattacggagactactggcgtggagactatgaggtcaacggagtggacggatacgactactccagaggacagctgattgaggacgtggagcacacgttcgaagagatcaagccgctctacgagcacctccatgcatacgtgagagccaaactgatgaatgcctacccatcgtacatctcgccgatcggatgcctcccggcccacctgttgggcgatatgtggggaaggttttggactaatttgtacagcctcactgtccctttcggacaaaagcccaatatcgatgtgaccgacgccatggttgaccaagcatgggatgcacagcggatcttcaaagaagctgagaagtttttcgtgagtgtgggactgccgaacatgactcaggggttctgggagaactctatgctgacggatcctggtaatgtccaaaaggctgtgtgtcatccgactgcatgggaccttggaaaaggggacttccggatcctcatgtgtactaaagtgaccatggacgacttcctgactgcccaccacgaaatgggccacatccagtacgatatggcatatgcagcccagcctttcctcctccgcaatggcgctaacgaaggattccacgaggcggtcggcgaaatcatgagcctgtccgccgcgaccccgaaacatctcaagtcgattggactgctcagccccgacttccaggaggataacgaaaccgagatcaactttctgctgaaacaagctctgaccatcgtgggcacgctgccttttacctacatgctggaaaaatggcggtggatggtctttaagggggagatccctaaggaccagtggatgaagaagtggtgggagatgaaaagggagattgtgggggtcgtagaaccggtgccgcacgatgagacttactgcgaccccgcgtcgctgtttcacgtgtctaacgactacagcttcatccggtactacacgcggaccctgtaccagttccagttccaggaagcgctgtgtcaagcagccaagcacgaaggaccgcttcataagtgcgatatctcaaactcgaccgaggctgggcagaagctgttcaatatgctgcgcctgggtaaatcagagccttggaccttggccctggaaaatgtcgtgggagccaagaacatgaacgtgcgtccgctgctgaactacttcgaaccactcttcacgtggctgaaagaccagaacaagaattccttcgtgggatggtcgactgattggagcccgtacgcagaccagagcatcaaggtccgcatttcgttgaaatcagctctcggcgacaaggcctacgaatggaatgacaacgaaatgtatctgttccgctcgtcggtcgcctacgcaatgaggcagtacttcctcaaagtgaaaaaccagatgatcctgttcggagaggaggacgtccgcgtggcgaatctgaaaccgagaatttcgtttaacttcttcgtgaccgcacctaagaacgtgagcgatatcatcccgcggaccgaagtggaaaaagccatcagaatgtcgagatctcgcatcaatgatgcttttcgccttaatgacaatagtctggagttcttgggcatccagccgactctcggcccgccaaaccagcctccagtctccatctggctcatcgtgttcggagtcgtgatgggggtcattgtggtgggcattgtcattcttatcttcaccggtatccgggatcgcaagaagaagaataaggcacggagcggagagaatccatacgcgtccattgacatctccaaaggcgagaacaatccgggctttcaaaacaccgatgacgtgcagacctcgttc

SEQ ID NO: 6226 - DNA, 2415 bp, Artificial Sequence
  Description of Artificial Sequence: Synthetic coding sequence
atgagctcctcgtcctggctgctgctttctctggtcgcagtgactgcagcccagtctactatcgaagaacaggcaaaaactttcctggacaagtttaaccacgaagcagaggatctgttctaccagtcgtcactggcgtcgtggaattacaacactaatatcactgaagaaaacgtccaaaacatgaacaatgcaggagataaatggtccgcctttctgaaagagcaaagcactctcgcgcagatgtaccctctgcaagagatccagaacctcacggtgaagctccagctccaggcgctgcaacagaatgggtcatccgtcttgtccgaagataagtcgaagcggctgaataccatcctgaacaccatgtcgaccatctactcgactgggaaagtgtgtaatcccgacaatccgcaagaatgtctgctgctggaacccggactcaacgaaatcatggcaaactcgcttgactacaatgagcggctgtgggcttgggaaagctggcgctcagaggtcggcaagcaattgcggcccttgtacgaagagtatgtggtgctgaagaacgaaatggcccgagccaatcactacgaggactacggagattattggcggggagactacgaggtgaacggagtggacggatacgactacagccgggggcagttgatcgaagatgtcgaacacaccttcgaggagatcaagccgctgtacgaacacctgcatgcctacgtcagagccaagctcatgaacgcctacccgtcatacatctcacctatcggatgtctcccagctcacctgttgggcgacatgtgggggcgcttctggaccaatctctattcactgaccgtccctttcggacagaagcctaacatcgacgtcaccgacgcgatggttgatcaggcctgggacgcgcaaagaatctttaaagaagcagaaaagttctttgtgtcggtgggacttccgaatatgacccaaggattctgggaaaattccatgttgaccgaccccggcaacgtgcagaaggcagtgtgccacccaactgcatgggacctgggtaagggagatttcaggatccttatgtgcactaaagtgactatggatgatttccttacggctcaccatgagatgggccatatccagtacgacatggcctatgctgcgcagccgtttttgctccgcaacggcgcgaacgaaggatttcacgaagctgttggtgaaatcatgtcactgagcgcagccacgccgaagcatctgaagtcgattgggctgctctcgccggattttcaagaagataacgaaaccgaaatcaatttccttttgaagcaggccttgaccattgttggaacgctcccgttcacttacatgttggagaagtggagatggatggtgttcaagggagagattccaaaggatcagtggatgaaaaagtggtgggagatgaaaagagaaatcgtgggtgtggtggaacctgtgccacatgacgaaacgtactgcgatccagccagcctgttccacgtgtcgaacgactactccttcatcagatactacaccaggactctgtaccaattccagttccaggaggcgctgtgccaggctgccaaacacgaaggacccctccataaatgtgatatttcgaactcgaccgaggctgggcaaaagctgtttaacatgttgcgcctgggtaaatcggaaccgtggaccctcgccctcgaaaatgtggtgggcgcaaaaaacatgaatgtccggccactgttgaattacttcgagccgctgttcacctggctgaaggaccagaacaagaattcgtttgtcggatggtccactgactggtcaccgtacgcggaccagtccatcaaagtgcggatttccctgaagtcggccctcggcgacaaggcttacgagtggaacgacaatgagatgtacttgttcagaagcagcgtggcttacgccatgcggcagtacttcctcaaggttaagaaccaaatgatcctgttcggtgaagaggacgtgagagtggccaacctgaagccacgaatctccttcaatttctttgtcactgcaccaaagaatgtgagcgacataatcccacggaccgaggtggagaaggcgattcggatgtctcgctctcgcatcaatgacgccttccgactcaacgacaattcgctcgaatttcttggaatccaacctactctcggacccccgaaccagccgccggtgtccatctggctcatcgtgttcggagttgtgatgggtgtgattgtcgtcgggatcgtcatcctgatcttcaccggaattcgagatcgcaagaagaagaacaaggctcggtcaggtgagaacccgtacgcgtctatagatatctccaaaggggagaacaacccgggattccaaaacacggacgatgtgcaaacttcgttt

SEQ ID NO: 6227 - DNA, 2415 bp, Artificial Sequence
  Description of Artificial Sequence: Synthetic coding sequence
atgtcttcatcctcatggcttcttctgagcttggttgccgtcaccgctgctcagtctactattgaagagcaagctaaaaccttcctagataaatttaaccatgaggctgaagatctcttttatcagtcgagcttagcctcttggaactacaatacaaatatcactgaggaaaacgtccaaaacatgaataacgctggcgataaatggtctgcctttctaaaagaacagtcaaccctcgctcaaatgtacccgcttcaagagattcaaaatttaacagtgaagcttcaattgcaagccttgcagcagaacgggtcttctgttctgtcagaggataaaagtaaaaggttgaacacgatactgaatacgatgtccacaatttatagtacaggaaaagtgtgcaaccctgacaacccgcaggaatgcctattgctcgaaccaggcctcaacgaaatcatggccaacagcctcgattacaatgaacgtctgtgggcgtgggagtcatggaggtcggaggtgggtaagcagttacggccattatacgaagaatacgttgtactgaagaatgagatggctagagcaaatcactatgaggactatggagattactggagaggtgattatgaggttaacggggtagatggatacgattattcacgtggtcaattgattgaggacgtggagcacacgttcgaagagattaaacctctttacgaacatttgcatgcttatgtccgtgctaagcttatgaatgcatacccttcgtatataagtccaatcggatgcctcccagcacaccttcttggagacatgtggggaagattttggacgaacttgtattccttaactgttcctttcggacagaaacctaatatagatgtgacagatgcgatggtcgatcaggcttgggatgcacagagaatctttaaggaggccgagaagttctttgtgtcggtggggctaccaaacatgactcagggtttttgggagaactctatgctaacagatcctggtaacgtacaaaaggccgtctgccatcctaccgcttgggatcttggaaaaggggacttccgaatacttatgtgcaccaaggtgacgatggatgactttcttacggcccatcatgagatgggacatattcagtacgatatggcttatgccgctcaaccttttctattacgcaacggagcgaacgagggtttccatgaagccgtcggagagatcatgagtttatcagctgcgacaccaaaacacttaaaatctatcgggctccttagtcccgatttccaggaagataatgaaaccgaaatcaattttctccttaagcaggccttgactattgttggtacactccccttcacttatatgcttgagaaatggcgctggatggtatttaagggcgagatccctaaagatcaatggatgaagaagtggtgggagatgaaaagagagattgtgggtgttgttgaaccagttccgcatgacgaaacatattgtgatcctgcgagcctgtttcatgtaagcaatgactattcattcattcggtattacactagaactctctaccaatttcaattccaagaggcactatgtcaggctgcaaaacatgagggtcctttgcataaatgtgatatttcaaattcgaccgaagcaggtcaaaagctgtttaacatgttgagattgggtaaatcagaaccatggacattagccttagaaaatgttgttggcgccaagaatatgaatgtgcgtccattgttgaattacttcgagccgctttttacctggttgaaggatcagaacaaaaactcatttgtaggatggagtacggactggtcaccttatgctgatcagtctattaaggttcgtatttcattgaagagcgctctcggcgacaaagcttatgagtggaacgataatgaaatgtatttgttccggtcttcagtagcctatgctatgcgacaatattttctgaaggtaaaaaaccagatgatcctttttggcgaagaggacgtgagagttgctaatttgaagccacggatctccttcaactttttcgttacagccccaaaaaatgtgagcgatattattccgaggacagaggttgaaaaagctatacgtatgtcccgaagcagaatcaatgacgcttttaggttaaacgacaattcacttgaattcctaggtattcaacccaccctcggtcctcctaatcaacctcctgtgtcgatatggttgatagtcttcggtgtcgtaatgggagtaatcgtcgttggcattgttatacttattttcacaggtattcgtgatagaaaaaaaaaaaataaagcaagatcgggagagaacccttacgcttccattgatatctctaaaggggaaaataatcctggttttcaaaacaccgatgatgtccagacatccttt

SEQ ID NO: 6228 - DNA, 2415 bp, Artificial Sequence
  Description of Artificial Sequence: Synthetic coding sequence
atgtcgtcgtcgtcatggcttctgctgtcactcgtggccgtcactgcagcacaatccaccatcgaagaacaggccaaaactttcctcgacaagttcaatcatgaagcggaagatctgttctaccaatcatccctggcctcctggaactacaacactaacatcacggaagaaaacgttcaaaacatgaacaacgcgggagataagtggtcagcgtttctgaaggaacagagcaccctcgcgcagatgtacccactccaagaaatccaaaacctgactgtgaaactccaactgcaagcccttcagcagaacggcagcagcgtgctgtccgaagataaaagtaagcgccttaataccattctgaacactatgtccactatctatagcaccgggaaagtgtgtaacccggataacccgcaggaatgcctgttgctcgagccaggactgaacgagataatggcgaactcactggactacaatgaaaggctgtgggcgtgggaaagctggaggtccgaagtgggtaaacagctgaggccgctttatgaggagtacgttgtgcttaagaatgaaatggcaagagccaatcactatgaagattacggggactactggcgaggcgattacgaagtcaacggagtcgatggatacgactactctcgcggccaactgatcgaggacgtcgagcacaccttcgaggaaatcaaaccactctatgaacatctgcacgcttacgtgcgcgcgaagttgatgaacgcctacccgtcatacatttcgccgatcggatgcctgccggctcacctgctcggcgacatgtgggggcgcttctggactaacctctactcgctgacggtgccattcggacagaagccaaacattgacgtgaccgacgccatggtcgaccaggcctgggacgcccaacggattttcaaagaagcagagaagttctttgtgagcgtcggactcccgaatatgacccagggattttgggagaactcaatgcttacggatcctgggaatgtgcaaaaagccgtatgccacccgactgcgtgggatctcggaaagggcgacttccggatcctgatgtgcactaaggtgaccatggatgacttcctcacggcgcatcatgagatgggccacatccagtacgacatggcctacgctgcacagccattcctcctgcggaacggtgccaacgagggcttccacgaagccgtgggcgagatcatgtcgctgtcagccgcgactccgaagcatctgaaatccatcggcttgctcagcccggatttccaagaggacaacgagacggaaataaacttcttgctcaagcaggctttgaccattgtgggcaccctgcctttcacgtacatgctggagaagtggagatggatggtcttcaaaggagaaattccgaaagaccagtggatgaagaagtggtgggagatgaagcgggaaattgtgggcgtcgtggagcccgtgccgcatgacgaaacctactgcgatccagcgtccctgttccacgtgtcgaatgactacagctttatccgatactacactcgcactctgtaccaatttcagttccaggaagctctgtgccaggcagctaaacacgaaggacctctccacaaatgtgatatctcgaactctacggaagcaggacagaaactgttcaatatgttgcggttgggtaaatcggagccgtggaccttggctttggagaatgtggtgggtgccaagaacatgaacgtccgcccactcctgaactactttgagcctctgttcacttggctgaaggaccaaaacaagaactcttttgtaggatggtccacggattggagcccttacgccgaccagtctatcaaagttagaatctctcttaagtccgcactcggtgataaggcttacgaatggaacgacaacgagatgtacctctttcgctcgtcggtcgcctacgccatgcgccagtactttctgaaggtcaagaatcagatgatcctcttcggcgaagaagatgtgagggtggcgaatctgaaacccagaatctccttcaacttctttgtgacggcacctaagaacgtgagcgacatcatcccacgcaccgaagttgagaaagccatccggatgtccaggtcgcgcatcaatgacgcatttagactgaatgataattccctggagtttctgggaatccaaccaacgctcggaccgccaaatcagccgcccgtgagcatctggctgatcgtgttcggagtcgtgatgggggtaattgtcgtcggcatcgtgattctcatcttcactgggatccgcgatcggaagaagaagaataaggcacggtcaggagagaacccgtacgcgtcgatcgacatctctaagggagagaacaatccaggtttccagaataccgacgatgtgcaaacctccttc

SEQ ID NO: 6229 - DNA, 2415 bp, Artificial Sequence
  Description of Artificial Sequence: Synthetic coding sequence
atgagttcgtcttcgtggcttttgctatcactggtcgcggttaccgcggcgcagtccaccattgaggagcaggccaagaccttcctagataaattcaaccatgaagcggaggatctcttctatcagtcctcgctggcctcctggaactataatacaaacatcaccgaagagaacgttcagaacatgaataacgcgggagataaatggagtgcattcttgaaggaacagtcaaccctagcgcagatgtacccgcttcaagagatccagaatcttaccgtgaagctccaactgcaggctctacagcaaaatggctctagtgtgctgtccgaggataaatcgaaacgccttaacacgatcctaaacacgatgtctacaatctattccaccggcaaggtctgcaacccggataacccgcaggagtgccttctgttggagccgggtttgaacgagattatggctaactcgttggactacaatgagagactgtgggcatgggagtcttggaggtcggaggtcggaaaacaactccgcccactgtatgaggaatacgtagtcctcaaaaacgagatggcgcgggcaaaccattacgaggattacggcgactactggagaggagactatgaagtcaacggagtggatggatacgactattcccgaggccagctaatagaagacgtggagcatactttcgaagaaattaagccactgtatgaacacctgcatgcatacgtgagagcaaagctaatgaatgcctatccgtcatatatctccccgataggctgcctaccggcgcatcttcttggagatatgtgggggaggttctggacaaatttgtattcgctcactgttccgttcggacaaaagccaaacattgacgttacggacgctatggttgatcaggcttgggatgctcaacgaatatttaaagaggccgaaaagtttttcgtgtcagtcggcctccctaatatgacgcaggggttttgggaaaattcaatgttgacagatcctggcaacgtccaaaaagcggtttgtcatcccacagcttgggacctgggaaaaggagatttccgtattcttatgtgcaccaaggtgaccatggacgatttcttaacggcccaccatgagatgggacatattcaatatgacatggcctatgcagcgcagccattcctgctgcgcaacggcgcaaacgagggttttcatgaagcagttggagagattatgtctttgtcagccgcgacgcctaaacatctaaagtctatcggacttctctctccggactttcaggaagataacgagactgagattaacttcctcctgaaacaggcgcttactatagtaggaacccttcccttcacttacatgcttgagaagtggcgttggatggtttttaaaggtgaaatcccgaaagatcaatggatgaaaaaatggtgggaaatgaaacgcgagatcgttggcgtcgtggagcccgtgccacatgatgaaacctattgtgaccccgcctcactctttcacgtctcaaacgattacagtttcatcaggtattatacaagaaccctttaccaatttcagttccaggaagcgctctgtcaagccgcgaagcatgaaggtccactacataaatgcgacatttccaactcaaccgaagctgggcagaagctattcaatatgttaagactcggaaagagcgagccatggacccttgcgctcgagaacgtcgtgggggctaaaaatatgaatgtccggcctctattaaactactttgaaccgctctttacatggctgaaggaccagaacaaaaattcctttgttggttggtctaccgactggtcgccctatgccgatcagagcatcaaagtccgcatctctcttaagagcgccttgggtgataaagcgtatgaatggaatgataacgaaatgtacctgttccggagcagtgtggcttacgcgatgcgacagtatttcctgaaggtgaagaatcaaatgatcctctttggtgaagaagatgtcagagttgcgaacctaaagcctcgtatctcttttaatttttttgtcaccgccccgaagaacgttagtgacatcatacctcgcactgaagttgagaaggccatccgtatgagccgttcacgtataaatgatgccttcagactgaacgacaactcactcgagttccttggaatacaacctacgctcggaccaccaaaccaaccaccagtctctatttggcttattgtcttcggtgtcgttatgggcgttatcgtcgttggaatcgtcatcttgatcttcacgggtatccgggaccgcaagaagaagaataaagcgcgctctggtgaaaatccgtatgccagtatcgacatttcgaagggcgaaaataaccccggattccagaacacggatgacgtgcaaacttctttt

SEQ ID NO: 6230 - DNA, 2415 bp, Artificial Sequence
  Description of Artificial Sequence: Synthetic coding sequence
atgtcgagttcatcctggctcctcctgagtttagtcgcagttaccgctgcacaatcaactatagaagagcaggctaagaccttcctcgataagttcaaccatgaagctgaagatctcttttatcagtcatctctggcttcatggaattataatactaacataactgaagaaaatgtccagaacatgaacaacgcaggtgacaagtggtcagcattccttaaagagcagagcacgttggcccagatgtatcctcttcaggaaatacagaaccttacggttaagcttcagttgcaggcactgcaacagaacggatcctctgtgcttagtgaggataagagcaagcggttgaacaccatccttaacacgatgagcactatctacagtaccgggaaggtttgtaatccagacaatccacaggaatgtctgctcctggagcccgggctgaacgaaataatggctaactcacttgattacaacgaaaggctgtgggcatgggaaagttggcgttcagaggtgggtaagcagctaagaccactctacgaagagtatgttgtgctgaaaaacgaaatggcaagagcaaaccattacgaggattatggagactactggcgtggagactacgaggtgaatggcgtggatgggtacgactatagccgtggccaactgattgaggacgtggagcacacctttgaggagataaaacccctctatgagcacctccacgcgtatgtgcgcgcaaagctgatgaacgcttacccctcatacattagtcctattggctgtctccccgcccacctattaggagacatgtggggccgcttttggacaaatctgtacagcctaaccgtgcccttcggccagaaacctaatattgacgttactgacgccatggtcgaccaggcatgggacgctcagagaatttttaaagaagccgagaagttctttgtttcggtcggcctccctaatatgacccagggtttctgggagaatagcatgctcacggaccctggtaacgttcagaaagccgtgtgccaccccacagcttgggacctgggcaagggggatttcaggatcctcatgtgcaccaaggtcacaatggatgactttttgaccgcgcaccacgagatgggccacatacaatacgacatggcttacgctgcccagccattcctattgcggaacggagccaatgaggggttccatgaggcggtgggtgaaataatgtcactttccgcagcaaccccaaaacaccttaagtcaattggtttactgtctcctgattttcaggaagacaacgaaaccgagattaactttctgctgaagcaggcactgacgatcgtgggcacactgccgttcacgtacatgcttgagaaatggcgctggatggtcttcaaaggggaaatcccaaaagaccagtggatgaagaagtggtgggagatgaaacgcgagattgtaggggtcgtggaacccgtaccccacgatgaaacctactgcgaccctgcctccttgtttcacgtgagcaatgattattctttcattcgttactatacacggactttgtaccagttccaattccaggaagccctctgtcaggccgctaagcacgaggggccgttgcacaagtgcgacatctctaattctactgaagctggccagaaactctttaatatgctgcgtctgggaaaaagtgaaccatggacactggccctggaaaacgtggtcggcgctaaaaacatgaatgtgcgacctctgctgaattacttcgaaccattgtttacctggttgaaggaccagaataaaaattctttcgtcggctggagcaccgactggtcaccttacgcagaccaatctattaaggtaagaatctccttgaaaagtgccctgggggataaagcctatgagtggaatgacaatgagatgtacctttttcgcagctccgtcgcatacgctatgaggcaatatttcctcaaggttaagaatcagatgattttattcggtgaggaagatgtgcgtgtggccaacctgaaaccccgaatctctttcaattttttcgtaacggctcctaagaacgtgtcagatatcatcccgaggacagaggtagagaaagcaatacggatgtcccgatcccgtataaacgatgctttccgattgaatgataattccttggagttccttggcattcagcctacgttaggcccacctaaccaaccccccgtaagcatctggctgatagtgttcggagtggtcatgggcgtgatcgtggtcggcatcgttatcctgatattcacagggattcgtgacaggaaaaaaaagaataaagccaggagtggcgagaacccctatgccagcatagacatcagcaaaggcgaaaacaatccgggcttccaaaacacagatgacgtccagactagcttc

SEQ ID NO: 6231 - DNA, 2415 bp, Artificial Sequence
  Description of Artificial Sequence: Synthetic coding sequence
atgtcaagcagcagctggttgctcctttcactggtagcggtcacggccgcccagtcaaccattgaagaacaggccaagacttttctggacaagttcaaccacgaggccgaggacctcttctaccaaagcagccttgcctcgtggaattacaatactaacattaccgaagaaaatgtccagaacatgaataacgccggagacaagtggtcagcgttcttgaaggagcagtcaactctggcacagatgtacccgttgcaagaaatccagaacctcactgtgaagttgcagttgcaggctctgcaacaaaatggatcctctgtcctttccgaggataaatcgaagcggctgaacactatcctgaataccatgtctacgatttactccaccggaaaggtgtgcaatccggacaatccacaagaatgcctcctgctcgaacctggactgaacgaaatcatggctaactcgctggactacaacgagcggctgtgggcgtgggagtcctggcgctcggaagtgggaaagcagctccgccctctgtacgaagaatacgtggtgttgaaaaatgagatggcccgggcaaaccactacgaggattacggggactactggagaggagactacgaggtgaacggagtggacggctacgattactccaggggtcaactcatcgaagatgttgagcacacctttgaagagatcaaaccactgtacgaacacctgcacgcgtatgtgcgggctaaactcatgaacgcatacccgagctacatctccccgatcgggtgcctgccggcgcacctgctgggagacatgtggggacggttctggactaatctgtattccctgaccgtgccattcgggcagaaaccgaatatcgacgtgactgacgccatggtggaccaggcctgggatgcgcagcgcatctttaaggaagcggagaagttcttcgtctccgtgggactcccaaacatgacccagggattttgggaaaattcaatgctcaccgacccgggcaatgtgcagaaagccgtgtgccacccgaccgcttgggatctcggaaaaggagacttcagaatcttgatgtgcaccaaggtgaccatggacgactttctgaccgcgcaccatgaaatgggacatatccagtacgacatggcttacgccgcacaaccctttctgctgcggaacggtgctaatgaaggcttccacgaagccgtcggagagatcatgtccctttccgccgccactccgaaacacctgaaaagcatcggccttcttagcccagattttcaagaggacaacgagactgagatcaacttcctcttgaaacaagcgctgaccattgtcggaacgctcccattcacctacatgctggagaaatggcggtggatggtgtttaagggagaaatacctaaagatcagtggatgaagaagtggtgggaaatgaagagagaaatcgtgggagtcgtggaaccggtcccacatgatgaaacctactgcgatccagcttcacttttccatgtgagcaacgattactcgttcatccgctactacacgagaactctgtaccaattccagtttcaggaagccctttgtcaggccgcgaagcacgaaggaccactgcataagtgtgacatcagcaacagcactgaagccgggcagaagctgttcaatatgttgagattgggcaaaagcgaaccttggaccctcgctcttgaaaacgtggtgggagccaagaatatgaatgtgaggccccttctgaattacttcgagcccctgttcacgtggttgaaggatcagaataagaactcgttcgtcggatggtccactgactggtcaccttacgccgaccagagcatcaaggtgcgcatctctctgaagagcgctctcggcgacaaggcctacgaatggaacgataacgaaatgtacctgtttcgctcgagcgtggcatacgccatgagacagtacttcctcaaggtgaaaaatcagatgatcctgttcggcgaagaggacgtcagagtggcaaacctgaagccgcggattagtttcaatttctttgtgaccgcgccgaagaatgtgtccgacatcatcccacgcacggaagtggaaaaagcgatcaggatgtcgaggtcacggattaatgatgcgttcagattgaatgacaactcgctcgaattcttgggcatccagccgactttgggcccaccgaaccaacctccggtgtccatctggctgatcgtctttggtgtcgtgatgggtgtgatcgtcgtgggaatcgtgatactcatcttcacgggaatccgggaccggaagaaaaagaataaggctagatcgggagagaatccatacgcctcaatcgatatttcaaaaggagagaacaacccaggattccaaaacactgatgacgtccagacctcattc

SEQ ID NO: 6232 - DNA, 2415 bp, Artificial Sequence
  Description of Artificial Sequence: Synthetic coding sequence
atgtcatcgtcctcgtggcttctcctctcactggtggcagtgactgcagcgcagagcaccatcgaggaacaggccaagacgttcctggacaaattcaaccacgaggccgaggatctcttttaccaaagcagcctggccagctggaactacaacaccaacatcaccgaggagaacgtgcagaacatgaataatgccggtgacaaatggtccgcctttttgaaagaacaatcaaccctggctcagatgtacccactgcaggaaatacaaaacctgacggtaaaactgcagctccaggccctgcagcagaacgggtcatcagtcctgagcgaagataagtcgaaacggttgaacaccatcctgaataccatgtccactatctacagcactgggaaggtttgcaacccagacaatccacaggaatgtctcctgctggaacctggactgaacgagatcatggccaatagcctggactacaacgaaagattgtgggcctgggaatcctggagatcggaggtcggcaagcaactgcgcccgctctacgaagaatacgtggtgctcaaaaatgagatggcgcgcgcaaaccactacgaggattatggcgactactggcggggagattacgaggtgaacggagtggatggctacgattactcgcggggccagttgatcgaagatgtcgagcacaccttcgaggaaatcaagccgctgtacgagcacttgcacgcctatgtgcgggccaagctcatgaatgcatacccatcgtacatttctccgatcggttgcctgccagcgcacctgctcggagacatgtggggccggttctggaccaatctgtatagcttgacggtcccattcggacaaaaaccaaatatcgatgtgactgacgccatggtggaccaagcctgggatgcacagcgcatctttaaggaggctgagaagttttttgtgtccgtcggactgcccaacatgacccagggtttctgggaaaactccatgctgactgaccctggcaacgtccagaaggccgtctgccaccctaccgcgtgggatcttggtaagggagactttcggatcctgatgtgtacgaaggtgactatggacgatttcttgactgcgcatcacgagatgggacacatccagtacgacatggcttacgccgcacaacctttcctgctgcgcaacggagccaacgaagggtttcacgaggctgtgggtgaaatcatgagcctctcggcggcaactccaaagcatctgaaatccatcggcttgctttctccggacttccaggaagataacgagactgagatcaacttcctgctcaagcaggcactcaccatcgtgggcactctgcccttcacttacatgctggagaagtggcggtggatggtgtttaagggcgagattccgaaagatcagtggatgaaaaagtggtgggaaatgaagcgggaaatcgtcggagtcgtggaacccgtgccgcacgacgaaacttactgtgatccggcatcgctgttccacgtgtcgaatgactactcgttcattcgttattacactcgcactctgtaccaattccaatttcaggaggccctgtgccaggctgcgaagcatgagggaccgctgcataagtgtgacatctccaattcgactgaagctggacagaagctgttcaacatgctccggctgggaaagagcgaaccatggactcttgcgcttgagaacgtggtcggcgctaagaatatgaacgtccggccgcttctgaactatttcgagccgctgttcacttggcttaaagaccagaataagaactcattcgtggggtggtcgactgactggtccccttacgccgaccagtcaatcaaggtgagaatctcgctcaagagcgccctcggtgataaggcatacgagtggaacgataacgaaatgtatctgtttcggtccagcgtcgcttacgccatgcggcagtacttccttaaggtcaagaatcagatgatcctcttcggcgaggaggacgtgcgggtcgccaatctgaaaccacggatcagcttcaacttttttgtcaccgcccctaagaatgtgtccgatatcatcccccgtaccgaggtggagaaggccatcaggatgtctcgcagccgcattaacgatgcattccgccttaacgataattcgctcgagtttttgggaattcagcccacccttgggccacctaaccaaccaccggtcagtatctggctgatcgtgttcggtgtggtgatgggcgtcattgtggttggaattgtgatcctcattttcaccggcatccgcgacagaaagaaaaagaataaggcgcggagcggtgagaatccatacgcgtccatcgacatctccaagggagagaataaccccggattccaaaacaccgacgacgtgcagacttccttt

SEQ ID NO: 6233 - DNA, 2415 bp, Artificial Sequence
  Description of Artificial Sequence: Synthetic coding sequence
atgagtagttcaagttggctcctgttgagcctggtggccgtcactgcagcccaaagtacaatcgaagagcaggccaagaccttcctggacaagttcaaccatgaagccgaggatttattctatcagagctctctggcgtcctggaactataacacgaatataaccgaggaaaatgtccagaatatgaacaacgcaggcgataagtggtccgcattcttgaaggaacagagcaccttggcccagatgtaccccctccaggagatccagaaccttactgtgaaactccagctgcaggccctccagcagaatggaagctccgttttgtctgaggacaaatctaagcggctgaacacaattctgaatactatgtctacgatatactcgaccggtaaggtttgcaaccccgataacccccaggagtgccttctgctggaacccggcttgaacgagattatggcaaattctttggactacaatgagagactttgggcatgggagagctggcgaagcgaagtgggcaagcaactgaggcccctttacgaggagtacgtggtactgaaaaacgaaatggcgcgtgccaatcattacgaggactacggagactactggaggggtgactacgaagtgaacggcgtggacggctacgactacagtcgggggcagctgatcgaagatgtagagcacaccttcgaggagattaaaccactctatgaacatctccacgcttatgtgcgagctaagctcatgaatgcttacccttcatatatttctccaattggatgccttccagctcatctgctaggtgacatgtggggaaggttttggacaaatctctattctctgaccgttccatttgggcagaaacctaacattgacgtgacagatgctatggtggaccaagcttgggatgcacagaggatctttaaagaggccgaaaagtttttcgtgagcgttggactgccaaatatgactcaggggttttgggagaatagcatgttgacagacccagggaatgtgcagaaggctgtctgccaccctaccgcatgggacttaggaaaaggagacttccgaattctgatgtgcacaaaagtgaccatggatgatttccttacagcacaccacgaaatgggacatattcagtatgacatggcctacgccgcccagccatttctcctccgcaatggagctaacgaaggttttcacgaggctgttggcgaaattatgtcactttccgccgcgactcctaagcacctgaagtctatagggctcctttctcctgacttccaggaagataatgagaccgagatcaatttcctgttaaagcaggcattaaccatagttggcacactgccatttacctatatgcttgagaaatggagatggatggtattcaaaggagagattcctaaagaccagtggatgaaaaaatggtgggagatgaagagggagatcgtcggcgttgttgaacctgttccgcacgacgagacttattgcgatccagcgagcttatttcatgtgtccaatgactattctttcattcggtattatacccggacgctatatcagttccagttccaggaggccctgtgtcaggccgccaagcatgagggcccattgcacaagtgcgacataagtaattcaacggaagctggccagaaactgttcaatatgcttcgtctcggaaagagcgagccatggactctggctctcgaaaacgttgtcggagccaaaaacatgaatgtacgacccctattaaactatttcgaaccactgtttacttggctgaaggatcaaaacaagaattccttcgttgggtggtcgaccgactggtccccctacgcagatcagtctatcaaggtaaggatttccctgaagagcgcattgggagataaggcctatgagtggaacgataatgagatgtatttattcagaagcagcgtggcctatgccatgagacagtactttcttaaggtgaagaatcagatgatcctctttggcgaggaggatgtgcgagtcgccaatttaaaaccgcggatctccttcaacttttttgtgaccgcccccaagaacgtgagtgatataataccccgaacagaggtcgagaaggcaatcagaatgagtcgttccagaattaatgatgcctttcgcctcaatgacaattccttagagttcctcggtatccagccaaccttaggacctcctaaccagcccccagtgagtatttggctcatagtgttcggcgtcgtcatgggtgttatcgtcgtgggtatcgtcatcctgatcttcactggaattagagataggaagaagaagaacaaagcccggtctggggagaacccgtacgccagcatcgatatctcaaaaggcgagaacaaccccgggtttcaaaataccgacgatgttcaaacctcgttt

SEQ ID NO: 6234 - DNA, 2415 bp, Artificial Sequence
  Description of Artificial Sequence: Synthetic coding sequence
atgtcctcaagctcgtggctgcttctgtcgctggtcgccgtcaccgcggctcaatcgacgatcgaagaacaggcgaaaaccttccttgacaaattcaatcatgaagcagaggatttgttctaccagagcagccttgcgtcgtggaactacaacaccaacatcactgaagaaaacgtgcaaaacatgaataacgcgggtgacaagtggtcggcctttcttaaagagcagtcaaccttggctcagatgtacccgctgcaggaaatccagaacttgaccgtgaaactccagctccaggcgttgcagcagaacggatcctcagtgctgtcagaagataagagcaaaagactgaatactattctcaacaccatgagcactatctactcaaccggcaaggtgtgtaaccctgacaatccgcaagaatgtctgctgctcgagccaggcctgaatgaaatcatggccaactcgctggattacaacgaacggctgtgggcgtgggaatcatggagatccgaggtgggcaagcagctccgcccactgtacgaagagtacgtggtgctgaagaacgagatggctcgggccaaccactacgaggattacggagactactggcggggagattacgaggtgaacggagtggacggctacgactactcaaggggacagctgatcgaggacgtggagcacactttcgaggaaatcaagccgttgtacgaacacctgcacgcttacgtgagagccaagctgatgaacgcctacccttcatatatctcccctatcggatgcctgcccgcacacctgctcggggatatgtgggggcgcttttggactaacctgtactcccttaccgtcccctttggacagaagccgaacatcgacgttacggacgccatggtggaccaagcctgggacgcccagagaattttcaaagaagccgagaagtttttcgtgtccgtcggcttgcccaacatgacgcaagggttctgggagaacagcatgctgaccgaccctggcaatgtccagaaggcggtgtgccacccgaccgcctgggatctgggtaagggagacttccgcatcctcatgtgtactaaagtgactatggacgacttcctgaccgcgcaccatgagatgggacatatccagtacgacatggcatatgccgcccagcccttcctgttgagaaatggagccaatgaaggattccatgaagccgtgggagagataatgtcgctgtccgccgccaccccaaagcacctgaagtctatcggcctgctgagcccagacttccaggaggacaacgaaaccgagatcaactttttgctcaaacaggccctgactatcgtgggaactctgccgtttacctacatgctggaaaagtggcggtggatggtgtttaaaggggaaatccctaaggaccagtggatgaagaagtggtgggaaatgaagcgcgaaatcgtcggagtcgttgaacccgtcccgcacgacgaaacctactgtgacccggcaagcctgttccacgtgtccaacgactactcgttcattcgctactacactcggactctctaccaatttcagttccaggaggccctgtgccaggcagcaaagcacgaaggcccgctccataaatgcgacatctcgaattcaaccgaggccggacagaaactgtttaacatgctccgtctgggaaagagcgaaccctggacgcttgcattggagaacgtggtcggagctaagaacatgaatgtgcggcctttgcttaactactttgagcctctcttcacctggctcaaagaccagaataagaattcgttcgtcggatggtccaccgattggtcgccgtacgcagaccagagcatcaaggtgagaatcagcctgaagtcggccctcggtgacaaagcgtacgagtggaatgataacgagatgtatctcttccgatcaagcgtcgcttacgcaatgcgccaatactttctcaaggtgaagaaccagatgatcctgttcggtgaagaggacgtgcgcgtggcaaaccttaagcctcggatctctttcaatttcttcgtgactgcaccgaagaacgtgagtgacattatcccgcggactgaagttgagaaagccatccgcatgtcgcggtccaggattaacgatgcctttcgcttgaacgacaattccctggaattcctggggatccagccgaccttgggaccaccaaaccagccaccggtgtccatttggctgattgtgttcggagtggtcatgggcgtgatcgtggtgggtattgtgatcctgatctttaccggtatccgggatagaaaaaagaagaacaaggcgcgctcgggagaaaacccgtatgcctccatcgacatctccaaaggagagaataaccctggattccagaacaccgatgacgtccagacttctttc

SEQ ID NO: 6235 - DNA, 2415 bp, Artificial Sequence
  Description of Artificial Sequence: Synthetic coding sequence
atgagctcttcttcgtggctgctcctgtcgctggtggcagtgaccgcggcgcagagcactattgaagaacaagcaaagactttccttgacaagtttaaccacgaggctgaggatctgttttaccagtcgtcgcttgcctcctggaattacaacactaacattaccgaagaaaatgtgcagaatatgaacaacgccggagataagtggagcgcatttcttaaggaacaatcgacgcttgcccaaatgtacccactccaagaaattcagaacttgactgtgaaacttcaactgcaggctctgcaacagaacgggtcatccgtcctgtcagaggataagtcaaagcgactgaacaccatactcaacaccatgtcaaccatctactccaccggaaaggtgtgtaacccggacaaccctcaagaatgtctgctcctggaaccaggacttaacgaaatcatggcaaattcactggactataacgagcgactctgggcatgggaatcctggaggagcgaggtcggaaagcagcttaggcccctttatgaagaatacgtggtgctgaagaatgaaatggcgcgcgcaaatcattacgaagattacggagattactggcgaggagattacgaagtgaacggtgtcgatggctacgactacagccggggacaactcattgaggatgtcgaacatacctttgaagaaatcaaaccgctttacgaacaccttcacgcatacgtgcgagccaaactcatgaacgcatacccttcctacattagccctataggatgccttcccgcacatctgctgggagacatgtggggaagattctggaccaatctgtacagccttacggtgcctttcggtcagaagccaaacattgacgtgaccgacgcaatggtggatcaagcatgggatgcgcagcggattttcaaggaagctgagaagttttttgtgtccgttggtctgcctaacatgactcaaggattctgggagaattccatgctgactgatcctggcaatgtccaaaaggccgtgtgtcatccaacggcatgggatctcggtaagggggattttagaatccttatgtgtaccaaagtcaccatggatgattttctgaccgcgcaccatgaaatggggcatatccagtatgacatggcctacgcggcacagccttttctgctgcggaacggtgctaacgaagggtttcatgaagctgtgggagaaatcatgtccctttcggcagccaccccaaaacatctcaaatcgatcgggcttctgtcacccgactttcaagaagataatgaaactgaaatcaatttcctcctcaagcaggcactcaccattgtcggcactcttccgtttacctacatgctcgaaaagtggagatggatggtgtttaaaggagaaattcccaaggaccaatggatgaagaagtggtgggaaatgaaaagagaaattgtcggcgtcgtggagccagtgccgcatgatgaaacctattgcgatcccgcatccctttttcatgtctccaatgattactcattcattcgttactacacgcgaactctttaccaatttcaattccaagaagccctgtgtcaggcggcaaagcatgaaggtcctcttcataagtgtgatatttcgaactcaactgaagcgggtcaaaaactgttcaacatgcttcgcctgggtaaatcagagccctggacgctggcgctcgaaaatgtggtgggagcaaagaatatgaacgtcagaccgctgctcaactacttcgaacccctgttcacttggctgaaggaccagaacaagaacagtttcgtgggatggtccactgactggtcgccctacgccgatcagtccatcaaggtgcgcatctccctgaagagcgccctgggagataaggcttacgagtggaacgacaacgagatgtaccttttccgcagctccgtggcatacgcaatgagacaatactttctgaaggtgaaaaatcagatgatactttttggtgaggaagatgtgagagtggcaaaccttaagcctagaatcagctttaactttttcgtcactgcaccgaagaatgtctcggacattatccctcggaccgaggtggagaaggccataagaatgtccagaagccgaattaacgacgcatttcgtcttaacgacaattcgttggagtttttgggtatccagccaactctgggcccacctaatcaaccacctgtgtcgatttggctgatcgtctttggcgtcgtcatgggagtgattgtcgtcgggattgtgattctcatcttcacgggaattcgcgatcgcaaaaagaagaacaaagcacgtagcggagagaacccctacgcgtccatcgatatctccaagggtgagaataatcctggctttcaaaacaccgatgacgtccaaacctcgttt

SEQ ID NO: 6236 - DNA, 2415 bp, Artificial Sequence
  Description of Artificial Sequence: Synthetic coding sequence
atgagctcatcgagctggctgttgctaagcttagtcgctgtgaccgcagcacaatctactattgaggagcaggcaaagacatttctagacaagttcaatcatgaagcggaggacctgttctaccagagtagccttgccagctggaactacaatactaacatcacagaggagaatgtgcagaacatgaataacgcaggggataaatggagcgcctttctcaaggaacaatcgacccttgcccagatgtaccctttgcaggagatccagaacctgaccgtgaagctacagctgcaggccctgcaacaaaacggtagtagcgtactgagtgaagataaatccaagaggctgaacactattctgaacaccatgtccacaatatattccacgggaaaagtctgtaacccagataacccccaggagtgtcttctgctagaacccggattgaacgagattatggccaattctctcgattataacgaacgcctgtgggcttgggagtcctggcgttcagaggtggggaagcaattgcggcccctttatgaagagtacgtggtgttgaagaacgaaatggcgcgagctaatcattacgaggactatggcgactactggaggggggactacgaagtcaacggagtggatgggtatgactatagtcggggtcaattgatcgaggatgtggagcatacatttgaggagataaaaccactatacgagcacctgcatgcatacgtgcgagcaaagctgatgaatgcttatccttcctacatttccccaatcggatgcttgcctgcccatttactgggtgacatgtggggccgcttctggacaaacctttatagcttgactgtgcccttcggacagaaaccaaacatagacgtcactgatgccatggtggaccaggcttgggacgcacaacggatcttcaaggaggctgaaaaattcttcgtttctgttggccttcctaacatgacccagggcttctgggaaaacagtatgctcaccgatcctggaaacgtccagaaggctgtatgccacccaactgcctgggacctgggaaagggtgattttcgcatcctcatgtgtactaaagtcaccatggacgattttctcacggcccaccacgagatgggccacattcagtatgacatggcgtacgccgctcaaccattcctactacggaacggcgccaatgaagggttccatgaagcagtgggggagattatgtcactgagcgcggccacgcccaaacacctgaaatctataggtctgttgagtcccgatttccaagaggacaatgaaacagaaattaacttcctgctgaagcaagccctcaccattgtgggcacgttacctttcacctacatgctcgaaaaatggaggtggatggtattcaagggtgaaataccaaaggaccagtggatgaaaaagtggtgggaaatgaaacgagaaatcgtgggcgtggtggagccagtacctcatgacgaaacatattgtgacccagcttccctgttccacgtctcaaacgactactccttcattcgctactacacacggaccttgtaccagtttcaatttcaggaggccctttgtcaggctgccaaacacgaaggtcccttgcataagtgcgatattagcaactctacagaggcgggacagaagctcttcaacatgctccgcttgggtaaatcggagccatggaccctcgccctggagaacgttgttggggcaaagaacatgaatgtacggcccctactcaactactttgaacctctgtttacgtggctgaaagaccagaacaaaaatagttttgttgggtggagcaccgattggtcaccttatgcagatcagtcaattaaagtacgcatcagcctgaagtccgccttaggcgataaggcctacgagtggaatgacaacgagatgtatctttttaggtccagcgtggcctacgctatgcgccagtattttttaaaggttaagaatcagatgatccttttcggcgaggaggatgtacgggtcgctaacttgaagccgcgcatctcatttaacttctttgttacagcacccaaaaacgtttcagatatcattccaagaacagaggtggagaaggctattcgtatgtctcgtagcaggattaacgacgccttccggcttaatgataatagtcttgaatttttggggattcagcctaccttggggcctcccaaccagcctccagtgagcatttggctgattgtttttggggtcgtgatgggggttatcgtggttggtatcgtgattctgatctttaccgggatcagagatagaaaaaaaaaaaataaagctcggtcaggcgagaatccttatgcttccatcgacatatccaaaggcgaaaacaatcctggttttcagaacacagacgatgtacagaccagcttc

SEQ ID NO: 6237 - DNA, 2415 bp, Artificial Sequence
  Description of Artificial Sequence: Synthetic coding sequence
atgtcaagctcgtcgtggcttctgctctcgctcgtcgccgtgaccgccgcccagtcaaccatcgaagaacaggccaagactttcctcgacaaattcaaccatgaagcagaagatctcttctaccagagctccctggcgtcttggaattacaacaccaacatcaccgaagaaaacgtgcagaacatgaacaatgccggagacaagtggtccgcgtttctgaaggaacagtcaaccctggcacaaatgtacccgctgcaagagatccagaacctcacggtgaagctccaactccaggcactgcaacaaaatggttcgtcggtcctgagcgaggataagtcgaaacggcttaacaccatcctcaatactatgtccacgatttactcgaccggaaaagtctgcaacccagacaatcctcaagagtgtctgctgctggaaccgggactcaacgaaatcatggctaactccctggactacaacgagagactgtgggcttgggagtcatggcggtcagaggtcgggaagcagctgcggccgttgtacgaagagtacgtggtgctcaagaacgagatggcgcgcgctaaccactacgaagattacggggattattggcgaggcgactacgaagtgaacggagtggacggctacgactactcccgggggcagttgatcgaagatgtcgaacatacgttcgaagaaatcaaaccgctgtacgaacacctgcatgcatacgtccgggcgaagctgatgaatgcttacccttcatacatctcaccaatcggctgccttccagctcacctgctgggagatatgtggggacgcttctggacgaacttgtactcgctgaccgtgccgtttggacagaaaccaaacatcgatgtcactgacgcgatggtcgatcaagcatgggatgcgcaacgcatcttcaaagaggccgagaagttcttcgtgtcggtgggactgcctaacatgacccagggcttctgggaaaacagcatgcttactgacccaggtaacgtgcaaaaggcagtctgccatcctaccgcttgggacctgggtaaaggcgatttcagaatcctgatgtgcaccaaggtgactatggacgattttctgactgcccatcacgaaatgggacacatccagtacgacatggcgtacgcggcacagcctttcctgcttaggaatggtgcaaatgagggattccatgaggccgttggagagatcatgtcactgtcggcggcgaccccgaaacatcttaagtctatcggactgctcagccccgactttcaagaagataatgagactgaaatcaacttcctgctcaagcaagcgctgaccatcgtggggactctgccattcacctacatgctcgaaaagtggcggtggatggtgtttaagggcgagattccaaaggatcagtggatgaaaaagtggtgggagatgaagagagaaatcgttggcgtggtggaaccagtgccgcacgacgaaacttactgtgaccctgcctcgctgttccacgtttcaaacgattactcatttatcagatactacactagaaccttgtaccagttccaattccaggaggccctgtgtcaggcagccaaacatgagggaccacttcacaagtgcgacatctcgaattcgaccgaggccggccaaaagctgttcaacatgctgagactggggaaatccgagccttggactctggcgttggagaatgtggtgggagccaaaaacatgaatgtgaggccgttgctgaactatttcgaaccgctgtttacctggctcaaggaccaaaacaagaactcctttgtgggatggtcaactgattggagcccgtacgcggatcagtccattaaggtgcgcattagcctgaagtcggctctgggagacaaggcttacgagtggaatgataatgagatgtacctcttccgctcgtcggtggcgtacgctatgaggcaatacttcctcaaagtgaagaaccagatgattttgttcggtgaggaggatgtgcgcgtggcaaatcttaagcctcgcatttcgtttaacttctttgtgaccgcccctaagaatgtttccgacatcatcccgagaaccgaagtcgaaaaggcgatccgcatgtccagatctcgtatcaacgacgcatttcgcctcaacgataactcactggaattcctgggcatccagccaactcttggaccaccgaaccagcctccggtcagcatctggctcatcgtgttcggcgtggtgatgggtgtgattgtggtgggtatcgtgatcctgatctttaccggcattcgggataggaagaagaaaaacaaggcacgctcaggagaaaacccctacgcatcgatcgatatttcgaagggcgagaacaatcctggattccagaacacggacgatgtgcagactagcttc

SEQ ID NO: 6238 - DNA, 2415 bp, Artificial Sequence
  Description of Artificial Sequence: Synthetic coding sequence
atgagctctagctcgtggctattacttagcctggtggcagttactgcggcccagtcaacaattgaggaacaggcaaagacattcctcgataagttcaatcatgaagccgaggatcttttctaccagtcttcactggccagctggaactataatactaatattaccgaggagaatgtgcagaatatgaataatgctggtgacaaatggtccgcattccttaaggaacagtccaccctcgcccagatgtacccattgcaagaaatccagaatttgactgtcaaactccagctgcaggcgctccagcaaaacgggtcgagtgtgctctcagaagacaaaagtaagcgactgaatacaatcctgaacaccatgagcacaatttatagcactggcaaggtgtgcaatcccgacaacccgcaggaatgcttgctgttggagcccggcttaaacgagataatggcgaactccctcgattacaacgaaaggctttgggcctgggagtcctggcgcagcgaagtcggtaaacagctcaggccgttgtatgaggaatatgtcgtgctgaagaatgaaatggcacgtgcgaatcactacgaggactacggcgactattggcggggcgactatgaagttaatggagtcgacgggtacgactatagtagagggcagctgatcgaggatgtagagcatacttttgaggagatcaagcctctctacgaacatctacatgcctacgtcagggccaaactgatgaatgcctacccgtcctatatctcccccatcggctgtctgcccgcccatctattgggggatatgtggggcaggttctggaccaacctatacagtctcactgtccccttcggacaaaagcctaacatcgacgtgaccgatgctatggttgaccaggcttgggacgcacagcggattttcaaagaggctgagaagttcttcgtttccgtgggactccctaatatgacacagggcttttgggagaacagcatgctcaccgacccgggtaacgtccagaaggctgtctgccaccccaccgcttgggatcttggcaagggagatttccggattctcatgtgtaccaaagtgacgatggatgactttctgaccgcccatcacgaaatgggacacatccagtatgatatggcttatgccgcccagccattcttgctccgaaacggcgctaacgagggattccacgaagccgttggtgaaattatgtccctcagcgcggcaactcccaagcaccttaaatcaataggtctgctgtctccagacttccaagaagataatgaaaccgaaattaacttcctgctcaaacaggcgctaaccattgtgggcacccttccattcacctatatgcttgagaagtggcggtggatggttttcaaaggagagatacccaaagaccaatggatgaagaagtggtgggagatgaaacgcgagatcgtcggtgtggtggagccagtgcctcatgatgagacatactgcgatcccgcatccctcttccacgtatcgaatgactactcttttatccgctattacactcgcaccctgtaccagttccagttccaggaagctttatgtcaagccgccaagcacgaaggcccgctgcacaaatgtgatatctctaactccacagaagcaggccagaaactgttcaacatgcttcgcttgggcaaatcagagccctggacacttgctctcgaaaatgtggtgggagccaaaaatatgaacgtgagaccacttttgaactattttgagccactgtttacatggttgaaggatcagaacaaaaactcattcgtaggatggtctaccgattggagcccttatgccgatcagagcataaaagtgcgcatctctttaaaaagcgccctaggagataaggcatatgaatggaatgataacgagatgtacctgttcagatcctccgtggcctatgctatgaggcagtacttcctgaaagttaagaatcagatgatcctcttcggtgaggaagatgtccgtgttgcaaacctgaagccccgaatcagttttaatttcttcgttactgccccaaagaacgtctcagatatcatccctagaacagaggtcgagaaggcgattaggatgtcaaggtcccgtatcaacgatgccttcagacttaatgataattccctcgagttcctcggaatccagcctaccctggggccaccaaaccaaccccctgtttccatctggttgatcgtctttggcgtggtcatgggcgttatagtggtgggcatagtgatcctgatcttcacaggcatccgggaccggaagaagaaaaacaaggccaggagcggcgagaacccttacgcatcaattgacatctcgaaaggtgagaataaccccggttttcagaatactgatgacgtgcagacctcgttc

SEQ ID NO: 6239 - DNA, 2415 bp, Artificial Sequence
  Description of Artificial Sequence: Synthetic coding sequence
atgtcctcctcgtcttggctgctgctgtcgctcgtcgcggtgaccgcagcccagtcgactattgaagagcaggccaaaacgtttctggacaagtttaaccacgaggcagaggacctcttttaccaaagctcgctcgcatcctggaactacaatacgaacattactgaggagaacgtgcagaatatgaataacgcaggggacaagtggtcggcgtttctgaaggagcagtcgactcttgctcagatgtaccctcttcaagaaattcaaaatctcaccgtgaagctgcaacttcaagcactgcaacagaatgggtcgtcggtgctttcggaagataagagcaagcggctgaacactatcctgaacaccatgtccacgatctattccaccggaaaggtgtgtaaccccgacaaccctcaggagtgtctcctgttggagcctggacttaacgagatcatggcaaattcgctcgattacaatgagagactttgggcgtgggaaagctggcgatcagaggtgggcaagcaacttcggcctttgtacgaagagtacgtggtcctgaagaacgagatggcaagagccaaccattacgaagattacggagattactggcgcggcgattacgaagtgaatggcgtggatggatacgactactcgcgggggcagcttattgaagatgtcgaacacaccttcgaggagattaaacccctttatgaacatctgcatgcatacgttagggcaaagctgatgaacgcctacccctcatacatcagccctatcggctgtctgcctgcccacctgctgggagatatgtggggacgcttttggacgaacctgtactcgctgaccgtcccattcgggcagaagcccaacattgatgtgaccgacgcaatggtggaccaagcatgggatgcgcaaagaatcttcaaagaggcagaaaagttttttgtgtcggtggggctccctaacatgacccaaggcttctgggaaaactcaatgctcactgaccctggcaacgtgcaaaaggctgtgtgccatcccactgcatgggatcttggaaagggagactttagaatactgatgtgtacgaaggtcactatggatgacttccttactgcccaccacgaaatgggtcatatccaatacgacatggcctacgcagcccaaccttttcttctcaggaatggggccaacgagggttttcacgaggcagtcggggagattatgtcactgtcggcagcaacccccaagcacctgaaatcgattggccttctctcgccagattttcaagaggataacgaaaccgagataaacttcttgttgaaacaggccctgactatcgtggggaccctgccattcacttacatgcttgaaaagtggagatggatggtgttcaaaggcgaaattccgaaggatcagtggatgaagaagtggtgggagatgaagcgcgaaatcgttggagtggtcgagcctgtgccacatgatgaaacttattgcgaccccgcatcacttttccacgtgtccaacgattactccttcataagatactacactagaactctgtaccagtttcaatttcaagaggcactgtgtcaagcagccaagcatgagggtcctctccataaatgtgacattagcaactccaccgaagcaggacaaaagttgtttaacatgcttcgccttgggaagagcgaaccatggaccctggcactcgaaaacgtcgtgggtgctaagaatatgaatgttagacccctcttgaactacttcgagcctctgttcacctggttgaaggatcagaataagaattcgtttgtgggttggtcgaccgactggtcaccttacgctgatcagtccattaaggtgaggatttcactcaagtcggctctcggcgataaggcgtacgaatggaacgataacgagatgtaccttttccgttcatccgtggcatacgcaatgcgacagtattttctgaaagtgaaaaaccaaatgattcttttcggagaggaggacgtcagggtcgcaaatctcaagcctagaatctcgttcaacttttttgtgaccgcacctaaaaacgtgtccgatatcatcccgagaactgaagtcgaaaaagcaattagaatgtctcggtcgcgcattaacgatgcattccgactgaatgacaactctcttgaattccttggaattcagcctaccttgggtccgccgaaccagcctcccgtctccatctggcttattgtgtttggggtggtgatgggtgtgatagtggtcggaatagtgattctcatctttacgggtatcagggatcgtaaaaagaagaataaggcacgatctggcgaaaacccatacgcttcgattgacatatcgaaaggagagaataacccagggtttcagaatactgacgacgtgcagactagcttc

SEQ ID NO: 6240 - DNA, 2415 bp, Artificial Sequence
  Description of Artificial Sequence: Synthetic coding sequence
atgagttcttccagctggctgctgctaagcctggtcgcggtgacggccgcccagagcaccatcgaagaacaagcgaaaactttccttgataaatttaaccatgaggccgaggatctgttttaccaaagctccctggcctcatggaactacaacacaaatattactgaggaaaatgttcagaatatgaacaacgcgggcgacaagtggagcgcttttctgaaggaacagtctaccctggcacagatgtacccactgcaggagattcagaacctaacagttaaactgcagctccaggctttgcagcaaaacggcagctccgttctcagcgaggataagagtaagagactgaacacgatactgaataccatgagcaccatctattccacgggtaaagtttgcaatcccgacaacccacaagagtgtctgctgctggagccaggcctgaatgaaattatggctaatagccttgattacaacgagcgactttgggcctgggaatcttggcgcagcgaggtgggtaagcagctgaggccgctctacgaagagtacgtggttttgaagaatgagatggcccgcgccaaccactatgaagattacggtgactattggcggggcgactatgaagtaaacggcgttgacggttatgattattcaaggggacaactgattgaggatgttgagcatacttttgaggagatcaagccactgtatgaacacctgcacgcgtatgtgcgcgccaagctcatgaacgcttacccaagctatatcagtcccattggatgtctgccagcccacctgctgggtgacatgtggggccgattttggacaaacctgtatagcctgactgtgccttttggccagaagccgaacattgatgtgaccgatgctatggtggaccaagcctgggacgcccagcgcatttttaaagaggcggagaagttctttgtttctgtaggactgccgaatatgacccagggtttttgggaaaacagcatgctgactgatccgggtaatgttcaaaaagcagtgtgccaccctaccgcgtgggatctgggcaagggcgacttccgcatcctgatgtgcaccaaggttaccatggatgatttcttaaccgcgcaccacgagatgggacacatccaatacgacatggcatacgccgcgcaaccatttcttttgcgcaatggagcaaacgagggcttccacgaggcggtcggtgagatcatgtctctgagcgccgcgacccctaaacatctgaaatctatcggtttgctaagccctgactttcaggaggataatgaaaccgaaatcaacttcctgctgaagcaggccctgacgatagttggaaccctgccttttacgtatatgttggagaagtggagatggatggtttttaagggcgaaattccgaaggaccaatggatgaaaaaatggtgggaaatgaaacgggagattgttggcgtggtggagccggtgccacatgacgagacctactgcgacccggcctctctgttccatgtttctaatgattactcgttcatccgctattacactaggacgctgtaccaattccagttccaagaggcgctgtgtcaggccgcgaagcatgagggcccactgcacaaatgtgatatatcgaacagcacggaggccggtcagaagctgttcaatatgttaagactgggcaagtctgaaccttggacgctcgcattggaaaatgtcgtgggtgcaaaaaacatgaacgttagaccactgttgaactattttgagcctttgttcacctggctgaaggaccaaaacaagaactcgttcgtaggttggtctactgactggtccccatacgccgatcaaagcatcaaagtccgtattagcttaaagagcgctctgggcgataaagcgtacgagtggaatgacaatgagatgtacctgttccgtagtagtgtggcctacgcaatgcgccagtatttcttaaaggttaaaaaccaaatgattttattcggtgaggaagacgtgcgtgtggccaacctcaaaccgcgcatcagcttcaactttttcgtgaccgcccctaagaatgtgtctgacattatccctcggacggaagttgaaaaagctatccgaatgagccgctcccgcatcaatgacgcatttcgcctcaacgataactctctggagtttctggggatccaaccgacccttgggcctcctaatcagccaccagtgagcatttggcttatcgtctttggcgtcgtgatgggtgttattgtcgtgggtatcgtaatcctgatttttaccgggatccgcgacaggaaaaaaaagaataaggctcgcagcggggaaaatccgtacgcctccattgacataagcaaaggggagaacaacccaggctttcagaataccgacgacgttcagacctccttc

SEQ ID NO: 6241 - DNA, 2415 bp, Artificial Sequence
  Description of Artificial Sequence: Synthetic coding sequence
atgtcgagctcatcatggctactgttatctcttgtcgccgtgaccgctgcccagtcgaccattgaggaacaggctaagacatttctggacaaatttaaccacgaggcggaggatttattctaccagtccagcttggcaagctggaactataataccaatattaccgaggaaaacgtgcaaaacatgaacaacgcgggtgacaagtggagcgcattccttaaagaacagagcaccctggctcaaatgtatccacttcaggaaatacagaacttgactgtgaaactgcagcttcaggcacttcagcagaacgggagttccgtcctttccgaagataagtcaaagcggctaaacactatactcaataccatgtccacaatatactctaccggtaaggtgtgtaaccctgataatccgcaagagtgtctgttacttgagcctggactgaatgagattatggccaattccctggactacaacgaacgactctgggcctgggagtcttggcggagtgaggtcggcaaacagcttcgcccgctgtacgaggagtatgtagtcttaaaaaatgagatggcccgggccaaccactacgaagattacggtgactattggcggggcgattacgaagtcaatggtgtggatggatacgattattcgcgcggccagctgattgaggacgtggagcacacattcgaggaaataaagcctttgtacgaacaccttcacgcgtacgtccgagctaagctaatgaatgcctatccgtcctatatctcgcccattggctgcctcccagcccacctgcttggcgatatgtgggggagattctggaccaacctatattcactgactgtcccatttggccagaaacctaacattgatgtaactgatgccatggtggatcaggcctgggatgctcaacgcatattcaaagaggcagagaaattttttgtatcggtgggcttgcccaatatgacccagggcttttgggagaattctatgctaacagatccagggaatgtacagaaggctgtgtgccaccccaccgcctgggacctcggtaagggggattttcgtatcttgatgtgcaccaaggttacaatggatgacttcctgactgcacaccatgagatgggacacatccaatatgacatggcctatgcagcccagccatttctgttacggaatggagcaaatgaaggtttccatgaagccgtaggcgagatcatgtctcttagcgctgcgacacctaaacacctcaaatctatcggcctactttccccggatttccaagaggataatgagaccgagattaacttcctgcttaagcaagctcttaccatcgttggaactctgccctttacttatatgctcgagaagtggagatggatggtgtttaagggcgaaattcccaaggatcaatggatgaaaaagtggtgggagatgaaacgagaaatagtcggagtggtcgagcccgtacctcatgatgaaacctactgcgatcctgcgagcctgtttcacgtatcgaatgattactccttcatcaggtattataccagaacgctgtaccagtttcagtttcaagaggccctctgccaggctgctaagcacgagggacccctgcacaagtgcgatatcagcaattccactgaggctggacaaaaactctttaatatgctcaggctgggaaaaagtgagccatggaccctagcgctagaaaatgtggtgggtgctaagaacatgaacgtccggcctctcctaaattactttgagcccctgttcacctggcttaaggaccaaaacaaaaacagcttcgttggctggtcgacagattggtccccctatgcggatcagagcatcaaagtccggatttcgctgaagagcgctctcggggacaaggcctacgaatggaacgacaacgaaatgtatctatttcggagcagtgtcgcctacgcaatgcgtcagtacttcctgaaagtgaagaaccagatgattctatttggagaagaggacgtgagagtcgccaacctgaagccccgaatctccttcaacttctttgtgacggccccaaagaacgtctccgacatcatcccaaggacagaagtggagaaagccattcggatgtctagatcccgaattaatgatgcatttcgactcaacgacaatagtcttgaattcctggggattcaaccaaccctgggccctcccaaccaaccgccagtttccatctggctgattgtgtttggcgtggttatgggcgtcatcgtcgtgggcatagttatcttgatttttactggcatacgcgatagaaaaaaaaagaataaggctcggagtggagaaaatccttacgcctctatcgacatcagtaaaggggagaacaaccctggatttcagaacactgatgacgtacaaacctccttc

SEQ ID NO: 6242 - DNA, 2415 bp, Artificial Sequence
  Description of Artificial Sequence: Synthetic coding sequence
atgtcatcctccagttggctgcttctatcgttggtcgcggttactgcagcccagtcgacaatagaggagcaggccaagacgtttctggataagtttaatcacgaggctgaggacctgttttatcagtcctcgttagcgagttggaactacaacactaacatcacagaggaaaacgtgcagaacatgaacaacgctggtgacaaatggtccgcgttcctcaaggagcaatcaacccttgcccagatgtacccgctccaggaaattcaaaacctcactgtgaaactccaactgcaagccctgcaacagaatgggagctcggtgttgtcggaggacaagagcaagcgcttgaacacaatactgaacaccatgtcaactatctactcaacgggtaaagtgtgtaacccagacaacccccaggagtgcctgctgttggagcccggcctcaacgagatcatggccaactccctggattacaatgaacgcctgtgggcgtgggagagctggaggtccgaggtgggcaagcaactgagaccgctgtatgaggaatacgtagtgttaaagaatgagatggcccgggccaaccactacgaagactacggcgactattggagaggagactatgaggtcaacggcgtggacggctatgactactcgcgaggccagctgattgaagacgtcgaacacacttttgaggaaatcaagccgctttacgagcatctacatgcctatgtccgagcaaagctaatgaatgcgtaccccagttatatctcgccgattggctgccttcccgcccatctactcggagatatgtggggccgtttttggacgaatctgtattcccttacggtcccctttgggcagaagccgaatatcgatgtgaccgacgcaatggtggatcaagcctgggatgcccagcgaatctttaaagaggcagagaaattctttgtttccgtgggactgccgaacatgacccaaggtttctgggagaatagtatgctgaccgatcctggaaacgttcaaaaggcggtatgccaccctacagcctgggacttgggcaagggcgacttccggatccttatgtgcacgaaagtcacaatggatgacttcctgacagctcaccacgagatggggcacatccagtacgatatggcgtacgctgcccaaccgttcttgctgcgcaacggcgcaaatgagggcttccatgaggccgtgggtgagattatgtccctgtccgcggccaccccgaagcatctcaagagcataggcctcctctcgcccgactttcaggaggataacgaaactgaaataaacttccttctgaagcaggccctaactatcgttggcactctaccctttacttatatgttggagaagtggagatggatggtgtttaaaggagagataccaaaggaccaatggatgaagaagtggtgggagatgaagagagagatcgtgggagtcgtagagccagttccgcatgacgaaacttattgcgacccagctagcctgttccacgtcagcaatgactattcgttcatccggtattatacgcgcacgttgtaccagttccagtttcaggaagccctgtgccaggccgccaagcatgagggtccgctccacaagtgcgatatatcgaacagtacggaggccggccaaaagcttttcaacatgctacgcctcggtaagagtgagccgtggacactcgcactagaaaacgttgtgggagcaaaaaacatgaatgtcagacctctcctgaactattttgagccgttgttcacctggctgaaggatcaaaacaagaactccttcgtgggctggtcaacggactggtccccctatgctgaccaaagtatcaaggtgcgcattagcctaaagtcggccctgggtgacaaggcatacgagtggaatgataatgagatgtacctgttccggagctccgttgcctacgccatgaggcaatattttctcaaggtaaagaatcagatgatattgttcggcgaggaagatgtgagggttgctaacctgaagccgcgtatttcattcaacttcttcgtcaccgccccaaaaaacgtttctgacattatcccacgcacggaagtggaaaaggctatccgaatgagccgtagcaggatcaatgatgcatttcgactgaacgataatagtctggaattcctgggcatacagccaacgttggggccccccaaccagccacccgtgtccatttggctgattgtgtttggcgtggtaatgggagtgatcgtggtcggcatcgtcatcctgatttttacaggaatccgggaccgaaaaaagaagaacaaggccaggagcggtgaaaacccgtatgccagcattgatataagcaaaggcgagaataatccaggttttcagaacactgatgatgtgcagacctcgttc

SEQ ID NO: 6243 - DNA, 2415 bp, Artificial Sequence
  Description of Artificial Sequence: Synthetic coding sequence
atgtcctccagcagctggctgctgttgagcctggtagctgtcaccgcagctcagtctacgattgaagagcaggctaagacctttctagataagttcaatcatgaggctgaggacctcttctaccagtcctccctggcttcatggaactacaataccaacataactgaagaaaatgtgcagaacatgaacaacgcaggagataagtggtccgcctttctgaaagagcagagtaccctggcacagatgtacccactccaagaaattcaaaacttgactgtgaagctccaacttcaggccttgcagcagaatggatcgtctgtgctttcagaagacaaatccaagcgacttaacaccatactcaatactatgtccaccatctacagcaccggcaaggtttgtaatcctgataacccacaagagtgtttactgctggaacccgggttaaacgaaatcatggcaaactctctcgactacaatgagcgactctgggcttgggaatcgtggcgcagcgaggtagggaaacagctgcgaccgctgtatgaggaatatgtggtgttgaagaatgaaatggcaagggccaaccactatgaagactacggcgattactggaggggtgattacgaggtgaatggcgtcgatggctacgactatagtcgcgggcagttaattgaggatgtggaacataccttcgaggagatcaagcccctatatgaacacctgcatgcatacgtgagagcaaagttaatgaacgcatatccttcatacatctccccaatcggatgcctgcctgctcacctgctcggggacatgtggggccggttctggaccaacctctacagcctgaccgtgccctttggccagaagcctaatattgacgtgactgatgcaatggtggatcaggcctgggatgcgcagcgaatttttaaagaagctgagaagttcttcgtgtccgtcggcctaccaaatatgactcaaggcttctgggagaattctatgctaactgatcctggtaatgtccagaaggcagtgtgccatccgacagcatgggatctagggaagggcgacttccgaattctaatgtgtaccaaagtgactatggatgactttctgaccgcccaccacgagatggggcatatccaatatgatatggcctacgcggcccagcctttcttgctgcgtaatggagccaacgaaggctttcacgaagccgtcggggaaattatgtccctcagcgccgctactcctaaacatctcaagtctatcgggctgttatccccagacttccaggaggacaacgaaacggagataaactttctattgaagcaagcgctcactattgtcggtaccctaccgttcacctatatgctcgagaagtggaggtggatggtgtttaagggcgagatccccaaagaccagtggatgaagaagtggtgggaaatgaagagggaaatagtgggcgtagtggaacctgtgccacatgatgaaacttactgcgatccagctagtctgtttcacgtgtccaacgactatagtttcatcaggtattatacaaggaccttataccagtttcagttccaggaggccctgtgtcaggccgctaagcacgaggggcctcttcataaatgtgacatttcaaactccactgaagcagggcaaaagctgtttaatatgctcagacttgggaaaagtgagccctggaccctcgctcttgaaaacgtggttggtgcaaagaacatgaacgtacgaccactgttaaattatttcgagccactttttacctggctgaaggatcagaacaagaactcatttgttggctggagtaccgattggagcccttacgccgaccagagtatcaaggtacggatttctctgaagagtgcgctcggcgataaagcttacgaatggaacgacaatgaaatgtatctcttccggtcctctgttgcctacgctatgaggcagtacttcctaaaagtgaagaatcagatgatcctgtttggagaagaggacgtgcgagtggccaatctgaagccacgaattagctttaattttttcgtaacagcgcccaaaaacgtaagcgatatcatacctcgaactgaggtggaaaaagcaatacgaatgagtagatctagaatcaacgacgcatttcgattgaatgataacagcctcgagttcttaggcatccagccaacgcttggcccgccaaatcagcctcctgtttcaatttggctcatcgtctttggggtggtgatgggcgttattgtcgttggcattgtgatattaatcttcaccgggattagagacagaaagaagaagaacaaggcaagaagtggggagaacccctatgccagtatcgacatttcaaagggtgaaaataatcccggctttcagaatactgatgacgtgcaaacgagcttt

SEQ ID NO: 6244 - DNA, 2415 bp, Artificial Sequence
  Description of Artificial Sequence: Synthetic coding sequence
atgtcgagttccagctggctccttctttcactcgtggcagtgaccgcagcacaatctactatcgaagaacaagcaaagacctttcttgataagttcaaccatgaagcagaagatttgttttaccaaagcagcctggcatcttggaattacaacaccaacatcacggaagagaatgtgcagaacatgaacaatgccggagacaagtggtccgcatttcttaaggaacaaagcaccctcgcgcagatgtacccactgcaggaaatccagaatcttactgtgaaactgcaacttcaggcgctgcagcagaacgggtcgagcgtgctctccgaggataaatcgaagcgtcttaataccattctcaacactatgagcaccatttacagcaccgggaaagtgtgtaaccccgataacccccaagagtgcctgctgcttgaacctgggcttaatgagataatggcaaactcactggattacaatgaaaggctttgggcttgggaatcatggagatcagaagtgggaaaacagcttagaccactttacgaagaatacgtggtgctgaaaaatgagatggccagggccaaccattacgaagattacggcgactactggcggggggactacgaggttaatggggtggatggatacgattattcacggggtcagctgattgaagatgtggagcacacttttgaagagatcaagccactgtacgagcatctgcatgcatatgtgcgagcgaaactcatgaacgcctacccaagctacatttcccccattggatgtctccccgcccatctgctgggcgatatgtggggcagattttggactaacctttactccctgaccgtgcctttcggtcagaagcctaacattgatgtgaccgatgcaatggtggatcaggcttgggatgcacaacgcattttcaaagaagccgagaagttttttgtctccgtcgggttgcctaacatgacccaaggattttgggaaaattcaatgttgacggaccctggaaacgtgcagaaggcagtgtgccacccaactgcctgggatctgggaaaaggtgactttagaattctgatgtgcactaaagtgactatggatgattttctgactgcacatcatgaaatgggtcacattcaatacgacatggcatacgctgctcaaccatttctcctgcgtaatggagcaaacgaaggctttcacgaggcagtcggtgaaatcatgtccctgtcagcagcaactcctaagcatctgaagtcgattggccttctgagccctgattttcaagaagataatgaaactgagatcaactttctgcttaaacaggctcttaccattgtggggactcttcctttcacctatatgttggaaaagtggcgctggatggtctttaagggcgagattccaaaggaccaatggatgaagaagtggtgggagatgaaaagggaaatcgtaggtgtggtcgaacctgtgccacacgacgaaacctactgcgaccccgcctccctgttccatgtgtcaaacgattatagctttattcgctactatactagaactctgtaccaatttcaatttcaggaggcactgtgtcaagcggcaaaacacgaaggtcctctccataaatgtgatatttcgaactcaactgaagctggccagaagctgtttaacatgcttagactggggaaaagcgaaccttggaccctcgccctggaaaatgtggttggcgcaaaaaacatgaacgtgcgcccccttctcaattactttgaacctctgtttacttggttgaaggatcagaacaagaattcatttgtgggttggagcaccgactggtccccctacgcagatcagagcatcaaggtgcgaatttcgttgaagtccgcactcggtgacaaagcatacgagtggaatgacaatgaaatgtacttgtttaggtcctccgtggcatacgcaatgaggcaatactttctcaaagtcaagaaccagatgatactttttggtgaagaagatgtcagagtggcgaaccttaaacccagaatctcatttaacttctttgtcactgcaccaaagaatgtgtctgatatcattcctcgcactgaagtggaaaaagcaataagaatgtcgaggtcccgcattaacgatgcatttcggctgaacgataattcgctggaatttctcggtattcagcctactctgggtccccctaatcagccaccagtgagcatttggctgatagtctttggcgtggtcatgggagtcatcgtcgtcgggatcgtcatcttgattttcacgggaatccgagatcgcaagaagaaaaacaaagcgagatccggtgaaaacccgtatgcgtccattgacatcagcaagggagagaacaacccaggattccaaaacactgatgatgtgcagactagcttc

SEQ ID NO: 6245 - DNA, 2415 bp, Artificial Sequence
  Description of Artificial Sequence: Synthetic coding sequence
atgtcctcttccagttggctcctgctctcactggttgcagtgacagccgcccagtctacaatcgaggagcaagccaaaactttcctggacaagtttaaccacgaggctgaggacctgttctatcagtcaagtttggcatcttggaactataatacgaatatcacagaggaaaatgtccagaacatgaataatgcaggtgataagtggtcagcatttttgaaagagcagtcaacccttgcccagatgtaccctctgcaggagattcaaaacttgactgtaaaattgcagcttcaagctctgcagcagaacgggagctcagttctgtccgaggataaatcaaagagactgaacaccattttgaacaccatgtccaccatttattccacgggcaaagtgtgtaacccggacaatccccaggaatgtcttctccttgagccaggtctgaacgaaatcatggctaatagcctggactacaacgagaggctgtgggcatgggagtcttggcggtctgaggtaggtaagcagttgcggcccctgtatgaggaatatgtggttctcaaaaacgaaatggcgcgggccaaccattacgaagattacggtgattactggcgcggagactatgaggtcaacggtgtcgatgggtatgattacagcaggggacagctcatcgaggacgtcgaacatacttttgaggaaataaagcccctgtacgagcacttgcacgcatacgtgcgggctaaactgatgaacgcctacccatcatacatctccccgattgggtgcctccctgcccacctgctgggtgacatgtggggaaggttctggaccaacctgtactctttgacagtcccctttgggcagaaacccaacatagatgtgacggacgccatggtggatcaggcctgggatgctcagcggatcttcaaagaggccgaaaaattcttcgtctctgtcggcctccccaatatgacacagggattctgggagaacagtatgctgactgatcccggtaatgtgcagaaggcagtgtgccaccctaccgcctgggatctgggcaaaggagacttccggattctgatgtgcactaaggtgacgatggatgacttcttgaccgctcatcacgaaatgggccatatccagtatgacatggcatatgccgcacaaccattcctgctgagaaatggagccaacgagggctttcacgaagctgttggggaaattatgtctctgtccgcagctacacctaaacatctgaaatccatcgggctcctttcacccgactttcaggaggacaatgaaaccgagatcaatttcctgttgaagcaggctctgaccattgtggggacgttgcccttcacatacatgttggagaagtggagatggatggtgtttaaaggggaaatcccaaaggatcagtggatgaaaaaatggtgggagatgaaacgcgaaattgtcggcgttgttgaaccagtgcctcatgacgagacctattgtgatccggcaagcctctttcatgtcagcaacgactacagtttcatccgatactacaccaggactctgtaccagtttcaattccaggaagctctgtgccaggctgccaagcatgaaggccccctgcataagtgtgacatatcaaacagcactgaagccggtcagaaactgtttaacatgctccgattggggaaaagcgagccttggacattggcactggagaatgtcgtcggggcgaagaacatgaacgttaggccacttctcaattattttgagcccctgtttacatggctgaaggatcaaaacaagaattcttttgttggatggtccaccgactggtctccctacgcagaccaatctatcaaggtccgaatatctcttaaatcagctctcggcgataaagcatatgagtggaacgataacgaaatgtatttgttcagatcctccgttgcctatgccatgcgacagtactttttgaaggtaaagaaccagatgatactgtttggtgaggaggatgtgagggtagccaacctgaagccgaggatttctttcaacttttttgtcactgctcccaagaacgtctcagacattatccctagaacggaagtcgagaaagcgattcgcatgtcccgctcacggattaatgatgcattccgcctgaatgataatagtttggaatttttggggatccagccaaccctgggccctccaaatcagccgcctgtctccatctggctgattgtctttggcgtcgtcatgggcgtaattgtagtgggcatcgtgatcctcatctttactgggatccgcgatcggaagaagaaaaacaaggcgaggagcggggaaaatccttatgcatcaatcgatatctccaagggcgaaaataatccaggctttcagaatacggacgacgtacagacaagcttc

SEQ ID NO: 6246 - DNA, 2415 bp, Artificial Sequence
  Description of Artificial Sequence: Synthetic coding sequence
atgtcctcgagctcctggctgctcctcagccttgttgcagtcaccgctgcccagtcgactatcgaagaacaggcgaaaactttcttggacaagtttaatcatgaggccgaggatctcttctaccagagctcactggcttcatggaattacaacaccaacattactgaagaaaacgtgcaaaacatgaacaacgcgggtgacaagtggtccgcattcttgaaggagcagtcgacccttgcacagatgtacccgctgcaggaaatccagaatctcaccgtcaaattgcaactgcaggccctgcaacagaacggctcgtcagtcctctccgaggacaaatctaagaggctgaacacgatcctgaacacgatgagcactatttacagcaccggaaaagtgtgcaatccggacaatccacaggaatgcctcctcctggaaccgggactgaatgaaatcatggcgaactctctcgattacaacgagagactctgggcatgggaatcatggcggtccgaggtgggaaagcagttgaggcctctgtacgaagaatacgtggtcctcaagaatgaaatggccagagctaatcactacgaagattacggagactactggcgcggagactacgaagtgaacggggtcgatggatacgactacagccgcggtcaactgatagaggacgtggaacacactttcgaagaaatcaaaccactgtacgaacacctgcacgcctacgtgcgcgccaaactcatgaacgcctacccaagctacatttcgccgatcggatgccttcctgcccacttgctgggagatatgtggggacggttctggactaacctgtactcgcttaccgtccctttcggtcagaaacctaatatcgacgtgactgatgccatggtcgatcaggcctgggatgcccagcggatcttcaaggaggccgaaaagttctttgtcagcgttggactcccaaatatgacgcaggggttctgggaaaactcaatgcttactgatccggggaatgtgcagaaagctgtctgtcacccgactgcatgggacttgggaaagggcgatttccgcatcctgatgtgtaccaaggtgaccatggatgacttcctgactgcccaccatgagatgggtcatatccaatacgacatggcgtacgccgcgcaaccattcttgctccgcaacggagctaacgagggatttcacgaggcagtgggagaaatcatgtccctttccgccgccacccctaagcatctgaagtcgatcggactgctcagcccggatttccaagaggataacgaaaccgagatcaacttcctcctgaagcaagcgctgactattgtgggtaccctgccattcacctacatgctcgagaaatggcggtggatggtctttaaaggagaaatccctaaggaccagtggatgaagaagtggtgggaaatgaaacgagagatcgtgggagtagtggaacccgtgccgcacgacgaaacctactgcgacccggcttcactgtttcatgtgtcgaacgactacagcttcatcagatactacactcgcactctctaccaattccagttccaggaagccctgtgccaggccgcgaagcacgagggacccctgcacaagtgcgatatctccaactccactgaagcaggacagaaactgttcaacatgctgcgcttgggaaaaagtgagccgtggactctggctcttgagaatgtggtgggagcgaagaacatgaacgtccgccctcttctgaactacttcgaacctctcttcacctggttgaaggaccagaataagaactcgttcgtcggctggtctactgactggagcccatacgcggatcagtcaatcaaagtgagaatctcccttaagtccgcgctgggggataaggcttatgagtggaacgataatgaaatgtacctgtttcggtcgtcagtggcttacgccatgaggcagtatttcctgaaggttaagaaccagatgatcctgttcggagaagaggacgttcgggttgccaaccttaaaccgcgcatctcctttaacttcttcgtgactgcaccgaaaaacgtctcggacatcattccgcgcaccgaagtggaaaaggcgatccgcatgagccgctcgcgcatcaatgacgcgttcagactgaacgataactccttggaatttctggggatccagccgaccctgggaccgcccaatcaaccgcctgtgtccatctggttgattgtgttcggcgtggtgatgggagtgattgtcgttggcatagtgatcctgatctttaccggcatccgggatcgaaagaagaagaacaaggcacggtccggtgaaaacccctacgcgtccatcgatattagcaaaggcgaaaacaacccagggttccagaacacggacgatgtgcaaacctccttc

SEQ ID NO: 6247 - DNA, 2415 bp, Artificial Sequence
  Description of Artificial Sequence: Synthetic coding sequence
atgtcatcatcctcatggctcctgctgtccctggtagccgtaacagcagctcagagcactattgaagaacaggcaaaaacttttcttgacaaatttaaccacgaagcagaagatctgttctaccagtcgagtctcgcctcgtggaattacaacaccaacattacagaggaaaacgtccagaacatgaacaatgctggggataaatggtccgccttcctgaaagaacaatccactctggctcaaatgtaccctctccaggagatccagaacctgacagttaagctgcagctccaggccctgcagcagaatggttcgtcagtcttgtctgaggataaatctaagaggctcaatacaatcttaaacaccatgtccactatttactcaaccggtaaagtgtgcaacccagacaatcctcaagagtgccttttgctcgaacccgggctcaacgagattatggcaaactctctggactacaatgaaagactgtgggcatgggagtcttggcggagcgaagtaggaaagcagctgcggcctctgtacgaggagtacgtggttcttaagaacgagatggctcgtgccaatcattacgaagactacggagattattggcgtggggattacgaagtgaatggagtcgacggttacgactattctagggggcagctgatcgaggacgtagaacatacatttgaggaaatcaagcccttgtacgagcatcttcacgcgtacgtgagggcaaaattgatgaacgcttaccctagttatatcagccctattggttgtttgccggctcacctgctcggggatatgtggggcaggttctggaccaatttgtactcattaacagtgcccttcgggcagaagcctaatatcgacgttaccgacgccatggtagatcaggcatgggatgcacaaaggatcttcaaagaagcagagaagttctttgtgagtgtagggctacccaacatgacccaggggttttgggagaactcaatgctgaccgaccccggcaacgtgcagaaggctgtgtgtcaccctactgcatgggacctgggaaagggtgacttcaggatactgatgtgtacaaaggtcacgatggacgattttctgactgctcatcacgaaatgggacacattcagtatgacatggcatatgccgcccagcccttcttgcttcgcaatggagctaatgaaggatttcacgaggctgtcggggaaattatgagcttgagcgcggctaccccaaagcatctgaagtccatcggcctgttgagccccgacttccaggaggacaacgaaacagaaatcaactttctgctgaagcaggcccttacaattgtagggacactccctttcacatatatgctggaaaaatggaggtggatggtgtttaagggggagattcccaaggatcagtggatgaagaaatggtgggagatgaagcgagagatcgtgggggtggtcgaacccgtgcctcacgacgagacctattgcgatccagcctcgctcttccatgtgagtaatgactattcttttattagatattacacgcgaactctctatcaatttcaatttcaagaggctctctgccaggcagcgaagcacgaaggacccctgcataagtgcgacattagtaactccacagaggcaggccaaaaactgttcaacatgctcagactggggaagtcagaaccctggactctcgcattggagaacgtcgtaggggcgaagaatatgaacgttaggcctttgttaaattacttcgaaccactctttacgtggctgaaagatcagaacaagaattctttcgttggctggtcgaccgattggtccccctatgcagaccaatcaattaaagtacgtatttccctcaagagtgctttgggggacaaggcctacgaatggaacgacaatgagatgtatctgttccggagttccgttgcttacgccatgcgtcagtactttctaaaagtaaagaaccagatgatcttatttggggaggaagatgtgagagtcgctaatctgaagcctagaataagctttaacttcttcgtgaccgcgccaaaaaatgtgagcgacataattccccgaactgaggtcgaaaaggctattcgcatgagcagatcccggatcaatgatgcgtttcggctgaatgataatagcctggagttcctcggcattcagccaactctgggccctcctaatcagcccccagtgagcatttggctcattgtgtttggcgttgtgatgggggtgatcgtggtgggaatcgtgattttgatcttcaccggcatacgcgataggaagaagaaaaataaggcacgaagtggcgagaacccgtatgcatcaattgatatcagtaaaggcgaaaacaaccccggattccaaaataccgatgacgtgcagacatcattc

SEQ ID NO: 6248 - DNA, 2415 bp, Artificial Sequence
  Description of Artificial Sequence: Synthetic coding sequence
atgagtagttcctcttggttattgctcagtctggtggctgtcaccgcagcccagtccacaattgaggagcaggccaagacattccttgacaagtttaaccacgaagcggaggacttgttttaccagtcttctctggcgtcctggaattataacacaaacatcactgaagagaacgtgcagaatatgaataacgccggcgataaatggagcgcattcctgaaagagcagtcgactctcgcccaaatgtatcccctgcaggagatccagaatctgacggtaaagctccagctgcaggccctgcagcagaacggctccagtgtgctgagcgaggacaagagcaagcgcctcaacacaatcctaaacaccatgtctaccatatattccacgggcaaggtgtgtaacccggataacccacaggagtgccttttgcttgaaccagggttaaatgaaatcatggctaacagtctcgattacaatgagaggttgtgggcctgggaatcgtggcgatccgaagtcggaaagcaactgaggccgctgtatgaagagtacgtcgtgctcaaaaatgagatggctagagccaaccactatgaagattatggagactattggcggggtgactacgaggtcaacggtgtggatggttacgactactcccgcgggcagctgatagaagacgtggaacatactttcgaggagatcaaacccctgtatgagcacctgcatgcctatgtccgcgccaaactcatgaacgcctacccatcctatatcagtccgattggctgtcttcctgcgcacctcctaggcgatatgtgggggagattctggactaacctgtactctctgaccgtgccctttggtcagaaacccaatatcgatgtaaccgacgctatggtcgatcaggcgtgggatgcgcagagaatttttaaagaagcagaaaagttcttcgtgagcgtcggactaccaaatatgacccaaggattctgggagaatagcatgttaaccgatcccggcaacgtgcagaaggcagtttgtcaccccaccgcttgggacctgggcaagggggactttcgtatattgatgtgcacgaaagtgaccatggatgacttcctgacagcccaccacgagatgggtcacatccaatacgatatggcctacgccgctcagccgtttcttctcagaaatggggctaatgagggctttcacgaggctgtgggggagatcatgagtttgtcagcagctacccccaaacatctaaagtcgatagggctgctctctcctgactttcaagaggacaacgagactgagattaatttcttactaaagcaagctctcaccatcgtgggaacgctccctttcacctatatgctggagaagtggcgatggatggtgtttaaaggcgagattccaaaagatcagtggatgaagaagtggtgggaaatgaagagagagattgttggcgtggttgagccagtcccgcacgatgagacctattgcgaccccgcatctctgtttcacgtgtcaaatgattactcctttatcaggtactatacacgaaccctatatcagttccagttccaagaggccctctgtcaggccgcaaagcatgaagggcctctgcataagtgtgacatcagcaacagcacagaggcaggacagaagctgttcaacatgctcagactgggaaaatcagaaccatggactctggcactcgaaaacgttgtcggtgcaaagaatatgaatgtccgcccccttcttaattattttgagcctctatttacatggttaaaggatcagaacaaaaactctttcgtggggtggtcaacggactggtcgccctatgcagatcagtcaattaaggttcgcattagtctgaagtcggctttaggagacaaggcatacgagtggaacgacaacgaaatgtatctttttaggagttcggttgcgtacgcgatgcgtcagtattttctaaaggtgaagaatcagatgattttgtttggggaggaagatgttagggtggctaatctgaagcccaggatctctttcaactttttcgtaacagccccaaaaaacgtgtctgatataatacccaggacggaggtcgaaaaagcaatccggatgtcccgcagccgtatcaatgatgcctttcggcttaatgacaattccctcgaatttctcgggatccagccaactctggggccccccaaccagcctcccgtgagtatctggctgatcgtctttggagtcgtgatgggtgtcatcgtggtcggcattgtgatcctcatctttactgggatccgagacaggaagaagaagaataaggctcgctctggagagaacccgtacgcctccattgatatatccaaaggggaaaataaccctggttttcagaacacggatgatgtgcaaacttccttt

SEQ ID NO: 6249 - DNA, 2415 bp, Artificial Sequence
  Description of Artificial Sequence: Synthetic coding sequence
atgtcaagtagcagttggttgctgctttcactggtagctgtgactgcagcccaatcaactattgaagagcaggcaaagaccttcctggacaagttcaatcacgaagccgaagatctgttctaccagagctcattggcctcttggaattacaacaccaatataaccgaagaaaacgtgcagaacatgaataacgctggtgacaagtggagtgccttccttaaggagcagagtacactggcccaaatgtacccgctgcaagaaatccagaacctgacagtaaaattgcagctgcaggctctccaacaaaatggatcatcagtccttagtgaggataagtccaaacgcctcaacacgatcttgaacacaatgtcaacaatctactctacgggtaaagtctgcaaccctgacaacccccaggagtgtctcctgttggaacccggcctgaacgaaatcatggccaacagcctcgattataacgaaagattgtgggcttgggaaagctggcgcagcgaggttggaaagcagctcaggccactttatgaagaatacgtggtgctgaaaaacgaaatggccagggctaaccactacgaagactacggagattattggcgcggcgactatgaagtgaatggtgttgacggctatgattactccaggggccagttgatcgaggatgttgaacataccttcgaggagattaagccattgtacgaacatctgcacgcctacgttcgcgcaaagttgatgaatgcatatccgagttacatctctcccatcggatgcttgcctgcccatcttttgggagacatgtggggtcgcttctggactaatctgtactccctcactgttcccttcggacaaaagccaaacatcgacgtcaccgatgctatggtggaccaagcttgggacgcacagaggatcttcaaggaggccgagaaatttttcgtgtcagtgggcctgccaaatatgactcagggattttgggagaactcaatgcttacagatcctggcaatgtgcagaaagctgtttgtcaccccactgcttgggacctcggtaagggagactttcgcattctgatgtgcacgaaggttacgatggacgatttcctgaccgcgcatcacgaaatgggacacatccaatacgatatggcctacgccgcccaaccatttcttctcagaaacggcgccaacgaaggctttcacgaggcagtgggcgaaattatgtcactttccgctgctacccccaaacacctgaagagtattggactgctcagtcccgacttccaggaagataatgagaccgagatcaacttcttgctcaaacaggccttgacgatcgtgggaaccctcccatttacctacatgttggagaagtggaggtggatggtcttcaagggcgagatccctaaagaccagtggatgaaaaagtggtgggagatgaaaagggaaatcgtgggagtcgtggagcccgttccacatgatgagacgtattgcgatcccgcctctctctttcacgttagcaacgactatagcttcatcaggtactatactagaaccctgtaccagttccagtttcaggaggccctgtgtcaggccgctaagcatgaaggacccctgcacaaatgcgatatctctaatagcacggaagccggccagaagttgttcaacatgctgagactgggcaagtcagagccctggactctggctctggagaacgtggtcggtgccaagaacatgaacgtacgccccctcctgaactacttcgagccactttttacatggctgaaggatcagaacaaaaattccttcgtgggatggtcaacagattggagcccatacgccgatcagtccattaaggtgaggatctctctcaaaagtgccctcggtgacaaagcctacgagtggaacgacaatgagatgtatctgttccgcagttcagtagcttatgccatgaggcaatatttcctcaaagttaagaatcagatgatactctttggcgaggaggatgtgcgcgtagccaacctgaaacctcgcatatcattcaatttcttcgtaacagcgccgaagaatgtctcagatatcataccaagaactgaagttgaaaaagctataaggatgtctaggtccagaatcaacgatgcttttaggctgaacgacaacagcctggaattcctgggaattcagcctactctcggccctcctaaccaacccccagtgagcatctggttgattgtgttcggagtggtaatgggtgtgatcgtggtgggcattgtcattcttatcttcacaggaattagggatagaaagaagaagaacaaggctagatccggcgaaaacccctatgctagtatagacatatccaagggtgagaataatcctggcttccagaatacagacgatgtgcagacatctttt

SEQ ID NO: 6250 - DNA, 2415 bp, Artificial Sequence
  Description of Artificial Sequence: Synthetic coding sequence
atgtcgtcgtcgtcgtggttattactatcgttagttgcggttacggcggcgcaatcgacgatagaagaacaagcgaaaacgtttctagataaatttaatcatgaagcggaagatttattttatcaatcgtcgttagcgtcgtggaattataatacgaatataacggaagaaaatgttcaaaatatgaataatgcgggtgataaatggtcggcgtttctaaaagaacaatcgacgctagcgcaaatgtatccgctacaagaaatacaaaatttaacggttaaattacaactacaagcgttacaacaaaatggttcgtcggttctatcggaagataaatcgaaacgattaaatacgatattaaatacgatgtcgacgatatattcgacgggtaaagtatgtaatccggataatccgcaagaatgtctattattagaaccgggtctaaatgaaataatggcgaattcgttagattataatgaacgattatgggcgtgggaatcgtggcgatcggaagttggtaaacaactacgaccgctatatgaagaatatgttgttctaaaaaatgaaatggcgcgagcgaatcattatgaagattatggtgattattggcgaggtgattatgaagttaatggtgttgatggttatgattattcgcgaggtcaactaatagaagatgtagaacatacgtttgaagaaataaaaccgttatatgaacatttacatgcgtatgtacgtgcgaaattaatgaatgcgtatccgtcgtatatatcgccgataggttgtttaccggcgcatttactaggtgatatgtggggtcgattttggacgaatctatattcgctaacggtaccgtttggtcaaaaaccgaatatagatgttacggatgcgatggtagatcaagcgtgggatgcgcaacgaatatttaaagaagcggaaaaattttttgtttcggtaggtttaccgaatatgacgcaaggtttttgggaaaattcgatgttaacggatccgggtaatgttcaaaaagcggtatgtcatccgacggcgtgggatctaggtaaaggtgattttcgtatactaatgtgtacgaaagtaacgatggatgattttttaacggcgcatcatgaaatgggtcatatacaatatgatatggcgtatgcggcgcaaccgtttctactacgaaatggtgcgaatgaaggttttcatgaagcggttggtgaaataatgtcgctatcggcggcgacgccgaaacatctaaaatcgataggtttactatcgccggattttcaagaagataatgaaacggaaataaattttttactaaaacaagcgttaacgatagtaggtacgctaccgtttacgtatatgttagaaaaatggcgttggatggtatttaaaggtgaaataccgaaagatcaatggatgaaaaaatggtgggaaatgaaacgtgaaatagtaggtgttgtagaaccggtaccgcatgatgaaacgtattgtgatccggcgtcgttatttcatgtatcgaatgattattcgtttatacgttattatacgcgaacgctatatcaatttcaatttcaagaagcgctatgtcaagcggcgaaacatgaaggtccgttacataaatgtgatatatcgaattcgacggaagcgggtcaaaaactatttaatatgttacgtctaggtaaatcggaaccgtggacgctagcgctagaaaatgtagtaggtgcgaaaaatatgaatgttcgtccgctattaaattattttgaaccgctatttacgtggttaaaagatcaaaataaaaattcgtttgtaggttggtcgacggattggtcgccgtatgcggatcaatcgataaaagtacgtatatcgctaaaatcggcgctaggtgataaagcgtatgaatggaatgataatgaaatgtatttatttcgatcgtcggtagcgtatgcgatgcgacaatattttttaaaagtaaaaaatcaaatgatactatttggtgaagaagatgtacgtgtagcgaatttaaaaccgcgaatatcgtttaatttttttgtaacggcgccgaaaaatgtttcggatataataccgcgtacggaagttgaaaaagcgatacgtatgtcgcgttcgcgaataaatgatgcgtttcgtctaaatgataattcgttagaatttctaggtatacaaccgacgttaggtccgccgaatcaaccgccggtatcgatatggctaatagtatttggtgtagtaatgggtgtaatagtagtaggtatagttatattaatatttacgggtatacgtgatcgaaaaaaaaaaaataaagcgcgatcgggtgaaaatccgtatgcgtcgatagatatatcgaaaggtgaaaataatccgggttttcaaaatacggatgatgtacaaacgtcgttt

SEQ ID NO: 6251 - DNA, 2415 bp, Artificial Sequence
  Description of Artificial Sequence: Synthetic coding sequence
atgtccagcagctcttggctcctgctgagcctcgtcgcagttaccgccgcgcagtcgaccatcgaagaacaggcaaaaactttcctggataagtttaatcacgaggccgaagatcttttctaccaatcctctctggcgtcctggaattacaacaccaacatcaccgaagagaacgtccagaatatgaacaacgcgggagacaaatggtccgcatttctgaaggagcagtcaaccctggcacagatgtatcccttgcaggaaatacaaaacctgaccgtgaagctccagttgcaggcgttgcagcaaaacggctcctcagtcctgagcgaggacaagtccaagcgcctcaatacgatcttgaacaccatgtctactatctattcaaccggaaaggtttgcaatccggacaacccgcaagaatgtctcctgctggaaccgggacttaatgaaatcatggctaactcgttggactacaacgagaggttgtgggcttgggagtcatggaggagcgaggtgggaaagcagcttaggccgctgtatgaagaatatgtggtgctgaagaacgaaatggcccgcgccaaccactacgaggactacggagactactggcggggagactacgaggtcaatggagtcgacggatacgattacagccgggggcagctgatcgaagatgtggaacatactttcgaagagataaaacctctctacgaacacctgcatgcgtacgtccgcgccaaacttatgaacgcctacccgtcatacatctcaccaatcggatgccttccggcccatctgctcggcgatatgtggggtcggttttggaccaatctctactcgttgaccgtccccttcggacaaaagcccaacattgacgtgactgatgcaatggttgatcaggcgtgggacgcccagcggatattcaaagaggcagagaagtttttcgtctcagtgggcctgccaaacatgacccagggcttctgggaaaatagcatgctcactgacccagggaacgtgcaaaaggccgtgtgccacccaactgcgtgggatctgggaaagggagattttcgcatcctgatgtgcaccaaggtgacgatggacgacttcctgactgcccaccacgagatggggcacattcagtacgacatggcgtacgctgcgcaaccctttttgcttagaaacggagcaaacgaggggttccatgaagctgtaggagagattatgtccctgtcagccgcgactcccaagcatcttaagtctatcggactgctctcgccggactttcaggaggacaacgagacggaaatcaatttcctgctgaaacaggccctgactatcgtcggcactcttcctttcacttacatgctcgaaaaatggaggtggatggtgtttaagggagagatcccgaaggatcagtggatgaagaagtggtgggaaatgaaacgggaaatcgtcggagtcgtggagccagtgccacatgacgaaacttactgcgatccagcttccctgttccacgtgtcgaacgattactccttcatccgctactacactagaactctctaccagttccagttccaggaagcactttgtcaagccgcgaagcacgaagggccgcttcacaaatgcgacattagcaattcaaccgaggcagggcagaaacttttcaatatgttgaggctgggaaagtcggaaccgtggacgttggcccttgagaacgttgtgggcgccaaaaacatgaacgtgcgccctctcctcaattacttcgagcccctcttcacctggctcaaggatcagaataagaattcgttcgtcggctggtccactgactggagcccgtacgccgatcagtccattaaagtaaggatctccctcaagagcgctctgggggataaggcctatgagtggaacgacaatgagatgtacctgtttaggagctcggtggcgtacgcgatgcggcagtacttcctgaaggtgaagaatcaaatgatcctgtttggagaggaagatgtgcgggtggccaacctcaagcctcgcatctcatttaacttcttcgtcactgccccaaagaatgtctcggatatcattccacgtaccgaagtggaaaaggctatcagaatgtcgagatcccgcatcaacgacgcctttcggctcaatgacaattccctggaattcttgggcatccaaccaaccctcgggcctcccaaccagccgcctgtgtccatctggctgattgtgttcggcgtggtgatgggggtgatagtggtgggcatcgtgatcctcatcttcactggtattagagacagaaagaaaaagaacaaggcacgctcgggagaaaacccttacgcatccatcgacatctcgaaaggagagaacaatccaggcttccaaaatacggacgatgtccaaacctccttc

SEQ ID NO: 6252 - DNA, 2415 bp, Artificial Sequence
  Description of Artificial Sequence: Synthetic coding sequence
atgagttctagttcatggttattgttatctttagtagcagtcactgcagcacaatctactatagaagaacaagctaaaacatttttagataagtttaatcacgaggctgaggatcttttttatcaatcaagtttagcttcttggaattataatacaaatattactgaagaaaatgttcaaaatatgaataatgctggagataaatggtcagcctttttaaaagaacaatctacgttagctcaaatgtatcctcttcaggaaatccaaaatcttactgttaaattacaattacaagctttacaacaaaatggatcttcagttttaagtgaagataaatcaaaaagacttaatactattttaaatactatgtcaactatttattctacaggaaaggtatgtaatccagacaatccacaagaatgtttattacttgaaccaggtttaaatgaaataatggcaaactctcttgattataatgaaagactttgggcatgggaatcatggagatcagaagttggaaaacaattaagacctttatatgaagaatatgtagtacttaaaaatgagatggcaagagcaaatcattacgaagattatggtgactattggagaggagattatgaagttaatggagttgatggttatgattacagtcgtggtcaattgattgaagatgtagaacatactttcgaagagattaaaccattatatgaacatttacatgcatatgttagagcaaagctaatgaatgcttatccatcttatatttctccaattggttgtcttccagctcatttattaggagatatgtggggtagattttggactaatttatatagtcttacagttccatttggacaaaaaccaaatattgatgttactgatgcaatggtagatcaagcatgggatgctcagagaatattcaaagaagcagaaaaattctttgtttcggttggattaccaaatatgactcaaggattttgggaaaattcaatgcttacagatccaggaaatgttcaaaaagcagtttgtcacccaacagcttgggatttaggaaaaggtgactttagaattcttatgtgtactaaagttacaatggatgattttttaacagctcatcatgaaatgggtcacatacagtatgacatggcatatgctgcacaacctttcctacttcgtaatggtgctaatgaaggatttcatgaagcagtcggagaaatcatgagtctaagtgctgctactccaaaacatttaaagtcaataggattattaagtccagacttccaagaagataatgaaacagaaattaattttttacttaaacaagctttgactattgtaggaacattaccatttacttatatgttagaaaagtggcgttggatggtattcaaaggagaaattccaaaagatcaatggatgaaaaagtggtgggaaatgaaaagagaaattgttggagttgtagaaccagttccacatgatgaaacatattgtgatccagcatcattatttcatgtaagtaatgattattcttttattcgttattatactagaacattatatcaatttcaatttcaagaagcactttgtcaagctgctaagcatgaaggaccattacataaatgtgatatttcaaatagtactgaagctggacaaaaattgttcaatatgcttagacttggaaaatcagaaccatggactttagcattagaaaatgtagttggagcaaaaaatatgaatgttagaccattattaaactattttgaaccactttttacttggttaaaagaccaaaataaaaattcctttgttggatggtctacagattggagtccatatgcagatcaaagtattaaagttagaatttcattgaaaagtgcattaggtgacaaagcatatgaatggaatgataatgagatgtatctttttagaagtagtgtagcttatgcaatgagacaatattttttaaaagtaaaaaatcaaatgatacttttcggtgaagaagacgtacgtgtagcaaatttgaaaccaagaataagtttcaattttttcgttacagctcctaaaaatgtttcggatataattccaagaacagaagttgaaaaagctatcagaatgtcaagatctaggattaatgacgcatttagattaaatgataattcattagaatttcttggaatacaaccaactttaggaccaccaaatcaaccaccagtttccatatggcttattgtatttggagtggttatgggtgttattgtagtaggtattgttattcttatatttactgggatacgagatagaaaaaaaaagaataaagctagatctggagaaaatccatatgcttctattgatatttcaaaaggagaaaacaatccaggttttcaaaacacagatgatgttcaaacttcattt

SEQ ID NO: 6253 - DNA, 2415 bp, Artificial Sequence
  Description of Artificial Sequence: Synthetic coding sequence
atgtcttcctcaagttggctgttgctttctctggtggcagttactgctgctcagtctactatcgaagagcaggcaaagacattcctggataagtttaaccatgaggcagaggatctgttctaccagtcatcacttgcttcttggaattataatactaacattactgaagaaaacgtgcaaaatatgaataacgccggagataagtggtccgcttttcttaaagagcagtccaccctcgctcaaatgtacccacttcaggaaatccagaacctgaccgtgaagctgcagctgcaagctctccagcagaatggctcatctgttctgagcgaggataagagtaaacgtttgaacacaatactgaacaccatgtccaccatttatagcaccggcaaggtgtgcaaccctgacaacccacaggagtgcttgctgctcgaacccggcctgaacgagatcatggcaaactccctcgattacaacgaacgcctctgggcatgggagtcctggagatctgaggtgggaaagcagttgcgccccctttacgaggaatacgtggtgttgaagaatgagatggctcgtgctaaccattacgaagattacggtgattactggcgtggtgattatgaggtaaacggagttgacggatacgattactcacgtggacaactcatcgaagacgtcgagcacacctttgaagaaataaagcccctttacgagcatcttcacgcctatgtgagggctaaacttatgaacgcatacccctcctacatctcccccatcggttgcctccctgcccatctcttgggagacatgtggggtaggttttggaccaacctctactcccttacagtccctttcggtcagaagcccaatattgatgtaaccgacgcaatggtcgaccaagcttgggacgctcagagaattttcaaggaggccgaaaagtttttcgtgtccgttggactgcctaacatgactcagggtttctgggagaatagtatgctcaccgacccaggtaacgtccagaaggctgtttgccatccaacagcctgggacttgggcaagggcgacttccgtatcctcatgtgcaccaaagtcaccatggatgattttttgacagcacaccacgaaatgggccatatccagtatgacatggcctacgccgctcaaccatttctgctgcgtaacggcgccaatgagggctttcatgaggctgtgggagaaatcatgagtttgagtgccgctacccctaaacacctgaagagcatcggactgctgtccccagacttccaagaagataatgagacagagatcaactttctgctcaaacaagctctcactatagttggtactttgcctttcacttacatgctggagaagtggaggtggatggtgtttaagggtgagattcccaaggaccagtggatgaagaagtggtgggaaatgaaaagagagatcgttggtgtggtggagccagtccctcacgatgagacttactgcgaccccgcatccttgttccatgtgtcaaacgactacagtttcattagatactacacccgcacactgtaccagttccagtttcaggaagctttgtgtcaggcagccaaacacgagggcccacttcacaagtgcgatatctccaacagtaccgaagccggccagaagttgtttaatatgctcaggttgggcaaatccgagccctggacactggctctggagaatgttgtaggagccaagaacatgaatgttaggcctcttcttaactatttcgaacccctcttcacttggctgaaggatcaaaacaagaactccttcgtaggatggtctacagactggtccccatatgccgatcaaagtatcaaggtgcgcatctcactcaaaagtgccctcggcgataaggcctacgaatggaacgataacgaaatgtacctctttaggagttcagtggcatatgcaatgcgccaatacttccttaaggtgaagaaccagatgatcctgttcggtgaggaggacgtgagggtggccaacctgaagcctcgtatcagcttcaacttttttgttactgcacctaagaacgtgtccgatatcatccccaggactgaggttgagaaagcaatacgcatgagcagaagccgtatcaacgacgccttcagattgaacgacaactccctcgaattcctcggtatccaacccacattgggcccccctaatcaacctccagtaagtatctggcttatcgtttttggagttgtgatgggagtgattgtcgtcggtatcgtgatcctgatttttactggcattcgtgacaggaagaagaagaataaagccagaagtggtgaaaatccctacgcaagcattgacatttctaagggtgagaataaccccggatttcaaaatactgacgatgtgcagactagtttt

SEQ ID NO: 6254 - DNA, 2415 bp, Artificial Sequence
  Description of Artificial Sequence: Synthetic coding sequence
atgtcttcaagctcatggctgctgctttctttagtggcagtcacggccgcccagagcacgatcgaggaacaagcgaagacattcctggacaagtttaaccatgaggcggaagacctgttctatcagagcagcctggcttcctggaattataataccaacataactgaggagaacgttcagaatatgaataacgcaggcgacaaatggtctgctttccttaaggaacagagtaccctcgctcagatgtaccctcttcaggagatacagaacctgaccgtcaagctgcagctacaggccctgcagcagaatggatcatccgtccttagcgaggacaagtccaagaggcttaacacaatcctcaacacaatgagcaccatctattcaaccggaaaagtatgtaatccagacaacccacaagagtgtttgttgcttgagccaggactcaatgagataatggccaactcgctggactacaatgagcgtctgtgggcctgggagagctggcgatcagaagtcggcaagcagctgcggccgctatacgaggagtacgtggtgttaaaaaatgaaatggcccgggccaatcactatgaggactacggggattactggagaggcgattacgaggtcaacggggttgatggctatgattactcgcgaggccagctgattgaggacgtggaacacaccttcgaggaaattaagccattatacgagcatcttcatgcctatgtccgggcgaaactcatgaacgcatatccgtcatatatatcccctattggatgtctgcctgctcatctcctgggtgatatgtggggccgcttctggacgaatctgtatagcctgacagtcccttttgggcagaaacccaacatcgacgtgaccgacgccatggtggaccaggcctgggacgctcaaaggatttttaaggaggcagaaaaatttttcgtctccgtgggcctgccaaacatgacacaggggttctgggaaaactcaatgctgactgaccccggcaatgtgcagaaagcagtatgccaccctaccgcctgggatctgggaaaaggagacttccgaatactaatgtgcaccaaagtgaccatggatgactttctgacggcgcaccatgaaatgggccacatacagtacgatatggcgtacgcagcccaaccatttcttctgcgcaacggcgcaaatgaaggcttccatgaggccgtgggggagataatgagcctgtcagcagcaacacctaaacatcttaaatccattggactcttgtcacccgatttccaagaggacaacgaaacggagattaattttctgttaaaacaggctctgacgatcgtaggcaccttgccatttacctacatgttggagaagtggcgatggatggtcttcaagggtgaaatcccaaaggaccagtggatgaagaaatggtgggagatgaagcgagagatcgttggcgtcgtcgagcctgtgccccatgacgaaacttattgtgatcctgcctcgctcttccacgttagtaacgactacagcttcatcaggtactacacccggactctgtatcagttccaatttcaggaagctctgtgccaggctgccaagcacgagggtcccctgcacaaatgcgatatcagcaattccactgaagcagggcaaaaactgttcaacatgcttagacttggcaaatctgagccctggaccttagcgttggagaatgtcgtaggggccaagaatatgaacgtaaggcccctgctcaactactttgagcccctgttcacctggctgaaggaccagaacaagaattccttcgtgggatggtcaactgattggagcccctatgcggaccagagcataaaggtgcgcatctctctgaaaagcgccttgggggataaggcctacgaatggaacgataacgaaatgtatctatttcgcagctcagtggcttacgcgatgcggcagtattttttaaaggtgaaaaaccagatgattcttttcggggaagaggatgtgcgggtcgcaaacttgaagcctaggatctctttcaacttctttgtgacagcacccaaaaacgtcagcgacataataccgcggaccgaggtagagaaggcaatcaggatgagccggtcccggatcaatgacgcctttagactgaatgacaatagtctggagtttctaggcatccagccaaccctgggaccccctaatcaaccacccgtttccatatggttgatcgtgttcggagtggtgatgggagtcatcgtggtcggtatagttattcttatatttacgggaatcagggaccgcaagaagaaaaataaggctaggagtggtgagaatccgtacgcgagcatcgatatttctaagggagaaaacaaccctggtttccagaacaccgatgacgttcagacctctttt

SEQ ID NO: 6255 - DNA, 2415 bp, Artificial Sequence
  Description of Artificial Sequence: Synthetic coding sequence
atgagctctagcagctggctgctcctgtcactcgtggcagtcaccgcagcccagtccaccatcgaagaacaggctaagaccttcctcgataagttcaaccatgaagctgaggacctgttctaccagtcatccctcgcgagctggaactacaacactaacatcacggaagaaaacgtgcaaaacatgaacaacgctggggacaagtggtccgctttcctgaaagagcagtcgactctggctcagatgtacccactccaggagatccagaatctgaccgtgaaactgcagctccaagccctgcaacagaacgggtcctctgtgctctcagaggataagtccaagcgtctgaacactatccttaatactatgtcaactatctactcaactggaaaggtctgcaaccctgataacccgcaagaatgcctcttgctcgaaccaggactgaacgaaattatggcgaactccctcgactacaacgagcgcctgtgggcctgggaatcatggagatcagaagttggaaaacaactgcggccgttgtatgaggaatacgtggtgctgaagaatgagatggcccgcgcgaatcattacgaggattacggtgactactggcgcggagactacgaggtgaatggggtcgacggctacgactacagccgggggcagctgatcgaggacgtcgaacacacctttgaggaaatcaaacctctctacgaacatctgcatgcctatgtcagagccaaattgatgaatgcatacccatcgtacatcagcccgattggctgcctcccggcccacctgctgggagatatgtggggacgcttttggaccaacttgtactcgttgactgtgcccttcggacagaagccaaacatagatgtcactgacgctatggtggatcaggcctgggacgcacaaaggatctttaaggaagccgaaaaattcttcgtgagcgtcgggctgccaaatatgacccaaggattctgggaaaactcaatgctgactgatccggggaacgtgcagaaggctgtctgccaccctaccgcttgggacctcggtaagggcgacttccgcatcctcatgtgcaccaaggtgacgatggacgacttcttgaccgcgcaccatgagatgggacacatccaatacgacatggcctacgcagcacagccttttcttctgagaaatggcgccaacgagggattccatgaggcggtgggcgaaatcatgtccctgagcgcggcaacgccaaagcacctgaaaagcatcggactgctgtctcctgacttccaggaggacaacgaaactgagatcaattttctgctcaagcaagccctcacgattgtcggaaccctcccgttcacttatatgctggagaagtggaggtggatggtgttcaagggcgagatcccgaaggaccagtggatgaaaaagtggtgggaaatgaagagggaaatcgttggtgtggtggagcctgtgcctcacgatgaaacttactgtgatccagcctcgctgttccacgtatccaacgattacagcttcatccggtactacactcgcaccctgtatcaattccaattccaagaagcattgtgtcaggcggcgaagcacgagggaccgctccacaaatgcgatatctccaactccaccgaggccggccagaagctgttcaacatgcttcgcctgggtaagtccgagccctggaccctcgccctggaaaacgtggtgggcgcgaaaaatatgaacgtccgccccctgcttaactacttcgagccgctgttcacctggctgaaggatcagaataaaaattcgttcgtgggatggtcgactgattggtcgccatacgctgaccagtcgatcaaggtgcgcatttcactcaagtccgccctcggcgacaaggcgtacgagtggaacgacaatgaaatgtacctgttccggtcgtcggtggcgtacgcaatgagacaatacttcttgaaggttaagaatcagatgatcctctttggagaagaggatgtccgggtcgcgaacctgaagccgaggatttccttcaattttttcgtgaccgccccgaagaacgtgtccgacatcatcccgcgcacggaagtcgaaaaagccattagaatgagcagaagccgaattaatgatgccttccggctgaatgacaactcgcttgaatttcttggcatccagccaacccttggcccgccgaatcagccccccgtgtcgatctggctgatcgtgtttggagtggtgatgggagtgatcgtggtcggaattgtgatcctgatcttcaccggaatccgggaccggaaaaagaagaacaaagcccggtcgggagaaaacccgtacgcaagtatcgacatctcaaaaggtgaaaacaatccagggtttcaaaatactgacgatgtccagacctcgttt

SEQ ID NO: 6256 - DNA, 2415 bp, Artificial Sequence
  Description of Artificial Sequence: Synthetic coding sequence
atgtcgtcgtcgagctggctgctgctgtcactcgtggctgtgactgccgcccagtccaccatcgaagagcaggccaagactttccttgataagttcaatcatgaagctgaggatctcttttaccaatcatcgctggcgtcatggaactacaacaccaacatcaccgaagaaaacgtgcagaacatgaacaatgcgggagacaagtggtccgctttcctcaaagagcagagcaccttggcccagatgtaccccctccaggaaatccagaatctgaccgtcaagctccaactgcaagccctgcaacagaatggatcgtccgtgctgtctgaggacaagtccaagcgcctcaacaccatcctgaacacgatgtccactatctattccacgggcaaagtgtgcaatccggacaaccctcaagaatgcctgctgctcgaaccgggtcttaacgaaatcatggccaattccttggactacaatgaaagactgtgggcgtgggagtcctggcggtcagaagtgggaaagcagctgcggccactttacgaagagtacgtcgtcctgaagaacgaaatggcccgtgccaaccactatgaggactacggagactactggcggggagattacgaagtgaatggagtggacggatacgactactcgcggggacagctgattgaggacgtggaacataccttcgaggaaatcaaaccactctatgagcacctccacgcgtacgtgcgcgcgaaactcatgaatgcctacccgagctacatttccccaattggatgccttccagcccatcttttgggagatatgtggggacggttctggactaatttgtactcgcttaccgtccctttcgggcagaagccaaacatcgatgtcactgacgcgatggtggaccaggcttgggatgcccagcgcatcttcaaggaggcggaaaagttcttcgtctcggtgggattgccgaacatgactcaaggattttgggaaaactcgatgctcactgatcctggaaatgtccagaaggcagtgtgtcacccgaccgcctgggaccttggaaagggagactttcggatactgatgtgtaccaaggtgactatggatgacttcctgaccgcccaccatgaaatggggcacatccagtacgatatggcctacgctgctcaacctttcctcctgcggaatggtgccaacgaaggttttcacgaggcggtgggtgagattatgtcgcttagcgccgctacgccgaaacacctcaagtccatcggcctgctgagccctgactttcaagaggataacgaaaccgagattaacttcctgctgaagcaagcattgaccatcgtcggaactctgccattcacctacatgttggagaagtggcggtggatggtctttaagggagaaatcccgaaggaccaatggatgaagaaatggtgggaaatgaagcgcgagattgtcggcgtcgtggagccagtgccgcacgacgaaacctactgcgatcctgcctcgctgttccacgtgtcgaacgattacagctttatccgctattacactcgcaccttgtaccaattccaatttcaggaagcactctgtcaggcggcgaaacacgagggccctctgcataagtgcgacatcagcaacagcactgaggctggccagaagttgttcaatatgctccggctgggcaagtcggagccgtggacccttgcgctggaaaatgtcgtgggagcgaaaaacatgaatgtaaggccgctgctcaattacttcgaaccgctctttacttggctgaaggatcagaacaaaaactcgttcgtgggctggtcaactgattggtccccttacgctgatcagagcatcaaagtgcggatatccttgaagtcagctctgggcgacaaggcttatgagtggaatgataatgagatgtacctctttcgctcctccgtggcatacgctatgcgccagtacttcctcaaggtgaaaaaccagatgatcctgttcggagaggaagatgtccgggtggcaaatctcaagccgcgcatctcctttaacttcttcgtgaccgccccgaaaaacgtgagcgacatcatccccaggaccgaagtggagaaggcaatcagaatgtcgcggtcgcggatcaacgacgccttccggctgaacgataactcgctcgagttcttgggaatccaaccgactctgggacctcccaatcagcctccggtgtccatctggctgatcgtgttcggagtggtgatgggagtgattgtggtcggcatcgtgatcctgatcttcaccggtatccgcgatagaaagaaaaagaataaggccagaagcggcgagaacccttacgcctccattgatatttccaagggcgagaataatccgggattccaaaacactgatgacgtgcaaacctcgttc

SEQ ID NO: 6257 - DNA, 2415 bp, Artificial Sequence
  Description of Artificial Sequence: Synthetic coding sequence
atgtcttctagtagttggttgctgcttagtctcgttgccgtaactgcagcccagagcaccatagaagagcaggcaaagacttttctcgacaagttcaaccatgaggctgaggatcttttctatcaaagcagcttggcttcctggaactacaacaccaacattacagaagagaatgtgcagaatatgaataacgcaggggacaaatggagtgcgttcctaaaagagcaatcaacactggcacagatgtatcccttgcaagagatccagaatctgactgttaagctccaactgcaggccctgcagcagaacggaagctctgtgctcagtgaggataaaagtaagcgcttaaataccattctcaataccatgtccactatttactctaccgggaaggtctgcaatccagacaaccctcaggagtgcttgcttctcgagccaggcctgaacgagataatggccaactctctggattataatgagcgactgtgggcctgggagtcatggcgcagcgaggtggggaaacaactacgaccgctgtatgaagagtatgtggtcctgaagaatgagatggccagggccaaccactacgaggactatggagattactggcggggcgattacgaggtgaatggggtggacggatacgactactccaggggtcagcttattgaggacgtggaacataccttcgaggaaatcaagccactgtacgagcatcttcacgcctatgtgcgagcgaaactgatgaacgcttacccttcatacatcagtccaattggatgtttgcccgcgcacctccttggcgatatgtggggcaggttttggaccaatctgtattcattgacagtcccattcggacagaaaccgaacattgatgtgactgacgctatggtcgaccaggcctgggacgcccagaggatcttcaaagaggctgaaaagttcttcgtcagcgtgggcctacccaatatgacccagggcttctgggaaaacagtatgctgaccgaccccgggaacgtgcagaaggctgtgtgtcatccgaccgcatgggaccttggtaaaggagatttccgtatactgatgtgtaccaaggtgacgatggacgactttctgacagcgcaccacgaaatgggtcacattcagtacgacatggcttatgcggctcagcccttcctgctcagaaacggagcaaacgaaggcttccacgaggcagttggcgagatcatgagcctttctgctgcgaccccaaagcatctgaagtcaatcggcctgcttagccctgattttcaagaagataacgagaccgagatcaatttcctgctcaagcaggctcttacaattgtcggcacactgcctttcacatatatgttggaaaaatggcggtggatggtcttcaagggcgagataccaaaggatcaatggatgaagaaatggtgggagatgaaacgggagattgtgggagttgtggaaccagtgcctcatgatgagacatactgcgatccagccagcctctttcacgtaagcaatgactattccttcatccgctactatacacggactctctaccagtttcagttccaggaagccctgtgtcaagctgcaaaacacgaaggacccttgcataagtgcgatatctcgaattccaccgaggccggccagaagctgttcaatatgctgcggcttggaaagtccgaaccctggaccctggccttggagaacgtcgtgggcgccaaaaatatgaacgttcgaccccttctgaactactttgagccgcttttcacttggttgaaggatcagaacaagaactccttcgtggggtggtcaacagattggtctccctatgccgaccagagcattaaggtccggatcagtctgaagtccgctctcggcgacaaagcctacgagtggaacgataacgagatgtacttgtttcgaagctctgtggcctacgctatgcgacagtattttctcaaagtcaagaatcagatgattctgtttggtgaggaggatgtgcgtgtggctaacttgaagcccagaattagtttcaattttttcgtgaccgcccccaagaacgtgtctgatatcatccccaggaccgaagtcgaaaaggccattcgcatgagccggtccaggatcaacgacgctttcaggctgaacgacaactccctggagtttctcggtatccagcctacgcttggcccccctaatcagccaccagtgtccatctggctgatcgtgttcggtgtggtcatgggagttatagtggtgggtatcgtgattctgatcttcaccggtattcgcgatcgcaagaagaaaaataaggcacggtctggggagaatccttacgcctctatcgatataagcaaaggcgagaacaatcctgggtttcagaacaccgatgacgtgcagaccagtttc

SEQ ID NO: 6258 - DNA, 2415 bp, Artificial Sequence
  Description of Artificial Sequence: Synthetic coding sequence
atgtctagttcctcctggctcctcctctccctggtggccgtgactgccgcacaaagcaccatcgaagagcaggcaaagacctttctggacaagttcaatcatgaggcggaagatctgttctaccagtcctccctggcctcctggaattacaacacgaatatcacggaggagaacgtgcagaatatgaataatgccggggataagtggtccgcctttctcaaggaacagtccactctggcccaaatgtacccgctccaagaaatccagaatttgaccgtgaagttgcaactgcaagcactccagcagaacggatcatcagtcttgagcgaggacaaatcaaagagactgaataccatcctgaacactatgtccaccatctacagcaccggaaaggtgtgtaacccagacaatccgcaggaatgcctcctgctggaaccgggcctgaacgaaatcatggcaaattcgctcgactacaatgagcggttgtgggcatgggaatcgtggcggtcggaagtgggcaagcaactgcgcccactctacgaagagtacgtggtgcttaagaacgaaatggcacgggcaaatcactacgaggactatggcgactactggagaggagattatgaggtgaacggggtggacggctacgactattctcggggccagctcatcgaggacgtggaacatactttcgaagaaatcaaaccattgtacgagcacctgcacgcgtacgtccgcgcgaagctgatgaacgcctacccttcctacatttcccccattggatgcctgccagcccacttgctgggagatatgtggggacggttctggactaacctctactccctgacggtgccgttcggccagaagccaaacatcgatgtgaccgatgcaatggtggaccaggcatgggatgcacaacgcatcttcaaggaagcagagaaattcttcgtgtcagtgggactccccaacatgacccaaggtttctgggaaaacagcatgctgaccgatccgggcaatgtccaaaaggctgtgtgccatccgaccgcctgggacctgggaaagggcgacttccgcatcctgatgtgcactaaagtgactatggacgacttcctgaccgctcatcacgagatggggcatatccagtacgacatggcatacgcggcacagcctttcctgcttcggaacggtgccaacgaaggcttccatgaggccgtcggggagatcatgtccttgtccgcggcaacccccaagcaccttaagtcgattggactcctgtcgccagacttccaggaggacaatgagactgaaatcaacttcctgctcaagcaggcgcttaccatcgttggaactctgccattcacctatatgctggaaaagtggcggtggatggtgttcaaaggagagattccaaaggatcaatggatgaagaagtggtgggaaatgaagagagagatcgtgggcgtcgtcgaaccagtgccccatgatgagacttactgcgatccggcctcgctttttcacgtgtcgaacgattacagcttcatcagatactacactaggactctgtaccagttccagttccaggaagctctgtgccaagctgccaagcacgagggtccactgcacaaatgcgacatctccaactcgactgaagccggccaaaagttgttcaacatgctcaggctgggaaaatctgagccgtggacccttgccctggagaacgtcgtgggcgcaaagaacatgaacgtccgaccgctgttgaattacttcgaaccgctgttcacttggttgaaggatcagaacaaaaactctttcgtggggtggtcaactgattggagcccgtacgccgatcagtcgatcaaagtgcgcatctcgctcaagtccgcactgggagataaggcatacgaatggaacgataatgagatgtacctctttcgctcgtccgtggcctacgctatgagacaatacttcctcaaagtcaaaaaccaaatgatcctctttggagaagaggacgtgcgcgtggccaacctgaagccgcggatctcatttaacttcttcgtgactgcgccaaagaatgtctcggacatcatcccgagaactgaggtggaaaaggctatcagaatgtcccgctcccggatcaacgacgccttccgcctcaatgataattccctcgagttcctggggatccaaccgactctgggaccgcctaatcagccaccagtctcaatctggctgatcgttttcggggtcgtcatgggtgttatcgtggtgggtattgtgattcttatcttcaccggaattagagacagaaagaagaaaaacaaggcacgctcaggcgaaaacccgtacgcgagcatcgatatctcgaagggagaaaacaacccgggattccagaacactgacgacgtgcagacttcgttc

SEQ ID NO: 6259 - DNA, 2415 bp, Artificial Sequence
  Description of Artificial Sequence: Synthetic coding sequence
atgtcgtccagctcctggctgttgctcagcctcgtagctgtcacagcggcgcagagtaccatcgaggagcaggcaaagacatttctggacaagtttaatcatgaagccgaagacctgttctaccagtcttccttggcttcttggaattacaacacaaatatcaccgaggagaacgtgcaaaacatgaacaacgctggcgataaatggagcgcttttctgaaggaacagagtaccctagctcagatgtatcccctgcaggagattcagaatcttaccgtcaagctgcagttgcaggccctgcaacagaacggttccagcgtgctgtccgaagataaatctaaaagactaaacaccattctgaacactatgagcacaatttattctaccggcaaggtgtgtaacccagacaatccacaggagtgtctcctattggagcccggtttaaacgagatcatggctaacagtctggattacaatgagaggctgtgggcctgggaatcctggagaagcgaagtaggtaaacagttgaggccactctacgaagagtacgtggtactgaagaacgagatggctcgggccaaccactatgaagactatggggactattggagaggtgattacgaggtcaatggggtggacggctacgactactctcgggggcaattgatcgaggacgttgagcataccttcgaagagatcaaacctctgtacgaacatctgcatgcctacgtcagggctaagctgatgaacgcttacccctcgtacatctcccctattgggtgtcttccagcgcaccttcttggcgacatgtggggacgcttctggaccaatctgtatagcttaacagtgcctttcggccaaaaacccaatatagatgtcactgatgcaatggtggatcaggcatgggatgcacagagaattttcaaagaagcagaaaagttttttgtatctgtcggtctgcctaatatgacccagggtttctgggagaattccatgctgaccgaccctgggaatgtgcaaaaagctgtatgtcatcccaccgcttgggatctgggtaaaggggattttaggatactgatgtgcaccaaggtaaccatggacgatttcctaactgcacaccacgagatgggccacatacagtacgatatggcttacgcggcgcaaccatttctgttgagaaacggtgcaaatgaaggtttccacgaggctgtcggagagattatgtccctctctgctgccacgcctaaacacctgaagagtattggacttctctcccccgattttcaggaggataacgagacagagattaatttcttgctcaaacaggccttgactattgtggggacgctgccgttcacttacatgcttgagaagtggaggtggatggtattcaagggggaaattcctaaggatcagtggatgaagaaatggtgggagatgaagagggaaattgtgggcgtggtggaacccgtaccccatgatgagacatactgtgaccctgcaagcctcttccacgtgagcaacgattacagcttcatccgatactacactagaactttataccagttccagttccaggaagctctgtgtcaagccgcaaagcacgagggccccctgcacaagtgcgacatatcaaactccacagaggctggccagaaactttttaacatgctgaggttgggcaaatctgagccctggactttggcgctcgaaaatgtagtcggcgctaaaaacatgaacgttcgacccctgctaaactactttgagcccttattcacttggttgaaggatcaaaataaaaacagttttgtaggctggtcaaccgactggtctccttatgctgaccaaagtattaaagtgcgcatcagtttgaaatccgctctgggcgataaagcgtacgaatggaacgacaatgagatgtacctttttagaagttctgtggcttacgccatgcggcaatactttctaaaggtgaagaatcagatgattctgttcggcgaggaggacgtgcgtgtcgccaacctaaaacctcgaatctcctttaacttctttgtgactgccccaaaaaatgtgtcagacatcatcccgcgcaccgaggtggaaaaagctatacgcatgtccagatccaggattaacgatgcgtttaggcttaacgataattcactggaatttctcggaatccagccaacattgggacctcccaaccagcctccagtgagtatctggctgatagtgtttggagtggtgatgggtgtcattgtggtagggatagtcatcctgattttcactggtatacgcgacaggaagaaaaaaaacaaagctaggtccggtgagaacccctatgcctctatcgacatctcaaaaggcgagaacaatccaggatttcaaaacaccgatgacgtgcaaacttccttt

SEQ ID NO: 6260 - DNA, 2415 bp, Artificial Sequence
  Description of Artificial Sequence: Synthetic coding sequence
atgagtagtagctcctggctcctgctgtctctggttgccgtgaccgcagcccagtccacgatcgaggaacaggccaaaaccttcctcgacaagtttaaccacgaggccgaggaccttttctaccagagcagtctggcctcctggaattataacaccaacataacggaggagaatgtccaaaacatgaacaacgctggcgacaagtggtccgctttcctgaaggaacagagcaccctcgcgcaaatgtaccctttgcaggagatccagaacctaaccgttaagctgcaacttcaggccctccagcagaacggttcgtccgtgttgagcgaggataagtcgaagcgtttgaatacaatcctgaacaccatgagtacaatctactccacgggtaaggtttgtaacccggacaaccctcaggagtgcttgctgcttgagcctgggctcaacgagatcatggccaactccctggactataacgagaggctgtgggcgtgggaaagctggcggtcggaggtgggcaagcagctgcgtcctctatacgaggagtatgttgtgctgaagaacgagatggctcgcgcgaaccactacgaagactatggtgactattggcgcggcgactacgaagtcaacggtgtcgacggatatgactattccagaggacaactaatcgaggatgtcgagcacaccttcgaggagatcaagccactttacgagcatcttcacgcttatgtgcgcgcaaagttgatgaacgcttacccttcctacatttctccgattgggtgtttgcccgctcacctgttgggcgatatgtggggacgcttttggacaaacctctattccctgaccgtccctttcggacaaaagcccaacatcgatgtcaccgatgccatggtcgatcaggcctgggatgcgcagaggatcttcaaggaagctgagaaattctttgtctcagtgggtctccccaacatgactcagggtttctgggagaactctatgctgaccgacccgggcaacgtccagaaggcggtttgccaccctaccgcttgggacttgggaaagggtgattttcgaattttgatgtgtaccaaggtcacgatggatgacttcctgaccgcccaccacgaaatggggcatatccagtatgacatggcctacgctgctcaacctttcctcctgaggaacggcgccaatgagggtttccacgaagccgtcggcgaaatcatgagcctctctgccgccacacccaagcatttgaagtctatcggtctgctgtctcccgattttcaggaggacaacgagaccgaaattaacttcctgctaaagcaggccttgaccattgtcggtacactcccgttcacctacatgctcgaaaagtggcgttggatggtgttcaagggggagattccgaaggaccagtggatgaaaaagtggtgggagatgaagcgcgagatcgtcggcgtcgtggagcccgtcccccatgatgaaacatactgtgatcctgccagtctcttccacgtatctaacgactacagcttcattcggtactacacgagaaccctgtaccagtttcagttccaggaagccctgtgccaggctgctaagcacgagggtccgctccacaagtgcgacatttcaaactccacggaggccggccagaagctgtttaacatgctgcgcctgggtaagtccgagccatggaccttggccctggagaacgttgtcggcgcgaagaacatgaacgtccggccgctgcttaactacttcgaacctttgtttacttggctcaaggatcagaacaagaattcgtttgtgggttggtctacggattggtccccctatgctgatcaaagcataaaagtccgtatctcactgaaatccgcgctgggagataaggcgtacgaatggaacgataacgagatgtatctgttccgtagctcggtggcatacgccatgcgtcagtacttcctgaaggtgaagaaccaaatgattctgtttggtgaggaggacgtgagggtcgcaaacctaaaaccccgtatcagctttaacttcttcgtcaccgcgcccaagaacgtttccgacatcataccacggaccgaggtggagaaagcaatccggatgagccgttcccgtatcaacgatgccttccggctgaacgacaacagcctcgagttcctggggatccagcccaccttaggaccgcccaatcagcccccggtctctatttggcttatcgtcttcggtgttgtcatgggtgtcatcgtggtcggtattgtaatcctgattttcaccggcatccgagaccgtaagaagaagaacaaggcccgctcaggtgagaacccgtacgcctcgattgacatttccaagggagaaaacaatcctggtttccagaacactgacgacgtccaaacttcattc

SEQ ID NO: 6261 - DNA, 2415 bp, Artificial Sequence; identical to SEQ ID NO: 6223
  Description of Artificial Sequence: Synthetic coding sequence

SEQ ID NO: 6262 - DNA, 2415 bp, Artificial Sequence
  Description of Artificial Sequence: Synthetic coding sequence
atgtcatcatcttcctggctgctgctgtcgctcgtcgctgtgactgccgctcagtcgaccatcgaggaacaggccaaaaccttcttggataagttcaaccatgaggcggaagatttgttctaccagagctccttggcaagctggaattacaacactaacattacggaagaaaacgtccaaaacatgaacaatgcgggcgataagtggtctgcgttccttaaagagcaatcgaccctcgcgcagatgtatccactccaggaaatccagaacttgactgtcaaattgcagctgcaggccctccagcagaacggctcgtcagttctgtccgaggacaaatcgaagcgcctcaacacgatcctgaatacgatgtcgaccatctactcgaccgggaaggtctgcaatccagataatccacaagagtgcctcctgcttgaaccggggcttaacgaaatcatggcaaactccctggattacaacgaacggctctgggcttgggagtcatggcgaagcgaagtgggaaaacagctccgccctttgtacgaagaatacgtggtcctcaagaatgaaatggctcgcgcaaatcattacgaggactacggagactactggcgcggcgactacgaagtgaacggagtcgacggctacgattacagcagaggtcagctgatcgaggatgtggaacatacctttgaggagatcaaaccactttacgaacacctgcatgcgtacgtgagagccaagctcatgaacgcgtacccatcatacatctccccgatcgggtgcctccctgcccacctgcttggggacatgtggggacgcttctggaccaatctttacagtcttaccgtgccgttcggtcagaagcctaatatcgacgtgacggacgcgatggtggaccaggcttgggatgcccagaggatcttcaaggaggccgagaaattctttgtgtcggtgggccttccaaatatgacccagggattttgggaaaactcaatgctgactgatccgggcaacgtgcagaaggcggtctgccacccgaccgcttgggaccttgggaaaggtgatttccggatcctgatgtgtactaaggtgactatggacgacttcctgacggctcaccacgagatgggtcacattcagtacgacatggcctacgccgcgcaaccgtttctcctccggaatggggcaaacgagggattccatgaggcggtcggcgagatcatgtccctgagcgccgccaccccgaagcacttgaaatcaatcggactgctgtccccagatttccaagaggacaatgagactgagatcaacttcctgctcaaacaagctcttaccattgtcggtacgctgccgtttacctacatgctggaaaagtggcggtggatggtctttaagggagaaatccccaaagaccaatggatgaagaagtggtgggagatgaagagggaaatcgtgggagtggtcgagccagtgccacacgatgagacgtactgcgatccggcgtcgctctttcacgtgtccaacgattactcgtttattcgctactatacccggactctgtaccaatttcagtttcaggaagctctttgccaagccgcgaagcacgagggacctcttcataagtgtgacatctcgaactccactgaggcaggacaaaaactgtttaacatgctcagactgggaaaatccgagccttggactctggccctggagaatgtggtcggggcgaagaatatgaacgtccggccactcctcaactactttgaaccgctgttcacttggctgaaagatcaaaacaagaactcgttcgtcggctggtctacggactggtcaccatacgctgaccaatcgatcaaggtgcgtatctcgctgaagagcgcgttgggagacaaggcttacgaatggaacgacaacgagatgtacctgttccggtcaagcgtggcatacgcaatgcggcagtacttcctgaaggtcaaaaaccagatgatcctgttcggggaggaggacgtgagggtggcgaacctgaagccgcgcatctcgttcaatttcttcgtgaccgctcccaagaacgtgagcgacattatcccgaggactgaagtcgaaaaagcgatcaggatgtctcggtcacgcatcaatgatgcgttccggctgaacgacaactcgctcgaattccttgggatccagccgaccctgggacctccgaaccagcctccggtgtccatctggttgatcgtctttggcgtggtgatgggagtgatcgtcgtggggatcgtcatcctgattttcaccggtatccgcgaccggaagaaaaagaataaggcgcgcagcggagaaaacccgtacgcctccatcgacatctccaaaggagagaacaatcccgggtttcagaacactgacgatgtgcaaacttccttt

SEQ ID NO: 6263 - DNA, 2415 bp, Artificial Sequence
  Description of Artificial Sequence: Synthetic coding sequence
atgtcctcatcttcatggttgctgctgagcttggtggcagtgaccgcagcccagtccacaatcgaggagcaggcaaagactttcctcgataaatttaaccacgaggcggaggacttattctatcagtcatcactcgcgagctggaactacaacaccaacatcacggaggagaatgtccagaacatgaataatgcaggagataaatggagcgcatttctgaaagagcagtctaccctggcgcagatgtaccctctgcaggagattcagaacctgactgtgaaattacaactgcaggccctgcagcagaacggtagctcagtgctcagcgaggacaaaagcaagcgtctgaatacaattctcaataccatgagcactatctacagtacgggaaaggtgtgcaatccagacaaccctcaggaatgcctgttgttggagcctggactgaatgagattatggcaaatagtctggattacaacgagagactgtgggcttgggaatcctggagatccgaggtgggcaagcagttacgccctctgtatgaagagtacgtcgttctgaagaatgaaatggctagggccaatcattatgaagactacggggactattggcgtggagattatgaagtcaacggcgtggacggttacgattactctagagggcagctaattgaggacgtggaacacacattcgaggagattaagccactctacgagcacctgcacgcttatgtccgggctaaattgatgaatgcctatccaagctatatctccccaattggatgcctccctgctcatctgctcggagacatgtggggacgcttttggactaacctttatagtttaaccgtaccctttggccagaagccaaatattgatgtgacagacgccatggtagaccaggcttgggatgcacaaaggatctttaaggaagccgagaagtttttcgtgagcgtcggactgccaaatatgactcagggcttctgggaaaattctatgttgaccgatccaggaaacgtgcagaaggcagtctgccaccctactgcttgggacctaggaaaaggcgacttccggattttgatgtgcacaaaggttacaatggacgatttccttacagcacatcatgagatggggcatatccaatacgacatggcctatgccgctcagccatttctgctgagaaatggcgcaaacgaagggtttcacgaggccgtgggcgagattatgtctcttagtgcggccactccaaagcacctcaagagtattggactgctttcccccgatttccaggaggacaacgagactgaaatcaattttctactgaaacaggccttgacaattgtcggcacactcccctttacatacatgctggaaaagtggaggtggatggtattcaagggcgaaattcctaaagatcagtggatgaaaaagtggtgggaaatgaagagggagatcgtgggagtagtggagccagtcccccacgatgaaacttactgcgaccccgcaagtctgtttcacgtcagtaatgattactcgtttataagatactatacacggacattgtatcagtttcagtttcaggaggccctatgccaagcagctaagcacgaaggccctctacacaaatgcgacatatctaatagtacagaagccggccagaagcttttcaatatgctgagattagggaagtcagaaccctggacgctcgccctggaaaacgtggtgggggccaaaaacatgaacgtccgcccacttctaaactattttgaaccactgttcacgtggctgaaagatcagaataagaacagtttcgtgggatggagtacggattggtcaccatacgccgatcaatccattaaagtgcgcatctctttaaagtcagccctgggcgacaaagcttatgagtggaacgacaacgaaatgtacctgttccggagctctgtggcttatgcaatgcggcagtacttcctgaaggtgaagaaccaaatgatcctgtttggagaggaggacgtgagagttgctaaccttaaacctaggatttcatttaactttttcgttacagcacctaaaaacgtctcagatatcatccctaggaccgaggtcgagaaagccataaggatgtcccgctcccgcatcaatgatgctttccgactgaatgacaattcgctggagtttctgggaatccagcctactctaggcccccccaaccagccccctgtgtctatctggttaatcgtgtttggggtggtgatgggcgtgattgtcgtggggatcgtgatcctgatctttaccggcatcagggatagaaaaaagaaaaacaaggccaggtcaggcgaaaatccctatgctagtatcgatataagcaagggcgaaaacaatcccggctttcagaatacggacgatgtgcaaactagtttc

SEQ ID NO: 6264 - DNA, 2415 bp, Artificial Sequence
  Description of Artificial Sequence: Synthetic coding sequence
atgagctcgtccagctggttacttctcagcctcgtcgctgtgacagcagcccagtctactatcgaggaacaggctaaaacgttcctggacaaatttaaccacgaagcggaggacttgttctatcagtcctccttagcaagttggaactataacactaacatcactgaagagaacgtccagaatatgaacaacgctggggacaaatggagcgctttcctgaaggaacagtctactctggctcaaatgtaccccctgcaagagattcagaatctcactgtcaagctccagctgcaggccttgcaacagaacggatcaagtgtgttgtctgaggacaaatcgaagcgtctcaatactatcctgaacactatgagcactatttattctacaggcaaagtatgcaatccagataatccacaggaatgtctcctgctagaaccaggccttaacgagatcatggccaatagcctggattataacgagcggctatgggcgtgggaatcgtggcgaagcgaagtcggcaagcagctacggcccctgtacgaggagtacgtcgtcctcaagaatgagatggcccgagccaatcactatgaggattacggtgactattggcgcggtgattatgaggtgaacggcgttgatggttacgattatagccggggtcagctgatcgaagacgtggaacatacattcgaagaaatcaaaccactttatgagcatctccatgcatacgtccgggccaaactgatgaatgcctacccctcttatatatctcccattggctgtctgcccgcacatctactcggcgacatgtggggacgcttttggaccaacctttacagcctgacggtgccctttggtcaaaagcctaatatcgatgtaactgacgcaatggtggaccaggcttgggatgctcagcggatctttaaggaagcagagaagttctttgtgagcgtcgggctacccaatatgacgcaggggttttgggaaaattccatgctgacagaccctggaaatgtgcagaaggccgtttgtcacccgaccgcatgggacctcgggaagggcgacttccgcattcttatgtgcaccaaggtgacaatggatgacttcctgactgcgcatcacgagatgggccacattcaatatgacatggcgtacgctgcccaaccatttctgctccggaatggcgcaaatgagggtttccacgaggctgtcggcgagattatgagtctgtctgcggcgactcccaagcacctaaagtcaatcgggttgcttagtccagactttcaggaggacaacgagacggagatcaactttctactcaaacaggcccttacaatcgtggggaccttgccgttcacatatatgctggaaaaatggcggtggatggtgttcaaaggcgagattcccaaggatcagtggatgaagaagtggtgggagatgaagagagagatcgtgggtgtcgtcgagcccgttccacacgacgagacctactgcgatccggcttccctgtttcacgtgtctaatgattactctttcatccgatactacacgcgcaccctataccagttccagtttcaggaggctctttgtcaggccgcaaaacatgaggggccactgcacaagtgtgacatcagcaattctacggaggcaggacagaagctgtttaacatgctaaggcttggtaagtctgagccctggacactcgctctggaaaacgtggtcggcgctaagaatatgaacgtgcgtcctcttctgaactacttcgagcccctgtttacctggttgaaggaccagaataagaactcatttgttggatggagtactgattggtcgccgtatgctgaccagtcaataaaggtcagaataagtcttaaatcggcgctgggcgacaaagcctacgagtggaatgacaacgagatgtatctctttaggtcatccgttgcgtacgcaatgagacaatactttttaaaagttaagaatcaaatgattttgtttggcgaagaggatgtccgcgtagcgaacctgaaaccgcgcatcagttttaatttttttgttacggcacccaaaaacgtgagtgatattatcccaaggacagaggtggaaaaagcaattaggatgagccgaagcagaatcaacgacgcttttagactaaacgataactctctagagtttcttggaatccagcccactctcgggccacctaatcagcctcccgtgtctatttggctgatcgttttcggtgttgtgatgggcgtgatcgttgtcggtatcgtcatccttatcttcaccggcatccgggatcggaaaaaaaaaaacaaagctcggtcaggcgagaacccatatgcttcaattgatatctcaaaaggcgagaataatccaggctttcagaataccgacgatgttcagactagtttt

SEQ ID NO: 6265 - DNA, 2415 bp, Artificial Sequence
  Description of Artificial Sequence: Synthetic coding sequence
atgtcctcttcctcatggttattgttatcactggttgcagtgaccgcagcacagtcgaccatcgaggaacaagcgaaaactttcttggataaatttaatcatgaggcagaggacctattctatcaatcgtctttagcatcttggaattataatacaaatattacagaagagaatgtgcaaaatatgaacaatgctggggataagtggtcggcatttttaaaagaacaaagtacattggcccaaatgtatccattgcaagagatccaaaaccttactgtcaagcttcagcttcaagccctacagcaaaacggctctagtgtactttcagaagataaatcgaaaagactgaatacgattttaaatactatgtccactatatacagtacggggaaggtgtgtaacccggataatccacaagaatgtctcctactggaaccaggcctaaatgaaattatggcaaactcgctcgattataacgaacgactgtgggcttgggaatcttggcgctctgaagtaggcaagcaattgcgacccttgtatgaagaatatgtagttctaaaaaatgagatggcacgggccaatcattatgaggactacggggattattggcgcggggattacgaagtaaacggtgttgacggatacgactactcccgaggacagctgattgaagatgttgaacatacttttgaagagatcaaaccattgtatgagcacttacatgcctatgtaagagcgaagctgatgaatgcttacccgtcctatatctctccaattggttgtcttcccgcacatctcctcggtgatatgtggggccggttttggactaacctttactctttaacagttccgtttggccaaaagccaaacattgacgttactgatgctatggttgaccaagcgtgggacgcgcaaagaattttcaaagaggctgaaaagttttttgttagtgtgggtcttccaaacatgactcagggattctgggagaactctatgctcactgatccaggaaacgtgcaaaaggctgtttgtcatccgactgcatgggacttgggaaaaggtgattttagaattttgatgtgtactaaagtgaccatggacgacttcttaacagctcaccatgaaatgggccatattcagtatgatatggcatacgcagcgcagccatttcttttgcgaaacggagctaatgaaggatttcatgaagctgttggtgaaattatgtcactctctgcagccacccccaagcatctgaaatctattggacttttgagtccagacttccaagaagataatgaaacagaaattaattttttgctgaagcaagccttgacaatcgttggaacattaccatttacatatatgttagagaagtggcgatggatggttttcaagggagaaataccgaaagatcaatggatgaagaaatggtgggaaatgaaaagagagatcgttggagtcgtcgaaccggttccgcacgacgaaacatactgtgatccagcttctctttttcatgtatcaaacgactactcatttattagatactacacgagaactttgtaccaatttcaattccaagaagccctctgtcaagctgcaaagcatgaggggccgctccataagtgtgatatttcgaactcgactgaagcaggacaaaagcttttcaatatgttgcgccttggaaaatctgaaccatggacactggctctggagaatgttgttggagcaaagaatatgaatgtccggcctttgttaaactacttcgaaccactctttacttggctaaaggatcaaaataagaattcatttgttggatggagtacggattggtctccatatgcggaccaatcaatcaaagtccgaatttctttgaaaagtgctctaggagacaaagcttatgaatggaatgacaatgagatgtacctctttaggtcctcagtcgcatacgctatgagacaatacttccttaaagtcaaaaatcaaatgattctgtttggagaagaagatgtcagagttgctaacctgaaacccaggatttcttttaatttctttgtcaccgctccaaaaaatgtttccgacatcattccacgaactgaggtcgagaaagctatacgcatgagccgtagccgaatcaacgatgcatttagacttaacgataactctttagaattcttgggtattcagccaacactgggaccccctaaccagccaccggtctctatctggttaattgtctttggcgttgttatgggagttattgtggttgggatcgttatactgatttttacaggcattagggacagaaagaagaaaaataaggcccgtagtggcgagaatccgtatgcttcaattgacatctccaagggagaaaataatccgggatttcaaaataccgatgatgttcaaacatccttt

SEQ ID NO: 6266 - DNA, 2415 bp, Artificial Sequence
  Description of Artificial Sequence: Synthetic coding sequence
atgtccagcagctcgtggcttttgctgagccttgtcgctgttacagctgcgcagtccacaatagaagagcaagcaaagacatttctggacaaatttaatcatgaagctgaagatttgttttatcagtcatctcttgcaagttggaactacaacacaaatattactgaagaaaatgttcaaaatatgaataatgcaggtgataagtggagcgcttttcttaaagaacagtctaccttggcacagatgtatccattacaagagattcaaaatcttacagtgaaacttcagttacaggcattgcagcagaatggctcgtccgtacttagcgaagataaaagcaaacgcttaaacacgattctgaatacgatgtctactatctactcaacgggaaaagtttgcaatccagataatcctcaagagtgtctcctccttgaaccgggcctgaatgaaattatggccaatagcctggactacaatgagcgcctctgggcttgggaatcatggcgaagcgaagtcggtaaacaacttcgtcctctgtatgaagagtacgttgtccttaaaaatgaaatggcacgggccaaccattatgaagactacggagattattggcgcggggactacgaagtaaatggtgtagacggatatgactatagcagaggacagttaatcgaagacgtggaacatacctttgaagaaatcaaaccgctctatgaacatttgcatgcttacgtgcgggcgaagctcatgaatgcatatccgtcatacatatctccgatcggatgccttccagcacatcttttgggggatatgtggggacggttttggacaaacttatattcattaactgtaccgtttggacaaaaaccgaacatagatgtaacggatgcgatggttgatcaagcatgggatgcacaacggatctttaaagaagcggagaagttttttgtaagtgttggacttcctaacatgactcagggattttgggagaattcaatgttgacagatcccggtaacgtacaaaaagcggtttgccatccgacagcgtgggatttaggcaaaggggattttcgtatcctcatgtgtacgaaagtaaccatggatgattttctgacggctcatcatgaaatgggacacatccagtatgatatggcctacgcggcgcagccgtttctgctgcgcaatggagccaatgaaggctttcatgaagcggttggagagataatgagcctttctgccgccactccaaaacatctcaaatcaattgggcttttaagccccgattttcaggaagataatgaaactgagattaattttcttcttaaacaagcattaacgatcgtaggcacactcccttttacatatatgcttgaaaagtggagatggatggtatttaaaggagagattccgaaggatcagtggatgaaaaaatggtgggaaatgaaaagagaaatcgttggtgtcgtggaaccggtacctcatgacgaaacatactgcgatccggcaagtctctttcatgtgtccaacgactattcgttcatccggtattatacacgcacgctgtaccaatttcaatttcaagaagctttatgccaggcagccaaacatgaaggaccgttacataagtgtgacatctctaacagcacagaagctggacaaaaactttttaatatgttgcgccttggcaaatcggaaccatggacgctggctctcgaaaacgtagtcggtgcgaaaaacatgaacgtgcgcccgctacttaattactttgaaccacttttcacttggctgaaagatcaaaataagaactcatttgtgggctggtccacagactggagcccgtacgcagaccagagtataaaagttcgaatctcccttaagagcgctctcggtgataaggcttacgagtggaacgataacgaaatgtacctctttagatcctctgtagcctatgcaatgcggcaatactttttaaaggtcaaaaaccaaatgatactctttggagaagaggatgtgcgtgtcgcaaaccttaaaccgcgtatatcatttaatttttttgtaacggccccgaaaaatgtgtccgatatcattccacgtacagaggttgagaaagccatccgcatgagtcgctcacgtattaatgacgcctttcgtttgaacgataatagcctagagtttctgggaattcagcctactttgggcccgcctaaccagccgcccgtttccatttggctaattgtcttcggggtggtcatgggcgtgatcgttgttgggatcgttatcctaatctttacggggatccgggatcgcaaaaaaaagaataaggcaaggtcgggagagaacccttacgcgtcaatcgatatctcaaaaggtgagaacaatccgggcttccaaaatacagatgacgtgcaaacgtcattt

SEQ ID NO: 6267 - DNA, 2415 bp, Artificial Sequence
  Description of Artificial Sequence: Synthetic coding sequence
atgtcctcttcttcctggctgctgctgagtctcgtcgctgtgaccgcggctcagagcacaatcgaagagcaggccaagacttttctggacaagttcaatcacgaggccgaggacctgttctatcaatcctcactcgcctcctggaactataataccaatattacggaggagaatgtacaaaatatgaataatgcgggggataagtggtccgctttcctaaaggaacagtcgaccctggcccagatgtatcccctgcaggagattcagaacctcaccgtaaaactgcagttgcaagcgctgcagcagaatggtagctccgttctgtctgaggacaagtccaaacgcctaaatacaattctcaacaccatgtccacgatctactcaaccggaaaggtctgcaaccccgataaccctcaggagtgtctgctgctcgagcccgggctgaatgagatcatggcgaattctttggattataacgaacgtctctgggcctgggagtcttggcgcagtgaggtcggaaagcaactaaggcctttatacgaagagtacgtcgttttaaagaacgaaatggcaagggctaatcattacgaagactacggggattattggagaggagattatgaggtaaacggcgtagacggatatgattactctcggggccagctcatcgaagacgtcgagcacacctttgaggaaatcaaaccactatacgagcacctccatgcatacgtccgcgctaaattgatgaatgcatacccttcttacatcagtcctataggatgtctcccagcgcaccttctgggagatatgtgggggcgcttctggactaacttgtactcgcttaccgttcccttcggacaaaaacccaacatcgacgttacggacgctatggtcgaccaggcctgggacgctcaacggatctttaaggaggccgagaagttttttgtgtctgtgggtctaccaaatatgacgcaaggattctgggaaaattcaatgctgactgatccaggtaatgtccaaaaggccgtgtgtcatcctactgcctgggacctaggaaagggtgacttccgtattctgatgtgcacgaaggtgacaatggatgacttcctcactgctcatcacgagatgggtcatattcagtatgatatggcttatgccgctcaaccatttttacttcgcaatggagccaatgagggttttcatgaagccgtcggcgaaataatgtcactaagtgccgccactcccaaacacctaaagtccattggtctgctatcccctgattttcaggaggataatgagacagagatcaactttttgctaaagcaagccctgacgatagtcgggacattgccctttacctacatgctggagaagtggcgctggatggtgttcaaaggtgaaatcccaaaagatcagtggatgaagaagtggtgggagatgaagagagagatcgtgggagtggtggaaccagtcccgcacgatgagacgtattgcgaccccgccagtctcttccacgtgtccaacgattactccttcattagatattataccagaacactgtaccagtttcagtttcaggaggcactctgccaggccgcaaagcacgaaggtcccctgcataaatgcgatattagcaactccactgaagcaggacaaaagcttttcaacatgctaagattgggcaagtctgaaccgtggacactggccctggagaacgtagtcggagcaaagaatatgaacgttcggccactgctgaactattttgaacccctgttcacatggctcaaggatcagaataagaactccttcgtaggttggtctacggactggtccccctatgctgaccaatccataaaagtgagaatcagccttaagagcgcgctgggcgacaaagcatacgagtggaatgacaacgagatgtaccttttcagatcatccgtggcatacgcgatgcgccagtatttcctgaaagttaagaatcaaatgatactgttcggggaggaagatgtgcgagtagcgaatttgaagccacgcatcagcttcaatttcttcgtgacagccccaaagaacgtgagtgacattatcccgagaactgaagttgaaaaggccatcagaatgtcaaggagcaggattaacgacgccttccgcctaaatgataactccctggagtttctcgggattcaacccactctgggacccccaaatcagcccccagtttccatctggcttatcgtcttcggggttgtgatgggggtgatagttgttgggatagtaatactgatctttacaggtattagagaccgcaaaaagaagaataaagccaggtcgggtgagaatccttatgcatctattgacatctccaagggagagaataacccgggcttccagaacaccgacgacgtccagacttcgttc

SEQ ID NO: 6268 - DNA, 2415 bp, Artificial Sequence
  Description of Artificial Sequence: Synthetic coding sequence
atgtcttcttcctcgtggctgctcctgtcacttgtggcagtgacagcggcgcagagcactatcgaggaacaggctaagacctttctcgacaaattcaaccatgaggccgaggatctgttctatcagagcagcctagcgtcctggaattacaacacaaacatcacggaggagaacgtgcagaacatgaacaacgctggcgataagtggtccgcttttctgaaggagcagtctaccctcgcccagatgtaccctctgcaagagatccagaacctgacagttaaactccaactgcaggcccttcaacagaacggatcatctgtgttgagtgaggacaaaagtaagaggctcaatacgatcctcaacaccatgtcgactatctattctaccggcaaggtgtgtaaccctgacaatcctcaggagtgtctgttgcttgagcccggacttaatgagatcatggcaaacagtctggactacaatgaacggctctgggcctgggagtcatggagaagtgaggtgggcaagcagctgagaccgctgtacgaagagtacgtggtcctcaagaatgagatggctcgagcaaaccactacgaggactacggggactattggcggggggactacgaggtgaatggagtcgatggctatgactattctagaggacagctgattgaagatgtcgaacacacgtttgaggagattaaacccttgtacgaacacctgcatgcttacgtgcgcgcgaaactgatgaacgcataccctagctatattagcccgatcgggtgcctacctgcacatttactcggcgatatgtgggggcgattttggaccaacttgtattctctgacagttcccttcggacaaaagccaaatatcgacgtcacagacgcaatggttgaccaggcttgggacgcccagcgcattttcaaggaagccgagaagttttttgtaagcgtgggcctgcccaacatgacccaggggttctgggaaaattcaatgttgaccgaccccgggaatgtgcagaaggccgtctgccaccctactgcatgggatctgggtaagggggatttccggattctgatgtgcactaaagtgactatggacgacttcctgaccgcccatcacgagatggggcatatccaatacgatatggcgtatgcagctcaaccgtttttactgcgaaacggcgctaatgagggcttccatgaggctgtgggcgagattatgagtcttagtgctgctaccccgaagcacctgaagagcatcggcttgctcagtcccgactttcaggaagataatgagaccgaaatcaacttccttctgaagcaggccctcactatagtggggacgctccctttcacttacatgctggagaaatggcgttggatggtcttcaagggcgagatacctaaagatcagtggatgaagaaatggtgggaaatgaagagagagatcgtgggggtggtagaacctgttccacacgatgaaacatattgcgatccagccagcctttttcatgtatccaacgattacagcttcatcagatactacacgagaacgctgtaccagtttcagtttcaagaggccttatgtcaggcagctaagcatgagggacctttacacaaatgtgatatatcaaacagcactgaagcaggacagaagctgttcaatatgctgcgcctcgggaagtctgagccatggacgctggcccttgagaatgtcgtgggggccaaaaatatgaacgttaggccactactgaactatttcgaaccactcttcacgtggttgaaagatcagaataaaaactcatttgtgggctggtccactgattggtctccttacgcagatcagtccattaaggtccggattagtttaaagagtgctctgggtgataaggcttatgagtggaacgacaacgaaatgtacctattccggtcctcagtggcctatgctatgcgccagtacttcttgaaggtgaagaatcagatgattctttttggggaggaggatgtccgcgtggccaacttaaagccccggatcagcttcaatttctttgtgacagctccgaagaatgtgtccgacattattccacgcactgaagtggagaaggccattcgaatgagtagaagcaggatcaacgacgcattccgcctgaatgataattccctggagtttttgggcattcagcctaccctcgggccacccaatcagccacccgtctctatctggctcatcgtgtttggcgtggtcatgggagttatcgttgtgggcatcgtaatcctcatcttcaccgggatcagggaccggaagaaaaaaaataaggcccgttcaggcgagaatccatacgcgtccatcgatatttctaagggcgaaaacaatccagggtttcagaacacagacgatgtgcagaccagtttc

SEQ ID NO: 6269 - DNA, 2415 bp, Artificial Sequence
  Description of Artificial Sequence: Synthetic coding sequence
atgtcaagcagttcttggctgctgctctcccttgttgcggtgacggccgctcagagcactattgaagagcaggccaaaacgtttctcgataagtttaaccatgaagcggaagatcttttttaccagtcatccctggcatcttggaattataataccaacatcaccgaagaaaatgtccagaacatgaacaacgctggggataaatggtccgccttccttaaggaacagagcacgcttgcgcagatgtacccactccaggagatccaaaacctgactgtgaaactgcagctccaagctcttcaacagaacggaagcagcgttctgtctgaggataagtccaaacggctgaatacaattctaaacactatgtccacgatctactcaacaggaaaggtttgtaatcctgacaacccacaagagtgcttgctactggagccaggccttaatgaaatcatggccaactcattagactacaatgagcgcctgtgggcctgggagtcatggcgctctgaggtcggaaagcagctccgcccactatatgaggagtacgtggtgctgaagaacgaaatggccagggcaaaccactatgaggactatggagactactggaggggagattacgaggtgaacggcgtggacggctacgactattcgagaggacaactcattgaggatgtggagcacacatttgaggagattaaaccactatacgagcatcttcacgcctatgtgcgggcaaagctaatgaacgcctacccaagctacatttcccccatcggttgtctccctgcccacctcctgggtgacatgtggggacgattttggacaaacctatatagcctgacggtgccgttcgggcagaaacctaatatcgatgtaacagacgcaatggtggaccaggcatgggacgcacagaggatcttcaaggaagccgagaaatttttcgtttcagtgggcctgccgaatatgacacagggattctgggagaactctatgctcacagatccagggaacgtacaaaaagcggtctgccaccccaccgcctgggacctggggaagggagactttaggattcttatgtgcactaaggtgaccatggacgacttcctgaccgctcaccacgagatgggacacattcagtatgatatggcctacgccgcgcagccatttctgctgcggaatggggcgaatgagggcttccacgaggccgtgggggagatcatgtccctcagcgccgcaacaccaaagcacctgaagtccataggactgctctcgccagacttccaggaagataatgaaactgagataaactttttgttgaagcaggctctgacgatcgtcggaaccttaccatttacctatatgctggagaaatggaggtggatggtgttcaagggcgagattccgaaggatcagtggatgaaaaaatggtgggagatgaaacgggagatcgtcggggtggtggagcctgtgccacatgatgaaacctactgtgatccagcgagcctgttccacgtgtcaaacgattatagcttcattagatattacactcgaaccctgtaccagttccaatttcaggaagccctgtgtcaagctgccaagcatgagggccctttacataagtgtgacatttccaatagtacagaggccggacagaaactgtttaatatgctccggctagggaaatccgagccctggaccctggctctagaaaacgtagttggcgccaagaacatgaacgtgaggccactgctgaattatttcgagcccctgtttacttggctgaaagaccagaacaaaaactcatttgtcggatggagtacagactggtccccgtacgctgatcaaagcatcaaggttcggatctcgctgaaatcggcccttggggataaggcctatgaatggaatgataacgagatgtatttgtttcggtcatctgtggcttatgcaatgagacagtacttcctgaaagtcaagaatcagatgatcttgtttggagaagaagatgttagagttgcaaatctgaaacccagaatctcttttaattttttcgttacagcaccaaagaatgtgagcgatatcatccccagaacagaagtcgagaaagccataaggatgagccgctcccgcattaatgacgcctttagactcaacgataactcgctagaatttctcggcatccagcctactttgggtccacccaaccagccaccagtgagcatctggctgattgtgtttggagtggtgatgggagttattgtcgtgggtatagtgatcctgatctttaccggcatccgagacaggaagaagaagaacaaggccaggtctggggagaacccttatgctagcatagatatttccaagggggaaaacaacccaggtttccagaacaccgacgacgttcaaacatctttc

SEQ ID NO: 6270 - DNA, 2415 bp, Artificial Sequence
  Description of Artificial Sequence: Synthetic coding sequence
atgagcagctcaagctggctgcttctgagccttgtggcagtgaccgcagcgcaatcgaccatagaggaacaagctaaaacctttctggataagtttaaccatgaagctgaagatctcttctaccaatcgtctctggcaagctggaactacaataccaacataaccgaagagaacgtgcagaatatgaataacgctggcgataagtggagcgcatttcttaaggaacaatcaactcttgcccagatgtacccactccaggagatccaaaacctcaccgtgaagttgcaattgcaggcactgcagcaaaacggatcatcggtgctttcggaagataagtccaagagacttaataccattctcaacactatgtcgactatttactccactggtaaggtgtgtaacccggacaatcctcaggaatgtctgcttcttgagcccgggctgaacgagattatggcaaactctttggattacaacgaacgactgtgggcatgggagtcgtggcgctccgaggtggggaagcaacttcgtccgctctatgaggagtacgtggtcctgaagaacgaaatggcacgggcaaaccactacgaagattacggagattattggagaggggattacgaagtgaatggagttgacggatacgactacagccgtggacaattgatcgaagatgttgaacacacctttgaagaaatcaagcctctctacgagcaccttcatgcttatgtgcgcgccaaacttatgaacgcatacccgtcgtacatcagccctattggttgtctgcctgcacacctgcttggagatatgtggggcaggttttggactaacctgtactcccttacggtgccatttggacaaaaaccgaatattgatgttaccgacgcaatggtcgatcaggcgtgggacgcccaaagaatattcaaggaggcagagaagtttttcgtgagcgtcggactccccaatatgactcagggcttttgggaaaacagcatgcttacggacccaggcaatgtgcaaaaggcagtgtgccacccaactgcatgggatcttggaaagggagacttcaggattctgatgtgcaccaaggtgaccatggatgacttcttgacggcacatcacgaaatgggccatatacagtacgatatggcttacgccgcgcagccttttctgctccgcaacggtgcaaacgaaggttttcatgaagccgtcggagagattatgtcactttcagccgccacccctaagcacctcaagtcgattggactgctttcgccggattttcaggaggataacgaaaccgagattaactttcttttgaagcaagcccttactattgtgggaaccttgccatttacctacatgctggaaaagtggaggtggatggtgttcaagggtgaaattcccaaggatcaatggatgaaaaagtggtgggagatgaagcgcgaaatagtgggagtggtcgaacctgtgcctcatgatgaaacctactgtgacccagcgtcacttttccatgtgtcaaacgattactcgtttattcggtactacactagaactctgtaccagtttcaatttcaagaggccctgtgccaggctgcgaagcatgaaggaccccttcataagtgtgacatctcgaattccactgaagcaggacagaaacttttcaatatgcttagacttgggaagagcgagccgtggactctggcactggaaaatgtggtgggtgcaaaaaacatgaacgtacgaccactgcttaactactttgagccgctttttacttggcttaaagatcaaaacaaaaactcgtttgtgggttggagcaccgattggtccccatacgcagaccagtccattaaagtcaggatatcacttaaatcagcacttggggataaggcgtacgaatggaacgacaatgaaatgtatctgtttagaagctcagtggcatacgcaatgcggcagtacttcctgaaagtgaagaatcagatgatcttgtttggggaggaagatgtcagagttgcaaacctgaagcctaggatttcatttaacttttttgtcaccgcgccgaaaaacgtgtcggatatcatacccagaacggaagtggaaaaggctatccgcatgtcgcgcagtcggatcaacgacgcctttagattgaatgataactcgcttgagttccttgggattcaaccaacccttggtccccctaaccaaccacctgtgtccatttggcttattgtctttggggtggtgatgggggtgattgtggtgggtattgtgatcctgatcttcactgggatccgggatcgcaagaaaaagaacaaggcgaggtcaggagagaatccttatgcaagcatcgatatcagcaaaggcgagaacaatccgggttttcaaaatactgatgatgtccagactagcttt

SEQ ID NO: 6271 - DNA, 2415 bp, Artificial Sequence
  Description of Artificial Sequence: Synthetic coding sequence
atgtctagtagctcctggttgctgttgagtctcgtggctgtgaccgccgcccagtctactatcgaggagcaagctaaaacttttttggataagttcaaccatgaggccgaggatctgttttatcagagctctttagcgtcctggaactataacactaacatcactgaggaaaacgttcagaatatgaacaatgcaggggataagtggtccgctttcttaaaggaacaaagcactttagctcagatgtacccgttacaggagatacagaaccttaccgttaagctccagctccaggccctacaacagaatggctcttccgtcctgtcagaagacaaaagcaagaggcttaataccattctgaacactatgagtaccatatattccacaggcaaggtctgcaaccctgataacccccaggaatgtctgctcttggagcctggactgaatgagataatggctaattcccttgactacaacgagaggctgtgggcatgggagagctggcgatccgaagttgggaaacagctgaggcccctgtatgaggagtacgtcgtgctgaagaatgagatggcacgagccaaccactatgaggattacggggactactggagaggggactatgaagtcaacggagtggacgggtacgattattcccgagggcaactgattgaagatgtggagcatacctttgaagagatcaagccactttacgagcacttgcatgcatacgtgcgcgccaaattgatgaacgcctacccttcctacatctcacccatcgggtgcctgcccgcccacctactgggagacatgtggggcagattttggactaacctgtactctctcacggtcccatttggtcaaaagcctaacatcgatgtgactgacgccatggtggaccaggcctgggacgcacaaagaatctttaaagaggccgagaaattcttcgtgagcgttggtttaccaaacatgacccagggattttgggagaatagcatgctcacagacccaggtaacgtccagaaggccgtgtgtcatccgaccgcatgggacctaggaaagggagactttaggatactgatgtgtaccaaggttactatggacgacttcctcacagcacatcacgagatgggacatatccagtatgacatggcgtatgccgcgcagccgtttctcctccggaacggggctaacgaggggttccatgaagccgtaggcgaaatcatgagcctgtctgccgccacacctaagcaccttaagtctataggcctcttgtcgccggacttccaggaggacaacgaaacagaaatcaactttctgctgaagcaggcgctaaccattgttggaactctgccctttacatatatgctagagaagtggcgatggatggtgttcaagggagagattcccaaagaccagtggatgaagaagtggtgggagatgaagcgcgagatcgtgggggtcgtcgagcccgtgccacacgacgaaacgtactgtgacccagcctcactctttcacgtcagcaatgattactcattcatccggtactatacccgcacgctctaccaattccagttccaggaagcgctctgccaagccgctaagcacgagggaccactccataagtgcgacatatctaattcgactgaggcaggacagaagttgtttaacatgctgaggctgggaaaaagcgagccatggacgcttgctttggagaacgttgtgggcgctaagaacatgaacgtgcgccccctgttaaactacttcgaacccctgttcacgtggttgaaggaccagaataagaattcctttgtcggatggtctaccgactggtctccatacgccgaccagtccatcaaagtccgaatctcccttaaaagcgcactgggggataaggcctatgaatggaacgacaatgagatgtacctgttcaggtccagcgtggcttacgccatgagacaatactttttgaaggtgaaaaaccagatgatcctgtttggcgaggaagatgttcgagtggctaatttaaagccccgaataagtttcaatttctttgtcacggcaccaaaaaatgtgtcagacattatccccaggacagaggtcgaaaaggctatccggatgagtcggagccggatcaatgatgctttcagactgaatgacaacagcctagaattcctgggaattcagccaacgctgggcccacccaaccaacctccggttagcatttggcttatagtattcggggtggtcatgggcgtgatcgttgtaggtattgtgatcctgatcttcaccggcatacgggacagaaagaagaaaaacaaggcacggtctggagagaatccttacgccagtatagacatctctaagggagaaaacaatcctgggtttcagaatacagatgacgttcagacaagcttc

SEQ ID NO: 6272 - DNA, 2415 bp, Artificial Sequence
  Description of Artificial Sequence: Synthetic coding sequence
atgagcagcagcagctggctgctgctctccctggttgctgtgaccgctgcacagagcactatcgaagaacaggccaagacttttttagataagtttaaccatgaggccgaagatctgttttaccagtccagcctggcgtcctggaactacaataccaacatcacagaagagaacgtgcaaaatatgaacaacgcaggagataaatggagcgctttcttaaaggagcagtccacactggctcagatgtacccgcttcaggaaattcaaaaccttacggttaagttgcaactgcaggcactgcagcagaacggctcctcagtattgagtgaggacaaatcaaaaaggcttaacacaatcctcaatacaatgagcaccatctactcaactggaaaagtgtgtaatcctgataacccacaggagtgcctgctgctggaaccaggtcttaatgaaatcatggccaactctctcgactataatgagaggctgtgggcctgggagtcctggaggagtgaggtcggtaagcagctcagaccactgtacgaggaatatgttgttttaaaaaacgaaatggctagagcaaaccactacgaggattatggagattactggcgaggggactacgaggtcaacggagtcgatgggtacgactattcacgcggacaactcattgaggatgtggagcatacttttgaagagatcaaacctctgtacgaacacttgcacgcatacgttagggcaaaactcatgaacgcttatcctagctacatcagtccgattggttgtttacccgcgcatctgctgggtgatatgtggggcaggttttggaccaatttgtacagcctcactgtgcccttcggccaaaaaccaaatatagatgtcaccgatgccatggtggatcaggcatgggacgctcagcgaatctttaaggaagcagagaaatttttcgtgtccgtaggcctgcctaacatgacacagggtttttgggaaaatagcatgctgactgatcccggcaatgtgcaaaaagctgtgtgccaccccactgcatgggaccttgggaaaggcgattttcgcattttaatgtgcactaaagttacaatggatgatttcctgaccgcccatcacgaaatgggacatatccaatacgatatggcctatgctgcgcaaccatttctgctgcggaatggcgcaaacgaggggttccacgaggctgtcggcgagataatgagtctgagtgcagcaactcctaaacacctgaaaagcattgggctcctctcaccggattttcaagaggataatgagaccgaaataaacttcctcctgaagcaagctctcacaattgtggggaccctaccctttacctacatgctggaaaagtggaggtggatggtgtttaaaggcgagatccctaaagatcaatggatgaagaagtggtgggaaatgaagcgcgaaatcgttggggtggtcgaacccgttccacacgacgaaacctactgcgatcccgcgtcactgttccatgtgagtaatgattacagctttatcagatactacacccggaccctttatcaattccagtttcaagaggccctttgccaggccgctaagcacgaaggccctttgcacaaatgtgatatcagcaacagtactgaggctggtcagaagttgttcaacatgctgaggctggggaagagtgaaccctggacccttgctctggaaaacgtggtgggagcaaagaacatgaatgtccgcccgctccttaactatttcgaacccctgtttacttggcttaaagatcagaataaaaactcatttgtcggctggtccaccgattggagcccatacgctgatcaatctatcaaagtgagaatttccctgaagtctgccctcggagacaaggcttacgaatggaacgataacgaaatgtatctgtttcgttctagcgtggcatacgcaatgagacagtactttctgaaggtgaagaatcaaatgatcttgttcggtgaggaagatgtaagagttgccaatttgaagcccagaatttcgtttaactttttcgtgaccgcccctaaaaacgtgagcgatatcattccaagaacagaggtagaaaaggctatacgcatgagtagatccagaattaacgacgcgttccgcctcaacgataacagtctggagtttcttggaatccagcctacactggggccccccaaccagcctcccgtgagcatctggctcatcgtctttggcgtggtgatgggcgtgatcgtggtggggattgtcatcctcatcttcacaggaataagagataggaagaaaaagaataaggccaggtccggggaaaacccgtacgcaagcattgacatcagtaagggggagaataacccaggctttcaaaacacagatgacgtgcaaactagcttt

SEQ ID NO: 6273 - DNA, 2415 bp, Artificial Sequence
  Description of Artificial Sequence: Synthetic coding sequence
atgtcctcgagctcctggttgcttctgtcgctggtcgcagtgactgcagcccaaagtactatcgaagaacaagccaagacctttctcgacaagttcaaccatgaggcagaggatctcttctaccaatcgtccctggcttcgtggaactacaacactaacattactgaggagaatgtgcagaacatgaataacgcgggagacaagtggtcagcgttcctgaaagaacaatccactctcgcacagatgtaccccctgcaagaaattcaaaaccttaccgtgaaactgcaactgcaggctctgcagcaaaacggatcgtccgtgctgtctgaagataaatccaagcgacttaacaccattctcaacactatgtcgaccatatactcgactggtaaggtgtgtaacccagataaccctcaagaatgtctcctgcttgagcccggcttgaatgagataatggcaaactcattggattacaacgagagactgtgggcgtgggagtcatggcggtcggaagtcggaaagcagctcagaccactgtacgaggaatacgtggtgcttaagaacgagatggcacgggcgaaccattacgaagattatggagattactggcgcggcgactacgaagtgaacggcgtcgacgggtacgactactcccgcggtcagcttatcgaggacgtggaacacacttttgaagagataaaacccctctacgaacatttgcatgcatacgtccgtgcaaaacttatgaacgcctacccaagctacatttcgcctattggatgtctcccagcacatctcttgggagatatgtggggacgcttttggaccaacctttactcgctcacggttccatttggccagaagccgaacatcgatgtgactgatgcaatggtcgatcaggcatgggatgcacaacgaattttcaaggaggccgagaagttttttgtgtcagtgggtctgcctaacatgacccaagggttttgggaaaactcaatgctgaccgatcccggaaacgtgcaaaaggcagtgtgtcatccaactgcatgggatctgggtaaaggtgattttagaatcctgatgtgtactaaggtcactatggatgattttcttacggcacaccacgagatgggccatatccagtacgatatggcctacgccgcacaaccttttctgcttagaaatggtgcaaacgagggctttcatgaggcagtgggagaaatcatgtccctctcggcagcgacgcctaaacatcttaaaagcattgggctcctttcccccgattttcaagaggataacgaaactgaaatcaacttcctccttaagcaggcactcactattgtgggaaccctgcctttcacttacatgctggaaaaatggcgctggatggtgttcaagggagagattccaaaggatcaatggatgaagaagtggtgggagatgaagcgagaaattgtcggagtggtggaaccggtgcctcatgatgaaacctactgcgatcctgcatccctttttcatgtatcaaacgattattcattcattaggtactacactcgcactctgtatcagttccaattccaagaggccctttgtcaagccgcaaaacatgagggacctcttcacaagtgcgacattagcaacagcaccgaggcaggtcagaagttgttcaacatgctccgtctgggaaagtcagagccgtggactcttgctctcgaaaatgtcgtcggagcgaagaacatgaacgtgaggcctctgcttaactattttgagccgcttttcacgtggttgaaggatcagaacaagaactcgtttgtggggtggtcgacggactggtccccctacgcggatcagtcaattaaggtgcggatatccctgaagtccgcactgggtgacaaggcatacgaatggaacgataatgagatgtaccttttccgctcgagcgtcgcgtacgcaatgcggcagtactttctgaaggtcaaaaatcaaatgattctgttcggtgaagaagatgttcgcgtggcgaacttgaagcctcggatatccttcaatttctttgttactgctccaaagaatgtgagcgacattattcctagaaccgaggtggagaaggcaattcggatgtcccggagccgtataaacgatgcattccgcctgaacgacaacagccttgagttccttggtattcaacctactctgggcccgcccaaccaaccacctgtctctatttggctgatcgtctttggcgtcgtgatgggagttattgtcgtcggaattgtcatactgatctttaccgggatcagagacagaaagaagaagaataaggccaggtccggagaaaatccttatgcttccatcgatatttccaagggggaaaacaatcctggattccaaaacactgacgacgtccagacttcattt

SEQ ID NO: 6274 - DNA, 2415 bp, Artificial Sequence
  Description of Artificial Sequence: Synthetic coding sequence
atgtcctcgtcctcctggctgcttcttagcctggttgcggtgactgcagcccaaagcaccatcgaagaacaggcaaagacttttctcgacaaattcaaccatgaggcagaagatctcttttaccagagctctcttgcttcatggaactacaacaccaatatcacggaggaaaacgtgcaaaacatgaataacgcaggcgacaagtggtctgcatttttgaaggagcaatcaactcttgcgcaaatgtacccactgcaggagatacagaatttgactgtgaagctgcaactgcaagcactccaacagaacggatcctcggtcctgtcggaagataaatcgaagcgccttaacacgattcttaacactatgagcaccatttactcaactggtaaggtgtgtaatcctgacaacccacaggaatgcctcctccttgaacccggactcaacgaaatcatggcaaacagccttgattacaacgaacgactctgggcatgggagtcgtggcgctccgaggtcggaaagcagctgcggcccctctacgaagaatacgtcgtgcttaagaacgaaatggcacgtgcaaaccactacgaagattacggagattactggagaggtgactacgaagtgaatggagtggatggttacgactactcgcgaggtcaactgatcgaggacgtcgaacacactttcgaggagataaagcctctctacgaacacctccatgcctacgtccgggcaaaacttatgaacgcgtatcctagctacatctcccctataggttgtctgccagcgcatcttctgggagatatgtggggacgcttctggacgaacctgtactcgcttactgtgccgtttggccagaaaccaaacatcgacgtgactgatgccatggtcgatcaggcctgggatgcacagcgtattttcaaggaagctgagaagttttttgtctcggtggggctgccaaacatgactcaaggtttctgggagaacagcatgctgacggaccctggcaatgtgcagaaggcggtatgtcaccctaccgcgtgggatctgggaaaaggtgactttagaatcctgatgtgtaccaaggtgaccatggacgatttccttaccgcacaccatgagatgggccacattcagtacgatatggcatacgccgcacagcccttcctgctgaggaacggtgcgaacgagggttttcatgaggccgtgggggagattatgtcgctttccgccgcaacgccaaaacatctgaagtcgattggacttctgtcgccagattttcaggaggataatgaaaccgagattaactttctccttaagcaagcactgaccattgtgggcactcttccattcacgtacatgctggaaaagtggagatggatggtgtttaaaggtgagatacctaaagatcagtggatgaagaagtggtgggaaatgaagagagaaatcgtcggagtcgtggaaccagtgcctcatgatgaaacgtactgtgatcccgcgagtctctttcatgtgagcaacgattactcattcataagatactacaccaggactctgtaccagttccagtttcaagaagcactgtgtcaagcagcgaagcacgaaggacccctccataagtgcgatataagcaactctaccgaagcaggacagaagctgtttaacatgctgcgactgggcaaaagcgaaccttggactctcgcacttgaaaacgtggtgggagcaaagaacatgaatgtgcgccccctgctgaactacttcgagcctctgttcacctggctgaaggatcaaaacaagaactcgtttgtgggctggtccactgattggtccccgtatgcagatcaatcgatcaaggtgcggatttccctgaaatcagccctgggtgataaggcttacgagtggaacgataatgaaatgtacctgttcagatcatctgtggcctacgctatgagacaatacttccttaaagtcaagaatcagatgattcttttcggtgaggaggacgtgagagtcgcaaacctgaagccacggatttcgtttaacttttttgtcaccgcacccaagaacgtcagcgatatcattccgcgcaccgaggtcgaaaaggcaatccgtatgtcaagaagcagaataaacgacgcctttcggctgaacgacaactctcttgaatttctgggtattcagcctaccctcggacccccgaatcaaccgcctgtgtcgatctggcttattgtgtttggagtcgtgatgggggttattgtcgtcggaattgtgatcctgatctttactggtatccgggatcgtaaaaagaagaataaagcccgcagcggtgagaacccttacgccagcattgatatctcgaaaggcgaaaacaatcctggtttccaaaacaccgatgatgtgcagacttcgttc

SEQ ID NO: 6275 - DNA, 2415 bp, Artificial Sequence
  Description of Artificial Sequence: Synthetic coding sequence
atgtctagttcaagctggctgctcctgtccctggtggcagtgaccgccgcccaatcgactatcgaagagcaggctaaaactttcctggataagttcaatcatgaggcagaagatctgttctaccaatccagcctggccagctggaattacaatacgaacatcacggaagaaaatgtgcagaacatgaataacgctggagacaaatggtcggcctttctgaaagaacaatctaccctggcgcagatgtacccgcttcaggaaatccagaatctgaccgtgaaactccagctccaagcgctgcaacaaaacggcagcagcgtcctctccgaggataagtcaaagcgtcttaacaccatcctgaacactatgtcgacgatctactcaaccgggaaagtctgcaacccggataatccgcaggaatgcctgctgctcgagccgggactgaatgagattatggccaactccctggactacaacgaaagactctgggcgtgggagtcttggaggtcggaagtaggtaagcagctgcgcccactgtacgaggaatacgtggtcctgaaaaatgaaatggcgagagcaaaccactacgaggactacggagattactggcggggagactacgaggtgaacggagtggatgggtacgactacagtagagggcagttgatcgaagatgtcgaacataccttcgaagagatcaagccgctctacgagcacttgcacgcctacgttcgggcgaagctcatgaacgcttacccgtcatacatcagcccgatcggttgcctgcctgcccacctgctcggggatatgtggggtcgcttttggactaacttgtactcgcttactgtgcctttcgggcagaagcccaatattgacgtcaccgacgccatggtcgatcaggcctgggacgcccagcgaatcttcaaggaggccgaaaagttcttcgtgtccgttggactccctaatatgacccagggcttctgggaaaactcgatgctcactgacccgggcaatgtccagaaagcggtttgtcaccctacggcctgggatttgggcaagggagatttcagaatcctgatgtgcactaaggtgaccatggacgactttttgaccgcacaccatgaaatggggcacattcaatacgatatggcatatgctgcacagccattcctgttgcgcaatggcgctaacgaaggttttcacgaagccgtcggcgagataatgtcactttcggcagctactccaaagcatttgaaatcgatcggactgctctcacccgacttccaggaagataacgaaactgagatcaatttcctgctgaaacaagctctcactatcgtgggaaccctcccgtttacttatatgctggaaaagtggcgctggatggtgttcaaaggagagatcccgaaggatcaatggatgaagaaatggtgggagatgaagcgcgaaatcgtgggagttgtggagccggtcccgcacgacgaaacctattgtgaccctgcttctctcttccatgtgtcaaatgattattcgttcatccgctactacacccggaccctgtaccaattccaattccaagaggcactctgccaggcagccaagcacgaaggaccgcttcataagtgcgatatctcgaactccacggaggcaggccagaagttgttcaatatgctgagacttggaaagagcgaaccgtggaccctggccttggaaaatgttgtcggagcgaagaatatgaacgtgcggcctcttctgaattactttgaaccactgttcacctggctcaaggatcaaaacaaaaacagcttcgtcggatggtctactgactggagcccgtacgcagaccagagcatcaaggtgcgcatctcgctgaagagcgccttgggagacaaggcatacgagtggaacgataatgagatgtatttgttccgcagcagcgtagcttacgcgatgagacagtacttcctgaaggtcaagaaccagatgatcctctttggagaagaagatgtgcgcgtggcaaacctgaagcctcggatctccttcaacttttttgttaccgccccaaagaatgtgtcagacatcatcccgcgcaccgaagtcgaaaaggcgatccgaatgtcccgctcgagaatcaacgacgccttcagattgaacgacaactcgctggaattcttgggcattcagccaaccctgggaccgccaaaccagcctcctgtctccatttggttgattgtgttcggagtggtgatgggtgtgatcgtcgtcggcatcgtcattctgatcttcactggaatcagggatcggaagaagaagaacaaggcgcggtccggagagaatccgtacgcttcgatcgatatctctaagggagagaacaacccagggttccagaacaccgatgacgtgcaaacctcgttc

SEQ ID NO: 6276 - DNA, 2415 bp, Artificial Sequence
  Description of Artificial Sequence: Synthetic coding sequence
atgagctccagctcgtggttgctgctgtctctcgtcgccgtgactgcagcgcagtccaccatcgaagagcaagcgaaaacgttcctggacaagttcaaccacgaagccgaggatctgttttaccagtccagcctggcgtcatggaattacaacaccaacatcacggaagagaatgtgcagaacatgaacaacgccggagataaatggtccgccttcctcaaagagcagtcaacccttgcacagatgtacccactgcaagaaattcagaacctcaccgtcaagctgcagttgcaagccctccagcaaaacggttcgtctgtcctgagcgaggacaagtcgaaacggttgaataccattttgaatactatgtccaccatctactcgaccgggaaggtgtgcaacccggacaatccccaagaatgtttgctcctcgagcctgggctgaatgaaatcatggccaattccctcgactataacgaaagactgtgggcatgggagtcgtggcgctcagaggtgggtaagcagctccggccactgtacgaggagtacgtcgtgctgaagaacgaaatggccagagctaaccactacgaggactacggagactactggcggggagactacgaggtgaacggcgtggacggatacgattacagccgcgggcagcttatcgaggatgtagaacatacctttgaggagatcaagcccctttacgagcatctccatgcctacgtgcgcgcaaagctgatgaacgcatacccttcgtacattagcccgatcggatgtctgcccgcccacttgctcggagatatgtggggacggttttggactaacctgtacagcttgactgtgccgttcgggcaaaaaccgaatatcgacgtgaccgatgcgatggtggaccaggcctgggacgcgcaacggatcttcaaggaagctgaaaagtttttcgtgtccgtcggactcccaaatatgacccaggggttctgggagaacagcatgctcaccgacccaggaaacgtccagaaggcagtgtgccatcctactgcgtgggacctgggaaaaggagacttccgtatcctgatgtgcacgaaagtgactatggatgatttcctgaccgcgcatcacgagatggggcacatccagtacgacatggcctacgccgcccaaccgtttctcctgcgaaacggtgcgaatgagggatttcacgaagctgtgggagagatcatgagcctgtcggcagcaacgccaaagcacctcaaatccattggcctgctttcgccagacttccaggaggataatgagactgagatcaacttcctgctcaaacaagcactgactatcgtcggaaccctccctttcacgtacatgctcgagaagtggagatggatggtgttcaaaggcgagatcccgaaggaccagtggatgaagaagtggtgggagatgaagagagagatcgtcggcgtggtggagcccgtcccacatgacgaaacctactgcgatccggcgtcgctcttccacgtgtcaaatgactactccttcatccgctactacacccggactctctaccagttccaattccaggaagctctgtgtcaagctgccaaacacgaaggacctctgcataaatgcgacattagcaactccactgaagccggacaaaagctcttcaacatgctgcggctggggaaatccgagccatggaccctggcgctggaaaatgtggtgggagcgaagaatatgaacgttagacccctgctcaattacttcgagccgctctttacttggttgaaggaccagaacaaaaacagcttcgtgggatggtcgaccgattggagcccgtacgcggatcagtcgatcaaggtccgcatctcgctgaagagcgccttgggagacaaggcctacgaatggaacgataacgaaatgtacttgttccgctcgagcgtggcttatgcaatgcgccagtacttccttaaggtgaaaaaccaaatgattctctttggagaggaggatgtcagagtcgccaacctgaaaccgagaatctcgttcaacttcttcgtcactgctcctaagaatgtgtcggacatcatcccacgcactgaggtggagaaggccattcgtatgtcgcgctcgcggatcaacgatgcatttcggctcaacgacaattccctggaattccttggaatccaaccaaccctcggacccccaaaccagccgccggtgtctatctggctgatcgtgttcggagtggtcatgggtgtgatcgtggtgggcatcgtcatcctgattttcaccggcatccgcgatagaaagaagaagaacaaagctagatcaggagagaatccgtacgcgagcatagatatatccaagggagaaaacaacccgggatttcagaataccgacgacgtgcagacgagcttt

SEQ ID NO: 6277 - DNA, 2415 bp, Artificial Sequence
  Description of Artificial Sequence: Synthetic coding sequence
atgtcatcttcttcatggctgcttctgtcactggtggcagtgaccgcggcacagtctactattgaagaacaggctaaaaccttcctggacaagtttaatcacgaagccgaggacctcttttaccagtcgagcctcgcatcctggaattacaacaccaatatcactgaagaaaatgtgcaaaacatgaataatgcaggcgataagtggtcagcatttcttaaagaacaatccaccctcgctcaaatgtaccccctgcaagagatccagaacttgactgtcaaacttcaactgcaggcgctgcagcagaatggcagctccgtgctgtcagaggacaaatcgaagcggctgaacactatcctcaacaccatgtccactatctactccactggaaaagtgtgcaatcccgataaccctcaagaatgtctcctgttggagcccggcttgaacgagataatggctaatagcctggattacaatgaaaggctgtgggcctgggaatcgtggaggtcagaagttgggaagcaacttcggcccctgtacgaagagtacgtagtgcttaagaacgagatggcacgcgccaatcactacgaggactacggcgactattggagaggtgattacgaagtgaatggtgtggacggatacgattacagccgcggtcaacttatagaggacgtcgagcatacctttgaagagatcaaacctctttacgaacatctccatgcatacgttcgcgcaaagctcatgaacgcatatccatcctacatttcccctattggatgcttgcccgctcacctgctgggcgatatgtggggccgcttctggactaatctctactcactgaccgtgccttttggtcagaagccaaacatcgacgtgactgacgcaatggtggatcaagcatgggatgcacaaaggattttcaaagaagcagaaaagttctttgtgtccgttggactgcctaacatgacgcaggggttctgggaaaactccatgctgacggaccccgggaacgtgcaaaaggcggtctgtcatcctaccgcttgggatttgggaaaaggtgactttaggattctgatgtgcaccaaggtcaccatggacgatttcttgaccgcccaccacgaaatgggacatattcaatacgacatggcctacgccgcgcagccttttttgcttcgtaatggtgcaaatgagggcttccatgaggcagtgggtgagattatgtccctgtccgcggcaacccctaagcatcttaagagcattggcttgctttccccggattttcaagaagataacgaaactgagataaacttcctgctcaagcaagcgcttactattgtgggaacgttgcctttcacgtacatgctggaaaagtggagatggatggtctttaaaggcgaaatcccgaaggatcagtggatgaagaagtggtgggagatgaagcgggagatagtgggtgtcgtggaaccagtgccccacgatgaaacctactgcgatccagccagcctgtttcatgtgagtaatgattacagctttattcgttactacactcgtaccctgtaccagtttcagtttcaagaagccctctgtcaggctgccaagcatgagggtccactccataagtgtgatatatcgaatagcactgaagcagggcagaagctcttcaatatgctgcgtctgggcaagtcggaaccttggacgctggctcttgagaatgtcgtgggcgccaaaaacatgaacgtgcggcctctgctgaattactttgagccgctctttacctggctgaaggatcagaataagaactcttttgtgggatggtcgaccgactggtcaccttacgccgaccagtccatcaaggtgagaatttcccttaagtccgcactgggggataaggcatacgagtggaacgataacgaaatgtacctgttcaggtcatccgtggcatacgcaatgcgccagtactttctcaaagtgaagaatcaaatgatcctgtttggagaagaggacgtcagagtggcaaatcttaagccaagaatttcatttaactttttcgtcaccgccccaaagaatgtttcggacataatcccgcgaaccgaggtggagaaagcaatccgaatgtcgcgctcacggattaatgatgctttccgcctgaacgataattcgttggagttccttggaatccaaccaacccttggacctcccaaccagcctccagtcagcatttggctcatcgtgtttggtgtcgttatgggagtgattgttgtgggaattgtgatcttgatctttactggcattcgggatcgcaagaaaaagaacaaggctcgatcgggagaaaatccatacgcatcgattgatatttccaagggagaaaacaaccccggatttcagaatacggatgacgttcagacttcgttc

SEQ ID NO: 6278 - DNA, 2415 bp, Artificial Sequence
  Description of Artificial Sequence: Synthetic coding sequence
atgtcatcatctagctggttgctgctgtcactcgtcgccgtgactgcagcgcaaagcaccatagaggagcaggccaaaaccttccttgataagttcaatcacgaagctgaggatctcttctaccagtcttccctcgcctcttggaactataacacaaacataaccgaggaaaatgtccagaacatgaacaatgccggggataagtggtcagccttcctgaaagagcagtccacactggcccagatgtacccactacaagaaattcaaaacctgactgtgaagctacagctgcaagcattacagcaaaatggttccagcgtgctgtcagaggacaaatcaaaacgacttaacactattctgaacacgatgtcaactatttattccacgggcaaagtctgtaacccggataatcctcaggagtgtttgctgttggagcctggccttaacgagattatggcaaactccttagactataatgagcggctgtgggcgtgggagtcctggcggtctgaagtcggaaaacagttaagacccctgtatgaagagtatgtggtcttgaagaacgagatggctcgtgccaaccactacgaagattatggggattattggcgcggggactacgaagtaaacggtgtcgacggctacgattatagccgcggccagttgatcgaagatgtggagcacacttttgaggaaatcaaacccttgtatgagcatctgcacgcctatgtacgagcgaagttgatgaacgcttatccgtcctacatttctccaatcggctgtctaccagcgcatttgctgggagacatgtgggggcgattctggacaaatctgtattctctgacggtgccttttggacagaagccgaacatcgacgtaaccgatgcaatggttgatcaggcgtgggacgcgcagcgcattttcaaggaggcggaaaaattctttgtcagcgttggactgccaaacatgactcaggggttttgggaaaactccatgctgaccgatccgggaaacgtgcagaaggcagtttgccaccccacagcatgggatttgggaaagggcgatttccggatcctgatgtgtactaaggttacaatggacgattttctgacagcccaccacgagatgggacatattcagtacgacatggcctatgccgcccaacctttcttgcttagaaatggagctaatgaggggttccatgaggctgtgggggagatcatgtcactgtctgccgctacacccaagcacctaaaaagcattggactgctgagcccggattttcaggaagataatgaaacagagatcaattttctcctgaagcaggccttgaccatagttggcacgctccccttcacgtatatgcttgaaaaatggcggtggatggtctttaagggagagatacccaaagatcagtggatgaaaaagtggtgggagatgaagcgggagattgtgggagtggtcgagccggtgccacatgacgagacttattgcgaccccgcatctctctttcacgtgtctaacgactactctttcatacgatactacactcggactctgtatcagttccaatttcaggaggcactgtgccaggccgctaagcatgaagggcctctgcacaaatgcgatatttccaattccacggaggccggacaaaagttgtttaatatgctccgccttggaaagtctgagccctggacactcgccctggaaaacgtggttggtgctaagaatatgaatgtaagacctcttcttaactatttcgagcctctgttcacctggctgaaggaccagaataaaaacagctttgtcgggtggtcaaccgattggtccccttatgccgatcagagcattaaggtgcgcatctcgctaaaatccgcactgggggataaggcgtatgaatggaacgacaacgagatgtacctcttccgaagttccgtggcctacgccatgcggcaatactttctcaaggtaaaaaatcagatgatcctgttcggggaggaagacgtccgagtcgctaacctgaaaccacggatttcctttaatttcttcgtgacagcacccaaaaacgtctccgatataatccctcgtaccgaggtggaaaaggcgatccgaatgtcccggagtaggataaatgacgccttccgccttaatgataactctctcgaattcctcggtattcagccaacactggggccgcctaatcagcctcctgtgtcaatttggctcatcgtatttggtgtagtgatgggggtaatcgtcgttggtatcgtgatactcatctttacagggatcagggaccgtaaaaaaaagaacaaagccagatcaggcgaaaacccctacgcaagtattgacattagcaaaggcgaaaacaacccaggttttcaaaacacagatgacgtccagacatccttc

SEQ ID NO: 6279 - DNA, 2415 bp, Artificial Sequence
  Description of Artificial Sequence: Synthetic coding sequence
atgtcatcgtcgtcctggctgctgctgtcgctcgtcgccgtcaccgcagcccaatcgacgatcgaagaacaggctaagacttttctggataagtttaaccatgaagcagaagatttgttttaccagtctagcctggcctcgtggaactataacaccaacatcactgaggagaacgtgcaaaacatgaacaacgccggggacaagtggtccgcgttccttaaggagcaaagcacgctcgctcagatgtaccccctccaggagatccagaacctgactgtgaaactccagctccaggcgctgcagcagaacggttcgtccgtactctcagaagataaatcaaagcgtctcaatacgatccttaacactatgtcgacgatctactcaaccggcaaggtgtgtaaccctgataacccacaagaatgtctgctcctggaaccgggattgaacgaaatcatggcgaattccctggattacaacgaaagactttgggcgtgggagagctggcgcagcgaggtgggaaaacagctgcgcccgctgtacgaggaatacgtggtgctgaaaaacgaaatggcccgcgcgaaccactacgaggactacggagactactggcggggggactacgaagtcaatggcgtggacggatacgactactcaaggggccagctcatcgaagatgtcgaacataccttcgaagagataaagccgctctacgagcatttgcatgcctatgtccgggccaagctcatgaacgcatacccgtcctacatttcaccgatcggatgccttccggcgcacctgctgggagacatgtggggacggttttggactaacctctattccctgaccgtcccattcgggcaaaagcctaacatcgatgtgaccgacgcaatggttgaccaagcctgggacgctcagaggatcttcaaggaggccgagaaattctttgtctccgtgggactgcctaacatgactcaaggattctgggaaaactcgatgctcactgaccctggaaacgtgcagaaagcggtgtgccatcccaccgcctgggacctgggaaaaggcgatttccgaatcctgatgtgcaccaaggtcacgatggacgactttctcactgcacatcacgagatgggtcatatccagtacgacatggcatacgcggcccaaccattcctcctcagaaacggcgcaaacgaagggttccacgaagccgtgggcgaaatcatgtccttgtccgctgcaaccccgaagcatctgaagtccatcggcctgctgtccccggatttccaagaggataatgaaaccgaaatcaatttcctgctgaagcaggctttgactatcgtcggtactctcccgttcacttacatgctggaaaagtggcgatggatggtctttaagggagagattcccaaagatcagtggatgaaaaagtggtgggaaatgaagcgggaaatcgtgggcgtcgttgaaccagtgccgcacgacgaaacctattgtgacccggcgtcgctgttccacgtgtccaacgattactccttcatccgctactacaccagaactctttaccaattccaattccaggaagcgttgtgccaggcagccaagcacgagggaccccttcacaaatgcgacatctccaatagcactgaagctggccagaaattgttcaatatgcttcgcctcggaaagtcagaaccgtggacgctggcacttgagaacgtggtcggcgcgaagaatatgaatgtgcgccctctgctcaactacttcgaaccactctttacctggctgaaggatcagaacaagaactcctttgtggggtggtcaacggactggtccccgtacgccgaccagtccatcaaagtgaggatctcgctcaagtccgcgctcggagacaaggcttatgagtggaacgataacgaaatgtacctgtttcgctcgtcggtggcgtacgcgatgagacagtacttcctgaaggtcaaaaatcaaatgatcctgtttggcgaggaggacgtgcgcgtggcaaacctgaagccgcgcatcagttttaacttcttcgtgactgcgcccaagaacgtgtcagacattattcctaggaccgaagttgaaaaagcgatccgcatgtccagatcgcgaatcaacgatgcctttaggctcaatgacaacagccttgaattcctggggatccaaccgaccctgggcccaccaaaccagccgcccgtctccatctggctcatcgtctttggcgtggtgatgggcgtcatcgtcgtgggcatcgtgatactgattttcaccggtatccgcgacagaaagaagaagaacaaggctcggtccggagaaaacccatacgcatccatcgacatctctaaaggagaaaacaatcccggcttccagaatactgacgacgtgcagacctcgttt

SEQ ID NO: 6280 - DNA, 2415 bp, Artificial Sequence
  Description of Artificial Sequence: Synthetic coding sequence
atgtcctcatcaagctggctcctcctctcgctggtggcagtcactgcagcacagtccaccatcgaggagcaggccaaaacctttctggacaagttcaaccacgaagcggaagatctgttctatcaatcatccttggcatcgtggaattacaacactaatatcaccgaagagaacgtacagaacatgaacaatgcgggtgataagtggagcgcatttcttaaagaacagagcactttggctcagatgtaccctctccaggaaattcagaacctgaccgtgaagctgcaactgcaggcacttcagcaaaacggatcctcagtcctgtccgaggacaagtcgaagagattgaataccatcctgaataccatgtcaactatctactcaaccggaaaagtctgtaaccctgataatccgcaggaatgcctcctcctggaacctggattgaatgaaatcatggcaaattccctggattacaacgagagactgtgggcgtgggagtcatggcggtctgaagtgggcaagcagctccgccctctgtatgaggaatatgtcgtcctgaagaacgagatggctcgggccaaccactacgaagattatggcgattactggcgcggagattacgaggtgaacggcgtggacggttacgactacagccgcggacaattgatcgaggacgtcgagcacaccttcgaggaaatcaaaccactgtatgaacatttgcatgcatacgtccgcgcgaagctgatgaacgcataccctagctacatatccccgatcggatgcttgccggcgcacctcttgggagacatgtggggccgcttctggacgaatctgtacagccttactgtgccattcggccaaaaacctaacattgatgtgaccgacgctatggtggaccaggcttgggacgcacagcggatctttaaggaagccgaaaagttctttgtgtcggtgggcctgcccaacatgactcaaggattctgggagaacagtatgctgaccgaccccggcaacgtccaaaaggccgtctgtcatccaaccgcatgggatctggggaagggtgattttcgcatactgatgtgcacgaaggttactatggacgactttttgacggctcaccatgagatgggccacattcaatacgacatggcctacgccgcgcaaccgttcctgctccgtaacggcgcgaatgaagggttccatgaagcggttggagagataatgtcgctgtctgcagccaccccgaaacatctcaagagcatcggcctcctttcccctgatttccaggaggacaatgaaacggaaatcaatttcctcctgaagcaggcacttacgatcgtgggaactcttccgtttacctacatgctggaaaagtggcgctggatggtctttaaaggagaaatccctaaggaccagtggatgaagaaatggtgggagatgaaacgggagatcgtgggagtggtcgaaccggtgccacacgatgagacgtactgcgatccggcatcgctcttccacgtgagcaacgactacagcttcatccggtactacaccagaactctctaccaattccagtttcaggaagctctctgtcaagctgccaagcacgaaggaccgttgcacaagtgcgacatctcgaattcaaccgaggccggacagaagctgtttaacatgcttcggttgggcaaatctgaaccgtggactctggcgctcgaaaacgtggtcggtgccaaaaacatgaacgtgcggccgttgcttaactattttgagccattgttcacttggctcaaagatcaaaacaagaactccttcgtgggatggagcactgactggagcccatacgccgatcagtcgatcaaagtccggatcagcctgaagagtgccttgggcgacaaggcatacgaatggaatgacaacgaaatgtacttgttcagatcctccgtggcttacgccatgagacagtactttctgaaggtgaagaaccagatgatcttgttcggagaagaggatgtgagggtcgccaacctgaagccacgcatcagcttcaacttcttcgttactgcgcccaagaatgtgtcggacatcattccaagaaccgaggtggaaaaagcgatcaggatgagcaggtcgaggattaacgacgctttccgtctcaatgataattcactggaattcctgggtatccaacccactctcggtccgccgaatcaacccccggtgtccatctggctgatcgtctttggggtggtgatgggagttattgtcgtgggtatcgtcatcctgatcttcaccggcattcgcgatcgaaagaagaaaaacaaggccaggtccggagagaacccatacgcctccatcgacattagcaagggagagaataatccgggattccagaacactgatgacgtccaaacgtctttc

SEQ ID NO: 6281 - DNA, 2415 bp, Artificial Sequence
  Description of Artificial Sequence: Synthetic coding sequence
atgtcatcttctagttggttattactctctctggtggcagtgacagctgctcagtccacaatagaagaacaggcaaaaacatttttggacaaattcaatcacgaagccgaagatctcttttatcagtcttccttggcttcatggaattacaacacaaatatcacagaagaaaacgttcagaatatgaataatgctggggataagtggtccgctttccttaaagagcagagtactctggctcagatgtatcctttacaggaaatccagaatctcacagtaaaactccagcttcaggcccttcagcagaacggatcctcggtattatcagaagacaagagtaaaagacttaatactatactgaatactatgtccactatctactccactggaaaagtgtgcaatcccgataatcctcaggaatgtctgctgctcgagcccggactgaacgagatcatggctaattccttagattataatgaaaggctctgggcctgggaatcatggcgctccgaagttgggaagcagttacggcctttgtatgaggaatacgttgtcttgaaaaatgaaatggcaagggctaatcattatgaagattatggggattattggaggggggactatgaagttaacggggtagatgggtacgattattcacggggacaacttatcgaggatgttgaacatacattcgaagaaataaaacctctgtatgagcatttgcacgcttatgttagggcaaaactaatgaacgcctacccctcctacatatcgcccatcgggtgtctcccagcacatctgcttggggacatgtgggggcgtttctggacaaatctctactcgctcacggttccttttggacagaaaccaaacatcgatgtcactgacgccatggtagatcaggcctgggatgctcagaggatctttaaagaggccgaaaaattttttgtgtctgtggggcttcctaacatgactcagggattttgggaaaactctatgctcactgatcctgggaatgtccagaaagctgtgtgtcatcctacagcgtgggatcttggaaaaggagatttcagaattctaatgtgtactaaggtgacaatggatgattttctgacagctcatcatgaaatgggacatattcagtacgacatggcttacgccgctcaacccttcctacttcggaatggagctaacgaaggattccacgaggccgtgggagaaattatgagtctatctgcagcaactcccaagcatcttaaatccatcggactcttatctcctgactttcaagaagataacgaaactgagataaacttcttattaaaacaggccttaacaatagtggggactttgccttttacatatatgctcgaaaaatggcgctggatggtgtttaaaggggagatacctaaagatcagtggatgaaaaaatggtgggaaatgaaaagggaaattgtcggagtggtcgagcccgttccacacgatgaaacttattgtgaccctgcttcactgttccacgtttccaacgattattcgttcatcagatattacacgcgcactctgtatcagttccaattccaggaagctctgtgtcaggctgccaaacatgagggacctcttcataagtgtgatatttctaacagtacagaggctgggcagaaactcttcaacatgttgagattaggaaagagtgaaccctggacgttggccctagagaacgtagttggggctaaaaacatgaatgtaagaccattactgaactactttgaacctctcttcacttggctcaaagatcagaacaaaaactcttttgttggatggtctactgattggtccccttacgccgatcagtctatcaaagtcaggatctctctaaaatctgcccttggagataaagcatatgaatggaacgataatgaaatgtatctgtttcggtccagtgttgcctatgccatgaggcagtattttctgaaagtcaaaaatcagatgatactctttggggaagaggatgtgcgcgtggccaacctaaaaccacggatttcttttaatttctttgttacagcaccaaaaaacgtctcagatatcatcccacgaacagaagtcgaaaaagctataaggatgtccaggtcacgcatcaatgatgctttccgattaaacgataactcactcgaatttctagggatccagcctacattagggccgcccaatcagcctcccgtcagtatatggctcatagtattcggagtagtgatgggggtgatagtggtgggaatcgtcatcctgatattcacaggaatcagagatagaaaaaaaaaaaataaggcacggtcgggggaaaatccctacgcttctatagacatctccaaaggagaaaataacccaggattccagaatacagatgatgtgcagacatctttc

SEQ ID NO: 6282 - DNA, 2415 bp, Artificial Sequence
  Description of Artificial Sequence: Synthetic coding sequence
atgtccagctcctcatggttacttctttcattggtggccgtgaccgcagcccagtccaccatcgaggaacaagccaagacgtttctcgataaattcaaccacgaggccgaagatcttttttaccagtccagcctggctagctggaactacaacaccaacatcacagaggagaatgtgcagaatatgaacaatgcaggagacaaatggtctgcattcttgaaggaacagtcgactctagcgcagatgtacccacttcaggaaatccagaaccttaccgttaaattgcagcttcaggcgttgcagcaaaatgggagctcagtgctttctgaggacaagtctaaaaggctgaatacaatcctcaacaccatgtccacgatttactccacagggaaggtatgcaatccagataatcctcaggaatgcctgctgcttgagcccgggctaaatgaaatcatggcaaatagcctcgactataacgaacgtctctgggcttgggagagttggcgctccgaagtgggaaagcagctccggcccctatatgaggagtacgttgtgctcaagaacgagatggcccgcgctaatcactatgaggactacggcgactattggaggggcgactacgaggtaaacggggtggacggctacgattacagtagagggcagcttatcgaggatgtggaacatacattcgaagagataaaacctctgtacgagcacctacacgcatacgtgcgcgcaaagttgatgaacgcctatcccagctatatttcccctatcggctgtctgcccgctcatctgctcggagatatgtgggggcgcttctggaccaacctttactctctgaccgtgccgttcggtcagaagcccaacatagatgtgaccgatgccatggtcgaccaggcttgggacgcacaaagaatctttaaagaagcagagaagttcttcgtgtcagtgggtcttcctaacatgacacagggtttttgggagaacagcatgctgactgacccaggaaatgttcagaaagctgtgtgtcacccaactgcttgggaccttggcaagggagatttcagaattctgatgtgcaccaaggtcacgatggatgatttcctgaccgcacatcatgagatggggcatattcagtatgacatggcatacgccgctcaacccttccttttgcggaacggggctaatgagggcttccatgaggctgtgggtgagatcatgagtctgtctgcagccacaccaaagcacttaaaatcaattggactgctgtctcctgatttccaggaggacaatgagaccgaaattaatttcctactgaaacaggccttaactattgtgggaacacttcctttcacttatatgctggaaaaatggcgctggatggtgttcaagggagagatccccaaggaccagtggatgaaaaagtggtgggaaatgaagagggagatcgttggcgtggttgagccagttccacatgatgagacctattgcgatcccgcttctctgttccatgtgagcaatgattattcctttatacgttattatacacgaaccctgtatcagtttcagtttcaggaggccctctgtcaggcagctaagcatgagggacccctccacaagtgtgatataagcaattccactgaggcaggccaaaagctgttcaatatgttgcgtttggggaaaagtgaaccctggactcttgctttagagaatgttgtgggagcaaaaaatatgaacgttaggcctcttctaaattactttgaacccctcttcacttggctgaaggaccagaacaaaaacagttttgtgggctggagtaccgactggagcccctacgccgaccagagcataaaggtgcgcatctctcttaaatcagcactgggcgacaaagcctacgaatggaatgataatgagatgtatttgtttagatcttcggtcgcctatgccatgcgacagtacttcctcaaggttaaaaatcagatgatcctcttcggagaggaagatgtacgcgttgccaatctcaaaccgcgtatctcattcaacttctttgtgaccgctcctaaaaatgtgtctgatataatacctcgcacggaagtcgaaaaggctatccgcatgtcacgttcccgaatcaatgacgcatttagactaaacgacaattcacttgaattcctgggaatccagcccacactaggacctccaaaccagccccccgtctcaatctggctgattgttttcggcgttgttatgggcgtaatagtcgttggcattgtgatactgatcttcacggggatccgagacagaaaaaagaagaacaaggcacgctctggggaaaacccctacgcttccatcgatatctctaaaggggagaacaatccggggtttcagaatacagacgacgtccaaacatcattc

SEQ ID NO: 6283 - DNA, 2415 bp, Artificial Sequence
  Description of Artificial Sequence: Synthetic coding sequence
atgtcctcatcctcctggctgctgctttcactggttgccgtgactgctgcacaaagcaccatcgaggagcaagccaaaaccttcctggacaaatttaatcacgaagcagaggatttattctaccagtcttccctcgcctcctggaactacaacacgaatataaccgaggagaacgtgcagaacatgaataacgctggcgataagtggagcgcctttctgaaagaacagagcacgctggcgcaaatgtatccactgcaggaaatacagaacctcacagtaaagctacagctgcaggcgttgcaacagaatggttcttctgttttgagtgaggacaaaagtaagcgcctgaacactatcctgaacactatgagcacaatctactctactggaaaagtctgtaatcccgataatccacaagagtgcctcctcctcgagccaggcctcaatgagatcatggccaacagcctggattacaatgagcggctctgggcctgggagtcatggcgttcggaggttggcaagcaactcagaccactgtatgaggagtacgtggttctgaagaatgagatggccagggctaatcactacgaggattatggagactactggcgcggagattacgaagtgaacggcgtggatggctacgactactcccggggtcagctgatagaagatgttgagcacacgtttgaggagatcaagcccttgtacgagcatctgcacgcttacgtccgcgcgaagttaatgaatgcgtacccatcctatatctcccccataggatgtcttcccgcgcacctactaggagacatgtggggtagattttggacaaatctctactccctgaccgttcctttcggacagaaaccgaatatcgacgttactgacgctatggtggatcaagcctgggacgcccaacgcatttttaaggaagctgagaagttctttgtttctgtgggcctgcctaatatgacacagggattctgggaaaatagtatgctcacggatccgggaaatgtacagaaagcagtgtgtcatcccaccgcctgggatctaggtaaaggggattttcggatcctgatgtgcacaaaagtcaccatggatgattttctcaccgctcaccacgaaatgggacacattcagtacgacatggcctatgccgcccagccatttctgctccgtaatggcgcgaatgaaggatttcacgaggccgttggagagataatgtctctttccgccgccacaccgaagcatctgaaatcaatcggactgctgtctcccgatttccaggaggataatgaaactgagattaacttccttctgaaacaggccctcacaattgttggaaccctgccattcacatatatgctggagaaatggaggtggatggtgtttaagggggagatcccaaaggatcagtggatgaagaaatggtgggaaatgaagagagaaatcgtgggtgttgtagagcctgtgccccacgatgaaacctactgtgacccggccagcctattccacgtgagcaatgactacagtttcattcgttattataccagaaccctgtaccagttccagtttcaggaagccctgtgtcaggctgcaaagcacgagggtccattacacaagtgcgacatcagcaattctacagaagcaggtcagaagctctttaatatgcttcggctgggcaagtccgagccttggaccctcgcattggaaaatgtggtgggagcaaagaatatgaacgtccggccactactgaactactttgagcccctttttacgtggcttaaggaccagaataagaacagctttgtgggctggtcaaccgattggagcccatacgctgaccagagcattaaggtgcggataagcctaaagtcagctttaggtgataaagcttacgagtggaatgacaacgagatgtacttgttcaggtcgtccgttgcctatgcaatgagacagtacttcctgaaagttaagaaccaaatgatactctttggagaggaagacgtgcgggtcgctaatctgaagcccagaatatcttttaattttttcgtgacggcccccaaaaacgtgagcgacatcatccccagaaccgaggtggagaaagccatacgcatgtccaggtccaggatcaatgatgcctttagattgaatgataattcactggaatttcttggtattcagcccaccctcggtcccccaaaccagccaccagtctctatttggctgattgtttttggtgtggtcatgggggttattgtggtggggatcgtgattctgatattcacaggtatccgtgaccggaagaaaaaaaataaggcccgcagtggagaaaatccatacgctagcatcgatatctctaagggcgaaaacaatcctggttttcagaatactgatgatgtccagacatctttt

SEQ ID NO: 6284 - DNA, 2415 bp, Artificial Sequence
  Description of Artificial Sequence: Synthetic coding sequence
atgtcgtcgtcctcgtggctcctgctttcattggtcgcagtgaccgctgcacagtccacgattgaggaacaagcaaaaacgtttctggataagtttaaccacgaggccgaggacctgttctaccagagctcccttgcatcctggaattacaacaccaacattaccgaggaaaatgtgcagaatatgaataatgcgggagataagtggtccgcgtttcttaaggaacagagcacgctcgcacaaatgtaccctctgcaagagattcagaatctgactgtgaaactccagcttcaggctctgcagcagaatggttcaagcgtactgtccgaagataagtcgaagagactcaacactattctcaacactatgtcgactatatactcaactgggaaggtgtgtaatcctgataacccgcaggagtgcctgctgctcgaacctggacttaacgagattatggccaactcgcttgactacaacgaacgattgtgggcatgggaatcctggcgctccgaagtgggcaaacagctgcggcctttgtatgaagaatacgtggtgctgaagaacgaaatggcccgggcaaaccactatgaagattacggagattactggcggggtgattacgaagtgaacggtgtggacggttacgattacagccgaggtcaactgattgaggatgtggaacacactttcgaagagatcaaaccactgtacgaacatctccatgcctacgtgagggcgaagctcatgaacgcctacccatcctacatctccccaataggatgtttgcccgcacacctgcttggagatatgtggggaagattttggactaacctgtactcgctcaccgtccctttcgggcaaaagcccaacatagatgtcaccgacgcgatggtggatcaagcatgggatgcacaacgcatattcaaagaagccgaaaagttttttgtgtcagtgggccttcccaatatgactcaaggtttttgggaaaactcaatgctgaccgatccaggaaacgtccagaaagcggtctgccaccctactgcatgggaccttgggaagggtgatttcagaattctcatgtgtaccaaggtgactatggatgattttctgactgcacatcatgaaatgggtcacattcagtacgacatggcttacgccgcacaaccatttctccttcgaaacggggcaaacgaaggatttcatgaagcagtaggggaaatcatgtctctttcagccgcaactcctaagcacctcaagagcattggccttttgagccctgatttccaagaggataatgaaacggagatcaacttcctgctgaagcaggctctgacgatcgtcggtactcttccttttacttacatgctcgaaaagtggagatggatggttttcaagggagagattcctaaggaccagtggatgaagaaatggtgggaaatgaagagagaaattgtgggtgtggtcgagcctgtgccacatgatgaaacctactgcgatcctgcatcgctgttccacgtgtcaaacgactactcgtttattcgctactacaccagaaccctgtaccaattccagtttcaggaagcgctttgtcaagctgcaaagcatgaaggacctcttcacaagtgcgatatatcaaactcaactgaagccggacaaaaactgtttaacatgctgagactgggtaagtctgaaccatggaccctggcgcttgaaaacgtggtcggagccaagaatatgaacgtccggccactgctcaactacttcgaacctctttttacctggctgaaggaccaaaacaagaattcgtttgtgggatggtcgactgattggtccccttacgcagatcagagcatcaaggttcgcatttcacttaagtcggcccttggcgacaaggcgtacgaatggaacgacaacgaaatgtaccttttcaggtcatcggtggcctacgcaatgaggcaatactttctgaaggtgaaaaatcaaatgattcttttcggggaagaggacgtccgggtggctaacctgaagcctcgtattagctttaactttttcgtgaccgcccccaaaaacgtgtcggatatcatcccaagaaccgaagtggagaaggcaattagaatgagccggtcccgcatcaacgacgcttttcgccttaacgataatagcctggaatttctgggtatccagcccacccttgggcctccgaaccaaccgccggtgtcgatctggcttatcgttttcggagtcgtcatgggagtgatagtcgttggaattgtgatccttatcttcactggaattcgtgacagaaagaaaaagaacaaggccagatcgggcgaaaatccatacgcgtcaatcgacatctcgaaaggcgagaataaccccgggtttcagaataccgacgatgtgcaaacctccttt

SEQ ID NO: 6285 - DNA, 2415 bp, Artificial Sequence
  Description of Artificial Sequence: Synthetic coding sequence
atgagcagctcttcctggcttcttttgagtctggtggctgtgacagctgcccagtctacgatagaagagcaggccaaaactttcctggataagtttaaccacgaggctgaggatttgttctatcagtcctcgctggccagttggaattacaacaccaacattacagaagagaacgttcagaacatgaacaatgccggggataaatggagtgcgttcctaaaagagcaaagtacactcgcacagatgtaccctttgcaggagattcagaacttaacggttaagctacagctgcaagccctgcagcaaaacggcagttcagtattgtctgaagacaagagcaagagattgaacacaattctgaacaccatgtcaacaatttactcaactggcaaagtgtgtaaccctgacaacccgcaagagtgtctgttattggagcctggtctgaatgaaatcatggctaatagtctggactacaacgagcgcctgtgggcatgggaaagctggcgatctgaggtgggaaagcagctacggcccttatatgaggaatatgtggtattgaagaacgagatggccagggccaaccattatgaagattacggcgactactggagaggggactatgaggtaaacggggtagacggatatgattattctcgcggacagttgatcgaagacgtggagcacacgtttgaagagatcaaaccattatatgagcatctccacgcatacgttagggcaaaactgatgaatgcctacccgtcatacatatcccccattgggtgtttgcccgcccatttgctgggagatatgtgggggaggttctggaccaacctgtatagcctcactgtccctttcggtcagaaacccaatatagatgttacagacgcgatggtggaccaggcttgggatgcgcagcgcatatttaaggaggcagagaagttcttcgtatccgtggggttgcctaacatgacccaaggattctgggagaattctatgcttaccgaccctggcaatgtacagaaagcagtctgccatcccaccgcgtgggacctgggcaagggcgactttcgcattctgatgtgtactaaggtaaccatggatgactttcttaccgcccaccacgagatgggacatatccagtatgatatggcatacgctgcgcagcctttcctgctgcgaaatggcgcaaatgaaggattccacgaagcagtgggcgagattatgtcactgtctgctgctacacccaaacatctcaaatctatcggcctcttaagccccgattttcaggaagacaacgagactgagatcaattttcttctgaagcaagcattgaccatagttggcactctgccctttacatatatgctggagaagtggcgctggatggtcttcaaaggggagatacctaaagatcagtggatgaaaaaatggtgggagatgaaacgtgagatagtgggagtggttgagcccgtgccgcacgatgaaacgtactgcgacccggccagtctgtttcacgtttctaacgactatagcttcatccgctactacacccgaacattgtatcaattccagtttcaggaggctctttgccaggcggccaaacacgaagggcccctccataaatgcgacatttcaaacagtactgaggccggacaaaaactgtttaacatgctccggctgggaaagagcgaaccatggactttggcattggagaacgtggttggggctaaaaacatgaacgtgaggccgttgttgaattactttgaacctctcttcacctggctaaaagaccagaataagaattcatttgtgggatggagcaccgattggagcccctatgcggaccagtccatcaaggtcagaatctccctgaaaagtgcacttggagataaggcctatgagtggaacgacaacgaaatgtacctcttccgcagtagcgtggcatatgctatgcgacaatattttctcaaagtgaagaaccagatgattctttttggtgaggaggacgtgcgtgttgcgaatttaaagcccaggatttccttcaatttcttcgtcacagctccgaaaaacgtgtctgacatcatacctagaaccgaggtggagaaagcaatacggatgtcccgttcgcggattaatgatgcgtttcggctcaatgacaactccctggagtttttgggcatccagcccacgctggggcccccaaaccagccacccgtttcgatatggcttattgtttttggcgtggtgatgggcgtgattgtggtgggcatcgtgattctcatttttactgggatcagagacaggaagaagaagaataaggccaggagtggtgaaaacccctatgcctcgattgatatatcgaagggggagaataatcctggcttccagaacactgacgatgttcagactagcttt

SEQ ID NO: 6286 - DNA, 2415 bp, Artificial Sequence
  Description of Artificial Sequence: Synthetic coding sequence
atgagttcttcctcatggctcctcttatcactcgttgccgtaaccgccgctcaatccaccatcgaggagcaggcgaagacgttcctggacaagtttaatcacgaagccgaggacttgttttaccagagtagtttggcgtcatggaactacaacaccaacatcaccgaggagaatgtgcagaacatgaataatgctggggacaaatggagcgcttttctgaaggagcagtctacgttagcccagatgtatccactgcaggaaatccagaacctcacagtcaagttgcagttgcaggccctccagcaaaatggcagcagcgttctctctgaagataagtccaaaaggcttaatactatcctgaatactatgagcaccatctatagtacaggaaaggtctgcaacccagacaacccccaggagtgtctgctgttggaacctggattgaacgaaattatggcaaactctctggactacaacgagcgcttgtgggcatgggaaagttggcggtctgaggtaggtaagcaattacggcccttatacgaagaatacgtcgtgctgaagaacgagatggcgcgtgctaatcattacgaggactacggggattactggaggggggactatgaggttaacggcgtggacggttacgactactcacgggggcagctaatcgaggatgtcgagcatacttttgaggagattaagcccctttatgagcatcttcacgcctacgtgcgcgccaaactaatgaacgcttatccaagctacatcagccccatcggctgcctcccggcgcacctgttgggagacatgtggggtcggttttggacaaatctttactctctcaccgtgcctttcggccagaaaccaaacattgatgtgacggatgcaatggtggatcaggcttgggatgctcagagaatcttcaaggaggcagagaagttcttcgtcagtgtcgggctccccaacatgactcagggattctgggaaaactccatgctcaccgatcccggcaacgtccagaaggccgtgtgtcatcctacagcctgggacctggggaaaggcgatttccgcatcctcatgtgtaccaaggtcactatggatgacttccttactgcgcatcatgagatgggacacatccagtatgatatggcttacgccgctcaaccatttctgctcaggaatggggctaatgagggatttcacgaggctgtgggggaaattatgtctctgtcagccgccactccgaaacacctcaagtctatcggtctcttaagccctgatttccaagaagataacgagacagagattaattttctcctgaagcaggcactaacgattgttggcacactgccatttacatatatgctcgagaaatggagatggatggtctttaagggagagatcccaaaggaccagtggatgaaaaaatggtgggagatgaagcgggagatagtgggggtcgtagagccagtccctcatgatgagacttattgtgatcccgcttctcttttccatgtgtcgaacgactactcatttatccgttactacactcggacactgtaccaattccagttccaggaagcactgtgccaggcagcaaagcacgagggaccgctgcacaagtgcgacatttcgaattccacagaagctgggcagaaactctttaacatgttacgactcggcaaaagcgaaccctggacactggcattggagaacgtagtgggagctaagaatatgaatgttaggcctttgctcaattattttgagccgctgttcacttggctgaaagatcagaacaagaactctttcgtgggatggtcaacagactggagcccatacgctgatcagtcaattaaggtccgcatctcactcaaaagtgccttgggggacaaggcatacgaatggaatgacaacgagatgtacctgttccggtcctctgtcgcttacgcgatgcggcagtatttcctaaaggtcaaaaatcagatgatcctgttcggcgaagaagatgttcgggtggcaaacctgaaacctcggatcagttttaactttttcgtgacagcacctaaaaatgtctcagacatcatcccacgcactgaggtagagaaggctatcaggatgagccgctcacgaattaatgacgcctttagactcaatgataatagtctagaattcctggggattcaaccgacactcggaccgccgaatcaacctcccgtgtcaatttggttaatcgtctttggagtggtcatgggagttatcgtagtagggattgtgattcttatctttactggaatccgcgaccgtaagaaaaaaaataaggctcggtccggagaaaatccctacgcttctatcgacataagtaaaggagaaaataatcccggatttcagaacaccgatgatgtccagactagcttt

SEQ ID NO: 6287 - DNA, 2415 bp, Artificial Sequence
  Description of Artificial Sequence: Synthetic coding sequence
atgagcagtagctcctggctattgctgtccttagtggcagtgactgcggcccagagcaccatcgaggaacaggctaagactttcctcgacaaatttaatcacgaggctgaggatctattttatcagagctcacttgcttcttggaattataacacgaatattacagaagagaatgttcaaaatatgaataatgccggggataaatggtccgcttttttgaaagagcaatcgaccctcgcccagatgtatccgctccaggaaatccagaacctgactgtgaaattgcagctgcaagccctacaacagaacggaagttcagtattatcggaagataagagtaaaaggctcaacaccatcctaaataccatgagcaccatttattctacagggaaggtgtgtaacccagataacccccaggagtgccttctcctcgaaccaggcttgaacgagatcatggccaatagccttgactacaacgaaaggctgtgggcctgggagtcttggaggtcagaggtcggaaaacagctgcggccactttacgaggaatacgtggttttaaagaacgaaatggcccgggccaatcactacgaggactatggcgactattggcgtggagattacgaggtcaacggcgtggacggttatgactatagtcgtggacagctcatcgaggatgttgagcatacatttgaggagatcaaacccctctatgagcacctgcatgcatacgtgcgcgccaaactaatgaatgcctatccttcatatataagtccaataggatgtctgccagctcacctgttaggcgatatgtggggacggttttggactaacctgtattcgctcaccgtgccttttggccagaaaccaaatattgatgtcactgacgctatggtcgatcaggcttgggatgctcagagaattttcaaagaggcagaaaagttctttgtgagtgtcggcctgcctaatatgacgcaggggttctgggagaatagtatgctgactgacccgggaaacgttcagaaggccgtgtgtcatcccaccgcctgggatttaggtaagggggatttcaggatcttaatgtgcacgaaggtaactatggacgacttcttaacggcccaccacgagatggggcatatccagtacgacatggcctacgctgcacaaccttttctgctgagaaatggagccaacgagggctttcacgaggccgtgggggaaattatgtctctgtccgcggctacgcctaaacacctcaagtccattggtctgctaagccccgatttccaggaggataatgagacagagatcaatttcctgctaaagcaggctctgaccatagttggcacactaccctttacgtatatgttggaaaagtggcgatggatggtgtttaaaggcgagattcccaaagatcagtggatgaagaaatggtgggagatgaagcgggagattgtcggagtggttgagcctgttccacatgatgaaacatactgcgatcctgctagtctctttcacgtttccaatgactatagtttcatacgctactacactagaacactgtatcagtttcagttccaagaggccttgtgtcaggccgccaaacacgaaggacctctgcacaagtgcgacatctccaattcaacggaggcaggccagaagttgttcaatatgctaaggttagggaagagtgaaccttggacattagctctcgaaaatgtggttggtgcgaaaaacatgaacgtaaggccactgctcaactatttcgaacctttgtttacttggctcaaggatcagaacaagaactcttttgtgggttggtcaactgactggagcccgtatgcggaccagtcgataaaggtgcgcatcagcttgaagtccgcactgggtgacaaggcctatgagtggaacgacaatgagatgtacctgtttaggtcaagtgttgcatatgccatgaggcaatatttcctcaaagttaagaatcagatgatcctatttggggaggaggacgtgcgggtagctaatctgaagcccagaatttccttcaactttttcgtgacagctccaaaaaatgtgtcagacataatacccagaacagaggtggagaaggcgatccggatgagtaggtctcggatcaatgatgctttcagattgaatgacaacagcttggagtttcttggaattcagcctactttgggaccgccaaaccaacctccggtcagcatttggctcatcgttttcggggtagtgatgggcgttattgtcgtgggcatcgtcatcctgattttcacagggatcagggatcgcaaaaagaagaataaggcacgctccggcgagaacccatacgcctctatcgatataagcaagggggagaataaccccgggtttcagaacaccgatgatgtccagacatccttc

SEQ ID NO: 6288 - DNA, 2415 bp, Artificial Sequence
  Description of Artificial Sequence: Synthetic coding sequence
atgagttccagttcttggctcctgttgtccttagtcgccgtgacagcagcacagtctacaatagaagaacaagctaagaccttcttggataaatttaaccatgaggccgaagacctgttttaccagtcttctctggcttcctggaactacaataccaacataacagaagaaaacgtgcagaacatgaacaacgcgggagacaaatggtcagcgttcctgaaagagcagtcaactttagctcagatgtaccccctccaggagattcagaatttgaccgtgaagctgcagttacaggcacttcagcagaatgggtctagcgtcctgtcagaagacaaatctaagaggctcaacacaattttaaacacaatgtcaacaatctattcaaccggcaaagtctgcaatccagacaacccccaagagtgccttctcttggaacccggactgaatgagattatggccaacagtctggactataacgaaagactttgggcatgggaaagctggcggagtgaggtgggtaaacagttgcgacccctctatgaggagtacgttgtgctcaaaaacgaaatggcccgagccaaccactatgaggactacggcgactactggcgaggggattatgaggtgaatggtgtggacggctacgactactcccgcggacagctgatagaagacgtagagcacacctttgaggaaatcaaaccactttacgagcacttacacgcatatgttagggccaagcttatgaatgcttatccttcttatattagcccaatcgggtgtttgccagctcacctgcttggtgatatgtggggcaggttttggacaaacctgtattccctcaccgttcctttcggccaaaaacccaacattgatgttaccgacgccatggtcgaccaggcgtgggacgcccagcggatcttcaaagaagccgagaagttctttgtgtccgtgggtctccccaacatgacccaggggttttgggaaaactcaatgctgacggacccggggaatgtccagaaggccgtctgtcaccctacagcttgggatttaggaaagggagatttcaggatcttaatgtgtactaaggtcaccatggatgatttcctgacggcccatcatgagatgggacacatccagtatgatatggcatatgccgcgcagccttttctcctcagaaacggggccaacgagggattccatgaggcagtcggtgagattatgtcgctgagtgcagccacacctaaacaccttaagagtatcggtctgttgtcacccgacttccaggaggacaacgagaccgagataaacttcttactgaaacaggcgctaacaattgtaggcaccctgccctttacatacatgctcgagaagtggcgatggatggtttttaagggggagatccccaaggatcagtggatgaagaagtggtgggagatgaagcgagaaatcgtcggagtcgtagagcccgtgccccacgatgagacttactgcgatcctgcctccttattccatgtgagtaacgactactcctttataaggtactacacgcgaaccctctaccagttccagttccaagaggctctgtgccaggcagctaaacacgaaggtcccttgcataaatgtgacattagtaatagcaccgaagcaggacagaaactattcaacatgctccgactgggaaagtctgagccctggaccctcgccttggagaacgtggtgggagcaaagaacatgaatgtaagacctctgttgaactattttgagccgctgtttacgtggctgaaggatcagaataaaaactccttcgttgggtggtccaccgattggagtccgtacgcagaccaatctatcaaagtacgaattagcctaaagagcgctttgggggacaaggcatatgaatggaatgataatgaaatgtacttgttccgcagcagtgtggcgtacgccatgcgacagtatttcctgaaggttaagaatcagatgattctatttggcgaagaagacgtccgtgtagctaacctaaagcctaggatttctttcaattttttcgtcaccgcaccaaaaaatgtcagtgacatcatcccgcgaaccgaggttgaaaaggctatccgcatgagtaggtccaggataaacgacgccttccgccttaacgataactcgctggaattccttggaatacagccaactcttggtccccctaaccagcctcctgtgtctatctggctcattgtctttggggtggttatgggagtaatcgtcgtcgggatcgtcatcctgatttttacgggtatccgagaccgtaagaaaaaaaataaggccagatcaggggaaaatccctacgctagtatcgacattagtaagggagaaaataacccgggattccaaaacacagacgacgttcagacctcattt

SEQ ID NO: 6289 - DNA, 2415 bp, Artificial Sequence
  Description of Artificial Sequence: Synthetic coding sequence
atgtcgtcctcctcatggctgctcctgtccctcgtggcagtgaccgccgcccaatcgactatcgaagaacaagcaaagactttcctcgataagttcaaccatgaagcggaggaccttttctaccaatcgtcattggcctcctggaactacaacactaacatcactgaagaaaatgtgcagaatatgaataatgccggcgacaagtggtccgcgtttctgaaagaacaatcaaccctggcacaaatgtaccccctccaagagattcaaaaccttactgtgaagctccagctgcaagctctgcagcagaatggaagcagcgtgctctccgaagataagtcgaagcgactgaatactatccttaacactatgtccactatttactcaaccggtaaggtgtgcaacccagataaccctcaagaatgtctgctcctcgaacctggtcttaacgagattatggccaactcgcttgattacaatgaacggctttgggcatgggaaagctggcgttccgaagtcggaaaacaactgcgccctctctacgaagaatacgtggtgcttaagaacgagatggccagagcgaatcattacgaagattacggggactactggagaggtgattacgaggtgaacggggtggacggatatgactactctcgcggacagcttatagaagatgtggagcatacttttgaggagatcaagccactgtacgaacacctccatgcgtacgtgagagcaaaactgatgaatgcatatccttcgtacatttccccgattggttgcctgccagcacatctcttgggagatatgtggggccgattctggactaacctttactctctgaccgtgccgttcggccaaaagccaaacattgatgtgacggatgctatggtcgatcaagcctgggatgcacagcgcattttcaaagaggccgaaaagtttttcgtgtcggtgggcctgcctaatatgactcagggtttctgggaaaacagtatgctgaccgatccgggtaacgtacagaaagcggtctgccaccctaccgcctgggacctggggaagggagattttcggattctgatgtgtactaaggtgactatggatgactttctcactgcacaccatgaaatggggcacatccaatacgatatggcctacgcagcccaaccatttctccttcgcaacggagccaatgaaggatttcacgaggcggtgggcgagattatgtcactgtcagcagcaaccccaaagcatcttaagtctatcgggctgctctccccagactttcaagaagataatgaaaccgaaatcaattttctgctcaaacaagctctgactatcgtcgggaccctcccctttacctatatgcttgaaaagtggagatggatggtgtttaaaggagaaatacccaaggatcaatggatgaagaaatggtgggaaatgaaacgggagatcgtcggagtcgtggagcctgtcccacatgatgagacttactgtgacccggcatccctcttccatgtctccaatgattactcgttcattaggtactacaccagaaccctttaccaatttcagtttcaagaggccctgtgtcaagccgccaaacatgaaggtccgcttcacaagtgtgacatttccaactcaaccgaggcaggacagaaacttttcaatatgctgaggctgggaaagtcagagccttggaccctggcactggagaacgtggtcggcgctaaaaacatgaatgtccgccctctcctgaattactttgagccattgttcacgtggctgaaagatcagaacaaaaactcgtttgtgggttggtccacggactggtccccatatgctgaccagtccattaaggtgcgcatttcgctgaagtcagcactgggtgacaaggcatacgaatggaacgacaacgaaatgtacctcttcagatcctcggtggcgtacgcaatgcgtcagtactttcttaaagtcaagaaccaaatgatactgtttggtgaagaggacgtcagggtcgctaacctcaaacctcgaatctcctttaacttttttgtgactgctccgaagaatgtgtccgatatcatcccgaggaccgaagtggagaaggcaattagaatgtcgcggtcgaggattaacgatgcctttcggctgaacgataactccctcgagtttctgggaatacagccaaccctcggtcctcccaatcagcctccggtgtcgatttggctgatagtctttggagttgtcatgggagtcattgtggtgggtattgtcatcctgattttcactggaattcgcgaccgtaaaaagaaaaacaaagctcggagcggagagaacccttatgcctccatcgacatctcgaagggagaaaacaacccaggctttcagaacaccgatgatgtgcagacctccttc

SEQ ID NO: 6290 - DNA, 2415 bp, Artificial Sequence
  Description of Artificial Sequence: Synthetic coding sequence
atgagcagctcaagctggctgctcttgtctctggtggctgtgacagctgcacagagcacgatagaggagcaggccaagacctttttggataagtttaaccatgaagccgaagatctcttttatcagagctcactggctagctggaattacaacacgaacatcacagaggaaaatgtacagaacatgaataacgcgggtgacaaatggtctgccttccttaaggaacagtctaccttggcccagatgtaccccctgcaggaaatccaaaaccttaccgtgaagctgcagctccaggccctgcaacagaatggttccagcgtattgagtgaggataaatctaagagattgaacaccatccttaatacaatgtccacgatctacagcaccggtaaagtatgtaaccccgacaatccccaagagtgtctcctgttggagccgggcctgaacgagattatggctaatagcttggattacaatgaaaggctctgggcctgggaatcttggaggagcgaggtggggaagcagttgcggcctttgtacgaggagtatgtcgtacttaaaaatgagatggctagagctaatcattatgaggactatggagactattggcgcggggactatgaagtgaatggtgttgacggttacgactactcccgcgggcagctgatcgaggacgtggaacacacattcgaagaaatcaaacccctctacgagcacttgcatgcctatgtccgagccaaacttatgaacgcctatccttcctacatttcccccatcggttgtctgcccgcacatctcctgggcgatatgtgggggagattctggacaaacttgtatagcctgacagtacctttcggccagaaacctaatatcgatgttaccgatgccatggtggatcaggcatgggacgcccagaggatcttcaaggaagccgaaaaattcttcgttagcgtgggcctccctaacatgacccaggggttttgggagaactccatgctcacggaccctggcaacgttcagaaggctgtctgccatccaaccgcgtgggacttgggtaagggagatttcaggattctcatgtgcactaaagtgaccatggatgacttcctgacggcccaccatgagatgggccacatacagtatgacatggcctatgccgcgcagccattccttctgcgaaacggtgctaacgagggcttccatgaagccgtgggagagattatgtcactgtccgccgcgacaccgaagcacctgaagagcattggactgctttcccctgattttcaggaagacaacgagactgaaatcaacttcctgcttaagcaggccctgaccatagttggcacattgcctttcacatacatgcttgaaaaatggcgatggatggtctttaagggggagattcctaaagaccagtggatgaagaagtggtgggagatgaagagggaaatagtcggggtggtagaacccgtgccacacgacgaaacctactgcgaccctgcgtctttgtttcatgtaagcaacgactactcttttatcaggtattacacccggaccctgtaccagttccagtttcaggaagcgttgtgccaggcggccaaacacgaggggccactccacaagtgtgatatatccaattcaacagaagctggccagaaactgtttaatatgctgcggctgggaaagtctgaaccatggacactggcactggagaacgtcgtgggagctaagaatatgaacgtccggcccttgctgaactatttcgaaccattgtttacatggctcaaagatcaaaacaaaaactccttcgtcggctggtccacagattggtctccctacgcagatcagagcattaaggttagaattagtctcaagtccgcattgggtgataaggcctacgaatggaacgacaacgagatgtatctgttcagaagcagtgtcgcttatgcaatgcggcaatacttcttgaaggttaagaaccagatgattctcttcggtgaggaggacgtgcgcgttgccaatctgaaaccgagaatcagcttcaacttttttgtcacagccccaaaaaacgtctccgatattattcctaggacagaagtcgagaaagccattaggatgagccgcagtcgaattaacgacgcattccggctcaatgataacagcttggagttcctgggcatacagcctacgcttggaccgcccaatcagcctccagtatcaatctggctgatcgtctttggagtggttatgggcgtgattgtggttggaatcgttatcctcatatttacaggcatccgggatcgaaaaaagaagaataaggcacgcagcggagaaaacccttatgcttctatagacatatccaagggtgaaaataaccctgggttccagaacacagatgacgtgcagacctctttc

SEQ ID NO: 6291 - DNA, 2415 bp, Artificial Sequence
  Description of Artificial Sequence: Synthetic coding sequence
atgtcatcttcatcctggctgctgctgtcattggttgcagtcactgctgctcagtccaccatcgaagaacaagcgaaaacttttctcgacaagttcaaccacgaagcagaggacctgttttaccaaagctccctggcttcctggaattacaatacgaacatcactgaggaaaacgtgcagaacatgaacaacgcgggagacaaatggtcggccttcttgaaagaacagtcaactctcgctcagatgtaccctctccaggaaatccaaaacttgacggtgaagctccagctccaagcacttcagcaaaacggatcatcagtgctgtcggaggacaaatccaagagactcaacaccattcttaacaccatgtcaactatctactcaaccggtaaggtgtgcaacccggataatccacaggagtgtctcctgctcgagcctggactgaacgaaatcatggcgaacagccttgattacaacgagagactctgggcttgggagtcctggcgatcggaggtcggtaagcagcttagacccctgtacgaggagtatgtggtgctgaagaatgaaatggcacgcgctaaccattacgaggactacggcgactattggagaggcgattacgaagtcaacggagtggatggctatgattacagccgcggacagctgatcgaggacgtcgaacacactttcgaagaaatcaagcctctctacgaacacctgcacgcatacgtccgcgccaaactgatgaacgcgtacccgtcctacatctctcctatcggatgcctgccggcacatctgctcggagacatgtggggcagattctggaccaatttgtactccctcaccgtgcccttcggacagaaacccaatatcgacgttaccgacgccatggtcgatcaagcctgggatgcacagcgcatattcaaggaagccgagaaattcttcgtgagcgtggggcttccgaacatgactcaaggcttttgggaaaattccatgctgactgacccgggtaacgtgcagaaggcggtgtgtcatccaaccgcctgggatctgggaaagggcgacttccggatcctgatgtgtactaaagtcaccatggacgatttccttaccgcccaccacgaaatggggcatatccaatacgacatggcctatgccgcccagccgttcttgctccgcaacggcgccaacgagggctttcatgaagccgtgggggagatcatgtccctgtctgccgctaccccgaaacaccttaagagcatcggactgctgagcccagatttccaggaggataacgaaacggaaatcaacttcttgttgaagcaagccctcaccattgtcggaaccctcccgtttacttacatgctcgagaagtggcgctggatggtgttcaagggtgaaattccgaaagaccagtggatgaaaaagtggtgggagatgaagcgcgaaatcgtgggagtggtggagcccgtgccacacgatgaaacctactgcgatccggcgagcctctttcacgtgtctaacgactattcctttatccgatactacaccaggactctttaccagtttcagtttcaagaagcactgtgccaggcggctaagcacgaaggacccctccacaagtgtgacattagcaactccactgaggccggacagaaactctttaacatgctgaggctcggaaagtcagagccatggacccttgcactggagaacgtcgtgggagccaagaacatgaatgtgaggccgctgctcaactactttgaaccgctgtttacgtggctgaaggatcagaacaaaaactcgttcgttggctggtcgactgactggtcaccttacgcggaccagagcattaaggtgcgcatcagcctcaagagcgccctcggagacaaggcgtacgaatggaacgataacgaaatgtacctgttcagatcatccgtggcctacgcaatgcgacaatacttcctgaaggtgaagaaccagatgatcctcttcggagaggaagatgtgcgcgtggcgaacctgaagccgagaatctcctttaacttcttcgtcaccgccccgaaaaatgtatctgacatcattccacgcactgaggttgaaaaggccatcagaatgagcagaagccggattaacgacgcctttcgcctgaacgacaattcgttggagttcctcggcatccagcccaccctgggtccgccgaaccaacccccggtcagcatttggctgatcgtgttcggggtcgtgatgggggtgatcgtggtgggaattgtcatcctgatcttcaccggaatccgcgatcgcaaaaagaagaataaggcgcggtccggtgaaaatccctacgcaagcatagacatctccaagggagagaacaatccgggatttcaaaacactgacgacgtgcagacttcgttc

SEQ ID NO: 6292 - DNA, 2415 bp, Artificial Sequence
  Description of Artificial Sequence: Synthetic coding sequence
atgtcgtcatcgagctggctgcttcttagccttgtggcagtgacggccgcacagagcactatcgaggaacaggcaaagacttttctggataagttcaaccatgaagccgaagatcttttctaccaatcctcccttgcatcgtggaactacaataccaacattacggaagaaaatgtccagaacatgaataacgccggagacaagtggtcggcttttctgaaggagcagtcgaccctcgctcaaatgtatcctctccaggagatccaaaatctcaccgtgaagctgcagctgcaagcacttcagcaaaatggatcctcggtgctttcggaagataagtcaaagcgcttgaatacgatacttaacaccatgtcaaccatatactccacgggtaaggtgtgtaatccagataatccgcaagagtgcctgctgcttgaacctggattgaacgagataatggcaaactcactggattacaacgaacggctttgggcatgggaatcatggcgttcagaagtcggaaagcaactcagacccctgtacgaggaatacgtggtgctcaagaacgagatggcacgagccaaccattacgaagattacggcgattactggcgcggagactacgaagttaatggagtggacggttacgattacagccgggggcaactgatagaagatgtagaacacactttcgaagagattaagccgctctatgaacacttgcatgcatacgtccgggcaaagctcatgaacgcgtacccgtcctacatctccccgattggctgccttcctgcacacctgcttggtgatatgtggggccgcttttggaccaatctgtactccctgaccgttccatttggacagaagcctaacatcgacgtgaccgacgctatggtggaccaagcgtgggatgcccaacgtatctttaaggaagcggagaaattctttgtaagcgtgggactccctaatatgactcaagggttttgggagaattccatgctcaccgacccgggtaacgtccagaaggcagtgtgtcacccaaccgcgtgggatctcggcaagggagactttcgaatactgatgtgtactaaagtgaccatggatgacttccttacggcccaccacgaaatgggacatattcagtacgatatggcatacgcagcacaaccgtttcttcttcggaatggggccaacgaaggattccatgaggcagtcggagagattatgtcgctctcagcagcgacgccaaaacacttgaagtcaattggcctgctgtcgcctgactttcaagaggataacgagactgagatcaactttcttcttaagcaggcgctcactattgtgggtaccctgccattcacctacatgcttgagaagtggagatggatggtgtttaaaggagagatcccaaaagatcaatggatgaagaagtggtgggagatgaaaagagaaattgtcggggtggtggaacccgtgccccatgatgaaacctactgtgacccagcctccctgtttcacgtgtccaacgattacagctttattcgatactacactcgtaccctgtaccaattccaattccaggaagccctttgtcaagcagccaagcatgaagggcctcttcacaagtgcgacattagcaacagcactgaggcaggtcaaaagctcttcaacatgcttcgccttgggaaatccgaaccctggactcttgcattggaaaacgtcgtcggggcgaagaatatgaacgtgcggcctctgcttaactactttgaacccctctttacttggttgaaagaccagaacaaaaactcttttgttggttggtcgaccgattggtccccttatgccgatcaatcaatcaaagtcagaatttccctgaaatctgctttgggcgacaaggcatacgaatggaatgacaacgaaatgtacctctttagaagctccgtggcatacgcaatgaggcaatactttcttaaggtcaaaaatcaaatgattctgtttggtgaagaggatgtgcgcgtggcaaacctgaagccacgtatttcgtttaactttttcgtgaccgccccgaagaacgtgtcggatatcatcccacggactgaagtggagaaggccattcgtatgtcgcgtagccgcattaacgatgcgttccggctcaacgataattcgctggaattcctcgggattcagcctaccctgggtccacccaatcagcctcccgtgtccatttggcttattgtgtttggagtggtcatgggagtgatcgtggtggggatcgtgattctgatattcaccggcataagagatagaaagaagaagaataaagcccggtccggagaaaatccttacgcatcgattgatatcagcaagggggagaacaacccaggatttcagaacactgatgacgtgcagacctcgttc

SEQ ID NO: 6293 - DNA, 2415 bp, Artificial Sequence
  Description of Artificial Sequence: Synthetic coding sequence
atgtcgagcagctcgtggttgctgctttcgctcgtggctgtgaccgcggctcagtcaacgattgaagaacaagcgaaaaccttccttgataagtttaaccacgaggccgaggatctgttttatcaatcgtccctcgcatcatggaattacaacaccaacatcactgaagaaaacgtgcagaacatgaacaacgccggtgacaagtggtcggcctttcttaaagagcaatcgaccctggcccaaatgtaccccctccaagaaatccagaaccttactgtgaagttgcaactgcaagctctccagcagaatggatcttcagttttgtcggaagataaatcgaagagactgaacactattctgaataccatgtcaaccatatactcgaccggaaaggtctgtaatccggataacccacaagaatgtctcctgctcgaacctggtcttaacgagattatggctaactccctggattacaacgaacgactctgggcatgggagtcgtggcgatccgaagtcggcaaacagcttagaccactgtacgaggaatacgtcgttctgaaaaacgaaatggctagagctaatcactacgaggattacggtgactactggcgcggtgattacgaagtgaacggcgtggacggttacgactactcaagggggcagcttattgaggacgtggaacatacttttgaagagattaagcctctttacgagcatcttcatgcctacgtgcgggcaaaacttatgaatgcatacccatcatacatttctccaatcggatgcttgccagcacatctgctgggtgatatgtggggacgcttttggaccaatttgtactccttgaccgtgccctttggacagaagcccaatatcgatgtgaccgacgcgatggttgatcaagcctgggatgcacaacgtatctttaaagaagcagagaaattctttgtgtctgtggggcttcctaatatgactcagggcttttgggaaaattcaatgctgacggacccggggaacgtgcaaaaagccgtttgtcatcctaccgcatgggatcttggaaagggtgatttccgaatcctgatgtgcaccaaggtcactatggatgactttcttactgcccatcatgaaatgggtcatatccaatatgatatggcttatgccgcgcaaccctttcttctccggaatggagcaaacgaaggctttcatgaagcagtcggagagatcatgtcgctctccgcggcaactccaaagcacctgaagtccatcggacttctctcgcctgattttcaagaggacaacgaaactgagatcaatttccttctcaaacaagcactcactattgtgggcaccctcccttttacctacatgcttgaaaagtggagatggatggttttcaagggtgaaatcccgaaggaccaatggatgaagaaatggtgggagatgaaaagagagatcgtcggagtggtggaacctgtgccccacgacgaaacttactgtgaccccgcatctttgtttcacgtgtcaaatgattactccttcatcagatactacacccgtactctttaccagtttcagtttcaggaggcactttgtcaagccgcaaagcacgaaggtcctctgcataagtgcgatattagcaactccacggaggcgggccaaaagctcttcaatatgctgcgtctcggcaagtccgaaccgtggacccttgcccttgagaacgtggtgggtgccaagaatatgaacgtccggcccctgctgaattacttcgaacctctcttcacgtggttgaaagaccagaataagaactcgttcgttggctggagcactgattggtcgccatacgcagaccaatccattaaggtgagaatttcccttaaaagcgcattgggagataaggcttacgagtggaatgataacgaaatgtacctctttagaagctccgtggcctacgctatgagacagtactttcttaaggtcaagaaccagatgatccttttcggagaagaggacgtccgtgtggcaaacttgaagccgaggatctcatttaactttttcgtcacggcaccaaagaacgtgtccgacattattccaaggaccgaggtcgaaaaggcaatccggatgagcaggtcacggattaacgatgcatttcgccttaacgataactcgcttgaatttctggggattcagccaactttgggaccacccaatcagcctcctgtctccatatggcttattgtgttcggagtggtgatgggagtgattgtggttggaatagtgattttgatattcactgggattagagatcgcaagaaaaagaacaaggcacgtagcggcgaaaatccatacgcatccattgatatatccaagggcgaaaacaaccctggatttcagaacactgatgacgtccaaacctcgttc

SEQ ID NO: 6294 - DNA, 2415 bp, Artificial Sequence
  Description of Artificial Sequence: Synthetic coding sequence
atgtcctcaagcagctggctgctgctctcacttgtggcggtgaccgcggctcagagcaccatcgaagagcaagcaaagacgttcctggacaaattcaatcatgaagccgaagatctcttctaccagagctcacttgctagttggaattataacactaacatcactgaagagaacgttcagaacatgaataatgcaggagataaatggagcgccttcctcaaggaacaaagcaccctggcacagatgtatccactgcaggagattcagaacctcaccgtaaaacttcagcttcaagccctgcagcagaacggctcaagcgtcctctcagaagacaagagcaaaagactgaataccatcttgaacaccatgtccaccatctactctacaggcaaggtctgcaacccggacaaccctcaagaatgtctcctgctcgagcccggtctgaacgagattatggccaactctctggactataatgagaggctgtgggcatgggaatcttggaggtccgaagtcggaaagcagttgaggccactgtatgaagaatatgtggtccttaaaaacgaaatggcgcgggcgaaccattacgaggattatggagactattggagaggagattacgaggtcaatggcgtagatggctacgactactctagaggacagcttatagaggatgtagagcatacgtttgaggagattaaacctttgtatgagcacttgcacgcctacgtgagagctaagttgatgaacgcatatccgtcgtacatcagccccataggatgccttcctgcccacctcctcggtgacatgtggggaaggttctggaccaacctttatagtctcactgtccccttcggacagaagccaaacatcgatgtgactgatgccatggtggaccaagcatgggacgctcagcggatcttcaaagaagctgaaaagttcttcgtgagcgtggggctcccaaacatgacccagggcttttgggagaattcaatgctgactgaccctggcaacgttcagaaggctgtgtgtcacccaacagcctgggatctcggaaaaggggactttaggatacttatgtgtaccaaggttacaatggacgatttcctgacagctcaccacgaaatgggtcacatacagtacgacatggcatacgctgcgcaaccatttctgctccgcaacggcgctaacgagggatttcacgaggctgtcggcgaaattatgtctctgagcgctgccacacctaagcatctcaagagcataggcctgctgagcccagatttccaggaagacaacgagacagaaattaactttttactgaagcaggctctgacaatcgtgggcaccctgccgtttacttacatgctggagaaatggcgatggatggtctttaaaggcgaaatccctaaggatcaatggatgaagaagtggtgggagatgaaacgcgagattgttggcgtagtggagccggtgccacatgatgaaacttattgcgaccccgcctctcttttccatgtgtcaaacgattactctttcatccggtattatacccgcactctttatcaatttcagtttcaggaggcactctgtcaggccgctaagcacgagggtcctctccacaagtgtgatatctccaactccactgaggccgggcaaaagctgttcaatatgctccgccttgggaagagcgaaccatggacacttgccctggaaaacgttgtgggcgcaaagaatatgaacgtgcgcccactgttgaactattttgagccactttttacctggctcaaggaccaaaacaaaaacagcttcgtaggatggagcaccgactggtctccgtacgccgaccagtcaatcaaggttaggatcagtctgaagtcagctttgggagacaaagcctacgaatggaatgacaacgagatgtacctgttcaggagcagcgtcgcatacgctatgcggcaatactttttgaaggtcaagaaccagatgatactgtttggagaggaggatgtgagggtcgctaacctgaagcctagaatctcttttaatttctttgtgactgcacccaaaaacgtgtcggatatcatcccacgcacagaagtggaaaaagctattaggatgtcacgctcacgaattaacgatgcctttcgcttgaacgacaactcattggaatttcttggcatacaaccaacccttggcccacccaaccaacctcctgtgagcatctggttgattgtctttggagtggtcatgggagtgatcgttgtgggtatcgtcatactgatttttacaggcattcgcgacaggaagaagaaaaacaaggccaggagcggcgaaaacccctacgcttctatagacattagcaagggagaaaacaacccgggcttccagaacactgatgatgtgcaaaccagtttc

SEQ ID NO: 6295 - DNA, 2415 bp, Artificial Sequence
  Description of Artificial Sequence: Synthetic coding sequence
atgtcctcgtcgagctggcttttgcttagccttgtcgcagtcactgccgctcagagcaccattgaagagcaagcgaaaacctttctcgataagtttaaccatgaagcagaggacctgttctaccaatcgtcgctcgcatcctggaactacaacactaacatcaccgaagagaacgtgcagaatatgaacaacgcaggtgataagtggtcggcgttccttaaagagcaatcgactctggcacagatgtaccccctgcaagaaattcaaaacctgacggtgaagctgcaactgcaagccctgcaacagaatggttcgtcggtgttgtcggaagataagtcaaagcgcctgaacactattttgaatactatgtccacgatttactccacgggaaaagtgtgtaacccagacaatccacaagaatgtctgttgttggagcctggactgaacgagataatggcaaactcccttgattacaatgaaagactctgggcatgggaatcttggcgatccgaagttggaaagcagcttaggcctctctacgaagagtacgtggtcctgaagaatgagatggcaagagccaaccattacgaggactatggagattactggcgcggagactacgaagtgaatggcgtggacggttacgactacagcagaggacagctcattgaggacgtggaacataccttcgaagagataaaaccactttacgaacacttgcatgcgtacgtgcgggccaaactcatgaatgcctacccttcatacataagcccgataggttgcctcccagcacatctcctcggtgatatgtggggccgcttttggactaacctgtacagcctgaccgtccctttcggtcaaaaacctaatatcgatgtgactgacgcgatggttgatcaggcgtgggacgcacagcgcatctttaaggaggcagaaaagttttttgtctccgtggggctgcctaacatgacccaaggtttttgggaaaacagcatgctcactgatccaggtaatgtgcagaaagctgtgtgtcaccccaccgcatgggaccttggcaagggcgactttaggattctcatgtgtacgaaagtgaccatggacgatttcctcaccgcgcatcatgagatgggacacattcagtacgatatggcttatgcggcacaaccgtttcttcttagaaatggggccaacgagggatttcatgaagcggtgggcgaaatcatgtctctgtcggctgcaacgccaaagcacctgaagagcattggactcctctcccctgatttccaagaggacaacgaaaccgagattaactttttgctgaagcaagcacttaccatcgtggggactctgccgtttacttacatgctggaaaagtggaggtggatggtgttcaaaggagaaattcctaaggaccagtggatgaaaaagtggtgggaaatgaaaagagagattgtgggagtcgtggaacctgtgccacacgatgaaacctactgcgatcctgcgtccctcttccatgtgtcaaatgattattcctttatccggtactacacgaggactttgtaccagttccagtttcaagaggcactctgccaagcagcaaagcatgaaggccccctccacaaatgtgatattagcaacagcaccgaagcgggacaaaagttgtttaacatgcttaggctcggcaagtcggaaccatggaccctggcacttgaaaacgtcgttggggccaaaaacatgaacgtaagacctttgctgaactacttcgagccccttttcacctggctcaaggatcagaataagaattcatttgtcggctggtccactgattggtcgccctatgccgatcagtcgattaaggtccgaatctcgcttaagtcagcactcggtgataaggcatacgagtggaatgacaatgaaatgtacctgtttaggtcatcagtcgcctacgcaatgcgtcaatactttcttaaggtgaagaatcaaatgatcctctttggtgaggaggacgtgagagtggcaaacctgaagcctcgaatatcctttaacttcttcgtcaccgctcccaagaacgtgtcggacataattccacgtactgaagtagagaaggcaatccggatgtcgaggtccagaattaacgatgcattccggcttaacgataactccctcgaatttctcggcattcagccgacccttggacctccgaaccaaccacctgtgagtatatggctcattgtgtttggagtggtcatgggtgtgattgtcgttggcatagtcatcctgattttcaccggaattcgcgaccgcaaaaagaagaataaggcacgatcaggagagaatccgtacgcctcgattgatatctcgaagggagagaacaacccgggattccagaacaccgacgatgtacaaacgtccttt

SEQ ID NO: 6296 - DNA, 2415 bp, Artificial Sequence
  Description of Artificial Sequence: Synthetic coding sequence
atgtcttcctcctcgtggcttctgcttagcttggtcgccgtgaccgccgctcagtcaacaatagaggagcaggcgaaaacctttctggacaaatttaatcacgaagccgaagacctgttctatcagtcatcgctggcgtcctggaactacaatacaaacatcaccgaggagaatgtgcaaaatatgaataatgccggggacaaatggtcagcgttcctgaaggagcagagcacgctggcccagatgtaccccctgcaggagatccaaaacctgaccgttaagctgcaattgcaggccttgcaacagaacggatcctcagtcctgtccgaagataagtcaaaacgactgaacacaattttgaatacaatgagtactatttactccaccggaaaggtgtgcaaccccgacaacccgcaggagtgtctcctcctggagccaggcctgaacgaaatcatggccaactcccttgactataacgaacggctatgggcatgggagtcttggcggagcgaggtgggcaagcagctgagaccactgtatgaagaatacgtggtgttaaagaacgagatggcacgggccaatcactatgaggattacggggactactggcgaggtgattatgaagtcaacggcgtcgacgggtatgactattcgcgtggccagttgatcgaggatgttgagcacacatttgaggagattaaaccactatatgaacacttacatgcatacgttagggccaaactcatgaacgcatatccaagctacatcagccctattgggtgcctcccagctcacctgcttggagacatgtggggcaggttttggactaacctttactctctgacagtgcccttcgggcaaaaacccaatatcgacgtcacagatgccatggtggaccaggcctgggacgctcagcgtattttcaaagaagctgagaagttcttcgtctcagtgggcctaccgaacatgacgcagggcttctgggagaattccatgctgacagaccctggaaacgtccagaaagcggtgtgtcatcctacagcttgggacctgggaaagggggatttccgtattctaatgtgtacaaaagtcaccatggatgactttctgacagcacaccacgagatgggacacattcagtatgatatggcttacgccgcacaaccattcctgctgcgtaacggggctaacgaaggtttccatgaggcagtgggagagataatgagtctatccgcagcgacgcctaaacaccttaagtcaattggactgcttagcccagactttcaggaggacaacgagaccgagattaattttttgttgaaacaggctctgactatcgtgggcaccctgccattcacttacatgttggagaagtggcggtggatggtcttcaaaggggagatccccaaggaccagtggatgaaaaaatggtgggagatgaagagagaaatcgttggagttgttgagcctgttccacatgatgagacttattgcgacccagcctctctttttcacgtgtccaacgattattctttcatcagatactacacgagaacgctctatcagtttcagtttcaggaggcgctgtgtcaggcagccaagcatgaagggcctttgcacaaatgcgacatcagcaactcaacagaagcaggccaaaagttgtttaacatgttgaggctcggtaagtctgagccctggaccctggcactggagaatgtcgtcggagcaaaaaatatgaatgtgcgtccactgctgaactattttgaaccactattcacatggttaaaagatcaaaataagaattcattcgtgggatggtctaccgactggtcaccatacgccgaccaaagcatcaaggtaaggatatccttgaagtcggcacttggcgacaaggcttatgagtggaatgataatgaaatgtacctgtttcgatcgagcgtcgcctacgcgatgaggcagtatttcctgaaggtgaaaaaccaaatgattctgttcggtgaggaagacgtcagggtggcaaacctgaagcctcgcatcagctttaactttttcgttaccgcccccaaaaacgtgtcagacataattccccgcacagaagtcgaaaaggccatacggatgagcaggtccaggataaatgacgccttcaggctaaacgacaattctttggagtttctggggatccagcctacccttggcccccccaatcagccccccgtgagtatatggctcattgtgtttggcgtagtaatgggagtgatcgtcgtgggtattgtcattctgatcttcacaggcatcagggatagaaagaaaaaaaataaggctagaagcggcgagaatccttacgcgtccatcgacatatcaaagggtgaaaataacccaggttttcaaaataccgacgacgtgcagacttctttc

SEQ ID NO: 6297 - DNA, 2415 bp, Artificial Sequence
  Description of Artificial Sequence: Synthetic coding sequence
atgtcctccagtagttggctgctgctgagtctagtagcagtaaccgcggcccagtccaccatagaggagcaagccaaaacatttctcgacaagtttaaccatgaggctgaagatctgttctaccagtcatctttggccagttggaactacaataccaatatcaccgaagagaatgtacagaacatgaataatgcgggcgacaagtggtccgctttccttaaggagcagtccacactcgcgcagatgtatccattgcaagagattcagaatcttaccgtaaagctgcagctgcaggctctccagcagaacggcagctccgttctgtctgaggacaaatccaagcggttgaacaccatcttaaacacaatgtctactatttattctaccggcaaagtctgtaaccctgataaccctcaagaatgcttgcttctggaaccaggcctgaatgaaataatggccaactcactagattacaatgagcgtttatgggcctgggaatcgtggagatcggaggtgggaaagcagttgaggcctttatacgaggagtatgttgtgctgaagaatgaaatggctcgcgccaatcattacgaggactacggcgattactggaggggtgattacgaagtgaacggagtggacgggtatgattacagccgggggcaacttatcgaggacgttgagcataccttcgaagaaattaagcccctgtatgaacacttgcatgcctatgtgcgtgccaagctaatgaacgcataccccagttatatttcacctatcggatgcctcccggctcacctgctgggcgacatgtggggtagattctggactaatttgtactccttaaccgtcccctttggacaaaaacccaacatagatgtgacagacgcgatggtggaccaagcatgggacgctcaaaggatattcaaagaggccgagaagttctttgtgagtgttggcctgcctaatatgacacaagggttctgggagaacagcatgctgacggatcccgggaatgtacagaaggccgtgtgtcatcctaccgcttgggacctcggcaaaggggacttccggattctgatgtgcacgaaggtgaccatggacgacttcctgaccgcacatcacgagatgggccatatccagtacgatatggcgtacgcagctcaacccttcctgttgcgcaatggggccaacgaggggtttcacgaggctgtgggcgagatcatgtcactgtcagctgctacacccaagcacctcaagtctattgggcttctcagccctgatttccaggaggacaacgagaccgagataaattttctcttgaagcaggccctgacaattgtcggaacactgccattcacgtatatgctagaaaagtggcgttggatggtgttcaaaggagaaattcccaaggaccaatggatgaagaagtggtgggaaatgaaaagagaaatcgtcggagtggtggaacccgtaccccacgatgaaacgtactgcgatccagcgtctcttttccacgtatccaacgactactcttttatcaggtactacactagaacactatatcagttccagtttcaggaagccctctgtcaggccgcaaagcacgaggggccgctgcacaaatgcgatatttcgaactcgaccgaggctggtcagaagttgttcaatatgctgagacttggaaagtctgaaccttggacactggcacttgaaaacgtggtcggggccaaaaacatgaatgttcgccctctcctgaactacttcgaaccactctttacctggttaaaggaccagaataaaaactcttttgtaggctggtcaaccgactggagtccttatgcagaccagtctatcaaagttcgcatcagtcttaaatctgctctgggagataaggcatacgagtggaatgataatgagatgtacctgtttcgctcctctgtggcctacgccatgcggcagtatttcctcaaggtgaaaaatcaaatgatccttttcggtgaagaggacgtgagggtggcaaatctgaagcctcgcataagcttcaatttctttgttacagctccaaaaaacgttagcgatatcattccacgcactgaggtggaaaaagcaatccgaatgtctcgctctaggatcaatgacgcctttcggctgaatgataattccctagaattcctggggatacagcccactctcggcccacctaatcagcccccagtgagcatctggcttattgtcttcggcgtggtcatgggggtgatcgtagtcgggatcgtgattctcatcttcacaggaattagagataggaaaaagaagaacaaggctaggagtggggagaacccttacgcctcgatcgacatctccaagggtgagaataacccgggctttcagaacaccgacgacgtccagacttccttc

SEQ ID NO: 6298 - DNA, 2415 bp, Artificial Sequence
  Description of Artificial Sequence: Synthetic coding sequence
atgtctagttcgtcctggctcctgctttcgctcgtggcagttaccgcagcacagtccaccattgaagaacaagctaagacgtttctcgataagttcaaccatgaagccgaggacctcttttatcagtcgtcgctcgcttcgtggaactacaacaccaacatcactgaagagaacgtgcaaaacatgaataacgcgggtgataaatggagcgcatttttgaaagaacaatccaccttggcccagatgtaccctctccaggaaattcagaaccttactgtcaagctccagcttcaagctcttcagcaaaacggctcctcggttctgtccgaggacaagtcaaagcgcctgaacaccatactgaatacgatgtccactatatactcaacgggcaaggtttgtaacccagataatccacaggagtgcctcctgctcgaacctggtcttaatgaaatcatggcaaactcactcgactacaacgagagactctgggcatgggaatcatggcggtccgaagtcggtaagcagctgcgtccactttacgaagaatacgtggtgttgaaaaacgaaatggcgagagcaaatcattacgaggactacggggattactggcgcggtgactatgaagtaaacggcgtggacggatatgattactcaagaggacagctgatcgaggacgtcgaacatacttttgaagagataaagcctctgtacgagcacctgcatgcctacgtccgggctaaacttatgaacgcatacccatcatacatcagccccatcggctgcctgcctgcccacctgctgggcgacatgtggggtcggttttggacgaacctttactctctgactgtgcccttcgggcagaagccaaacattgatgtgactgatgccatggtggaccaggcctgggatgcacaaagaatattcaaagaagcagaaaagttctttgtcagcgtcggtctgccgaacatgactcagggattctgggaaaattcaatgcttaccgaccctggaaacgtccagaaggcagtgtgtcatccaaccgcatgggatctcgggaagggggattttcggatccttatgtgcaccaaggtcactatggatgattttcttacggcgcatcatgagatgggacacattcaatacgatatggcatacgcagcccaaccgttccttcttcgcaacggagcaaacgaaggctttcacgaagctgtgggagagatcatgtcactgtcggcggcaacccccaaacatcttaagtccattgggctgctgtcgcctgactttcaagaagataacgaaactgagattaactttctgctgaagcaggcacttactattgtgggaacgttgcctttcacctatatgctggagaagtggcgctggatggtattcaagggagagatccctaaggatcaatggatgaagaaatggtgggaaatgaagcgggaaattgtgggagtcgtggagcccgtccctcacgatgaaacctactgtgatccagcatccctgtttcatgtgtccaatgactactcattcatccgctactatactcggaccctttaccagtttcagtttcaagaggcattgtgtcaagccgccaagcacgaaggcccccttcacaagtgtgatatctcgaacagcacggaggcaggtcaaaagttgtttaacatgcttcgactgggaaaaagcgaaccctggaccctcgcgttggagaatgtggtaggcgcaaaaaacatgaacgtgaggcccctgttgaattactttgaacctctctttacttggctcaaggatcagaataagaattcgtttgtgggttggtcaactgactggagcccttacgccgatcagtccattaaggtgcggatttccctgaagtcggctctgggtgataaggcatacgagtggaatgataatgaaatgtacttgtttagatcgagcgtcgcatacgcgatgcgacagtactttttgaaggtgaaaaaccaaatgattctttttggggaagaggacgtgcgtgtcgcgaacctgaaacctcggattagcttcaacttctttgtgactgcgccaaaaaacgtgagcgacattatccctagaaccgaagtggagaaggctatcagaatgtcccgtagcagaatcaatgacgcgtttcgcctgaacgataactctcttgagtttcttggaatccaaccgacgctgggcccaccaaaccagcccccagttagcatctggctgattgtgttcggggtggtgatgggagtgattgtggtcggaattgtcattcttatctttaccggcatcagggaccgtaagaagaagaacaaggccaggtcaggagaaaacccttacgcgtcgatcgatatctcaaagggagaaaacaaccccgggtttcaaaacactgatgacgtgcagacttcgttc

SEQ ID NO: 6299 - DNA, 2415 bp, Artificial Sequence
  Description of Artificial Sequence: Synthetic coding sequence
atgtccagctcatcctggctccttctctcactcgtggccgtgactgcagcccaatcaaccattgaagagcaagctaaaacgtttttggataagtttaaccatgaggccgaggatctgttttaccaatcctccctggcgtcttggaactacaatacgaacataacggaggaaaacgtccagaatatgaacaatgctggggataaatggtcggcattcctgaaagagcaatcgacgttggcacaaatgtatcctctgcaggagatccagaacctgaccgtgaaactgcagcttcaggctctgcaacaaaacggatcgagcgtgctgtccgaggataaatcgaagcgccttaacactattcttaacaccatgagcaccatatactcgacgggaaaggtgtgtaacccagataacccacaagaatgtctgctgctcgaaccgggccttaatgagattatggcaaactctctcgactacaacgagaggttgtgggcctgggagagctggaggtcagaggtcggtaagcagctcagacctctgtacgaagagtacgtggtgctgaaaaatgagatggcccgggcaaatcattacgaagattacggtgactactggagaggtgattacgaagtcaatggagtcgatggttacgattactccagaggacaactgatcgaagatgtggaacatacctttgaggagattaaaccgctttacgaacatctgcacgcatacgtgagggcaaagctgatgaacgcgtatccttcgtacatttccccaataggatgtctgcccgcacacctgctcggggatatgtggggcaggttctggaccaacctttacagcctcactgtcccatttggccaaaagccaaacattgatgtgaccgatgccatggtcgatcaagcatgggacgcacaacgcattttcaaggaggccgaaaagttttttgtgtcggtgggtctgccaaatatgactcaggggttttgggagaattcaatgctcaccgacccaggaaatgtccaaaaggcggtctgtcatcccaccgcatgggatttgggtaaaggagacttcagaattctcatgtgtaccaaagtcactatggatgacttccttacggcccaccatgaaatgggccacattcaatacgatatggcctacgccgcacagccatttttgctgaggaatggggccaacgaaggattccatgaggcagtgggcgagattatgagcctgagcgcagcaaccccaaagcatctgaaatcaattgggctgctttcgcccgactttcaagaggacaacgaaaccgagataaactttctgctgaagcaggctcttaccattgtcggaactcttcctttcacctacatgctcgagaagtggaggtggatggtgttcaagggagaaattccgaaggaccaatggatgaaaaagtggtgggagatgaagcgagaaatagtgggggtggtcgaacctgtcccgcacgatgagacttactgcgatccggcctcgttgtttcacgtgtccaacgattactcgttcatccggtactacactagaactttgtaccaattccaattccaggaggcactctgccaggcagcgaaacacgaaggcccactgcataagtgcgacatctcgaattccaccgaggcaggacaaaagctgtttaacatgcttcgcctgggcaagtccgaaccctggactctggcacttgaaaatgtcgtgggagcaaagaacatgaatgtgcggccgcttctcaactactttgaaccccttttcacgtggcttaaggatcagaataagaacagctttgttggctggtccactgactggagcccctacgcagatcaatcaattaaggtgagaatctctcttaagagcgcactgggagacaaggcgtatgagtggaacgataatgaaatgtacctctttcgttcgtcagtcgcatacgcaatgcgtcagtacttcctgaaggtgaagaaccaaatgattctgtttggggaagaagatgtgcgtgtcgcgaaccttaagccccgtatctcgtttaacttctttgtcactgcgccaaagaatgtgtcggatatcatacctcgaactgaggtggagaaggcaattcggatgagcagaagcagaatcaacgatgcatttcgtcttaatgataattcgctggaattcttgggaattcaacctactctcggaccaccaaaccagccacctgtgtccatttggctgattgtgttcggagtggtgatgggagtgatcgtggtgggaattgtgattctcatcttcactggtatccgcgacagaaagaaaaagaataaagcgaggtccggcgaaaacccttacgcatcgattgatataagcaagggagaaaacaacccaggtttccagaatactgatgatgtgcaaacctcgttt

SEQ ID NO: 6300 - DNA, 2415 bp, Artificial Sequence
  Description of Artificial Sequence: Synthetic coding sequence
atgagcagctcaagctggctgctcctgagcctggtggcggtgactgcggcacaatcgactatcgaggagcaggccaagactttcctggacaagttcaaccacgaagccgaagatctgttctaccaaagctctcttgcctcgtggaactacaacactaatatcactgaagaaaatgtgcagaatatgaacaatgccggcgacaagtggagcgcattcctgaaggaacagagcaccctcgcccagatgtaccctctccaggaaatccagaacctgaccgtgaagctccaacttcaggcactgcaacagaacgggtcgtcagtgctctctgaggataagtccaaacggctgaatactattctgaacaccatgagcacgatctactcaactgggaaggtgtgtaacccggataacccacaggagtgcctcctgctggaacctgggctgaacgagatcatggccaatagcctcgactacaacgagcgcctttgggcttgggaatcatggagatcggaagtcggcaagcagttgaggccactgtacgaagagtatgtggtgctcaaaaacgaaatggctcgggctaatcactacgaggattacggagactactggagaggagactacgaagtgaatggagttgacggatacgactactccagggggcagctcatcgaggacgtggaacacactttcgaagagatcaagccgctctacgagcacctgcacgcctacgtgcgcgcaaaactcatgaatgcttatccgagctatatctcgcccatcggatgcttgccagctcatttgctgggagatatgtggggacggttctggactaacctctactcgcttaccgtccctttcggacaaaagcccaatatcgacgtgactgacgctatggtggaccaagcctgggacgcacagcggatctttaaggaggccgaaaagttcttcgtgtcggtggggctcccaaacatgacccagggcttttgggagaactcgatgctgaccgacccgggcaatgtgcagaaagccgtctgccatcctaccgcctgggatcttgggaagggagatttccgcatcctcatgtgcactaaggtgaccatggacgacttcctgactgcccatcacgaaatgggccatatccaatacgatatggcctacgcagcgcagccttttctgctccgcaacggggcgaacgagggattccatgaggcggtaggagagattatgtccctgagcgcagctacgccgaaacacctcaagtcaataggactcctctcaccggacttccaagaggacaatgaaactgagatcaatttccttcttaagcaagccctcaccatcgtgggtaccctccccttcacctacatgctcgaaaagtggcgctggatggtctttaagggtgagatccctaaggaccagtggatgaagaaatggtgggagatgaagagggagattgtcggagtggtggaaccagtcccgcacgatgaaacgtactgtgacccggcttcgctgttccacgtgtccaacgattacagctttattcggtactacacgcggactctttaccagtttcagttccaagaggctctttgccaggctgcgaaacacgaaggccccctgcataagtgtgacatcagcaactcaactgaggcaggacaaaagctgttcaacatgctccggttgggaaaatccgagccttggaccctggcgctcgagaacgtcgtcggcgctaaaaacatgaatgtgaggccgcttctgaattactttgaaccgctgttcacttggctcaaggatcagaataagaattctttcgtgggttggtcgactgactggagtccgtacgcagaccaatcaatcaaggtacgcatctcgctgaaatccgcattgggcgataaagcgtacgagtggaatgataacgaaatgtatctttttagatccagcgtggcttacgctatgcgccaatacttcctgaaggtgaagaaccagatgatcctcttcggcgaggaggatgtccgtgtggcaaacttgaagcctcgcatcagcttcaatttcttcgtgactgcaccgaaaaatgtgagcgacatcatcccgcgcactgaggtcgaaaaagcgatcagaatgtcccgctcccggattaacgacgccttcagactgaacgacaacagcctggaatttctcggcatccagccgaccctgggacctcctaaccagccgccggtgtccatctggcttatcgtgttcggtgtggtcatgggagtgatcgtggtcggcatcgtgatcctgatctttactggaatccgggatcggaaaaagaaaaacaaggcgcgcagcggggaaaacccctacgcctcgatagacatctcgaagggagagaacaatccaggttttcaaaatactgatgacgtgcagacttccttt

SEQ ID NO: 6301 - DNA, 2415 bp, Artificial Sequence
  Description of Artificial Sequence: Synthetic coding sequence
atgtcgagttctagttggctgctgctttcactggttgctgtgactgctgcacagagcaccattgaggaacaggccaaaaccttcctggacaaatttaatcacgaagccgaagacctgttttatcagagtagtctcgcctcctggaactacaacaccaatataactgaggagaatgtgcagaatatgaataatgctggcgataaatggtcagcttttctgaaagagcagtccaccttggcccagatgtatcctctgcaggaaatccagaacctgaccgtcaagctgcagttgcaggccctgcagcagaatgggtcttccgtgctcagtgaggacaaaagtaagagattgaacactatcctgaatacgatgagtactatttactctactggaaaggtgtgtaacccagataacccccaggagtgcctgttgcttgagccgggtctgaatgagattatggcaaactcactcgattacaacgaacgcctgtgggcctgggagtcgtggcgctctgaagtgggcaagcagctccgccccctatatgaggagtatgtggtccttaagaatgagatggctcgagccaaccattacgaggactatggtgattactggagaggtgactacgaggtgaatggcgtcgacggctatgactattcgcgtggccaactaatcgaggatgtggagcacacatttgaggaaatcaagccactatacgagcatcttcacgcctatgtgcgcgcaaagctgatgaatgcatacccctcatatatttcccccattgggtgcctgcctgctcacttactgggcgatatgtggggcaggttctggacaaacctgtattctttgactgtaccgttcggtcaaaagcctaacattgatgtgacagacgcgatggtcgatcaggcttgggacgcccagcgaatatttaaggaagcagaaaagttctttgtctcggtagggcttccaaatatgacccagggtttctgggaaaacagcatgctgacagaccccggcaatgttcagaaggcagtttgccatcctacagcatgggacctgggaaagggcgattttcggatcctcatgtgtaccaaggtgactatggacgattttctgaccgctcaccacgagatgggccacatacagtatgacatggcatacgctgcacagcccttcctgttgagaaacggtgctaatgaggggtttcatgaggcagtgggcgagatcatgtctctgtccgccgctactccaaaacaccttaagagcataggacttctatctcctgatttccaggaagacaacgagacagagattaacttcttgctcaagcaggccttgactatcgtcggaaccttgcccttcacttacatgttggagaaatggcgctggatggtctttaagggagagatccctaaggatcagtggatgaagaagtggtgggagatgaagagggagattgtgggagtcgtggaaccagtgcctcacgatgaaacttattgcgaccccgcgtctctgttccacgtatccaacgactacagcttcatccgatattacaccagaacactgtatcagtttcaattccaggaggctctgtgtcaggcggcgaaacatgaaggtcctcttcacaaatgtgacatctccaactctacggaggccggccaaaagctctttaatatgctgcggctcggtaaatccgaaccgtggacactggccctggagaacgtcgtgggcgctaagaatatgaacgtgcgtcccctgttgaactattttgaaccattatttacctggctgaaagatcagaataaaaatagcttcgtgggctggagcacagattggagcccctacgccgaccagtcaatcaaggtgcgcatttcactgaaaagtgcgctgggggataaagcctacgaatggaacgataacgagatgtacctatttaggagttcggtagcgtacgcaatgaggcagtactttttaaaggtcaagaatcagatgatcctgttcggagaggaggacgtgcgcgtggccaatctcaaacctcgtatttctttcaactttttcgtaacggctcctaagaacgtgtccgacatcatcccacgaacagaagtggaaaaggccattcggatgagccggagcaggattaatgatgcttttaggttaaatgacaacagcttggaattcctagggatccagcccactctcggcccgccaaaccagccccctgtgtctatctggctcatagtattcggcgtagtgatgggcgttatagtggtcggcatcgtgattctcatttttaccggaattcgtgataggaagaagaaaaacaaggcccgaagcggcgagaatccctatgcgagcatcgatataagtaagggagagaataaccctggatttcaaaacactgatgatgtgcagacttcattt

SEQ ID NO: 6302 - DNA, 2415 bp, Artificial Sequence
  Description of Artificial Sequence: Synthetic coding sequence
atgagctccagctcgtggcttcttctctcgcttgtggcggtgactgcagcacagtcgacgattgaggagcaagcaaagactttcctggataagtttaatcatgaggcggaagatctcttttaccagtcgtcacttgcttcatggaactacaacaccaacatcaccgaagaaaatgtgcagaatatgaacaacgccggagataagtggtctgcattcctgaaagaacaatctacccttgcacaaatgtaccctttgcaagaaatccaaaacctgactgtgaaactccagctgcaggcattgcagcagaacggatcctcagtcctctcggaagataaatccaagagactgaacactattcttaacacgatgagcactatttactcaactggtaaggtgtgtaacccagataaccctcaagagtgcctgctgttggaaccaggactcaatgagataatggcaaactccctggactacaatgagcgcctttgggcatgggagtcctggcgatcggaagtgggtaagcagcttcgaccactctacgaggaatacgtggtgctgaagaacgaaatggcccgggcaaaccattacgaagattatggagactactggcgcggagactacgaggtgaacggcgtggacggttacgactattctcggggacagcttattgaagatgtggaacacacttttgaagaaatcaagcccctgtacgagcatctgcatgcctacgtgagagccaaactgatgaacgcgtacccctcctacatatcgccaatcggctgtctgcccgcacacctcctcggtgatatgtggggccgattttggaccaacctttactcccttaccgtcccatttggacaaaagccaaacattgatgtcaccgacgccatggtcgatcaagcatgggatgcacaacgcatctttaaggaagcagaaaagttttttgtgagcgtgggacttccaaacatgactcaaggattctgggaaaattccatgctgactgatccaggaaatgtgcaaaaggccgtgtgccatcccaccgcatgggatctgggaaagggagattttcgaattttgatgtgcactaaggtcactatggacgattttctgaccgcccatcacgaaatgggacatatccagtacgacatggcatacgcagcgcaaccatttttgctgaggaatggagcaaacgaaggttttcatgaggcagttggggagatcatgtcattgagcgcagctacccctaagcatctcaagtccattggactgctgtcccctgacttccaagaggataacgaaaccgagataaactttcttctcaagcaggcgctgactatcgtgggtactctccctttcacttacatgcttgaaaagtggagatggatggtgtttaagggtgaaatccctaaggaccaatggatgaagaaatggtgggaaatgaagcgggaaattgtgggtgtcgtcgaacccgtgccacatgacgaaacgtactgtgaccctgcatcgctgttccatgtgtcgaacgactactcctttatccgttactacactcgtaccctctaccaatttcagttccaggaagccctctgccaggctgccaagcatgaaggacctttgcacaagtgtgatatatcgaactccaccgaagcagggcagaaacttttcaatatgctgaggctgggaaagtccgaaccttggaccctggcacttgagaacgtggtcggagctaagaatatgaacgtaagaccgctgctgaattactttgaacccctgttcacttggcttaaagatcaaaacaagaatagcttcgtgggctggtcaaccgactggtcgccctacgcggatcagagcattaaggttcggattagccttaagtcggcactgggagacaaagcatatgaatggaatgataatgaaatgtacctctttaggtcatccgtggcatacgccatgcggcaatactttcttaaagtgaagaaccagatgatactctttggtgaagaggacgtccgggtggccaaccttaaacctcgcatatcgtttaacttcttcgtgactgcaccaaaaaacgtgtcggacattatccctcggaccgaagtggaaaaggcaattcgcatgtcgagaagcagaattaacgatgcatttcgacttaacgacaattctctggagttcttggggattcaaccaaccctgggaccgccgaatcaaccaccagtcagcatctggctgatcgtctttggagtggtcatgggggtgatcgtggtggggatcgtgattctgattttcacgggaattagagatcgtaaaaagaagaataaagcgcgttccggagaaaacccatacgcttccatagatatctccaaaggagagaacaaccctggttttcaaaataccgatgacgtgcagacctcattt

SEQ ID NO: 6303 - DNA, 801 bp, Artificial Sequence
  Description of Artificial Sequence: Synthetic coding sequence
atgaaggccgccgtgctgactttggcagtcctgtttttaactggctcccaggcccggcacttttggcagcaggatgagccaccccagagtccctgggatcgcgtgaaggaccttgcgaccgtgtacgttgacgtgttgaaggattctggacgcgattacgttagccagtttgagggatccgctcttggcaaacagctcaacctgaagctgctcgataactgggatagcgtaactagtactttcagtaagctgagggaacaattgggccccgtcacacaggagttctgggacaatctggagaaggaaacagaggggctgcggcaggaaatgagcaaggatcttgaggaggtaaaggcaaaagttcagccttatctggacgattttcagaagaagtggcaggaggagatggaactctacagacaaaaggtcgaacctttacgcgcggaattgcaggaaggagccagacagaagctgcacgaattgcaagagaagctgagtccgctcggcgaggagatgagggattgcgcccgggcccacgtagatgccttgcgcactcaccttgccccatactctgatgaactcaggcaacggctcgccgctaggttggaggcgctgaaagagaatggcggagctcggctggctgagtaccatgccaaggcaactgagcacttgagtactctctcggaaaaggccaagcccgcccttgaagacctccgacaaggactcctccctgtactggaaagttttaaagtgtcctttctatccgccctcgaggaatacaccaaaaaactgaacacacag

SEQ ID NO: 6304 - DNA, 801 bp, Artificial Sequence
  Description of Artificial Sequence: Synthetic coding sequence
atgaaagccgctgtgctaacccttgccgttctattcttgactggttcccaggctagacacttttggcagcaggacgagccaccccagtccccttgggaccgtgtcaaggacctggccaccgtttacgtagatgtgcttaaggatagcggccgggattacgtctcccagttcgaaggaagcgcacttggcaagcaactcaacctgaagctgttggacaattgggattccgtgacaagcacgttcagcaagcttcgtgagcagctcggaccagttacccaggagttctgggataacttggagaaagagacggaaggactacggcaagaaatgagtaaagatcttgaggaagtgaaggctaaggtgcagccataccttgacgactttcagaaaaagtggcaggaagaaatggagctgtaccggcaaaaagtagaacccctcagggccgaattacaggaaggcgccagacagaagttgcacgaactgcaggaaaagctctcccctttgggagaggagatgcgcgactgcgcacgcgctcatgtggatgcccttaggacccatcttgcgccctacagcgacgaacttcgtcaaaggctagccgcaagactagaggctctaaaagagaacggcggggctaggctggcagagtaccacgctaaggccacagaacacctgtcaactctgagcgagaaagccaagcccgccttagaggatctacgtcagggcttgctgcctgtgctggaaagtttcaaagtgagtttcctgtctgcgctggaggaatatacaaaaaaactcaacacacag

SEQ ID NO: 6305 - DNA, 801 bp, Artificial Sequence
  Description of Artificial Sequence: Synthetic coding sequence
atgaaggcagcagtgcttactcttgcagtgctgtttctgaccgggtcccaggcaagacatttttggcagcaggacgaacctccccagtctccatgggatcgggtgaaggatctggcgactgtctacgtggatgtgctgaaggattcgggtagggattacgtgagccaattcgaaggatcggcactgggtaagcaactcaatctgaagctcctggataactgggactcagtgacctcgacgttttcgaagctgagagagcaactgggacccgtgactcaggagttttgggacaacctcgaaaaggaaaccgaagggctgcgtcaggaaatgtcgaaggatctggaagaagtcaaggccaaagtccaaccttacctggacgactttcagaagaaatggcaagaagaaatggagctctaccgccaaaaggtggaacctctgagggcagaattgcaggaaggagccagacagaaacttcatgagctccaagagaagctgtcccctctgggagaagaaatgagagattgcgctagggcacatgttgatgccctccgaacccacctggcaccatacagcgatgaactccgacagcgtctggcggcaaggctcgaagcactcaaagagaatggaggggcacgcttggctgaataccatgcgaaggcaaccgaacatctctcaactctttccgaaaaagcgaagcccgcactggaggacctgcgccagggactcctcccagtgctggagagctttaaggtgtccttcctctccgcattggaagaatacaccaagaaactgaatacccag

SEQ ID NO: 6306 - DNA, 801 bp, Artificial Sequence
  Description of Artificial Sequence: Synthetic coding sequence
atgaaggccgccgtcctcaccctggctgtgctgtttctgacggggtcgcaagcaagacatttctggcagcaggatgaaccacctcagtccccatgggaccgggtgaaggatctcgccactgtatatgtagatgtgctgaaagattctgggagagactacgtcagccaatttgaaggatccgcccttggcaagcagctgaaccttaagttactggataactgggattctgtgacgagcacattctccaagctccgcgaacagctggggccagtgacccaggagttttgggacaacctcgagaaggagactgagggcctgcgccaggagatgtctaaagacctggaggaggtcaaagctaaagtgcagccttatttggacgatttccagaagaaatggcaggaggaaatggagctgtaccgccagaaagtggaacccctacgagcagaactacaggagggggcaaggcagaagctccatgagctgcaggagaaactgagcccgctgggcgaagagatgagggattgtgctcgagctcatgtcgatgccttgcggacgcatctggcaccgtattcagacgagctgaggcaaaggctcgcagctcggctcgaagcactcaaggagaacgggggtgccaggctagctgaatatcacgcgaaagccacggagcatttaagcactttgtccgaaaaggcgaagcctgctttagaggacctacgtcagggactgcttcctgttctggaatcttttaaagtgagctttctctccgcactggaggagtacacaaagaaacttaatacacag

SEQ ID NO: 6307 - DNA, 801 bp, Artificial Sequence
  Description of Artificial Sequence: Synthetic coding sequence
atgaaagccgcggtgctcactctcgctgtgctgtttctgactggatcccaggccagacatttctggcagcaggatgaaccaccgcaaagcccttgggaccgggtgaaagacctggcgacggtgtacgtggacgtgctgaaagattcgggtcgcgattacgtgtcccaatttgagggttcagcccttggaaaacagctcaacctgaaacttctggataactgggactctgtgacttccaccttctcgaagttgagggaacaactgggtcctgtcacccaggaattttgggacaacctggaaaaggagactgagggacttcgccaagaaatgtccaaagatcttgaggaagtgaaagccaaagtgcaaccgtacctcgacgatttccagaagaaatggcaagaagaaatggagctgtatcgtcagaaggtcgaaccactgcgcgctgaactgcaggaaggagcgcgccagaagctgcacgagctccaggagaagctgtcgcctctcggagaagaaatgcgcgactgtgcacgggctcatgtggacgcgctgcggacccatcttgccccttactcggacgagctgcggcagagattggcggcgcggctggaggccctcaaggagaatggaggggccagactggccgaataccatgctaaggccacggagcacctgagcactctgtccgaaaaggccaagcccgccctggaagatcttcgccagggactcctgccggtgctggagtccttcaaagtctcatttctgagcgcgcttgaggaatacaccaagaagctcaacactcag

SEQ ID NO: 6308 - DNA, 801 bp, Artificial Sequence
  Description of Artificial Sequence: Synthetic coding sequence
atgaaagctgctgtattgaccttggctgttcttttcctgaccggttcccaagctcgccacttctggcagcaagacgaaccccctcaaagcccctgggacagagtgaaggacctcgctactgtctatgtcgacgtcctgaaggacagcggccgcgactatgtctcccagttcgaaggttctgctctgggtaagcaactcaacctgaagctgttggataactgggattctgtcactagcacattctccaagctcagggaacagttgggtcccgttacccaggaattctgggacaacttggagaaggaaaccgagggcttgcgtcaagagatgtcaaaggacctggaagaggtcaaggccaaggtgcagccctacctggacgacttccaaaagaagtggcaggaggagatggaactgtacaggcagaaagtcgagcccctgcgcgctgagctgcaggagggagccaggcagaagttgcacgagctccaggagaaattgtctccactgggagaggagatgcgtgactgcgctcgtgcacacgtggacgcactgaggacccatctggccccatatagcgatgagctccgtcagagactggccgctagactggaggcactcaaggagaacggaggcgcccgcttggccgaatatcacgctaaggctacagagcatctgtctaccctgtccgagaaagccaagcctgctctggaggatttgaggcagggcctgttgccagtgctcgagtcctttaaggtctctttcctgtccgcacttgaagagtacaccaagaagttgaacacccag

SEQ ID NO: 6309 - DNA, 801 bp, Artificial Sequence
  Description of Artificial Sequence: Synthetic coding sequence
atgaaagcggccgtcctaaccttagccgtcctctttctaaccgggtctcaagcgcgacatttttggcagcaggatgaacccccccaaagcccttgggaccgggtcaaagacctcgcaacagtgtacgtagacgtccttaaggattcgggaagggattacgtctctcagttcgagggatctgcccttggcaagcagctcaatctaaagctgttggataattgggatagcgtgactagcaccttctcaaaactcagggagcagttgggacctgtgacccaggagttttgggataacttggaaaaggagaccgaggggctgaggcaggagatgagcaaggatcttgaggaagtgaaggcaaaggtgcaaccataccttgatgactttcagaaaaagtggcaggaagagatggagctgtaccggcagaaggtggaaccactaagggccgagctgcaagaaggcgcccggcagaaactgcacgagctacaggaaaagctgagtcctctgggcgaggagatgagggactgtgccagagcacacgtggacgctctgagaacccacctcgccccctactcagacgagttgcgacagcggctggcggccaggctggaagcccttaaagagaacgggggcgctaggctggctgagtaccacgccaaagccactgagcacctgtccacactgagcgagaaggcgaagccagcactggaggacctccgtcagggtctcctacctgtgctcgagagctttaaagtcagctttctttccgccttagaggaatacacaaaaaagttgaacacccag

SEQ ID NO: 6310 - DNA, 801 bp, Artificial Sequence
  Description of Artificial Sequence: Synthetic coding sequence
atgaaagcggccgttcttacactggccgtgttgttcctgacaggtagccaggctcgacatttctggcagcaagacgagccccctcagagcccttgggatagagtgaaggacttggcaaccgtgtatgtggacgtcttaaaggattccggtcgcgactatgtgtctcagtttgaaggtagtgctctcggcaagcagctcaatttgaagctactagataactgggacagtgtgacgtccaccttttcaaagttgagagaacaactgggaccagttactcaggaattctgggataatcttgagaaggaaacagaggggctacgccaagaaatgagtaaggatttggaggaagtcaaggctaaggttcagccctacctggatgactttcagaaaaaatggcaggaggagatggagctttatcgtcagaaagtggagcccctgagagccgagctacaggagggggcacggcaaaagctacatgagttgcaagagaagctctcccccctaggcgaggagatgcgcgactgcgcacgagcccacgtcgatgcattaagaactcatttggccccttattcagacgaactgagacagaggctagcggcgcgtctggaggccctgaaagaaaacggaggagccagattggcagagtaccacgctaaagccactgaacacctcagcacattatccgaaaaggccaagccagccctggaagatctgcgtcaggggcttctgcctgtgctggaatcctttaaggtctcattcctgtcagctctggaggagtataccaagaaactgaacactcag

SEQ ID NO: 6311 - DNA, 801 bp, Artificial Sequence
  Description of Artificial Sequence: Synthetic coding sequence
atgaaggcagccgtgctaacacttgctgtgctgtttcttacggggagccaggcaaggcacttctggcagcaggacgaaccgccccaaagtccctgggaccgcgttaaggatctggctacagtgtacgtcgatgtgctcaaggattcagggcgggattatgttagtcagttcgaaggttccgctctcggaaaacaactgaatctgaaactgctggataactgggatagcgtgacctccaccttctcaaagttgagagagcaacttggaccagtcactcaggaattctgggacaacctcgaaaaagagaccgaaggacttagacaggaaatgtctaaggaccttgaagaagtcaaagcaaaagtgcaaccctatttggacgattttcagaagaaatggcaagaggagatggaactgtaccgacagaaggtggaacccctgcgagccgaactgcaggagggggcacgacagaaactacatgaactccaagagaagttgtctcctctgggggaagaaatgagggattgtgccagagcacacgtcgacgccttacgcacccatttagctccttactccgacgaactgcggcagaggttggccgcacgccttgaggctcttaaggaaaacggaggtgcacgtctggccgaatatcatgctaaggccaccgaacacctgagtacgctcagcgaaaaggccaagcctgcccttgaggatctgcgccaagggctcttacccgttctagaaagcttcaaggtctctttcctctctgccttggaggaatataccaagaagctgaacacgcaa

SEQ ID NO: 6312 - DNA, 801 bp, Artificial Sequence
  Description of Artificial Sequence: Synthetic coding sequence
atgaaagccgctgtactgaccctggcagtgctgtttctgactggctcccaggctcgccatttctggcagcaggacgaaccgccacagtcaccctgggatagggtgaaggacttggctacagtgtatgtcgacgttttaaaggattccggacgcgactatgtgtctcagttcgagggctccgctctggggaaacagctgaacctaaaactgctcgacaattgggactccgtgacctctaccttcagtaaactccgagaacagctgggtccagtgactcaagaattttgggataatcttgagaaggagacagaaggcctccgccaggaaatgtccaaagatctggaggaggtgaaggctaaagtgcagccatacctcgatgatttccagaagaaatggcaggaggagatggaactctaccgacaaaaggtggagcctctgcgggcggagttgcaggaaggagccaggcaaaagttacacgagctgcaagagaagctgtccccactgggcgaggagatgcgggattgcgctagagcgcatgtcgatgctctacggacccatctggcaccatacagcgacgagctcaggcagcggttggcggctcgcctggaggccttgaaggagaatggaggtgcaagattagctgaatatcacgctaaggcaacagaacacttatccaccctgagcgagaaggccaagcccgccctggaagacttgagacagggcctgctccctgttctagagtctttcaaggtgtccttcctgagtgccctcgaagaatacactaaaaagttgaacacgcag

SEQ ID NO: 6313 - DNA, 801 bp, Artificial Sequence
  Description of Artificial Sequence: Synthetic coding sequence
atgaaagcagccgtccttacgctcgcagtcctgttccttaccggcagtcaggctcggcacttctggcaacaagacgagcctccacagtcgccttgggatcgtgtcaaggatctggcgaccgtgtacgtcgatgtgttgaaagacagcggaagagactacgtctcccaatttgaaggatccgcccttgggaagcagctcaatcttaagctgcttgacaactgggattccgtgacgagcacgttttcaaagctgagggaacagttgggtcctgtgacgcaggaattctgggataacctcgaaaaggaaactgagggtttgcggcaggaaatgtcaaaggaccttgaagaagtgaaagcaaaggtgcaaccttacctcgatgacttccagaagaagtggcaagaagaaatggaactgtaccgccagaaggttgagccccttagagccgaactccaagaaggggcacgccagaaacttcatgagcttcaagagaaactgagccctctcggtgaagagatgagagattgtgcaagagcacatgtcgacgcactgcgcacccacctggcaccctattcagatgagcttcgtcaaagactcgcagcgcgtctcgaggcactgaaggaaaatggaggtgcacggctggctgaatatcacgccaaagccactgagcatctttccactctctccgaaaaggcaaaacccgcattggaggacctccggcagggacttctgccggtcctggaatcgtttaaggtttcatttcttagcgcactcgaggaatacaccaagaagctgaatactcag

SEQ ID NO: 6314 - DNA, 801 bp, Artificial Sequence
  Description of Artificial Sequence: Synthetic coding sequence
atgaaagcagcagtgcttacactagccgtgctattcctgacaggtagtcaagctcgccacttctggcaacaagacgagccaccacagtcaccatgggacagggtcaaggatttggccaccgtatacgtggacgtcctgaaggacagcggaagggattacgttagccagtttgaaggcagcgcgctgggtaaacagcttaaccttaagctgctagacaattgggactcggtaacatcgactttctctaagctaagggaacagctcggtcccgtgacacaggaattctgggataaccttgagaaggaaacggaaggtttaaggcaagagatgagcaaggatctggaagaagtgaaggcgaaggtacagccctatttggatgattttcagaaaaagtggcaggaggagatggaattgtacaggcaaaaagtagagcctctgagggcggagctgcaggagggggcaagacaaaagctccacgaactgcaggagaaactctctcccttgggggaagagatgagagattgcgcacgcgcacacgtggatgcacttcgaacccacttggctccatactccgacgaactaaggcaaaggctggccgcccgacttgaagccttaaaagagaacggcggcgccagacttgcggaatatcacgcaaaagccacagagcatcttagtactctcagcgagaaagcaaagcccgcactggaagacctgcggcaaggattgctgccagtcctcgaaagcttcaaagtgagctttctttctgccttggaggaatacaccaagaagcttaatacccag

SEQ ID NO: 6315 - DNA, 801 bp, Artificial Sequence
  Description of Artificial Sequence: Synthetic coding sequence
atgaaggcagcagttctcaccctggcggtcctgttcctcaccggaagtcaagccagacacttctggcaacaggatgagccgccccaaagtccctgggaccgcgtgaaagaccttgctacagtctacgtggacgtgctcaaggattctggccgcgattacgtgtcccagttcgagggttccgcacttggtaaacagttgaaccttaaactgctagataactgggattctgtcacctctaccttctctaagctacgggaacagttaggccctgtcacccaagagttctgggacaatttggaaaaagagaccgaaggcctgagacaggaaatgtccaaggaccttgaagaggttaaggccaaggtgcaaccatatctcgacgattttcagaagaaatggcaagaggaaatggaactgtacaggcagaaggtggagccccttcgagccgaattgcaggagggagccaggcagaagctccatgaactacaagagaaactgtccccattgggagaggaaatgagggattgcgcccgcgcgcacgtggacgccctacgcacccacctcgccccatattctgatgagctgagacagaggctcgctgcaaggctggaagcactcaaagagaacgggggggcgagacttgctgaatatcatgccaaggctactgaacacttatccaccctatccgagaaagccaaaccagcactggaggaccttcgacaggggctactgcccgtgctcgaatccttcaaggtctcctttctatcagccctggaggagtatactaagaaattgaatacccag

SEQ ID NO: 6316 - DNA, 801 bp, Artificial Sequence
  Description of Artificial Sequence: Synthetic coding sequence
atgaaggcggcagtcctgactttggccgtgctgttcctgaccggctcgcaggcgaggcatttttggcagcaggacgaaccccctcagtcaccgtgggatcgggtgaaggacctggcaaccgtgtacgtcgacgtcctgaaggactccggacgcgactatgtgagccagtttgaaggatccgcactgggcaagcagcttaatctgaaactgctggataactgggactcggtgacttccaccttcagcaaactcagagaacagctgggaccggtgactcaagaattttgggacaatctggagaaggaaaccgagggactcagacaagaaatgtccaaggatctcgaggaagtcaaagccaaagtgcagccatacctcgacgacttccagaagaagtggcaagaggaaatggaactctaccggcagaaagtggaaccgctcagagcggaactccaggaaggagcaagacaaaagctccacgaactgcaggaaaagctctcgccgctgggagaggaaatgcgggattgcgccagggcccacgtcgatgccctgaggactcatttggctccgtactccgatgagctccgccagcggctggcggcaagattggaagccctcaaggaaaacggaggagctagattggctgagtaccacgcgaaggccaccgagcacctctccactctgtcagaaaaggcaaaacctgcactcgaggacttgcgccagggactcctgccagtcctggaatcgttcaaggtgtcgttcttgtcggccctggaagaatacactaagaagctcaacacccag

SEQ ID NO: 6317 - DNA, 801 bp, Artificial Sequence
  Description of Artificial Sequence: Synthetic coding sequence
atgaaggcggccgtgcttaccttggccgtgcttttcctgaccggttcgcaagcacgtcatttttggcagcaagacgaaccgccacaatcgccctgggatagagtcaaggacctcgcaaccgtgtacgtggacgtcctgaaagattccggaagggattacgtgtcacaattcgagggttcggcgctcggtaagcagcttaacttgaagctcctggataattgggactcggtgacctcaacgttctccaaattgagagaacaacttggtcctgtgacccaagaattttgggataaccttgaaaaagaaaccgagggacttcgccaagaaatgtcaaaggatctggaagaggtgaaagccaaagtccaaccatacctggacgacttccagaagaaatggcaggaggaaatggagctgtaccgtcagaaggtggaaccactcagggcagaacttcaagagggcgcaagacaaaaacttcacgaactccaagaaaagctgtcacctctgggagaagaaatgagagactgtgcacgcgcacacgtcgacgcccttcgcacccatttggcaccttactcagatgagcttaggcagcgtcttgcggcccgcctggaggcactcaaagaaaatggaggagcgcgccttgcagagtaccacgcaaaggccaccgagcacctgtcaactctgtccgagaaggcgaagccagctctggaagatctccggcaaggtctgcttcctgtcttggagagctttaaagtcagcttccttagcgcactggaggagtacactaagaagctcaacacgcag

SEQ ID NO: 6318 - DNA, 801 bp, Artificial Sequence
  Description of Artificial Sequence: Synthetic coding sequence
atgaaggccgcggtccttacgttggcagtcctgtttcttactggatcccaagccaggcatttctggcaacaggatgaacccccacaaagcccatgggaccgggtgaaagatctcgcaaccgtgtacgtggacgtactgaaggactcaggaagagattacgtttcgcaattcgaaggcagcgcacttggaaagcagcttaatctcaagctcctggacaactgggatagcgtgacttcgacttttagcaagctgagggaacagctcggtcctgtgacgcaggaattctgggataacttggaaaaggagactgagggactgcggcaagagatgtcgaaagacctggaagaagtgaaggcaaaggtgcaaccctaccttgacgattttcagaagaaatggcaagaagagatggagttgtatagacaaaaggtggagccccttagagccgaactgcaagaaggagcccgccagaaacttcatgagctccaggagaagttgtcgcctcttggcgaggaaatgagggattgtgctcgggcacacgtggacgctttgcgaactcatctggcaccgtatagcgatgaactcagacaacgcctggccgcacgcctcgaagcattgaaggaaaatggcggcgcaagattggctgaataccacgcaaaggccactgaacatctctccaccctgagcgaaaaggcaaaacccgcactggaagatctgagacaaggtttgctgccagtccttgaatcgttcaaggtgtcctttctgtcagcgctggaggaatacaccaaaaaacttaacacccag

SEQ ID NO: 6319 - DNA, 801 bp, Artificial Sequence
  Description of Artificial Sequence: Synthetic coding sequence
atgaaggccgctgttttaacactggcagttctgtttttgacaggctcccaggcgagacatttttggcagcaggatgagcctccgcagagcccctgggatcgggtcaaggacctggccacggtttatgtcgatgtattaaaggactccgggagagactacgtcagccaatttgaaggttcagcactgggcaagcagcttaacctcaaactactggacaactgggattcggtgactagcacattctccaagctgagggaacagcttggacccgtgacgcaggaattctgggataacctcgaaaaggagaccgaggggctgcgtcaagaaatgtctaaggatttggaagaggttaaggccaaggtccaaccttacctggatgacttccaaaagaagtggcaggaagagatggaattatatcgtcagaaggtagaaccattaagagccgaactgcaggagggggcgcgccaaaagctgcatgagctccaagaaaagctgtcccctctgggggaagagatgcgcgattgtgcccgcgcacacgttgacgctctgcgtacacacctggccccatattcagacgaactcagacagaggcttgctgctagactggaggccctgaaagagaatgggggagcccggctcgcagagtatcatgccaaggctaccgaacacctgtcgactctatcggagaaggctaaacctgcgttggaggatctaaggcaaggcctgctgcctgtgctggaaagctttaaggtgagctttctgtcggctctcgaggaatacactaaaaaactgaacactcag

SEQ ID NO: 6320 - DNA, 801 bp, Artificial Sequence
  Description of Artificial Sequence: Synthetic coding sequence
atgaaggcagctgttttgaccctcgccgtcctgttcctaaccgggagccaagctaggcatttctggcagcaggacgaacctccccaaagtccatgggatcgggtgaaagacctagctacagtctacgtcgacgtgttaaaggatagcggccgcgattacgtgtcacagttcgagggctccgctttgggtaaacagctgaacttaaagctgcttgataactgggactcggtgacatcaaccttctccaagttgcgcgagcagctagggcctgtcacacaggaattttgggataacctcgagaaagagactgaagggttgcgccaggaaatgtctaaagatctcgaggaggtcaaagccaaggtgcagccttacctggacgatttccagaagaagtggcaggaagagatggagctgtatcggcagaaagtggaacccctgagggccgaactgcaagaaggcgcgcgtcagaagcttcatgagctgcaagagaaactttcaccactgggagaagagatgcgagattgcgctcgcgcgcacgtcgatgcactgcggacacacctggcaccctatagcgatgagctccgacagcggctggccgccaggctggaggctctgaaagagaacgggggcgctcggctggccgagtaccatgccaaagccaccgagcacctgtctaccctgtccgagaaagccaaacccgccctcgaggatctgaggcaggggctcctgccggtcctggagtccttcaaagtgtcgttcctgagcgcgctggaggaatacacgaagaagctgaatacccaa

SEQ ID NO: 6321 - DNA, 801 bp, Artificial Sequence
  Description of Artificial Sequence: Synthetic coding sequence
atgaaagctgcagttttaactctagctgtattatttttaactggaagtcaagctagacatttttggcaacaagatgaaccaccacaatcaccatgggatagagttaaagatttagcaacagtatatgttgacgttttaaaggatagtggtagagattatgtatctcaatttgaaggatcagctttaggaaaacaacttaacttgaaattgttggataattgggactctgttacttctactttctcaaaactaagagaacaacttggtccagttactcaagaattttgggataatcttgaaaaagaaactgaaggacttagacaggagatgagtaaagatttagaagaagttaaggcaaaagttcaaccatatcttgatgatttccaaaaaaaatggcaagaagaaatggaattatatagacaaaaggttgagcctttaagagctgaattgcaagaaggggcaagacaaaaattacatgaacttcaagaaaagcttagtccattaggagaagaaatgagagattgtgcaagagcacatgttgacgctttaagaactcatttagcaccatattcagatgaattaagacaaagattagccgctagattagaagcattaaaggaaaacggaggtgcaagattagctgaatatcacgctaaagcaacagaacatttatccactttatctgaaaaagcaaagccagcattagaggatctaagacaaggacttttaccagttttagaatcatttaaggtttcattcttatctgctttagaagaatatacaaagaagttaaatactcag

SEQ ID NO: 6322 - DNA, 801 bp, Artificial Sequence
  Description of Artificial Sequence: Synthetic coding sequence
atgaaggcagccgtgcttacgctcgcagtcctttttctcactgggtcccaagcccgccatttttggcaacaggatgagcctcctcagagcccctgggatcgcgtgaaggatcttgccactgtgtacgtggacgtgttgaaggattcaggaagagattacgttagccagtttgaaggatcggctcttggaaaacagcttaatctgaaactcctcgataactgggactcagtcacctctaccttctccaaactgagggaacaactgggccctgtcactcaagagttctgggacaaccttgaaaaggaaaccgagggacttagacaggaaatgagcaaggatctcgaagaagtgaaggcgaaggtccagccatatctggacgactttcaaaagaagtggcaagaagagatggagctttaccggcagaaggtggaacctctgcgggcggaacttcaagaaggtgcacggcagaaactgcatgagctgcaggaaaagctctctcctctgggtgaggaaatgcgtgattgtgcgagggcccatgtcgatgcactcagaacccacctggcaccatactccgatgagctcagacagcgacttgcagcgaggcttgaagcactcaaagaaaacggaggggcgcgccttgcagagtaccacgccaaagcaacggagcatctgtccactctttcagagaaggccaaaccagcacttgaagatttgaggcaaggtctgttgcccgtgcttgagtctttcaaagtgagctttctgtccgcacttgaagaatacactaagaagctgaacacccag

SEQ ID NO: 6323 - DNA, 801 bp, Artificial Sequence
  Description of Artificial Sequence: Synthetic coding sequence
atgaaagccgcggtccttacactggctgtgttgtttttgaccggtagtcaagcaagacacttctggcagcaagatgagccaccacaatccccttgggacagggttaaggacctcgcaacagtatacgtggatgtgctgaaggactccggccgtgactacgtgtctcagttcgagggctccgctctggggaagcagctcaatttgaagcttcttgataactgggacagcgttacaagtacgttctcaaagctacgcgaacagctgggccccgttacccaggagttctgggacaacctggagaaagagaccgagggattaaggcaggagatgagcaaagatttggaggaggtgaaggccaaagtgcagccatacctggacgacttccagaagaagtggcaggaggagatggaactctatcgccagaaggtagaacctttgcgggctgagcttcaagagggagcccgtcagaagttacatgagctgcaggagaaattatccccactcggggaggaaatgcgcgactgtgccagggcacacgtggacgcactgagaacgcacctggcaccttatagcgatgaactcagacagagattggctgcgcggctcgaggcactgaaagagaatggcggggctcggctggcagaataccatgccaaggccaccgagcatctgtccacactatctgaaaaggccaagcccgctttggaggacctgcggcagggtctgcttcccgtgctggagtcttttaaagtcagtttcctatccgctctggaggagtatactaaaaaactgaacacccag

SEQ ID NO: 6324 - DNA, 801 bp, Artificial Sequence
  Description of Artificial Sequence: Synthetic coding sequence
atgaaagcggctgtcctcacactggccgttctgttcctcactggctcacaagcaagacatttttggcaacaggatgaacctccgcagagtccatgggacagggtgaaagatctcgcaacagtgtatgtagacgttctgaaggacagtggaagagactacgttagccagttcgaggggagcgcactgggcaaacagctgaatctgaaattacttgacaactgggatagcgtcactagcacgttctcaaagctgcgggaacagctcggccccgtgacacaagaattctgggataatctggagaaggagactgaagggcttaggcaggagatgtccaaggacctcgaggaagtgaaggctaaggtgcaaccttatctggatgacttccagaaaaagtggcaagaagaaatggagctgtacaggcagaaggttgaacccttgcgggccgagttacaggaaggagcgcgccagaagctgcatgagctccaagagaaattgagcccattgggtgaggaaatgagggattgcgctagagcccatgttgatgcccttaggacccatctcgccccatattcagacgagctgcggcagcggctggctgccagactggaggctttaaaagagaatgggggagccaggctggctgaataccacgcgaaagcaacagaacacctgagcacattgagtgaaaaggctaagccggctctcgaagatctgcggcaaggcctgctgccggtgctggagtcctttaaggtaagctttcttagtgccctggaagaatacacaaagaagctgaacacacag

SEQ ID NO: 6325 - DNA, 801 bp, Artificial Sequence
  Description of Artificial Sequence: Synthetic coding sequence
atgaaggcggccgtgctgacactggctgtgctctttctcacgggcagtcaagcaaggcatttttggcagcaggatgagcctccacaaagcccatgggatcgcgtcaaggatctggcaacggtgtatgtggacgtactgaaggacagcggccgggattatgttagtcagtttgagggcagcgctctgggaaagcaactcaatctgaagctgcttgataactgggattccgtaacctctaccttttccaaactgcgagaacagctgggtcccgtcacgcaggaattctgggacaatctcgaaaaggagaccgaaggcctgaggcaggagatgagtaaagacttggaagaagtaaaagccaaggtgcagccctatctggatgatttccagaagaagtggcaggaagagatggaactctatcgccagaaggtcgagcccctgagggcagaactccaggaaggcgctcgacagaaattgcatgagctgcaggagaaactctccccccttggagaagagatgcgggactgtgctcgggcgcacgttgatgctctgaggacacacctcgccccctactccgacgaattgcgacagcgcctcgccgccagactggaagcactgaaggagaacggaggtgctaggttggctgaatatcacgcaaaggcaactgaacatctttcaacactgagcgaaaaggcgaagccagccctggaagacctgaggcagggtctccttccagtgcttgagtcatttaaggttagtttcctgtctgctctggaagagtataccaaaaaactgaacacacag

SEQ ID NO: 6326 - DNA, 801 bp, Artificial Sequence
  Description of Artificial Sequence: Synthetic coding sequence
atgaaggcagcggtgctgactctggcggtgttgttcctcacgggcagccaggcgcgccacttttggcaacaagatgagccaccgcagtcgccctgggatcgggtgaaagacctggccaccgtctacgtcgacgtgctgaaagactccggacgggactacgtctcgcaattcgagggaagcgcgctgggaaaacagctgaatctgaaactgctcgataattgggattcagttacctcgacgttcagcaaactccgcgaacagctgggacctgtcacgcaggaattctgggacaatctcgaaaaggaaaccgagggactgcgccaagagatgtctaaagacctggaggaagtgaaggcaaaggtgcagccgtacctggacgatttccagaagaagtggcaagaagaaatggaactgtacaggcagaaagtggagcccctgagagctgaactgcaggaaggggcccgccagaagctccacgaactccaagagaaactcagcccactcggtgaggagatgcgcgattgtgccagagcccacgtggacgccctgcggactcatctcgctccgtactcggatgaactgcgccagcgcctggcagccaggttggaggccctcaaggaaaacggaggggcacgcctggcggagtaccatgcaaaggccactgaacacctctcaactctgtccgaaaaagccaagccggcgctcgaagatctgcgccagggactcctgccggtcttggaatcgttcaaagtgtcatttctttcggccctggaagaatatactaagaagctgaacactcaa

SEQ ID NO: 6327 - DNA, 801 bp, Artificial Sequence
  Description of Artificial Sequence: Synthetic coding sequence
atgaaggcagccgttctaactctcgcggtattgtttcttacagggtctcaggcccgtcatttttggcagcaggatgaacctccacaatcaccctgggaccgagtgaaggatcttgctacggtgtatgtggacgtgctgaaggacagcggaagagattacgtgtctcagttcgaaggatctgccttaggcaagcaattgaatttgaagctgttggacaactgggattctgttacatcgacgttttccaaattgcgagaacaattaggacccgtcacccaagagttctgggacaatctggagaaggagacggaaggtttacgccaggagatgtctaaggatcttgaggaagttaaggcgaaggtgcagccgtatctcgacgacttccagaagaaatggcaagaagaaatggaactgtacagacaaaaggtcgagcctcttcgcgccgaactgcaagagggcgcacgccaaaagctgcatgaactacaggaaaaactctcccccttgggggaagaaatgcgtgattgtgctcgcgcgcatgtcgacgccctaagaacccatctggccccctattccgatgaactgcgccaacgccttgcggctcgcttggaagcattgaaagaaaatggaggtgcgcgcctcgccgaataccacgcaaaggctactgaacatcttagcactctctccgagaaggccaagcctgccctggaggatctgcgacagggactcctcccagttttagaaagcttcaaagtgtcttttttgtcagcgcttgaagagtataccaagaaacttaacacacag

SEQ ID NO: 6328 - DNA, 801 bp, Artificial Sequence
  Description of Artificial Sequence: Synthetic coding sequence
atgaaggccgctgtgctcactctcgccgtgctcttcctgacaggcagccaggcccgccacttttggcagcaagatgaacccccgcagagcccttgggaccgtgtaaaggacctggcaacggtatacgtggacgtgcttaaggactcaggacgagactatgtgagtcagttcgagggtagcgccctaggcaaacagctcaaccttaaactgctggacaattgggacagcgtcactagtacgttctcgaaattgcgtgagcaactgggacccgtaacacaagaattttgggacaacctcgagaaggaaactgagggcctcagacaggaaatgagcaaagacttggaggaggtgaaggccaaagttcaaccatacctggatgattttcagaagaaatggcaggaagaaatggagctctatcgtcaaaaagtggagccattgagagcggaactccaggaaggggcccgtcaaaagttgcacgagctacaagagaaactctcacccttgggggaggagatgcgcgactgtgcccgggctcatgtcgatgccctgcgtactcacttggccccctatagtgatgagctgagacagagactcgctgctcggttggaagccttgaaagagaatggcggggcacggctggcagagtatcatgcgaaggccaccgagcatttgtccaccttgagcgaaaaggctaagccggcattagaggacctacgacagggactgctgccggtgctggagagcttcaaggtgtcctttctgtctgctctggaagaatacacaaaaaagcttaacacacag

SEQ ID NO: 6329 - DNA, 801 bp, Artificial Sequence
  Description of Artificial Sequence: Synthetic coding sequence
atgaaagcggcggttttaacgctagcggtattatttttaacgggttcgcaagcgcgacatttttggcaacaagatgaaccgccgcaatcgccgtgggatcgtgtaaaagatctagcgacggtttatgttgatgttctaaaagattcgggtcgtgattatgtttcgcaatttgaaggttcggcgttaggtaaacaactaaatttaaaattactagataattgggattcggtaacgtcgacgttttcgaaattacgtgaacaactaggtccggttacgcaagaattttgggataatttagaaaaagaaacggaaggtttacgtcaagaaatgtcgaaagatttagaagaagtaaaagcgaaagttcaaccgtatctagatgattttcaaaaaaaatggcaagaagaaatggaattatatcgtcaaaaagtagaaccgctacgtgcggaattacaagaaggtgcgcgacaaaaactacatgaactacaagaaaaattatcgccgttaggtgaagaaatgcgtgattgtgcgcgtgcgcatgtagatgcgttacgtacgcatttagcgccgtattcggatgaactacgtcaacgtctagcggcgcgattagaagcgttaaaagaaaatggtggtgcgcgattagcggaatatcatgcgaaagcgacggaacatttatcgacgctatcggaaaaagcgaaaccggcgctagaagatctacgtcaaggtttactaccggtattagaatcgtttaaagtatcgtttctatcggcgttagaagaatatacgaaaaaattaaatacgcaa

SEQ ID NO: 6330 - DNA, 801 bp, Artificial Sequence
  Description of Artificial Sequence: Synthetic coding sequence
atgaaggccgctgtgctcacccttgccgtgctgttcctgactgggtcacaagctaggcacttctggcagcaagatgaaccaccgcagtccccttgggatcgcgtgaaagacttggctactgtgtacgtcgatgtgctgaaggactcaggccgggattacgtttcgcagttcgaaggatccgcgctcggcaaacaacttaacctcaagctgcttgacaattgggacagcgtgacctccacgttctccaagctgcgggagcaactgggaccggtgactcaggagttctgggataacctcgaaaaggaaacggaaggactccgccaagagatgagcaaggatctggaggaggtgaaggcaaaagttcaaccttacctggacgactttcagaaaaagtggcaggaagaaatggagctgtatagacagaaggtcgagccgctgcgagcggagctccaggagggtgcccgccaaaagttgcatgagctccaggaaaaactgtctccacttggcgaagagatgcgcgactgtgcccgggcgcatgtggacgccctccggacccacctggctccgtactctgatgagctccgccagcgcctggcagcacgacttgaggcactgaaggaaaatggaggggccaggctggccgaataccacgcaaaggcaaccgaacacctgtcgactctgagcgaaaaggctaagcctgcccttgaggaccttaggcagggactcctcccggtcctcgaatcgtttaaggtgtcattcctttcagcactggaggaatacaccaaaaaactgaacacccag

SEQ ID NO: 6331 - DNA, 801 bp, Artificial Sequence
  Description of Artificial Sequence: Synthetic coding sequence
atgaaggccgcagtcttgactctggccgtactgtttctgaccggcagtcaagcccgccacttttggcagcaagatgagcctccccagagcccttgggatcgcgtcaaagatctcgccactgtgtatgtggacgtcctgaaggactccggaagggactacgtttcccagttcgaggggtccgccctgggcaaacagctaaacctgaagctgctggataactgggattcagtaacaagtactttctctaaactccgagagcagctaggtcccgtcactcaggaattctgggacaatctggaaaaggagactgagggtctgcgacaggagatgtctaaagatttagaagaggtcaaggctaaggtgcagccctaccttgacgacttccagaagaagtggcaggaggagatggagctgtacagacagaaagtggagcccctgcgtgccgaactgcaggagggggcacgtcagaaactccatgagcttcaggagaagctctctcccttaggcgaagaaatgagggactgtgcgcgtgcccacgtggatgccctcaggacccacctcgccccttatagcgacgagctccgtcagcgtttggcagcccggctggaggccttaaaggagaatgggggcgcccgactggccgaataccatgccaaagccaccgaacacctaagcacgctgtctgaaaaagccaagcctgcactggaggatctgcggcagggtcttctgcccgttttggagtctttcaaggtgtcattcttatcagccctcgaggaatatactaaaaagctgaacacccag

SEQ ID NO: 6332 - DNA, 801 bp, Artificial Sequence
  Description of Artificial Sequence: Synthetic coding sequence
atgaaagcagctgtgctgacgttggcggtgctctttttgaccggctctcaggcacgccacttctggcagcaggatgagcctccacagagcccctgggatagggtaaaggatttggccacggtgtatgtcgatgtcctgaaagattccgggcgcgactatgtttcccaatttgagggctccgcactaggcaaacaactgaacctcaaactgttggacaattgggattctgtcactagcactttctctaaactgcgagagcagttgggcccagtgacgcaggagttctgggacaacctggagaaggaaaccgagggactgcgccaagaaatgtcaaaagacctggaggaagtgaaagcgaaagtgcagccgtatttagatgatttccagaaaaagtggcaggaggagatggagctgtaccgccagaaggtagagcctctgcgtgcggagctgcaggagggcgctcgacagaagctccacgagctgcaagaaaagctgtcaccattgggagaggaaatgcgcgactgtgcgcgcgctcatgtcgacgctctgcgcactcatcttgcgccgtattcggatgaactgcgacaaagactcgcggcacgcctcgaggccctgaaggaaaacggtggtgcacgcctggctgaataccatgccaaggcgaccgaacacttaagcaccctttctgaaaaggcgaagccggctttggaagatctgcgacaaggcctgctgccggtcctggagtcctttaaagtctctttcctgagcgctctggaggagtatacaaagaagttgaatactcag

SEQ ID NO: 6333 - DNA, 801 bp, Artificial Sequence
  Description of Artificial Sequence: Synthetic coding sequence
atgaaggcagcggtgctcaccctggccgtgctttttctcaccggttctcaagcacggcacttttggcagcaagacgaaccccctcaatccccctgggaccgggtcaaggatctggcgaccgtatacgtggatgtgctgaaagattccggaagggactacgtgtcccaattcgagggctcagccctgggaaagcagcttaatctgaaacttcttgacaattgggactcggtgacgtcaactttttcaaagctcagggaacaacttggtccagtgactcaggaattttgggataacctcgaaaaggaaactgaaggactgcgccaggagatgtcgaaagatctggaggaggtcaaggccaaggtgcagccgtacctggacgatttccaaaagaagtggcaggaagagatggaactctacaggcaaaaagtggaaccacttcgtgccgaactgcaagagggcgcgcgtcaaaagctgcacgagcttcaggaaaaactgtcaccgcttggagaggaaatgagggattgtgcaagagctcacgtggatgccctgagaactcatcttgcaccgtacagcgacgaattgcgtcaacgcctcgccgcaaggctcgaggcactcaaggaaaacggaggagcacggcttgcagaataccatgcaaaagcaactgaacatctttcgactctttccgagaaggcaaagccagctcttgaggaccttcggcaaggccttctgcccgtgctcgaatcctttaaagtgagcttcttgtcggcactggaagaatacaccaagaagttgaacactcag

SEQ ID NO: 6334 - DNA, 801 bp, Artificial Sequence
  Description of Artificial Sequence: Synthetic coding sequence
atgaaagcggccgtgctgactctggccgtgcttttcctcaccggatcgcaggctagacatttctggcagcaggacgaaccgccgcagtcaccttgggaccgcgtgaaggatttggcgacggtctacgtggatgttctcaaagactcgggaagagactacgtgtcacagttcgagggatcggcccttgggaagcagctgaacctcaaactccttgataactgggattccgtgacctcaactttctccaagctgcgcgaacaactgggcccggtgacccaggagttctgggacaacctggaaaaggagactgaaggactgaggcaagagatgtccaaggacctggaggaagtgaaagccaaggtgcagccgtacctcgacgactttcaaaagaaatggcaggaagagatggagctgtacaggcagaaggtcgagccactgcgtgccgagctgcaggaaggcgctcggcaaaagttgcatgagttgcaggaaaaattgtcccctctcggagaggaaatgagagactgcgcacgggctcacgtcgatgccctgcgcacccacctggcgccctatagcgatgagctccggcaacgcctcgcagcccgcctggaagctctgaaggaaaatggcggtgcgcggctggccgagtaccacgcaaaggccaccgaacacctcagcactctgtcggaaaaggcaaagccagcactcgaggaccttcgacaagggctgctcccagtcctggaatcgttcaaggtcagctttctctctgcgctggaagaatacaccaaaaagctgaatactcaa

SEQ ID NO: 6335 - DNA, 801 bp, Artificial Sequence
  Description of Artificial Sequence: Synthetic coding sequence
atgaaagcggccgtgctgactctcgccgtgctcttcctgaccgggtcgcaggcccgacacttttggcagcaggatgaaccaccacagagcccatgggatcgggttaaagatcttgccaccgtctacgtggacgtcctgaaggactcgggacgcgactacgtgtcacagttcgaaggatcagccctgggaaaacaactcaatcttaagctcctggacaattgggattcagtgacctcgaccttctcgaagttgagggaacagttgggaccagtgacccaagaattctgggataacctggaaaaggagactgagggtctgcgccaggagatgtctaaagatctggaagaggtcaaagccaaggtgcaaccatacctggatgactttcaaaagaaatggcaggaggagatggagctctacagacagaaagtggaaccactgcgggccgagctgcaggagggagcgagacagaagctgcatgagctgcaggaaaagttgtcacccctgggggaagaaatgagggactgcgcacgcgcccacgtcgacgccctccgcacccacctggctccatactcagacgaattgagacagcgcctcgccgccagactggaagcgctgaaggaaaatggaggggcacgcctcgcagagtaccatgcaaaggcgactgagcatctgtcgacgttgtccgagaaggcaaagccggccctcgaggatctgagacaaggcctgctgcctgttctggagtccttcaaggtgagctttctgtccgctttggaggaatatactaagaaacttaatacccag

SEQ ID NO: 6336 - DNA, 801 bp, Artificial Sequence
  Description of Artificial Sequence: Synthetic coding sequence
atgaaagctgctgttctcacgctggcggtactgttcctaaccggctcacaggctaggcacttctggcagcaggatgagccgccacaaagcccctgggatcgggtgaaggatctggccacggtttacgtcgatgtgctgaaggattcgggcagagattacgtaagtcaatttgaagggtctgcactaggcaagcaattaaatttgaagcttcttgacaactgggattcggtgacaagtaccttttccaagttacgagagcagctagggcccgtaacccaggaattctgggataatcttgagaaagaaactgagggattgcgacaggaaatgtcaaaagaccttgaagaagtaaaagcgaaagttcagccttatctggatgactttcagaagaagtggcaggaggagatggagttgtatagacagaaggtggagcccctaagagccgaactgcaggaaggcgctcgacagaagctgcacgagcttcaggaaaagctctcccccctaggcgaagagatgagggactgtgctcgagcccacgtcgacgccttgagaactcacctggccccatattcagacgagctgcgacagcgattggctgctcgattagaggccctgaaagagaacggtggtgctcggctcgctgaataccatgccaaggcaactgaacacttgagtactctctccgagaaggctaaaccagccttggaggatctgagacaaggcttgctccccgttcttgagtccttcaaagtgtcctttttatccgcacttgaagagtatacaaaaaagttaaatacacag

SEQ ID NO: 6337 - DNA, 801 bp, Artificial Sequence
  Description of Artificial Sequence: Synthetic coding sequence
atgaaggctgccgtccttacactggctgtgctgtttttgactgggtcccaagcacgccacttttggcaacaggacgaaccacctcagtcaccctgggacagggttaaggacctggctactgtttatgtagatgtgctgaaagacagcggccgtgattatgtgtctcaattcgaaggcagcgctctgggaaagcagcttaaccttaaactgcttgataactgggattccgtcacatccactttcagtaaactcagggaacaactgggaccagtgacccaagaattctgggataacctcgagaaggagacagagggactgaggcaagagatgagcaaggacctcgaggaggtgaaagcaaaggtccagccgtacctggacgatttccagaaaaagtggcaggaggaaatggaactgtataggcaaaaagtggagcctctccgcgcagagctccaagaaggtgcgagacaaaaactgcatgaactgcaagagaagttaagcccactgggcgaggagatgagagactgtgctcgcgctcacgtcgacgccctccggacccatctcgccccctattcagatgagctccggcaaagactggcagcccggctggaagccctgaaggaaaacggtggagctcggctggccgaataccacgcgaaggctactgagcacctctctaccctctctgagaaggcgaagcctgctcttgaagatctgagacagggcctactcccggtcctggaatcttttaaagtttcttttctcagcgctttggaggaatacactaagaaactgaacactcaa

SEQ ID NO: 6338 - DNA, 801 bp, Artificial Sequence
  Description of Artificial Sequence: Synthetic coding sequence
atgaaggcggcggtgctgaccttggcagtcctcttcctgaccggatcacaggcgcgccacttttggcagcaggacgaacctccgcagtcaccgtgggatcgcgtgaaagaccttgccactgtgtacgtcgatgtgttgaaagattccggcagggattacgtgtcccaatttgagggtagcgccctgggaaagcaacttaacttgaagctgctggataactgggacagcgtcactagcacgttcagcaagctgcgggaacagctcggacctgtgactcaggagttctgggacaacctggagaaggaaactgaaggcctgagacaggagatgtcaaaggacctcgaggaagtgaaggcgaaggtgcagccgtaccttgatgattttcagaagaagtggcaggaagaaatggaactgtaccgccagaaagtggaacctctgagagccgaacttcaggagggagctcggcagaagctccatgaactccaagagaagttgtcacctctgggagaggagatgagggactgcgcgcgcgcccatgtggacgcgctcagaacccacctggcaccgtactccgacgaactgcggcagagacttgccgcgcggcttgaggcgctgaaagagaatggaggagctcggctggcagagtaccacgccaaagccactgaacatctttcgaccctttcggagaaggccaagcccgccctggaagatctgcggcaggggctcctgcctgtgctcgaatctttcaaggtgtcattcctgtccgcgctggaggagtacaccaagaaattgaacacgcaa

SEQ ID NO: 6339 - DNA, 801 bp, Artificial Sequence
  Description of Artificial Sequence: Synthetic coding sequence
atgaaggctgcggtcctgaccctagcggtgctattcctgaccggctcacaggctcgccatttctggcagcaagatgagccaccccagtctccatgggatcgagtgaaggacctcgccaccgtctacgtagacgtgctaaaagacagtgggcgtgactacgtgagtcaatttgagggcagcgctctgggcaaacagctcaacctcaaactgttagataattgggacagtgtgacttccacgttctctaaactgcgggaacagttaggcccagtcactcaggaattctgggataacctggagaaagaaacagaggggctacgccaggagatgagcaaggatctcgaagaagtgaaggctaaggtccagccatatctcgatgactttcagaagaagtggcaggaggaaatggagctgtacaggcagaaagttgaacctttgagggctgagttgcaggagggagcaaggcagaagctccacgaactacaggagaaactgtcacccctcggcgaagagatgcgcgactgcgcccgcgcccacgtggacgcactccgaactcatttggcgccgtatagcgatgaactccggcagcgtctagctgcaagactggaggccctgaaggaaaacggcggagcccgtctcgctgaataccacgccaaggcaacagaacatctgagcactctgtccgaaaaggccaaacccgctctggaagacctgcggcaggggcttctccccgtgctcgagtcatttaaagtgagctttttatctgctctggaggagtatacgaaaaaacttaatactcag

SEQ ID NO: 6340 - DNA, 801 bp, Artificial Sequence
  Description of Artificial Sequence: Synthetic coding sequence
atgaaggccgctgtgctgactctggcagtgcttttcctgaccggctctcaagccaggcacttctggcagcaggacgagcctccacagtccccgtgggaccgcgtcaaagacctggcaaccgtgtacgtggacgttctgaaagattctggacgagattacgtgtcccagttcgagggctctgcacttggtaaacagctgaacctcaagttgctggacaactgggactcggtgacttcgactttcagcaagctgcgcgaacagctcggccctgtcacccaagaattctgggacaaccttgagaaagaaacggaaggattgagacaagaaatgtcaaaagatctcgaagaggtgaaggctaaggtccaaccatacctcgatgactttcagaagaagtggcaagaagaaatggagctctaccgtcagaaggtggagccacttagggccgagcttcaggaaggagccagacagaagttgcacgagctgcaagagaaattgagcccgctgggagaagaaatgcgcgactgcgcccgggcccacgtcgacgcgcttcgaactcatctggcgccctactcggatgaattgcgccagaggctggcggctcggctcgaagcgctcaaggagaatgggggagcccgcctggcagagtatcatgccaaggccaccgaacacttgtcaactctgtccgagaaagctaagccggccctcgaggatttgcggcagggcctcctgccggtgctcgagtcgttcaaggtgagctttctgtcagccttggaagaatacacgaagaagctcaatacccaa

SEQ ID NO: 6341 - DNA, 801 bp, Artificial Sequence
  Description of Artificial Sequence: Synthetic coding sequence
atgaaggccgcggttcttaccttggctgtgctgttcctgactggaagccaagcacggcacttctggcagcaagacgaaccgccgcaatccccgtgggatagagtcaaggatctcgcgaccgtgtacgtggatgtgcttaaggattcagggcgcgattatgtgtcccagtttgagggatccgcactgggaaagcagctcaatctgaagctgctggacaactgggactccgtgacctccaccttctccaagttgcgggaacagctgggaccggtcactcaggaattttgggataacctcgaaaaagaaaccgaaggattgcgccaggaaatgtcgaaggacttggaggaggtcaaggccaaagtgcagccatacctggacgacttccaaaagaaatggcaggaggaaatggaactctatcgccaaaaagtggaaccgcttcgggcagaactccaagagggcgctcgacaaaaactgcatgagctgcaggagaagctcagcccactgggcgaggagatgcgtgactgcgcacgcgcccatgtggacgcgcttcgcacccacctggctccgtattcggatgaactgagacagcgtttggcggcaaggcttgaagctctgaaagaaaacgggggtgcccgcctcgcagaataccacgccaaagccacggaacacctgtcgactctcagcgaaaaggccaagcccgcgctcgaagatctgaggcaaggcctgcttcccgtccttgagagtttcaaggtgtccttcctcagcgcactggaggaatacactaagaaactgaatacccag

SEQ ID NO: 6342 - DNA, 801 bp, Artificial Sequence
  Description of Artificial Sequence: Synthetic coding sequence
atgaaggccgcagtgctgaccctggcagtgttgttcctgacgggaagccaggcacggcatttctggcagcaggatgaacccccacaatcaccctgggaccgcgttaaagacctcgcaaccgtttatgtggatgttctgaaagattctggacgggattatgtgtctcagttcgagggctctgccctcggaaaacaactgaacctgaagctgttagacaattgggacagcgtcacctctacgttctctaaactcagggaacagctgggccctgtgacccaggagttctgggacaacctggagaaggaaaccgagggtctgagacaggagatgtccaaggatcttgaggaagtgaaggcaaaggttcagccctacctggacgacttccagaagaagtggcaggaggaaatggagctctacaggcagaaagttgaaccattgagggccgagctgcaggaaggagcacgccaaaaattgcacgagcttcaggagaagcttagcccccttggagaggaaatgcgcgactgtgcacgggctcacgtcgatgcccttagaacccatctcgccccctattctgatgagctcaggcagagactggccgctagacttgaggccctcaaggaaaacggaggggcacgcctcgccgagtaccacgcaaaagccacggagcatctgtccactctctccgaaaaagcaaagcccgctcttgaagatctgaggcaaggactgttaccggtgctggaatctttcaaagttagtttcctgtccgcgctggaggaatacaccaaaaagctgaacactcag

SEQ ID NO: 6343 - DNA, 801 bp, Artificial Sequence
  Description of Artificial Sequence: Synthetic coding sequence
atgaaggccgccgtcctgacccttgccgttctgttcctgaccggaagccaggcccggcacttttggcagcaggatgagcctccccagagcccctgggatagggtcaaagaccttgccacggtgtatgtggatgtgttgaaagattccggtcgagactatgtgtctcagtttgaaggaagcgcccttggcaagcagctcaatttgaagcttctggataattgggattcagtcacatccactttctctaaactccgcgaacagctgggaccggttactcaggagttttgggataatcttgaaaaggaaactgagggtctgaggcaggaaatgagtaaggaccttgaagaagtaaaagcaaaagtgcagccatacctggatgactttcagaagaagtggcaagaggaaatggaactctatagacagaaagttgaaccattgagagcagagctccaggagggcgcgcgccagaaactgcacgaacttcaagaaaaactgtcccccctgggcgaggagatgagagattgtgccagagctcatgtcgacgcccttaggacacacctggctccatatagtgatgagctcaggcagagacttgccgcccgcttggaggcactcaaggagaacgggggtgcccggctcgcagaataccacgctaaggccaccgaacatctgtctacactgagtgagaaagccaagccggcacttgaggacctgcgacagggtttgttgcccgttctcgagagcttcaaggtgagcttcctgagtgcgttggaggaatacaccaaaaaactgaacactcag

SEQ ID NO: 6344 - DNA, 801 bp, Artificial Sequence
  Description of Artificial Sequence: Synthetic coding sequence
atgaaagctgcagttcttaccctggccgtgttgttccttaccggttctcaagctcgtcatttctggcaacaggatgaaccaccgcaatcaccttgggatagggtgaaagacctcgccacggtttatgtggatgttttgaaggatagcggaagggactatgtttcacaattcgaaggttccgcgttgggaaaacaattgaatctaaagctattagacaattgggattccgttactagcaccttctccaagcttcgggagcaactcgggcccgtcacacaagaattctgggataacttggaaaaagagaccgagggtttgagacaagagatgtctaaagatttggaggaggtgaaggctaaagttcaaccttatcttgacgattttcagaagaagtggcaagaggagatggagctgtataggcaaaaggttgagcccttgagagctgagctacaagagggggctagacagaagctgcacgaacttcaagagaagttgagccctcttggagaagaaatgagagattgtgcaagagctcatgttgatgcattgagaactcacttagcaccttatagcgatgaacttcgtcagcgattagcagcccgattagaggctctgaaagagaatggaggagcacggctcgctgaatatcacgctaaggccactgaacatctttcaacgttgagtgagaaggctaagcccgctctggaagatttgaggcagggacttcttcctgtgttggaaagctttaaagtcagcttcctttcagcgttagaagagtataccaagaagctcaatacccaa

SEQ ID NO: 6345 - DNA, 801 bp, Artificial Sequence
  Description of Artificial Sequence: Synthetic coding sequence
atgaaagccgcggtgctcacattagcggtgctgtttcttaccggctctcaggctagacatttttggcagcaggatgaacccccacagtctccttgggaccgggtgaaggacttggccactgtgtacgtagatgtcctgaaagactccgggcgagattatgtgagccagttcgagggaagcgcgctcggcaagcaattaaaccttaaactgttggacaactgggattccgtcacatccactttctcaaaactgcgcgaacaactgggccccgtgacccaagagttctgggataacctcgaaaaggaaacagaaggattgcggcaggagatgtctaaggacctggaggaggtgaaggctaaggtgcaaccctacctggatgacttccagaaaaaatggcaggaggagatggagttataccggcagaaagtcgagcccctcagggctgagctgcaggagggagcacgccaaaaactccatgagctgcaggagaagctgagcccgctgggtgaagaaatgcgtgactgtgcccgtgcccacgtcgacgccctccggacccacctggcaccttatagcgatgaactcagacagcgtttggcggcgcgcctggaggccctcaaggaaaatggtggagcccgcctcgcagaataccacgccaaagcaaccgaacacctgtctactctgtcagagaaggccaaaccagcactggaagacctgagacaagggctccttcccgtgctagaaagcttcaaggtgagcttcttaagcgccttggaggagtatactaagaaactgaacacccag

SEQ ID NO: 6346 - DNA, 801 bp, Artificial Sequence
  Description of Artificial Sequence: Synthetic coding sequence
atgaaggccgccgtgctgaccctggccgtgctgttcctgacggggtcgcaagcgcggcacttctggcagcaagacgagccaccacagtcgccctgggaccgcgtgaaggacctggcgaccgtctatgtcgatgtcctcaaggactcgggacgggactacgtctcccagttcgaaggatccgctctgggcaagcagcttaacctgaagctcctggataactgggattccgtgacctcgaccttctcgaaactgcgtgagcaattgggtccggtgactcaggagttctgggacaacttggaaaaggaaacggagggactccggcaagagatgtcaaaggacctggaagaggtgaaggcaaaggtgcagccgtacctggacgacttccaaaagaagtggcaggaagaaatggagctttaccggcagaaggtcgaacctctgcgggcggaactgcaagaaggagctagacaaaaacttcatgaactgcaggagaaactcagcccacttggtgaagagatgcgcgactgcgctcgggctcacgtggatgcattgaggacccacctggccccatactccgatgagctgcgccagagactggcagcccgcctcgaagcactcaaagagaacggcggcgccagacttgcggaataccatgcaaaagctaccgaacatctgagcactctctccgagaaagccaagccagcattggaggacctccgccagggactcctgccggtcctggaatcgttcaaggtgagcttcctgtcggccctggaagaatacacgaagaaactgaacacccag

SEQ ID NO: 6347 - DNA, 801 bp, Artificial Sequence
  Description of Artificial Sequence: Synthetic coding sequence
atgaaggccgctgtgctgactcttgccgtgttgtttcttactggtagccaagcgagacacttctggcagcaagatgaaccgccacaaagcccttgggatagggtcaaggatctcgcaactgtgtacgtggatgtccttaaggattcgggtagagactatgtctcccaatttgaaggtagcgcactgggaaagcagctgaacctgaaactcctggataactgggattcagtgacttctaccttctcgaagttgcgcgaacaacttgggcccgtgacccaagaattctgggataacctcgaaaaagaaaccgaggggctgagacaggaaatgtcaaaggatctcgaagaagtcaaggcaaaggtccagccttacctggatgactttcagaagaaatggcaggaagagatggagctgtaccgtcagaaggtggaacctctcagagccgagctgcaggaaggagcacggcaaaaactgcatgaacttcaagagaagttgtcaccattgggggaggagatgcgagactgtgcacgcgcccatgtggatgctctgcggacccatctcgccccgtacagcgatgaactcagacaacgcctcgcagcaaggttggaagcactcaaagaaaacgggggtgcaaggctggcagaataccacgcaaaggccaccgaacatctgtcaacgctctctgaaaaggccaagccagctctggaagatctgagacaaggacttctgccagtccttgaatcctttaaggtgtcatttttgagcgccttggaagagtacacgaaaaagctgaatactcag

SEQ ID NO: 6348 - DNA, 801 bp, Artificial Sequence
  Description of Artificial Sequence: Synthetic coding sequence
atgaaggctgcagtgctgaccctggccgtccttttccttacgggatcgcaagcgcgccatttttggcagcaagacgaacctcctcagtcgccttgggatcgagttaaagatctggccacggtgtatgtggacgtcctgaaggactccggtcgtgattacgtgtcacaatttgagggttcagcattgggaaagcaacttaatcttaagctgttggacaattgggattcagttacttcgacgttctcgaaacttagggaacaattgggcccggtaactcaagaattctgggataacttggaaaaagaaactgaaggcctccggcaggagatgtccaaggatttggaagaggtcaaggcaaaggtgcaaccttacctggatgattttcagaaaaagtggcaggaggaaatggagctttacaggcagaaggtggaaccgctgagggccgagttgcaggaaggagcccggcagaagttgcatgaactccaggagaagctgtccccgctgggagaggagatgcgtgattgcgctcgtgcacatgtggacgcgcttcgcacccacctggcaccatacagcgacgaattgagacagagactggcggcaagactcgaagcattgaaggaaaacggaggggcaagactggccgaataccatgcgaaggccaccgaacaccttagcaccctgtcggaaaaagcaaaacccgcccttgaagatctccgccaggggctccttccagtccttgaatcctttaaagtctcttttctttcagcacttgaagaatacaccaaaaaactcaacacgcaa

SEQ ID NO: 6349 - DNA, 801 bp, Artificial Sequence
  Description of Artificial Sequence: Synthetic coding sequence
atgaaggctgccgtgctgacccttgcagttctctttctcactggtagtcaggcacgacatttctggcagcaggatgagccacctcagtccccatgggatcgtgtgaaagatctggccacagtttatgtggacgtgctgaaggactctggccgggactacgtgtcgcagtttgaaggcagcgccctgggcaagcagctcaacctgaagctgctcgacaactgggacagcgtcacaagcacatttagtaagttgcgggaacaattgggtccagtcactcaggaattttgggacaatctggagaaagagactgaggggctacgccaggagatgtccaaagacctggaggaggtaaaagccaaggtgcaaccctacttggacgattttcaaaagaaatggcaggaggaaatggagttgtacagacagaaggtggagccgttgagagctgagttgcaggagggggccaggcaaaagctccacgaacttcaggagaaattgagccctcttggtgaggagatgcgggactgtgccagggcacacgtagacgccctcagaacacacctcgcaccctactccgatgagcttagacagcgtctggcagctcggttagaggccctcaaggagaatgggggtgcccgtctcgcagagtatcacgctaaagccaccgagcatttgtcaacactgtctgaaaaggctaagcccgccctggaagatctgcgccaaggactgctgcctgtccttgagtcttttaaggtatcctttctgagcgccttggaggagtatacaaagaagctgaacacccaa

SEQ ID NO: 6350 - DNA, 801 bp, Artificial Sequence
  Description of Artificial Sequence: Synthetic coding sequence
atgaaggcagcggtcttgactctcgcggtcctgtttctgacagggtctcaggctcgacacttttggcagcaggatgagccgccgcaatctccttgggatcgagttaaggacctcgcgacagtatacgtggacgtccttaaagacagtggccgtgattatgtctctcagtttgaagggagcgcacttggcaaacaactaaatttgaaattattggataattgggattctgttacatccacattttccaaactgcgagagcagctgggaccggtgacgcaggaattttgggataacctcgaaaaagaaacagaaggccttaggcaagaaatgtcgaaggatctagaagaagtgaaagccaaggtgcaaccttacttagacgattttcagaagaaatggcaggaagagatggagttatatcgccagaaagttgaacccttacgggcagaactgcaagagggagcgcgacaaaagctgcatgaactgcaagaaaaactctccccccttggcgaagaaatgcgcgattgcgctagggcgcatgttgacgcgttacgcacacatctggctccttactctgatgaattaagacaaaggcttgctgctagattggaagcgctcaaggaaaatgggggagctcggcttgccgaatatcatgcgaaggcaactgaacatctgtctacactgtcggaaaaggcgaaaccggcgctggaagacctccgccaagggcttcttccagtactcgaatcattcaaagtctcattcctttcagcactagaagaatataccaaaaagttaaatacgcag

SEQ ID NO: 6351 - DNA, 801 bp, Artificial Sequence
  Description of Artificial Sequence: Synthetic coding sequence
atgaaggcagcagtcctgacgcttgcagtgctgttccttaccggatcccaagcacggcatttttggcaacaggacgaaccaccacaaagcccatgggatagagtcaaggatcttgcaactgtgtacgtggatgttctgaaggactccggtcgtgactacgtgagccaatttgagggatccgcattgggaaagcagttgaacctcaagctgctggacaactgggacagcgtcacctccactttttctaagctgcgggaacaactcgggcccgtgactcaagagttttgggataatctcgagaaggagactgagggactgagacaggaaatgagcaaggatctggaagaagtgaaggccaaagtgcaaccatacctcgatgattttcagaaaaagtggcaagaagaaatggaactctacagacagaaggtcgaacccttgcgtgcggagctgcaagaaggagcaagacagaaacttcacgaacttcaggaaaaactgagtcccttgggtgaagaaatgagagattgtgctcgggcccacgtggatgctttgagaacccatctggcaccctactccgacgagcttagacaaaggcttgcagcacggctcgaagcactcaaagaaaatggcggtgccagactcgccgaataccacgctaaagcaactgagcatctgagcaccctttcagaaaaggcaaagcctgcactcgaagatctgaggcagggcctccttcccgtgcttgaatcgtttaaggtgtccttcctgtcagccttggaagaatacactaagaaactgaacacgcag

SEQ ID NO: 6352 - DNA, 801 bp, Artificial Sequence
  Description of Artificial Sequence: Synthetic coding sequence
atgaaggccgcagtgttgactcttgctgttcttttcctgacgggctcccaggcacggcacttctggcagcaggacgagcctcctcagagcccctgggaccgggtgaaggacctggccaccgtctacgtggacgtcctgaaagacagcggccgggactacgtgagccagttcgagggttccgccctgggtaagcagctcaatctgaagctcctggataattgggattcagtgacttcgaccttttctaagctcagagaacagcttggcccagttactcaggaattctgggataacttggaaaaggaaacggaaggactccgccaagaaatgtcaaaggatctcgaggaggtcaaggcgaaggtgcagccatatctggatgacttccagaaaaagtggcaagaggagatggaactgtaccgccaaaaagtagagccgcttcgcgcggagctccaagaaggcgctcgtcagaaactccacgagctgcaagagaaactttcaccactgggggaagagatgcgggattgtgcgcgcgcccacgtggacgctctgcgcactcatctcgcgccttacagtgacgagctgcggcagagactcgctgcgcgcctggaagccctgaaggagaatggaggtgcgaggcttgcggaataccatgcgaaggcgacggaacacctctccacgctctcggaaaaggccaagccggcactggaggatctccgccagggactgctgccggtgctggaatccttcaaagtgtcgtttctgtcggcactcgaagaatacactaagaaactgaatacccaa

SEQ ID NO: 6353 - DNA, 801 bp, Artificial Sequence
  Description of Artificial Sequence: Synthetic coding sequence
atgaaagcggccgtactgaccctggcagtgctctttctgactggatcccaggcccggcacttttggcagcaggacgagccgccacagtcgccgtgggatcgggtcaaggacctggccactgtctacgtcgatgttctgaaggatagtggacgcgattacgtgagtcagttcgaaggaagcgcgctgggaaaacagctcaatctcaagctgcttgacaattgggactccgtgacctcgaccttctccaaattgcgcgaacaacttggcccagtcacccaggagttctgggataacctcgagaaggagacggaagggctgcgccaagaaatgtccaaagatctcgaagaggtgaaagctaaggtgcagccgtatctggatgatttccagaaaaagtggcaagaggagatggaactgtaccggcagaaggtggaaccactgcgggcggaactgcaggagggagcccgccaaaaattgcatgagctccaagagaagctctcgccgctgggcgaggagatgcgcgactgcgcccgggcccatgtggacgctctgcggacccaccttgcaccgtactccgacgaacttaggcagcggttggcggcgcggctggaagcactcaaggaaaacggaggagccagattggcggaataccatgcgaaggccactgagcacctgagcacgctttcagaaaaagctaaaccagcactggaagatttgcgccagggcctcctccccgtgctcgaatcgtttaaagtctccttcctgtcggccctggaagagtacaccaagaagctgaacacccaa

SEQ ID NO: 6354 - DNA, 801 bp, Artificial Sequence
  Description of Artificial Sequence: Synthetic coding sequence
atgaaagcagctgtgctgactctggcggtgttgttcctcactgggtcacaggcacggcatttctggcagcaggatgagccgccacagagcccgtgggaccgggtgaaagacctcgccactgtctacgtggacgtgctgaaggacagcggaagggattacgtgtcacagttcgaaggatctgcgcttgggaagcaactgaatctgaaattgctggacaactgggattccgtgacttcgactttctcgaagctgcgcgagcagctggggccggtgacccaagaattctgggacaacttggaaaaggagactgagggccttcggcaggagatgtcgaaggacttggaggaggtcaaggcgaaggtgcagccttacctcgacgattttcaaaagaaatggcaagaagagatggaactgtaccggcaaaaggttgaacccctgagagcggaactgcaggaaggagcacggcagaaactgcatgagctgcaggaaaagctctctccgttgggtgaggagatgcgcgattgcgccagagcgcatgtcgatgcgttgcgcactcatcttgcaccatactcggacgaactgcggcaacgcttggccgcaaggctggaagccttgaaggaaaatggaggcgctagactcgcggaataccacgctaaagcaacggaacatctcagcactctgtccgaaaaagcaaagcccgctctcgaggatctccggcagggactcctgccagtgctggaatcgttcaaggtgtcgttcctctcggccctggaagagtataccaagaagctcaacactcaa

SEQ ID NO: 6355 - DNA, 801 bp, Artificial Sequence
  Description of Artificial Sequence: Synthetic coding sequence
atgaaggccgcggtcttgacgttggccgtgctcttccttaccgggtcccaagcgaggcatttctggcaacaagacgaacctccacagtccccgtgggaccgagttaaggacctggccaccgtgtacgtggatgtcctgaaggattcgggacgcgactacgtgtcccagtttgagggttcggccctgggaaaacagttgaacctgaagctgctggataattgggatagcgtgacttccactttcagcaaactgcgagaacaacttggaccagtcactcaggagttttgggacaacctggagaaagaaactgaaggcctgcggcaagagatgtccaaggacctggaagaagtgaaggccaaggtgcagccttacttggatgatttccagaaaaagtggcaggaagaaatggagctgtaccgccagaaagtcgagccattgcgggccgagctgcaagagggagcgcgccaaaagctgcacgagctgcaggagaagctcagcccgctgggagaagagatgcgcgactgcgcgagagcacacgtggacgcattgaggacccacctggccccgtactccgatgaactccgtcagcggctggcagcacgattggaggcactcaaggagaacggcggagcgcggttggcggagtatcatgcgaaagccaccgagcatctgagcacgctgtccgagaaagccaaaccggcgctcgaagatctgcggcagggtctgctgcctgtgttggagtcttttaaggtcagcttcctctcagctctcgaagagtacaccaagaagctgaacactcag

SEQ ID NO: 6356 - DNA, 801 bp, Artificial Sequence
  Description of Artificial Sequence: Synthetic coding sequence
atgaaggcagctgtcctcaccctcgccgtccttttcctcaccggatctcaagcacgccacttttggcagcaggacgagcctcctcagtccccgtgggatcgggtgaaggacctcgcaaccgtgtacgtcgatgtgcttaaagattcaggacgcgactacgtgtcccaattcgagggaagcgccctgggtaaacagctgaatctgaagctccttgataactgggatagcgtgactagcacgttcagcaagctgagagaacagctgggaccggtgactcaagaattttgggacaatctggagaaggaaactgagggactccggcaggaaatgtcaaaagaccttgaagaagtgaaagccaaggtccagccttacctggacgacttccagaagaagtggcaggaagaaatggaactgtacaggcagaaagttgaaccgctgagagcagaactgcaggaaggggctcgccaaaagctgcatgaactgcaggagaagctctccccgttgggcgaggagatgcgcgactgcgcgcgtgcccacgtggacgccctccgcacccacctcgccccatattccgacgaactcagacaacgtcttgcggccagactcgaagcactgaaagagaacggaggggcccgcctggccgagtaccacgccaaggctactgagcacctgagcacgctgtcagagaaggccaagccggccctggaggacctccgccaaggactcctgccggtcctggagtcattcaaggtgtccttcctttcagccctggaggaatacaccaagaagctcaacacccaa

SEQ ID NO: 6357 - DNA, 801 bp, Artificial Sequence
  Description of Artificial Sequence: Synthetic coding sequence
atgaaagccgcggtcctcaccctggcggtgctcttcctcactggctctcaggctcgtcacttctggcaacaagacgagcccccacaatccccatgggatcgggtgaaggacctcgctaccgtctacgtggacgtgctcaaagactccggacgcgactatgtgtctcagttcgagggaagcgcactggggaagcagttaaatttgaagcttttggataactgggactccgtaacctcaacgttctcaaaacttagagaacaactgggacctgtcacgcaggagttctgggacaatctggaaaaagaaactgagggcctgagacaggagatgagtaaagatctcgaggaagtcaaggctaaggtgcagccttacctggacgacttccagaagaagtggcaggaagagatggagctgtacaggcagaaagtggaaccgctgcgggccgagctgcaagaaggcgccagacagaaactgcacgagctgcaggagaagctgagtcccttgggggaggagatgcgggactgcgcaagagcccacgtggatgcccttcgcacgcatctcgctccttacagcgatgaactgcgacaacgattggctgcccggttagaagccttgaaggagaatgggggagctcggctggccgaataccacgccaaggcgacagagcatctttccaccttgtccgaaaaggccaagcccgctctggaagatttgagacagggtctgcttcccgtgttggagagtttcaaggtgtcctttctaagtgcgctggaagagtatactaagaagctgaacacccag

SEQ ID NO: 6358 - DNA, 801 bp, Artificial Sequence
  Description of Artificial Sequence: Synthetic coding sequence
atgaaggccgccgtcctgactctcgccgtcctgtttctgacgggatcccaggcccgtcacttctggcaacaggacgagccccctcaatcaccatgggatagggtgaaagaccttgcgaccgtgtacgtggacgtgctgaaagactccgggcgcgactatgtgagccaattcgagggctcagcgttgggaaaacaactcaacctcaagctgctggacaactgggactcggtgacctcgacgttcagcaaacttcgcgagcagctcggccccgtcacccaggagttctgggacaacctggagaaggaaactgagggactccggcaagaaatgtccaaggatctcgaggaagtgaaagcaaaggtgcaaccctacctggacgacttccagaaaaagtggcaggaagagatggagctgtacagacagaaggtcgaaccactcagggccgaactccaggaaggcgcgcggcagaagctgcacgaactgcaggagaagctgagcccactcggagaagaaatgagggattgcgcccgcgcccatgtggatgcactccggacccaccttgccccttactcggacgaactgcggcagagactggccgcacgcttggaagcgctcaaggagaacggtggagcgcggcttgccgaataccacgcgaaggccacggaacatctctcaaccctgtcagaaaaggcaaagcctgcgctggaggatttgcgccagggcctcctcccggtcctggagtcgtttaaagtctcgttcctcagcgcactggaggaatacacgaaaaagttgaacacccaa

SEQ ID NO: 6359 - DNA, 801 bp, Artificial Sequence
  Description of Artificial Sequence: Synthetic coding sequence
atgaaagctgcagtcttaacattagctgtgctttttctaacaggatcacaggcacgacacttttggcagcaggatgaacccccccaatctccctgggaccgggttaaagacctagcgactgtttacgtggatgtactaaaagatagtgggcgggattatgtgtcccagttcgaaggatctgccctggggaaacagctaaatctaaaactgctcgataactgggactcagttacttccactttcagtaagcttcgcgaacagctcggacccgtgactcaggaattttgggataacctggaaaaagaaacagaaggactccggcaggagatgtccaaagacctggaagaagtgaaagcgaaagttcagccctacctggacgattttcagaaaaaatggcaagaagagatggaactgtaccggcagaaagttgaacctctccgagccgaactccaagaaggagcccgccagaaattgcacgaactgcaggagaagctgtctcctctgggagaagaaatgagggattgtgctagagcccacgttgatgcactcagaactcatctcgctccctactcagatgaactgcgccagcggttagcagcaaggctcgaagctttaaaagagaacggaggagccagactcgctgagtaccacgccaaggcgacagagcatttatcaactctttcagagaaagcaaaacctgctctcgaggatttacgccaggggctcctgcctgttttagaatcattcaaagtctcattcctatctgctctcgaagagtatacaaaaaaacttaatactcaa

SEQ ID NO: 6360 - DNA, 801 bp, Artificial Sequence
  Description of Artificial Sequence: Synthetic coding sequence
atgaaagcggccgtgctcacattggcagtgctgttcctaactggatctcaggccagacatttctggcagcaagatgagccaccccagagtccctgggacagggtgaaagatcttgccactgtctacgtggacgtcctgaaagatagtggaagagactacgtatcccagttcgaagggtcagcattaggaaagcagctcaacttgaaactcctcgataactgggattcagtgacatcgacgttctctaaactccgagaacagttaggaccagtaactcaggaattttgggataacttagaaaaagagacagaaggactcagacaggagatgagtaaagatctcgaggaagttaaagcaaaggttcagccctatcttgatgattttcagaaaaagtggcaagaagagatggaactatacagacagaaagtcgaacccctgcgggccgaactccaggagggggctcgacagaaattacatgaactgcaggaaaaattatctcctctgggggaggaaatgcgggattgtgcaagggcgcacgtggatgccttgaggacacacctcgccccctattccgatgaattaagacaaagactagccgcaagattagaagctctgaaggaaaacggaggggctaggctggctgagtatcacgccaaagcaacagaacacctatccacactatccgaaaaagcaaaacctgcactcgaagacctcaggcaggggcttctgccagtgctcgaatccttcaaagtgtcatttttgtcagcgcttgaagagtatacaaaaaagcttaatactcag

SEQ ID NO: 6361 - DNA, 801 bp, Artificial Sequence
  Description of Artificial Sequence: Synthetic coding sequence
atgaaggcagcggtgttgactctggcagtgctgttcctcacgggtagtcaggcccgccatttttggcaacaggacgagcctccgcagtctccttgggatagggttaaggatctcgccactgtctatgtggacgtgctcaaagatagtggtcgggactatgtaagtcaatttgaaggcagtgccttgggcaaacagctcaatcttaagctcctcgataattgggatagtgtcactagcaccttctccaagttacgcgaacaactgggccctgtcacacaggagttttgggacaacctggagaaagagactgaaggcctaaggcaggagatgtcgaaggacctcgaagaggtgaaggccaaggtccagccatacctggacgacttccagaaaaaatggcaagaggagatggaactctatcggcagaaagtggaaccactccgcgccgagttgcaggagggtgcccggcagaagctgcatgagctgcaggagaaattatcgccactaggtgaggaaatgagggactgtgcgcgggcgcatgtcgatgctttgcgtacccatttggctccttacagcgacgagttacgacagaggctcgctgccagactggaggctctcaaagagaatggcggcgccagattggcagagtatcatgccaaagccaccgagcatctctcaaccctgagtgaaaaggcaaagcccgctctcgaagatctgagacaagggctgctgccagtgctggagtccttcaaggtctctttcctcagcgctctagaggagtatacgaagaagctaaacacacaa

SEQ ID NO: 6362 - DNA, 801 bp, Artificial Sequence
  Description of Artificial Sequence: Synthetic coding sequence
atgaaagccgccgtactcactctggctgtcctgttcctgacagggagccaggcccgtcatttttggcaacaggacgaaccccctcaatccccgtgggatcgcgttaaggatctcgctacagtgtacgtggatgtcctgaaggactctggcagagactacgtctcccagtttgaaggcagtgcactgggaaaacagctcaatttaaaattgctggacaattgggactctgtcacctctacattttccaagctgagagagcagctgggcccggtgacacaggagttctgggacaacctggagaaagaaactgaaggtctgcgccaggagatgagcaaggatttggaagaggtgaaggcaaaagtgcagccttacttggacgactttcagaaaaagtggcaggaagaaatggaactatatcgccagaaagtggagcctctacgtgccgaattgcaggagggagcgaggcagaagctgcacgagcttcaagagaagttaagtccactgggagaggagatgcgcgactgcgcaagggctcacgtcgacgccctcagaacgcatctggcgccgtattccgacgagctgcgacagagattagctgctaggctggaagccctgaaggaaaacggaggtgcccgactcgccgagtaccatgccaaggcgacagaacacttgagcactcttagtgagaaggctaagcctgctctggaagacttgagacaggggctgctgcccgtgttagagtctttcaaggtgtcatttcttagcgcactggaggagtatactaaaaagttgaatacgcaa

SEQ ID NO: 6363 - DNA, 801 bp, Artificial Sequence
  Description of Artificial Sequence: Synthetic coding sequence
atgaaggccgcagtgctgacactggccgtgctatttctgacaggatctcaggctagacatttctggcagcaagatgaaccaccgcagtcaccctgggaccgtgtgaaggaccttgccacagtttacgtggacgtactgaaggactcaggacgagattacgtttcccagttcgagggttctgctttaggtaagcagttgaatctgaagttgttagacaactgggactctgtgacttccaccttttctaaactgagggagcagctgggcccagtgacacaagagttctgggacaacctagaaaaagagacagaaggtttgcgccaggagatgagcaaggacctcgaggaagttaaggcaaaggtccagccttatcttgacgatttccagaagaagtggcaggaagagatggaactgtacaggcagaaggttgaacccctccgcgccgagctgcaggagggagctcgccagaagctccacgaactgcaggagaagctgagccccctgggagaggaaatgcgcgattgcgccagagcgcatgttgatgccctgcggacccatcttgctccatactccgacgagctgagacaaaggctcgccgcacgcttggaagccctaaaggagaatggcggcgccagattggcagagtatcacgccaaggccacggaacatctatccacactaagcgaaaaggcgaaacctgccctggaggaccttaggcaggggctactgcccgtgctagagtccttcaaagtctccttcctgagtgctcttgaggaatacacaaaaaagttgaatacccaa

SEQ ID NO: 6364 - DNA, 801 bp, Artificial Sequence
  Description of Artificial Sequence: Synthetic coding sequence
atgaaggccgcggtacttacattagccgtgcttttccttacaggttcccaagcccgccacttttggcagcaggatgagcccccccagtccccttgggatagagtgaaagacctcgcgaccgtatacgtagatgtgctaaaagacagtggtagggactacgtaagccaattcgagggcagtgccctcggcaagcagctgaatttgaagcttctggacaattgggactcagtaacaagcacattttcaaaactccgggagcaactgggaccagtcacccaggagttttgggacaatctggagaaagaaactgaaggtcttagacaagagatgagcaaagacttggaagaggtgaaagcaaaagtccagccatatttggatgatttccaaaaaaagtggcaggaagagatggagctatatagacaaaaagttgagcctttgagagctgagctgcaagaaggtgcccgacaaaagttgcacgagctgcaagagaagctgtcgcccctcggagaggaaatgagggattgtgccagagcccatgtggacgcattaagaactcacttggccccatacagtgacgaacttcggcagaggctggctgccaggctggaagccctaaaagaaaatggaggggctagactggcagagtaccatgccaaggcaacggaacatctgagcacgttgtccgagaaggctaagcctgcccttgaagaccttagacagggcttactgcctgtattagaatcgttcaaggttagcttcctgtctgcccttgaagaatacactaagaagctaaatacccag

SEQ ID NO: 6365 - DNA, 801 bp, Artificial Sequence
  Description of Artificial Sequence: Synthetic coding sequence
atgaaggcagccgtgctgactctcgccgtgctgttcctcaccggaagccaggccaggcatttctggcagcaagacgaacctccacagtcgccgtgggatcgggtcaaggacctggctacggtgtacgtggatgtgctgaaggattccggacgggattacgtctcgcagttcgagggttcagcgctcgggaagcaactgaacctgaaactcctcgataattgggatagcgtgaccagcactttttcgaaactgcgcgaacagctcggtcctgtgacccaagaattctgggataacctggaaaaggaaaccgaggggctgcggcaagaaatgtcgaaggacctggaagaggtgaaagctaaggtgcaaccttacctcgatgatttccaaaagaaatggcaggaggagatggagttgtacaggcagaaggtggaaccactcagagcggaactccaggaaggggcccggcaaaagctgcacgaactgcaagaaaaactgtcaccgctcggcgaagaaatgcgcgactgcgcgcgcgcccacgtcgacgctctgcgcacccacctggcaccatactccgacgaactgcgccagcggcttgcggcccgtctggaggcactgaaggagaacggcggcgctcgccttgccgagtatcacgctaaggccaccgaacacctgagcaccctgtcggaaaaagcgaaaccggccctggaggatctgagacaaggcctcctccctgtgctggagtcgttcaaggtgagcttcctgagcgcattggaagaatacaccaagaagctcaacactcag

SEQ ID NO: 6366 - DNA, 801 bp, Artificial Sequence
  Description of Artificial Sequence: Synthetic coding sequence
atgaaggccgctgttctgacgttagccgtgctgttcctgaccggatcacaagctagacacttctggcagcaagatgaaccaccacagagtccctgggatagggttaaagatctggccaccgtgtacgtagatgtgctgaaggattctggtcgcgattatgtctctcagttcgaaggttctgccttgggcaaacagctgaacttgaagctgctcgataactgggattcagtaaccagtaccttctctaaactccgtgagcaactgggccccgttactcaggaattctgggacaatctggaaaaggagacagagggactccgccaggaaatgagtaaggatttggaggaggtgaaagcaaaagtccagccatatctggacgattttcagaagaagtggcaggaagagatggaactctacagacagaaagtggaaccactgagagctgagctgcaggagggggctaggcagaaactccatgagcttcaagaaaagttatccccactgggcgaggagatgcgagattgcgcgagagcacatgtagacgccttgaggacacatcttgccccctactcggacgagctgaggcaacggctggccgctcgccttgaggccctgaaagaaaacggaggggccagattggctgagtatcatgcgaaagcaactgaacacctatccactctgtcagagaaagcaaaaccagctctggaagatcttaggcagggcctcctgccggtgctagaatccttcaaggtgtcctttctatcggcgctggaggagtacacgaagaaattgaacacgcag

SEQ ID NO: 6367 - DNA, 801 bp, Artificial Sequence
  Description of Artificial Sequence: Synthetic coding sequence
atgaaggccgcggtgctcacgttggcagtgctgttccttaccggatcccaagcgcgccacttttggcagcaggacgaacctccgcagagcccgtgggatcgcgtgaaagatctcgccaccgtttacgtggacgtgctcaaagattccggacgcgattacgtttcccagttcgagggatcagccctgggaaaacagctgaacttgaagctcctggataactgggactctgtgactagcactttttcgaagctgagagagcaattggggccggtgacgcaggaattttgggataacctggaaaaggagactgaaggtttgcgacaagaaatgtcaaaggatcttgaagaggtgaaggccaaggtgcagccgtacctggatgacttccagaagaaatggcaggaagaaatggaactttaccgccaaaaggtggagcctctgcgggccgaactccaagaaggagctaggcaaaagctccatgaactgcaagaaaaactctcacccctgggcgaggagatgagagactgtgcgagagcacacgtggacgcgcttcggactcacctcgctccgtactccgacgaactcaggcaacggctggcagccaggctcgaggccctgaaggaaaatggaggagcacgcctggctgaataccatgccaaggcgaccgagcacctgagcacgctgtcggaaaaggccaagcctgcgctggaggacctccgtcaaggcctcctgccagtcctcgagtcgttcaaggtttcatttctctcggccctcgaggaatacactaagaagctcaatacgcag

SEQ ID NO: 6368 - DNA, 801 bp, Artificial Sequence
  Description of Artificial Sequence: Synthetic coding sequence
atgaaggccgccgtcctgacactggctgttcttttcctaacaggctcccaggcccgtcatttctggcaacaggacgagcccccgcaaagcccatgggatcgagtaaaagacttagctacagtttatgtagacgtgttaaaggatagcggaagagactatgtgagccagttcgagggctcggctttgggtaaacagctgaacttgaaactgctggataattgggactcggtgacctctactttctcaaaattacgtgaacagctcggccctgtaacccaagagttctgggacaacttggaaaaggaaaccgagggcttgaggcaggagatgagcaaggacctggaggaagtgaaagcgaaggtgcagccttacctggacgatttccaaaagaagtggcaggaagaaatggaactctaccgacaaaaagtggaacccctaagggctgagttacaggagggagcccgacagaagctccacgagctacaagaaaagctctcgcctctgggagaagagatgagggactgcgctcgggcccacgtggacgccctccgcacgcacctagccccctacagcgacgagctgcggcaacgacttgccgcacgattggaagccctgaaggaaaacggcggggcccgactggcagagtaccatgctaaggcaaccgagcacctgagtacactgtcggaaaaggccaaacctgccctcgaggacctgaggcaggggttgctgcctgttcttgaatcttttaaagtgagtttcctgtcggcactagaggaatacaccaaaaaattaaacacccag

SEQ ID NO: 6369 - DNA, 801 bp, Artificial Sequence
  Description of Artificial Sequence: Synthetic coding sequence
atgaaagctgccgtcctgactcttgcagtcctctttctgactggatcccaagcacggcatttttggcaacaagacgagcctccccagtcaccgtgggatcgggtgaaggatcttgctactgtgtacgtggatgtgcttaaggactccggaagggattatgtttcacaattcgaaggctcagccctcgggaaacagctgaatctgaaacttctcgataactgggacagcgtgactagcaccttctcgaagctgcgggagcagctcggacctgtgacccaggagttttgggataatctggaaaaggaaaccgaaggacttcgtcaagagatgtcgaaggatctggaggaggtgaaggccaaagtgcaaccttaccttgatgacttccagaagaagtggcaagaagaaatggaactctaccggcagaaggtcgaacctttgagagcagaactgcaggaaggagcaagacaaaagctccacgagcttcaagaaaaactttcacctttgggtgaagaaatgcgcgattgcgctagagcgcatgtggatgcactgcgcacgcatctcgcgccgtactcggacgaactccggcagagattggccgcgagactggaagcgctgaaggaaaatggtggtgcacggctggcagaataccacgctaaggccactgagcacctgtccaccctttcggagaaagcaaagcctgcactggaggacctgcgccaggggttgctccccgtgcttgagtcatttaaggtcagcttcctctcggcgctggaagaatacaccaagaaacttaacacccaa

SEQ ID NO: 6370 - DNA, 801 bp, Artificial Sequence; identical to SEQ ID NO: 6331
  Description of Artificial Sequence: Synthetic coding sequence

SEQ ID NO: 6371 - DNA, 801 bp, Artificial Sequence
  Description of Artificial Sequence: Synthetic coding sequence
atgaaggcagcagtgctcactcttgcagtcctgttcctcactggaagccaggcccgacacttttggcaacaggacgaacccccgcaatcaccatgggatcgtgtgaaggatctggccaccgtgtatgtggacgttctgaaggatagcggccgcgactacgtgtcccagttcgaaggatccgcactgggtaaacagttgaatctcaaactgctcgataactgggattcggtgacctcaactttttcgaaactgcgagaacagcttggtcccgtgacccaggaattctgggacaacctggagaaggaaactgaaggtctgagacaggagatgtcgaaggatcttgaagaggttaaggcaaaggtgcagccttaccttgatgatttccaaaagaagtggcaagaagaaatggagctttacaggcaaaaggtcgaacctctcagggcagaactccaggagggagccaggcaaaagttgcatgaacttcaagagaaactctcgcctttgggtgaggagatgcgggactgtgcccgggctcatgttgatgcactgcggactcatctggcgccttactcggatgaactccgacagagactggccgccagactcgaggcgcttaaagagaatggaggtgcaagactcgccgagtaccatgctaaggcgaccgaacacctttccaccttgtcggaaaaggccaaacctgctctggaagatctccgtcaaggacttctgcctgtgctcgagagcttcaaggtgtcgttcctttccgcgctggaagaatacaccaagaaacttaacactcag

SEQ ID NO: 6372 - DNA, 801 bp, Artificial Sequence
  Description of Artificial Sequence: Synthetic coding sequence
atgaaagccgctgtgctgactttggctgtactattcctaactggcagccaggcacgccacttttggcagcaggacgaaccgccccagagcccttgggaccgcgtgaaggatcttgcaacggtgtatgttgatgttctcaaggacagcggcagggattacgtgtcccaattcgaaggttccgccctggggaagcagctgaacttgaagctgcttgacaactgggatagcgtgacctccaccttcagtaaactccgagagcagttgggccccgtgacccaggagttttgggataaccttgaaaaagagaccgaaggactgcgccaggagatgtccaaggatctggaggaggtgaaagctaaggtccagccctacttggatgactttcaaaaaaagtggcaggaggagatggaactgtaccgccagaaggtcgagcctcttagagctgagttgcaggagggcgccaggcagaagctgcatgagcttcaagagaaactgagcccactgggtgaggagatgcgggactgtgccagggcacatgtggacgctctccgaacccacctggctccttattccgacgagctgcgtcagcggttagcggccaggctcgaggcactcaaggaaaatggcggtgcccggctcgccgaataccacgcgaaggctacagaacacctgagcacattaagcgagaaagcaaagccggcattggaggatctgagacaggggctgctgcccgtactcgaaagctttaaggtatctttcctgtccgctttggaggagtacactaagaagctcaacactcag

SEQ ID NO: 6373 - DNA, 801 bp, Artificial Sequence
  Description of Artificial Sequence: Synthetic coding sequence
atgaaggccgctgtgctgactttagcagttctgtttctcactggaagtcaggctagacacttctggcagcaggacgaaccccctcagtccccctgggaccgtgtgaaggatctcgcaactgtttacgtggatgtgctcaaggattcgggaagagattacgtgtctcaattcgagggatccgccctgggaaagcagctaaatctgaagcttctggataattgggactcggtaacttctacattcagcaaactgagggaacaactcggaccagtgacccaggagttctgggacaatttagaaaaagagactgagggactgcggcaggagatgagcaaagacctagaggaggttaaggccaaagtgcagccttatctggacgattttcagaaaaagtggcaggaggagatggagttgtatcgtcagaaagtcgagccactgagagccgaattacaggaaggggctagacagaaattgcacgagctgcaggaaaagctctccccactgggtgaagagatgcgggactgtgctagagcgcacgtcgacgcgctccgaactcacctggctccttacagtgacgaactgaggcagagactggcagctcgcttggaagcgctcaaagagaacgggggagcaaggctagccgagtatcacgctaaagctactgaacatctgtcaaccctctcagaaaaggcgaaacctgcactggaagacctgcgccagggactgctcccggtccttgagagcttcaaggtgtcattcctgtccgccttggaggagtatactaaaaaactgaatactcag

SEQ ID NO: 6374 - DNA, 801 bp, Artificial Sequence
  Description of Artificial Sequence: Synthetic coding sequence
atgaaggccgcagtcctcactcttgcagtgctttttctgaccgggtcgcaagccagacatttttggcagcaagacgagccaccccaatcaccttgggaccgcgttaaggatcttgctaccgtgtatgtggatgtcctcaaggattcaggtcgagactacgtctcccagtttgaaggaagcgcactggggaagcaactcaatctgaaactcctggataactgggactctgtcacgtccacttttagcaagctccgagaacaacttggaccagtcacgcaggaattttgggacaatttggagaaagaaactgaaggactcagacaggaaatgtcgaaggatttggaggaagtcaaggcgaaagtccagccgtacttggatgatttccaaaagaagtggcaggaagagatggagttgtaccgccaaaaggttgaacctctgagagccgaacttcaagaaggtgcaagacaaaaactccacgaactccaggagaagctcagcccacttggagaagagatgcgcgactgtgcaagagcgcatgtggacgccctcaggacccaccttgcaccttactcagatgagctgagacaacgcctcgctgcacgcttggaggcgcttaaggagaatggtggggcacgtcttgcagaataccatgccaaagcaactgaacacttgtcgactctgtcggaaaaggctaagcctgccctggaggatctgcggcaaggacttctcccggtgttggaatcctttaaagtgtccttcctctccgcacttgaagaatacactaagaaactgaatacccaa

SEQ ID NO: 6375 - DNA, 801 bp, Artificial Sequence
  Description of Artificial Sequence: Synthetic coding sequence
atgaaggccgcggtgcttacactggcagtcttgttcctcacaggatctcaggcccggcacttttggcaacaagacgaaccaccacaatccccctgggacagggttaaggatctcgccactgtctacgtagacgtgctgaaggattcagggcgggattatgtctcccaatttgaaggctcggcgctgggcaaacagcttaatctgaaactcttagataattgggactctgtgacctcaaccttttctaaactgagggagcagctgggcccggttactcaggagttttgggataacctggagaaagaaactgagggactgcgccaggaaatgagcaaagatctggaagaagtcaaagccaaggtccagccctatcttgatgattttcagaagaaatggcaagaggagatggaactgtatcggcagaaggttgagcccctgcgagccgaacttcaggagggagctcgacaaaagctacacgagcttcaggaaaagttgagccccctgggcgaagaaatgcgggactgtgctcgcgctcatgtggacgctttacgaacgcacctggctccatatagcgacgaactcagacagcgccttgcagcaagactcgaggctctgaaagagaatggcggcgcacgactcgcagagtatcacgccaaggccaccgagcatctcagcaccctgagcgaaaaggcaaaaccagcccttgaggacttgcgtcagggcctcctacctgtgctcgagagttttaaagtgtctttcctatcagctttggaggagtacacaaagaagctgaacacacag

SEQ ID NO: 6376 - DNA, 801 bp, Artificial Sequence
  Description of Artificial Sequence: Synthetic coding sequence
atgaaagctgccgtgctgactcttgcagtgctgtttcttaccggctcgcaagcccggcatttctggcagcaggacgagcctcctcagagcccttgggaccgggtcaaagaccttgcaacggtttacgtggacgtgctcaaggacagcggacgcgattacgtcagccaatttgaaggatcagcactgggcaagcagctgaatcttaagctgctggacaattgggattcggtcacctccaccttcagcaaacttcgggaacagctgggtccagtcacgcaagaattttgggataaccttgaaaaggagactgaaggccttcgccaagaaatgagcaaggatcttgaggaggtgaaagcaaaggtgcaaccctacctggatgactttcaaaagaagtggcaggaagaaatggagctttaccgacagaaagtcgagccccttagagcggaactgcaagaaggggcaaggcagaagctgcacgaactccaggagaagctgagcccacttggagaggagatgcgggactgtgcgagagcgcatgtcgacgccctcaggacccatctcgcaccctactcggacgagctgcgacagcgtcttgccgcccgcctggaagccctcaaggagaatggcggagcgcgcctggcggaataccacgcaaaggccaccgagcatctgtccactttgtcggagaaggcgaaaccagcactggaagatctccgccaaggcctgcttcctgtcctggagtcctttaaggtgtcgtttctgtctgccctcgaggagtatactaaaaagttgaacactcaa

SEQ ID NO: 6377 - DNA, 801 bp, Artificial Sequence
  Description of Artificial Sequence: Synthetic coding sequence
atgaaggccgccgtgctcactttggccgtgctcttcttgaccgggtcccaggctagacacttctggcagcaggacgaacctccacaaagcccttgggatcgggtgaaggacttggcaaccgtgtatgtggatgtgctgaaagactcagggcgcgattacgtgtcccagttcgaaggtagcgccctcggaaaacagctgaatctgaagctccttgacaactgggattcagtgacttccaccttctctaaactcagagaacagctgggcccagtcactcaagagttctgggataacctggagaaggagactgaaggcctccggcaagaaatgtcgaaggatctggaagaagtgaaggcgaaggtccagccttacctcgacgactttcagaaaaagtggcaggaagaaatggagctgtaccggcagaaggtggaaccccttcgcgctgagcttcaagagggtgcccgccagaaactccatgaactgcaggaaaaactctcacctctcggagaagagatgcgggactgcgcgagggcccacgtcgacgctctgagaactcacctcgccccatactccgatgagctgaggcaaaggctggccgcccgcctcgaggcactcaaagaaaatggaggagccaggctggcagagtaccatgcgaaggccaccgagcatctgtccaccctgtcggaaaaggcaaagcctgctcttgaggatcttcgccagggcctccttcctgtcctggaatcgttcaaggtgtcgttcttgtcggccctcgaagaatacaccaagaaactgaatactcag

SEQ ID NO: 6378 - DNA, 801 bp, Artificial Sequence
  Description of Artificial Sequence: Synthetic coding sequence
atgaaagccgccgtcttgaccctcgcggtgctgttcttaacaggcagccaggcacgacatttctggcagcaggatgagccgccccagtccccctgggatcgcgtcaaggatctggctacagtctacgtggatgtgctcaaggatagcggacgggattacgtttcccagttcgaaggctccgcgctgggtaagcagctgaacctcaagctcttggataattgggattccgttacgagtaccttctcgaagctgcgcgagcagctgggtccagtaacccaggagttttgggataacctcgaaaaggagactgagggactcagacaggagatgtcaaaggacttggaggaggtgaaggccaaggttcagccatacttagatgattttcagaaaaagtggcaagaggagatggaactgtaccggcagaaggtcgagccgctgcgtgcagagctgcaggaaggtgcccgccaaaagctgcacgagctgcaggagaaactctccccactgggcgaggaaatgcgcgattgtgcacgcgcacacgttgacgccttgcgtacgcacctcgccccatactcagacgagctgcgtcagcgccttgctgcgcgcctggaggccttgaaggaaaacggcggagcacgtctggccgagtaccatgctaaggcaacagaacacttgtccacccttagcgagaaagctaagccggctctggaggatcttcgacagggactgttgcccgtcctggagtcctttaaggttagtttcctttcagccctcgaggagtacacgaagaagctaaatacgcaa

SEQ ID NO: 6379 - DNA, 801 bp, Artificial Sequence
  Description of Artificial Sequence: Synthetic coding sequence
atgaaggcagcagtgctgactctcgcggtattgttcctcactggaagccaggcacgtcacttctggcaacaagatgagcctccgcagtcaccttgggaccgtgtcaaagacctggcgactgtttacgtggacgttctgaaggactccggccgggattatgtgtcgcaatttgaaggatcagcattgggaaagcagctcaaccttaaacttcttgataactgggatagcgtcacgtctaccttttccaagctgcgggagcagcttggtccagtcactcaagaattttgggataacttggagaaagaaaccgaagggctgcgccaagagatgtcaaaagacttggaagaagtgaaggcaaaagtgcagccatatctggacgactttcaaaagaagtggcaagaggaaatggaactgtacagacagaaggtggagcctctgcgtgcagagcttcaagaaggcgcccgccagaaactccatgaacttcaggaaaaactctcgccccttggtgaggagatgcgggattgtgcgcgagcacatgtcgatgcactcaggacccacctggcaccgtacagcgatgaattgagacaacgcctggcagcgcggcttgaggcgctcaaggagaatggaggggcgcgtctggcggaataccatgccaaagccaccgaacatcttagcaccctgagcgaaaaggccaagccggcgcttgaagatctgaggcaaggtcttttgcctgtgctcgaatcgtttaaggtgtccttccttagcgccctggaagagtacaccaagaagctgaatactcag

SEQ ID NO: 6380 - DNA, 801 bp, Artificial Sequence
  Description of Artificial Sequence: Synthetic coding sequence
atgaaggcagcggtgctgaccctcgcagtgcttttcctgactggatcccaggctcgtcatttctggcagcaagacgagcccccacagtcgccatgggatagagtgaaggacctcgccactgtgtacgtcgacgtgcttaaggattccggccgtgattacgtctcccagttcgaaggttcggcactgggtaagcaacttaacctgaaactgctcgacaattgggatagcgtgacctcaactttctctaagctccgggagcagcttgggcctgtcactcaagagttctgggataacttggagaaggaaactgaaggactccgtcaagaaatgtcgaaagatctggaagaagtcaaggccaaggtccagccctaccttgacgattttcaaaagaagtggcaagaggaaatggaactctaccggcaaaaggtggagccccttcgggcagaactccaggagggggcgagacagaagctgcatgagctgcaagagaaactgagccccctgggagaagagatgcgagattgtgcaagagcgcatgtggatgctctgcgaacgcaccttgctccttactcggacgagctccggcaacggcttgccgcacgacttgaggcactgaaggaaaacggcggagccagattggctgaataccatgcgaaggccaccgaacacctttcgactctttcagagaaggcaaaacctgccctggaagatcttcgacaaggactgctccctgtcctggaatcgttcaaggtgtcgtttctgtcagcactggaagaatacactaaaaagctgaacactcag

SEQ ID NO: 6381 - DNA, 801 bp, Artificial Sequence
  Description of Artificial Sequence: Synthetic coding sequence
atgaaagccgcagtgctgaccctcgccgtcttattcctcacaggcagccaggctcgccacttttggcagcaggacgagcccccccagagtccctgggaccgggttaaggatctggctaccgtttacgtcgatgttttgaaagacagcggaagggactatgttagccaatttgaggggtcagctctgggtaaacaattgaatctgaaacttttggataattgggattccgtgacaagcaccttttcaaaactacgagagcagctagggcccgtgacccaggagttctgggacaacctggagaaggagacagagggattaagacaggagatgtctaaggacttggaggaagtaaaagccaaggtacagccatacctggacgattttcaaaaaaaatggcaggaggaaatggaactctataggcagaaggtggagcccctaagagcagagctgcaggagggcgctaggcagaagctacatgagctgcaagagaagctgagtcctctgggtgaggaaatgcgagactgtgcgcgtgcacacgtggacgccctgaggacccacctggcgccctattcagacgagctgagacagagactggctgcccggcttgaggcactgaaggagaacggcggagcgcgattggctgagtatcacgcaaaggcaacggagcatctgtcgacccttagcgagaaggccaaaccagcactggaggatctgcgtcaaggtttactccctgtcctggagagcttcaaggtttcatttctgtccgccctcgaagaatacacaaaaaaactgaacacccag

SEQ ID NO: 6382 - DNA, 801 bp, Artificial Sequence
  Description of Artificial Sequence: Synthetic coding sequence
atgaaggcagccgttctgaccctggcagtgttgtttctgacaggttcacaggccagacatttctggcaacaagatgaaccccctcagagcccttgggatagggtgaaagatctggcaacagtctacgtggatgttttaaaggacagtggaagggactatgttagccagttcgagggctctgcgctgggcaaacaactcaacttgaagctgctggacaattgggattcagttaccagcaccttctcgaagctcagggagcaactgggcccggttacccaagagttctgggataacctggaaaaagagacagaggggctgagacaggagatgagcaaagacctggaagaggtgaaggcaaaggttcaaccatacctggacgatttccagaaaaagtggcaggaagaaatggaactttatagacagaaggtggagcccctgagagctgaattgcaggagggggctagacagaagctacacgagcttcaagagaaacttagccccttgggggaggagatgagggattgcgcccgagctcacgtcgacgcccttcgtacccatctggcgccttatagcgacgaattgaggcaaaggttggcagccaggctggaggctcttaaggagaacgggggtgcaagacttgccgaatatcacgcaaaggctaccgaacatctcagtacattaagcgagaaagccaaaccagccctggaggatctgagacaaggtctgctgccagtacttgagtcatttaaggtcagtttcttgagcgctttggaggaatacacaaagaagttgaacacacaa

SEQ ID NO: 6383 - DNA, 801 bp, Artificial Sequence
  Description of Artificial Sequence: Synthetic coding sequence
atgaaagcggctgtgctaacacttgctgttctgtttttaactggctcacaagcgagacacttttggcaacaggatgagcctccccaatccccctgggaccgagtaaaggatttagctaccgtttatgtcgatgtccttaaagattctggcagagactacgtcagccagttcgagggttccgcattgggaaaacagctcaacttgaagttgctggataattgggatagtgttacatctaccttttctaagttgcgtgaacaattgggaccagtgacacaagagttttgggataatttggaaaaggaaactgagggattgcgacaagaaatgtcgaaggatttagaggaggttaaggcaaaagtgcaaccatacctagatgatttccagaaaaaatggcaggaagaaatggaattatacagacagaaagtcgaaccattacgtgcggagttgcaggaaggagcacgacaaaaactgcacgagttgcaagaaaaactcagcccgcttggagaggaaatgagagattgtgctcgagcccatgtggatgcgctgcgaacccaccttgcgccgtattctgatgaattgcgtcaacgtctcgctgcccgtctcgaagcactcaaggaaaatggaggagctcgtttggctgaatatcatgcgaaggctacagagcacctttcaacattgagcgaaaaagcgaaaccagcacttgaggaccttcgtcagggacttctgccggtcctcgaatcatttaaggttagttttctttccgctctcgaggagtatactaaaaaactcaacacacaa

SEQ ID NO: 6384 - DNA, 801 bp, Artificial Sequence
  Description of Artificial Sequence: Synthetic coding sequence
atgaaggccgcggtgcttaccctcgctgtgctgttccttactggctcacaagcacgccatttctggcagcaggatgaacctcctcaatccccatgggatcgggtgaaagatctcgcaaccgtgtatgtggacgtccttaaggattccggacgcgactacgtgtcacagtttgaaggttcggcgttggggaagcaactgaacctgaagctgctcgataattgggactccgtgacctcgaccttttcgaagctccgggagcaactgggacctgtcacccaggagttttgggacaacctggaaaaggaaaccgagggacttagacaggaaatgagcaaagatctggaagaagtcaaagcaaaggttcagccatacctggacgactttcaaaagaagtggcaagaagagatggagctgtaccggcaaaaggtcgagcctcttagggcggagcttcaggaaggcgcgcggcagaaactccatgagcttcaggagaaactgtcgcccctcggtgaagaaatgcgggattgcgcgcgggcacatgtggatgcactgagaacccaccttgcaccctactcggacgaacttcgccaaagactcgcagcaagactcgaagcacttaaggaaaatggaggagcccgactcgctgaataccatgcgaaggcgaccgagcatctgtcaaccctctcggaaaaagctaagccggcattggaggacctgaggcaagggctcctgcctgtcctcgaatcatttaaggtcagcttcctgtcagcattggaagaatacaccaagaagctgaacacccaa

SEQ ID NO: 6385 - DNA, 801 bp, Artificial Sequence
  Description of Artificial Sequence: Synthetic coding sequence
atgaaggcagcagtgctcactctcgctgtgctctttctcaccggaagtcaagccaggcacttctggcagcaggacgagccaccacagtcaccatgggatcgcgtgaaagacttggcaacggtctatgttgacgtcctgaaagatagtggtagggactacgtatcccagtttgaaggatcagcgctgggcaaacagttgaacctcaagcttttggacaactgggacagtgttacctccaccttcagtaagcttcgcgagcagttgggccccgttacccaggaattctgggataaccttgaaaaggagacagagggtctgagacaggagatgtccaaggacttggaggaagttaaggccaaagttcagccctatctcgacgacttccaaaaaaagtggcaggaagagatggagttgtacaggcagaaggttgagccacttcgcgcagagctgcaggagggtgcgagacagaagctgcacgagctgcaagaaaaactgtcacccttgggtgaggaaatgagagactgcgcaagggcccatgtggacgctctgaggacacacttggcaccctacagtgacgaactcaggcagcgcctggcggcgagactcgaggccctcaaggagaatggaggcgctcgcttggctgagtaccacgcaaaggcgacagagcacctctccactttgtccgagaaggccaaacccgcccttgaggatcttcgccaaggtttgctcccggttttggagagtttcaaagtgagcttcctgtctgctcttgaggagtacacaaagaagctcaatacccaa

SEQ ID NO: 6386 - DNA, 801 bp, Artificial Sequence
  Description of Artificial Sequence: Synthetic coding sequence
atgaaggcggcagtgctgaccctcgccgttttgttcttgacaggcagtcaggcccgccacttttggcaacaggatgagccgcctcagtcgccctgggatcgggtgaaggatcttgccaccgtttacgtggacgtcctgaaggacagcggtcgcgactacgtcagtcagttcgaggggagcgcgctgggtaagcaattgaacctgaagctcctggacaattgggattcggttacctccacattctcgaagctgcgggagcagttgggtccggtcacgcaggagttctgggacaaccttgaaaaggagaccgaggggctgcgccaggagatgtcgaaggatctggaggaggtcaaggctaaggtccagccctaccttgatgatttccagaagaaatggcaggaggagatggagctctacaggcagaaggtcgagccccttagagcagagcttcaggaaggcgccaggcagaagttgcacgagctgcaagaaaaactgagccccctgggcgaggaaatgcgtgactgcgctcgtgcccacgtcgatgctctccgtacgcaccttgccccgtactctgacgagctgcgtcaacgtctcgccgcgcgactggaggctctcaaggagaacggcggcgcgcgtctggccgaatatcacgcgaaagccactgagcacctctccacactgtccgagaaagctaagcccgccctggaggaccttcgtcagggtctgctgcccgttctagagtctttcaaagtgtccttcctctccgccttggaggagtataccaaaaagcttaacactcag

SEQ ID NO: 6387 - DNA, 801 bp, Artificial Sequence
  Description of Artificial Sequence: Synthetic coding sequence
atgaaagctgcagtgcttacgctggctgtgctcttcctcactggttcgcaggccagacatttctggcaacaagacgaaccaccccaatcaccatgggatagggtgaaagatcttgcgactgtgtatgtcgatgtgcttaaggactccggaagagactacgtttcccagtttgagggtagcgcacttgggaagcagcttaacttgaagctcttggataactgggactcagtgactagcactttctccaagctccgagaacagctgggtcctgtgactcaggagttttgggataatcttgaaaaggaaaccgagggcctgcgtcaagagatgtccaaggatctcgaagaagtcaaggcaaaagtgcagccataccttgacgatttccagaagaagtggcaggaagaaatggaactgtaccgacaaaaagttgaaccacttcgggccgagctgcaagaaggagcgcgacagaagctgcatgaacttcaagaaaagctgtcccctcttggtgaggaaatgagagattgcgcacgcgcacatgtggacgcgctgagaacccatctcgcaccctattcagatgaactgagacagcgactggcagcacgactggaggcattgaaagaaaacggaggcgcccggctcgcagagtaccatgcgaaggcaaccgaacatctcagcaccctctcagagaaggcaaagcccgcattggaagatctcagacaaggactgctcccggtgctggagtcctttaaagtgtcgtttctttccgcccttgaggaatacactaagaagctgaacacccaa

SEQ ID NO: 6388 - DNA, 801 bp, Artificial Sequence
  Description of Artificial Sequence: Synthetic coding sequence
atgaaggccgctgtgctgactctcgccgtgttattccttaccggaagccaggccagacacttttggcagcaggacgaaccccctcagtccccctgggatagggtcaaagatctggccacagtgtacgtggatgtgctcaaagacagcggcagagactatgtctctcagtttgagggaagtgcactgggcaaacagctgaatctgaagctgctagacaattgggactctgtgacaagcacattctctaagctgcgcgagcagctcggccctgtgacacaggagttctgggataatctggagaaggagaccgagggcctccggcaggagatgtctaaggatctcgaagaggttaaggctaaagttcaaccctacctggacgacttccaaaagaagtggcaagaagaaatggagctgtatcggcagaaggtggagccactgagggcagagctgcaggaaggagctcggcagaagctgcatgagctgcaggaaaagctcagccccttaggagaggaaatgcgggactgtgcaagggctcatgttgacgctttgagaacccacctggccccctactcagatgaactgagacaaaggttagccgcaaggttagaggcactgaaagagaatggaggggcccgtctggccgaatatcatgctaaggctactgaacacctgtcaactctcagcgagaaagcaaaaccagccctggaggacctcaggcaaggtctactgcctgtgcttgagtcattcaaagtttcttttctatccgccctggaagagtacaccaagaagctaaatacccaa

SEQ ID NO: 6389 - DNA, 801 bp, Artificial Sequence
  Description of Artificial Sequence: Synthetic coding sequence
atgaaggccgccgtcctgacacttgcggtgctgttcttgacaggttcccaggcaaggcacttctggcaacaggacgagccgccacaaagtccttgggaccgggtgaaggatttggctaccgtgtacgtcgatgttttgaaagactctggccgagactacgtgtcccagtttgaggggtctgccctgggtaaacagctgaatcttaagctgctggataactgggactctgtcacctccaccttttctaagctgagggagcaattgggtcccgtgactcaggagttctgggataacctggagaaggagaccgagggactgcgccaggaaatgtctaaggacctggaggaggtgaaggcaaaggtacagccatatctggatgactttcaaaagaagtggcaggaagagatggaactctacaggcaaaaggtcgaacctctgcgagctgagttgcaagagggcgcacgacaaaaactccacgaactccaggaaaaactctcacctcttggagaggagatgcgggactgtgcaagggctcatgtggacgccctgaggacacatctcgcaccatattcagatgaacttcgccaacgactggccgcgagacttgaagccctcaaggagaatggcggagcccgcctggctgaataccatgccaaagctaccgagcatctgagcacgctttccgagaaggctaaacccgcactggaggacctcaggcaggggctgcttccggtgctggagtcatttaaggtgagctttctttccgccctggaggagtatacaaagaagctgaacactcag

SEQ ID NO: 6390 - DNA, 801 bp, Artificial Sequence
  Description of Artificial Sequence: Synthetic coding sequence
atgaaagccgccgtgctgactctggctgtgctgtttctgactggatctcaggccaggcatttttggcaacaggatgaaccgccccaatcgccgtgggatcgggtgaaggacctggcgacggtttacgtggacgtgttgaaagattcgggcagggattacgtgtcccaatttgaaggaagcgcgttggggaagcaattgaacttgaagctgctggacaactgggactctgtgacttccactttctccaaactgcgcgaacagctggggcctgtgacgcaggagttctgggataacttggagaaagaaacggaaggccttcggcaggaaatgagcaaagacctggaggaagtcaaagctaaggtgcaaccatacctcgatgatttccagaagaagtggcaggaagagatggaactgtatcgccagaaagtcgagccactgcgggctgagttgcaagagggtgcacgccagaagctgcacgagctgcaggaaaagctgtcgccactgggagaggaaatgcgggaccgggctagagcccacgtggacgcacttagaacccacctggcgccttactcagatgagctccgacagcggctggctgcccgcctggaagccctcaaggaaaatggaggagcccgccttgcggaataccatgcaaaggcgaccgaacacttgtccactctctccgagaaggccaagccggccctggaagatctgcgccagggactgctgccagtgctcgagtcgttcaaagtctcttttctctcagctctcgaagagtacactaagaagttgaacactcaa

SEQ ID NO: 6391 - DNA, 801 bp, Artificial Sequence
  Description of Artificial Sequence: Synthetic coding sequence
atgaaggcagctgtgcttactctggctgtgttgttcctcaccggaagccaagcccgacacttttggcagcaggacgaaccaccacaatcaccctgggatcgggtgaaggatctggccacggtgtacgtcgacgttcttaaggactcgggacgggactacgtgagccaattcgaaggctccgcgcttggtaagcagctgaacctgaaactcctggacaattgggacagcgtcacctcgactttctccaagctccgggaacagcttgggccggtcacccaagagttctgggacaacctggagaaggaaaccgaaggtctgcggcaagaaatgtcaaaggatcttgaagaggtcaaggccaaagtgcagccataccttgatgatttccagaaaaagtggcaggaggaaatggagctttatcgacaaaaagtcgaaccactccgagcagaacttcaagaaggggcacggcagaaactccacgagctgcaggaaaaactttcgccgttgggggaagaaatgagagatagagcgagagcccacgtggacgcactgcgcacccatctggccccgtactccgatgagttgaggcagcgcttggccgcgaggctcgaggctctgaaagagaacggaggagcacggcttgccgaataccatgcgaaagcaactgagcacctgtcgaccctgagtgaaaaggcgaagcctgccctcgaggacctgcgccagggactcctgccggtgctggaatcattcaaggtgtcttttctgtctgctttggaggagtacactaagaagctgaatacgcaa

SEQ ID NO: 6392 - DNA, 801 bp, Artificial Sequence
  Description of Artificial Sequence: Synthetic coding sequence
atgaaagccgcggttctgacacttgccgtgctgtttcttacaggtagtcaggctcgccatttttggcagcaggatgagcccccgcagtctccgtgggatcgcgtcaaggatttggctactgtgtacgtagacgtcctgaaagattcaggacgggattacgtttcccagttcgaaggctctgccttgggtaagcaacttaacctgaagctgttggacaactgggattccgtcacatcaactttttccaagctgagggagcaactgggccccgtgacccaagagttttgggataacctcgagaaagaaaccgaaggattgcgccaggaaatgagcaaagacttggaggaagtcaaggcaaaagtgcagccttacctggacgactttcaaaaaaaatggcaggaggagatggagctctacagacagaaagtggagccactgcgggccgagctgcaggagggagcacggcagaaacttcacgaactgcaggaaaagttgtccccgctgggggaggaaatgagagacagggccagggcccacgtggacgcacttcgaactcacctcgcaccttactctgatgagctgcggcagagactcgccgctagactggaggctctcaaggagaacggcggggctaggctcgccgaataccacgccaaagccacagaacacctgagcacgcttagcgaaaaggccaaacctgctttggaagatttgagacagggactgttgcccgtcctggagtcctttaaggtttctttcctgtccgccctggaagaatataccaagaagttgaatactcag

SEQ ID NO: 6393 - DNA, 801 bp, Artificial Sequence
  Description of Artificial Sequence: Synthetic coding sequence
atgaaggcggcagtccttactctggcggtcctctttctgaccgggagccaagctcggcacttttggcagcaagacgaacctccgcagtcgccatgggatagagtcaaggatctcgccactgtgtacgtagacgtgctgaaggattcgggccgggactacgtgtcccagtttgagggcagcgccctgggaaagcaactcaatctgaaacttcttgataactgggatagcgtgacttcgactttcagcaaactcagagaacagctcggcccagtgactcaggaattttgggataaccttgagaaggaaacggaaggattgcgacaagaaatgtcaaaggatcttgaggaggtgaaggcaaaggtgcaaccttacctggatgatttccagaagaaatggcaagaggaaatggaactgtacagacaaaaagtcgaaccacttagggcagaactccaggagggagctcggcagaagctccatgagcttcaggaaaagctctccccactgggtgaagaaatgagagacagagcaagggcacatgtggatgcacttaggacccaccttgccccatattccgacgaactccggcagcgacttgcagcccgcctcgaggcactgaaagagaatggtggagcccgactggctgaataccatgcgaaggcgaccgaacatctgtcgactctctcggagaaagcgaagcctgccctggaggatctgcgtcaaggactgctgcccgtcctcgagagctttaaagtttcctttctttcggctcttgaagaatacaccaaaaaactcaacacccag

SEQ ID NO: 6394 - DNA, 801 bp, Artificial Sequence
  Description of Artificial Sequence: Synthetic coding sequence
atgaaggcagccgtcctgactctggcggtcttgttcctcactgggagccaagcacgccacttctggcagcaagacgagccgcctcaatccccgtgggatcgcgtgaaagatttggccaccgtgtacgtggatgtgctgaaggattccgggcgcgactacgtgtcgcaattcgagggttcggccttggggaagcaactgaacctgaagctgctggacaattgggactccgttacgagcaccttttctaagctcagagaacagttgggaccagtcacccaggagttttgggataacctggaaaaggaaaccgagggcctgcggcaggaaatgtccaaggacctggaagaggtgaaggctaaggtgcagccatacctggacgatttccagaagaagtggcaagaagaaatggaattgtacaggcaaaaggtcgagcctctgcgcgccgagctccaggagggggccaggcagaagctgcatgagctgcaggagaaactgtccccgctgggagaagaaatgagggatagagctcgagcgcacgtcgacgcactccgcacgcatctggctccttactcggacgaattgcgccagagacttgctgcaaggctcgaagcgttgaaggaaaacggaggtgcccgcctcgcggaataccacgccaaagctactgaacacctgagcaccctttcggagaaggccaagcccgcgctcgaggacctgagacaaggcctgctcccagtgctggagagcttcaaggtgtcgttcctgagcgccctggaagaatacactaagaagctgaacacgcaa

SEQ ID NO: 6395 - DNA, 801 bp, Artificial Sequence
  Description of Artificial Sequence: Synthetic coding sequence
atgaaggccgctgttctaactctggcagtgttgtttctaaccggctcccaggccaggcacttttggcaacaggatgagccaccacagagcccctgggatcgcgtaaaagacttggctacagtgtatgtggatgtactgaaggacagcggcagggattatgtctcccagtttgaaggtagcgccctgggaaaacaactgaacctgaaattgcttgacaattgggattcagtgacttcgaccttttctaagctgagggaacagctgggacccgtgacacaagagttttgggacaatttggaaaaggaaacagaaggtcttagacaagagatgagtaaggacctggaagaagtgaaggccaaggtgcagccttacttagacgattttcagaagaaatggcaggaagaaatggaactgtataggcaaaaggtggagcctctgagagcggaacttcaagagggcgccagacagaagcttcacgaactgcaggaaaagttgagccccctgggagaagagatgcgtgacagggccagagcccatgtggatgctctgagaacacacctggctccatactccgatgagctacggcaacggctggcagctagattggaggccctgaaggagaacgggggcgctcgtctagccgaatatcatgctaaggccaccgagcatttgtctactctttcggaaaaggccaaacctgcgttggaggacttgaggcagggtctcctcccagtgcttgaatctttcaaagtctcatttctttccgcattagaggaatacaccaaaaaattaaacactcag

SEQ ID NO: 6396 - DNA, 801 bp, Artificial Sequence
  Description of Artificial Sequence: Synthetic coding sequence
atgaaggcagcagtccttacgcttgctgtgctttttcttaccggttcgcaggcgcggcatttctggcaacaagatgaacctccacagtcaccgtgggatcgggtgaaagatcttgcaaccgtgtacgtcgatgtccttaaagactcaggtcgcgactacgtctcccagttcgagggatcggcactgggaaagcaattgaatctcaaactgcttgataattgggattcagtgacgtccactttttccaaactgcgagaacaacttggtccagtcacccaggagttttgggacaatctggaaaaggagactgaaggacttcgtcaggaaatgtcgaaggatctcgaagaagttaaggcaaaagtgcagccatacctcgatgactttcagaaaaagtggcaagaagaaatggagttgtaccgtcaaaaggtcgaaccacttagagcggagcttcaagagggtgcgagacaaaagctgcatgagcttcaagaaaaactcagcccactcggagaggaaatgagagacagggcccgggcacatgtggatgcgctgcgcacccatctcgcaccgtactcggatgaactgaggcagcgactcgctgcgagattggaagccctcaaggagaacggcggagctagactcgccgaataccacgccaaggcaacggagcacctttcgaccctttcggagaaagcaaaaccagccctggaggatctgaggcagggtctgctgcctgtcctcgaatcattcaaggtgtcattcctgtccgccctggaggaatacaccaagaagctgaacacgcag

SEQ ID NO: 6397 - DNA, 801 bp, Artificial Sequence
  Description of Artificial Sequence: Synthetic coding sequence
atgaaggcagccgtcctcaccctcgctgttctgtttcttacaggctcacaggctagacacttttggcagcaggatgagcctccacagtccccttgggatcgggtcaaggatctggccaccgtgtacgtcgacgtgttgaaagacagcggaagggattatgtatcccagtttgaaggctccgcattgggcaagcagctgaacttgaaactgttagataattgggacagcgtgacctcaacattctccaagttaagagaacagctggggcctgtgacacaggagttttgggacaacctcgagaaggaaaccgaaggcctgcgacaggagatgagcaaggatctggaagaagtaaaagctaaggtgcaaccctatctcgatgacttccaaaaaaagtggcaggaagaaatggaactgtaccgacagaaggtggagccactccgtgccgaactgcaggagggtgccaggcagaagttgcacgagttgcaggagaagctgtctcccctgggtgaggagatgagagaccgggcccgagcacatgttgatgccctgagaactcacctcgccccatactctgacgaactgcgccagaggctagccgctaggctggaggccctgaaggagaatgggggtgcgcgtttggccgaatatcacgcgaaggcaactgagcacttgtcaactttgagcgaaaaggctaaacctgccctagaagacttgcgccagggcctcttaccggttctcgagagctttaaggtaagctttttgagtgccctggaagagtatacaaagaagttgaacacacag

SEQ ID NO: 6398 - DNA, 801 bp, Artificial Sequence
  Description of Artificial Sequence: Synthetic coding sequence
atgaaagctgctgttctgaccctggctgtactgttcctaacaggctcacaggccagacatttttggcaacaagatgagcctccgcagagcccctgggaccgcgtcaaggacctcgccactgtctacgtcgatgtgctgaaggacagcgggcgcgactacgtctcccagtttgaaggctccgcactgggaaagcagcttaatctgaagctgctcgacaattgggactccgtcacctccaccttctcgaaactgcgcgaacagctgggcccggtaacgcaggagttctgggacaatttggaaaaggaaacagaggggttgcgccaggaaatgagcaaagatttagaagaagtgaaggcaaaagtacaaccgtaccttgacgattttcagaaaaagtggcaggaggaaatggaactgtatcgccagaaagtggaacctctgcgcgctgaactccaggagggggcaagacagaaattgcatgagcttcaggagaaactgtcccctctgggcgaggagatgagggatcgcgccagggcacatgtggatgcacttcggacacatctggccccctatagtgacgagcttcgtcagaggctggctgcccgactggaagcacttaaggagaacggcggggcaaggctggcggaataccatgcaaaagccactgaacatttatcaacactgtccgagaaagccaaaccggcattggaggatctgaggcagggtctcctgcccgtgctcgagagctttaaagtgtcctttcttagtgccctggaagaatatacaaaaaagctgaacacccag

SEQ ID NO: 6399 - DNA, 801 bp, Artificial Sequence
  Description of Artificial Sequence: Synthetic coding sequence
atgaaagcggcggtattaacgctagcggttttatttttaacgggttcgcaagcgcgacatttttggcaacaagatgaaccgccgcaatcgccgtgggatcgagttaaagatttagcgacggtatatgttgatgtactaaaagattcgggtcgtgattatgtttcgcaatttgaaggttcggcgctaggtaaacaattaaatctaaaactactagataattgggattcggttacgtcgacgttttcgaaattacgagaacaattaggtccggttacgcaagaattttgggataatttagaaaaagaaacggaaggtttacgacaagaaatgtcgaaagatctagaagaagtaaaagcgaaagtacaaccgtatttagatgattttcaaaaaaaatggcaagaagaaatggaactatatcgacaaaaagtagaaccgttacgagcggaactacaagaaggtgcgcgtcaaaaactacatgaactacaagaaaaattatcgccgctaggtgaagaaatgcgtgatcgtgcgcgagcgcatgttgatgcgttacgaacgcatctagcgccgtattcggatgaattacgtcaacgtttagcggcgcgtttagaagcgctaaaagaaaatggtggtgcgcgtctagcggaatatcatgcgaaagcgacggaacatttatcgacgttatcggaaaaagcgaaaccggcgttagaagatctacgtcaaggtttattaccggtattagaatcgtttaaagtatcgtttctatcggcgctagaagaatatacgaaaaaattaaatacgcaa

SEQ ID NO: 6400 - DNA, 801 bp, Artificial Sequence
  Description of Artificial Sequence: Synthetic coding sequence
atgaaggccgctgtgctgaccctcgctgtgttgtttctgactggttcccaagcacgtcatttctggcagcaggatgaaccgccgcagagcccttgggatcgcgtgaaggatctggccaccgtgtatgtcgacgtgctgaaggactcagggcgcgattacgtgtcgcaattcgaaggatcggcgctcggaaaacaactgaacctcaagttgctggacaactgggactccgtgacctcgacgttctcgaaattgcgagagcagctcggccctgtgacccaggagttctgggacaatctcgagaaggaaaccgaagggctgagacaagaaatgtctaaggatctcgaggaagtcaaagcgaaagtgcagccgtacctggacgattttcagaagaagtggcaggaagaaatggagctgtacagacagaaggtcgagcctctgcgcgctgagctccaagaaggagcccgccaaaagctgcacgagctccaagagaaattgtccccgctcggagaagagatgagggaccgcgcgcgggctcatgtcgacgcactgagaacccatcttgctccatactctgacgagctgcggcaacgcctggcggctcggctggaagcactgaaagaaaacggcggagcgagactcgccgagtaccacgccaaggctaccgagcacctttcaactctgtccgagaaagctaagccagcccttgaggacctgaggcagggactgttgcctgtgctcgagtcgttcaaggtgtcgttcctgagcgcactggaagaatacactaaaaagctcaatacccaa

SEQ ID NO: 6401 - DNA, 801 bp, Artificial Sequence
  Description of Artificial Sequence: Synthetic coding sequence
atgaaggcggcagtgctgacgctcgcggtcctttttctaaccggttctcaagcccgacatttttggcagcaggatgagccacctcagtcaccatgggaccgagtaaaggacctggcaactgtgtatgtggacgtgctcaaagattccgggcgcgattacgtgagccagttcgaaggatcggcacttggcaaacaacttaatctcaaactgctggataactgggacagcgttactagtacattctcaaagctgcgagagcaactaggcccggtcacacaagagttctgggataaccttgagaaggagaccgagggactccgacaggagatgtccaaggatctagaagaggtgaaagcaaaggtgcaaccctaccttgacgacttccaaaaaaagtggcaagaagaaatggaactgtaccgacagaaggtcgagccacttcgggccgaactccaggagggtgcaaggcaaaagctacacgagctgcaggaaaagctgtcaccccttggagaggaaatgagagacagggcccgagcccacgtcgacgccctgcgtacccacctcgcaccatactctgacgagttaaggcaaagactggctgccaggctcgaagcactgaaagaaaacggcggggctaggttggcggaatatcacgccaaggccaccgaacatctgtccactctatcagagaaggctaaaccagccctggaggacctgagacagggcctactgccagtgctcgagtcttttaaagtgtcttttctgtccgctctcgaggagtacactaagaagctgaacacccag

SEQ ID NO: 6402 - DNA, 801 bp, Artificial Sequence
  Description of Artificial Sequence: Synthetic coding sequence
atgaaggcagctgttttaacacttgccgtgctcttccttaccggctcacaggcccgacatttttggcaacaggacgagcccccacagagcccctgggacagggtgaaagatctagctacagtctacgtggatgtgctcaaggattctggcagggattacgtgagccagtttgagggcagcgccctcggcaagcagctcaacttaaaattactggataactgggatagtgtcacctcaacctttagcaagcttcgagaacaactagggcccgtcacgcaagaattctgggacaatctcgaaaaagaaacggaaggtcttagacaggagatgagcaaggacctggaggaagttaaagctaaggtgcaaccttatttagatgatttccagaaaaagtggcaggaagaaatggaactctatagacagaaagtcgaacccctgagagccgaactgcaagagggcgccaggcagaaactacatgaactgcaagaaaagttgtcacccctgggtgaagagatgcgggacagggccagagcacacgtggatgcattacgcacgcacttagccccttatagtgacgaattaagacagcgactggccgcacggctcgaagcactgaaggaaaatggcggagctcgccttgcagaataccacgccaaggccactgagcatctctctaccctttccgaaaaggcaaagcctgccctggaggacttgaggcaaggattacttcccgtgttggagtcatttaaggtgtcttttctgtcggctctggaagagtacacaaaaaaactcaatacacag

SEQ ID NO: 6403 - DNA, 801 bp, Artificial Sequence
  Description of Artificial Sequence: Synthetic coding sequence
atgaaggctgcagtgctgaccttggctgtgttgtttctaaccggttctcaagcacggcacttctggcagcaggatgaaccaccacagagcccgtgggaccgtgtgaaggatctggctactgtctacgtggatgtgctgaaggatagcgggagggattacgtgtctcagttcgagggcagcgccttgggaaagcagctcaaccttaaactactggacaactgggattctgtgacttcgacctttagtaaactccgtgagcagttgggccccgttacccaggagttctgggacaacttggaaaaggagacagagggactaagacaagagatgagtaaggatctagaggaagttaaggcaaaagtacagccatacctggatgactttcagaaaaagtggcaagaggaaatggaattgtacagacaaaaggtggagcccctaagagcagagctacaggaaggtgcccggcagaagctgcatgagctgcaggagaagctgtctcctttaggggaggaaatgcgggacagggcacgtgcccacgttgacgcactgaggacacatctcgcaccttatagtgacgagctgcggcagcgtctagccgcacggttagaagcgctcaaggagaatggaggcgccagactagccgagtaccatgctaaggctactgagcacctgagtaccctgtccgaaaaggcaaaacccgctctggaagatctgcgccaaggactgttgcccgttctggagagtttcaaggttagcttcttgtcagctcttgaggagtatacgaagaagttaaatacccag

SEQ ID NO: 6404 - DNA, 801 bp, Artificial Sequence
  Description of Artificial Sequence: Synthetic coding sequence
atgaaggctgcggtgctgacattggctgtgctgttcctgacaggatcacaagccagacacttctggcagcaagatgagcctccacagagtccctgggaccgggtgaaggatcttgctacagtctatgtcgatgttctaaaagactccggccgcgactatgtctcccaattcgagggaagtgctctcggaaagcaattaaaccttaagctgttggacaactgggattcagtaacgagtacgttctccaaactgagggaacaactcggcccagtgacccaggagttttgggacaaccttgaaaaggagaccgagggacttcgccaggagatgtccaaagacctggaggaagtgaaagccaaagtgcagccttacctcgacgacttccagaagaagtggcaagaagagatggagctctaccgacaaaaggtagagcccttgcgagcagagttacaggaaggagcccggcagaagctgcacgagctgcaggaaaagttgagcccgctcggggaggagatgcgcgatcgggccagagcccacgttgatgccctgcggacgcatctcgccccttattcggatgagctgcggcagcgactggcagcccggcttgaggcactcaaagaaaacgggggggcacggctggcagagtaccatgccaaggccaccgaacatctctccaccctttctgagaaagccaaacccgccttagaggacctccggcaaggcctgttgcctgtgctggaaagtttcaaagtgagcttcttatcagctctcgaagagtacactaaaaagctgaatacacag

SEQ ID NO: 6405 - DNA, 801 bp, Artificial Sequence
  Description of Artificial Sequence: Synthetic coding sequence
atgaaggctgcggtcctgacactcgccgtcctgtttttgactgggtcccaagccagacacttttggcagcaagatgagcctccacagtctccatgggaccgcgtaaaggatctagcgaccgtctatgtcgacgtgctcaaggactccggtcgcgattacgtatcacagttcgaaggcagcgccctggggaaacagctcaatctaaaactgctggataattgggatagcgttacatccaccttttcaaaactgcgtgaacagctgggtccagtgacccaagaattttgggacaatctagagaaagagactgagggactgagacaagaaatgagcaaagacctggaagaggtgaaagctaaagtgcagccctatttggacgatttccagaaaaagtggcaagaggagatggaactgtacaggcaaaaggtggaaccgctgcgcgccgagctccaagaaggagccaggcagaagctgcacgagcttcaagagaagctgtcacccctgggcgaagaaatgagggatcgggcacgtgctcatgtggatgcactcaggacccacctagccccttactccgatgaactccgccagcgccttgccgctcgactggaggcactgaaagaaaatgggggtgcacggcttgcagaataccatgccaaggcgactgaacacctctccactctgagcgaaaaggccaagcccgctctggaggatctgcgccagggactgttgccagttctagaatcattcaaggtttccttcctgagtgccctcgaagaatacacaaaaaaactgaacacacag

SEQ ID NO: 6406 - DNA, 801 bp, Artificial Sequence
  Description of Artificial Sequence: Synthetic coding sequence
atgaaagcagccgtccttaccttggctgtcctttttcttaccggcagccaggcacgtcatttctggcaacaggatgagcctccacaatccccatgggatagagtgaaggatcttgccacggtgtacgtcgatgtcctcaaagatagtggaagggactacgtgtcacagttcgagggctcggccctgggtaaacaactgaatctgaagctgttggataactgggattcggtaactagcactttttcaaagctcagggaacagcttggcccggtcactcaagaattctgggacaacctggaaaaggaaactgagggcctcagacaagaaatgtccaaagatctggaagaagtgaaggcgaaggtccagccgtacctggacgactttcaaaagaagtggcaagaggaaatggagctctacagacaaaaggtggagccacttagggcggaactgcaggagggagccaggcaaaaactgcatgagctccaagagaaattgtcgcctctcggggaagaaatgagagatcgggcccgggctcacgtggacgcactgcgaactcatctggccccatattcggacgaactgcgtcaacgcctcgcagcgcgacttgaagcactgaaggagaacggcggggcgcggttggcagagtaccatgcaaaggctaccgaacacctgtcgacgctgtcggagaaggcaaagcctgcacttgaggatcttcggcagggactcttgccagtgctggaatcgtttaaggtgagcttcctgtccgcactggaagagtacaccaagaagttgaacactcaa

SEQ ID NO: 6407 - DNA, 801 bp, Artificial Sequence
  Description of Artificial Sequence: Synthetic coding sequence
atgaaggctgccgtcctgaccctggccgtgctcttcttgacgggcagccaggcacgtcacttttggcagcaggacgaacctcctcagagtccctgggacagggttaaagatctggcgacagtgtatgtggatgtgctcaaagattcaggcagggattacgtaagccagtttgagggatccgccctcggcaaacagctgaatctgaaattactggacaattgggacagcgttacatctactttcagcaaacttagggagcaattgggaccagtcacacaggaattttgggacaatcttgagaaagaaactgagggcttgcgacaagaaatgtccaaagacctggaggaagtcaaggccaaagtgcagccatatctagatgactttcagaaaaaatggcaagaggagatggagctataccgtcagaaagtcgaaccacttagggcggaactgcaggaaggagccagacaaaagctgcatgagttgcaggagaagctgagcccactcggcgaagagatgagagaccgtgccagagctcatgtggatgcactgcgtacccatctggccccatacagtgatgaactgcggcaaagattggccgctagactggaagcattgaaagagaacgggggggcgaggttggcggagtaccatgccaaggctactgaacacttgtctacactgagcgaaaaggcaaaacctgcgctggaggatctccgtcaaggcctattgccagtgcttgagagcttcaaagtcagttttctttctgcactggaagagtataccaaaaaacttaatacccaa

SEQ ID NO: 6408 - DNA, 801 bp, Artificial Sequence
  Description of Artificial Sequence: Synthetic coding sequence
atgaaagctgccgtattgaccctggccgtgcttttcttgaccggctcccaagctcgtcacttctggcagcaggacgagccgccccagtcaccatgggatagagtcaaggatctcgcaactgtgtacgtggatgttctgaaagattccgggcgcgattatgtcagtcagtttgaggggagcgcccttgggaagcagttgaacctgaaacttctcgataattgggatagcgtgacatctacattttccaagctacgcgagcagcttgggcctgtgacacaggagttttgggataacctggaaaaggagactgaaggtcttagacaggagatgtctaaagatcttgaggaggtgaaggctaaggtgcagccctacctagacgacttccaaaagaagtggcaggaggagatggagttgtatcgccaaaaagttgaaccattgagggcagagcttcaggaaggcgcacggcagaagctccacgagctccaagaaaagctgagcccccttggcgaagagatgcgggacagagcacgggcccatgtggatgcattgcggactcatctagctccctatagcgacgagctgcgccagcgcctagctgcgcgacttgaagctctaaaagagaacggaggggctagacttgctgagtaccacgctaaggctactgagcatctaagtacgctctcggaaaaagcaaagcccgccctagaggacctcagacagggcctgctccccgtcttggaatccttcaaggtgtcctttctttctgcacttgaggagtatacgaagaaacttaacacccag

SEQ ID NO: 6409 - DNA, 801 bp, Artificial Sequence
  Description of Artificial Sequence: Synthetic coding sequence
atgaaggcagcagtcctgaccctcgcagtgctgtttcttaccggatcacaggcccgacatttctggcagcaggacgaaccaccacagtcgccctgggatcgggtcaaggaccttgcaaccgtgtacgtcgacgttctgaaagatagcggaagggattatgtgtcccagttcgaaggttccgccctcggcaagcaacttaatctcaagctgctcgataactgggattccgtgacgagcacctttagcaaactcagagagcagcttggtcctgtgactcaagaattctgggataacctggagaaagaaactgagggccttcgacaagaaatgtccaaagatctggaggaagtcaaagccaaggtgcagccttacctggacgattttcaaaagaagtggcaagaagaaatggaactttataggcagaaggtggaaccacttagagccgaattgcaagaaggtgcacgacaaaagctgcacgagcttcaagagaaattgtccccattgggtgaggaaatgagagacagggcgagggcacatgtcgatgcacttcgaacccaccttgcaccttactcggacgagctccgacagcggctcgcggcaagacttgaggcgctcaaggaaaatggaggggcgagacttgcagaataccacgccaaggcaactgaacatctgtcgacgctttcggaaaaagcaaagccagccctggaagatctgagacaaggactgttgccggtgttggagtccttcaaggtttcctttctctcggcccttgaggagtacaccaagaagctgaacacccaa

SEQ ID NO: 6410 - DNA, 801 bp, Artificial Sequence
  Description of Artificial Sequence: Synthetic coding sequence
atgaaggccgcagtgttgaccctggcggtcctcttcctgaccggctcgcaagctcgccacttctggcaacaggatgaaccgccgcagtcgccatgggatcgcgtcaaggatcttgcgactgtgtacgtcgacgtgttgaaggactccggccgggactacgtctcgcagttcgagggatcggcgctgggcaagcaactgaaccttaaattgttggataattgggattcagtgacttcgaccttctccaaactccgcgagcaactcggccccgttactcaggagttttgggataacctcgagaaggagacggagggactgaggcaggaaatgtcaaaggaccttgaagaggtgaaagcaaaagtgcagccatatctcgacgatttccaaaagaagtggcaagaagagatggaactgtaccggcaaaaggtcgaaccgctgcgggccgagctccaagaaggagcccgccaaaagctgcacgaactgcaagagaagctgtcgcctctgggagaggaaatgcgcgaccgggccagagcccacgtggatgcgcttaggacccatctggccccgtactcggatgagctgagacagcggctcgctgcacggctcgaagcgcttaaggagaacggaggtgcccggctggctgaataccatgcgaaagctaccgaacatctctcgactctgagcgaaaaagccaaacctgccttggaggacctcaggcagggcctgctgccggtgctggagtcattcaaagtgagcttcctctcagccctggaggaatacactaagaagctgaacactcag

SEQ ID NO: 6411 - DNA, 801 bp, Artificial Sequence
  Description of Artificial Sequence: Synthetic coding sequence
atgaaggcagccgtgctgactcttgcagtcctcttcttgaccgggtctcaggccaggcatttttggcagcaggatgagccaccacagtctccctgggacagagtgaaagatctggccaccgtgtatgttgatgttctcaaggacagcgggcgcgattacgtttcgcaattcgagggctcggctctaggaaaacagctaaatctgaagctgcttgacaactgggattctgtgactagcaccttcagcaagttacgcgaacagttgggcccggtgacacaagaattttgggacaatctggaaaaagagaccgaaggacttcgtcaggaaatgagtaaggatctagaggaagtgaaagctaaagtgcaaccctatctggatgactttcagaaaaagtggcaagaagaaatggagttatatcgtcaaaaggtagaacctctgagagctgaactgcaagagggagccaggcagaaacttcacgaactgcaagagaaactgagcccccttggggaggaaatgcgggacagagctagggctcacgtggatgctctcaggacccatctggctccttactccgacgaattgcggcagcgcttggcggccaggcttgaggccctgaaagagaacggtggcgccagactcgccgagtatcacgcaaaagctaccgagcacctgtccaccctgtcagagaaagctaagcctgcacttgaggacttgcgtcagggactgctaccggtcctggagagcttcaaggtgtctttcctatccgctttggaggaatataccaaaaaattgaacactcag

SEQ ID NO: 6412 - DNA, 801 bp, Artificial Sequence
  Description of Artificial Sequence: Synthetic coding sequence
atgaaagcagcagtgctcacactagctgtactgtttcttaccggatcccaggcgcgacacttctggcagcaggatgaaccaccgcagagtccttgggatagagtcaaagatctggccacggtctacgttgacgtgttaaaggatagtggccgtgattacgtcagtcagtttgagggctcagcgctcggcaaacagctgaatctgaaactcctggacaactgggatagtgtgacctcgactttttccaaactgagggagcagctgggtcccgtgactcaggagttctgggacaatctggaaaaagagaccgaaggcctgcgccaggagatgtccaaagatctcgaagaagtgaaagctaaagtccagccatacttggatgatttccagaagaagtggcaggaggaaatggagctgtatcggcagaaggtggaaccactgcgcgccgagcttcaggaaggagcgcggcagaaactgcacgagcttcaggaaaagctgagtcctctcggggaggagatgcgagacagagcccgagcacatgtggatgcgcttagaactcacctcgccccttattccgacgaacttcgccagagattggccgcccgcctggaggcccttaaagaaaatgggggagcacgattagcggaatatcatgccaaggctactgagcatctttctacactctcggaaaaggccaagccagcccttgaggacctgcgtcagggcctcctcccagtgctggaatcttttaaggttagttttctcagtgccctggaggagtatacaaagaagcttaatacgcag

SEQ ID NO: 6413 - DNA, 801 bp, Artificial Sequence
  Description of Artificial Sequence: Synthetic coding sequence
atgaaagcagcagtattaacgctggctgttctattcttgacaggatcacaagctcgccatttttggcagcaggacgaaccaccacaatctccttgggatcgagtgaaggacctcgcaacagtctatgttgatgttctgaaagactccggcagagattatgtctcccaattcgaaggctctgccctaggcaagcagctgaatttgaaactactggataattgggactcagttacatctacctttagcaaattacgcgaacaattagggccggttacgcaagaattttgggataatctggagaaagagaccgaagggctgagacaagaaatgtctaaagatttggaagaggtcaaggctaaggtccaaccgtacctcgacgactttcaaaagaaatggcaagaggaaatggagttgtatcgccagaaggttgaaccgctgagggccgaactgcaggagggcgcccgacagaaacttcacgaactgcaagaaaaattatcccctttaggcgaggaaatgcgcgaccgtgcacgggcgcatgtcgatgcactgaggacgcaccttgccccatactcggacgagctccgacagcgactggctgcgcggctggaagcgcttaaggaaaatggtggcgctcgcttagcggagtatcacgcgaaagctacggaacacttatctacattatccgaaaaagcaaaacccgcgttggaggacttgcgccaaggtctcctcccagtgttagaatctttcaaagtatctttcctgagcgcacttgaggaatatactaaaaagcttaatacacag

SEQ ID NO: 6414 - DNA, 801 bp, Artificial Sequence
  Description of Artificial Sequence: Synthetic coding sequence
atgaaggcagctgtgctcactctggctgtgctcttcttgactggctctcaggcccgccacttctggcaacaggatgagcctccacagtccccctgggatcgtgtaaaggacctcgccacagtctacgtagacgtgctgaaggactctggccgcgactatgtgtcacagtttgaaggctctgctctcggtaagcagctgaacttgaaactcctggacaactgggatagcgtgacaagtacattctcaaagcttagagaacaactcggcccagtcactcaagagttttgggacaatcttgaaaaggagactgagggactgcgccaggagatgtccaaggatctggaggaggtgaaggcaaaggttcagccatacctggatgacttccaaaagaaatggcaggaggagatggaactgtacagacaaaaggtggagccattgcgcgctgagctgcaagagggagctcgccagaagctccatgagctccaggagaagctctctcccctgggtgaggagatgcgtgatcgcgcccgcgcccacgtggatgccttgagaacacatctggctccttactccgacgagcttagacagagactggcagctcgtctggaggcactgaaggagaatggcggagccagactcgctgagtatcatgccaaagccactgagcacctctctactcttagcgagaaggccaaaccagctcttgaagacttgaggcagggcctgctgccagtcctggaatcttttaaggtgagctttctctcagccctggaagagtacacaaagaaactgaacacacag

SEQ ID NO: 6415 - DNA, 801 bp, Artificial Sequence
  Description of Artificial Sequence: Synthetic coding sequence
atgaaggcagcggtgttgaccctcgctgtactcttcctgacagggtctcaggcgagacatttctggcagcaggatgagcctccacagtctccttgggatcgagtgaaggacttggccaccgtctacgtggacgtgttgaaggatagcggtcgagattatgtgagtcagtttgagggaagtgccctcggcaaacagctgaatctgaagctgcttgacaattgggattctgtcacttctacgttcagcaaattgagggaacaactcgggcctgtcacccaagagttttgggataatctggagaaggagaccgaagggctcaggcaggaaatgtcaaaagacctggaagaggtcaaagctaaggtgcaaccctaccttgatgactttcagaaaaagtggcaggaagaaatggagctgtaccgtcagaaggtagagccactgcgcgctgaactgcaggagggagccagacagaaactgcacgaattgcaggagaagctgtctccactaggcgaggagatgagagaccgcgcccgagcgcatgtggacgccctgaggacacatcttgccccctattcagacgagctgaggcaacggctggctgctcggctggaagcgctgaaggagaatggtggtgcccgactggctgagtaccatgctaaggcgacagaacatctatctacactctctgaaaaggccaaaccggcacttgaagacctcaggcaagggctgctccccgtgctggagtctttcaaagtcagcttcctctccgcactcgaggagtataccaagaagctgaatactcaa

SEQ ID NO: 6416 - DNA, 801 bp, Artificial Sequence
  Description of Artificial Sequence: Synthetic coding sequence
atgaaggcagccgtgcttactctggcagtcctttttctgacggggtcccaagcgcggcacttttggcaacaagacgaaccgccccaatccccttgggatagagtgaaggaccttgccactgtgtacgtggacgtgttgaaggatagcggccgtgattacgtgtcccaattcgagggatccgcacttgggaagcaactgaatcttaaacttctggacaactgggattcggtgacgtccacgtttagcaagctgcgcgagcaactgggtcctgtgacccaggaattttgggataacctggagaaggaaaccgaaggactccggcaagaaatgtccaaggatctggaagaagtcaaggccaaggtgcagccttaccttgatgatttccagaagaagtggcaggaggagatggaactttacaggcagaaggtggaaccacttagagcagaactccaagaaggagccagacagaaactccatgaactccaggagaagttgtcaccgctcggagaggaaatgagggatcgcgcccgcgcacatgtcgatgcattgcgcactcatctcgcaccatacagcgacgaactcagacagcggctcgcagcaagactggaagcactgaaagaaaacgggggagcaagacttgccgaataccatgccaaagcgaccgaacacctctcgactctttccgaaaaagcaaaacctgcactggaggacctccggcaagggctgcttcccgtgcttgaatcatttaaggtcagctttctttccgcactcgaggaatacactaaaaagctgaacactcag

SEQ ID NO: 6417 - DNA, 801 bp, Artificial Sequence
  Description of Artificial Sequence: Synthetic coding sequence
atgaaggccgcggtgttgaccctggctgtgctcttccttactggaagccaggcccgccacttttggcagcaagatgaaccaccgcagtctccatgggatcgggttaaggacctggctacggtgtacgtggatgtgttgaaggactcaggccgcgattacgtgtcacaattcgaaggaagcgccctcggaaagcagctgaacctgaagctgttggataactgggactccgtgacgtctaccttcagcaaacttcgcgaacaactgggaccagtaacccaggaattctgggacaacctcgagaaggagactgagggactgcggcaggagatgagtaaggacctggaggaagtcaaggccaaggtccagccctaccttgacgacttccagaaaaagtggcaagaagaaatggaactgtataggcaaaaagtggaaccgctgcgggcggagctccaagaaggcgcccgacagaaattgcacgaactgcaagagaaactgtcgcctctcggggaagagatgcgtgaccgggccagagcacacgtcgacgccctcagaacccatctcgcaccctactccgacgagctcaggcagcgcctcgctgctagattggaagccctgaaagagaatggaggggcacggctggcggaataccacgccaaggcaactgagcacctgagcactctgtccgagaaggcaaaaccggccctggaagatcttaggcaaggccttctgccggtgctggagtcgttcaaggtgtcgttcttgtcggcgctggaagaatataccaagaaactgaatactcag

SEQ ID NO: 6418 - DNA, 801 bp, Artificial Sequence
  Description of Artificial Sequence: Synthetic coding sequence
atgaaggctgccgtgctgacactcgcagttctgtttctgactggatcacaagcccggcacttttggcaacaggacgagccaccacaatcaccttgggaccgggttaaagatctggccacagtttacgtggacgtgctgaaggacagcggacgggattatgtgtcacaattcgagggctctgcgctcgggaaacagctgaatcttaagcttctcgacaactgggacagcgttaccagcaccttctcgaagctgcgcgaacagcttggcccagtgacccaggagttctgggacaacttagaaaaggagaccgaggggctacggcaggagatgtccaaggatctcgaagaggtgaaagcaaaggtgcaaccgtacctggacgactttcaaaaaaaatggcaggaggagatggagctgtacaggcagaaggtggagcccttgcgggccgagctgcaagaaggggcccgacaaaaactccacgagctgcaagaaaaattgagccctctcggggaagaaatgcgcgaccgggcacgggctcacgtggacgccctccgaacgcacttggccccctattccgatgagcttcggcagagactggccgcccgcctggaggccctgaaagaaaatggcggtgctaggctagcagagtatcatgcaaaggcaactgagcatctgtccaccttaagcgaaaaagcaaagcccgctctggaggacctccgccagggcctgctgcctgtgttagaaagcttcaaagtaagtttcctaagtgctctggaagagtacacgaaaaaactgaatacccag

SEQ ID NO: 6419 - DNA, 801 bp, Artificial Sequence
  Description of Artificial Sequence: Synthetic coding sequence
atgaaagccgcagttctgactctggcagtgctctttctgactggctctcaggcccggcacttttggcaacaggacgaacctccccagagtccttgggaccgggtgaaagaccttgctacggtgtatgtggatgtcttgaaagatagcggaagggattatgtgtcccagttcgaggggtcagctctcggaaagcagctgaatctgaagctcttagacaactgggatagcgtaacaagtacgttctccaaattgcgcgaacagctgggcccagtgacacaggagttttgggacaacttggagaaagaaactgagggtctcaggcaggaaatgagcaaagacctggaggaggtgaaggccaaagtgcagccctacttagatgactttcagaaaaaatggcaagaagaaatggagctctaccgccagaaggtggagccccttcgggctgagcttcaggagggggcgcggcagaagctgcacgaactccaggaaaagctctccccactgggggaagagatgcgtgacagggcgcgggcccacgtggacgcacttaggacccacctggctccctatagcgatgagctgcgccagagactcgcagcccggctcgaggcactcaaggaaaacggaggcgcaaggctcgccgaatatcacgccaaagccaccgaacacctgagtactctgagtgagaaagcgaaaccagcactcgaggacctccgccaaggcctgctgcccgtcctggagtcgtttaaggtatcattcctgtccgctctcgaagaatacactaagaagctcaacacccag

SEQ ID NO: 6420 - DNA, 801 bp, Artificial Sequence
  Description of Artificial Sequence: Synthetic coding sequence
atgaaggccgcggtccttaccctggcagtcctctttctcacggggtcccaggccaggcatttttggcagcaagatgagcccccgcaatcgccatgggaccgcgtgaaggatcttgcaaccgtgtacgtggatgtgctcaaagacagcggtcgggactacgtgtctcagtttgagggatctgcgctgggcaagcaactgaatcttaaacttcttgataactgggacagcgtgacctccaccttctcgaaactgcgtgaacaactgggacctgtgactcaagagttttgggataaccttgagaaggagactgaaggactccgtcaggagatgagcaaagatcttgaagaagtcaaggcaaaggtccaaccatacctggatgatttccagaagaagtggcaggaagagatggaactgtaccggcaaaaggtggaaccacttcgagctgaacttcaggagggtgcaagacagaagctccacgagttgcaggagaagctgtcgcctcttggagaggaaatgcgagacagggcgcgggcccatgtagacgcactgcggacccacctggcaccctactctgatgagcttagacaacgccttgcggcccggctggaagcacttaaagagaatggcggtgcccgcctggccgaataccatgctaaagctaccgaacatctgtccaccctgtcagagaaagccaagcctgccttggaagatctgcggcaaggtcttttgcctgtgctcgagagcttcaaggtgtcgtttctgtcagctttggaagaatacaccaaaaagctgaacactcaa

SEQ ID NO: 6421 - DNA, 801 bp, Artificial Sequence
  Description of Artificial Sequence: Synthetic coding sequence
atgaaagccgccgtgcttacattggccgttttgtttcttaccggatctcaggctagacacttctggcagcaggacgaacctccccagagcccctgggaccgagtgaaggacttggccactgtctacgtagatgtgcttaaagactccgggcgcgactacgtgtcccagttcgaaggcagtgccctggggaagcagctcaatctaaagctgttggacaattgggatagtgtgacatctacattttcaaaactccgtgaacagttagggccagtgactcaggaattctgggacaatttagagaaggagaccgaggggctgcgccaggaaatgtccaaggacctggaggaggtgaaagctaaagtgcagccctaccttgacgatttccagaaaaaatggcaggaggaaatggaactgtacagacagaaggtggaacccctgcgcgcagaactgcaggagggtgccaggcagaaactacacgagctccaggaaaaactctctccactcggggaggagatgcgcgacagggcccgggcccatgtggacgccttgcgaactcacctggccccttacagcgacgaactgaggcagaggcttgcggcccgtttggaggccctgaaggaaaacggcggagcgaggctagctgagtatcatgccaaggccaccgagcacctctccacccttagtgaaaaggcaaagcccgcactcgaagacctgcgacagggtttgctccccgtactggagagcttcaaggtgtcattcttgtccgcactagaggaatacaccaagaagctcaacacacag

SEQ ID NO: 6422 - DNA, 801 bp, Artificial Sequence
  Description of Artificial Sequence: Synthetic coding sequence
atgaaagccgcggtgctgaccctcgcagtactgttccttactggatcccaagccagacacttttggcaacaggatgagccgccgcaaagcccatgggacagagtcaaggatctggctaccgtctacgtggacgtgctgaaagactcgggacgcgattacgtgtcgcaattcgaagggtcggctttgggaaaacagctcaatctgaagctgctggacaattgggacagcgtgacgtcgaccttttcgaagctgagagaacaactcggaccggtgactcaggagttctgggacaacctggagaaggaaactgaaggattgaggcaagaaatgtctaaagacttggaagaggtcaaggccaaggttcagccatacttggacgattttcagaagaagtggcaagaggagatggagctttaccgtcagaaggtggaacccctcagggcagaactccaggaaggtgcgcgccagaaactccacgaactgcaggaaaagctgagcccgctgggagaagaaatgcgcgacagagcacgggcccacgtcgatgccctgagaacgcacctcgcaccatactcggacgaattgaggcaacgccttgccgctcggctcgaggcgctgaaggaaaacggaggagcaaggctggccgaataccacgcaaaggcgactgaacacctgtcgaccctttccgaaaaagctaaacctgccctcgaagatctccggcaaggcctgctgcccgtgctcgaatccttcaaagtctcatttctgagcgctctcgaggagtacacgaagaagctcaacactcag

SEQ ID NO: 6423 - DNA, 801 bp, Artificial Sequence
  Description of Artificial Sequence: Synthetic coding sequence
atgaaggcagcggtcctcacgcttgctgttcttttcttgaccgggagccaagcgcgccacttttggcaacaagacgaaccaccccagagcccgtgggaccgcgtcaaggatttggcaaccgtctacgtggatgtgctgaaggacagcgggcgcgattacgtgagccagttcgaaggaagcgccttggggaagcaactcaatctcaagctgctggataactgggactcggtcacctccaccttcagtaaactgagagaacagctgggccccgtgactcaagagttctgggacaacctggagaaagagactgaaggcctgcggcaggaaatgtcaaaggacctggaggaggtgaaggccaaagtgcagccttaccttgacgacttccagaaaaagtggcaggaagaaatggagctctatcggcagaaggtggagcctctgagagccgaactgcaagagggagcgcggcagaagctgcacgaactgcaggaaaagctgtcaccactgggggaggagatgagagatcgggctcgcgcgcacgtcgatgccttgcggactcatctcgcaccatactcggacgaactgcggcaacgccttgccgcaaggctggaggctcttaaggaaaacggtggagcacggctcgccgaataccatgcaaaggccacggaacacctctcaaccctgtccgaaaaggccaaaccagccctggaagatctccggcagggacttctcccagtcctcgagagcttcaaagtctcctttctcagcgcactggaagagtataccaaaaaacttaatactcaa

SEQ ID NO: 6424 - DNA, 801 bp, Artificial Sequence
  Description of Artificial Sequence: Synthetic coding sequence
atgaaggcagccgttttgacgctagcggtcctgttcctcacgggctcgcaggcccgacatttctggcaacaggacgaaccgccccagtccccctgggaccgggtcaaggatctcgctacagtttatgtggatgtccttaaagactccggtcgggactacgtcagccaatttgagggctcagctttgggaaaacagctgaatctaaagctgctggataactgggactcggtgacgtctaccttctcgaagctgcgcgagcaactcggtccagtgacccaggagttctgggacaacctcgaaaaggagacggaaggtctgcgccaagagatgtcgaaggatcttgaagaggtcaaggcaaaggtccagccatacttggatgacttccagaagaaatggcaggaggagatggaactttaccgccagaaagtggagccactgcgcgccgagcttcaggagggggccaggcaaaaactgcatgagctgcaagagaaactgagcccactgggtgaagaaatgcgcgatcgcgcccgcgcacacgtagatgcactaaggacacatttggccccctacagtgacgagctacgccaaaggcttgccgctcggctcgaagcgctgaaggagaacggaggtgctcgcctcgccgaatatcatgctaaggctaccgagcacctgagtaccctgagtgaaaaggctaagccggccctggaagatctgcgtcagggcttgctgccggtactggagtcgttcaaggtgtcgtttctgtccgcgctggaggagtacactaaaaagctaaatactcag

SEQ ID NO: 6425 - DNA, 801 bp, Artificial Sequence
  Description of Artificial Sequence: Synthetic coding sequence
atgaaggcagcagtcctcactcttgcggtgctcttcctcaccggcagtcaggcacggcatttctggcagcaagacgagcccccgcagtccccatgggaccgagtcaaggatctcgccaccgtgtacgtcgatgtattaaaagattcagggcgggattacgtgtctcaattcgagggctcagccctcgggaagcagcttaacctaaagctgctagacaactgggattcagtcacgtctactttctccaagctccgagagcagctggggccggtaacccaggagttttgggataacctggaaaaagaaacagaagggttgagacaggagatgtccaaagatctcgaagaagtcaaggctaaggtacaaccttacctggacgatttccagaagaagtggcaagaagagatggaactctacaggcagaaagtcgagcccttgcgcgccgagttgcaggagggagctcgccagaagttgcacgagttacaggaaaagctgtcgccgcttggcgaggagatgcgggatagagctagagcccacgtagatgcactgagaacacatctggctccttattccgatgagctccgacagaggctggcagcgcggttagaggcacttaaggaaaacggaggcgcaaggctggcagagtatcacgccaaggcaaccgagcacctcagcaccctgtccgaaaaagctaaaccagccttggaggaccttcgccaagggttgttgcctgtcctcgagagctttaaggtgtcattcctgagcgccttggaggaatacaccaagaaactgaacactcaa

SEQ ID NO: 6426 - DNA, 801 bp, Artificial Sequence
  Description of Artificial Sequence: Synthetic coding sequence
atgaaagcagctgttttaacacttgcagttttgtttcttacaggatctcaagctagacatttttggcaacaagatgaaccaccacaatcaccatgggacagagtaaaagatcttgcaactgtttatgttgacgtattaaaggattcaggaagagattatgtttctcaatttgaaggttctgcacttggaaaacaattaaatcttaaactactcgataattgggattcagttacatcaacattttcaaaattacgtgaacaattaggaccagttactcaagaattttgggataatttggaaaaagaaacagaaggattgagacaagagatgtcaaaagacttggaagaagtaaaagctaaagtacaaccatatttagatgatttccaaaaaaaatggcaggaagaaatggaattatatagacaaaaagttgaacctttaagagcagaacttcaagaaggagctcgtcaaaaacttcacgaattacaagaaaaactttcaccattaggggaagaaatgagagatagagcaagagcacatgttgacgcattaagaactcatttagcaccatattctgatgaacttcgtcaacgtttggcagcaagattagaggcattaaaagaaaacggaggagcaagattagctgaatatcacgctaaagcaacagagcacttatcaactttaagtgaaaaggcaaagccagcattagaagaccttagacaaggattattaccagttttagaatcttttaaggtttcatttctttcagcattagaagaatacactaagaaattaaatactcaa

SEQ ID NO: 6427 - DNA, 801 bp, Artificial Sequence
  Description of Artificial Sequence: Synthetic coding sequence
atgaaagcggccgtgctcactctcgcagtgctgttcttgaccggaagtcaagcccgccacttttggcagcaagatgaacccccgcagtccccttgggacagagttaaggacctcgccacagtttatgtagacgtgctcaaggactccggtcgggactacgtgtcgcagttcgaagggagtgctctggggaagcagctcaacctgaagcttttagataattgggactccgtgaccagcacattcagtaaactgagagagcaactggggcctgtcacccaggagttttgggacaatcttgaaaaggaaacagaagggctccgacaggaaatgtctaaggacctggaggaggtgaaagctaaggtgcaaccttatctggatgactttcagaagaagtggcaggaggaaatggagctctataggcagaaagtggaacccctgagggccgaactccaggagggagcaagacaaaagttacatgagctgcaggaaaaactgagccctctaggagaggaaatgagggatcgagcaagagcacatgtggacgcactgagaacccacctggccccatactctgatgaactgcggcagcgtctggcagcaagattagaagcacttaaggaaaacgggggagctaggttggcagagtatcacgccaaggccacagaacatctgtccacactgtccgagaaggccaaaccagccttggaggacttgcgacaaggtctgttgcccgtgttagagagtttcaaggtctcttttctgtcagccctcgaagaatacaccaagaagctgaatactcaa

SEQ ID NO: 6428 - DNA, 801 bp, Artificial Sequence
  Description of Artificial Sequence: Synthetic coding sequence
atgaaggccgccgtgttaaccctggccgtgctcttcttaacaggatctcaggcgcgtcacttctggcagcaggatgagccacctcaaagtccatgggatagggtgaaggacttggctactgtctatgtggacgtgctgaaggactccggcagagattacgtgtcccagtttgaggggagcgccttgggaaaacagttgaacttgaagctgcttgacaactgggacagtgttacttcgacattcagcaagctccgcgaacaattaggacctgtcacccaggaattttgggataatctcgagaaggaaactgagggactaagacaggaaatgtccaaagatcttgaagaagtaaaggccaaagtccagccatacctggatgattttcagaagaaatggcaggaggaaatggagctgtatcgccagaaagtggaacccctccgagcggaactgcaggagggcgcgcggcagaaattgcatgagctgcaagagaagttgagtccgctgggggaagaaatgcgggacagagccagggcccatgtcgatgccctcagaacacatttggcaccatattcagacgaactacgccagcgactcgccgctagactggaggctctgaaggagaatggcggcgcccgtttggcagagtatcacgctaaagccaccgagcacttgtctacgttgagtgagaaggcgaaacctgcccttgaggacctgagacagggattactgcctgtgttggagagcttcaaagtttcatttctttcagccctcgaggagtatacgaagaaactgaacacgcaa

SEQ ID NO: 6429 - DNA, 801 bp, Artificial Sequence
  Description of Artificial Sequence: Synthetic coding sequence
atgaaagccgccgtgctgactctggcagttctctttctgactgggtcccaggctcgacacttctggcagcaggacgaaccccctcagtccccatgggaccgggtgaaagatctggcaacagtgtatgtggatgtcctcaaggactccgggcgggattatgtgagtcagttcgaggggtctgctctagggaagcagctcaatttaaaactactggataattgggatagtgtcacatcaacattttccaaactccgagagcaactcgggcctgtgactcaggaattctgggacaatctcgaaaaagagacagaggggcttcgacaggagatgtctaaagatcttgaggaagtgaaagccaaagtgcagccttatttagatgattttcagaaaaaatggcaggaggagatggaactctataggcagaaagtcgagccacttagggccgaactccaggaaggagcccggcagaagttgcacgaactccaggaaaaactctcgcctctcggggaagaaatgcgggaccgcgcccgcgctcacgtcgatgcccttagaacacatctcgcaccttacagtgatgaactaaggcagcggctcgctgcaagactggaagcactgaaagaaaacggaggagctcggttggctgaatatcacgccaaagctactgaacatctgtctactctttcagaaaaggctaaaccagcactggaagatcttcggcaggggctacttccagtgttagagtcttttaaagtgtcatttttgtccgcccttgaggaatatacaaaaaaacttaatacacag

SEQ ID NO: 6430 - DNA, 801 bp, Artificial Sequence
  Description of Artificial Sequence: Synthetic coding sequence
atgaaggccgcggtgctcaccctggccgtgctgtttctgactggttcccaagcgcgacacttttggcagcaggatgagccgccgcaatccccgtgggaccgcgtcaaggatttggcaactgtctacgtggatgtgctgaaggactcagggcgcgactacgtgtctcaattcgagggctccgccctcggcaaacaactgaacctcaagttgctcgataactgggacagcgtgacctcgacgttctccaagctgcgggaacaattgggtcctgtgacccaggaattttgggataaccttgagaaagaaaccgaaggcctgagacaggaaatgtcaaaggacttggaagaggttaaagcgaaggtgcaaccgtacctcgatgatttccaaaagaagtggcaggaagagatggaactctataggcagaaagtggagcccctccgcgccgaattgcaagaaggagcaagacagaaactgcacgagctgcaggaaaaactctcgccccttggggaggagatgcgcgaccgcgctcgggcgcacgtcgacgcgctgcggacgcatctcgcgccttacagcgacgaacttcgccagagactcgctgccagactcgaggcactgaaggaaaatggaggtgctaggctggccgaataccatgctaaggctactgaacatctgtccaccctctcggaaaaggctaagccggccctcgaggatctccgccagggcctccttccagttcttgagtcgttcaaagtgtccttcctctccgcgctggaagagtacactaagaaactgaatacccag

SEQ ID NO: 6431 - DNA, 801 bp, Artificial Sequence
  Description of Artificial Sequence: Synthetic coding sequence
atgaaggcagcagtgctcacgctggcagtgctgtttctgactggttcgcaagcacgacatttttggcagcaggacgagcctccacaatcaccctgggacagggtgaaggatctcgcaaccgtctacgtcgatgtgctcaaggactccggacgcgattatgttagccaatttgaggggtctgcactcggaaagcagctgaacctgaaattgctggataattgggattccgtgacttcaactttttccaagttgagggagcagctgggccctgtgactcaggaattctgggacaaccttgagaaggaaacggaggggctcagacaggaaatgtcgaaggatcttgaggaagttaaggccaaagtgcagccgtacctggatgattttcaaaagaaatggcaggaagagatggaactttacagacagaaagtggaacctcttcgtgcagaactccaagagggagcgcgtcaaaagctgcacgaacttcaggaaaagctgtccccgcttggagaagaaatgcgcgacagagcacgggctcacgtggatgcgcttcgaacccatctcgcgccatactcggacgaactcagacagcgactggctgcgaggttggaagccctgaaggaaaacggcggcgcgaggcttgccgaataccatgcaaaggcaactgaacatctttcaactttgtccgagaaggcaaagcctgcgctggaagatctgaggcagggactgctgccagtgctcgaaagtttcaaagtgtcgtttctctccgcacttgaggaatacactaagaagttgaatactcag

SEQ ID NO: 6432 - DNA, 801 bp, Artificial Sequence
  Description of Artificial Sequence: Synthetic coding sequence
atgaaggcggcagtgttgaccctcgcggtcctgtttctgacgggctcgcaggcccggcacttctggcagcaagatgagccaccgcaatccccctgggatcgagtgaaggatctggcgactgtgtacgtagacgtcttgaaggactcgggccgcgattatgtgtctcagttcgagggttccgcgctcggtaagcagctgaacctgaaattactggataactgggatagcgttacgtccacgttctccaagctgcgcgagcaattgggcccggtcacgcaggaattctgggacaacctcgaaaaggagaccgagggtctgaggcaagagatgagcaaggacctggaggaggtgaaagcaaaggtgcagccatatttggatgactttcagaaaaaatggcaggaagaaatggaactgtatcggcaaaaagtggagcctctacgcgcagagctgcaagaaggtgccaggcaaaagctgcatgaactgcaggagaaactgagcccgctgggggaggagatgcgcgatcgggcccgcgcccacgtcgacgccttgagaacccacctggccccttacagcgatgagcttcgccaaagattagccgcccgcctggaagcgcttaaggaaaatgggggtgctcgcctagcggagtatcatgcaaaagccactgagcatctgagcacgttgagcgaaaaggcaaagcccgctcttgaggatctgcgccaaggcctgctgccggtacttgagagctttaaagtgtcatttttgtcagccttggaggagtataccaagaagcttaacacccag

SEQ ID NO: 6433 - DNA, 801 bp, Artificial Sequence
  Description of Artificial Sequence: Synthetic coding sequence
atgaaagcggctgtccttaccctggcagtgttgtttcttacgggcagtcaagcacggcatttctggcagcaggatgagcctcctcaatcaccctgggacagggtgaaagacctggctacagtttacgtagatgttcttaaggattctggaagggattacgtgtctcaatttgagggatctgccctcggaaagcaacttaatcttaagctgttggataactgggacagcgttactagcacatttagcaagctccgggaacagcttggccccgtcacacaggagttttgggacaacttagaaaaggagacagagggcctgagacaagaaatgtccaaagaccttgaagaagttaaagcaaaggtccagccctaccttgatgacttccagaaaaagtggcaagaagaaatggaactctacaggcagaaggtggaaccccttagggcagaactgcaagagggagcgcgccagaaactgcatgaactgcaggaaaaactgagtcccctgggggaggaaatgagagacagagcgagagctcacgttgacgctcttaggactcacctcgcaccatacagcgatgagcttcgtcaacgtttggctgcgcggctggaggctcttaaggaaaacgggggagctcgcttggccgagtatcatgcgaaagccaccgagcatctttcaacactcagcgaaaaggccaaacctgcccttgaggacctgaggcaggggcttctgcctgtgctggagagctttaaggtgagcttcctgagcgctttggaagagtatacaaagaaactcaacacccaa

SEQ ID NO: 6434 - DNA, 801 bp, Artificial Sequence
  Description of Artificial Sequence: Synthetic coding sequence
atgaaagccgcagtgctgaccctggctgtactgtttctgacgggctctcaggcccgtcacttttggcagcaggacgagcctcctcagagcccctgggacagggtgaaagacctggccacggtgtacgtcgacgtcctgaaagattccggtagggactacgtgagccaatttgaggggtccgccctgggaaagcagctgaatctgaagctgctggataactgggactctgtcacaagcactttcagtaagctcagagagcagctggggcctgtcactcaagagttctgggacaatctggagaaggaaacagaggggctgcggcaggagatgtccaaggatctggaagaggtcaaagccaaggtgcaaccatacttagacgactttcaaaagaagtggcaggaagaaatggagctgtaccgccagaaggttgaacctctgagggcggagctgcaggaaggagcaagacagaagttacatgagttgcaggagaaactgagtccactcggcgaagaaatgcgagatagggcccgcgcacacgtggacgccctacggacgcacctcgctccatattctgacgaactccggcagcgcctcgccgctcgcctggaagccctgaaagagaacgggggagccagactcgctgagtaccatgctaaggccaccgagcatctctctacgctgagcgagaaggctaagccggctttggaggatctgcgtcagggcctgctccctgtgctggagtctttcaaagtgtctttcctgtccgcactggaagaatatactaaaaaactcaacacccag

SEQ ID NO: 6435 - DNA, 801 bp, Artificial Sequence
  Description of Artificial Sequence: Synthetic coding sequence
atgaaggctgctgtccttactttggcggtcctcttcttgaccggctcacaagcaagacacttttggcagcaggatgagcctccacagtccccatgggaccgcgtgaaggaccttgccaccgtgtatgtggacgtgctcaaagattccgggcgagattatgtcagccaatttgagggatcggcactgggcaaacaacttaacctgaagctgctggacaactgggattccgtgacctccacgttttccaaacttagagagcagcttggtcctgtgactcaggagttctgggataaccttgagaaggaaaccgaaggtctgcgacaggagatgagtaaagaccttgaggaagtgaaggctaaggtgcaaccttaccttgatgactttcagaagaaatggcaggaagaaatggaactttaccgtcagaaggtcgaaccactgagggccgaacttcaggaaggagcaagacaaaagctgcatgaactgcaagagaagttgtcccccctgggagaggaaatgcgtgatagagcgcgagcacatgtcgatgcactcagaacccatcttgccccatacagcgacgaactgagacaaaggctggcggcacgattggaagcccttaaggaaaacggaggagcgagactggcagaataccacgccaaggccacggaacatttgagcactctgtcagaaaaggcgaagcccgcactcgaagatctgcggcaaggtctgcttcctgtcctggaatcgtttaaggtgtcatttctttcggcactggaagaatacacgaagaaacttaatacgcaa

SEQ ID NO: 6436 - DNA, 801 bp, Artificial Sequence
  Description of Artificial Sequence: Synthetic coding sequence
atgaaggctgcggtgctcaccctcgcggtgctgttcctcactggctcacaagcacgccacttttggcagcaggacgagcctccccagtccccgtgggaccgcgtgaaggacctcgctactgtatacgtggatgtgctgaaggattccgggcgcgattacgtgtcgcagttcgaaggctccgccctgggcaagcaacttaacctcaagttgttggacaactgggattcggtgaccagcaccttctcaaagttgcgcgagcaactgggcccggtcacgcaagagttttgggacaatctcgagaaagaaaccgagggactgcggcaagaaatgagcaaggatctcgaggaagtgaaggcgaaggtgcaaccatacctcgatgacttccagaaaaagtggcaagaggaaatggaactgtacagacagaaggttgaaccactccgcgcagagcttcaggaaggagcgcgccagaaacttcatgagctccaggaaaaactgtcgcctttgggagaagaaatgcgcgacagagcccgcgcccatgtggacgcactgcgaacgcacctggcgccttattcggatgaactccggcagcgccttgcagcccggctggaggctctgaaggaaaatggcggcgcccggttggcggaataccacgcgaaggcgaccgaacacctgagcacccttagcgagaaggctaagccggccctcgaggaccttcgccaaggtctgctgccggtcctggaatcgttcaaggtgtccttcctgtcagcgctggaggagtacacgaagaaattgaacactcaa

SEQ ID NO: 6437 - DNA, 801 bp, Artificial Sequence
  Description of Artificial Sequence: Synthetic coding sequence
atgaaggcggcggtcctcaccctggcggtgctctttctgacgggatcgcaagcgcgccacttctggcagcaggacgaaccgccgcaaagcccgtgggaccgcgtcaaggacctggctactgtatacgtggacgtgctgaaagattcgggaagagactatgtgagccaattcgaaggttccgcgctcggtaagcaactgaacttgaagctcttggataattgggactcggtgacctcaactttcagcaagctccgtgaacagctgggccccgtcactcaggaattctgggacaatttggaaaaggaaaccgaaggactccggcaggaaatgtcgaaagatttggaagaggtgaaggccaaggtgcagccgtacctggatgatttccaaaagaagtggcaggaagagatggaactgtaccggcaaaaggtcgagcctctgcgggcggaattgcaggaaggcgcgcggcagaaactgcacgagctccaggaaaagctgtctccactcggtgaggagatgcgcgaccgggccagggctcacgtggacgcgctgcgcactcatcttgcaccgtactccgatgagctgagacaacgtctggccgcccgcctcgaggctctgaaggagaatggtggcgcgagactcgcagaataccatgcaaaggccaccgaacatctgtccactctttccgaaaaggctaaaccagctctggaggacctgagacaggggctcctgccagtgttggagtcattcaaggtttcgtttttgtccgccctcgaagagtacaccaaaaaactgaacacccag

SEQ ID NO: 6438 - DNA, 801 bp, Artificial Sequence
  Description of Artificial Sequence: Synthetic coding sequence
atgaaggcggcggtgctgactttggccgttctgtttctgactggtagccaggcacgacacttctggcaacaggacgagccgccacagagcccatgggaccgcgtgaaggatttggcaacagtgtacgtcgatgtgctcaaagattctggcagggactacgtctcccagttcgagggctccgccctgggaaaacagctgaatctgaaactcctggataactgggacagcgtaacttcaacattcagcaagcttcgcgagcagctcgggccagtcactcaggagttctgggataacctggagaaggaaaccgagggtctgagacaggagatgtccaaggaccttgaggaagtcaaggcgaaggttcagccctatctggacgatttccaaaaaaagtggcaggaagaaatggaactgtaccggcagaaagtcgagcctctcagagccgagctccaggaaggtgcccggcagaagttgcatgaactgcaggaaaaattgagcccgttgggagaagaaatgcgcgatcgcgcacgggcccatgtcgatgcgctgagaacccaccttgctccttattcagatgaactgcggcaacgactcgcagcaaggcttgaagctttgaaagagaacggcggagcgagacttgctgaatatcacgcgaaggcgaccgaacacctttctactctctccgaaaaagccaaaccagcccttgaggacctccggcaggggctgctgccagtgcttgaatcattcaaggtatctttcctgagcgccctggaagaatacacgaagaaactcaacacgcaa

SEQ ID NO: 6439 - DNA, 801 bp, Artificial Sequence
  Description of Artificial Sequence: Synthetic coding sequence
atgaaggcggccgtccttactcttgccgtgctcttcctgaccggatcccaagcacgccacttctggcagcaagacgaaccacctcaatccccatgggatagggtgaaggacctcgccaccgtctacgttgatgtgctgaaggactctggtagagattacgtgtcgcagtttgagggctcggcactgggaaagcaactgaacctgaaactccttgataattgggactcggtgacctccacttttagcaaactcagggaacagttgggacctgtgactcaggaattctgggacaatctggaaaaggagacggagggtctgaggcaagagatgtcaaaagatctggaagaagtcaaggcaaaggtgcagccgtaccttgatgattttcagaagaagtggcaagaggaaatggagctttacaggcaaaaggtcgagcctcttagggcagagctgcaagagggagcgaggcaaaagttgcatgagctgcaggaaaagctcagccccctgggagaggagatgcgtgatagagcaagagcacacgtggatgccctgcggactcatctggctccatactcagatgaactccggcaaaggctcgcggcaagactggaagctcttaaagaaaacggtggggcaagactggccgagtaccatgcaaaagcaaccgagcatctctccaccctgtcggagaaggctaagccggcactggaagatctccggcagggtttgctccccgtgctcgagagttttaaggtgtcttttctgtccgcgttggaggaatacaccaagaaacttaacactcag

SEQ ID NO: 6440 - DNA, 801 bp, Artificial Sequence
  Description of Artificial Sequence: Synthetic coding sequence
atgaaggccgctgtcctgactctggcagtcctgttcctgaccggatcccaagcacgccacttttggcaacaggatgagccacctcagtccccctgggaccgcgtgaaggacctggcaaccgtgtatgtcgacgtgcttaaggactcaggaagggactacgtgagccagttcgagggttccgcgctcgggaagcagctcaacctcaagctgctcgacaattgggactcagttacctcaactttcagcaagctgcgcgagcagctcggccccgtgacccaggaattctgggacaacttggaaaaggaaacggagggcctgagacaagaaatgtcgaaagacctggaagaggtgaaggcgaaggtccagccgtacctggacgacttccagaaaaagtggcaggaagagatggaactgtaccggcaaaaggtcgaaccgttgcgagctgagctgcaggagggtgctcggcagaaactgcatgaactgcaggaaaagctgtcgcccctgggggaagagatgcgggaccgagccagggcacacgtggacgccctccggacccacctggccccgtactcggacgagctccggcagaggctcgcggcacgccttgaggccctgaaagaaaatggcggagcgcgactcgcggaataccatgccaaagcaaccgagcatctgtcaaccctgagcgaaaaagcgaagccagccctggaagatctccgtcaaggcctgctgccggtgctggagtcctttaaggtgtcctttttgagcgccttggaggagtacacgaagaaactgaatacccag

SEQ ID NO: 6441 - DNA, 801 bp, Artificial Sequence
  Description of Artificial Sequence: Synthetic coding sequence
atgaaggctgcagtgcttactcttgctgtattgttcttgacaggatctcaggcacggcatttctggcagcaggatgaaccaccacaaagcccttgggatagggtcaaagatttggctaccgtgtacgtggacgttctcaaagattctggcagagattatgtttcacaattcgagggcagcgccttgggtaaacaactgaacctgaagttacttgataactgggacagcgttacaagtactttctcaaagttacgcgaacagttgggtcccgtcactcaagagttttgggataaccttgaaaaggagaccgagggtctgcgacaagaaatgagtaaggatttagaggaagtgaaagctaaagtccagccatacttggacgacttccagaagaagtggcaagaagagatggagttgtatcgtcaaaaggttgagccacttcgagccgaacttcaggagggtgctaggcagaagcttcacgaattgcaagagaaactatcaccgttgggtgaagaaatgagggatcgagcgcgtgcacacgttgacgcactgaggacacatcttgctccctactctgatgagctacgtcaaaggctggcagccaggttagaagcgcttaaagagaatgggggagctcggttggcagagtatcatgctaaggccactgaacacctctctactctttcggagaaggccaagcctgcattggaggatctacgacagggcttgctcccagttttggaatcctttaaagtaagttttctaagtgcattggaggagtatacaaagaaattgaacacacaa

SEQ ID NO: 6442 - DNA, 801 bp, Artificial Sequence
  Description of Artificial Sequence: Synthetic coding sequence
atgaaagcggctgtcttgactctcgccgtgctgttcttgactgggtcacaagcacggcatttttggcagcaggacgagccgccgcagtcgccgtgggaccgcgtgaaagaccttgccaccgtctacgtggatgtgctgaaagattccgggcgcgattacgtctcccagttcgagggatctgccctgggcaagcaactgaaccttaagctgctggacaactgggattcagtcacctcgacgttcagcaaattgagggaacagctggggccggtgacccaagagttctgggacaatctggaaaaagagactgaggggttgagacaagaaatgtcgaaggacctcgaggaggtcaaagcaaaagtgcagccctacctcgacgattttcagaagaagtggcaggaagaaatggaattgtatagacagaaggtggagcccctgcgggcagaactgcaagagggtgctaggcaaaaactgcacgaacttcaagaaaaactgtcaccacttggagaggaaatgagggaccgcgcccgcgctcacgtcgatgccctgcggactcacctcgcaccttactccgatgaactgcgccagaggctggcagcccgcctggaagccttgaaggagaacggcggcgcgcggctcgcggagtaccatgccaaggccaccgagcacttgtctacgctgtcggaaaaggcgaagcctgctctggaggacctcaggcagggcctgctgccagtgctggagagcttcaaggtgagcttcctttcggcgttggaagaatacaccaagaaactcaatacccaa

SEQ ID NO: 6443 - DNA, 801 bp, Artificial Sequence
  Description of Artificial Sequence: Synthetic coding sequence
atgaaggcagccgtgcttaccctggcagtgctttttctgaccggatctcaggcaagacatttctggcaacaagacgagcctccgcagagcccctgggatcgggtgaaagatctcgcgaccgtctacgtggatgtcctcaaagactcgggtagagattacgtgtcgcagtttgaaggaagcgcacttggaaagcagctgaacctgaagttgctggataattgggattcggtgacctccacctttagcaagctgagggaacagctgggccccgtgactcaggaattttgggataacctcgaaaaggaaactgaaggtttgcggcaagaaatgtcgaaggatctggaagaagtcaaagcaaaggttcaaccataccttgacgattttcaaaagaagtggcaagaggagatggaactctaccgccaaaaggtggagcctctccgagcagaactgcaagaaggcgcaaggcagaaactccatgaactgcaggagaaattgtcacctttgggcgaggagatgagggatcgagcaagagcacacgtggacgccctgaggacccatctggcaccttactccgatgaactgcgccagcgcctggcagcaagactcgaagcactgaaagagaatgggggagcgagacttgcagaataccatgcaaaagcaactgaacatctttccacgctctcagaaaaggcgaagccagctctcgaggacctgcggcagggactgctgccagtgctggaatcgttcaaagtttcctttctctcggcactggaggagtacacgaagaaacttaatacgcag

SEQ ID NO: 6444 - DNA, 801 bp, Artificial Sequence
  Description of Artificial Sequence: Synthetic coding sequence
atgaaagctgccgtgctcaccctggcagtgctattcctgactggctctcaggctagacatttctggcagcaagatgaaccaccccagagtccatgggacagagttaaggatctcgccacggtttacgtggatgtgctgaaggacagtgggagggactacgtttctcagttcgaggggagtgcattaggcaaacagctgaatttgaaactactggacaactgggactccgtgacctccactttttccaagctacgcgagcagttgggccccgtgacacaggaattttgggataatctggagaaagagaccgagggtctgcgccaggagatgtcaaaggatctggaggaggtgaaggcaaaagtccagccgtatctagatgactttcagaagaagtggcaggaggagatggagctgtacagacagaaggttgaacctttgcgagctgaactccaagagggggcccggcagaaacttcacgagctccaggagaaactgtcccctctcggtgaagaaatgagagaccgagcaagggcacatgtggatgccctgcgtacacacctggccccctactcggatgaattgagacagcggttagccgctagactggaggccttgaaggagaacgggggagctaggcttgcagagtaccatgcgaaggccaccgagcacctgtccacattgtccgagaaagccaaacctgccttagaggacctccggcaaggtttgctgcccgtgctggagagtttcaaagtgtccttcctgtccgcactggaggagtataccaagaaactgaacacacag

SEQ ID NO: 6445 - DNA, 801 bp, Artificial Sequence
  Description of Artificial Sequence: Synthetic coding sequence
atgaaagcggccgtgttgaccctggcagtcctgttcctgactggaagccaggcaaggcacttttggcaacaggacgagcctccgcaatcgccatgggacagagtgaaggatctggccaccgtctacgtggacgtgttgaaggacagcggacgcgactatgtcagccagttcgaaggatcggctctcggtaagcagctgaacctgaaattgctggataattgggacagcgtgacctcaaccttttccaaacttagggaacaactcgggccggttacccaggagttttgggacaatctggaaaaggaaaccgaaggactccgccaggaaatgtcgaaggacctggaagaggtgaaggccaaggtgcaaccataccttgatgacttccaaaagaaatggcaggaagaaatggagctgtacagacagaaagtcgagccacttcgggcggagctccaggaaggcgcacggcagaagctgcacgaactccaggaaaagctctccccccttggggaggagatgagagatcgggcgcgggcccacgtggatgctctgaggacccatctggcgccgtactcggacgagctgcgacaacggctggctgcccgactggaagccctgaaagaaaacggcggggccaggttggccgaataccacgctaaagcaaccgagcatctgtccactctgtccgaaaaggccaaaccagccctggaggatttgcgacaggggcttctgcccgtgctggaatccttcaaagtgtcgttcctttccgctctcgaagaatacaccaaaaagttgaacactcaa

SEQ ID NO: 6446 - DNA, 801 bp, Artificial Sequence
  Description of Artificial Sequence: Synthetic coding sequence
atgaaagcggctgttctgaccttggctgtgctgtttcttacaggatcccaggcgcggcacttctggcagcaggacgaaccgcctcagtccccctgggacagagtcaaggacctggccacagtttacgtcgatgttctcaaggactccgggagagactacgtctcacagttcgaaggctctgctcttgggaaacagttaaacctcaaattgttagacaattgggacagcgttacatccaccttttccaaactcagagaacagctcggacctgttacccaagagttctgggataacctagagaaagagacagagggacttcgccaggaaatgagtaaagacctggaggaggtgaaagccaaggtacagccgtacctcgatgatttccagaaaaaatggcaggaggagatggaactctaccggcagaaagtcgaacccctgagggccgaactgcaagagggcgccaggcagaaactacacgaactacaggagaagctttcccccctcggagaagagatgagagaccgggcgcgcgcccatgtggatgctcttaggacccatctcgcaccatactcggacgagctcagacaaagactggctgccagacttgaagctctcaaggagaatggcggcgctaggctggcagagtaccacgctaaggccacagagcatttgtctacactctctgagaaggctaagcctgccctcgaagatttacgccaaggcctgcttcctgtgctggagtcatttaaggtctctttcttgtcagcattagaggagtacacgaagaaactaaatacacag

SEQ ID NO: 6447 - DNA, 801 bp, Artificial Sequence
  Description of Artificial Sequence: Synthetic coding sequence
atgaaagccgcagtccttaccctggccgtcctgtttctgactggtagccaggctaggcatttttggcaacaagacgagcctcctcagtctccatgggacagagtgaaggatttagccaccgtctacgtggatgtcctgaaagatagtggaagagattacgtgtctcaatttgagggttcagcattggggaaacagctcaatctgaaactgctggacaactgggatagcgtgacaagtaccttttccaagttgagagagcaactcggaccagtgacccaagaattctgggataatttggagaaagagaccgaaggtctgaggcaggagatgtctaaagatctggaggaagtcaaagcaaaggtccagccttacctggacgactttcagaagaagtggcaggaggaaatggaattatacagacagaaggtagaaccattgcgtgcagaactgcaggagggggcccgacagaaactccacgaacttcaagaaaaactaagccctcttggagaggagatgagggacagggcgcgggcacacgtcgacgctctcaggactcatctcgcaccttatagtgacgaattgcgtcaaaggctcgccgctaggcttgaggctctgaaggagaacggaggtgcacgcctcgccgaataccacgccaaagctaccgagcatctgtcgactctgagcgaaaaagccaagcccgccttggaggacctgcgccagggtctcctgcctgtcctggaatcgtttaaagtcagcttcctgtccgcactcgaggagtacactaaaaaactgaacacccaa

SEQ ID NO: 6448 - DNA, 801 bp, Artificial Sequence
  Description of Artificial Sequence: Synthetic coding sequence
atgaaagccgctgttttgaccttggctgtactgtttctcactgggtcacaagcccgccatttttggcaacaagacgagccgccgcagtctccttgggatagagtgaaggatttagctactgtttacgtcgatgtattgaaggatagtgggagagattatgtttcccagttcgaggggtctgctttgggtaaacaactaaatctgaaactcttagacaactgggacagcgtgacgagcaccttctctaaactgagggagcagctggggcctgtcacacaagagttctgggataatctcgaaaaagagaccgaggggctaaggcaggagatgtctaaagatctcgaagaggtcaaggctaaggtccagccgtatctggacgactttcaaaagaaatggcaggaggaaatggagttgtatagacaaaaagtagagcccctccgcgccgaactgcaggaaggagctcgtcagaaactgcatgaattacaggaaaagttatccccactcggagaggagatgcgggaccgcgcccgggcgcacgttgatgccctacgcacacacctggctccttatagtgatgagctgcggcagcgcctggccgccaggctggaagcgttgaaggaaaacggcggtgcccgccttgccgagtaccacgccaaggccacagagcatctgagtactctcagcgagaaggccaaaccggcgctcgaagatctgcgccaaggtctgttgcctgtgttggaatctttcaaagtgtcgttcttgtctgcactggaggagtacactaaaaaactcaatactcag

SEQ ID NO: 6449 - DNA, 801 bp, Artificial Sequence
  Description of Artificial Sequence: Synthetic coding sequence
atgaaggccgcagtgctcaccctggccgtgctttttctaacgggaagccaggctagacatttctggcaacaggatgagcctccgcaaagcccatgggaccgggtcaaagatttggctacggtgtatgtcgatgtgttgaaggactcaggacgagactatgtgtcacagtttgaaggttcagcactagggaaacagctgaatctgaagctgcttgacaactgggactccgtaactagcacatttagtaagcttcgtgaacagctgggtcctgttacgcaagaattttgggacaatctcgagaaggaaacagagggactccggcaagagatgtctaaggaccttgaagaggtaaaagcaaaggtacaaccataccttgacgactttcagaagaagtggcaggaagagatggagctgtataggcaaaaggttgagcctctccgggccgagctccaggagggcgcacgacaaaaactacacgaactgcaggaaaaactgagtcccctcggtgaagagatgcgagaccgtgcccgagctcacgttgatgcattgcgcactcacctggcaccctactctgacgagctgcgccagcgattggcggctagactcgaagctctcaaggagaatggcggcgctagattagccgagtatcacgcgaaggccactgagcacctgagtaccctgagcgaaaaggccaagccggccctagaagacctcaggcaaggcctactacctgtgttggagtcttttaaagtctccttcctgtccgccctggaggaatatacaaagaagctgaatacccag

SEQ ID NO: 6450 - DNA, 801 bp, Artificial Sequence
  Description of Artificial Sequence: Synthetic coding sequence
atgaaggcggcagtgttgactttagccgtgctcttcctcacgggtagccaggcacgacatttctggcagcaggatgaaccgccccaaagcccatgggacagagttaaggacttagcaacagtgtatgtggacgtgctgaaagatagtggtagagattatgtgtcacagtttgaaggtagcgctctcggaaagcaattgaatttgaagcttctagacaactgggactcagtaacaagcacatttagcaagctccgtgagcaactgggacccgtcacacaggagttctgggataacttggagaaagaaactgaaggtctcaggcaagaaatgagcaaagatcttgaagaagttaaggctaaggtgcagccgtacctggatgattttcaaaagaaatggcaagaagaaatggagctctaccggcaaaaggttgaaccgctacgggcagagttgcaagaaggtgcccgtcagaagctgcatgagctacaggaaaagctgtcaccgctaggagaggaaatgagggaccgagctcgtgcgcatgtggacgcgctacgaactcatttggccccctatagtgacgagctccgtcaaagacttgctgcacggcttgaggcgctgaaagaaaacggtggagctcgcctcgcagagtatcacgcgaaggctacggagcacctgtcgaccctttctgaaaaggccaaacccgcacttgaagacctccggcaagggttgttaccggtgctggaaagcttcaaagtctcttttctgtcagccctcgaagaatatacaaagaagttgaatactcag

SEQ ID NO: 6451 - DNA, 801 bp, Artificial Sequence
  Description of Artificial Sequence: Synthetic coding sequence
atgaaggctgctgtcttgacactggcagtactgtttctgactggcagccaggccaggcatttctggcagcaggacgagccaccccaaagcccctgggatcgcgtgaaggatctggccactgtttacgtggatgtattgaaagatagcggccgagactatgtgtctcagtttgagggctctgctctagggaagcagctgaatttgaaactgctcgataattgggattccgtcactagtactttctctaagttacgtgagcagctggggcccgtgacgcaggagttttgggacaatttggaaaaggaaacagaggggctgagacaggagatgtcaaaggaccttgaagaggttaaagctaaagtccaaccctacttggacgattttcagaagaagtggcaggaagagatggaactgtaccggcaaaaagtagagcctctgagagccgaacttcaggagggcgccagacaaaaactccacgagctccaggagaagctctcccccttgggtgaagaaatgcgcgatcgtgctcgggctcacgtggacgctttgcgcacccacctagccccatacagcgatgagctaagacagagactggccgctcgccttgaagccctgaaggaaaacggtggcgcgaggcttgccgaatatcacgccaaagccactgagcacctctcaacattgagtgagaaggccaagccagccctagaggacctacggcaagggctcctgccagtgctcgaaagtttcaaggtgagctttctgtcagccttggaagagtacactaaaaagcttaacacacag

SEQ ID NO: 6452 - DNA, 801 bp, Artificial Sequence
  Description of Artificial Sequence: Synthetic coding sequence
atgaaggcagcagtgctgacccttgctgtgctgttcctgaccgggtcgcaagccagacacttctggcagcaagatgaaccaccccagtcgccctgggaccgggtgaaggacctggcaactgtctacgtcgatgtgctcaaggactcgggccgggactatgtttcacagttcgaaggttcggcacttggcaagcaactgaaccttaaacttcttgacaactgggattcggtgacgtcaacttttagcaaacttcgcgagcagcttggtccagttacccaagaattttgggataatctcgaaaaggaaacggaaggactgagacaagaaatgtccaaggatcttgaagaggtcaaggcgaaggtgcaaccctacctcgatgattttcaaaagaagtggcaggaggagatggaactgtaccgacagaaggtggagccgctgcgggcagagctgcaagagggagcaaggcaaaaactgcatgaacttcaggaaaaactttcacctcttggagaagaaatgcgagatagagcccgtgcacatgtcgacgcattgaggacccaccttgcaccgtactccgatgaactgcggcagcgacttgcagcaagactggaagcactcaaggaaaatggtggggcgcgtttggcagagtaccatgccaaggcaactgaacatctctcaactctttccgaaaaggctaagcctgcacttgaggacctgagacaaggactgctgccagtgttggagagctttaaagtgtcgtttctgtcagcacttgaggagtatactaaaaagctgaacacccag

SEQ ID NO: 6453 - DNA, 801 bp, Artificial Sequence
  Description of Artificial Sequence: Synthetic coding sequence
atgaaggccgccgtgctcactctcgctgtgctgttcctgacagggtctcaggccagacacttctggcagcaggatgaaccaccccagagtccctgggatagggtgaaagatcttgccactgtatacgtggatgttcttaaggattcagggcgggattatgtgagtcagttcgaagggagtgccttaggaaagcagcttaaccttaaactccttgacaactgggattctgttactagtacattttctaaactcagggagcagctcgggccagtcactcaagaattctgggataacctcgaaaaagaaacagaagggctgagacaggaaatgtccaaagatctcgaagaagtcaaagcgaaagtccagccatatctggatgattttcagaaaaaatggcaggaagaaatggaattgtatcggcagaaagtagagcccttacgggcggagctccaggaaggggctagacagaaacttcatgaactccaggaaaaactgtctcctctcggggaagagatgagagatcgggcgagggcccatgtggatgccctaagaactcatcttgcaccatactctgatgaattgcggcaacggctcgccgcaagacttgaagctcttaaagaaaacggaggagccagactcgccgagtaccatgcaaaagcgacagaacatttgtcaactctcagtgaaaaagcaaaacctgccctggaagatctccggcagggactgctccctgtgcttgaatcttttaaagtttcctttctttctgcccttgaggaatacacaaaaaaactcaatacacag

SEQ ID NO: 6454 - DNA, 801 bp, Artificial Sequence
  Description of Artificial Sequence: Synthetic coding sequence
atgaaagcagcagtccttactttggcggtcttgtttctcactggctcacaggcaagacatttctggcagcaagatgaaccacctcagagcccctgggatcgcgtgaaggacctggcaaccgtctacgtggatgtcttgaaggattcgggacgcgattacgtttcgcaatttgaagggtccgccctgggaaagcagctcaacctgaagctcctcgacaactgggattccgtgacttcaaccttcagcaaactcagagaacagctgggtccggttacccaagagttttgggataacctcgaaaaggaaacggaaggtttgcgacaggagatgtcgaaggatcttgaagaagtgaaggcaaaggtgcaaccttatcttgacgattttcaaaagaagtggcaagaggaaatggaactttaccgtcaaaaagtggagcctctgcgggcggagcttcaagaaggcgccaggcaaaagctgcacgaacttcaagaaaaactttccccgcttggggaggaaatgcgtgatagggcccgcgcacacgtggacgccctgcgaacccacctggcaccctactcggatgaactgagacagcggcttgcggcgcgcctggaagcgctgaaggagaatggaggtgcacggcttgcagaataccatgcaaaagccactgagcacctttcaactttgagcgagaaggccaagcctgcactggaggacctgcgacaagggctccttcctgtgttggagagcttcaaagtctcctttctgtcagcactcgaagagtacactaagaaacttaacacgcag

SEQ ID NO: 6455 - DNA, 801 bp, Artificial Sequence
  Description of Artificial Sequence: Synthetic coding sequence
atgaaggcagccgtgctcaccttggcagtgctgtttctcactgggagccaggcgaggcacttctggcagcaggatgagccaccacagtcaccatgggaccgggtgaaagatctggccaccgtgtatgtcgatgtgttgaaggatagcgggcgggactacgtttcccagtttgagggcagtgcgctgggtaagcagctgaatttgaagctacttgacaattgggatagcgtgacctctaccttcagtaagctgcgggaacagctaggccctgtgactcaggagttttgggataatctggagaaagaaacagagggccttaggcaagagatgagcaaggacctggaggaggtcaaggccaaggtgcagccttatctggatgactttcagaagaaatggcaagaggagatggaactgtacaggcagaaagtggaacccctgagggcggaattacaggaaggagcccggcaaaaactacacgagctgcaggagaagttgtcacccctcggggaagaaatgcgagatcgtgctcgagcacacgtagatgccctccggacccatctggccccctactctgacgaactgcgccagagacttgccgcaagacttgaagcactcaaggagaacgggggggccaggcttgcggagtaccatgcgaaggctaccgaacacctgtctaccctgtctgaaaaagctaagccggcattggaggatctcagacagggcctactcccggtgcttgagtcattcaaagtgtcttttctgtcagcgttggaggaatataccaagaagttgaatacccag

SEQ ID NO: 6456 - DNA, 801 bp, Artificial Sequence
  Description of Artificial Sequence: Synthetic coding sequence
atgaaagcagcagtgttgactctggccgttctgttccttaccggatcacaagcacggcacttttggcaacaagatgaacccccacagagcccttgggacagggtcaaggatcttgctactgtctacgtcgacgtccttaaggattcgggtcgtgactacgtgtctcagttcgaaggatcggcactcggtaagcaactcaatttgaagctcctcgataattgggactcagttacttcgaccttctccaagctgcgggaacaactcggtcccgtgacccaggagttttgggacaacctggaaaaggaaaccgaaggtctgcggcaggaaatgtcgaaggaccttgaagaagtgaaagcgaaggtgcaaccatacctggatgattttcagaagaagtggcaggaggagatggaactttacaggcaaaaagtcgaacctctgcgggcagaactccaggaaggtgcacggcagaagctgcatgagctccaggagaagttgtccccccttggagaggaaatgcgagatagagctagggcacatgtcgacgcactgcgtacccatctggcaccgtacagcgatgaactcagacaacgcttggccgcaagattggaggcgctcaaggagaacggtggcgctcggttggcagaataccatgccaaggcgactgaacacctgagcaccctttccgaaaaggcaaaaccagcgctggaggaccttcgacagggacttctgcctgtccttgagtcattcaaagtgtcattcctgtccgcactggaagaatatactaagaagctcaacactcaa

SEQ ID NO: 6457 - DNA, 801 bp, Artificial Sequence
  Description of Artificial Sequence: Synthetic coding sequence
atgaaagcggcagtgcttacccttgcagtgttgtttcttacggggtcacaggcacggcacttttggcagcaagatgagcctccccagtccccttgggatagagtgaaggatcttgccaccgtgtacgtcgacgtgttgaaggattcgggacgtgattacgtgtcgcagttcgaaggctccgcacttggaaagcaacttaatcttaaactgcttgataattgggattccgtcacctcgactttttccaaactgcgagaacagttggggcctgtgactcaggaattctgggataacctcgaaaaggagactgagggactgaggcaagaaatgagcaaggatcttgaagaagtgaaggcaaaggtgcaaccctacctggacgattttcaaaagaagtggcaagaagaaatggaattgtaccggcagaaagtggaacctctgcgagcagaactgcaggaaggtgcaaggcagaaacttcacgagctccaagaaaagctcagcccactcggggaagaaatgagagatcgagcaagagcacatgtcgacgcgctccgcacccatctcgcgccatactccgacgaactgaggcagcgccttgccgctcgcctcgaggcactgaaagaaaacggtggtgcccgcctggcagagtatcacgccaaggcaaccgagcatctttccacgctttcagagaaggctaaaccagcactggaagatcttagacaaggactgcttcccgtcttggaatcattcaaagtgtcatttctgtcagcccttgaagaatacactaaaaagctcaatacccaa

SEQ ID NO: 6458 - DNA, 801 bp, Artificial Sequence
  Description of Artificial Sequence: Synthetic coding sequence
atgaaagcggccgtgctgaccctcgctgtgttgttcctgactggcagccaggctcggcatttctggcagcaagacgagccgccacagagcccgtgggaccgcgtcaaagatctcgccactgtgtacgtggatgttctgaaggactccggaagagactacgtgagccaattcgaaggctcggctctgggaaaacagctcaacctgaagctgctggacaattgggattcggtgacctcaaccttctccaaattgcgcgagcagctcgggccagttacgcaggaattctgggacaacctggaaaaggaaaccgagggactgagacaagaaatgtcaaaggacctcgaagaagtgaaggccaaagtccagccatacctcgacgattttcagaaaaagtggcaggaagagatggaactgtacaggcagaaagtggaaccgctccgggctgaactccaggaaggagcgcggcaaaagctccatgaactgcaagaaaagctgagcccgttgggggaggagatgagagacagagcacgcgcccacgtggacgcgttgcggactcacctcgccccctacagcgacgagctccgccaacgcctggctgcaagactggaagccctgaaggagaatggaggagcgaggctggccgaataccatgcaaaggcaacggagcacctctcgaccctctccgagaaggcaaagccggctctggaggatctgagacaaggcctcctgccagtgctggagagcttcaaggtcagcttcctgtccgccctggaagaatacactaagaagctcaacacgcag

SEQ ID NO: 6459 - DNA, 801 bp, Artificial Sequence
  Description of Artificial Sequence: Synthetic coding sequence
atgaaggcagcagtgttgactctcgctgttctgtttctgacgggttcacaggccagacatttttggcagcaggacgagccaccgcagtccccctgggacagagtgaaagatctggctaccgtgtatgtggacgtactgaaagattctggaagggattacgtatctcagttcgagggcagcgcgcttggaaagcagttgaatctaaagttactagacaactgggactctgtcacttccacctttagcaaactacgggaacagcttgggcccgttacccaggagttctgggacaatctggagaaagaaaccgagggcttgcgccaggaaatgtccaaggatctcgaggaggttaaagccaaggtgcaaccgtacctggacgactttcaaaagaagtggcaagaagaaatggaattgtatcgccagaaggttgagccgctgagggccgagcttcaggagggcgcgcggcagaagttgcatgagctccaggaaaaactgtcgccgctaggggaggagatgagggaccgtgcccgagcacatgttgatgcgctgcgcacccatctagcaccttactctgacgagctgcgccaacgtttggcggcccgcctggaagcgcttaaggagaacggcggggctagacttgccgaataccacgccaaggctaccgaacatctctccactctgtccgagaaagctaaacctgccctagaagacctgcggcaaggcctcctccccgtgctggaaagtttcaaggtctccttcctgtccgccctggaggagtacaccaaaaaactgaacacccaa

SEQ ID NO: 6460 - DNA, 801 bp, Artificial Sequence
  Description of Artificial Sequence: Synthetic coding sequence
atgaaagctgccgtgctaactctggctgtgctgttcctcacagggtcccaggctaggcacttttggcagcaggatgaaccaccacagtccccctgggaccgagtaaaggacctcgcaactgtgtacgtcgatgtccttaaggatagcggccgtgactatgtgagtcagttcgaggggtccgcgctaggcaaacaactgaatctgaaactcctggacaactgggatagtgttacatctactttctccaagcttagggagcagctgggacccgttacccaggaattttgggataacctggaaaaggagacggagggccttcgacaggagatgagcaaagacctggaagaggtgaaagccaaagtgcaaccctaccttgacgatttccagaagaagtggcaggaagagatggaactctacaggcagaaggtcgaacctctgcgtgcagagctgcaagagggggccagacaaaaactacatgagctgcaggaaaagttatctcccctgggtgaagagatgcgagaccgtgcgcgagcacacgtcgatgcactacgaacccatctggccccttattccgacgagttgcgacagaggttggctgcacggctggaagcacttaaggaaaatggtggggctaggctcgccgagtatcacgccaaggccaccgaacaccttagtacactttctgagaaggctaagccagcactcgaggatttaaggcaaggactcctgcccgtactcgaaagttttaaggtgagcttcttgtccgctctagaagagtacacaaagaaactgaacacccag

SEQ ID NO: 6461 - DNA, 801 bp, Artificial Sequence
  Description of Artificial Sequence: Synthetic coding sequence
atgaaggcagctgtgttgactttggcagtcctgttcctgactggttctcaggcaaggcacttctggcagcaagatgaaccaccccaaagtccatgggacagggtgaaggacctagccaccgtttatgtagacgtgctcaaagatagtggtagagattacgtgagccagtttgaaggcagcgccctgggaaaacagctcaacctcaagcttttagacaactgggatagtgtgacaagcactttctctaagctccgggagcagctgggtccagtgactcaggagttctgggacaacttggagaaagaaactgagggtctgagacaggaaatgtccaaggacctcgaagaggtcaaggcgaaggtgcaaccctacctggacgacttccagaagaaatggcaagaggaaatggagctgtaccgacagaaggtcgagcctctcagggccgagcttcaagagggggcgaggcagaagctgcatgaattacaggagaagttgtctcccctcggggaagagatgcgagatagagccagggcccatgtggatgccctgcggacacatttagccccctactctgatgagctgcgccaaaggctcgcagcccgccttgaggcgttgaaggagaacgggggagccaggttggccgagtaccatgctaaagccactgaacacctaagtacccttagtgagaaagccaaaccagcgctcgaggacctccggcaaggactgctgcccgtcctggaatcatttaaggtaagttttttatcagctcttgaggagtacaccaagaagctgaacactcag

SEQ ID NO: 6462 - DNA, 801 bp, Artificial Sequence
  Description of Artificial Sequence: Synthetic coding sequence
atgaaggcggctgtgctcaccctcgccgtgctttttctcaccggctctcaagccaggcatttttggcaacaggatgagccgccccagagcccttgggatagggtgaaggatctggcaactgtgtacgtggatgtcttgaaggattctggacgggattacgtgtcgcagttcgagggatcagccctgggaaagcagctgaaccttaagctgctggacaattgggacagcgtgactagcacgttctcaaagctccgcgaacagctcgggccggttactcaggaattttgggacaaccttgaaaaggaaaccgagggactgcgacaggaaatgtcaaaggatcttgaagaagtgaaagcaaaggtccagccataccttgacgatttccaaaagaaatggcaagaggagatggagctttatcgccaaaaggtggaaccccttcgggcagaattgcaagagggagcgcgtcaaaaactgcacgagttgcaagagaaacttagccctttgggtgaagagatgcgggacagggcacgtgcacatgtcgacgcactccgtactcacctcgctccatactcggatgaacttcgtcaacgactggcagcgcgcttggaagcactgaaagaaaacggcggggccaggcttgcagaataccatgccaaagccaccgagcatctgagcaccctgtccgaaaaagcaaagcccgctttggaggacttgcggcaggggctgctgcccgtgctcgaatcctttaaagtgtcattcctgtccgcgcttgaagaatacaccaaaaagctgaatacgcag

SEQ ID NO: 6463 - DNA, 801 bp, Artificial Sequence
  Description of Artificial Sequence: Synthetic coding sequence
atgaaagcagctgtgctgacccttgcagtcttgttcctgactggatcccaagccaggcacttttggcagcaggacgaaccgcctcagtccccttgggatagagtgaaagacctggccactgtgtacgttgacgtgctcaaggatagcggaagagactacgtgagccaatttgagggcagcgcgctcggtaagcagctcaatctgaaacttctggataactgggattctgtgacctcgacgttctcgaaactccgggaacagctcggaccagtgacgcaggaattttgggacaacctcgaaaaggaaactgagggattgaggcaagagatgtcgaaggacctggaagaggtgaaagccaaggtgcagccgtatctggacgacttccaaaagaagtggcaggaagaaatggaactgtaccgtcagaaggtggaaccactccgggctgaactccaggaaggcgcccgccaaaaactgcatgaattgcaggaaaagctcagccccctgggagaggaaatgcgggatcgagcaagagcacacgtggacgccctcaggacccatctggccccatattccgacgaattgcgccaacggctcgcggcacgcttggaagctctcaaagaaaacggtggagcccgactcgccgagtaccacgcaaaggctacggagcacctgagcactctctcagaaaaggccaagcctgcactggaagatctgaggcagggcctcctgcctgtgctggaatcgttcaaggtcagcttcctgtccgcgctggaggaatacaccaagaagctcaacacccaa

SEQ ID NO: 6464 - DNA, 801 bp, Artificial Sequence
  Description of Artificial Sequence: Synthetic coding sequence
atgaaagcagccgtgcttacccttgcagtgctgtttcttactggctcccaagcacggcatttttggcagcaagatgaaccccctcaatcgccctgggatcgtgtgaaggaccttgcgacggtgtacgtggacgtcctgaaggattcaggaagagattacgtgtcgcaattcgaagggagcgccctgggtaagcaactgaacttgaagctccttgacaactgggatagcgtgacgtcaacctttagcaagctgcgcgagcagctcggaccagtcacgcaagaattttgggataacttggagaaggaaaccgagggccttcggcaggaaatgagcaaagacctggaggaagtgaaagctaaagtccaaccatacctggatgatttccagaaaaagtggcaggaagagatggaattgtatcgacaaaaggtcgagcctcttagggcagagctccaagagggtgcaagacaaaagctgcatgagctgcaagaaaagctgtcaccactcggagaggaaatgagggatcgagcaagggcacacgtggatgcactgcgtacccatctggccccctactccgatgagcttaggcaaagattggccgcacgtctggaagcactgaaagaaaacggtggagctcggcttgcagagtaccatgcaaaggcaaccgaacatttgtccactctttccgaaaaggctaagccagccctcgaggatctccgccagggccttctgccagtccttgaatcgtttaaggtgagcttcctctcagcactggaagaatacactaagaaactcaatacccaa

SEQ ID NO: 6465 - DNA, 801 bp, Artificial Sequence; identical to SEQ ID NO: 6434
  Description of Artificial Sequence: Synthetic coding sequence

SEQ ID NO: 6466 - DNA, 801 bp, Artificial Sequence
  Description of Artificial Sequence: Synthetic coding sequence
atgaaggccgcagtgctgaccctggctgtcctgtttcttaccgggtcacaggcgcgccacttctggcagcaggatgaaccgccacaatcgccgtgggaccgcgtgaaagacctggccaccgtgtatgtcgacgtcctcaaggacagcggacgggactacgtgtcccaattcgaaggaagcgcactgggcaagcaacttaacttgaagctgttggacaactgggattccgttacttcaactttttcgaagttgagggaacagctgggaccagtgacccaggagttctgggacaatctcgaaaaggaaaccgagggactgaggcaggagatgagcaaggatctggaagaggtgaaagcgaaagtgcaaccttacctcgatgacttccagaaaaagtggcaggaagaaatggagctctaccgccagaaggtggaaccgctgcgggctgagctgcaagaaggagcgagacaaaagctgcacgagctccaagagaaactgtcgccgctgggtgaggaaatgcgcgatagagcacgcgcccacgtcgacgccctgcgcacccatctcgctccctacagcgacgagcttcggcagcgactggcggccagactggaggcactgaaggaaaatgggggcgctcggctggccgagtaccatgcgaaggccacggaacacctctctactctctccgaaaaggccaaacctgcactcgaagatctccggcagggcctgctcccagtcttggagtcattcaaggtgtccttcctctcggccctggaagagtacactaagaaacttaacactcag

SEQ ID NO: 6467 - DNA, 801 bp, Artificial Sequence
  Description of Artificial Sequence: Synthetic coding sequence
atgaaagcggccgtgctgactctggcagtcctgttccttactgggagccaagcccgacacttctggcagcaggacgagccgccgcaatccccgtgggaccgggtgaaggatctggccaccgtgtacgttgatgtcctcaaggattcaggacgggactacgtgtcacagtttgagggaagtgcgctgggaaaacaactgaaccttaagttgctcgataattgggactccgtgactagcacgttctcgaaacttcgggagcagctcggaccagtgacccaggaattctgggataatctggaaaaggaaaccgagggtctgcgacaagaaatgtcaaaggacctcgaggaggtgaaggcgaaggtgcagccatacctggacgactttcagaagaagtggcaggaagaaatggaattgtacaggcaaaaggtggaaccgcttcgggccgaactgcaggagggtgccaggcagaaactgcacgaactgcaagaaaagctctctcctctgggggaggaaatgagagatagggcgcgggctcatgtcgacgcccttagaactcatcttgctccttactccgatgagcttcgtcagcgcctggctgccagactggaggctctgaaagaaaacggaggagctagacttgctgagtatcacgcgaaggcaacggaacatctcagcactttgtccgaaaaagctaaacccgccttggaggaccttaggcaaggcttgctcccagttctggagtccttcaaggtgtcctttctgtcagccctcgaagaatacaccaagaagctgaacacccag

SEQ ID NO: 6468 - DNA, 801 bp, Artificial Sequence
  Description of Artificial Sequence: Synthetic coding sequence
atgaaagcggctgttctcacccttgctgtcctctttctgacaggtagccaagctagacacttctggcagcaagacgaacctccccagtcaccttgggatcgggtcaaagacttggccactgtttatgtggatgtgttgaaggatagcgggcgcgattatgtcagccagtttgagggcagcgcccttggcaagcagcttaacctcaaactgctggataactgggactctgtgacaagtacattctccaagctgcgggagcagttaggtcccgtaacgcaggaattttgggataatctcgagaaggagacagaaggcctccgtcaggagatgagtaaggacctggaagaggtcaaagctaaagtgcagccctatctggatgacttccagaagaagtggcaggaagaaatggaactttatcgacaaaaggtcgagcctctgagagccgagctgcaagagggggctcgtcaaaagctgcacgagctgcaggagaagctatcacctttgggagaggaaatgcgcgaccgggcgagggcgcacgtggacgctctacgaacacacctagctccttattctgatgaactgcgccaacgattggccgcacggctggaagccttgaaggagaacggtggcgcacgcctagctgagtaccacgccaaggcgacagaacatttgtctactctgtccgaaaaggctaagccagccttagaagacttgaggcagggactcctacccgtcctggaatcattcaaggtctcttttttgagcgctctcgaggagtataccaaaaaattgaacacccag

SEQ ID NO: 6469 - DNA, 801 bp, Artificial Sequence
  Description of Artificial Sequence: Synthetic coding sequence
atgaaagccgccgtcctgactttggccgtgctttttctgactggttctcaagctcgccatttctggcaacaggacgagcctccccagagcccttgggaccgcgtgaaggatctcgcaacggtctacgtggatgtactgaaggactccggacgggactacgtgtcgcaatttgagggttccgccctcggcaagcaattgaacttgaagctgttggataactgggactccgtcacttctaccttctcgaagttgcgtgagcagctgggtccggtcacccaggagttttgggataatctcgagaaggaaaccgagggcctgcgccaggagatgagcaaggacctcgaagaagttaaggctaaggtccagccctaccttgatgactttcagaagaagtggcaggaggaaatggaactttaccgtcagaaggttgaacctttgcgtgccgaactccaggagggggcccgtcaaaagttacatgagcttcaggagaagctgtccccgctgggagaggagatgagggatcgtgctcgcgcgcatgtcgacgctttacggacccaccttgccccttattcggatgagctccgacagcggttggccgcacgcctcgaggccctgaaggagaatggcggcgctcggctggccgagtaccacgccaaggcaaccgaacacttgtcgacgctgtcggaaaaggctaaaccggctttggaagacctccggcagggtctgttaccggtgcttgagagttttaaggtgtctttcctatctgctctggaggaatatacaaagaagttgaacacccag

SEQ ID NO: 6470 - DNA, 801 bp, Artificial Sequence
  Description of Artificial Sequence: Synthetic coding sequence
atgaaggcagccgtgctcaccctcgcagtcctgtttctgactggaagccaggcgcgccatttctggcagcaggatgaacctccgcagtccccttgggatagagtcaaggatttggcaacggtgtacgttgatgtgctgaaagactcgggaagagattacgtgagccaattcgagggatccgcactgggaaaacagctgaatctgaagctgctcgataactgggacagcgtgacttccactttttcaaagctgcgagaacaacttgggcccgtcacgcaagaattctgggataacttggagaaagagactgaaggtctgcggcaggaaatgtcaaaagatctcgaggaggtgaaggccaaggtgcaaccatacctggatgacttccagaagaaatggcaggaagaaatggagctctaccgacaaaaagtggaaccacttagagccgaactgcaagagggagcaagacaaaaactgcatgagttgcaggaaaaactgagtcctcttggtgaagagatgcgcgatcgtgcgcgcgcccacgtggacgcgctgagaacccatctggcaccgtactccgacgaactgcgccaacggctggcggcccgtcttgaagcacttaaggaaaatggtggggcacgacttgcggaatatcacgccaaggctactgagcacctgagcactctttcagaaaaggcaaagccagcacttgaagatcttcgacagggccttcttcctgtgcttgaatccttcaaggtgtcctttctgtccgcacttgaggaatacactaagaaattgaacactcag

SEQ ID NO: 6471 - DNA, 801 bp, Artificial Sequence
  Description of Artificial Sequence: Synthetic coding sequence
atgaaggctgcagtgctgactcttgccgtgcttttcctgactggatcccaagcacgccatttctggcagcaggatgagccgccgcaatcgccgtgggaccgcgtgaaggacctggccaccgtgtacgtcgacgtgctgaaggattcaggtcgagactacgtgtcccagtttgagggatccgccctgggaaaacagctgaatctgaagctgttggacaactgggacagtgttacgtcaaccttctcaaagctgagggagcagctgggaccagtcactcaggaattctgggacaacctggagaaagaaactgagggactgagacaagagatgagcaaggacctggaggaagtgaaggcaaaagtgcagccatacctggacgacttccaaaagaagtggcaggaggagatggagctgtaccgccaaaaggtggaacccctccgggcggagctgcaggagggggctcgtcagaagctgcatgagcttcaagaaaaactgtccccgctcggggaagagatgcgcgaccgcgcgagggcccacgttgacgccttgagaactcacctcgccccatacagcgacgagctgagacaacggttggcggcacggctggaagccctgaaggagaacggaggagccagactcgccgagtatcatgccaaggcgaccgaacacctctcgaccctgtcggaaaaggccaaaccagcactcgaggatcttcggcagggactgctcccggtgctcgaatccttcaaggtgtcttttctgtcagcactggaggaatacactaagaagctgaatactcag

SEQ ID NO: 6472 - DNA, 801 bp, Artificial Sequence
  Description of Artificial Sequence: Synthetic coding sequence
atgaaggcggccgtactgactctcgccgtgctttttttaactggatcccaagccagacatttctggcaacaagatgagccccctcaatctccctgggaccgagtgaaagaccttgccacagtgtacgtggatgtcctgaaggatagtggacgggattacgtgagccagtttgagggaagtgcattgggcaaacagctgaacctgaagctactcgataattgggactctgtaacttccaccttcagcaagctgagggagcagctcggacccgtgactcaggaattttgggacaaccttgaaaaagaaaccgaggggttgcggcaagaaatgtctaaagatctggaagaggttaaagcaaaagttcagccatacttagacgacttccaaaagaaatggcaagaggaaatggagctatatagacagaaggtggagcccctgagggcggagctgcaggagggtgctcgccagaaactgcatgaactgcaagaaaagctgagtccactgggagaggaaatgagagaccgggcgcgggctcatgtggatgccctgcgaacccacttagcgccctatagcgatgaactgcgccagagactggccgcgcgtctggaagcccttaaggaaaatgggggcgcaagactggcagaataccatgccaaggctactgagcacctgtcaacactaagcgaaaaggctaaaccagctttagaagatctgcgacaggggctcctacctgtgctggaatcctttaaggtttcgttcctcagtgctctggaggaatacacgaaaaagttgaacacacag

SEQ ID NO: 6473 - DNA, 801 bp, Artificial Sequence
  Description of Artificial Sequence: Synthetic coding sequence
atgaaagctgccgtattgaccctcgcagtcttgttcctgacaggatctcaggcccggcacttttggcagcaagacgaaccaccacagagcccatgggaccgtgttaaagacctcgctactgtttatgtagacgtcttaaaagactcaggaagagactacgtttctcaattcgagggttcagcccttggaaaacagctgaacctcaagttgttagataattgggactctgttacctccaccttttcaaaacttcgtgagcagctaggaccagtgacccaggaattctgggacaatctggaaaaagaaacagaagggttgagacaggaaatgtcgaaagatctcgaggaagtgaaggcaaaagtccaaccgtaccttgacgacttccaaaaaaagtggcaagaagaaatggaactttatcgtcaaaaggttgagccgcttcgagcagagcttcaagaaggagctaggcagaagcttcacgagttgcaagagaaattgtcacctcttggcgaagaaatgcgggatagggctagggcccatgttgatgcacttcgcacacatctcgcgccctatagtgatgaactcagacagcgtttggctgccaggttggaagcacttaaagaaaacggaggagcgcgactggcagaatatcatgcaaaagctacagaacatctgtctactctttctgaaaaagcaaaaccagccttggaagatcttagacaaggtttattaccagtcctcgaatctttcaaagtatcatttttgtctgcacttgaagaatacacaaaaaagttgaatacacaa

SEQ ID NO: 6474 - DNA, 801 bp, Artificial Sequence
  Description of Artificial Sequence: Synthetic coding sequence
atgaaggccgccgtgttgacactcgctgtgctcttccttactgggtctcaagcccgacatttctggcagcaagatgaaccaccacagagcccctgggacagagttaaggaccttgccaccgtatatgtggatgtgttgaaggattccggccgagactatgtcagccagttcgaggggtctgcgctgggtaaacagctgaacctgaaacttctcgacaattgggatagcgtcacctccacctttagcaagttgcgagagcagctgggtccagtgactcaggagttttgggacaacctggaaaaagagactgaaggcttgcgccaggaaatgtccaaggacctggaggaggttaaggcaaaggttcagccatatttggacgacttccagaagaagtggcaagaggaaatggagctctacagacagaaggtggaaccacttagggctgagctccaggagggtgctaggcaaaagctccatgagctccaggagaagctgtctcctcttggggaagagatgagagaccgggcccgcgctcacgtggacgcgctgagaacccatctggctccctactccgacgagctgagacagaggctggctgcgaggctggaggctttgaaagaaaacggcggagctcggctggccgagtaccacgccaaagccactgaacacctttcaacactgtccgaaaaggctaagcctgccctcgaagatctccggcaggggttgctccctgtcctggaatctttcaaggtttcattcctgtctgccctggaggagtatactaaaaaactgaacactcaa

SEQ ID NO: 6475 - DNA, 801 bp, Artificial Sequence
  Description of Artificial Sequence: Synthetic coding sequence
atgaaggcagccgtgttgaccctggctgtgctgttccttactggcagtcaagctcgccacttctggcagcaagatgagccccctcaaagcccctgggaccgtgttaaagacctggcaaccgtgtacgtggatgtgcttaaggactccggacgtgactacgtgagccagttcgagggcagcgccctaggaaagcagctaaacctcaagctgttggacaactgggatagcgtcacttctactttttccaagttacgtgagcagctgggaccagtcacacaggaattctgggacaatctggagaaggaaaccgagggactccgtcaagaaatgagtaaggacctggaggaagttaaggcaaaagtgcagccctacctcgatgattttcaaaaaaagtggcaggaagagatggagctgtatcgccagaaggtggagccattacgagccgagttacaggaaggggcccgccaaaaactgcatgagctgcaagagaagctgtcacctttaggtgaagagatgagagatagagcaagggcccacgtggacgctctccgcacccacctggccccctatagtgatgagctgagacagcgtctggccgcccgcctcgaggccctgaaggagaatggaggggctaggctggccgagtatcacgccaaagccactgagcatctcagcaccctgtctgagaaagccaagccagccctggaggatttacgccaggggctccttcctgttctggaatcattcaaagtttcttttctaagtgctttggaggagtataccaagaaactgaatacacag

SEQ ID NO: 6476 - DNA, 801 bp, Artificial Sequence
  Description of Artificial Sequence: Synthetic coding sequence
atgaaggccgccgtcctcaccttggcagtactcttcctgactggttcccaagcccgccacttctggcagcaggatgagccccctcaatccccttgggacagggtcaaagacttggccactgtctacgtggatgtcctgaaggacagcggtagagactatgtctcacagttcgagggctccgcgctgggaaaacagctcaacctcaaacttctcgacaattgggattctgtgacttcaactttctccaagctgagggagcaacttggccccgtaacacaggaattctgggacaacctggagaaggagacggagggcctcaggcaagagatgtcaaaagacttggaagaggtaaaggcaaaagtccagccctacctcgacgactttcagaagaagtggcaggaagaaatggagctttatcgccagaaggtagaacctctcagagctgaactccaggagggagcacgccagaagctccacgagctgcaggaaaagttgtctccactgggcgaagagatgagagatagggcgagggctcacgtggatgcccttagaacccacttggccccctattctgatgagctgaggcaacgcctggccgcgaggctcgaagcactgaaggagaacggtggcgccagactcgcggaataccacgctaaggccacggaacatctcagtacactctctgaaaaggcaaagcctgctctggaagatttgagacaaggactgctgcctgtgttggagagcttcaaggtcagcttcttgagcgcccttgaggagtacaccaaaaagctgaacacccag

SEQ ID NO: 6477 - DNA, 801 bp, Artificial Sequence
  Description of Artificial Sequence: Synthetic coding sequence
atgaaggcagccgtgctcactctggccgtgttgtttcttaccggttcccaagcacgccatttttggcaacaagatgagcctccccaatcgccttgggatcgcgtcaaagatttggctactgtgtacgtggatgtgctgaaggattcagggcgcgactacgtctcacagtttgaaggtagcgccctgggcaagcaactcaacctgaaacttctggataactgggatagcgtgactagcactttctcaaaacttagagaacaactcggacctgtgactcaggaattttgggacaacttggagaaggaaactgagggccttcggcaggaaatgtcgaaggacctggaggaggtcaaggcaaaggtgcagccatatctggatgactttcaaaagaagtggcaagaggaaatggaactttaccgccagaaggtcgagccacttcgcgcagagctccaagaaggagcaagacaaaaactgcatgagttgcaagaaaaactgtcacctctgggagaggagatgcgcgatagggcacgcgcccatgtcgatgcccttcgaacccacctggcgccctactcagacgaactccggcaatgcttggcggcacgacttgaagcactcaaggaaaatggaggggcaagacttgcagaataccatgcgaaggcaaccgaacacctgtcaaccctgtcagaaaaagcaaagcctgcccttgaagatcttcggcagggactgcttccagtgctggaatcattcaaggtcagcttcctgtcggcgcttgaagagtacaccaaaaaactcaatacccaa

SEQ ID NO: 6478 - DNA, 801 bp, Artificial Sequence
  Description of Artificial Sequence: Synthetic coding sequence
atgaaggccgctgtcctgacacttgccgttctcttcctcacaggctcacaggcccgtcacttctggcagcaggacgaacctccccaaagcccttgggatagggtgaaggatcttgccactgtgtatgtcgacgtgcttaaggactcaggtcgcgattatgtatcccaatttgaaggaagcgcattaggcaaacaacttaacctgaaattactggataattgggactctgttaccagcaccttttcgaaactccgggagcagttggggcccgttacccaggagttctgggataacctcgagaaggagaccgaggggcttcgccaggaaatgagcaaagacctggaagaggtcaaggctaaggtgcagccctacctggacgacttccagaaaaaatggcaggaagaaatggaactctacaggcaaaaagtcgaacccctgagggcggagttgcaggaaggcgcacgccagaaacttcacgaactccaggaaaagcttagcccgttgggcgaggagatgagggatcgcgctagggcgcacgttgacgcgcttcggacacatctggccccatatagcgacgaacttcgacagtgcctggctgcccggctcgaggcgttaaaggagaacggtggcgcaaggctcgctgaatatcatgccaaggctaccgagcatctgagcaccctctcagaaaaggcgaagcccgcactcgaagaccttaggcaaggcctgcttcccgtcctcgagtctttcaaggtgagctttttgagcgctttggaggagtacacgaagaagctcaatacacag

SEQ ID NO: 6479 - DNA, 801 bp, Artificial Sequence
  Description of Artificial Sequence: Synthetic coding sequence
atgaaagcagcagttctaaccctggcggtgttgttcttaactggttcgcaagctcgtcacttctggcagcaggatgagccaccccagagcccctgggacagggttaaagatctggccactgtatacgtggatgttttaaaggattctggtcgggattacgtatctcagtttgagggttctgcgctcggaaagcagctgaatcttaaattactcgacaactgggactccgtgactagcacattctccaaattgcgagagcagctgggccccgtcacgcaagagttctgggataacttagaaaaggaaacagagggcctcaggcaagaaatgtccaaagatctcgaggaagtgaaagcgaaggtgcagccatatctcgatgactttcaaaagaagtggcaggaggaaatggaactttaccggcaaaaggtggaacccttgagggccgagctgcaggaaggcgctcgacagaagctacacgaacttcaggagaagctatctcctctgggcgaagagatgcgcgaccgagctagagcccatgtggatgcgctcaggacacatctggcgccgtacagcgatgagttgcggcagtgcctagctgctaggctggaggcactcaaagagaacgggggcgcgcggctcgctgagtatcatgcgaaagccaccgagcacctgtccacacttagtgagaaggcaaagccggcccttgaggatttacggcagggccttttgcccgtcctcgagtctttcaaggtaagtttcctgtcagcgctggaggaatacaccaaaaagctgaatacccaa

SEQ ID NO: 6480 - DNA, 801 bp, Artificial Sequence
  Description of Artificial Sequence: Synthetic coding sequence
atgaaggccgccgtgctgaccctagcagtgctcttcctaaccggctcccaagctcgccacttctggcagcaagatgaacctccccagtcaccatgggacagagtgaaggacttggcgaccgtgtatgtggacgtgcttaaggactcaggccgtgactacgtatcgcagtttgaaggatccgcactgggaaagcagctaaatcttaagctgctagataattgggattctgtgaccagcacatttagtaaacttcgagaacagctaggccccgtgacacaggagttttgggataaccttgaaaaagaaaccgaagggttaaggcaggaaatgtcgaaagatttggaggaagtcaaggcaaaggtgcagccatatttggacgatttccaaaaaaagtggcaagaggagatggagttgtatagacaaaaggttgaaccgctacgcgccgaactgcaggagggggctcgacagaagttacatgaattgcaggaaaaattgtcaccactcggggaagaaatgcgagaccgagctagggcccatgtcgacgctttaagaacccacctggcaccttactccgacgagcttcgacagtgcctcgccgctaggttggaggcccttaaagagaacggaggagctcgattggcagagtaccacgccaaggcgaccgagcacctttctaccttatccgagaaggccaagccagcccttgaagatctgcgtcaggggctgctgccagtgttggagtccttcaaagtatctttcctgtcagccctggaggaatatacaaagaaactgaacacacag

SEQ ID NO: 6481 - DNA, 801 bp, Artificial Sequence
  Description of Artificial Sequence: Synthetic coding sequence
atgaaggccgccgtactgaccttggccgtactttttctgacaggaagccaggcccggcatttttggcaacaggacgaaccacctcaatctccgtgggatagggtgaaagacttggcaaccgtgtacgtggatgttctcaaggattccgggcgagattacgtgtcacagttcgagggaagcgccctggggaagcagctgaatctgaaattgttggataactgggattcagtaacttccaccttttctaaactgagggaacagctgggacccgtcacacaagagttctgggacaacttggagaaggaaacagagggtctgcgacaagaaatgagtaaggatctcgaagaggtaaaggcaaaagtgcagccttaccttgatgacttccagaagaaatggcaggaagagatggaactctacaggcagaaggttgaaccgcttcgcgccgagctgcaggagggagctaggcaaaagctgcacgagctccaggaaaagctctcacctctgggagaagaaatgagagaccgcgccagagcccatgtggacgcgctccgcacccaccttgccccttatagcgatgagctgcggcagtgtctggctgcgcggctggaagctcttaaagaaaacggtggcgccagactggctgagtatcatgcaaaggcaacagagcatctctccacactctcagagaaggcgaaacctgcgttggaggatcttagacaaggtctcctgcctgtgcttgaaagcttcaaagtcagctttctcagcgcactcgaagagtataccaagaagcttaatactcaa

SEQ ID NO: 6482 - DNA, 801 bp, Artificial Sequence
  Description of Artificial Sequence: Synthetic coding sequence
atgaaagctgcagtgttgaccttggctgttttgttcctgactgggagccaggcgaggcatttctggcaacaggacgaaccacctcaatccccctgggaccgggtgaaagacctcgccacagtgtacgtggacgtgctcaaggacagcggcagagattacgtctcacaattcgaggggtcagccctgggaaagcagctgaacctcaagctgctggataattgggattccgtgacaagtacattttcaaagctccgggaacagttagggcctgtgacccaggaattctgggacaacctggagaaggagaccgagggactgcgacaagagatgagcaaggacttggaagaagtgaaagccaaagttcagccatacttggacgacttccaaaagaaatggcaagaggagatggaattgtatagacagaaggtggaacctttgagggcagaactgcaggagggagcccgccaaaagctgcacgagcttcaagagaaactgtctccacttggcgaagaaatgagggacagagctagagcgcacgttgacgcacttcgcacacacctggctccatactccgacgagttgagacagtgcctggctgccagactggaggcactgaaggagaacggtggagccagattagctgaatatcatgcgaaagccaccgaacatttgagtactctgtccgaaaaggccaagcccgctctggaggatttgcgtcagggtctactccccgtactagaatcatttaaagtgagtttcctgtcagcattagaggaatacaccaagaaactgaatactcaa

SEQ ID NO: 6483 - DNA, 801 bp, Artificial Sequence
  Description of Artificial Sequence: Synthetic coding sequence
atgaaagcagccgtgttgacccttgccgtccttttcctgaccggttcgcaggcaagacatttttggcagcaagatgagccccctcagtccccttgggacagagttaaggacttggcaaccgtgtacgtggatgtcctgaaggatagcggacgtgattacgtgtcacaattcgaaggttccgcactgggcaagcagctgaacctgaagctgctggataattgggattccgtgacgagcacgttttcgaagctgagagaacaacttggacccgtgacccaagaattctgggacaatctcgaaaaggagactgagggccttcgtcaagaaatgagcaaggatctggaagaagttaaagccaaggtccaaccatacctggatgacttccaaaagaagtggcaggaggaaatggaactctaccgtcagaaggttgaacctcttcgggcagagctgcaagaaggtgcacggcaaaaacttcatgaactgcaggagaagctgtcacctctgggagaagaaatgcgcgatcgtgcccgggcccacgtggacgcgcttagaacccatctggctccctattcagatgaacttaggcagtgcctcgcagcgcgcctggaggccctgaaagaaaacggtggagcgagactggccgaataccacgccaaagcaactgaacatctgagcactctctccgagaaagcaaagccagcgcttgaggaccttcgccagggactgctccctgtcctggagtcgtttaaggtttcgtttctttccgcgctggaggaatacaccaagaagctgaacacccaa

SEQ ID NO: 6484 - DNA, 801 bp, Artificial Sequence
  Description of Artificial Sequence: Synthetic coding sequence
atgaaagcggcggttctgacactcgcagttctctttctgaccggatcgcaagctcggcacttttggcagcaggacgagcctccccagtccccatgggaccgagtaaaggacctcgcaacggtgtacgtcgatgtcctgaaggactccgggagagattacgtgtcccagttcgaaggctctgctctgggaaagcagctgaacctgaaactgttagataactgggattctgttaccagtacattctccaagctgcgggaacagctgggacccgtaacacaagagttctgggataaccttgaaaaggaaaccgaaggcctcagacaggagatgtctaaggaccttgaggaggtcaaggccaaagtgcagccgtatctcgacgatttccaaaaaaagtggcaggaagaaatggagttgtacaggcagaaagtcgaacccctgcgtgccgagcttcaagaaggcgctagacaaaaactgcatgagctccaggagaagttgtcacctttgggagaggaaatgagggatagggcccgcgctcacgtggatgcgctgcgaacccatctagctccctactcggacgaactgcgtcagtgtctggccgcgaggttagaggcactaaaagaaaacggtggagctagactcgcagagtaccatgccaaggccaccgagcatctctccactctttccgagaaggccaaacccgcgctcgaagacctcaggcagggcctgctgcctgtgctggagtcattcaaggtgtctttcctgtccgccctggaggaatatacaaagaagctgaacacccag

SEQ ID NO: 6485 - DNA, 801 bp, Artificial Sequence
  Description of Artificial Sequence: Synthetic coding sequence
atgaaagccgccgttctgactttagcggttcttttcctgaccgggagtcaggctcgccatttttggcagcaggacgagcctcctcagtctccgtgggacagagtgaaggacctggccaccgtttacgtcgacgttttgaaggactctgggagagattacgtctcacagtttgaggggagcgctcttgggaagcagctgaatctgaagctgttagacaactgggacagtgtgacctccacctttagtaagctgcgtgagcagctgggccccgtgactcaagaattttgggataatcttgaaaaagagacagagggcttgcgccaagaaatgtcaaaagacctggaagaggtcaaagcgaaagtccagccctacctggacgatttccagaagaagtggcaagaggaaatggaactgtatagacaaaaagtcgaaccgctccgcgccgagctacaagagggtgcccgacagaaactgcacgagctccaggagaaactgagccccctcggagaggagatgcgagatcgcgcacgggcacacgtggacgccctgcgaacacacctagcaccgtactctgacgagcttcgccaatgcctcgccgcccgcctggaagctctgaaagagaatggcggggctcggctggccgagtatcacgccaaagcaaccgaacacttgtctactctaagtgagaaagctaagcctgcattggaagaccttcggcagggtttgctgcccgtgctcgagagctttaaggtgtctttcctatctgccctggaagagtacacaaagaaactaaatacacaa

SEQ ID NO: 6486 - DNA, 801 bp, Artificial Sequence
  Description of Artificial Sequence: Synthetic coding sequence
atgaaagctgctgtcttgacgcttgcggttttatttcttactggcagccaggctcgtcacttctggcaacaggatgaacctccacaatcaccgtgggatagagtcaaggatctagctacggtgtatgtagatgtcctgaaggattctggtagagattatgttagccaatttgaaggttccgctctgggaaaacaactaaatcttaaactgctggataactgggattccgtgacgtccactttcagcaaactgcgtgagcaacttggaccagttactcaagagttttgggataacctggagaaggaaacagagggtctaagacaagaaatgtccaaggatcttgaagaagtgaaagcgaaggtacaaccgtatcttgacgactttcagaaaaagtggcaagaggaaatggagttataccggcagaaagtggagccacttagagcggagctccaagagggagcgcgtcaaaagctccatgagcttcaggagaaattgtcaccattgggtgaggagatgcgagatcgagctcgggcacatgtggatgcgctgcgtactcacttggctccgtacagtgatgaattgcgccagtgtttggctgcccgattggaagccttgaaagaaaacggtggtgccagattagctgaataccatgctaaggcaacggagcatctctcaaccctctcagaaaaggccaagccggcccttgaggatctccgtcaaggacttctgccagtgcttgaaagcttcaaggtgtcattcctgtcagcacttgaggaatatacgaaaaagttgaatacacag

SEQ ID NO: 6487 - DNA, 801 bp, Artificial Sequence
  Description of Artificial Sequence: Synthetic coding sequence
atgaaggctgctgtgttgacccttgcagtactctttttgaccggatctcaggctcgtcatttctggcagcaggatgaacccccacaaagcccgtgggaccgagtcaaagacctcgccactgtatatgtggacgtgctcaaagacagtggccgagactatgtgtcccagttcgaggggtctgccctaggtaaacagcttaatttgaagctcctggataactgggactccgtcacctctacgttctcaaagcttcgggaacagctcggccctgtgacgcaggagttttgggacaatttggaaaaagagactgaggggctgcgacaggagatgtcgaaagacctggaagaggtgaaagctaaagtccagccctacttagacgacttccagaagaagtggcaagaagaaatggagctctaccgccagaaagtggagccattacgagccgagctccaggaaggcgcaagacagaagctccacgagctgcaggagaagctgtccccacttggggaggaaatgcgcgatagagccagagcccacgtcgatgcacttagaacccatctggcaccctactcagacgagctgcggcagtgtttggcggcccgcctagaggcactgaaggagaacggcggagcgaggctggccgagtaccacgccaaagcaaccgaacacctttccacgcttagtgagaaggctaaaccggccctggaagaccttagacaaggcttgcttcctgtcctggagagtttcaaagttagctttctaagcgcgctggaggagtacactaaaaagcttaacacccag

SEQ ID NO: 6488 - DNA, 801 bp, Artificial Sequence
  Description of Artificial Sequence: Synthetic coding sequence
atgaaggcagcagtcctgactctggctgttttatttctgacgggatcgcaggcgagacatttttggcagcaggatgaaccgccccaaagtccctgggaccgcgtaaaggatctggcgacggtgtacgtggatgtgttgaaggattctggaagagattatgtgtcccagttcgagggaagtgctttagggaagcagcttaacctgaaactgctggacaattgggacagcgtgacatcaactttttccaagcttcgagagcaactaggcccagtcacccaggagttctgggataacctggagaaagaaacagaaggcctccgccaggaaatgagcaaagacttggaggaggtaaaggccaaagtacagccttatttggatgactttcagaagaaatggcaggaggaaatggaactgtatcggcaaaaagtggagcccctgcgcgccgagttacaggagggggcccgacagaaactgcacgaactgcaagagaaactgtctcccctgggggaggaaatgcgcgacagggcccgcgcgcacgtggacgccctccgcactcacctagctccgtattccgatgagctgcggcaatgtcttgccgcacgtttggaggctctcaaagaaaacggaggagccagactagctgagtaccacgctaaagccacggagcatttgagcactttgtccgaaaaggctaagccggcactcgaagatctccggcagggattactcccggttctggaaagctttaaggtgtccttcttgagcgccctcgaggagtacacgaaaaagcttaatacccaa

SEQ ID NO: 6489 - DNA, 801 bp, Artificial Sequence
  Description of Artificial Sequence: Synthetic coding sequence
atgaaggccgcagtgctcacactggccgtgctgttcctaaccgggtcccaggcccgacatttttggcagcaggacgaacccccacagtcaccatgggatcgggtcaaagacctggctactgtgtacgtggacgtactgaaggacagtggcagagactacgtctcacaattcgaagggtctgcactgggcaaacagctaaatcttaaactgctcgacaactgggactcggttacgagcacgttctctaagctgagggagcagcttggcccagtcacacaggaattctgggacaacctagagaaagagacagaggggctcaggcaggagatgtcgaaagacctagaagaagtgaaggctaaggtacagccatatctggatgactttcagaaaaagtggcaggaggaaatggaattgtataggcagaaagtggagcctctgagggccgagctgcaggaaggcgcacggcagaaacttcacgaattacaagaaaaactttcccccttaggggaggaaatgcgcgatcgcgcccgagcccacgtggacgccttgaggacacatctcgcaccatatagcgatgagttgcgtcagtgcctggcagctcgactagaagcattgaaggagaacggcggagcccgactggcggaataccatgccaaggccaccgagcaccttagtacattaagtgagaaggccaagccagccctggaggacctgagacaggggctgctgccagtactggagtcctttaaggtgagcttcctatccgccctcgaggaatatacaaagaagctaaacacacaa

SEQ ID NO: 6490 - DNA, 801 bp, Artificial Sequence
  Description of Artificial Sequence: Synthetic coding sequence
atgaaggccgctgtgttgactctcgccgtgctcttcttgactggttcccaagccaggcacttctggcaacaggatgagcctccgcagagcccatgggatcgcgtcaaggacctcgctactgtgtacgtggatgtgctcaaagatagtggacgcgattacgtgtcgcagttcgaggggagcgcgctgggtaagcaattgaatttgaagctgctggacaactgggattcggtcacttcgactttcagcaaactgcgggagcagctcggaccagtgactcaggagttctgggacaatctggaaaaggaaaccgagggcctccgccaagagatgtccaaagatctggaagaagtgaaggctaaagtccagccttatctggacgacttccaaaagaagtggcaggaggagatggaactgtacagacaaaaggtggaaccgctgcgggcagaactgcaggagggcgctcggcaaaaactccacgaactgcaggaaaagctctcccctttgggagaggagatgcgggaccgtgccagagctcacgtcgacgcacttagaacccaccttgccccgtattcagatgagctgcgccagtgcctcgccgcaagattggaagccctgaaagaaaacggcggagcgcgcctcgcagaataccacgctaaggctaccgagcatctcagcactctctcggagaaagccaagccggcactcgaggaccttcgccaaggacttctgccggtcctcgaatcctttaaggtttctttcctgtcggccctggaagagtacaccaagaagctgaacacccaa

SEQ ID NO: 6491 - DNA, 801 bp, Artificial Sequence
  Description of Artificial Sequence: Synthetic coding sequence
atgaaggcagcggtgctcactctcgcagtgttgtttctgaccggatcccaagccaggcacttttggcagcaagacgagcccccgcaatccccctgggacagggtgaaggacctcgccacggtgtacgtggacgtgctgaaggattcagggagagactacgtgagccagttcgaggggagcgcactcggaaaacaacttaatctgaaacttcttgacaactgggacagcgtcaccagcaccttttcgaaactccgcgaacaacttggcccagtcactcaagagttttgggataaccttgaaaaggaaactgaagggcttagacaggaaatgtcgaaggacctggaagaggtgaaagcaaaggtgcagccttacctggatgacttccagaagaaatggcaagaagaaatggagctttaccgtcagaaggtggaacctttgagagcagaactgcaggagggcgcacgccaaaagctgcatgagctgcaagaaaagttgtcacctctgggagaagaaatgcgagatcgtgcgagagcacatgtggacgcactgcgaacccatcttgcaccatacagcgatgaactgcgtcaatgccttgcagcacggctcgaggcactcaaggaaaatggtggtgccagacttgcggaataccatgcaaaagcaactgaacacttgtcgaccttgtcggagaaggccaagcctgcactcgaagatctgagacaaggtttgcttccagtgctggagtccttcaaagtgtcattccttagcgcattggaggagtacactaagaagctgaatacccaa

SEQ ID NO: 6492 - DNA, 801 bp, Artificial Sequence
  Description of Artificial Sequence: Synthetic coding sequence
atgaaggcagccgtgctcacgttggcagtccttttcctcaccgggagccaagcccgccacttctggcaacaggacgagccgccacagagcccgtgggatcgcgtcaaggatctcgcgaccgtgtacgtggacgtgctgaaagactcaggaagagattacgtcagccagtttgagggttcggcccttggaaaacagctgaatctcaaacttctggacaactgggactccgtgacctcgacctttagcaagctcagagagcaactcgggccggtgactcaagagttctgggataacctggaaaaagagactgaggggctgcggcaggaaatgtccaaggatctcgaagaagtcaaggcaaaggtccagccatacctggacgacttccagaagaaatggcaggaagaaatggaactttaccgccagaaagtggagccgcttagagctgaattgcaagaaggagcccggcagaagctgcacgagctccaggaaaagctgtcgccacttggtgaggagatgcgcgaccgagctagagcacatgtggatgcactcagaacccatctggcgccgtactccgacgagctccggcagtgcctggcagcccgcctcgaagcgttgaaggagaacggaggagcccggttggcggaataccacgcaaaggcaaccgagcatctgtcgaccctttccgagaaggccaagcctgcactggaggacctgcgccaaggattgctccccgtgctggagtccttcaaggtgtcgttcctgtctgccctggaagagtacaccaagaaactcaatacccag

SEQ ID NO: 6493 - DNA, 801 bp, Artificial Sequence
  Description of Artificial Sequence: Synthetic coding sequence
atgaaggcagctgtgctgacactggctgtgttattcctgacaggatctcaggcccgccacttttggcagcaggatgaacccccacagtctccctgggatagagtaaaggacctcgctaccgtgtacgtggatgtgctgaaagacagcggtagggactacgtgtcacaatttgagggatcagccctaggcaagcagctgaatctcaagctgctcgataactgggactccgtgacatccacatttagcaagctgagggagcaactcggaccggttacccaggaattctgggacaaccttgaaaaggagactgaaggtttaagacaggagatgagtaaagatctcgaggaagtgaaggccaaagtccaaccttacctcgatgacttccaaaaaaagtggcaagaggagatggagctctatcgccagaaggtggagcccttaagagccgagttacaggaaggggctaggcagaagttgcacgagctgcaggagaagctgagcccactgggcgaagaaatgcgcgatagggcccgggctcacgtcgatgcactccgcacgcacctggcaccatactcagatgaattgcgacagtgcctcgcagcaaggcttgaagccctcaaagaaaatggcggcgccagactggccgaataccacgcaaaagccactgaacacctttccaccttatcagaaaaagccaaacccgcgctcgaggatctgcggcaagggcttctgcctgtgttggagagtttcaaggtgtcgtttctcagcgctcttgaagaatacactaagaaactgaatacccaa

SEQ ID NO: 6494 - DNA, 801 bp, Artificial Sequence
  Description of Artificial Sequence: Synthetic coding sequence
atgaaggccgcggtgctgaccctcgccgtgctgttccttacgggaagccaggcgcgccacttctggcaacaggatgaaccgcctcagtcaccctgggatagagtgaaggacctggctaccgtgtacgtcgacgtgctgaaggacagcgggcgcgattacgtgtcacaattcgagggatccgcgttgggaaagcagctgaacctcaagctcctggataactgggactcggtgacctcgacgttctcgaagctgcgggagcaactcggcccggtgactcaggagttttgggataatctggaaaaggaaaccgaaggactccgccaagaaatgtcgaaggatctggaggaggtgaaggccaaggtccaaccttacttggacgactttcagaagaaatggcaggaagagatggaactgtatagacaaaaggtcgaaccgctgcgagcggaattgcaggaaggcgcaagacagaaactccacgagcttcaggaaaaactttcaccgcttggagaggagatgagggacagggcacgggctcacgtcgatgcgctgagaacccatctcgcgccgtactccgacgagctccgacagtgcctggccgcgagacttgaagcacttaaagagaatggcggggctcggctggccgagtaccatgccaaggccaccgagcacttgtcgacgctctccgagaaagccaaacccgccttggaggacctgcgccagggactgctgcctgtgttggaatccttcaaggtgagcttcctgtcggcactggaggagtacaccaagaagctgaatacccaa

SEQ ID NO: 6495 - DNA, 801 bp, Artificial Sequence
  Description of Artificial Sequence: Synthetic coding sequence
atgaaggcggcagtgctgaccctggccgtccttttcctgactggatctcaggcgaggcatttctggcagcaggatgaaccgccccaatcaccttgggatagggttaaggatctggcaaccgtgtacgtggacgtgctgaaagattctggacgtgattatgtgtcccaattcgaaggatcagcactgggtaagcagcttaacttgaaactgctcgataactgggacagcgtcacctctaccttttccaagctccgagaacaactcgggcctgtgacgcaagaattttgggataatctcgagaaggaaacggaaggccttcggcaagaaatgtcaaaggaccttgaagaagtgaaggcgaaggtgcagccatacctcgatgactttcaaaagaaatggcaagaagaaatggaactctacagacaaaaagtcgagccactgagagcagaactgcaagaaggtgctagacagaagctgcatgaacttcaggaaaaactttcacctcttggtgaagaaatgagggaccgggcgagagcacatgtggatgcccttcgcactcatctggcaccatacagcgatgaacttcgccagtgtctcgcggcgcggcttgaagcactgaaagaaaatggaggagcacgcctggctgagtaccacgcaaaggccaccgagcatctctcaactctctcggagaaagcaaagccagctttggaggacctccgtcaaggactgctgccagtgctcgagagcttcaaggtgtcatttctttcggcattggaggagtacactaagaaacttaacactcaa

SEQ ID NO: 6496 - DNA, 801 bp, Artificial Sequence
  Description of Artificial Sequence: Synthetic coding sequence
atgaaagccgctgtactgactctagctgtactttttctcaccggcagccaggcccggcacttttggcaacaggatgagccccctcagtctccctgggacagagtaaaggacctcgccaccgtttacgtggacgtattaaaagacagtgggagggactatgtgagccagttcgaaggaagcgctctcggtaaacagttgaacctgaagctgttagacaactgggattccgtgacttccacattcagcaagcttcgtgaacagttgggccccgtgactcaggagttttgggataacctggagaaagagactgaagggctgcgccaagagatgagtaaggacctggaggaggtgaaggctaaagtccagccctatctcgatgactttcagaaaaaatggcaggaggagatggagctgtacagacagaaggtcgagcctctgcgggccgagctacaggagggggccaggcagaaacttcacgaactgcaggaaaagctgtcaccactgggggaggagatgcgggatagagcccgcgctcacgtcgacgctcttcgcacccacctcgccccctacagcgacgagctgagacagtgcctggccgccaggctcgaagctttaaaggagaatggaggagccagacttgccgaatatcatgccaaggccacggagcacctgtcgaccctctcagagaaagctaagcctgccctcgaggatctgaggcaggggttgctccctgtccttgagtccttcaaggtttcctttttaagtgcgctggaagagtacacaaaaaagctgaatacacag

SEQ ID NO: 6497 - DNA, 801 bp, Artificial Sequence
  Description of Artificial Sequence: Synthetic coding sequence
atgaaggccgcggtgcttactctggcggtgttgttcctcactggctcacaggccaggcatttttggcaacaggacgagcctccgcagagcccgtgggaccgggtcaaggatctcgctactgtgtacgtggacgtcttgaaggactcgggacgcgattacgtgtcacagtttgaaggaagcgcgttgggaaagcagctcaatctgaagttgctggacaactgggattcagtgaccagcactttctcaaagctgcgggaacagctgggacctgtcactcaggaattttgggacaatctggagaaggaaaccgaggggctgagacaggaaatgtccaaggaccttgaagaagttaaggccaaggtgcagccttacctggacgatttccaaaagaaatggcaggaagaaatggagctctacagacaaaaagtggagccgctgcgggcggaactgcaggaaggcgcccgccaaaagctgcacgagctccaggagaaactgtctccactgggcgaagaaatgcgagatcgggctcgcgcccacgttgacgctctgcgcacccacctcgctccatactccgacgagctgaggcagtgccttgccgccagactggaagccctgaaggagaacggtggagctcggttggcggaataccatgctaaagccactgaacatttgtcgactctgtcggagaaggctaaaccagctctcgaggaccttcgccagggactgcttccggtgctcgagtcattcaaagtgagcttcctttcagcgctggaagagtacaccaagaagctgaatactcag

SEQ ID NO: 6498 - DNA, 801 bp, Artificial Sequence
  Description of Artificial Sequence: Synthetic coding sequence
atgaaggccgcagtgctgacgctggccgtccttttcctgaccggctctcaggctcggcacttttggcaacaggatgaacccccgcaatcgccttgggatagagtgaaggatctcgcgactgtctatgtggatgtgctgaaggatagcggccgagactacgtgtcccaattcgagggatccgcgcttggtaagcagctgaatcttaaacttcttgacaactgggactcagtgacttcgaccttttccaagctcagagaacagctgggtcctgtcacccaggagttctgggataacctggaaaaggaaacggaaggattgcgccaggaaatgtccaaggacctcgaagaggtgaaagcaaaagtccaaccctacttggatgatttccagaagaaatggcaagaagagatggaactctataggcaaaaggtggaaccactgcgcgcggaactgcaagaaggggccagacaaaaacttcatgaacttcaagaaaagctgtcgccgctgggagaagagatgagagatcgggcccgagcgcacgtcgacgcactccgtactcatttggccccatactcggatgaactgagacaatgtctcgctgcaaggctcgaagcgctgaaggaaaatgggggcgcacgccttgcagaataccacgccaaagcaactgaacacctttccacccttagcgagaaggctaagcctgccctcgaggatctccggcaaggactgctgcctgtccttgaatcgtttaaagtgtcctttctgtcagctctggaggaatacaccaaaaagctcaacactcaa

SEQ ID NO: 6499 - DNA, 801 bp, Artificial Sequence
  Description of Artificial Sequence: Synthetic coding sequence
atgaaggccgcggttctcaccctggctgttctgttcctcacaggttcccaggcccggcatttttggcagcaggatgagcccccccagagcccttgggaccgtgttaaggacctggcgactgtctatgtggacgtgctgaaagacagtggcagggattatgtctcgcaattcgagggctccgccctcggcaaacagcttaacctcaaattgttggacaattgggatagtgtaacttccaccttctctaagttaagggaacaactgggacccgtgacgcaggaattttgggacaatctggaaaaagaaacagaagggctcaggcaggaaatgagcaaagatctcgaggaggtgaaggccaaagtgcagccgtatttggatgacttccaaaaaaagtggcaggaggagatggagctgtaccgtcagaaggtcgagcctctgcgggctgaactgcaggagggcgcccgacaaaaattacatgagctacaggaaaagctgtcacccctgggagaggagatgagggaccgcgctcgggctcacgtggacgcgctgcggacccacctagccccatactctgatgaattaaggcagtgtctggcagctagacttgaagccttgaaagagaacggcggtgctcgcttggccgagtatcacgccaaggctaccgagcaccttagtacgctgtccgagaaagcaaagcccgcactggaagatctccggcaaggcctgttacccgtgctggaatcattcaaggtaagcttcctgagtgccctggaggaatataccaagaaactaaacacccag

SEQ ID NO: 6500 - DNA, 801 bp, Artificial Sequence
  Description of Artificial Sequence: Synthetic coding sequence
atgaaggcggccgtcctcactctggccgtcctcttcttgactggatcacaggctcgccacttttggcagcaagatgagccaccgcagtcgccgtgggatcgggtgaaggacttggcgaccgtgtacgtggatgtcttgaaggactcgggacgggattacgttagccagtttgaaggtagcgccctgggaaaacagcttaacctgaagctgctggacaattgggactccgttacctcaactttcagcaagctgagagaacaactgggaccggtcactcaggagttctgggataacctggaaaaagaaactgagggactgcgccaggagatgtcaaaagacctcgaggaggtgaaggcaaaagtgcaaccatacctggatgacttccagaaaaagtggcaggaagagatggagctctacagacagaaagttgaaccgctccgggcggaactgcaggagggagcccgacaaaagctgcatgaactccaggaaaagctctctccactgggcgaggagatgcgcgacagggcccgggcgcacgtggatgcgttgagaactcatctggccccttacagcgatgagttgcggcagtgccttgccgcccggctggaggcccttaaagaaaatggaggagcaagattggcagaataccatgcaaaagccaccgaacacctgtcaactctgtcggagaaggctaagccagccctggaggacctgcggcagggtctgctgcccgtgctcgaatcgttcaaggtgagcttcctctcggccctggaggagtatactaaaaagctgaacactcaa

SEQ ID NO: 6501 - DNA, 801 bp, Artificial Sequence
  Description of Artificial Sequence: Synthetic coding sequence
atgaaggctgcagtgctcacgctcgccgtgctgttcctgacgggatcccaggcacggcatttttggcagcaggatgaaccaccgcagagcccgtgggacagagtgaaagatctggccactgtgtatgtggacgttctgaaagattcagggagagattacgtgtcccaattcgagggtagcgcccttggcaagcagctcaaccttaagctcttggacaactgggactccgtgacttcgacgttctccaagctccgcgaacagctgggcccagtgacccaggagttctgggacaatctggagaaggagactgaaggactccgccaggagatgtcaaaggacctggaggaggtgaaggctaaagtccaaccgtacctggacgattttcaaaagaagtggcaggaagagatggaactgtaccgccagaaggtggaacctttgcgggcggagctccaggaaggagcccgccagaagctccacgagctgcaagaaaaactttcccccctcggcgaagagatgcgcgaccgggcccgcgctcacgtggacgcgctgcgaacccatctggcgccatactcagacgagctgcggcagtgcctggctgcgcgccttgaggcccttaaagaaaatggtggcgctcgcctggccgaataccacgccaaggccaccgagcatctctccacgctgtctgaaaaagccaaacccgcattggaggacctgcggcaggggctgttgccggtcctggagagcttcaaggtgtccttcctgtccgcactggaagaatataccaagaagctgaacactcag

SEQ ID NO: 6502 - DNA, 801 bp, Artificial Sequence
  Description of Artificial Sequence: Synthetic coding sequence
atgaaagcggcggtactaacgctagcggtattatttttaacgggttcgcaagcgcgacatttttggcaacaagatgaaccgccgcaatcgccgtgggatcgtgtaaaagatttagcgacggtatatgttgatgttctaaaagattcgggtcgagattatgtatcgcaatttgaaggttcggcgttaggtaaacaattaaatttaaaactactagataattgggattcggtaacgtcgacgttttcgaaattacgtgaacaattaggtccggtaacgcaagaattttgggataatttagaaaaagaaacggaaggtttacgacaagaaatgtcgaaagatttagaagaagtaaaagcgaaagtacaaccgtatctagatgattttcaaaaaaaatggcaagaagaaatggaactatatcgacaaaaagtagaaccgctacgtgcggaattacaagaaggtgcgcgacaaaaattacatgaattacaagaaaaactatcgccgttaggtgaagaaatgcgtgatcgtgcgcgtgcgcatgttgatgcgctacgaacgcatctagcgccgtattcggatgaattacgtcaatgtctagcggcgcgactagaagcgctaaaagaaaatggtggtgcgcgactagcggaatatcatgcgaaagcgacggaacatctatcgacgttatcggaaaaagcgaaaccggcgttagaagatttacgacaaggtctattaccggtactagaatcgtttaaagtttcgtttttatcggcgttagaagaatatacgaaaaaactaaatacgcaa

SEQ ID NO: 6503 - DNA, 801 bp, Artificial Sequence
  Description of Artificial Sequence: Synthetic coding sequence
atgaaagcagccgttcttaccctcgccgtgctgttcctcaccggaagccaggcgaggcacttctggcaacaggacgaaccgccacaaagcccttgggacagagtgaaggacctcgctaccgtgtatgtggacgtcttgaaggattcaggccgggattacgtgtcacagtttgagggatccgcgcttgggaagcagctcaacctcaagctgttggataactgggactccgtgacctcaactttttcgaaactgcgggagcagctgggaccggtgacgcaggaattttgggataacctcgagaaggaaaccgagggactgcgccaggaaatgtccaaggacctcgaagaggtcaaggctaaggtgcagccgtaccttgatgatttccagaagaaatggcaggaagaaatggagctgtacagacaaaaggtcgagcctctgagagccgaactccaggaaggggcccggcagaaacttcacgagctccaggaaaaactgtccccgctgggggaagaaatgcgcgaccgcgcgcgggcccacgtggatgcattgaggacccatctggcaccatacagcgacgaactgcgacaatgcttggcagcccggttggaagccctcaaagaaaacggaggagctcggctcgcggaataccacgccaaagcaactgaacacctctcaaccctgtcagaaaaagccaagccagctcttgaggacctgcgccaaggtctgctcccagtgctggagtccttcaaagtgtcgtttttgagcgccctcgaggaatacacgaagaagctgaatactcag

SEQ ID NO: 6504 - DNA, 801 bp, Artificial Sequence
  Description of Artificial Sequence: Synthetic coding sequence
atgaaggctgccgtcttgaccctggcggtgcttttcctgacaggctcccaggctcgtcatttctggcagcaggatgaacccccacaatctccctgggatagggtcaaagatctagcaaccgtgtatgtggacgtgctgaaggattcgggaagagattacgtaagtcagttcgaaggttcggccctaggtaagcagctcaatttgaagctcttggataattgggactccgtaacatcaacgttctcgaaactacgtgagcagctgggtcctgttactcaggagttttgggataatctggaaaaggaaactgaaggactgcgacaggaaatgtctaaggatctggaggaagtgaaggcaaaggtccagccgtaccttgacgacttccaaaagaagtggcaagaagagatggagctttaccgccagaaagtcgaacccctacgagcggagctccaggagggcgctagacaaaaactccatgaactccaggagaagctgtcccccttgggtgaagagatgcgggatcgcgcgagagcccacgtggatgcgctgcgcacacacttggccccatactcggacgaacttcgacagtgccttgctgcccgtcttgaagctctcaaggagaatggcggagccaggttggctgaataccatgccaaggcgacagaacacctcagcactctatctgagaaggccaagcccgcactggaagatctgcgacagggactgctccctgtcctcgagagcttcaaagtatcgtttctcagtgcccttgaagagtacacaaaaaagctcaatactcag

SEQ ID NO: 6505 - DNA, 801 bp, Artificial Sequence
  Description of Artificial Sequence: Synthetic coding sequence
atgaaggccgcagtgctgaccttggcagtactgttcctgaccggttcccaggcacgccacttctggcaacaggacgaaccgccccaatccccttgggatcgagtgaaggatctggcaaccgtgtatgtggatgtccttaaagactcgggacgggattacgtttctcaatttgaagggtccgcgctcggcaagcaacttaatcttaaactgctggataattgggactcggttacttctacgttttccaagctgcgcgaacagttgggaccggtcacccaagaattctgggacaaccttgaaaaagaaactgagggactcagacaggagatgtccaaagatctcgaagaagtcaaggcgaaagtccagccttaccttgatgactttcagaagaagtggcaagaagagatggagctgtaccggcagaaagtggaacctcttagagcagaactgcaagaaggtgcgagacaaaagctccatgaacttcaagagaagctctctcctctcggcgaagagatgagggatagagccagggcacatgtggacgcacttagaactcatctcgccccatactcggacgagctgaggcagtgtctggcagctcgcctggaagctctgaaggaaaacgggggagcacgactggctgaataccatgccaaggcaacggaacacctttcgacccttagcgagaaggccaagccagccctggaggatctccgtcaaggactgttgccggttctcgagagttttaaggtgtcctttctttcggcacttgaggaatacaccaagaagttgaacactcag

SEQ ID NO: 6506 - DNA, 801 bp, Artificial Sequence
  Description of Artificial Sequence: Synthetic coding sequence
atgaaggcagcggtccttacccttgcagtgctgtttctgaccgggtcccaggcccgccatttttggcagcaggatgagcccccgcagtcaccatgggaccgggtgaaggatctggcgactgtctacgtcgatgtgctgaaggatagcgggcgagattacgtctcccaattcgagggaagcgccctcggaaagcaacttaaccttaaactgctcgataattgggatagcgtgacgagcacgttctcgaaacttcgagaacagcttggccctgtgactcaggaattttgggataacctcgaaaaggaaaccgaggggctccggcaggagatgtcaaaggaccttgaagaagtgaaagcaaaggtgcaaccgtacctggacgatttccaaaagaagtggcaggaggaaatggaactttaccgacaaaaagtggaacctcttagggcagaactgcaggagggggcacgccaaaaacttcatgagctgcaggaaaaactttcccccctgggtgaagaaatgcgtgatagggcgagagcgcatgtcgacgcccttaggacccacctggccccttatagtgacgaacttcgtcaatgcctcgcagcaagactcgaggcacttaaggagaacggaggagcaagactggcagaataccatgcgaaggcaaccgaacacctctctaccctttcagaaaaagcgaagccagcacttgaggatcttaggcagggattgcttccagtgctcgaatcctttaaggtttcatttctttcggccttggaagagtacaccaagaaacttaatactcag

SEQ ID NO: 6507 - DNA, 801 bp, Artificial Sequence
  Description of Artificial Sequence: Synthetic coding sequence
atgaaggcggccgtactgactctcgccgttctcttcctgaccgggtcacaggcacgccatttttggcagcaggacgaaccacctcagagcccctgggatagggtcaaggatctggcaactgtctatgtggatgtgttgaaggattccggccgggattacgtgagccagttcgaggggagcgcattaggaaaacagttgaatctcaaactgctggacaactgggactctgtcactagtactttttccaaactaagggagcagctaggccccgtcacccaggaattttgggacaacttagagaaggagaccgagggccttagacaggaaatgagtaaagacctggaggaggtgaaagcaaaggtccagccctacctcgatgatttccagaaaaagtggcaagaggagatggaattgtaccggcagaaggtggaacctctgagggcagaactgcaagaaggagctaggcaaaagctgcatgagctgcaggagaaattgagccctctgggcgaagagatgcgagaccgcgcacgtgcacacgtagatgctcttagaactcaccttgcaccttactctgatgagctgagacagtgtctggctgccagactagaggcactcaaagaaaatggaggcgccagattggcagaatatcacgctaaagccacagagcatttgtctacacttagcgagaaggcaaagcctgcactcgaggacctccggcaggggctgctgcccgtacttgagtcattcaaggttagttttcttagtgctctggaagagtatactaagaagctgaatacccag

SEQ ID NO: 6508 - DNA, 801 bp, Artificial Sequence
  Description of Artificial Sequence: Synthetic coding sequence
atgaaggctgcagttcttactctcgctgtgctcttccttactggatctcaggctagacacttctggcagcaggacgaaccacctcaatccccctgggatcgcgtcaaggatctcgcaaccgtctacgtcgacgtgctgaaggactctggtcgtgattacgtttcccagttcgagggatcagccctgggcaaacagctcaacctgaaactcctcgacaactgggactctgttaccagcaccttcagcaaactccgtgaacagctgggaccagttacacaggaattctgggataatctggaaaaggaaaccgaaggcctccgtcaggagatgtctaaggatctggaggaggtaaaggccaaggttcagccctacttggacgacttccaaaaaaagtggcaggaagagatggagttgtaccgccaaaaagtggaaccccttcgtgccgaacttcaggagggagccagacagaagctgcacgaactgcaggagaagctctctcccctgggtgaggagatgcgtgatagagcccgcgctcatgtggacgccctgaggacccatctggcaccctactcagacgagctcagacagtgtcttgctgcccgtctggaagccctcaaggaaaacggcggagcaaggctggccgagtaccatgctaaggccactgagcaccttagtaccctgtccgagaaggcaaaaccagctctcgaggacttgaggcagggtctgctcccagtcctggaatcttttaaggtgtccttcctcagcgcattggaggagtatacaaagaagctgaatacccag

SEQ ID NO: 6509 - DNA, 801 bp, Artificial Sequence
  Description of Artificial Sequence: Synthetic coding sequence
atgaaagctgccgtgctgaccctggctgtactgttccttactggcagtcaggcgcgccatttctggcaacaagatgaaccaccacagtctccctgggatagagtgaaagacctcgccactgtatacgtggatgtattgaaggactcaggccgcgattacgtgtctcagttcgaaggcagcgccctgggaaaacagctcaacttgaagctgttggacaattgggatagtgtgacgagcacattctccaaactcagggagcagcttggccccgtgacccaggagttctgggataaccttgagaaggaaaccgagggcctgcggcaggaaatgagcaaggatcttgaggaagtcaaggccaaggtccagccatatctagacgattttcagaagaaatggcaagaagaaatggagctttatcgtcaaaaggtggagccattgagagcagagctacaggagggcgccagacaaaaactacacgagcttcaggaaaagctgagtccattgggggaagagatgcgggacagggctcgcgcacacgtagatgcacttcgaacacacctggccccttattcagatgagctgagacagtgtcttgctgctcggctggaagcactgaaagagaacggcggtgcccggctggccgagtatcacgcaaaagccaccgagcacctgagcaccctcagtgagaaggccaagcccgccctagaggatctgagacagggtcttctacccgtgctagagtcctttaaagtaagcttcctgtccgccctggaggaatatactaaaaaactgaatacccag

SEQ ID NO: 6510 - DNA, 801 bp, Artificial Sequence
  Description of Artificial Sequence: Synthetic coding sequence
atgaaggcagctgttctgactttggccgtgctttttctgactgggtcccaagcacgccacttctggcaacaagatgagccacctcaatcaccctgggacagagtgaaagatctagcaacagtgtatgtcgacgttctgaaggattctggaagagactacgtctcccagttcgagggatcggcactgggcaaacagctaaatctcaaattgctcgacaattgggatagtgttacctccactttcagtaagcttcgggaacaacttggcccagtgacacaggaattctgggataatctcgagaaagagactgagggcctcaggcaggagatgagtaaagatcttgaggaggttaaagcaaaagtgcagccatacctggacgatttccagaaaaaatggcaggaggagatggagctgtataggcagaaagtggagccacttagggccgaactccaagaaggggccagacagaaactgcacgaactccaagaaaagctctctccactgggggaggagatgcgagaccgggcaagggcccacgtcgacgcactgaggactcacttagccccttactccgacgagcttagacaatgcctagcggcgcgactggaagccctgaaggaaaacggcggggcccggctggcagagtatcatgccaaggccacggagcacctctctaccctatcagagaaagccaaacccgcgctggaggatctcagacaggggctcctgcctgtccttgagtcctttaaagtatccttcctcagcgcattggaagaatatacaaagaagttgaacacccaa

SEQ ID NO: 6511 - DNA, 801 bp, Artificial Sequence
  Description of Artificial Sequence: Synthetic coding sequence
atgaaagcagctgttctgacactagcagtgctgtttctcacaggatctcaggctcgccacttctggcagcaggatgagcctccccagtctccttgggatcgggtaaaagatctggcaactgtgtatgtggatgtcctgaaggattctggaagagattatgtctctcagttcgaagggtccgcccttggaaaacagctaaaccttaaactcctagacaactgggacagtgtgacatctactttttcaaaactgcgggaacagttgggacctgtaactcaggaattctgggacaacctggaaaaagaaacagaagggttacggcaggaaatgagtaaagatctcgaagaagtgaaggctaaagtacagccctatctcgatgatttccagaagaaatggcaggaagaaatggaactgtatagacagaaagtggaacctctgagagcagaacttcaggagggagcccgtcagaaattacacgaacttcaggagaaactttctcccctcggggaagaaatgagggatcgggccagggctcacgtggatgcgctacgcactcatctcgccccatactcagatgaacttagacagtgtttggcagcaaggctagaagctctgaaagaaaacggaggggcacggctcgccgaatatcatgctaaagcaactgaacatctgagtacactgtcagaaaaagctaaacccgcgctcgaagatcttagacaggggctattacccgttcttgaatccttcaaagtgagtttccttagtgctcttgaagaatacacaaaaaaactcaacacacaa

SEQ ID NO: 6512 - DNA, 801 bp, Artificial Sequence
  Description of Artificial Sequence: Synthetic coding sequence
atgaaagccgcggtactgacccttgccgtcctgttccttactgggagccaagctcggcatttctggcagcaggacgagcctcctcagtcgccttgggatagagtgaaagacctcgcaaccgtctacgtcgatgtcctgaaagatagcggtcgcgattacgtgtctcaatttgaaggatcggcgttgggaaaacagctgaacctcaagctgctcgataactgggactcggtgacttcaacttttagcaaactgagagagcaactgggaccagtgacgcaggaattctgggacaacctggaaaaggaaactgagggactgagacaggagatgtccaaggatctcgaggaggttaaagcgaaggtgcagccgtacttggacgacttccaaaagaaatggcaggaagagatggaactgtatagacaaaaagtggaaccactgcgggccgaacttcaggaaggtgcacgacaaaaacttcatgaactgcaagagaagctctctccactgggcgaagaaatgcgcgatagggcacgcgcccatgtggatgcccttagaacgcaccttgcaccatactcagatgaacttaggcaatgtttggcggcccggcttgaagcactgaaggagaacggaggagcgcggcttgctgaataccacgctaaggcaactgaacacctgagcactctgtccgaaaaggccaaaccggcgctcgaggatctgcgccaaggtctgttgcctgtcttggagtcgtttaaggtgagctttctgagcgcactcgaggaatacaccaagaagctgaatacccag

SEQ ID NO: 6513 - DNA, 801 bp, Artificial Sequence
  Description of Artificial Sequence: Synthetic coding sequence
atgaaggccgcagtgctgaccctggcggttctctttctcactggatcgcaggcacggcacttttggcagcaggatgaaccacctcaatcgccatgggacagagtcaaggacctcgcaaccgtgtacgtggacgtcctgaaggactcaggccgtgactacgtgagccagttcgaaggatcggcgcttggtaagcaacttaacttgaaactgctggacaattgggactcggtgacctccaccttctcgaagctccgcgaacagctgggtccggtgactcaggagttctgggacaatcttgagaaagagactgaagggcttcggcaagagatgtctaaggacctggaagaggtgaaagccaaggtgcaaccgtacttggatgactttcagaagaaatggcaagaggagatggagctctaccggcagaaagtggaaccactcagggcagagttgcaggaaggggccagacaaaagctccatgagctgcaggaaaaactctcaccgctcggagaagaaatgcgcgatcgagccagagcccatgttgacgcgctgcgcactcatctggccccttatagcgatgaattgagacaatgtctggcggctcggctcgaggcactcaaggaaaacggcggtgcgaggttggctgaataccacgccaaggcaactgaacacctgagcaccctgagcgagaaggccaagccagccctggaagatctgaggcagggactgctgccagtgctggaatcattcaaggtgtccttcctctcggccctggaggaatacaccaaaaagctcaatactcag

SEQ ID NO: 6514 - DNA, 801 bp, Artificial Sequence
  Description of Artificial Sequence: Synthetic coding sequence
atgaaagccgcggtccttactctggcggtcctgttcctgaccggctcccaggcaagacacttctggcaacaggatgagccacctcaatctccttgggatcgtgtcaaggacttggcgactgtatatgtcgatgttctgaaagattcgggtagggactatgtttcccagttcgagggcagtgccctcggtaagcagctcaacctgaagcttctcgataactgggattccgtgacctcgaccttctctaagctccgggagcaactcggccctgttactcaggagttctgggacaacctggagaaagagaccgaaggcctcaggcaggaaatgtccaaggatttggaggaggtcaaggccaaggtgcagccttacctggacgacttccagaagaagtggcaagaggagatggaactgtaccgccagaaggtcgagccgctacgcgctgagctgcaggagggcgcacggcagaagctccacgagcttcaggaaaagctctctccacttggagaggagatgcgcgatcgagctcgcgcccatgtcgatgcactgcgcacccacctggcaccttacagtgacgagcttcgtcagtgtctcgccgctcgcctggaggctctgaaggagaacggtggcgcccgacttgccgagtaccacgccaaggctaccgagcacttgagcaccctctcggagaaggccaaaccggctttggaggacctccggcagggactcttgcccgtcctcgagtccttcaaggttagtttcctgagcgcgctagaggagtacaccaaaaagttgaacactcag

SEQ ID NO: 6515 - DNA, 801 bp, Artificial Sequence
  Description of Artificial Sequence: Synthetic coding sequence
atgaaggccgcagtgctcactctggctgtcctgttcctgaccggaagccaagctcgacacttctggcagcaagatgaaccgccgcagtccccgtgggacagggtgaaggatctggcgactgtgtatgtggacgtgttgaaggactccggcagagattacgtcagccaattcgagggatcggccttgggaaagcagctcaacctgaaattgctggacaactgggattcggtgacttccactttctcaaagctgcgggaacaacttggacctgtgacccaggaattctgggataatctggaaaaggaaactgaggggctgcgccaggaaatgtccaaggatcttgaagaggtcaaggctaaggtgcagccatacctggacgattttcaaaagaagtggcaggaagagatggagctgtatcgccagaaggttgaaccgctcagagcagagctgcaagaaggagcgcgccagaagctccatgagctgcaggaaaaactgtccccgctcggagaagaaatgcgggaccgggctcgggcccacgtggacgcactccggacccatcttgccccgtattcagatgaacttagacagtgcttggcagctcgcctggaagccctcaaggagaacggaggagcgcgcttggccgagtaccacgcaaaggctactgagcacctgagcacgctgtcggaaaaggccaaaccagccctcgaagatctgcgccaagggctgcttccggtgctcgagtccttcaaggtgtcgttcctgagcgctctcgaagagtacactaagaagctcaacactcag

SEQ ID NO: 6516 - DNA, 801 bp, Artificial Sequence
  Description of Artificial Sequence: Synthetic coding sequence
atgaaagcagctgtgcttaccttggcagtcctgtttctgaccggatcacaggcaagacatttttggcaacaggatgaaccgcctcagtcgccttgggatcgagtgaaagacctggcgactgtgtacgtggatgtgcttaaagatagcggtagagattacgtctcccaattcgaaggatccgcactcggaaagcagctcaacctgaagctgctggataactgggactcggtgacttccactttttcgaaactcagagaacaacttggtcccgtcacccaagaattctgggataacctggaaaaggaaactgagggactgcgacaagagatgtccaaagatctggaagaggtgaaagccaaggtgcagccataccttgacgactttcagaagaagtggcaagaagagatggaactgtacagacagaaggtcgagccattgagagcagaacttcaggagggtgcgaggcagaagttgcacgagctccaagaaaagctgtcgcctcttggcgaagaaatgagagatcgagcgagagcacatgtcgacgctcttaggacccaccttgccccgtactccgacgaactgagacagtgcctcgcagctcgcctggaagcactgaaggaaaacggaggggcccgcttggcagaataccatgcaaaggcaaccgagcatctttccacgctgtcagaaaaggccaagcccgccctggaggatctcagacaaggactgctgcctgtactcgagtcctttaaagtgtcgttcctgagcgcactggaggagtacactaaaaagctcaacacgcag

SEQ ID NO: 6517 - DNA, 801 bp, Artificial Sequence
  Description of Artificial Sequence: Synthetic coding sequence
atgaaagcggcggtgttgacattggctgtgctcttcctgaccggaagccaggccagacatttttggcaacaggatgaaccaccacaatctccatgggatcgtgtgaaggacctggccaccgtttatgttgatgtgctcaaggatagcggaagagactacgtctcgcaatttgaagggtctgctcttggcaagcagttgaatctgaagttattggataactgggattcagtgacctctaccttttccaagttacgggagcagctgggccccgtcacccaggagttttgggataacctcgagaaagagaccgagggcttgagacaggagatgagcaaagatttggaggaagtgaaggctaaagtgcagccgtatctcgacgactttcagaagaaatggcaggaggagatggagctctaccgtcagaaggtggagccgttaagagcagagctccaggagggcgctcggcagaagctacacgagctgcaggagaaactctcaccactcggagaggagatgcgtgatcgggcccgggctcacgttgacgccctaaggacccacttggccccctacagcgacgagctacgccaatgcctcgcagcaaggctcgaggcgctgaaagagaacggcggggctcggttggccgagtatcatgcgaaggcaacggagcatctcagcactctgtctgaaaaggccaagcccgccctggaagacctgagacaaggactgctgcccgtgctagagtcatttaaggtttcttttctgtccgccctggaggaatacaccaaaaaactcaacacccag

SEQ ID NO: 6518 - DNA, 801 bp, Artificial Sequence
  Description of Artificial Sequence: Synthetic coding sequence
atgaaggctgccgtgttgactttggcagtgctttttcttacggggagccaagctcgtcacttctggcaacaagacgaacccccacaaagcccttgggatcgcgtcaaggacctggcgactgtttacgtcgatgtgctcaaagacagcggtcgggattatgtctctcaatttgaaggatcggcactgggtaagcagcttaacctgaagctcctggataattgggattccgttacctcaaccttctctaagctcagagagcagttgggacctgtaacccaagaattttgggacaatctggagaaggaaactgaagggcttcgacaggagatgagcaaggatctggaagaggtgaaagcgaaagtgcagccatacctcgacgatttccagaagaagtggcaggaggaaatggaactgtataggcagaaggtcgagcccctccgtgccgaactgcaagaaggagccaggcaaaagctgcatgagctccaggagaaactctcgcctcttggcgaagagatgcgagatagagcccgtgcacatgtggatgcccttcgtacccacctcgcaccctactcagatgagttgcgccaatgtctggcagctcggctcgaagcactgaaagaaaacggaggggccagactggcagagtaccacgcaaaggcaactgaacatctgagcacgcttagcgagaaagccaagcccgcgcttgaggacctcagacagggcctgctgccagtgcttgaatcgttcaaggtgtcgtttcttagtgcactcgaagaatacactaagaagctgaacacccag

SEQ ID NO: 6519 - DNA, 801 bp, Artificial Sequence
  Description of Artificial Sequence: Synthetic coding sequence
atgaaagccgcggtgctcacgttggccgtactgtttcttactgggtctcaggcacgacacttttggcagcaggacgaaccaccccagtctccttgggaccgtgtgaaggacttggccacagtttatgtggacgttctgaaggactctgggcgagattatgtttcccaattcgaaggatcggcattaggcaagcaactcaacctgaagctacttgacaactgggattcagttacatccacgtttagcaagttgcgtgaacagttgggccctgtgacccaagagttctgggacaatctcgaaaaggagacggagggtctgaggcaggaaatgagcaaggaccttgaagaggtaaaagctaaggttcaaccatatctcgacgactttcagaaaaagtggcaggaagaaatggagttgtatcgacagaaggtagagccgcttcgagctgaactgcaggagggcgcacgccagaagttgcatgagcttcaagagaaactgtctcccttgggtgaggagatgagagacagagcccgtgctcacgtcgatgcgctaagaacccacctggccccatatagcgacgagctccggcagtgtttagcagcccgattggaggcactcaaagaaaacgggggagcacgcttggctgagtatcacgctaaagctactgagcacctctccactctatctgaaaaagctaagccggctcttgaggatctccgtcagggcctactaccagttttggagtcgttcaaggtgtcgtttctatccgccctcgaagaatatacaaaaaagctcaatacccag

SEQ ID NO: 6520 - DNA, 801 bp, Artificial Sequence
  Description of Artificial Sequence: Synthetic coding sequence
atgaaagcagccgttttgacgttggcggttctctttttaaccggaagtcaagctcggcatttttggcaacaggacgagcccccacagagcccatgggatcgcgtcaaagacctcgccacagtctacgttgatgtgctgaaagactccggcagagactacgttagtcaattcgaggggtcagctttgggaaaacagctcaatttaaagctgctggacaattgggactcagtcacatctactttcagcaagctgcgagagcagttgggccccgtgacacaggaattctgggacaacttggagaaagaaacagaggggctgaggcaggagatgtctaaagacctggaggaagtgaaagcaaaggtccagccctatctcgatgatttccagaagaagtggcaagaggagatggaactataccgccagaaagtggaacctctgcgcgccgagctccaagagggagcgcgccagaaattgcatgagctgcaggaaaaactctctcccctgggagaggagatgagagatcgcgcccgagcacacgttgatgccttacggacccacctcgcaccatattctgatgagcttcggcagtgcttggccgcacggctggaagcccttaaggagaatggaggcgcccgtctcgcggagtatcacgctaaagcgaccgaacatctttccactctgagtgagaaggccaaacccgccctggaggacctgcgccagggtttacttccggttttagagtcttttaaggtcagcttcctgagcgcgctcgaggagtacaccaagaaactgaatactcag

SEQ ID NO: 6521 - DNA, 801 bp, Artificial Sequence
  Description of Artificial Sequence: Synthetic coding sequence
atgaaagccgccgtgctgacccttgcagtcctgtttcttactggatcgcaggcacgccacttctggcagcaggatgaaccgcctcagtccccttgggaccgggtgaaggatctggcaactgtgtatgtcgatgtgctcaaggattccggaagggattacgtgagccagtttgagggttcggcacttggcaagcaactcaatctgaagctgctcgataattgggactcggtcacctcgaccttttcaaagctgcgtgagcagctgggacctgtgactcaagaattttgggacaacttggaaaaagaaactgagggactgcgccaagagatgtcgaaggatcttgaagaagtgaaagcaaaggtgcagccatacctggacgatttccaaaagaagtggcaagaagaaatggagctgtaccgacagaaggtggagcccctgcgtgccgagttgcaggaaggggcgcggcaaaaacttcatgagcttcaagagaagctgtcacctttgggagaagaaatgagagatagagcacgtgcccatgtggatgcgcttaggacccacctggcgccttactccgatgagctccgccaatgcctggcagcgcgcctcgaagcacttaaagaaaacggtggtgcacgcctggcagaataccatgcaaaggcaaccgaacacctttcaactcttagcgaaaaggcaaaacctgccctcgaagatctcaggcagggactgctgccagtcctggaatcttttaaggtgtcgtttcttagcgcgctcgaggaatacaccaagaagctgaacacccaa

SEQ ID NO: 6522 - DNA, 801 bp, Artificial Sequence
  Description of Artificial Sequence: Synthetic coding sequence
atgaaggcagcagtgctgactctggccgtgctgttccttaccggaagccaagcaagacatttttggcaacaagatgaacccccacaatccccttgggatagggtgaaagaccttgcaaccgtgtacgtggatgtgctgaaggattcaggaagagattacgtgagccagttcgagggttcggccttgggaaagcagcttaacctgaagctcctggataactgggattcggtgacctcgactttttcaaagctgcgtgaacagttgggaccagtgacccaagaattttgggataatctggaaaaggaaactgagggactcagacaagagatgtcaaaagatcttgaagaagtcaaggctaaggtgcagccctacctcgatgatttccagaagaaatggcaagaagaaatggagctgtaccggcagaaagtcgaaccacttcgggccgagcttcaggaaggagccagacagaagctccatgaattgcaagaaaagctgagccctcttggcgaagagatgagggaccgggcgcgagcccatgtggatgctctccgcacgcacctggctccatactccgatgaactgagacagtgtctggctgcacggctggaagcactcaaagagaatggaggggcccgccttgcagaataccacgctaaggcaacggaacacctttccactctgagcgagaaagcaaagccagcactggaggatctcagacagggcttgcttcctgtgcttgaatcattcaaggtgtctttcttgtcggcattggaagaatacaccaagaagctgaacacccag

SEQ ID NO: 6523 - DNA, 801 bp, Artificial Sequence
  Description of Artificial Sequence: Synthetic coding sequence
atgaaggcagctgtgctcactcttgcagtcctgtttcttacggggtcacaggctcggcatttttggcagcaagatgaacctccacaatcgccatgggacagagtgaaggatctggcgaccgtgtatgtggacgtcctgaaggattccggccgcgattacgtgtcccagttcgaaggatcagcacttggaaaacaacttaacctgaagctgctggataattgggattcagtgacgagcaccttcagcaagctgagggaacaactggggccggtcacccaagaattttgggataacctcgaaaaggaaaccgagggactgcgtcaagaaatgagcaaggatctcgaggaagtgaaagcaaaggtccagccttacctcgacgacttccagaagaagtggcaagaagagatggaactctacaggcagaaagttgagcccctcagagcagaactccaagagggtgcgagacaaaagctgcatgaacttcaagaaaaactttcgccattgggagaggagatgagagatagagctagggcccacgtcgacgcactccgtacccatcttgcaccttacagtgacgaactgaggcagtgtttggcggcacgccttgaagcattgaaagaaaatggtggagcaaggctggctgaataccatgccaaagccaccgagcacttgtccactctttccgagaaggcaaaacctgccttggaagatctgcggcaaggcttgctccccgtactcgaatcgtttaaggtatcgtttctttcggccctggaggagtacaccaagaagctgaacactcag

SEQ ID NO: 6524 - DNA, 801 bp, Artificial Sequence
  Description of Artificial Sequence: Synthetic coding sequence
atgaaagccgccgtgctgaccctcgccgttcttttcctgacagggagtcaggcccgacacttctggcagcaggatgagcctccacaatccccctgggatcgggtaaaggatctcgcgacagtgtatgtggatgtgttgaaagattcaggaagggactatgtctctcagtttgaagggtcagctttgggtaagcaactgaatctgaagctgctggataactgggacagcgttacctctacgttctctaaacttagggaacaactgggccccgttactcaggaattctgggataatcttgaaaaggagaccgagggtctgcgacaagaaatgagtaaggacctcgaggaggttaaggctaaggtgcagccatacctcgacgatttccagaaaaagtggcaggaagaaatggagctgtaccgacaaaaggtggagccactgcgcgccgagctccaagagggggcgcggcaaaagcttcacgagctgcaagagaagctgtcacctctcggcgaggagatgagggacagggccagggcccacgtggatgcactcagaacgcacctcgctccctacagcgatgaactgcggcaatgcctggccgccaggctggaggccctgaaggaaaacggtggggccaggctcgccgaatatcacgctaaggcaactgaacacttgagtactctgagcgaaaaggccaaaccggctctggaggatctgagacagggacttcttccagttttggagtcctttaaagtgtctttcctttccgctctcgaggagtacactaaaaagctgaacacccag

SEQ ID NO: 6525 - DNA, 801 bp, Artificial Sequence
  Description of Artificial Sequence: Synthetic coding sequence
atgaaggcagccgtgctcactctcgctgtgcttttcctgacagggtcacaggcaagacatttctggcaacaagacgagccaccacagtccccttgggacagagtaaaggacttagccaccgtctacgtggatgtcctcaaagatagcgggcgcgattacgtctcgcagttcgaagggagcgccctaggaaaacagctgaacctgaagctgctggataactgggatagcgttaccagcactttctcaaagctgcgtgaacagttgggcccagtgacacaggaattttgggacaacctcgagaaggagacagaaggcttgaggcaagagatgtcgaaagacttagaggaggtcaaggccaaggtgcagccatacctcgatgatttccagaagaaatggcaggaagaaatggaattatatcgccaaaaggtggagcctttgcgggccgaacttcaggagggtgccagacagaaactccatgagctccaagagaagttgagcccactgggcgaagaaatgagggatcgagcccgagcacatgtcgacgccctaaggacacatctggcgccgtactctgacgagcttaggcaatgcttggcagctagactggaggccctcaaagagaatggaggggccagacttgccgaataccacgctaaggctactgagcatctatcaacactgtcagagaaggccaaacctgcccttgaggatctgcggcaagggctcttgcccgtcctggaatccttcaaggtgtcgttcctatctgctctcgaggaatatacaaagaaactgaacactcag

SEQ ID NO: 6526 - DNA, 801 bp, Artificial Sequence
  Description of Artificial Sequence: Synthetic coding sequence
atgaaagcagccgtgctgacactggcagtgctcttcctgacaggctcccaggcgcggcacttctggcagcaggatgagcccccacagagcccctgggaccgagtaaaagatctggcaactgtttatgtagacgtgctcaaggactctgggagggattatgtgagtcagtttgaaggtagtgcccttgggaaacagttaaacctcaagctcctggacaattgggattctgttactagcactttctccaaactgcgtgagcaactgggacctgttacgcaagagttctgggataatctggagaaggaaaccgaaggcttaagacaggagatgtcaaaggatctggaggaggtcaaagccaaggtccagccatatcttgatgatttccagaagaagtggcaagaagagatggaactgtaccggcaaaaggtggaacccctgagggcagaactccaagaaggggctaggcagaaattgcatgagttacaggagaaactcagcccactcggtgaagagatgagggatcgagctagagcccacgtggacgctttgcgcacacacctggctccgtactccgacgaattgcgacagtgcctcgccgccagactggaagccctgaaagaaaatggaggtgctagactggccgaataccacgctaaggcgaccgagcatttatcaactctcagtgaaaaggcaaagccagccttggaggacctacggcaaggccttttgccagtgcttgagagcttcaaggtcagttttctctctgcattggaggagtacactaagaagcttaatactcaa

SEQ ID NO: 6527 - DNA, 801 bp, Artificial Sequence
  Description of Artificial Sequence: Synthetic coding sequence
atgaaggccgcagttttaacattagcggtgctgttcttgacagggtctcaggcaagacatttttggcagcaggacgaaccaccccagagcccttgggatagggtaaaggatctggcaaccgtgtatgttgacgttctgaaggacagtggccgggactacgtatcacagtttgaaggatctgctctcgggaaacagctgaatctcaagctcttggacaactgggacagcgttacaagcacttttagcaagttgcgggagcaacttggacccgttacacaggaattttgggataacttagagaaggaaactgaaggccttcgtcaggagatgagtaaggatctggaagaagtaaaagccaaagttcagccttacctggacgatttccagaagaagtggcaggaggaaatggagttgtataggcagaaggtggagcccctccgggctgagctgcaggagggggctagacaaaagctccacgagctccaggagaagctgtctcccctcggtgaggaaatgagggatagagctcgggcccatgtggacgctttaaggacccacctggctccttatagtgacgaactccgccagtgtctggcagcgcggctggaggcgttgaaagagaatggcggcgctcggttagctgaatatcatgcgaaagccaccgaacacctgtctacactctctgagaaggccaaaccagcactggaggacctaagacagggcctacttcctgtactagaaagtttcaaagtgtcgttcctctccgctctggaagagtataccaagaaactaaatacgcag

SEQ ID NO: 6528 - DNA, 801 bp, Artificial Sequence
  Description of Artificial Sequence: Synthetic coding sequence
atgaaggcagcagtcctgaccctggccgtgctgttcctgacggggagccaggcgcggcatttttggcagcaagacgagccgccgcagagcccctgggaccgcgttaaagatctggccacggtgtacgtcgatgtgttgaaggacagcggccgtgactacgtctctcaatttgaaggtagcgctttgggaaagcaactgaacctaaagctcctggataattgggattctgtgacctccaccttcagtaaactgcgggagcaactgggccccgtaacacaggagttttgggacaacctggagaaggaaaccgaaggtctgcgtcaggagatgtcaaaggatctggaggaggttaaggcaaaagtgcaaccttacctcgacgattttcagaaaaagtggcaggaggaaatggagttataccgccagaaggtggaaccgctgagggccgagttacaggaaggcgcgcgccagaagctgcacgagctgcaggagaagttgtctcctctgggagaagagatgcgcgatcgcgcgcgcgcccatgtggatgcacttcgtacccacttggccccgtactccgacgagctgcgccaatgcctggctgcacggctggaggccctcaaggagaatggtggggctagactcgcagagtaccacgctaaagcgaccgagcatctttccaccctgtccgagaaggctaagcctgcgcttgaagatctgcgacagggtttgctgccagtcctggagagctttaaagtttcattcttgagcgctcttgaggagtataccaaaaaattgaacactcag

SEQ ID NO: 6529 - DNA, 801 bp, Artificial Sequence
  Description of Artificial Sequence: Synthetic coding sequence
atgaaagctgccgtcctcactctcgcggtgctgttcctcactgggtcacaggcgaggcacttctggcagcaggatgaacctccgcagtccccatgggacagagtgaaagatctggctaccgtctacgtggatgtcctgaaggattccggtagagactacgtctcacagtttgaaggatccgcattgggaaaacagctcaacctgaagctgctcgataactgggatagcgtaacgtccacgttcagcaagctgcgggaacagttggggccggtaacacaagagttctgggacaacctggagaaagagacagagggcctccgccaggaaatgtccaaggacttggaagaggtgaaggccaaagtacagccttacttggacgacttccagaaaaaatggcaggaggaaatggagttgtaccggcagaaggtcgagcccttgcgagcagaactgcaagaaggggctcggcagaaactgcacgaactccaggaaaaactttcacccctcggtgaggagatgcgcgacagggcaagggctcacgtggacgccttgcggacacatctcgctccatattcagatgaactgagacagtgtcttgccgctaggttggaagcgctgaaggaaaacggtggggcgagattggccgagtatcacgctaaggctaccgaacatctcagtaccctgtccgaaaaggccaagcctgctttggaagatctccgccagggcctgcttcccgtgcttgaaagcttcaaagtatcttttctcagtgccctggaggaatatacaaaaaagttgaacacccag

SEQ ID NO: 6530 - DNA, 801 bp, Artificial Sequence
  Description of Artificial Sequence: Synthetic coding sequence
atgaaagccgcagttctcactcttgctgtgctgttcctgaccggatcgcaggcgcggcacttctggcagcaagacgaaccgccgcagtcgccgtgggacagggtgaaggaccttgcgacggtgtacgtggacgtgctgaaggactcgggacgcgattacgtgtcacaatttgaggggagcgctcttggcaagcaactgaacctgaagttgctcgacaactgggactcggtaacttcaaccttctccaagctgagagaacagctcggcccggtcacccaggaattctgggacaatctggaaaaggaaaccgaaggcctcaggcaggaaatgagcaaagatctggaagaagtcaaggccaaggtgcaaccctacttggacgacttccaaaagaagtggcaggaagaaatggagctgtaccgccagaaggtcgaacctctcagagccgagctccaggagggagcgcgccagaagctgcacgaactgcaggaaaaactctcccccctcggagaggaaatgagagacagagcaagggcccatgtggacgccctccgcacccatctggccccgtactcggatgaactgcggcaatgcctcgcagccaggctcgaagccctgaaggaaaacggcggagccaggctggccgagtaccacgcgaaggccactgaacacctgtccactctcagcgaaaaggcgaagccggccctggaggatctgagacagggactcttgcctgtcctggagtcgttcaaagtcagcttcctttcagccctggaagagtatactaagaaattgaacacccaa

SEQ ID NO: 6531 - DNA, 801 bp, Artificial Sequence
  Description of Artificial Sequence: Synthetic coding sequence
atgaaagcagcagtattgacgctcgcagtactatttttgaccggctcacaagcacgccatttctggcaacaggatgagccaccacagagcccgtgggaccgtgtcaaagatttagctacagtctacgtggatgtcctgaaagattcaggtcgtgattatgtgtctcagtttgagggcagcgcgttgggtaaacagctgaacttgaagctgcttgacaactgggattctgtaacaagcacttttagtaaacttagagaacaactgggacctgtgacgcaggaattctgggacaaccttgaaaaagaaacggaaggacttcgtcaggaaatgtctaaagatcttgaggaagtaaaagctaaagtgcagccttacctcgatgactttcaaaaaaaatggcaagaagagatggaattgtacagacaaaaggtggaaccgttaagagcggaattgcaggagggagcaagacaaaaactccatgaattacaagaaaaactctcaccgcttggggaggaaatgcgcgacagagcgcgcgcacatgttgacgcccttagaacacatcttgccccgtatagcgacgaattgaggcaatgcctggcagcacggcttgaggctttaaaagaaaacggaggggcgcgcttagccgaatatcatgctaaagcaactgaacatcttagtacattgtcagaaaaagccaaaccggcgcttgaagatttgcggcagggactgctgcctgtacttgaaagctttaaggtctccttcctaagcgctttagaagagtatacgaagaaattaaatacacag

SEQ ID NO: 6532 - DNA, 801 bp, Artificial Sequence
  Description of Artificial Sequence: Synthetic coding sequence
atgaaagccgctgtgctgaccctggctgtgttattcctcaccgggtcccaggctaggcacttttggcagcaggatgaacccccacagagcccctgggatcgagtaaaggacctcgcgactgtctatgtggacgtgttgaaggacagcggacgcgactacgtgtcccagttcgaaggaagcgcccttggtaagcagctaaacttgaaactgctagacaattgggacagcgtgacaagcacgtttagtaagctcagggagcagctgggaccagtgacccaggagttttgggataatttggagaaagaaacagaggggctgagacaagaaatgtccaaagaccttgaagaggttaaggctaaggtccaaccctaccttgacgacttccagaagaagtggcaagaagagatggaattgtatcgacagaaagtggagcctttgcgcgccgaactccaggaaggcgcaagacaaaagctccacgagcttcaggagaagttatctcccctgggcgaggagatgcgcgaccgtgctagagctcacgtggatgcccttcgcactcacttggctccttatagtgacgaattgcgccagtgcctggccgctcggctggaggcgctgaaggaaaacggtggagcacggcttgctgagtatcacgctaaggcaactgaacacctcagcacactctccgaaaaggctaagccagctttagaggaccttcgacagggcttgctgcctgtgctggaatcgttcaaggtgtccttcttaagtgccctagaggagtacactaagaagctgaacacacaa

SEQ ID NO: 6533 - DNA, 801 bp, Artificial Sequence
  Description of Artificial Sequence: Synthetic coding sequence
atgaaggcagcagtcctgacactggcagtgctatttttgaccgggagccaagccaggcatttctggcaacaggacgaacctccacagtcaccctgggacagggtaaaggatctagccacagtgtacgtcgatgtactgaaagattccggacgagattacgtgagccaatttgaaggcagtgcattaggaaagcaattaaatcttaagttgctcgacaattgggatagcgtgacgagcaccttttctaagttgcgcgagcaattgggtcccgtgacacaggagttttgggataatctggagaaagagaccgaaggtctccgtcaggaaatgagcaaggaccttgaagaagtgaaggcaaaagtgcagccttacctcgatgactttcagaagaaatggcaggaggaaatggagctttaccggcagaaggtggagccccttagggctgaactgcaggaaggcgctagacaaaaactgcatgagctgcaggaaaaactgtctccactcggggaagaaatgcgagaccgcgcccgggcccatgttgacgccctgcgtacccatctagccccctacagcgacgaactgcgccagtgcttggcagcccggttggaggcactcaaggaaaatggaggagcaagactcgctgaatatcatgctaaggccaccgagcacctatccactctgtcggagaaagcaaaaccagctctggaggaccttcgacaggggttgctaccagtattggagtcgttcaaggtgtcctttttatctgctctggaagaatatacgaagaagctgaacactcaa

SEQ ID NO: 6534 - DNA, 801 bp, Artificial Sequence
  Description of Artificial Sequence: Synthetic coding sequence
atgaaagcggctgttctgactctggcggttttgttcctgaccggttctcaagccaggcatttttggcagcaggatgagccaccccaatccccttgggacagagtaaaagacctggcaaccgtgtacgtggatgtactgaaagacagtgggcgggactacgtgtctcagtttgaagggagtgccctgggcaagcagctgaatctgaaactattagacaattgggattctgtgaccagcactttctcaaagctgagggaacagctcggccctgtcacacaggagttttgggacaacctggagaaggagactgaaggcctgcgtcaggaaatgagcaaggatctagaagaggtcaaagctaaggtgcagccgtatctggacgactttcaaaagaagtggcaggaggagatggagctctatagacagaaggtagagcctctgcgggcagagctgcaggaaggcgcccgtcagaagctgcatgagttgcaggaaaagttaagccctcttggagaggaaatgcgcgaccgggctagagcccacgtggatgcactgcgcacccatctggcgccttactccgacgagcttcgacagtgcctcgcagcgaggctggaggctctgaaggagaacgggggcgctcgcctggccgaatatcacgccaaagctaccgagcacttgtcaactctcagcgagaaggccaagcccgctctcgaggacctgagacaggggctgctaccggttttagaaagcttcaaagtgtctttcctgtccgccctcgaagaatacacgaagaagctcaacacccag

SEQ ID NO: 6535 - DNA, 801 bp, Artificial Sequence; identical to SEQ ID NO: 6527
  Description of Artificial Sequence: Synthetic coding sequence

SEQ ID NO: 6536 - DNA, 801 bp, Artificial Sequence
  Description of Artificial Sequence: Synthetic coding sequence
atgaaagcggccgtgctgaccctcgcggtgctgtttctcaccggaagccaggccaggcatttctggcagcaagacgagcctccacagtcgccgtgggacagagtcaaggatctcgcgaccgtctacgttgatgtcctgaaagactccgggagagattatgtctcgcagttcgagggatcagcgctgggaaagcagctgaaccttaagctgctcgacaattgggactccgtgacgtccaccttctccaagctccgcgaacaactgggaccggtgactcaggaattttgggataatctcgaaaaagagacggaagggttgaggcaggaaatgtctaaagatttggaggaagtcaaggctaaggtgcaaccgtacctggatgactttcaaaagaagtggcaggaagaaatggaactctaccggcagaaggtggagcccttgcgggccgaactccaggaaggagcccgccaaaagctccacgagctccaggaaaagctgtctccgctgggagaagaaatgcgggaccgcgcccgcgctcacgtcgacgctctgaggactcatttggccccttactcggacgagctgcggcaatgcctcgccgcgcggctggaggcgctcaaagaaaacggaggagcgcgactcgcagaataccacgccaaggcgaccgaacacctctccaccctctcggagaaagccaaacctgcgctcgaggatctgagacaggggctgctgccagtgctggaatcattcaaggtgagcttcctgtcggctctggaagagtacaccaagaaactcaacacgcag

SEQ ID NO: 6537 - DNA, 801 bp, Artificial Sequence
  Description of Artificial Sequence: Synthetic coding sequence
atgaaagcggctgtattaactcttgcggtactttttttaacagggtctcaggcacgacacttctggcagcaggacgagcctccacagtctccctgggaccgtgttaaagatctggccactgtgtacgtggatgtcctcaaagatagtgggcgcgattatgtgtcgcagttcgaagggtccgctctgggaaagcagctcaatctcaagcttttagataactgggattccgtcacttctactttctccaagctgcgagaacagctcggacccgtcacgcaggaattttgggataacctggaaaaggaaactgaagggttaaggcaggaaatgtctaaggatctagaagaagtcaaggccaaagtccagccctacttggatgatttccagaaaaaatggcaggaagaaatggaactgtatagacaaaaggtcgaacctcttagagctgaactgcaagaaggagcccggcagaagctgcacgaactacaggaaaaactcagtcccctcggggaggagatgagggatcgcgcacgggctcacgtcgatgccctacggacacacctggctccatacagtgatgaattacggcaatgcctggccgcacggctcgaagccctgaaagaaaacgggggggctcgcctggcagaataccatgcaaaggccacagaacacctctcaactttatctgagaaagccaagcccgcattagaagatctaagacaggggctcctccccgtactagaatcctttaaagtgtctttcctgtccgcgcttgaagaatatactaaaaagctgaatacacag

SEQ ID NO: 6538 - DNA, 801 bp, Artificial Sequence
  Description of Artificial Sequence: Synthetic coding sequence
atgaaggccgcagtgctgactctggctgttctttttctgacaggcagccaggcccggcacttctggcagcaggacgaacctccacaatcaccctgggacagagttaaggatctggcgaccgtatacgtagacgtgctgaaagattccggcagagactacgtatctcaatttgagggaagcgctcttgggaagcagcttaacttaaaattattggacaactgggatagcgtcacgagcacctttagtaagctgagagagcagttaggccccgtgacacaggagttttgggacaaccttgaaaaggagacagagggactgcgccaggaaatgagcaaagacctcgaagaggtgaaggcaaaggttcagccttaccttgacgactttcagaaaaagtggcaggaggagatggagttgtaccgccagaaagtggaacctttgagagccgagttgcaggagggcgcacgccaaaagttgcatgaactccaggaaaagctctcaccacttggagaggaaatgagagacagggcacgcgctcacgttgatgctttacgcacccatttggctccttattcggacgagctgaggcaatgcttagcagcgcgcttagaggcactgaaagaaaacggtggagctcgtctggcagaatatcatgcaaaagccacagaacatctcagcacactgtcagagaaggctaagccagcacttgaggaccttcggcagggcctccttccagttctcgaaagcttcaaggttagtttcctatccgcactcgaggagtataccaagaagctcaacactcag

SEQ ID NO: 6539 - DNA, 801 bp, Artificial Sequence
  Description of Artificial Sequence: Synthetic coding sequence
atgaaggccgcagtcctgaccctggcagtgctcttcctgaccggaagccaggcgcgacacttctggcagcaggacgaaccaccacaaagcccgtgggaccgggtgaaggacctggccaccgtgtacgtggacgtgttgaaagactcaggcagagactacgtgtcgcagttcgaaggatctgctctcgggaagcagctcaatctcaaactgctggataactgggattccgtgacttccactttctcgaagttgcgcgaacagctgggaccggtcactcaggagttctgggacaacctcgaaaaggaaactgagggcctgaggcaagagatgtcaaaggatctcgaagaggtcaaagccaaagtgcaaccgtacctggacgactttcaaaagaagtggcaggaggagatggagctttacagacaaaaagttgagcctctccgggccgagcttcaggaaggcgcacgccagaaactccacgaactgcaagagaagctgtccccactgggtgaagaaatgcgtgatagagcccgggcgcacgtcgacgccttgcgcacccacttggcgccgtattcagatgagctgcgccaatgcctggccgcacgcctggaagccctgaaggaaaatgggggagcccggctggctgaataccatgcgaaggctactgagcatctctcgaccctgtccgaaaaggcgaagcctgcactggaagatctcaggcagggacttctgcccgtcctggaatcgttcaaagtgagctttctcagcgctcttgaggagtacaccaagaagctcaacacgcag

SEQ ID NO: 6540 - DNA, 801 bp, Artificial Sequence
  Description of Artificial Sequence: Synthetic coding sequence
atgaaagcagctgtgctgaccctggctgtgttgtttctaaccggaagccaggcccgacatttttggcagcaagatgagccccctcaatctccatgggatagagtgaaagacctggccaccgtttacgttgacgtgttaaaagatagcggcagggattacgtatctcaatttgagggcagtgccctgggaaagcagttgaacctcaagctgctggataactgggactcagtcacctccacctttagcaagcttagagaacagctgggtcctgttacccaggagttttgggacaatctggaaaaggaaactgaaggtcttcgtcaggaaatgagtaaggatctggaagaagtcaaagccaaggtgcagccttatctggatgacttccaaaagaagtggcaggaagaaatggaactgtacaggcagaaggtcgaacccctgagggcagagctccaggaaggcgctagacagaaactacacgaacttcaagaaaaactctctccactgggagaggaaatgcgggaccgcgctagggcacacgtcgacgcgcttcgcacccacctggctccttatagcgacgagctgcgccaatgtctggctgctcgcctggaggcgttaaaagaaaatgggggcgcacgtctcgcggaatatcacgcaaaggcaaccgaacacctgtctaccctttctgagaaagccaagcctgcactggaagatctgagacagggtctgttaccagtgttggaaagcttcaaggtgtccttcttgtctgcacttgaagagtacaccaaaaagctgaacactcaa

SEQ ID NO: 6541 - DNA, 801 bp, Artificial Sequence
  Description of Artificial Sequence: Synthetic coding sequence
atgaaggccgcggtcctcacactggccgttctatttcttactgggtcacaagctcgtcacttttggcaacaggatgaaccccctcagtccccttgggatagagttaaggatctggccaccgtttatgtggacgtacttaaggactctgggagagattatgtctctcagttcgagggcagcgcgttaggaaagcagctcaacttgaagctgctggacaactgggactccgtgaccagtactttttctaaactgcgcgagcaattgggccccgtgacccaggagttttgggacaacttggagaaggaaacggaaggcctgagacaggaaatgagcaaggacctggaagaagttaaggcgaaggtgcaaccctacctcgacgatttccaaaaaaagtggcaggaagagatggaactgtaccgccagaaggtcgagcccctgcgagctgagctccaggaaggagctagacagaagcttcatgagttacaggagaagttgagccccctaggcgaagaaatgcgcgatcgagcccgagctcatgtggatgccctccgcacccaccttgctccgtattctgacgaactacggcagtgccttgcagcccgattagaggccctcaaggagaacggtggcgcacggttagctgagtaccacgctaaagctaccgaacatttatcaacattgtctgagaaggctaaacccgcgctggaagatttaaggcaggggctccttcccgtcctggaaagcttcaaagtttcgtttctgagtgctctcgaagagtatactaaaaaactgaacacgcaa

SEQ ID NO: 6542 - DNA, 801 bp, Artificial Sequence
  Description of Artificial Sequence: Synthetic coding sequence
atgaaagctgctgtcctgacactagccgtgctgttcctgaccggctcccaggcaagacatttctggcaacaagacgaacccccccaatccccatgggaccgcgtaaaggacctggctaccgtttatgtagacgtgctgaaggactcaggacgcgattatgtatcccagtttgagggctccgctctgggaaaacagttgaacttaaagctactagataactgggatagcgttacttctaccttctccaagctgcgtgaacagctaggaccagtgactcaagagttctgggacaatttggaaaaagagacagagggcctgaggcaggaaatgtctaaagatctcgaggaggtcaaagcaaaagttcagccctacctcgacgactttcaaaagaaatggcaggaagaaatggagctatacagacagaaggtcgaaccactgcgggcagagctgcaagaaggtgctaggcagaagctgcacgagctgcaggaaaaactgagtcctctgggggaagaaatgagagatagggcccgagctcatgtggatgctttacgcacccacctggctccctacagcgatgaactgcgccaatgtctggcagcaaggctggaggctctaaaggagaacggcggggctcgactcgccgagtaccatgccaaggcaaccgagcacctgagtactctgtctgagaaggccaagccagctctcgaagatctgcggcagggactgctacctgtgctagaaagcttcaaagttagttttctatctgctctagaggagtatactaaaaaactgaacacacag

SEQ ID NO: 6543 - DNA, 801 bp, Artificial Sequence
  Description of Artificial Sequence: Synthetic coding sequence
atgaaggcagcggttttgactctggcagtcctcttcttgacgggaagccaagcgcgtcatttctggcagcaggatgaacctccacagtcaccttgggacagggttaaagatctcgccactgtttacgtcgatgttctaaaggactcaggacgagattatgtttcacaattcgagggatccgcactgggtaaacaactgaatttgaaacttttagataactgggacagcgtgacatcaacgttttcgaagctaagagagcagttgggtcctgttacccaagaattctgggacaacctcgaaaaagagacggaggggctgcgtcaggaaatgtcaaaggatcttgaggaggtcaaggccaaagttcagccatatttagatgatttccagaaaaaatggcaagaagaaatggagctttacagacagaaagttgaaccattgcgagcagaacttcaggagggggcccgtcagaagctccacgagttgcaagaaaagttgtcgccattaggagaggagatgagggacagagccagagctcatgtcgacgccctgcgtacccatcttgccccttacagtgatgaactccggcagtgtttggctgcaagactagaagctctcaaggaaaacggcggtgccaggctcgccgagtatcacgcgaaggcgaccgagcatcttagtaccttatcggaaaaagcaaagcctgctcttgaggacctgagacagggactccttcccgttttggaaagcttcaaagtgtcgttccttagtgcccttgaagagtacactaaaaagttaaacactcaa

SEQ ID NO: 6544 - DNA, 801 bp, Artificial Sequence
  Description of Artificial Sequence: Synthetic coding sequence
atgaaggcagcagtgctgaccctcgcagtgttgttcctgactggatcgcaagcacggcatttctggcagcaggacgagccgccgcaaagcccgtgggaccgtgtgaaggacctggctaccgtgtacgttgatgtgctgaaggacagcggacgggactacgtgtcgcaattcgaaggtagcgcactgggtaagcagctgaatctcaagctgttggataactgggattcagtcacctcaaccttttcgaaactgcgcgaacagttgggtcccgttactcaggagttctgggataacctggaaaaagaaactgaagggctgcgccaggaaatgtcgaaagacctcgaagaagtgaaagcgaaggtccaaccttacttggacgatttccaaaagaagtggcaagaagaaatggaactgtaccgccagaaggttgaacctcttagagccgagctgcaagagggcgcgaggcaaaaactgcacgagctgcaggaaaagctgagtccgctgggcgaagaaatgagagacagggctcgcgcgcacgtcgacgctctccggacccacctggcaccctattccgacgagctccgacagtgtctcgccgccaggctcgaggccctcaaggagaacggaggagcgcggctggcagagtaccatgctaaggcgactgaacacctgagcactctgtcagagaaggcgaaaccggcactggaggaccttcgccaagggcttctgccggtcttggaatcctttaaggtgtcattcctgtccgcgcttgaggagtacactaagaaactcaatacccag

SEQ ID NO: 6545 - DNA, 801 bp, Artificial Sequence
  Description of Artificial Sequence: Synthetic coding sequence
atgaaggccgcagtcctcaccctggcagtgctctttctgactggatcccaggcgcggcacttctggcagcaggatgaacctccccagtccccgtgggatagggtgaaggacctggcgaccgtgtacgtggacgtgctgaaggactcgggacgcgactacgtgtcccagttcgagggatccgctctgggaaagcaactgaatcttaagctgctggataactgggactcggtgactagcacttttagcaaacttagagagcaactcgggccggtcacccaggagttctgggataacctggaaaaggaaacggaaggcctgcggcaagagatgtcgaaagacctcgaagaagtgaaggcaaaggtccagccgtacctggacgactttcagaagaaatggcaagaggagatggaactgtaccggcagaaagttgaaccgctgagggcggagctgcaagaaggggctcgccagaagctgcacgaactccaggagaagctctccccactgggagaggagatgcgcgatcgggccagagcacacgttgatgcgttgcggacccacctggccccttactccgacgagctccggcagtgcctggccgcaaggcttgaagccctcaaggaaaacggtggagcacgcttggcggaataccacgccaaggctactgagcatctttcgaccctgagtgaaaaggcgaaaccggcactcgaagatctccggcagggactcctcccagtgctggaatccttcaaggtgtcattcctgtctgctttggaagaatacactaagaagctgaacactcag

SEQ ID NO: 6546 - DNA, 801 bp, Artificial Sequence
  Description of Artificial Sequence: Synthetic coding sequence
atgaaggcagccgtgcttactctcgctgtgttgttcctcaccggtagccaagctagacacttctggcaacaagacgagcccccgcaaagcccttgggatcgggttaaggaccttgcgactgtctacgtggatgtgctcaaggactccggccgggactacgtctcacaattcgagggatcggccctcggaaagcaactgaatctgaagctgctggacaactgggactcggtgacgagcacgttctccaagctccgcgagcagctggggcctgtgactcaagagttctgggacaatcttgaaaaggagacggaaggactgagacaggaaatgtccaaagaccttgaggaggtgaaggccaaagtgcaaccatacttggatgattttcagaagaagtggcaagaggaaatggaactgtaccgccagaaggttgaacccctgcgcgcggaacttcaggaaggagcgcgccagaaattgcacgaactgcaggagaagctgtcaccgctcggcgaagaaatgagggatagagcacgcgcacacgtggacgcgcttcgcacccaccttgcaccgtattcggacgagctgcgccagtgtctggccgccaggctggaagccctgaaagagaacggtggggcacgcctggcagagtaccacgctaaggcgaccgaacatctttcgacgctgtcggagaaggccaagccggcactggaggacctgcgccagggactcctgccggtgctggagtctttcaaagtctcctttctgtccgccctggaggagtacaccaagaagctgaatactcag

SEQ ID NO: 6547 - DNA, 801 bp, Artificial Sequence
  Description of Artificial Sequence: Synthetic coding sequence
atgaaagctgcagtgctaactctggctgtactgtttttgaccgggtctcaggctcggcacttctggcaacaagatgagcctccgcaatctccatgggaccgggtgaaggacctcgccactgtctatgtcgatgtattaaaggactctgggcgcgattatgtgtcccagttcgaagggtcggcgctcggaaagcaactgaaccttaaattgcttgataactgggactccgtgacgagcacttttagcaagttgcgggagcagttaggccctgtcacacaggaattctgggacaacctagaaaaggagacagagggtctgcgacaggaaatgagtaaagaccttgaggaagtgaaggctaaagtgcagccataccttgacgactttcagaaaaaatggcaggaggagatggaattgtataggcagaaggttgagccgttgcgcgctgagctgcaagagggtgcgcggcagaagctgcatgagctgcaggaaaagctgtcccccctgggagaggagatgagagatcgcgcccgtgcacatgtcgatgccctgcgcactcatctcgccccatatagcgatgaattgcgacagtgtctggccgccagactcgaagcactcaaggaaaatgggggtgcacggctggcagagtaccacgccaaagctacagaacatctctctaccctgtcggagaaagccaagccagccctggaagatctgcggcaaggtctcctccccgtgctggaatcctttaaggtgagcttcctctcagcgctagaggagtacacaaagaagttgaacacacag

SEQ ID NO: 6548 - DNA, 801 bp, Artificial Sequence
  Description of Artificial Sequence: Synthetic coding sequence
atgaaggcggccgtgctgacccttgcggtgctgttcttgaccggttcgcaagcccggcacttttggcagcaagacgaaccgccgcagtcaccttgggaccgcgtcaaggatctggcgactgtctatgttgacgtgctcaaagattcaggtagggactatgtgtcccaatttgaagggtccgccctgggcaagcaactgaacctgaagctccttgataactgggactcggtgacctccactttcagtaaactccgcgaacagctggggcctgtgacccaggaattttgggacaacttggaaaaggaaaccgaagggctgcgccaagaaatgtctaaagacctggaggaggtgaaagccaaggtgcaaccgtacctggacgactttcagaagaagtggcaagaggaaatggagctctaccgccagaaagtggagccgctgcgcgcagaactgcaagagggagcgaggcagaagctgcacgaactgcaggagaaactgtcgccgctcggagaagaaatgcgggatagggcgcgggcgcacgtggacgctcttagaacccatctggccccatactctgatgagttgagacagtgcctggctgcccggctcgaagccttgaaggaaaatggcggagcaaggctggccgaataccacgcaaaagccactgagcatctctccactctgtcagagaaagctaaacctgctctcgaagatctccgccagggattgctgccagtcctggaatcatttaaagtttcattcttgagcgccttggaggagtacaccaagaagctgaatactcag

SEQ ID NO: 6549 - DNA, 801 bp, Artificial Sequence
  Description of Artificial Sequence: Synthetic coding sequence
atgaaggccgcggtgttaactctggcggtgctcttcctgacgggtagccaagctagacacttctggcagcaggatgagccgccgcaatcaccctgggatagagtgaaagatcttgcaaccgtttatgtggatgtcctcaaggatagcgggcgggattatgtgtctcagttcgaagggtctgctttgggcaagcaactgaatttgaagttattggataattgggacagcgtcacgtcaacgttctctaagctacgcgagcagcttggaccagtgacacaagagttctgggacaatctggagaaggagacagagggattacggcaggagatgtccaaagacctggaagaagtaaaagcgaaggtgcagccatacctcgatgatttccaaaagaagtggcaggaagagatggaactctaccgtcaaaaagttgagcccctgcgagctgaactccaggaaggagccagacagaagttgcatgagttgcaagaaaaactgagccctttaggagaggagatgcgcgaccgggcacgggcccacgtggatgctctcagaacccatctcgccccctacagcgatgaactccgtcagtgcctagccgccagactggaggccctgaaggaaaatggaggagcccggttagccgagtatcacgcgaaggcgactgaacatttgtcaactctgagcgagaaagcaaagccagctctagaagatctaagacaagggctactgcctgttctggaaagcttcaaagtatccttcctatctgctttggaggaatacaccaaaaaactcaatacacag

SEQ ID NO: 6550 - DNA, 801 bp, Artificial Sequence
  Description of Artificial Sequence: Synthetic coding sequence
atgaaggctgccgtccttaccctcgcagtgctgtttctcacgggatcacaagcaagacatttttggcaacaagatgagccccctcagtcaccgtgggatcgagtcaaagatttggcgaccgtgtacgtggatgtcctgaaggacagcggtcgagattacgtctcccagttcgagggtagtgcgcttggaaagcaattgaacctgaaactgctggacaactgggatagcgtgacgtccacgttctccaaacttagggaacagctgggtcctgtgacccaagaattctgggataaccttgaaaaagaaactgaaggtttgagacaggaaatgtccaaagatctggaagaggtgaaagccaaagtccagccttacttggatgacttccaaaagaagtggcaggaagaaatggagctgtatagacaaaaagtggagccactcagggctgaacttcaggagggagcacgccagaaactgcatgaacttcaagaaaagttgtccccacttggcgaagagatgcgtgatagggcccgtgcgcacgtcgatgccctgcgtacccacctggcgccttactcagatgagcttcgacagtgtcttgctgcacggctggaggccctcaaggagaatggaggagctcgcctggccgaataccatgcaaaggcaactgaacatctctcgaccctctcggagaaggcaaaacccgcactggaagatctccggcaggggctcctgccagtgcttgagtcgtttaaggtatcgtttctgagcgcacttgaagaatacaccaagaagttgaatactcag

SEQ ID NO: 6551 - DNA, 801 bp, Artificial Sequence
  Description of Artificial Sequence: Synthetic coding sequence
atgaaggcagcagtgctgaccctggctgtgttgtttcttaccgggtcgcaggcaagacacttctggcagcaggacgaaccccctcagtctccctgggatcgcgtgaaggaccttgctaccgtttatgtcgatgtcctcaaagacagtggtagggactatgtgtcccagttcgaggggtcagcactgggtaaacagctgaatctaaaactcctagataattgggactctgttacgtcaaccttctctaagctgagagaacagttaggtcccgtgacccaggaattttgggataatctcgagaaggagactgagggtctcagacaagagatgagcaaggatttggaggaagtgaaagccaaggtgcaaccctaccttgatgactttcagaagaaatggcaggaggaaatggagctgtatcgccagaaagtcgagcccctgagagcagagctccaagagggcgccaggcagaagttgcacgaactgcaggaaaagctgtcccccttaggggaggagatgagagatcgagctcgcgcccatgtcgacgccttgagaacccacctcgctccctactctgatgaactgcgacaatgccttgccgcccggctcgaagcccttaaagagaacggcggcgccagactggcagaataccacgccaaagcaacagagcacctctccacactgagtgaaaaggctaagcccgcactggaagatctcagacaggggctgctaccagtgctcgagtctttcaaggtcagcttcctttctgcgttagaggagtacactaagaagcttaatacgcag

SEQ ID NO: 6552 - DNA, 801 bp, Artificial Sequence
  Description of Artificial Sequence: Synthetic coding sequence
atgaaagctgcggttctgacacttgcagtcctgttcctgacgggatcacaggctaggcacttctggcagcaagatgagccgccccagagcccctgggaccgcgtgaaggatcttgccacagtgtacgttgatgtcctaaaggactccggtcgcgactatgtgtcccagtttgagggttcagccttgggaaagcaactgaacctgaagctgctcgataattgggactccgttacgtcaacgttcagtaagctacgagaacaactgggcccagtaacgcaggaattctgggataacctcgagaaggagaccgagggtctacgacaggagatgtccaaggatttggaagaagtgaaagcgaaggtgcaaccatacctggatgacttccagaagaagtggcaggaggagatggagttgtataggcagaaggttgagcccctgcgcgccgagctccaagagggcgctcggcagaagctgcacgagttgcaggaaaagttatcgcctctgggagaagaaatgcgggaccgcgcaagagctcatgtcgacgcgctacgaacccatttggccccgtatagcgacgagcttcgccagtgccttgccgcccgtctggaagctcttaaggagaacgggggggcacggctggccgagtatcacgccaaggcgactgagcatctgtcgacgctgagcgaaaaggccaagcccgcactggaggatttgcggcagggtctgcttccagtgttggagtctttcaaggtgagcttcctgagtgctctagaggagtataccaagaagctgaacactcag

SEQ ID NO: 6553 - DNA, 801 bp, Artificial Sequence
  Description of Artificial Sequence: Synthetic coding sequence
atgaaagccgccgtgttgacactggctgtcctttttctgacaggaagccaagctagacacttttggcaacaggacgagccacctcaaagtccctgggacagggtgaaagacctggctacggtttacgttgatgtgttgaaggactctggaagggattacgtctcacaattcgagggctccgctctcggaaaacagctcaacctgaaactgcttgacaattgggacagcgtgactagtacatttagcaagctccgcgagcagttgggccccgtgacccaggaattttgggacaatctggagaaggagacagaaggtcttcgccaggaaatgtccaaggacctggaagaggttaaagccaaggtgcagccttatctcgatgactttcagaaaaagtggcaagaagaaatggagctgtatcgccagaaggtggaacctctcagggccgaacttcaggaaggcgctcgccagaagctccatgagctgcaagaaaaattgagccctttgggcgaagagatgagagatcgcgctcgcgcccacgtcgatgctctgaggactcatctcgccccctactctgacgaattgaggcagtgtctcgcagccaggcttgaggcattgaaggagaacggtggcgcaagactggccgagtatcacgccaaggctactgaacatctttcaactttgtcagaaaaagctaagccggcgttggaggatttgcgccagggtctgctgccagtgctggagtcttttaaggtgtcctttctctctgctctggaagagtacacgaagaagctgaacacccag

SEQ ID NO: 6554 - DNA, 801 bp, Artificial Sequence
  Description of Artificial Sequence: Synthetic coding sequence
atgaaggcagcggtgctgaccctggcagtcctgtttctgactgggtcgcaagcgaggcatttttggcaacaggatgagccaccccaatccccttgggaccgtgtgaaggatctcgcaactgtgtacgtcgatgtgcttaaggactctggtcgcgattacgtctcgcaattcgaaggatcagccctcggtaagcaactcaacctcaagctgcttgataattgggactcagttacctctaccttctcgaaacttagggaacagcttggaccagtgactcaggaattttgggacaatcttgaaaaggaaactgaaggtctgcgccaggagatgagcaaagatttggaagaagtcaaagcaaaggtgcaaccttacctggacgatttccagaaaaagtggcaagaagaaatggaattgtataggcaaaaggtcgaaccgctgagagcggagctgcaagagggcgcccgtcaaaagttgcatgagctccaggaaaaactttcccctcttggagaggagatgagggaccgagcacgcgcacatgtggatgcgttgagaactcacttggcaccttacagcgacgagcttagacagtgtcttgccgcacggcttgaggccctcaaggagaacggaggagctagactcgctgaataccacgcgaaggcgaccgagcatctttccacgctgagcgaaaaagcgaaaccggcactggaggatttgcgccaaggtttgctgcctgtgttggaatcctttaaggtgagctttttgtcggctctggaagaatacaccaagaaacttaacacccag

SEQ ID NO: 6555 - DNA, 801 bp, Artificial Sequence
  Description of Artificial Sequence: Synthetic coding sequence
atgaaagctgccgtcttgacattggcagtcctctttctgacgggctcgcaggctcgacacttttggcagcaggatgaaccaccacagagtccctgggacagagtaaaggatcttgccaccgtgtatgtggacgtgttgaaggactctggccgggattacgtgtcccagtttgaaggaagtgccctggggaaacaactcaatctgaaacttctggataattgggactctgtgaccagcacattcagcaaactgagagagcagctcgggcctgtcacacaggaattttgggacaacctagaaaaagagactgaggggttgcggcaagaaatgtctaaagatttggaagaggttaaggcaaaggttcagccctaccttgacgactttcagaagaaatggcaggaggagatggaactataccgccaaaaggtggagcctctgcgcgccgaactccaggaaggcgcaaggcagaagttgcatgagctgcaggagaaattgagtcccctgggcgaggagatgcgtgatagggcccgcgcccacgttgatgcccttagaacgcacctagcgccctattcggacgagctgagacagtgtcttgccgccaggctcgaagctctgaaagaaaatggcggagctcgcctagctgagtaccacgctaaggccacagaacaccttagtactctgtcggagaaggcaaagccggccctggaagatctacgacagggacttctgcccgtgctcgagtccttcaaggtcagtttcttaagcgcccttgaggagtatactaagaagcttaatacacag

SEQ ID NO: 6556 - DNA, 801 bp, Artificial Sequence
  Description of Artificial Sequence: Synthetic coding sequence
atgaaagctgcggttttgacactcgccgtgctgttcctcaccggtagccaagcccgccacttttggcaacaggatgaaccgccccagagtccgtgggaccgggtgaaggacttagcgaccgtatatgtggatgtgctgaaagactctggacgtgattatgtgagtcagttcgaaggtagcgcactcggcaaacagctcaacctaaaactgctcgataattgggattctgtcacatctacgttctctaagctccgcgagcagctgggaccagtcacacaagagttctgggataacctggagaaggaaaccgagggtctgcggcaggaaatgagcaaggatctagaagaagtcaaagcaaaagttcagccgtacttggacgatttccagaaaaaatggcaggaggaaatggagctataccgtcagaaggtagagcctctcagagcagaattgcaggagggcgccagacaaaaacttcacgagctgcaggaaaagctgagcccactcggagaggaaatgcgggacagggctcgtgcacacgtcgatgccttgagaacacacctggccccctactcagatgagctgcgccagtgtctagcagctcggctcgaagcactgaaggagaacggcggtgcacgcctggctgagtaccatgcgaaagccaccgaacacctcagtacccttagcgaaaaagcaaaaccagctctggaagatctgagacaggggctcctacccgtgttggaatcatttaaagtaagcttcttgagcgcacttgaggaatatactaaaaagctcaatacacag

SEQ ID NO: 6557 - DNA, 801 bp, Artificial Sequence
  Description of Artificial Sequence: Synthetic coding sequence
atgaaagcagccgtgcttactctggccgtcctcttcctgactggttcacaggcccgccacttctggcaacaggacgagccgccgcagtcgccatgggatcgggttaaggatctggccactgtgtatgtggatgtcctgaaggattccggacgcgattacgtctcccagtttgaaggatcggcgttgggaaaacaactgaatctcaagctgctggacaattgggactccgtgaccagcaccttctcgaagctgcgggagcaacttggtccggtcacccaggaattttgggataacctggaaaaagagacggagggactcagacaggaaatgtccaaggatctggaagaggtgaaagctaaagtgcagccgtacctcgacgatttccagaagaagtggcaggaagaaatggaactgtaccggcagaaggtggaaccgttgcgcgcggagctgcaggaaggcgcacgccagaagctccatgaactccaggaaaagctgtcgccgctgggggaagagatgcgcgacagagctcgcgcccacgtcgatgccctgaggactcatctggccccatatagcgacgaactgcgccagtgcctggcggccagattggaagcgctcaaggaaaatggaggagcgcgacttgcggaataccacgcaaaggcaaccgaacacttgtccactcttagcgagaaggcaaagcctgccctggaggacctccgacagggcctgctgccggtgctggagtccttcaaagtgtcgtttctctcagccttggaagagtacaccaaaaagctgaacactcag

SEQ ID NO: 6558 - DNA, 801 bp, Artificial Sequence
  Description of Artificial Sequence: Synthetic coding sequence
atgaaagcagccgtgctcacccttgcggttctgtttcttacggggagccaagctagacacttttggcaacaggacgagcctccccaatctccgtgggatagggtgaaggatcttgcaacggtctacgtggatgtgttgaaggattcgggtcgtgattacgtctcgcagttcgaaggaagcgccctgggcaagcaacttaacctgaagctcttggataactgggactcagtcacctcgactttctctaagctgagagaacaactggggcccgtcactcaggagttttgggataacctcgagaaggaaaccgaaggattgcgccaagaaatgtcaaaggatcttgaagaggtgaaggccaaagtgcaaccatacctggacgactttcaaaagaaatggcaggaagaaatggaactgtatcgacagaaggtcgaaccactgcgggcagagttgcaggaaggcgccaggcaaaaactccatgaactccaggaaaaactttcgccgctgggtgaagaaatgagggaccgagcaagagcacacgttgatgcactccggacgcatctcgcaccctacagtgacgaacttagacaatgtttggctgcccgccttgaggcactgaaagagaatggtggtgcgcggctggcagagtaccatgcaaaggccaccgaacatctgtcaaccctctctgagaaggcgaaaccagcgcttgaggacttgcgccagggcctgctgccagtgcttgaatcgtttaaagtgtcattcctttcggcgcttgaagaatatactaagaagttgaatactcag

SEQ ID NO: 6559 - DNA, 801 bp, Artificial Sequence
  Description of Artificial Sequence: Synthetic coding sequence
atgaaggcggcagtgctgactctcgctgtgctgttcctgaccggatcacaggcccggcatttttggcagcaggacgagcccccgcagagcccttgggaccgggtaaaagatcttgccaccgtgtacgtggacgtgctgaaggacagcgggcgcgactatgtgtcccagttcgagggatccgcactgggcaagcagctgaacctgaaactgctggacaattgggactctgtcacctcgactttttcaaaactgcgcgagcagctcggacctgtcactcaagagttttgggataacctggaaaaggaaaccgagggcctgagacaggaaatgagcaaggatctcgaggaagtgaaggcgaaagttcagccatacctggacgacttccaaaagaaatggcaagaggagatggaactctacagacagaaagtggagccactccgcgcggaacttcaagaaggtgccagacaaaagctgcacgagctgcaggagaagctctcccccctgggtgaggagatgcgcgaccgggcgcgggcgcacgtggatgcgttgagaacgcacctggcgccgtatagcgatgaactgcgccagtgtctggctgcccggctggaagcactcaaggaaaacggaggagcacgtctcgcggagtaccacgcgaaggccaccgagcacctttcgacgctctccgaaaaggcgaagccggctctggaagatctccggcagggcctgctgccggtcttggagtcgttcaaggtgtcgtttctgagcgccctcgaagagtacactaagaagctgaacacccag

SEQ ID NO: 6560 - DNA, 801 bp, Artificial Sequence
  Description of Artificial Sequence: Synthetic coding sequence
atgaaggcggcagtgctgactctggccgtgctgtttttgactggttcgcaagcgcgccacttctggcaacaggacgagccgcctcagtccccctgggaccgagtgaaggatctcgcgaccgtctacgtggacgttctgaaggattctgggcgggactacgtctcccagttcgaagggtcagcacttggaaaacagctcaatctcaagctcctggacaactgggactcagtgactagcaccttttcgaagctccgcgaacaactcgggcccgtgactcaggaattctgggacaatctcgaaaaggaaaccgagggactccgccaggaaatgtcgaaggatctcgaggaggtgaaggcaaaggtgcagccgtacctggacgatttccagaagaagtggcaggaggagatggagctctaccgccaaaaagtcgaaccgctgagagcggaattgcaagagggagcccgccaaaagttgcatgaactccaagaaaaactgtcccctctgggggaagaaatgcgggaccgggctagagctcatgtcgacgctctgcgcacccaccttgcgccttactcggacgaactgaggcagtgcctggcggcaaggctcgaagccctgaaagaaaatggaggggctcggctcgcggaatatcacgctaaggccactgaacacctgagcaccctctcggagaaggccaagccagcgcttgaagatcttagacagggactcctcccagtgctggagtcctttaaggtttcgttcctgtccgctctcgaagagtacactaagaagctcaacactcag

SEQ ID NO: 6561 - DNA, 801 bp, Artificial Sequence
  Description of Artificial Sequence: Synthetic coding sequence
atgaaggctgcagttttaacacttgctgttttatttcttactggatcacaagctcgtcatttttggcaacaagatgaacctccacaaagtccatgggacagagttaaagatttagctacagtatatgttgatgttcttaaggattcaggaagagattatgtttcacaatttgaaggttcagcattaggtaagcaattaaatttaaaattgctagataattgggattctgttacatcaacattttcaaagttgagagaacaattaggacctgtaacacaagaattttgggataatcttgagaaagaaactgaaggtcttcgacaggaaatgtctaaagatttagaagaagttaaagcaaaagttcaaccatatttagatgattttcaaaaaaaatggcaagaagaaatggaattatatagacagaaagttgaacctcttagagctgagttacaagaaggagcaagacaaaagttacacgagttacaagaaaaattaagtccattaggagaagaaatgagagatagagctagagcacatgttgatgctttgagaactcatttggctccatattcagatgaattgcgacaatgtctagccgctagacttgaagcacttaaagaaaatggaggagctagattagctgaatatcatgctaaagctacagaacatctatcaactctttcagaaaaggctaaaccagcattagaagatttaaggcaaggacttcttccagttttagaatcatttaaagtttctttcctttctgctcttgaagaatatacaaagaaattaaatacacaa

SEQ ID NO: 6562 - DNA, 801 bp, Artificial Sequence
  Description of Artificial Sequence: Synthetic coding sequence
atgaaggcagcagtcctcacccttgcggtgctcttcttgacgggatcacaagcgagacacttttggcagcaagacgaaccgccacagtcaccatgggacagggtgaaagaccttgccaccgtctacgttgacgtcctcaaggattcaggacgcgactacgtgagccaatttgaagggtccgcacttggtaagcaacttaatctgaagctgttggataactgggattcggtcaccagcactttctccaaactcagagaacagctgggtcctgttactcaggaattttgggataaccttgagaaggagacggaagggcttaggcaggagatgagtaaggatctggaagaggtgaaagccaaagtgcaaccatacctggacgatttccaaaagaagtggcaggaggagatggagctctaccggcaaaaggttgaaccgttgagagctgagttgcaagaaggggcgagacaaaaacttcacgaacttcaagagaagttgtcgcccctcggagaagagatgcgggaccgtgcacgagcacatgtggatgcgctgcggacccatcttgctccgtactcagacgaactgcgacaatgtctggcagcgcgccttgaagcactgaaagagaatggtggagccagacttgcagagtatcatgcaaaggcaaccgaacatctgtccactcttagcgagaaggcgaagccagccctcgaagatctgcgacaaggactgcttcccgtgcttgagtcgtttaaggtgtccttcctgagcgccttggaggaatacaccaaaaagctgaacactcaa

SEQ ID NO: 6563 - DNA, 801 bp, Artificial Sequence
  Description of Artificial Sequence: Synthetic coding sequence
atgaaggcagccgtgctgacactggccgtcctgttcctgactggctcacaagctagacatttctggcagcaggacgagccccctcagtccccatgggaccgagttaaggacctggctactgtatatgtcgatgtattgaaagattccggtcgtgactacgtctcacagtttgagggttccgcgctgggcaagcagttaaacctcaaattgctggacaattgggactcagtgaccagcacgttcagcaagctgagagagcagcttggccccgtcactcaggaattttgggataacctggagaaagaaacagagggcctgcggcaagaaatgagcaaggatctggaggaagtgaaagctaaagtgcagccctacctggacgatttccagaagaaatggcaggaggaaatggagctgtacaggcagaaagttgaacccttgcgagccgagttgcaggaaggcgcccgacagaaacttcacgaactccaggaaaagctgtccccactgggagaggaaatgagagatcgagctcgcgctcacgttgatgccttgcgcactcacttggccccttacagcgacgagttgcggcagtgccttgccgccagactggaggctctgaaagaaaacggtggcgcccgactggctgaataccatgctaaggctaccgagcacctgtctacgctgtcagagaaggcgaagcccgcgctggaggatctccgacaaggcctgttgcccgttctagaatcctttaaggtaagctttcttagtgctctcgaggagtatacgaagaaattgaacactcaa

SEQ ID NO: 6564 - DNA, 795 bp, Artificial Sequence
  Description of Artificial Sequence: Synthetic coding sequence
atgaagaaggaggtgtgctctgtcgcttttctaaaggcggtgttcgcagaattcttggcgacgctgatctttgtgttttttggcctggggagtgctctgaagtggccctctgctttgcccaccatcctccaaatcgcccttgccttcggattggcaatcgggacccttgcccaagccctgggacccgtgagcggagggcacattaacccagctataaccctcgctctgctggtcggcaatcagatctctttgctgcgagccttcttttacgtggcagcccagctggtgggagccatcgcgggggctggaatactgtatggtgtcgctcccctgaatgcgcgaggcaatctggcagtgaacgccttgaacaataacactactcaggggcaggcaatggtcgttgaactgattctgacatttcaactggccctgtgcattttcgcatctaccgacagccgccgtacaagtcccgttggttcccccgctctgtctattggcctctctgtgacgctgggccaccttgtcggcatatacttcaccggctgctcaatgaatccagctcgaagttttggacctgccgtggtcatgaatcggttcagcccggcgcactgggtcttttgggtcggtcccatcgtcggtgcggttctggcagccatcctgtatttctatctcctgtttcccaattcgttatctctgagtgaaagggtggccatcataaaggggacgtacgagccagatgaggactgggaggagcaacgggaggagagaaaaaagacaatggagctaaccacacgc

SEQ ID NO: 6565 - DNA, 795 bp, Artificial Sequence
  Description of Artificial Sequence: Synthetic coding sequence
atgaaaaaagaggtctgctccgttgcttttctgaaagcagtgttcgcagagttcctggcgacactgatctttgtgtttttcgggctgggctctgcccttaagtggccaagcgcgttaccgaccatcctacagattgcgctggccttcgggctggctattggcaccctggcccaggctctagggccagttagtgggggccatataaatcccgccattaccctagcactcctggtgggtaatcagatcagtctgctgagggctttcttttacgtggccgcccagctggtgggagctattgccggtgcagggattttatacggggtcgcgccacttaacgcaaggggaaacctggcagtgaacgcgttaaataacaatactacacagggacaggcaatggtggtcgaactcatactcacgttccagttggccctctgcatttttgccagcaccgacagccggcggacatcccccgtcggttcgcccgctctaagcattggtctgtctgtgactctcggacacctggtgggaatctatttcactggatgctccatgaatcccgcgcgctcttttggcccggcggtcgtaatgaatagattttcacctgcgcactgggtattttgggtgggtcctatcgtaggggcagttttagctgctatcctctacttctacctcctgttccctaactccttgtcactgtcagaaagggtcgccatcattaaaggcacctacgaacccgatgaagactgggaggagcagagagaagagcgcaaaaaaactatggagttgactacccgc

SEQ ID NO: 6566 - DNA, 795 bp, Artificial Sequence
  Description of Artificial Sequence: Synthetic coding sequence
atgaagaaggaggtgtgttctgtcgccttcctcaaagcagtcttcgctgaatttctggctaccttgatttttgtgttcttcggactcggcagtgctcttaaatggccatcagcactgcccaccattttgcagatcgcactggcttttgggctggcaataggaacgctcgcccaagcattggggcccgtgagcgggggccatattaatcctgctataaccctggcactgctggtggggaaccagatcagcttacttcgagcttttttctacgtggctgctcagctggtaggcgccatcgctggagccggcattctgtacggagtcgcgccattgaacgcacgcggcaacctggccgtgaacgccctgaataacaacaccacacagggtcaggctatggtggtggagcttattttaacttttcagctggctctctgcatcttcgccagtaccgatagcaggcggacgtcgcccgtgggcagtcccgctctctctatcggactgtccgtcacgctcggacacctggtcggcatctacttcaccggatgctctatgaatcctgcaaggtcttttggaccagccgttgtaatgaaccggttctcaccagcgcactgggttttttgggtaggccccatcgtgggcgcagtgcttgccgctatcctctatttctatcttctgtttcccaacagtcttagcctctcagagagagtcgccattatcaaggggacttatgaaccagatgaagattgggaagagcagcgagaggaacgtaagaaaactatggagctcacaactagg

SEQ ID NO: 6567 - DNA, 795 bp, Artificial Sequence
  Description of Artificial Sequence: Synthetic coding sequence
atgaaaaaggaggtgtgcagcgtcgccttcctcaaggcggtgttcgccgagttcctggctaccctgatctttgtctttttcggactgggctcagcgctcaaatggccatccgctctcccaactatcctgcaaattgcactggctttcggactggcaatcgggaccctggcacaggcactgggaccagtgtccgggggacatatcaacccggccatcaccctcgcactgctggtcggcaatcagatcagccttctgcgcgccttcttctacgtggctgcccagctggtcggagccattgccggagccgggatcctttacggagtcgctccccttaacgcgagaggaaacctggcagtcaacgcgctgaataacaacacgacccagggacaggccatggtggtggaactgattctgacgttccaactggctctgtgcatcttcgcctcgaccgactcccgccggacctccccagtcggttcgccggcgctgtcgattggattgtcagtgaccctgggacatctggtgggaatctactttactggttgctccatgaacccagccaggtcgtttggaccggccgtggtgatgaaccgattctcacctgcccactgggtgttctgggtggggccgatcgtgggcgcggtcctggcggctatcttgtacttctacctcctctttccgaatagcctgtcgctctccgaacgcgtcgctatcataaagggcacttacgagcccgatgaggactgggaggaacagcgcgaagaaagaaaaaagactatggagctgacgacccgc

SEQ ID NO: 6568 - DNA, 795 bp, Artificial Sequence
  Description of Artificial Sequence: Synthetic coding sequence
atgaaaaaagaggtatgttccgttgctttcctcaaggcagtgtttgcagaatttctcgctactctgatttttgtgttttttggactgggatcagcgttgaagtggccatcagcactgcctaccattcttcaaatagcgcttgcatttggactggcaattggtacgcttgcacaagctctgggtcctgtgtccggtggacacattaatcctgccattactctggcactccttgtgggcaatcagattagtttgctgagagcgttcttttacgtggctgcacagctggtgggtgcaatcgcaggagcgggaatcttgtacggcgtggcgccactgaacgcacggggtaacttggccgtcaatgcgctgaacaacaataccactcaagggcaagccatggtggtggaacttattctgaccttccaactggcgctctgcatcttcgcgtctaccgattcacggcgaaccagcccagtcggatcgcctgcactctccattggcctttcagtgactctcgggcatctcgtcggaatatacttcaccggctgtagcatgaaccccgcacgttcgtttgggccagcggtcgtcatgaaccgcttttcacccgcccattgggtattctgggtgggtcctatagtgggtgccgtcctggccgcaatactgtacttttatcttctctttccgaactcccttagtctgtccgagagggtggcgatcatcaaggggacttacgaacctgacgaagattgggaagagcagagagaagaacgcaaaaagacgatggagctcactacgaga

SEQ ID NO: 6569 - DNA, 795 bp, Artificial Sequence
  Description of Artificial Sequence: Synthetic coding sequence
atgaaaaaagaagtatgttcggtagcgtttttaaaagcggtatttgcggaatttttagcgacgttaatatttgttttttttggtttaggttcggcgttaaaatggccgtcggcgttaccgacgatactacaaatagcgctagcgtttggtctagcgataggtacgttagcgcaagcgttaggtccggtatcgggtggtcatataaatccggcgataacgttagcgttattagtaggtaatcaaatatcgctattacgtgcgtttttttatgtagcggcgcaattagttggtgcgatagcgggtgcgggtatactatatggtgtagcgccgttaaatgcgcgaggtaatctagcggttaatgcgttaaataataatacgacgcaaggtcaagcgatggtagtagaactaatattaacgtttcaactagcgctatgtatatttgcgtcgacggattcgcgtcgtacgtcgccggttggttcgccggcgctatcgataggtttatcggtaacgctaggtcatctagttggtatatattttacgggttgttcgatgaatccggcgcgatcgtttggtccggcggtagtaatgaatcgtttttcgccggcgcattgggttttttgggtaggtccgatagtaggtgcggttctagcggcgatactatatttttatctattatttccgaattcgctatcgttatcggaacgtgtagcgataataaaaggtacgtatgaaccggatgaagattgggaagaacaacgtgaagaacgaaaaaaaacgatggaattaacgacgcgt

SEQ ID NO: 6570 - DNA, 795 bp, Artificial Sequence
  Description of Artificial Sequence: Synthetic coding sequence
atgaaaaaagaggtgtgctctgtcgcgtttctgaaggcagtgttcgcagagtttctggcaactctgatcttcgtgttcttcggtctgggctctgcgctgaagtggcccagtgctcttccaaccatattgcagattgccctggcttttggcctggccattggcacactggcccaagccctcggaccagtgtccggggggcacatcaatcccgccataacattggcccttctggttggaaaccaaattagcctattgagagccttcttttacgttgccgctcagctggtgggcgctatagcaggggccgggattctctacggggttgctcctttgaacgcccgcggaaacctggcggtaaatgcattgaataacaacacaacacagggacaggccatggtcgtcgaactgatcctgacgttccagttagctctttgtatctttgcaagcactgatagccgacggacctcacccgttggtagtcccgcgctgtcgattggcctgtctgttaccctggggcacttggtcggaatctactttacggggtgctccatgaacccggcccgcagttttggccccgccgtggtcatgaatcgatttagccccgcccactgggtgttctgggtggggccgatcgttggcgccgtgctggctgcaattctttacttctatttgctgttcccgaactctctgagcctctccgagagggttgccatcatcaaagggacctacgagcccgatgaggattgggaggaacagagagaagaacgcaaaaagacaatggagcttactactcgc

SEQ ID NO: 6571 - DNA, 795 bp, Artificial Sequence
  Description of Artificial Sequence: Synthetic coding sequence
atgaaaaaggaggtgtgctcagtcgccttcctgaaggcggtgttcgcagaatttttggcgacactgatcttcgtcttcttcggcctgggctccgccctgaagtggccgagtgccctgccgacaattctgcagattgccttggccttcggcctcgccattggcacgctcgcccaggctctaggaccagtgtcgggaggacacataaacccggccatcactcttgcgctcctagtgggaaaccagatttccctattgcgggctttcttttacgtggcagcccagctcgtcggcgcaatcgcaggcgcaggcattctgtacggagtagctcccttgaatgcccggggaaacttggccgtgaatgcccttaataacaataccacccagggccaggcgatggttgttgagctgatcctaactttccaactggcactatgtatttttgcctcgacagattctcgtcgcaccagcccggtgggttcgcccgcgttaagcatcggattatccgtgaccctggggcatcttgtgggaatctacttcactggttgtagcatgaacccggcaagatctttcggtccggccgttgtgatgaatcggttttcgcctgcacattgggtgttctgggtcggacctatcgtcggcgcggtcctcgcagctatactatatttttacctcttgttcccgaatagcttgtcgctctccgaacgcgtcgccataatcaaaggcacgtatgagccggatgaagattgggaggaacagcgcgaagagcggaagaagacgatggagctgacaacccga

SEQ ID NO: 6572 - DNA, 795 bp, Artificial Sequence
  Description of Artificial Sequence: Synthetic coding sequence
atgaaaaaagaggtgtgctcggtggcctttctgaaggccgtgttcgcagagttcctagcgaccttgatctttgtgttttttggcctggggtctgcactgaaatggcccagtgcattacctactatactgcagatcgctctagctttcgggctcgccatcggaactctggcccaagccctgggaccggtgtctgggggccatattaaccccgccatcactctggctctactggtcgggaaccagatcagcctgctgagggctttcttctacgtcgcggcacaacttgtgggcgctattgccggggcaggcattctgtatggggtcgcccccctgaacgcgcgcggaaatctggctgtcaatgcattgaataacaatactacgcagggacaggccatggtggtggagctgattctgacatttcagctagcactgtgcatttttgcatcaaccgacagcaggcggaccagccctgtcggtagccccgcccttagtataggcctgtcagttacacttgggcatctcgtggggatctatttcactggttgctccatgaaccccgcccggtcattcgggcccgccgttgtgatgaacaggttttctccggcccattgggtgttttgggtaggtccgattgttggagctgtgttggccgcaatcctgtacttctatctcttgtttcccaatagtttgtcactctccgagcgagtcgccataatcaaaggcacctacgagcctgacgaggactgggaggagcagcgagaggagcggaaaaagacaatggagctgacaacacgt

SEQ ID NO: 6573 - DNA, 795 bp, Artificial Sequence
  Description of Artificial Sequence: Synthetic coding sequence
atgaagaaagaagtctgctctgtggcattcctgaaggccgtattcgccgagttcttggccactctgatcttcgtgttttttgggctgggttcggctctgaagtggccgtccgcgttgccaacgatcctccagatcgcactggctttcggacttgctatcggaacgctggcacaagcactcgggccagtttccggcggacatatcaacccggcaataactttggcactcctcgtgggtaaccagatctcgttgttgcgcgcattcttctacgtggcggcgcaattggtgggagcaatcgccggagctggaatcctctatggcgttgccccactgaatgcaagaggtaacctcgctgtcaatgccctgaacaataacaccactcagggccaggcaatggttgtggagcttatcctcacctttcagcttgccctgtgcatcttcgcgtcgaccgactcaagacgcacctctccggtgggatcgccggcgcttagcattggactgagtgtgaccttgggacacctggtgggcatttacttcaccgggtgttcaatgaaccccgcccggtccttcggtccagcagtggtcatgaacaggttttcccccgcacactgggtgttctgggtgggaccaatcgtcggggccgtattggctgccatcctttacttttacctgctgttcccaaattcgctgagcttgtcagaacgggtcgccattatcaaaggaacgtacgaacctgacgaggattgggaagaacaacgcgaggaacggaaaaagactatggagctgaccactcgc

SEQ ID NO: 6574 - DNA, 795 bp, Artificial Sequence
  Description of Artificial Sequence: Synthetic coding sequence
atgaaaaaggaagtgtgttcagtcgctttcctgaaagcggtgtttgccgaatttctggcaactcttatctttgtattctttggactcggttccgcgctcaagtggccttccgcacttccaaccattcttcaaattgcactggcatttggccttgccattggtacccttgcacaagctctggggccagtgtcgggaggacacattaaccctgcaatcacgctggccctgcttgtgggaaatcagataagcctcctgagagcattcttctacgtggccgcccaactcgtgggagcaattgcaggagccggcattctttacggagtcgcaccactgaacgcacgaggcaacctggcggtgaatgcattgaataacaatactacccagggtcaagcaatggtcgtcgaattgattcttacctttcagcttgcactgtgcatttttgcgtcgaccgattcacggcgcacttcaccagtgggctcgcccgccctgtctattgggctttcggtgactctgggacacctcgtgggcatttacttcacgggatgttcaatgaaccctgcacgttcatttggccccgctgtggtcatgaacagattttccccggcacactgggtgttttgggtcggcccgattgtgggggcagtgctggccgcaatcctgtacttctacctgctgttcccgaattcactgtccctgagcgagcgggtcgcaatcataaaaggcacttacgaaccggacgaggattgggaagaacagagagaagagaggaaaaagaccatggagctgacgaccaga

SEQ ID NO: 6575 - DNA, 795 bp, Artificial Sequence
  Description of Artificial Sequence: Synthetic coding sequence
atgaaaaaagaggtttgctctgtggcgtttcttaaagcagtcttcgctgagttcttggcgacactcattttcgtattcttcgggctggggagcgccctgaagtggccttccgcattgccaactatcctgcagattgcattagcgtttggactcgctattggaacacttgctcaggccctgggacccgtatctggcggacacatcaaccccgccatcacattggccctgctggtggggaaccagatcagtctgctcagggcgtttttttacgtagcagcacaattggtcggagcgattgccggagcgggcatcctttatggggtggccccactcaatgccaggggtaacttagcggtgaacgccctcaacaataacacaacccaaggccaggctatggtggtggagctgatactgaccttccagcttgccctctgcatcttcgcgtcaacagactctaggcggacctcccctgttgggagtccagccctgagtatcggactgagcgtgaccctgggccatctagttgggatctatttcacaggatgttcaatgaatcccgcaagatccttcggccctgccgtggtaatgaaccgcttttctccggcccactgggtcttctgggtaggtcctatcgtgggagccgtgttggccgcaatcctctacttttacctactttttcccaactctctcagtctcagcgagcgagtcgccataatcaaaggcacatatgaacccgatgaagactgggaggagcagagggaggaaagaaagaaaaccatggagttgactacaaga

SEQ ID NO: 6576 - DNA, 795 bp, Artificial Sequence
  Description of Artificial Sequence: Synthetic coding sequence
atgaaaaaagaagtatgtagtgtagcattcttgaaggccgttttcgccgagttcctggcgactttaatctttgttttttttggacttggctctgctttgaagtggccaagcgcactgcctacaattctccaaattgccttagcattcggcctcgcgatcgggaccttggctcaggcccttggccctgttagcggtgggcacatcaaccccgccataactctggcactgcttgtgggaaatcagattagtctcctccgggctttcttttacgtcgccgcgcaactcgtcggggctatcgctggagcaggtatcctgtacggcgtggctcccctgaacgcccgcggcaatttggccgtgaacgctcttaataacaatacaactcagggacaggccatggtggtagagctgatcctgacgttccagctggccctatgcatttttgcctctacagactctcgtaggacctcaccagtgggctcgcccgcactcagcatcggcctttctgtcacactgggccacctcgtgggcatttatttcacgggatgctctatgaaccctgctcggagctttgggccggcagttgtgatgaaccgattctccccagcccactgggtcttctgggtcggacctatagttggagctgttctggcagctatcttatacttttaccttttattccctaattctctctcactttccgagagagtggccatcattaagggtacttacgaacccgatgaggactgggaagagcaacgtgaggaacggaagaaaacaatggaattaaccacaaga

SEQ ID NO: 6577 - DNA, 795 bp, Artificial Sequence
  Description of Artificial Sequence: Synthetic coding sequence
atgaagaaggaagtgtgttctgtggcatttctgaaggcagtttttgcagaatttctggcaactctgattttcgttttctttggactgggctcagcactcaagtggcccagcgcccttcctaccatccttcaaatcgctctcgcctttggacttgcgatcggaactcttgcgcaggcgctcggccctgtgtcaggtggacatatcaatcctgcaattaccttggcactgcttgtggggaaccagatttcgctgcttcgtgccttcttttacgtggcggcacagcttgtgggagcaatagcaggggcagggattttgtacggtgtggcccccctcaatgcccgtggtaacctggctgttaacgcactcaataacaatactacccagggccaggcgatggtggtggaacttatcctcacgttccaacttgccctctgcatatttgcatcgactgattccaggcgcacctcaccagtgggttcgcctgccctgtcaattggtctgtcggtcactctcgggcacctcgtgggaatctactttaccggttgtagcatgaatcccgctcgttcttttggtcccgccgtcgtgatgaaccgcttctcacctgcacattgggtcttttgggtcggacctattgtgggggctgtccttgcagcaattctttacttctacctgctgttccctaattccctctcgctttccgaaagagtcgcaatcattaaaggcacttatgaaccagacgaggattgggaggaacaacgggaggaaaggaaaaagacgatggagctcaccaccaga

SEQ ID NO: 6578 - DNA, 795 bp, Artificial Sequence
  Description of Artificial Sequence: Synthetic coding sequence
atgaagaaggaagtgtgtagcgtcgcgtttctcaaggctgtgttcgccgaatttcttgcgactctgatattcgtgttttttggtctgggatctgccttgaagtggccttcagcactgccgacgattctccaaatcgcgcttgcctttggccttgcaatcggaacccttgctcaggctcttggcccagtgagtggagggcatatcaaccctgctatcacccttgcactgttggttggcaatcagatatcgcttctgcgcgccttcttttacgtcgcagcacaactcgtgggagcaattgcaggagcaggtatcctgtacggagtggcacctctgaatgcaagaggcaatcttgcagtgaacgccctgaacaacaacactacccagggtcaagccatggtcgtggaactcattttgacgttccaactggctttgtgcatttttgcgagcaccgactcgcgacgtactagccctgtcggcagtccagcactgtcaattggcctgtctgtgactcttggacacctcgtggggatttactttactggttgttcaatgaatcccgcacggagcttcggtcccgcagtcgtcatgaaccgcttttccccagcgcattgggtattctgggtgggaccaatagtgggtgccgtgttggctgccattttgtacttctatcttctctttcccaactcactctcgctctcggaacgggtcgcaatcattaaagggacctacgaacctgatgaagattgggaggaacaacgagaggagaggaagaaaacgatggagctgaccactaga

SEQ ID NO: 6579 - DNA, 795 bp, Artificial Sequence
  Description of Artificial Sequence: Synthetic coding sequence
atgaagaaggaggtctgttcggtggcatttctcaaggccgtgtttgctgagtttctggctacgctgattttcgtgttttttggacttgggtccgcgctgaagtggccaagcgcactgccgactattcttcaaatcgcgctggcttttggactggcaatcggtactctcgcccaagctctcggcccagtgtcgggtggccacatcaatccagcaataaccttggcacttctcgtcggaaaccagataagccttttgagagcgtttttctacgtcgcggcacagctggtcggagccattgcgggtgccggtattctgtacggtgtcgctccacttaacgctcgcggtaaccttgcggtgaacgctttgaataacaataccacccagggtcaagcaatggtggtggaactgattctgaccttccagctcgccttgtgcattttcgcatccactgatagcagaaggacttcgcccgtcgggtcccctgcactttcaatcggattgtcagtgactcttggtcatctggtgggaatctactttaccggatgttctatgaatcctgcacggtcgtttgggccagccgtggtgatgaatcgcttttcgcctgcacattgggtgttctgggtcggccccattgtgggcgcagtcctggcagctatcctgtacttctatcttctttttcctaacagtctttccttgagtgaaagggttgcaatcataaaagggacttatgaacctgatgaggactgggaggaacaacgcgaagaacgaaagaaaactatggagttgactactcgt

SEQ ID NO: 6580 - DNA, 795 bp, Artificial Sequence
  Description of Artificial Sequence: Synthetic coding sequence
atgaagaaagaagtgtgctcagtggcctttcttaaagccgtgttcgcagaattcctggccaccctgattttcgtgtttttcggccttggaagcgcactcaagtggccatccgcactgcctactattcttcaaatagcgctcgcatttggactggcaatcggaactctcgcacaggcacttgggcccgtgtcgggcgggcacattaatcctgcaatcactcttgccctccttgtcgggaaccagatctcattgcttagagcgtttttctacgtcgcagcccaacttgtgggagcgatcgccggagcaggaattctgtatggggtcgcacctcttaatgcacgcggtaatctggcagtcaatgcgctgaacaacaataccacccagggacaagccatggtggtggaacttattctgacgtttcagcttgcactctgtattttcgcttcgaccgattcccgccgtacctcccctgtgggttcgcctgctctttcgattgggctcagtgtgaccttggggcatcttgtcggaatatacttcaccggttgctccatgaatcctgcccgttcgtttggcccagcggtggtgatgaaccggtttagccctgcacattgggtcttttgggttggaccaattgtcggcgcagtgctggcagcaatcctgtacttttacttgctgttccctaactcccttagcttgtcagaacgggtggcaatcattaaagggacctacgaacctgatgaggattgggaggaacaacgcgaagaaagaaagaaaaccatggaacttaccaccagg

SEQ ID NO: 6581 - DNA, 795 bp, Artificial Sequence
  Description of Artificial Sequence: Synthetic coding sequence
atgaagaaggaagtgtgtagcgtggcctttctgaaagcagttttcgccgagttccttgcgacactcatctttgtattttttggactgggtagtgcactgaaatggccgagtgccctgcccacaatcctgcagattgccttagccttcggattagccataggtacgctggcccaagccctgggcccagtctccggagggcatatcaaccctgctattaccctggcactcctcgtcggtaaccagatatctctgctcagggccttcttttacgtggcggcacagctcgtaggggcaattgccggtgctggcatactgtacggcgtcgccccactgaacgcccgcggtaacctcgccgtcaacgctcttaacaacaatactacacaagggcaggcgatggtggtggaacttattctcactttccagctggcgctctgcatctttgcctcaaccgactccagacggacttcccccgttggttcccccgcactgagcatcgggttgagtgtgacactgggacatctggtgggcatttatttcactggatgtagcatgaatccagctaggtcattcggtcccgccgtggtgatgaacaggttcagtcctgcacactgggtgttttgggtgggcccgattgtgggagcagtgctggcagccatcctgtacttctatttgctgttccctaatagtttgtcgctgagcgaacgagtcgccatcattaagggaacatatgagcccgatgaagattgggaagagcaacgggaggagaggaaaaagaccatggaactgaccacacga

SEQ ID NO: 6582 - DNA, 795 bp, Artificial Sequence
  Description of Artificial Sequence: Synthetic coding sequence
atgaagaaagaggtgtgttcagtggctttcctgaaagccgtcttcgccgaattccttgcgacactgatcttcgtgttctttggattgggctctgcgctgaagtggccttccgctttgccaacaatcctacaaatcgcattggcgtttggactggcaatcggtaccctcgcacaggcactggggcctgttagcggcgggcacataaaccctgcaataacacttgctctactagttgggaatcagatcagtttgctccgggctttcttctatgtcgccgcccagctggtcggcgcaatcgctggggccggaattttatatggggtggcccccctgaacgccaggggtaacctggcagtaaacgctctgaacaataataccactcagggacaagccatggtggtggaacttatcttaacctttcagttggctttatgcatcttcgctagcacagactctcggaggacatcccctgtcggttccccggccctgagcatcggcttgtctgtgacacttgggcatcttgtagggatctattttacaggttgtagcatgaacccagcacggtcttttggaccggccgtggtcatgaaccgcttttcccctgctcactgggttttttgggtgggccccatcgtgggagccgtgctggccgcaattctgtacttttatctgttatttccaaatagtctgtctctctctgagcgggtggccataattaagggtacttatgaacccgacgaggattgggaagagcaacgtgaagagaggaaaaaaacaatggagttgactacgagg

SEQ ID NO: 6583 - DNA, 795 bp, Artificial Sequence
  Description of Artificial Sequence: Synthetic coding sequence
atgaagaaagaggtgtgttcggtggcgtttcttaaggctgtgttcgcagagttccttgcgaccctgatcttcgtgtttttcgggcttgggagcgcactcaaatggccttccgcactgccaaccatcctgcagattgccttggcatttggattggcaattggaactctggctcaagcgctgggtccggtgtcaggcggacatatcaaccctgcgatcactttggcacttctggtgggcaatcaaatttccctgcttcgcgcatttttctacgtggcagcccagctcgtgggagctatagcaggtgccggaatcctctacggtgtggcacccttgaacgcaagaggtaatctggccgtcaacgcactcaataacaacaccactcagggacaggcaatggtcgtggaattgatccttacgtttcaactggcactgtgcatttttgccagcaccgattccaggcggacctccccggtggggtcaccggccctgtctattggactgtccgtgaccctgggccatcttgtgggcatctacttcaccggctgttcgatgaatcccgcacgctcattcggccccgcagtcgtgatgaacagatttagcccagcacactgggtgttttgggtggggcctattgtcggagcagttctcgcggccatcctttacttctaccttctttttcccaattcgctttccctctcagaacgggtggccataatcaagggaacctatgaacctgatgaagattgggaagagcagagggaggagcggaaaaagactatggagctcaccacccgc

SEQ ID NO: 6584 - DNA, 795 bp, Artificial Sequence
  Description of Artificial Sequence: Synthetic coding sequence
atgaaaaaggaagtgtgctccgtggcgtttcttaaggccgtgttcgccgagtttctggcaaccctcatttttgtgttttttggcctcggctccgcacttaagtggccatcggctcttcctaccattctgcagattgcccttgcattcgggttggccattggcaccctggcgcaagctctcggtcctgtcagcgggggtcacattaacccagccattactctggctctgctggttggtaaccaaatcagcctcctgagggcttttttctacgtggcagcacaactggtgggagcaattgcaggagctgggattctttacggtgtcgcccctctgaatgcccggggcaaccttgcagtgaacgccctgaacaacaacacgactcagggacaggcaatggtggtcgagctgatcctcacttttcaacttgcattgtgcatttttgcatcgactgatagcagaagaaccagcccggtcggttcacccgcgctttcaattggactctcagtcactctggggcacctcgttggaatctacttcaccggttgctcaatgaatccagccaggtcttttggacccgcggtggtgatgaaccgattttctcctgcacattgggtgttttgggttggccctatcgtgggagcagtgctggccgcaattctgtacttttatctgctttttccaaactcactgtcgctcagcgaaagagtggcgatcatcaaggggacgtacgagcctgatgaggattgggaagaacaaagagaagaacgaaagaaaaccatggagttgacgactaga

SEQ ID NO: 6585 - DNA, 795 bp, Artificial Sequence
  Description of Artificial Sequence: Synthetic coding sequence
atgaagaaggaggtgtgttcggtggctttcctgaaggcggtgttcgccgagtttcttgcaactctgatattcgtgttttttggcctcggttcagccctcaaatggccttccgcactgcctaccattcttcagatagcacttgcctttggattggctatcggtactctggcacaagcactgggaccagtcagcggtggacacatcaatccagccattaccctggcactcctggtgggaaaccaaatttcccttctgagagccttcttctacgtggcagcgcagctggtgggagctattgcgggggctggtattctgtacggtgtggcccctcttaatgctagggggaatcttgcagtgaacgcactgaacaacaacactactcagggacaagcaatggtggtcgaactgattttgacctttcagcttgccctgtgtatctttgcatcgactgattcgcgtcgtacttcgccagtgggaagccctgccctgagcattggactgtcagtcactctgggtcatctcgtcggtatttacttcactggttgctcgatgaatcctgcccgctcatttggaccagcggtggtgatgaaccggttttcaccagcccattgggtgttttgggtcggtcctattgtcggggccgtgctcgcggcaattctctacttctacctcctgttcccaaactccctgagcctgtcggaaagagtggcgattatcaagggaacctacgagcctgatgaagattgggaagaacagcgcgaggagaggaagaaaaccatggaattgaccactaga

SEQ ID NO: 6586 - DNA, 795 bp, Artificial Sequence
  Description of Artificial Sequence: Synthetic coding sequence
atgaagaaagaggtttgctctgtggcctttctgaaggccgtgtttgccgagtttctcgctaccctgatctttgtgttctttggcctgggctctgccctgaaatggcccagcgccctccccacaatccttcaaatcgccctcgcctttggcctggccatcggaactctggcccaggctttgggccctgtgagtggtggccatattaacccagctattaccctggctctcctggtaggcaatcagatctctctcctgcgggctttcttctacgttgcagcccagctggtgggcgctatcgctggcgctggcattctttatggggtggcccctcttaatgccagggggaaccttgcagtgaacgccctcaacaacaataccacccagggacaggccatggtggtggagctgatcctgaccttccaacttgccctctgcatttttgcttccactgactctcggaggaccagtccagtgggttctcctgctctgtccattggcctgtctgtcactctgggccacctcgtcggcatttatttcaccggttgttccatgaaccccgcccgcagcttcggacccgcagtagtgatgaacagattttctccagcacactgggtgttctgggttggacctatcgtgggtgctgttctggcagcaatcctctatttttatctgctgttccctaactctctgagcctgtcagaaagagtcgctatcataaaggggacttacgagcctgatgaagactgggaagaacagagggaagaaagaaagaaaacaatggaactgacgacgcgg

SEQ ID NO: 6587 - DNA, 795 bp, Artificial Sequence
  Description of Artificial Sequence: Synthetic coding sequence
atgaaaaaggaggtgtgtagtgtggcctttttgaaagccgtatttgccgagttcctggcaaccctgatttttgtgttctttgggctgggaagtgcgctgaagtggccatcagccctgcccacaatcctccagatcgctttggcattcggcttggccatcggaaccctggcacaggccttgggcccagtctccggaggccatattaatcctgcgataaccctggccctgctggtgggcaaccaaatctcccttctgcgagccttcttctacgtcgccgcacagctggtgggcgctatcgcgggagctggtatcttgtacggcgtggcaccgctgaacgccaggggcaatctcgcagttaatgcacttaataataacaccactcaaggccaagcaatggttgtagagctcatcctgacgttccagctggcactgtgcatcttcgccagcacggactccaggaggacttctcccgtcggctcacctgccctgtcaatcggtctgagcgttactctgggacacttggttgggatttacttcacaggctgtagtatgaatcctgcgagaagctttgggccggcagttgttatgaatagattcagtcccgctcactgggtgttctgggtaggacccattgtcggagctgtgctggccgccattttgtacttttatctcctttttcctaattccctgtctctgtctgaacgcgtagcaattattaagggaacatatgagccggatgaggattgggaggagcagagggaagagcggaagaaaaccatggagctgaccacacgg

SEQ ID NO: 6588 - DNA, 795 bp, Artificial Sequence
  Description of Artificial Sequence: Synthetic coding sequence
atgaaaaaggaggtatgctcagtggcatttctcaaggccgtgttcgcagaattcttggctaccctgatctttgtgttctttggactggggtctgcattgaagtggccaagtgctttacctaccatccttcagatcgctctggcctttgggctggcaattggtaccctcgcccaagcacttggtccagtctctggaggccatataaatcccgctatcactctcgctttgttagtggggaaccaaatctcactgctgagggcatttttctacgttgcagcccaacttgtgggcgcaatcgccggagccggtatcctgtatggagtggctcctcttaatgcaagagggaacctcgctgtgaatgcccttaacaacaacactactcaaggacaggctatggtggtggagttgattctgaccttccagctggctctttgtatctttgcgtcgaccgactcgaggcgaacatctccagtcggaagccccgcactgtctatcggcctttccgtcaccctgggccatctggtggggatctactttaccgggtgctcgatgaaccctgcacgcagctttggacctgctgtagtgatgaacagattttctccagctcactgggtcttctgggtgggaccaattgtcggggcagtgctggccgcaatattgtatttctatctccttttccctaactctctgtcattgagtgaacgagtggctatcattaaaggcacctacgagccagacgaagattgggaagaacagagagaggagaggaagaaaacaatggaacttaccactcga

SEQ ID NO: 6589 - DNA, 795 bp, Artificial Sequence
  Description of Artificial Sequence: Synthetic coding sequence
atgaaaaaggaagtttgttccgtggccttcctgaaagcagtctttgccgaattccttgccacattgatattcgtgttcttcggtctgggctccgcccttaagtggccaagcgccctgcccaccatccttcaaatcgcgcttgctttcggtctggcgatcggaacattagcccaagccttaggtcctgtgtccggcggacatataaatccagcaattacactggcccttcttgtggggaatcagatctcactcctacgggcctttttctacgtggctgcccagctggtgggggcgattgccggagcaggcattctgtacggagtcgcccccctgaacgccagggggaacttagcagtgaacgccctcaataacaacaccacacagggacaggcaatggtggtggagcttatcctcacttttcaactcgcactttgcatctttgctagtaccgactcaaggagaacatcccccgttggatctcccgcattgagcattggtctgagtgtgactttggggcaccttgtgggcatttactttaccggctgtagcatgaacccggcgcgatcttttggccccgctgtagtgatgaaccgcttctcaccagcgcactgggtgttctgggtcggcccgatcgtaggggcagtacttgccgcaatcctgtatttctacctgctgtttcccaactccctctccctgagcgagagggtcgcaatcatcaagggtacatatgaacctgacgaggactgggaagaacagcgcgaggagcgaaagaaaacaatggagcttaccacccgt

SEQ ID NO: 6590 - DNA, 795 bp, Artificial Sequence
  Description of Artificial Sequence: Synthetic coding sequence
atgaagaaggaagtgtgttcggtggcatttttgaaggctgttttcgctgaatttttggctactctaatcttcgtgtttttcggactggggagcgcgcttaaatggccatcggcactgcccaccatcctacagattgccctagcttttggacttgccatcggaacgctagcacaggcactgggacccgtgagcggcggccatatcaatcctgccatcaccttagcgctcctggtcgggaaccaaataagcctattgcgcgccttcttttacgtggccgcccagctggtgggggcgatcgccggggctggcatcttgtatggggtcgctcctctgaacgcacgcggtaacctggccgtaaatgcactgaacaacaacactacacaggggcaggccatggtggtggagctaattcttacatttcagctggcactgtgcatcttcgcatctaccgattcccgacgtacttctccagtcggatcacctgctctgtcaattgggttgtccgtgaccttgggacacttagtaggcatctactttacaggctgtagcatgaatcctgcgcgctcattcgggccagctgtcgtgatgaatagattttcccctgcccactgggtgttctgggtcggtcccatagtcggtgcggttttggctgctattctctatttctacctgcttttccccaatagcctgtctctgtcggagcgggttgcaatcattaaaggaacttacgagccagatgaggattgggaagagcagcgagaggagcgtaaaaaaactatggaacttaccacacgg

SEQ ID NO: 6591 - DNA, 795 bp, Artificial Sequence
  Description of Artificial Sequence: Synthetic coding sequence
atgaagaaagaggtgtgctccgtcgcgttcctgaaagccgtgttcgccgagttcctcgcaactctgatcttcgtgttcttcggactgggatccgcccttaagtggcctagcgctcttcctacgatcttgcaaatcgcccttgctttcgggctggcgattgggaccctcgcccaggccctgggtcccgtcagcggaggacacattaacccggccatcactctcgcactgctcgtcggtaatcagatttcgctcctcagagccttcttttatgtggccgcacagctcgtgggagctatcgcaggtgccggtatcctgtatggcgtcgcaccacttaacgcgaggggcaaccttgcggtgaatgctctgaacaacaatacgacgcagggacaggcaatggtggttgagcttatcctgacctttcaactcgccctgtgtatctttgcttcaaccgattcgcgcagaacttcgccggttggctccccagcgctcagcatcgggctctcggtcactctgggtcacctcgtcggcatctatttcaccggatgctccatgaaccccgctcggagcttcggtccggccgtcgtgatgaatcggttttcgcctgcgcattgggttttctgggtgggtcctattgtgggggcagtgctggccgctatcctgtacttctacctgctctttcctaacagcctgtcgctgtcagaacgagtggctatcatcaaaggcacttacgagccggacgaggattgggaggaacagcgtgaagaacgcaagaaaaccatggaacttactacccgc

SEQ ID NO: 6592 - DNA, 795 bp, Artificial Sequence
  Description of Artificial Sequence: Synthetic coding sequence
atgaaaaaagaagtgtgttcggtcgcatttctgaaggccgtgtttgctgagttcctggccacactcatctttgtcttttttgggctagggtcagctctcaagtggccatctgccctgccaactatcctccagatagcactcgcattcggcttggcaattggtacactggcgcaagctctcgggccagtgagtggcggacacatcaatccagccatcactctggcgctgttggttggcaatcagatcagcttactgcgcgcttttttctacgtggccgcccagctggtcggagccatcgccggggctggaatcctgtacggtgtcgcccctctgaacgcccgcggcaatttagccgttaacgcccttaacaacaataccacgcaggggcaagcaatggtcgtggaactcatactgacattccagctggctttgtgcattttcgcaagtaccgatagccgacgcaccagcccggtcggctcacccgcattgagcattggcctgagcgtgacacttgggcatctggtcggaatctacttcaccgggtgcagcatgaatcccgcgcggagctttggcccagctgtggtgatgaacaggttcagtcccgcacactgggttttctgggtgggtccgatcgttggagcggtcctggctgctatcctttatttctatcttctgtttccaaactcattgtctttatctgaacgggtggccatcattaaggggacctacgagcccgatgaagattgggaggaacagcgagaagaaagaaagaaaactatggagttgactacgcga

SEQ ID NO: 6593 - DNA, 795 bp, Artificial Sequence
  Description of Artificial Sequence: Synthetic coding sequence
atgaagaaggaagtgtgttccgtggcatttctgaaggccgtgtttgcggaatttcttgcgacccttatcttcgtgttttttggactcggttctgcactgaagtggcctagcgctctgcctactattctgcagattgcacttgcctttggactggcaattggaacgctggcgcaagccctgggtcctgtgtctggcggccacatcaaccctgcaattaccctggcacttctggtgggcaatcaaattagccttttgagagcattcttttacgtggccgcccaactcgtgggggcaatagcaggtgcaggtattctctacggggtcgcacccctgaacgcacggggcaatctggcggtgaacgctctcaacaataacactactcaaggtcaggcaatggtcgttgagcttattctcacctttcagctggccctttgtattttcgcatcgaccgactcaaggaggacttcgcccgtgggttcgccagcactctctattgggttgtcggtgaccttgggacatctcgtgggcatttactttaccggttgctccatgaacccagccaggtccttcggacctgccgtggtgatgaataggttttcgcctgcccattgggtgttttgggtcggacctatcgtcggcgcggtgctcgcagcgattctgtacttctacctcctctttccaaattcactttcgctttccgaacgggttgcgatcattaagggaacgtacgaaccggacgaggattgggaagaacagcgcgaagagcgaaaaaagactatggaattgaccactagg

SEQ ID NO: 6594 - DNA, 795 bp, Artificial Sequence
  Description of Artificial Sequence: Synthetic coding sequence
atgaagaaggaggtctgttcagtggccttccttaaggccgtgtttgcggagttcctggcaactctcatttttgtgttctttggtcttggatccgctctgaagtggccatccgcccttccaactattctgcagattgccctggcttttggccttgcaattggtaccctcgcccaagcactgggacctgtgtccggcggtcacattaaccccgctattaccctggctctcctggtgggtaaccagatatcgctgctgagagctttcttctacgtggcagcacagctggttggagcgattgcaggagcaggcattctttatggagtggcacccttgaatgcacgcggtaacctcgcagtgaacgcactcaacaacaataccactcaaggtcaggcaatggtggtggaactcatcctcacctttcagctggccctttgcatattcgcatcgaccgattccagacgaacttcgcctgtgggatcgccagcgctgtccataggactctcggtgactcttggccacctggttggcatttacttcactggttgctcgatgaaccccgcacggagctttgggcctgctgttgtgatgaatcgattttcgcccgcccattgggtgttctgggtcgggccaattgtcggagccgtgcttgcagccattctgtacttttacctgctgtttccaaactcgctgtccctctcagagagagtggcaatcatcaagggaacctacgaaccagacgaggactgggaagaacaaagagaagaaaggaagaaaaccatggaactcaccacccgc

SEQ ID NO: 6595 - DNA, 795 bp, Artificial Sequence
  Description of Artificial Sequence: Synthetic coding sequence
atgaagaaggaggtgtgctccgtggcgtttctcaaggccgtattcgctgaattcctcgcgaccctgatcttcgtgttcttcgggctgggcagcgcgctgaaatggccgtcagctctgccaaccatcctccagatcgcgctggcttttggcctggccatcggaacgctcgcccaagcgctcggacctgtctctggaggacatatcaacccagcgatcaccctcgcccttctggtcggcaatcagattagcctcctcagagctttcttttacgttgccgcccagctggtgggtgccatcgctggagcgggaatcttgtacggagtggctccattgaacgcccgcggaaacctggcagtaaatgccctgaacaataacacgactcagggacaggctatggtggtggaacttatcctgacttttcagctcgcattgtgcatcttcgcctcaactgattcccggcgcacttcgccagtgggaagcccggcgctgtccatcggactgtctgtgactctggggcatctggtgggcatctactttaccgggtgctcaatgaacccagcccggtccttcggtccagcggtcgtgatgaatcggttcagccctgctcactgggtgttttgggtcggcccgattgtgggagccgtgctggcggccatcctgtatttctacctcctgtttccgaactcgctgtccctctcggaaagagtcgcaatcattaaagggacctacgagccagacgaggactgggaggaacaacgcgaggaacgcaagaaaacgatggaactgactactaga

SEQ ID NO: 6596 - DNA, 795 bp, Artificial Sequence
  Description of Artificial Sequence: Synthetic coding sequence
atgaaaaaggaagtctgttcagtggctttcctgaaggcggtgtttgcagagtttctggccactctcattttcgtgttcttcggcctgggctcggccctgaagtggccatcggcccttccaaccatcctccagattgccctcgcttttggattggcgatcgggacgctcgctcaagcactcggaccggtttcgggcgggcatatcaatccggccatcaccctggccctgctggtcggtaaccagatctccctgctcagagcgttcttctatgtggccgctcagctggtgggagctatagcgggagctggcatcctgtacggtgtcgcccctctcaatgcacgcggaaatctggcggtgaacgccctgaacaacaatactacccaaggacaggcaatggtggtggaacttatcttgacctttcaactggccctgtgcatcttcgcctccactgacagccgacggaccagcccggtgggatcgcccgcgctgtccatcgggcttagcgtgactctgggacaccttgtcggaatttacttcaccggctgctctatgaaccccgcccgctcattcggaccagcagtcgtgatgaacaggttttcccctgcccactgggtgttctgggttggcccgatcgtcggtgccgtgctcgcggcaatcctgtacttctacctgttgttccctaactcactcagcttgtcggagcgggtggcgatcatcaagggaacgtacgaaccggatgaggactgggaggaacagcgcgaggaacggaaaaagactatggaactcactaccaga

SEQ ID NO: 6597 - DNA, 795 bp, Artificial Sequence
  Description of Artificial Sequence: Synthetic coding sequence
atgaagaaggaggtctgctccgttgccttcctgaaggcagtctttgcagaatttctggccaccttgatatttgtattttttggactgggctccgctctcaaatggccgtctgcactccccacaattctgcaaatcgctctcgccttcggcctcgccattggtacactggcgcaggcacttggtcctgtgtctggcggtcacatcaacccggcaatcactctggccctgctcgtgggaaatcagatctcccttttgcgcgcatttttctatgttgctgcccagctggtcggcgctatcgccggcgccggaatcctctacggtgtggctccactgaatgctaggggcaacctggctgtgaacgcgcttaacaacaacacgacacaaggccaggctatggtcgtggagttgatcctgacgtttcagcttgcactgtgtatcttcgcctctacggacagtaggaggaccagtcccgtgggcagtcccgccctgagcatcggcctgtccgtgacgctcggtcaccttgtgggtatatacttcactggttgctccatgaacccagcccgcagctttggtcctgcagttgtcatgaatagattctctcctgcccactgggtgttttgggttggccccattgtcggcgctgtcctggctgccatcctgtacttttacctgctgttccccaattccctcagtctgtctgagagagtagccattatcaaaggcacatacgaaccagacgaagattgggaggagcagcgcgaggaaagaaagaagacaatggagctgaccactaga

SEQ ID NO: 6598 - DNA, 795 bp, Artificial Sequence
  Description of Artificial Sequence: Synthetic coding sequence
atgaaaaaggaagtatgtagcgtggcctttctcaaggctgtgttcgcggagtttcttgccacactgatcttcgtgttctttggcctggggtctgctctcaagtggccgagtgcgctgccaactattctacagatcgcactcgcattcggtcttgccatcggcaccttagcccaggcactcgggccagtgtcgggtgggcacattaaccctgccattacgctggcgttactggtggggaatcagattagtctgctgagagctttcttttacgtggccgctcagctcgtcggggcgatcgccggagctggcatactgtacggcgtcgccccacttaacgcacgcggaaatttggcggtgaacgctctaaataataatacgacacaggggcaagctatggtagttgagctgatcctcacgttccagctcgctctttgtatattcgcgagcacggactccaggaggacatctccggtcggaagtcccgctctaagtattggactgagcgtcacactggggcatctagttggtatctacttcaccggttgtagtatgaatcccgcacgcagtttcggtcctgccgtggtcatgaataggttttctcccgcacattgggtattttgggtgggaccgatcgtgggggctgtgctggccgctatcctttatttctacctgctgtttcccaacagtctctctctttcagagagggtagccatcatcaagggtacttacgagcctgatgaagattgggaggagcagagggaggaaagaaagaaaactatggaactgactacacga

SEQ ID NO: 6599 - DNA, 795 bp, Artificial Sequence
  Description of Artificial Sequence: Synthetic coding sequence
atgaaaaaagaggtttgttctgttgccttcctgaaggcggtttttgcggaattcctggcaacattgattttcgtcttcttcggattgggatcagctttgaagtggccaagcgccctcccaacaattctccagatagcacttgcttttggactcgcaattggtactctagcgcaggctctcggaccagtgagtggcggccacatcaatccggcaataacgctcgcacttctggtgggaaaccagatatcactcctccgagcatttttttacgttgcagctcagctcgtgggggctattgcaggagcaggtatcttgtacggcgtggcccctctaaacgcaagaggaaatctcgctgtaaacgccttgaataataatacaacacagggacaggccatggttgtcgaattgatcctcactttccaattggctttatgtattttcgcgagtacggactcgcgtcggacgtctccagtcggaagtccagcactctcaatcggactgagcgtgaccctaggtcaccttgtgggtatttacttcacaggatgttccatgaacccagcccgtagttttggaccagcagtagttatgaatcgtttttcaccagctcactgggtgttctgggtgggtccaattgttggagcagtattagcggctattctctatttttatctacttttcccgaactctttatcattgtctgaacgtgtggctattattaagggaacgtacgagccagatgaagactgggaagaacaaagagaggagcgtaagaaaacgatggaactcactacaaga

SEQ ID NO: 6600 - DNA, 795 bp, Artificial Sequence
  Description of Artificial Sequence: Synthetic coding sequence
atgaagaaggaagtgtgctctgtcgccttcctgaaggcagtattcgccgagttcctagccaccctaatctttgtttttttcgggctgggctctgctctgaagtggccctctgcgttacctacaattcttcaaattgcgctggccttcgggctggcaattggaacgctggcacaggctctcggaccagtaagtggcggccacataaaccccgcaattaccctggccctacttgtcggtaaccagattagcctactgagggcgttcttctacgtggccgctcaactggtcggagccatagccggcgcggggatattatatggcgtcgctcctctgaacgcccgagggaacctggccgtcaacgcactgaataataataccacccagggacaggccatggtagtcgagctcatcctgacattccagcttgctctctgcatctttgccagcactgattctaggcgaaccagccctgttggctcgccggccctctccatcgggctttccgtcactctggggcacctcgtgggcatttacttcaccgggtgcagcatgaatcctgcaaggtcctttgggcctgccgtagttatgaatcgattctcccccgcccactgggtgttctgggtgggtcccatagtgggcgcggtacttgcagcaattttatatttttacctattgtttcctaacagcctgtctttatccgagcgagtggctatcataaagggaacttacgaaccagacgaagactgggaggagcagcgagaggaaaggaagaaaacaatggagcttaccaccaga

SEQ ID NO: 6601 - DNA, 795 bp, Artificial Sequence
  Description of Artificial Sequence: Synthetic coding sequence
atgaagaaggaggtgtgctcagtggcatttctgaaagcggtctttgcggaattcttggcgaccctgatttttgtgtttttcggtctgggttctgccctcaaatggcccagtgcgctccccacgattcttcaaatcgccttggcgtttggacttgcgataggtactctggcccaagctcttggaccagtctcagggggtcacatcaacccagccatcacactggcccttcttgtgggtaaccagatttccttgctgcgcgcattcttttatgtcgccgcccagctggtcggagctatcgctggcgctggtattctgtacggggttgccccactgaacgcccgcgggaatctcgcggtgaatgctctcaataacaatactacccagggacaggctatggttgtcgagctgatccttacctttcaattggccctgtgcatttttgcgagcacggattctaggagaacgtcccctgtgggtagtcccgcactgtctataggcctcagcgtgaccctgggacatctggtggggatatactttacaggatgttccatgaaccccgccaggagcttcgggcccgcagtggtgatgaaccgcttttctccagcacactgggtcttttgggtgggacccattgtaggcgctgttctggctgcaatcctctacttttatctcttgtttccgaattctctctctctcagcgagcgcgttgcaattatcaagggcacttatgagcccgacgaagactgggaagagcagcgggaggagcggaagaagaccatggaactgactacccgc

SEQ ID NO: 6602 - DNA, 795 bp, Artificial Sequence
  Description of Artificial Sequence: Synthetic coding sequence
atgaaaaaggaggtgtgcagcgtggcgttcttgaaggcggtgttcgcagagttcttggcgactctcatcttcgtctttttcggcctcggatcggccctgaagtggccgtccgctctgccgacgatcctccaaattgccctggcgtttggactggccatcggcactctcgctcaggccctgggaccggtgtcaggaggacacatcaaccctgcgatcactctggccctgctcgtgggcaaccaaattagccttcttcgcgcctttttctacgtggctgcacaattggtcggagcaatcgccggtgctggcatcctctacggagtggcccctcttaatgcacgcggtaatttggctgtgaacgcgctgaacaataacaccacccaggggcaggcaatggtggtggaactgatccttacctttcagctggctctgtgtatcttcgcatcgaccgattcgagacggacctcacccgtgggttcaccggcactctcgatcggtctgtcggtgactcttggacatctggtggggatctatttcaccggatgctccatgaatccggcccggagctttggaccagcggtcgtgatgaatagattttcgccagctcactgggtgttctgggtgggacctatcgtgggagcagtgctggctgcaattttgtacttctacctcctgttccctaacagcctgtcgctctcggaacgcgttgcgatcatcaagggtacctacgagccagacgaggactgggaagagcaacgggaggagagaaagaaaacgatggaactcactaccaga

SEQ ID NO: 6603 - DNA, 795 bp, Artificial Sequence
  Description of Artificial Sequence: Synthetic coding sequence
atgaagaaagaggtctgctcagtggcattccttaaggcggtgtttgcagaatttctcgcgaccctcatctttgtgtttttcggtcttggaagcgctctgaaatggccttccgcgctcccgactattcttcagatcgctttggcatttggattggctatcgggacgttggcccaggcgcttggccctgtcagcgggggacacattaatcccgcaattactctggcactgctcgttggtaaccaaatatcactgctccgtgcctttttctacgtggcggcccagctcgtcggggcaattgcaggcgccggaatattgtacggtgttgcaccactgaacgcaaggggaaacctggctgtgaacgcactcaataacaacactacccaaggacaagccatggtggtggaacttattcttacttttcaactcgccctgtgtatcttcgcgtccactgatagtcggcgcacctctccagtgggatcgcccgctctttcgatcggcctttcggtcaccctgggccacctcgttggaatttactttaccggatgcagcatgaatcctgcgaggtccttcggacctgctgtggtgatgaacaggttttccccagcacattgggtgttctgggtgggtcctattgtgggtgcggtgctggcagcgatcctgtacttctatctcctctttccaaattccctttctctgtcggaacgggtggcgatcattaaaggcacgtacgagccagacgaggattgggaagagcagagagaagagagaaagaaaaccatggaactgaccactagg

SEQ ID NO: 6604 - DNA, 795 bp, Artificial Sequence
  Description of Artificial Sequence: Synthetic coding sequence
atgaagaaggaagtttgctccgtcgcgtttctgaaggctgtgttcgcagaattcctcgcaaccctcatctttgtctttttcggcctgggatctgcgctgaagtggccttccgctctacccaccatccttcagatcgccctcgcttttggtctggcaatcgggactctcgctcaggccctgggacctgtatccggtgggcatattaaccctgcgatcacgctcgcactactcgtcggcaaccagatcagcctactgcgcgccttcttctacgttgcggcccagttggtgggtgccatcgcgggtgctggtattttgtatggggtagctccgctcaacgccaggggaaaccttgctgtcaatgccctaaacaacaacaccacccaaggccaagccatggttgtcgagctgattctcaccttccagctggccctttgcatctttgcttcaacggacagtcgtagaaccagcccggtcggctcgcctgctctcagtatcggcctgtctgtcaccctcggtcatttggttggcatttatttcaccggctgcagcatgaatcccgctcgatccttcggcccagcagtggtgatgaacagattcagcccggctcactgggtcttctgggttggtcccattgtcggagcggtgctggccgccatcctgtacttctatctgctttttcccaactcgctgagtttaagtgagcgcgttgccatcatcaagggaacttacgagccggacgaggactgggaggagcagcgtgaagagcgtaagaagaccatggagcttaccaccagg

SEQ ID NO: 6605 - DNA, 795 bp, Artificial Sequence
  Description of Artificial Sequence: Synthetic coding sequence
atgaagaaggaagtctgtagcgtggcgtttttgaaagctgtgttcgctgagtttctggccaccctgatcttcgtgttcttcggcctggggagcgccctcaagtggccctccgccctgccgacgatcctgcaaattgcgcttgcctttggattggccatcggaactctcgcacaggcgctgggacctgtatcaggaggccacattaacccggcgattaccctcgctctgttggtgggaaaccagatcagcctgctcagggctttcttttacgtggcggcccaactggtgggggctatcgcgggggcaggcatcctctatggggtcgcaccgctcaatgctcgcggtaacctcgctgtgaacgccctgaacaataacacgactcagggacaggctatggtcgttgaactgatcctcacgtttcaacttgcgctgtgcatattcgcctcgaccgattcgcggcgcaccagcccggttggttccccagcgctcagcatcggcctctcagtaactctggggcacctggtcggaatctacttcaccggttgctccatgaatcctgcccgatcgttcggacctgccgtcgtgatgaatcgtttctcccccgcccattgggtgttttgggtcggaccgattgtcggtgccgtgctggccgccatcctttacttctacctcctgttccctaactccctttcgctgtcagaacgagtggcaatcatcaagggcacttacgagccagacgaagattgggaggagcagcgcgaagaacgcaagaaaactatggaacttaccactcgg

SEQ ID NO: 6606 - DNA, 795 bp, Artificial Sequence
  Description of Artificial Sequence: Synthetic coding sequence
atgaagaaggaggtttgttcagtggccttcttgaaggccgtctttgcggaattcctggcaactctcatctttgtgttcttcggcctggggtcggccctgaagtggccgagcgcgcttcctaccattctgcaaatcgcgctggcgtttggactcgccatcggtactcttgcacaggcactcggaccagtgtcaggtggccacatcaacccggccatcacccttgctctgctcgtcgggaaccagattagcttgctgcgggcctttttctacgtcgcagcgcaactggtcggagccatcgcaggagcaggcattctgtacggagtcgcccccctgaatgctagaggcaacctggcagttaacgctctcaacaacaacaccactcaaggccaggctatggtggtcgaactgattttgacgttccagctggccctgtgcattttcgcgtccacggactcgcgcagaacttccccggtggggtcccctgccctctccattgggctgtctgtcaccctcggacaccttgtgggcatctacttcactggttgctctatgaatccggcgcgcagctttgggcccgcggtggtgatgaaccggttttcaccggcccattgggtgttttgggtcggaccaatcgtgggcgctgtgctggcggccatcctctacttctatctcctctttccaaattcactgagcctctccgagcgagtggccatcatcaagggcacctacgagccagacgaagattgggaagagcagagagaggagcgcaagaaaactatggagctgactacccgg

SEQ ID NO: 6607 - DNA, 795 bp, Artificial Sequence
  Description of Artificial Sequence: Synthetic coding sequence
atgaagaaggaggtatgttcagtcgcgtttttgaaagcagtgttcgctgagtttctggccactcttatttttgttttcttcggcctgggttccgctctgaagtggccctcggctctgcccactatcttgcagatagctctggcctttggattggccatcggtactctggcacaggccttgggacccgtaagtgggggacacatcaaccctgcaattaccctggccctgctggtggggaaccagatcagcctgctaagggcatttttctatgtcgccgcacaactggttggcgccattgcgggagcaggcatattgtatggtgttgcacccctgaatgcccgggggaacctagcagtaaatgcgctgaacaacaacacaacacagggccaggcgatggttgttgaactaatcctgacttttcagcttgcattatgcatatttgcctcaaccgattctcggaggacaagtcccgttggctccccagcactgtccatcgggctctccgtgaccttgggccatctagttggaatctattttaccggatgtagcatgaatccagccaggtctttcggccctgcagttgtcatgaatagattcagtccggcccattgggtgttttgggtagggcctatcgtgggcgccgtcttggctgccattctctatttctatttactgttccctaacagtttgagcctttctgagcgagtggctataatcaagggcacctatgagcccgacgaagactgggaggaacagcgcgaagagcgtaaaaaaaccatggaactaaccacaaga

SEQ ID NO: 6608 - DNA, 795 bp, Artificial Sequence
  Description of Artificial Sequence: Synthetic coding sequence
atgaagaaagaagtctgttcggttgcctttcttaaagcggtgttcgcagagttcctggcaaccctgatcttcgttttttttgggctgggtagcgcactgaaatggccatccgcactcccgactattcttcagattgctttagcattcggattggcgattggtaccttggcgcaggctttgggccccgtgagcgggggccatattaacccggccatcactctggcactgctggtcggtaaccaaattagcctgctccgcgccttcttctacgtggcggcccaactagtgggagctattgccggtgcaggcattctgtacggtgtcgcgcctctcaatgctaggggaaatctggccgttaacgcgctgaataacaatacgacccaggggcaagcaatggttgttgagctgatccttacgtttcagttggcgctgtgtatttttgccagcacggacagccgccgcacgagcccggtcgggagcccggctctgtccatcggtctcagcgttaccctgggccaccttgttggaatttattttactggttgtagcatgaatcctgcgcgcagcttcggcccagccgtcgtgatgaaccgtttttctccggcacattgggttttctgggtagggccaattgtgggagccgtgctggctgcaatcctgtacttctacctgctcttccctaacagcttgagtctgagtgagcgcgtggccattattaaggggacctacgagcctgacgaagactgggaagagcaacgcgaagagcgaaaaaagacgatggagttgaccacccga

SEQ ID NO: 6609 - DNA, 795 bp, Artificial Sequence
  Description of Artificial Sequence: Synthetic coding sequence
atgaaaaaagaggtatgttccgtagcatttctgaaagcggttttcgccgaatttttagcaaccttaatttttgttttttttgggcttggttctgcattaaaatggcctagcgcgcttccaacgatccttcaaattgcactggcctttggactagcgattggcacacttgcacaggcccttgggccagtttcagggggtcatattaatccggcaattactttggcattgcttgttggaaaccaaatcagcctgctcagagcatttttctatgtcgcagcgcagttggtaggcgcgatcgccggggccggaatcttgtatggggtcgctcctctgaacgcccgcggcaatttggcagttaacgcgttaaataacaatacaacacagggtcaggcgatggtcgttgaactcatcctgacattccagctggctctgtgcatttttgcttccacagattctaggcgtactagcccggtaggctcaccggcactttctattggcttgtcagtaacgcttggtcatctcgttggcatatatttcacaggatgctctatgaaccctgcgaggagcttcggaccggctgtagtgatgaatcggttttcacccgcgcattgggttttctgggttggtcctattgtgggagcagtcttggccgcgatattgtatttctatcttctttttccaaattccttatctctgtctgaacgggttgcgattattaaaggtacgtatgagcctgatgaggattgggaggaacaaagagaagaacgaaagaaaacaatggagctgacaacgcgg

SEQ ID NO: 6610 - DNA, 795 bp, Artificial Sequence
  Description of Artificial Sequence: Synthetic coding sequence
atgaaaaaggaggtttgttctgtggccttcctgaaggcagtgttcgctgagtttctggcaaccctgattttcgtattttttgggctcggctccgcgttgaaatggccatcggcactccctacaatccttcagatcgcgttagccttcggtttggcaatcggcaccttggcacaggctttgggccccgtgagcggaggccatattaaccccgccatcacgctggccctactggtggggaaccagattagcctcctgcgagcctttttttatgtggctgctcaactcgtgggcgctatcgccggagctgggattctctatggggtggcccccttgaatgcccgcgggaacttggcagttaatgccctaaataacaacaccactcagggccaggccatggtggtggaactcattcttacctttcagctcgcattatgtattttcgccagcacagacagtagaagaacatctcccgtgggaagcccggctctgtccatcgggctgtctgtgactctggggcacctcgtaggtatatacttcacgggttgttccatgaaccctgcccggtccttcggtcccgccgtggttatgaacaggttctctccggcccactgggtattttgggtcggccccatcgtcggagctgttctcgctgccatcctgtatttttacctgttgtttcccaattccctctccctctcagagagagtggccattattaagggtacttatgaacccgatgaggattgggaagagcagcgggaagaaaggaaaaagaccatggaacttaccaccagg

SEQ ID NO: 6611 - DNA, 795 bp, Artificial Sequence
  Description of Artificial Sequence: Synthetic coding sequence
atgaagaaagaggtgtgcagtgtcgctttcctaaaggctgtgtttgcagagtttctggccactctgatatttgtgttcttcggtctcggcagtgctctgaagtggccgtccgcactgcccaccatcctccaaatcgcactggcatttggtttagcaataggcaccctggctcaggcactcggacctgtgtccggggggcacatcaaccctgcgattaccctggcattgcttgttggaaatcaaatcagtctgctgcgcgccttcttttatgttgcagcgcagctggtaggtgctattgctggcgctggaattctctatggtgttgctcctctaaacgccaggggtaaccttgctgtaaatgcgctgaacaacaacactacacaggggcaggctatggtggtggagctcattcttacattccagttggccctgtgcattttcgcctccactgactcccggcgtacgagcccggtcggatcacccgctctgagcattggcctctcagtgacactgggtcacctcgtgggaatctacttcacaggctgcagtatgaaccctgccagatccttcggccctgccgtggttatgaacagattctctccagcacactgggtattttgggtgggacccatcgtaggagccgttctggcggctatactgtacttttacttactgtttcccaactcgctgtccctgtctgagagggtagcgatcattaagggaacatatgagcccgatgaggattgggaagaacagcgtgaagaacgcaagaaaacaatggaactgactacccgc

SEQ ID NO: 6612 - DNA, 795 bp, Artificial Sequence
  Description of Artificial Sequence: Synthetic coding sequence
atgaagaaggaagtgtgttctgtggcttttctgaaggccgtgtttgcagagttccttgcgactcttatctttgtgttttttgggctcggaagcgctcttaagtggccgtccgccttgcctaccatactccagattgcccttgcatttggtttggcaatcgggacccttgcacaagcactgggccctgtgtccggaggacacattaacccagcaattaccttggctctgctcgtcggaaaccagataagcctccttcgggctttcttttacgtcgccgcccaactcgtgggtgcaattgcaggagcggggatactgtacggtgtggcgccccttaatgcccgaggtaatcttgcagtgaacgccttgaataacaataccacccaaggccaggcaatggtggtggaactgatcctgacttttcaactggccctttgcatcttcgcatccacggattcgagacgcacttccccagtgggctcgcctgcgctgtcgattggcctgtctgtcaccttgggacaccttgtgggaatttacttcaccgggtgttctatgaacccagcacgctcctttggaccagcggtggtcatgaatagattttcaccagcccattgggtgttctgggtgggccccatcgttggagccgttctggcagcaatcctgtacttttatctgctgtttcctaactcgctgtccctttccgaaagagtcgccatcatcaaagggacctacgagccggatgaggactgggaagaacagagggaggaaagaaagaaaactatggagctgactaccagg

SEQ ID NO: 6613 - DNA, 795 bp, Artificial Sequence
  Description of Artificial Sequence: Synthetic coding sequence
atgaagaaggaggtctgctcggtcgcatttcttaaagcagtgttcgccgagttcctcgcaaccctcatctttgtgttttttggcctgggctccgcactgaagtggccctccgcactccctaccatacttcagattgcgttggcttttggattggcaattggaactctcgcacaggcacttggacccgtgagcggaggccatatcaacccggcaatcaccctggcccttcttgtggggaaccagatttcgcttcttagagcgttcttctacgtcgcagcacagctggtgggagcaatagcaggtgcgggtatcctctacggcgtggcaccccttaatgcaagaggtaacctcgctgttaatgcactcaacaacaataccacgcagggacaagcaatggtggtcgagcttatccttacctttcagctcgcgctgtgcatttttgcctcgaccgactcacgcagaaccagccctgtgggctcgccggccctctccatcgggctctctgttactttgggccatctggtcggcatttactttactggatgctcaatgaacccagcgcgctcgtttggcccagcagtggtcatgaacagattttcccccgcccattgggtgttttgggtcggtcctattgtgggagccgtgctggccgcaatactttacttttaccttttgtttccaaactcactgtccctgtccgaacgggtggcgatcattaagggaacgtacgaacccgatgaagattgggaggaacaaagggaggaacgaaagaaaacgatggaactcactacgagg

SEQ ID NO: 6614 - DNA, 795 bp, Artificial Sequence
  Description of Artificial Sequence: Synthetic coding sequence
atgaagaaagaggtctgttccgttgcttttctgaaggctgtcttcgctgagtttctggcaacgctcatcttcgtctttttcggcctgggtagtgctctgaagtggccctccgcacttcccacaatccttcaaatcgccttggcgttcgggctcgccatcggcacacttgcccaggctctcgggcccgtgagtggggggcacataaaccccgccatcaccctcgcactgctcgtggggaatcagataagcctgttgcgggccttcttctatgtggccgcgcagttagtcggtgccatcgctggcgccgggattttgtatggcgttgctccactgaacgcacgcggtaacctggcagtgaacgcactgaacaacaataccacccaagggcaggccatggtcgtcgagctgatcctaacattccagttagcattatgcatttttgcatctaccgatagtcgtaggactagccccgtcggatctccggcactgtcaatcggcctgagtgtgacacttggtcacctggtggggatttactttactgggtgttctatgaacccagccaggtccttcggccccgccgtcgtgatgaatagatttagcccagcccattgggtgttctgggtaggccctattgtgggtgctgtcttagccgctatcctatatttctacctgctatttccaaactcactttctctgtcggaaagggtagcaatcatcaaggggacttacgaacccgatgaggactgggaggaacagcgcgaagaacgcaagaaaacaatggagctgaccacacgt

SEQ ID NO: 6615 - DNA, 795 bp, Artificial Sequence
  Description of Artificial Sequence: Synthetic coding sequence
atgaaaaaggaggtctgtagcgtcgctttcctcaaggctgttttcgcagaattcttggccactctgatcttcgtgttcttcggcctgggaagcgccctcaagtggccttcagccctgccaaccatcttgcagattgcgctcgcgtttggacttgctatcgggaccctggctcaagcactgggcccggtaagcggagggcatatcaacccggcgatcactttggcgctccttgtgggaaatcagatttctttgcttcgcgccttcttttacgtggctgcccagcttgtgggtgcaatcgcgggcgcgggcatactttacggagtcgcacccctgaacgcaagaggtaacctggcggtgaacgccctgaataacaacaccacccaagggcaggcaatggtcgtcgagctcatcctgacgttccaactcgccctgtgcatcttcgcatccaccgacagcagacgtactagtccggtcggctcaccggccctgtcgattggactgtcggtgactctcggacacctggtgggaatctactttactggatgctcaatgaacccggcccggtccttcggacccgccgtggtgatgaatcgcttctctcctgcgcactgggtgttttgggtcgggcccatcgttggcgccgttctggctgccatcctctacttctatctgctgttcccaaattcgctcagcctttcggaaagagtcgcgatcataaagggtacctacgagccagacgaggattgggaggaacagagggaagaacggaagaaaactatggaactcactacccga

SEQ ID NO: 6616 - DNA, 795 bp, Artificial Sequence
  Description of Artificial Sequence: Synthetic coding sequence
atgaaaaaggaagtgtgttcagtcgctttccttaaggccgtgtttgccgagtttctcgcgactttgatcttcgtgtttttcggactggggtcagcactcaaatggccatccgcccttcctaccatcctgcaaatcgcactcgcctttgggctcgcaataggcactctggctcaagcacttggaccggtgtcaggggggcacataaatccagctatcacacttgctctgttagtgggcaaccaaatctctttgcttcgcgcgttcttttatgtggcagcccagttggtgggagcaatagccggagccggtatactgtatggcgtcgcacccctgaacgccagaggaaacctggcagtgaacgctcttaacaataatacgacgcaaggacaggcgatggtggtcgaattgattctgaccttccagctggctctgtgtatattcgccagcaccgactctagaaggacttcccccgtcggctctcctgccttgtccatcgggctgtctgtcactttaggtcatcttgtgggaatttactttacgggatgcagtatgaatccagctcgtagctttgggcctgccgtggttatgaaccggtttagccctgcccactgggtgttttgggtgggtccaatagttggagcagttttggctgctatcctgtatttctatctgctgtttccaaatagcctgagtctgagtgaacgagtggccataatcaaaggtacatatgaaccagacgaggactgggaggagcagcgggaggaacggaaaaaaactatggagctcacaactaga

SEQ ID NO: 6617 - DNA, 795 bp, Artificial Sequence
  Description of Artificial Sequence: Synthetic coding sequence
atgaaaaaggaagtgtgttccgtcgccttcttgaaggccgtgttcgctgaattcctggccactctcatctttgttttctttggactggggtcggcgctcaaatggccgtcggccctgcctactatcctgcagatcgccctggcgttcggcttggctatcgggaccctcgcgcaggctctgggacccgtctcgggtggccacattaacccggccattaccttggccctgcttgtgggcaaccagatctcactcctgcgggccttcttctacgtcgccgcacagctggtgggcgcaatcgcgggagccggaattctctacggagtggcgccgctcaatgcgcggggtaatctggccgtgaacgcactcaacaacaataccactcagggccaagccatggtggtcgaactcatcctcacttttcaactggccctgtgtatctttgcatccactgactcacgccgtacctcgccagtgggatcacctgcactgtcgatcggtctgagcgtgactctgggacacctggtcggaatctacttcactggatgttcaatgaaccccgcaaggagcttcgggccggcagtcgtgatgaaccggttttcaccggctcactgggtgttctgggtgggaccgatcgtcggagcagtcctggccgcaatcctgtacttctatctcttgttcccgaactccttgtcgctgagcgagagagtcgcaatcataaagggaacttacgagcctgacgaggactgggaggaacagagagaggaacggaaaaagaccatggaactgaccacccgg

SEQ ID NO: 6618 - DNA, 795 bp, Artificial Sequence
  Description of Artificial Sequence: Synthetic coding sequence
atgaagaaggaagtgtgctccgtcgcgttcctgaaggcagtattcgccgagttcctggcgactctgattttcgttttcttcggcctggggtccgcccttaaatggccttccgctttgccgactattctccagatagcactcgccttcgggctggccatcggcaccctggctcaggcgctgggcccagtctccggcgggcatatcaatccagcaatcaccctggcgctcctggtgggtaatcaaatcagcttgctgagagccttcttctacgtggccgcccagctggtgggagcaatcgcaggagccggaatcctgtatggagtcgcaccgcttaacgcccggggaaacttggccgtgaatgccctgaataacaacaccacgcagggccaagcgatggttgtggaactgatcctgaccttccagcttgccctgtgtattttcgcctcgactgactcgcgccgcaccagcccggtcggatcccctgcactgtcgatcggactctcggtgaccctgggccacctcgtgggaatctacttcaccggctgttcgatgaaccctgcgcggagctttggacctgcggtggtgatgaataggttcagcccggctcactgggtgttctgggtcggtccaattgtgggagcagtgttggctgccatcctctacttctacttgctgttccctaacagcctgtccctctcggagcgtgtggcaatcattaagggcacctacgagccggatgaagattgggaagaacagagagaggaacggaagaaaactatggaattgaccactaga

SEQ ID NO: 6619 - DNA, 795 bp, Artificial Sequence
  Description of Artificial Sequence: Synthetic coding sequence
atgaaaaaggaggtgtgttcggtcgcgttcctgaaggcggtctttgcggaattcctcgccactctcatcttcgtgttttttggactcggatcggccttgaagtggccgagcgcgctccctactatcctgcaaatcgccctggccttcggccttgcgatcggtaccctcgcgcaggctttggggccagtctccggaggacacatcaatcctgccatcacgctcgcactcctggtgggaaatcagatcagcctgcttagagcctttttctacgtggccgcgcaactcgtgggcgcgatcgcgggcgctggaatcctttacggcgtcgccccactcaacgcacgcggaaatttggccgtgaatgccctgaataacaatactactcaaggtcaggctatggtggtggaacttatcctgaccttccaattggcgctttgtattttcgcctcgactgattcacgcaggacctccccagtgggaagcccggctctgtcgatcggtctgtcggtcactctgggccatctggtgggaatttacttcactggatgcagcatgaaccctgcaagatcgttcggccctgccgtggtgatgaaccggttctcgcctgcacactgggtgttctgggtcgggccgatcgtcggagcagtattggccgcgatcctgtacttctacctgctgttccccaacagcctgagcctgtcagagcgcgtcgctatcatcaagggtacgtacgaaccagacgaggactgggaggaacagcgtgaggaacggaaaaagacgatggaactcacgacccgc

SEQ ID NO: 6620 - DNA, 795 bp, Artificial Sequence
  Description of Artificial Sequence: Synthetic coding sequence
atgaaaaaggaggtttgctctgtagcattcctcaaggcagttttcgcagaattcctcgcgacactgatctttgtgtttttcgggctaggatctgctctaaagtggcctagcgccctgcccacaatactgcagatagccctcgcatttggattagctatcggtacacttgcccaagcgctgggaccagtgagtgggggccacatcaaccccgccatcacactggctctgctagtagggaatcaaatttccctgctgcgagcatttttttatgttgcggcccagctggtcggtgccattgctggcgctggcattctctatggcgtggccccattgaacgcaaggggcaatctggcggtgaatgccttaaacaacaacaccacccagggtcaggcgatggtcgttgaattaatcctgaccttccaattggcactgtgcatctttgcctccaccgactcccgtcggacctctccagttggaagccctgctctgagcattggcctgtccgtcactttggggcatttagtggggatttatttcactggctgctccatgaatccggctcgctcctttggcccagccgtggtgatgaacaggtttagccctgcgcattgggtattctgggtcggccctattgtaggggctgtccttgctgccattctatacttctatctgttgtttccaaactctctgtccctgtcagagcgggtagccataatcaagggcacctacgaaccagacgaagattgggaggaacagcgagaagagcgaaagaagaccatggaattaacaaccaga

SEQ ID NO: 6621 - DNA, 795 bp, Artificial Sequence
  Description of Artificial Sequence: Synthetic coding sequence
atgaaaaaagaagtgtgtagtgtggcgttccttaaagcggtgttcgctgagttcctggctacacttatcttcgttttctttggcttggggagcgcactgaagtggccaagcgccctcccaactattctgcagattgccttggcattcgggctggctatcgggacgctggcccaagccctggggcccgtgagtggtggacacattaaccccgcgatcacccttgcccttctggtgggcaatcagatttctctgctgcgcgcctttttctacgtggcagctcagcttgttggcgccattgccggagctggcatcctgtacggtgttgcccctcttaacgcccggggaaatctggcggtgaacgcattaaacaataataccacccaaggacaagctatggtggtcgaattaattcttacattccagcttgcactttgtatattcgcttcaactgattctaggaggacctcacccgtgggctccccagccctgtcgattgggctctccgtaacacttggacatctggtggggatctactttactggatgtagtatgaatccggctcgcagcttcggccccgccgtcgtgatgaatagatttagcccagctcactgggtgttctgggtgggcccgatcgtcggcgctgtcctggccgccattctgtatttctatttgctcttccccaattcactctcattgagtgagagggtggccattatcaaaggaacatatgagcctgatgaagactgggaggagcagcgagaagaaaggaagaaaacaatggaactaacgacacgg

SEQ ID NO: 6622 - DNA, 795 bp, Artificial Sequence
  Description of Artificial Sequence: Synthetic coding sequence
atgaaaaaagaagtgtgtagcgtggcattcctgaaggcagtgttcgcagagtttcttgccacccttatcttcgtgttctttggattgggctcagcacttaagtggccaagcgcactgcccacgatccttcaaattgcgttggcattcgggctggctattggtactctggcccaagcactcggacccgtctcgggtggtcacataaaccccgcaattaccctcgcactgctggtcggaaatcagatctcgcttctgcgtgctttcttttacgtggctgcccagctggtgggtgcgatagcgggcgcgggcatcctttacggtgtggccccacttaatgcacgcggcaatcttgcagtgaatgcccttaacaataacaccacccagggacaggcaatggtcgtggaactgattctgacgttccaactcgcgctttgtatctttgcctccacggattcgcggcggacttcgcccgtcgggtcgccagcactttcgattggtctgtccgtgacccttgggcatctggtgggaatttacttcactggatgttccatgaatcctgcacgctcttttggacctgcagtggtcatgaaccggttttccccagcacattgggtgttttgggtgggaccgattgtcggagccgtccttgcagcaatactttacttttacctgctgttccctaatagcctttcactttcggaacgcgtggcaattatcaagggaacgtacgaacctgatgaagattgggaggaacaaagagaagagcgcaaaaagaccatggagctgaccacccgc

SEQ ID NO: 6623 - DNA, 795 bp, Artificial Sequence
  Description of Artificial Sequence: Synthetic coding sequence
atgaagaaggaagtgtgctcagtggcctttctaaaagctgtgttcgccgagttcctcgccacgcttatcttcgtatttttcggcttgggcagtgccctgaaatggcctagcgcgctgcctacaatactgcagattgcacttgcctttggactcgcgatcggaaccctcgctcaagctctcggtcctgtgtctggaggtcatatcaaccctgccataactcttgccctgctggtcgggaatcagatctcactcctgcgggccttcttttacgtggccgcgcagcttgtgggcgctatcgctggcgcagggattctgtacggcgttgcgcctctgaatgcccggggcaatctggcagtgaacgccctgaacaataacaccacgcaggggcaagccatggtggtcgagttgattctgacgttccagctggcgctgtgcatcttcgcttcgactgatagccggagaacatctcccgttggatcccccgccctatccattgggcttagcgttacgttgggtcacctggtgggaatttacttcacagggtgtagcatgaatccggctagatcattcggcccagctgtggttatgaacagatttagtccggcccactgggtgttttgggtgggcccaatagtgggggctgtgctggctgcaattctctacttctatctcttattccctaactctctgtccctgtctgagagagtggccatcatcaaggggacctacgaaccagacgaggactgggaagagcaacgggaggagagaaaaaaaactatggaactcactacgaga

SEQ ID NO: 6624 - DNA, 795 bp, Artificial Sequence
  Description of Artificial Sequence: Synthetic coding sequence
atgaaaaaagaggtttgcagtgttgcttttctgaaggccgtgtttgcggagtttctggctaccctgatcttcgtgtttttcggactagggtctgctctgaagtggccatccgccctccctaccatcctgcagattgcactcgcgttcggtctagcaattgggacgctggcacaggccctcggaccagtatccgggggacacataaaccctgcgatcaccctggccctcttggtaggcaaccagatcagtctgcttagggcgttcttctacgttgctgcacaattggtgggggcaatcgctggggctggtatcctatacggcgtcgccccgctcaacgctaggggcaatttagcagttaatgccctgaacaataacaccactcagggccaggctatggtagtggaacttattctgacctttcagctggccctttgcattttcgccagcactgactctcgacgcacgtctcccgtaggttccccagcactgagtattggcttgagcgtcaccctgggccacctcgtgggcatatacttcacaggatgttccatgaatcccgcacgatcatttggaccggccgtcgttatgaaccggttcagtcccgcacactgggtgttttgggtcggtcctatcgttggcgctgtgctggcagcaatcctgtatttttacctgctatttcccaattctctgtcactgtcagaacgagtggccatcattaagggcacgtacgaaccagacgaggactgggaagaacaacgcgaagagaggaagaaaacgatggaattgactacacgg

SEQ ID NO: 6625 - DNA, 795 bp, Artificial Sequence; identical to SEQ ID NO: 6614
  Description of Artificial Sequence: Synthetic coding sequence

SEQ ID NO: 6626 - DNA, 795 bp, Artificial Sequence
  Description of Artificial Sequence: Synthetic coding sequence
atgaagaaagaagtgtgcagcgtggcgttcctcaaggccgtgtttgcggaattcctcgccactcttatctttgtgttcttcggtcttggttcagctctgaagtggccgtccgcactcccaacgattttgcaaatcgcgctcgcttttgggctggccatcggcactttggcccaggcgctgggaccggtatctggtggacatatcaacccagcaatcaccctggccctgctcgtgggaaatcagatctcgctgctcagggcctttttctatgttgctgcccagctcgttggtgccatcgccggcgcgggaatattgtacggagtcgcgccgctgaacgcccgggggaacctggccgtcaacgcactgaataacaataccacccagggacaagcgatggtcgtggagctcatcctgacttttcagctcgcactctgtattttcgccagtaccgactcgcgacgcacttcccccgtgggatcgcctgccctgtcaatagggctgtcggtgactctgggacacctggttggaatctacttcaccggttgcagcatgaatcctgcacggtcgttcgggccagccgtggtgatgaaccggttctccccagcgcactgggtgttttgggtggggccgatcgtgggagccgtgctggctgccattctgtatttctacctcctgttcccgaacagcctcagcctgtcggaacgcgtcgctatcatcaagggaacctatgaaccggatgaggactgggaggaacaaagagaagaaagaaaaaagaccatggagctcaccactcgc

SEQ ID NO: 6627 - DNA, 795 bp, Artificial Sequence
  Description of Artificial Sequence: Synthetic coding sequence
atgaagaaagaggtgtgcagcgtggccttcctcaaggccgtattcgctgagtttcttgcaaccctgatctttgttttcttcggactcggttccgcccttaaatggccatcagccctgccaacaatccttcaaatcgcattagcctttggactcgccattggcactttggcacaggctctgggacccgtgagcgggggacatatcaatcctgctataaccctcgctctactagtgggtaatcagatttcccttctgcgtgcatttttttacgtggccgcccagctagtgggagcaattgccggggccgggattctttacggagttgcacctttaaacgcacgcggaaacttagccgtgaatgctctgaacaataacacgacacaaggtcaggccatggttgtggaactcatcttgacctttcagctagcgttatgcatcttcgccagcacagatagccgtagaacaagccctgtgggaagccccgcactatccataggactgagcgtgactctgggccacctagtcggcatatacttcacgggttgttccatgaatcctgctcggtccttcggccctgctgtggttatgaacagattctcccctgcgcattgggtcttttgggtcgggccaatcgtgggagccgtcctggcagctatcctgtacttttatctcttgttccctaactctttatcattaagcgagcgtgtcgcaataatcaaaggtacctatgagccagacgaagattgggaggaacagcgtgaggagaggaagaaaaccatggagctcactaccaga

SEQ ID NO: 6628 - DNA, 795 bp, Artificial Sequence
  Description of Artificial Sequence: Synthetic coding sequence
atgaagaaggaagtgtgctcggtggcctttcttaaggcagtgtttgcagagttccttgccaccctgatctttgtcttttttggtttggggagcgcactgaaatggccaagcgcgctcccaaccatccttcagatcgcgctggcatttggtcttgcaataggaactctcgcacaggcccttggccctgtgtccggtggtcacattaaccctgcaatcacccttgcgctgcttgtcggaaaccaaatttcgcttcttcgcgcatttttctatgtggccgcacaactcgtgggtgcaattgcgggagccggaattctttacggagtggcaccactgaatgcacgcggtaatctggccgtgaatgcactcaacaacaacacgacccaagggcaagccatggtggtcgaactgattctgacctttcagttggccctctgtattttcgcttcgactgattcgaggcgaacttccccagtggggagccctgcactgtcgattggactgtccgtgacgctgggtcacctggtcggaatatactttaccggatgttcaatgaacccagctcgtagctttggtcctgcagtggtgatgaaccggttttcgcctgctcactgggtattttgggtgggtcctatcgtgggcgcagttctggcagcaatactgtacttttacctcctgtttcctaactcgctgagcctctcagaacgtgtggccatcattaaggggacctatgagccagacgaggattgggaagagcaacgagaagaaaggaagaaaactatggaactgaccacgaga

SEQ ID NO: 6629 - DNA, 795 bp, Artificial Sequence
  Description of Artificial Sequence: Synthetic coding sequence
atgaaaaaagaggtgtgtagcgttgcctttctaaaggcagtgtttgccgaattcctggcaaccctgatattcgtgttcttcggcttaggaagcgctctaaaatggccatctgcactgcctaccattctccagattgctcttgcctttggcctagcaattggcactctggcccaagccctgggcccagtatcaggcggccatatcaacccagctatcacccttgccctgctggtggggaatcagataagcctgctgagggctttcttctacgtagccgcacagcttgtgggcgcaattgccggcgccggaatcctctacggcgtggcacctttaaacgccaggggcaaccttgccgtgaatgcactcaacaacaacactacacagggccaggccatggttgtggaactcatcctgactttccagctggccctgtgcatttttgcctcaaccgattctagacgcacttctcctgttgggtctcccgctctatctattggcctgtccgttaccctgggacatttagtgggaatctatttcactggctgctcaatgaacccagcacgctcctttggcccagcagtagtgatgaatcgcttcagccctgcccactgggtcttctgggtcggccctatcgtgggcgctgtactagctgctattctctacttctacctgttgtttcctaattccctgtccctgtccgagagagtggcaataataaagggcacctacgagcctgacgaagactgggaggaacagagggaggaacgcaaaaagaccatggagctcactacaaga

SEQ ID NO: 6630 - DNA, 795 bp, Artificial Sequence
  Description of Artificial Sequence: Synthetic coding sequence
atgaagaaagaggtttgtagtgttgcctttctgaaagccgtgttcgctgagttcctagcgactctgatcttcgtgtttttcggactcggatctgctctgaagtggccttcggccctgcccaccatcctgcagatcgccctggcattcggactggccataggcacattggcccaagcattaggtccagtctccggggggcatatcaatcccgctattacactggctctcctggtgggtaaccagatttcattgcttagagcatttttctacgtcgctgcgcagcttgtgggtgctattgctggggctgggattctatatggggtggcgccattgaatgctcgcggaaacttagcagtcaacgctctcaacaataacactacgcaggggcaggccatggttgtggagctcattcttacctttcagctggccctttgtatctttgcttcaacagattcaagacggacctccccagttggatcgcccgctttatcgataggactgtcagtgaccctgggacatctggtggggatctacttcacaggatgctccatgaatccggctaggtctttcggacctgcagtggtgatgaaccgattctccccagcacactgggttttctgggtaggtcctatcgtgggcgcagtgctggccgctattttgtacttctatcttctgttccctaattctctgtctctgagtgagagagttgcaattattaaaggcacatacgaacctgatgaggattgggaagagcagcgggaggagagaaagaaaacgatggagttgaccaccaga

SEQ ID NO: 6631 - DNA, 795 bp, Artificial Sequence
  Description of Artificial Sequence: Synthetic coding sequence
atgaagaaggaagtgtgcagcgtggctttcctcaaagccgtcttcgcagagttcttggccaccttgatcttcgttttcttcggactgggctccgctctgaaatggccgtccgcactgcccaccattctgcagattgcacttgcttttggactagctatagggaccctggctcaggccctagggcccgtgagcggtggacatattaatccagctattacactagcactcctcgtgggcaaccagatcagtttgttgagagcgttcttttatgttgccgcacagctggtgggcgcgattgccggcgccggaattctttacggcgtagctcccctgaatgcccggggcaatcttgccgttaatgcattgaataacaacaccacacaaggacaggccatggtcgttgagctgatcttgaccttccagcttgcgttgtgcatcttcgcgtctacagattctagaagaacatctccagtcggtagtccagcattgtccatcggactctctgtgacactcgggcacctggtcggaatctacttcactggatgtagtatgaacccagctcggagctttgggccagccgtagtgatgaaccgtttcagtccagcgcattgggtgttctgggttggacctattgtcggtgcagtgctcgccgcaattctgtatttttaccttctgtttcccaatagcctgtcattgtctgagcgggtagccattatcaagggaacatatgagcccgacgaggactgggaagagcagagggaagagcgcaaaaagacgatggagctgactacaaga

SEQ ID NO: 6632 - DNA, 795 bp, Artificial Sequence
  Description of Artificial Sequence: Synthetic coding sequence
atgaagaaggaagtgtgctctgttgcctttctgaaagccgtgttcgccgaatttctcgctaccctgatcttcgtgtttttcggactgggttctgcattgaaatggcctagtgcactcccaaccatcctgcagatcgccctggccttcggactcgctattggaaccctggctcaagctttgggacctgtttctggaggtcacattaacccagccatcactttggcactcttggtcggcaaccaaatatccctcctgagagcttttttctacgtggctgctcagctcgttggcgcaatcgctggtgccggcatactgtacggtgttgctccattgaatgctagaggtaacctcgcagtcaacgccttgaacaacaacaccacccagggacaggcaatggtagtggaattgattcttaccttccagcttgccctgtgcatctttgccagcaccgactctaggagaactagccctgtgggcagtccagccctgtctatcggtctgtctgtcaccctcggccatctggtgggcatttactttactggttgttccatgaatcctgcccgcagctttggtccagctgtcgtgatgaacaggttttcacctgctcattgggtcttctgggtgggcccaatcgttggtgcagttttggctgcaatactctatttttacctgctgttcccaaactccctgagtctctcagagcgtgtggcaattatcaagggaacctacgagccagacgaggactgggaggaacaaagggaggagcgcaaaaagactatggagctcaccactcgc

SEQ ID NO: 6633 - DNA, 795 bp, Artificial Sequence
  Description of Artificial Sequence: Synthetic coding sequence
atgaagaaggaggtctgcagcgtagcgtttctgaaagccgtgtttgccgaattccttgctacacttatattcgtattctttggactgggcagcgcgcttaagtggccctccgctcttccaaccatactgcagatagcactggcatttggtttagcgatcggtacactagcccaggcccttggtcccgtttctggcggccatattaacccagcaattacgctggctcttttagtgggcaatcagatatcccttcttagggctttcttctacgtagcggcacagctagtgggtgctatagccggcgcagggatcttatatggcgtggctcctcttaatgcacgcggaaacctggctgtgaatgctttgaataacaataccactcaagggcaagccatggtggtcgaactgatactgacctttcagctggccctctgcattttcgcgagcacagattcaaggagaacatcccctgttggctcccctgccctctctatcggtttatctgttacactcgggcacctggtcgggatttatttcactggctgctccatgaatcctgcacgcagcttcggtcctgccgtcgtgatgaataggttctctcccgcccactgggtgttctgggtcgggcccatcgtcggggccgttctcgctgccatcttatacttttatctgctgttccctaattcattgtctctgtcagagcgggtggccatcatcaagggcacctacgagcccgacgaagattgggaggagcagcgggaggaaaggaagaagacaatggaactcacaaccaga

SEQ ID NO: 6634 - DNA, 795 bp, Artificial Sequence
  Description of Artificial Sequence: Synthetic coding sequence
atgaaaaaagaggtctgctccgtggcgtttctaaaggctgtcttcgcagaatttttggccacacttattttcgtgttctttggactagggtctgctttaaagtggcccagtgcccttccaacaatacttcagatagctctggcttttggattagctatcgggacactggcccaagcattaggacctgtgtccggggggcatataaaccccgcgatcacacttgccctactcgtcgggaatcagatctcactcctgcgggcttttttctatgtagccgcgcaactcgtgggggctatcgccggggccgggatattatatggggtggcacccctgaatgctagagggaacctcgccgtcaatgctctcaacaacaacactactcagggacaggcaatggtagtagaacttatcctaactttccaattagcactatgtattttcgcctccactgattccagacgcacatcccccgtcgggagtccagcactgagtatagggctttctgtgacacttggacacctggtagggatttactttactgggtgttctatgaaccctgcacggagtttcgggccagccgtagtcatgaacaggttctctcctgcccattgggtcttttgggtcggacctatcgtaggagcagtacttgcagcaatcctctatttctatctcctatttcctaattctctctccctaagtgaaagagttgctattatcaaaggaacatacgaacccgatgaagattgggaggaacagcgggaagagagaaaaaaaacgatggaactgactacgcgg

SEQ ID NO: 6635 - DNA, 795 bp, Artificial Sequence
  Description of Artificial Sequence: Synthetic coding sequence
atgaaaaaggaagtttgttcagttgcctttttaaaagctgtatttgcagaatttctagctacattaatttttgttttttttggattaggatcagcacttaaatggccttctgctttaccaacaattcttcaaatagctcttgcttttggattagcaattggaactcttgcacaagctcttggaccagtttctggaggacatataaacccagctattacattagctcttcttgtaggaaatcaaattagtttacttagagcttttttttatgttgcagcacaattagttggagcaatagctggagcagggattttatatggagttgcaccacttaatgctagaggaaatttagcagtaaatgcattaaataataatactacccaaggtcaagcaatggtagttgaacttattcttacatttcaattagctttatgtatatttgcaagtacagattcacgtagaaccagtcctgtaggaagtccagctttatctattggattatcagttacattggggcatttagttggaatttattttactggttgttctatgaatccagcacgatcattcggaccagctgttgttatgaatagattttcacctgctcattgggttttctgggtgggaccaattgttggagctgttttagcagccattttatatttttatcttttatttccaaattcattatcattatcagaaagagttgctataattaaaggtacttatgaaccagatgaagactgggaagaacaaagagaagaaagaaaaaagactatggaacttactactagg

SEQ ID NO: 6636 - DNA, 795 bp, Artificial Sequence
  Description of Artificial Sequence: Synthetic coding sequence
atgaagaaagaggtgtgttctgttgcatttttaaaggcggtatttgcagagtttctggctaccctaattttcgtctttttcggcctgggtagcgccttgaagtggccttccgcactccctacgatcttgcagatcgcgctagcgtttgggctcgctattgggactttggcccaggcgttgggccctgtctccggtggtcatattaatcctgcaataacactggccctgctagtaggtaaccagatttccttgttgagagcattcttctacgttgcagcccaactggtgggggcaatcgcaggcgccggtattctgtacggggtggcgcctttgaatgccagaggaaatttagcggtcaacgcgctcaacaacaataccactcagggtcaagcgatggtggttgagctgatcttgactttccagcttgctctctgcatattcgcaagcaccgacagtcgtaggacaagtcccgtggggtcgccggccttgagtatcggtcttagtgtcacgctcggccatctcgtcggcatctatttcacaggatgtagcatgaatccagcacgatcgtttggtccagctgtcgtcatgaacagattttcccctgctcattgggttttctgggtgggtccaatcgttggcgcagttctggcggcaatactttatttctaccttttatttccgaattctctttcattatctgaacgagtggccattattaagggcacatatgaaccagatgaagactgggaagaacagcgcgaggaacgtaagaagaccatggaactgactacccgc

SEQ ID NO: 6637 - DNA, 795 bp, Artificial Sequence
  Description of Artificial Sequence: Synthetic coding sequence
atgaaaaaagaagtatgcagtgtcgctttcctcaaagccgtgtttgctgaattcttagcgactctcatatttgttttctttggacttgggtccgctctaaaatggccatcagccttacctacaatcctgcagatagctctggcatttgggctcgccatcggaactctggcacaggccctgggaccagtgagtgggggacacataaaccctgctataacacttgctcttctagtagggaatcagatatctctcctaagggcttttttctacgtggcagcccagctcgtcggggcgatcgccggagccggaatcctttatggagtggctccattgaacgctcgagggaatctagcagtgaacgcactgaacaacaatactactcaggggcaggccatggtggtggaactaatacttacattccagcttgccctgtgtatctttgcgtcaactgactcgaggagaactagtccagtcgggtcccccgctctttctatcgggctctctgtgactttgggacatctagtgggaatctattttactgggtgttccatgaatccagccaggtcttttggaccagcagttgtcatgaatcggttctctcccgctcactgggttttttgggtgggacctattgtgggagctgttttggccgccatcctctacttttatctcctattccccaacagtctatctctgagtgagagagtagctatcatcaaagggacatatgagcctgatgaggactgggaagagcagcgcgaggaacgaaaaaaaacaatggaactcacaacaaga

SEQ ID NO: 6638 - DNA, 795 bp, Artificial Sequence
  Description of Artificial Sequence: Synthetic coding sequence
atgaaaaaagaagtttgttccgttgcattcttaaaagcagtgttcgcagagttccttgcgacactcatttttgtgttcttcggcctaggttctgctttaaagtggccctcagcccttccgaccatacttcaaatagcattggcatttggtcttgcaattggtactctcgctcaagcactcggacccgtgtccggagggcatattaaccccgcaatcacgttggctttgttggttggtaaccaaatctccttgctcagggcattcttctacgtggctgcccagttagttggagctattgctggagcaggtattctctatggagtggcacctctaaatgcacgcggaaaccttgccgtaaacgcactgaacaacaacactacacaaggacaggcaatggtagtagaacttatactgactttccagctagccttgtgtattttcgcctctaccgactcacgtcgtactagcccggtgggttctccggcattgtctattggtttgtcagttactctaggacatcttgttggcatttatttcacaggatgtagtatgaaccccgctaggtctttcggaccagccgttgttatgaacaggttttcccctgcccattgggttttctgggtgggtcctatcgttggagccgttctagcggctatactgtatttctatctcctattccctaacagcctttcccttagtgaacgagttgctatcatcaaaggcacatatgaacctgatgaagattgggaggagcagcgtgaggaaagaaaaaagacgatggaattaaccacacgt

SEQ ID NO: 6639 - DNA, 795 bp, Artificial Sequence
  Description of Artificial Sequence: Synthetic coding sequence
atgaaaaaggaggtgtgcagtgtggccttcctcaaggccgtgttcgcagaattcctagcgaccctgatctttgtgttctttggactaggatccgccctcaagtggcctagtgcactgcccaccattctgcagatcgctctggcgttcgggctcgcgattggcactctggcgcaagcccttggaccggtctctggaggacatatcaatcctgcaatcactttggccctcctagtagggaatcagatcagcctcttacgggctttcttctatgtggccgcgcagctggtaggcgccatcgccggggctggtatcctttatggtgtggcgcccctaaacgcgcggggaaacctagcggtaaacgccctgaataataacacaacgcaaggacaggcaatggtagtagagctcatcttaaccttccagttggccctatgcatattcgcctctacagacagccgcagaacctcacctgtaggcagccccgcgctcagtattggcctaagtgtgaccctgggtcacctggttggcatctattttaccggttgctcaatgaaccctgcccgatcattcggtcctgctgtggtaatgaatcgtttttcaccagcccactgggttttctgggtgggcccgattgtgggtgccgtcctagccgcgattctatatttttatctgctgtttccaaactctttaagtctctcagaaagggtcgcgattataaaaggaacatacgaaccagacgaggactgggaggagcagagggaagaacgcaagaaaacaatggaactgacgaccaga

SEQ ID NO: 6640 - DNA, 795 bp, Artificial Sequence
  Description of Artificial Sequence: Synthetic coding sequence
atgaagaaagaggtgtgttcggtggctttccttaaagccgtgttcgcagagtttctcgccactctcatcttcgtgttcttcggactcggatccgcgctcaaatggccaagcgcccttccaactatcctccagatcgccctcgcgttcgggctggccatcggaaccctggcacaagcgctggggccagtgtctggcggacacatcaatccagccatcaccttggcgctgctggtgggaaaccagatcagcctgttgcgggctttcttctacgtcgctgctcaactcgtgggagctattgcaggagctggaatcctctacggagtcgctccgctgaacgcccgcggaaacctggcggtgaacgcactgaataacaacaccacccaaggtcaggctatggtggtcgagttgatccttacctttcagctggcgctctgcatctttgcctccactgattcgagaagaacctcccctgttggctctccggcgctcagcatcggcctttcagtcactctcggacatttggtcggaatctactttaccgggtgttccatgaatccggccaggtcctttggcccggccgtagtgatgaatcggttcagcccagcccactgggtcttctgggtcgggccgatcgtgggagctgtgctggcagcaatcctctacttttacctgctcttcccaaattcgctctccctgtcagaacgggtggccatcatcaaagggacttacgaaccggacgaagactgggaggaacagcgcgaggaacgcaagaaaaccatggaactgaccacccgc

SEQ ID NO: 6641 - DNA, 795 bp, Artificial Sequence
  Description of Artificial Sequence: Synthetic coding sequence
atgaaaaaggaggtctgctcggtggcgtttctgaaagccgtatttgctgagttcttagcaaccttgatatttgtattctttggtttgggcagtgccctgaagtggccgtccgcgctacctacaatcctacaaatcgctctggcctttggccttgctatcggaacactcgcccaggcgttgggccctgtgagcggcggccatatcaatcctgccatcaccttggccttgctagtgggaaatcagattagcttattacgggcctttttttatgtcgccgctcagttggtgggagccattgccggcgcaggaattctgtatggcgttgcccccctcaatgcaaggggaaacctggctgtaaatgcccttaataataacactacccagggtcaggccatggtggtcgagttgatcctcaccttccagctggcactctgcattttcgcctctacagattcacggcggacctcacctgttggctctcccgctttgtcaatcggtttgtctgtgacactgggccacctcgtggggatctacttcacaggatgcagcatgaacccagctaggtctttcggaccagcagtagtgatgaaccggttctcacctgcacattgggttttctgggtgggacccatcgttggggcagtgttagccgccatcctgtacttctatctcctcttccccaatagtctctccctgtccgagcgcgtggcaattataaaaggcacctacgaacctgacgaagattgggaggagcagcgcgaggagaggaaaaagaccatggagctaaccacgaga

SEQ ID NO: 6642 - DNA, 795 bp, Artificial Sequence
  Description of Artificial Sequence: Synthetic coding sequence
atgaagaaggaagtgtgttccgtggcgttcctcaaagcggtgtttgccgagtttctcgcaactctcatctttgtgtttttcggtctgggctcagcgctgaagtggccatcggccctgccgaccattctgcagatcgccctcgccttcggtttggccatcggaacccttgctcaggccctgggcccagtttcgggagggcacattaatcctgcgatcaccctggctctgctggtgggaaaccaaatcagcctgctccgggctttcttttacgtcgcggcccagctggtgggagctatcgccggggcggggatattgtacggcgtggcccctctgaacgcacggggtaacctggccgtgaatgctctcaataacaacaccacccagggacaagccatggtggtggaactgatcctcacctttcaactggccctgtgcattttcgcgtcaaccgactcacggcggacttcacctgtggggtccccggcgctgtcgatcggactcagcgtcacgctgggacacctggtgggaatatacttcactggatgctccatgaacccagcacggtcgtttggccccgctgtggtgatgaacagattctcgccggctcactgggtgttctgggtcggaccgatcgtcggggcagttttggcagccattttgtacttctacctcctgttcccgaattccctgtcgctgtccgaacgcgtggcaatcatcaagggcacttacgaaccggacgaggactgggaagaacagcgcgaagagaggaagaaaaccatggagttgaccactcgg

SEQ ID NO: 6643 - DNA, 795 bp, Artificial Sequence
  Description of Artificial Sequence: Synthetic coding sequence
atgaagaaggaagtgtgctcggtggccttccttaaggcggtgttcgcagaatttctggcgaccctcatcttcgtattcttcggactgggttccgcgctgaaatggcccagcgccctcccgactatcctccagattgccctggcattcgggctggcgatcggcaccctggctcaggccctgggaccagtgagcggaggccacatcaacccggcaatcaccttggccctgcttgtcggcaaccaaatttcacttctgcgggcgtttttctacgtcgcggctcagctcgttggagccatcgctggcgcgggcatcctctacggagtcgctccacttaacgcccgcggcaatctggccgtgaacgccctgaataacaacactactcagggacaggccatggttgtcgagctgattctgaccttccagttggccctttgcatcttcgccagcaccgacagccgccggacgagccctgtcggatcaccggccctgtccattggactgtccgtgacgctcggccacctcgtgggaatttactttactggctgctcgatgaacccagcccggtccttcggtccagcagtggtgatgaatcggttctcaccagcccactgggtgttctgggtgggccccatcgtcggagccgtgctcgcagcaattctgtacttctacctgctcttcccgaactccctctcgctgagcgagcgggtggcaatcatcaagggaacctacgaaccagacgaggattgggaggagcaaagagaagaaagaaaaaagaccatggaactgaccacccgc

SEQ ID NO: 6644 - DNA, 795 bp, Artificial Sequence
  Description of Artificial Sequence: Synthetic coding sequence
atgaagaaggaagtgtgctccgtcgcattcctcaaggcggtgttcgccgaattcttggccactctgatatttgtgttctttggactgggcagcgccctcaagtggccatccgctctcccaactatcctgcagatcgcgcttgctttcggactggcgatcggaaccctggcccaggcattgggcccggtgtctgggggccacatcaacccagcaatcaccctggccctcctcgtggggaaccagatcagcctgctgcgcgcctttttctacgtggccgcgcaactcgtgggagccattgccggagcaggaatcctgtacggggtggccccactgaacgccaggggaaatctggccgtgaatgccttgaacaataacaccacccagggccaggccatggtcgtggaactgatcctgactttccaactggcgctgtgcatcttcgcttcgactgattcgagacggaccagcccggtcggatcgccagctctgtcgatcggactctcagtcaccctcggacatctggtgggaatttacttcaccggatgtagcatgaaccctgcacgcagcttcgggccagctgtggtgatgaacagattttcaccggcacattgggtgttttgggtcggtccgatcgtgggcgccgtccttgcggctattctttacttctacctgctgttcccaaattcactgtcgctctcagagcgcgtggcgatcatcaaggggacctacgagccggacgaggattgggaggagcaacgcgaggagcgcaagaaaactatggaactgaccactagg

SEQ ID NO: 6645 - DNA, 795 bp, Artificial Sequence
  Description of Artificial Sequence: Synthetic coding sequence
atgaagaaagaagtatgctcagtggccttcctgaaagccgtgttcgctgagttcctggccacactgatcttcgtgtttttcggtctgggctcggcgctgaagtggcccagtgcattacctacgatcctgcagattgctctggcgttcgggctggccattgggaccctcgcgcaagccctggggcctgtgagcggaggacacatcaaccctgcaattactctggccctcttggtgggtaaccaaatcagtctcttgcgagcattcttttatgtagcggctcaactggtgggagccatcgctggggccggcatactttacggagtcgccccgttgaatgcacggggcaaccttgccgtcaacgctctcaataataacacaacgcagggacaggctatggtggtggaacttattctcacctttcagctcgcactgtgcatctttgcttcaacggattcacggcgtacctcccccgtggggtcgcctgctctgagtatcggcctgagcgtcaccctggggcacttggttggaatctacttcaccggttgctctatgaaccctgctcggtcctttggccccgccgtcgtgatgaataggttcagccccgctcactgggttttttgggtaggaccgatcgttggcgccgtacttgcagctattttgtacttctacctcttgttccccaacagtctgagcctgtctgagcgcgtggccataataaaggggacctacgagccggatgaggactgggaggagcagagagaagagcgaaagaaaacaatggagttgacgactcgt

SEQ ID NO: 6646 - DNA, 795 bp, Artificial Sequence
  Description of Artificial Sequence: Synthetic coding sequence
atgaagaaggaagtctgctctgtggctttcctgaaagcagtcttcgccgaattcctggccaccctcatcttcgttttttttggactgggttcagccctcaagtggcctagcgcccttccgacgatcctacagattgctctagccttcgggctggccatcggcaccctcgctcaggcactgggcccagtctctggagggcatatcaacccagctatcaccctggcgctgctcgtgggcaaccagatatccttactgagagcattcttctatgtagccgcccaacttgtcggggccatagcaggcgccggaattctgtatggcgttgcccctctgaatgcacgggggaacctcgccgttaatgcgctgaacaacaataccactcagggtcaagctatggtggtcgagctgattctaacctttcagctggcgctctgtatttttgcatccaccgattcaagacggactagtcccgtgggctctcctgccttgagcatcggtctctccgtgactttgggccatctagttggcatttatttcaccgggtgttctatgaacccagctcggagtttcggaccggcggttgtcatgaacaggtttagtccagcacactgggtcttctgggtcggcccgatcgtgggtgccgtcttggcagcaatactgtacttttatttacttttcccgaactcattgtctctttccgagcgagtcgccatcatcaaagggacatatgagcccgacgaggattgggaggagcagagagaagagagaaagaaaacaatggagctgacaacacgc

SEQ ID NO: 6647 - DNA, 795 bp, Artificial Sequence
  Description of Artificial Sequence: Synthetic coding sequence
atgaagaaagaagtctgctcggtggcctttctgaaggccgtgttcgccgagttcctcgcaacgctgatcttcgtgttctttggcctcgggagcgcattgaagtggccttcggccctgccaaccatcctccaaatcgcattggcatttggactggccattggaacgcttgcacaggctctcggaccggtgtcgggtggacatatcaacccagcgatcaccctggccctgttggttggaaatcagatttcacttctcagggcgtttttctacgtggccgcccaactcgtcggcgccatcgccggagccggcatcctttacggagtggcaccgctgaatgctcggggaaatcttgcggtgaacgccctcaacaataacactactcaggggcaggccatggtcgtggaattgatcctcacttttcagttggccttgtgcatctttgcatcgacggattcgcggcggacctcgcccgtgggatccccggccctctctattggactgagcgttactttggggcacctggtgggcatctatttcaccggatgtagcatgaaccctgcgcgctccttcggaccggccgtcgtaatgaatcgcttctcaccggcccattgggttttctgggtggggccaatcgtgggcgccgtgttggccgcgatcctgtacttttacctgctgttcccgaacagcctttcgctgtccgagagagtggctatcattaagggaacctacgaaccggatgaggattgggaagaacaaagggaagaacggaagaaaaccatggagctgactacccgc

SEQ ID NO: 6648 - DNA, 795 bp, Artificial Sequence
  Description of Artificial Sequence: Synthetic coding sequence
atgaagaaagaggtgtgctcagtggcgttcctaaaagctgtgtttgccgagtttctggcaactctgatttttgttttttttgggcttggaagcgcgctgaaatggccttctgccctgcctacgatactacaaatcgccctcgcgttcggccttgctataggaacactggcacaagctctgggcccagtaagtggtggacacatcaaccccgccataaccctcgccctgcttgtcggcaatcaaatttctcttctcagggcctttttttatgtcgcggcccaactggtaggggcgatcgctggggctggcatattatacggtgtggcacctcttaatgccagagggaatctagctgtcaacgcgctgaacaacaataccacccagggccaggcaatggtggttgagctaatccttacctttcagctggccctgtgtatcttcgcttctacagattcccggcggacaagccctgtcggatccccggcgttgtcgattggccttagtgtgaccttaggccacctggttggcatttatttcaccggctgctcaatgaatccggcccggtcgttcgggccagccgttgtcatgaatagattctctccagcacactgggtcttctgggtgggcccaatagtcggggcggtcctcgccgctatcttgtacttttatcttttgtttcctaacagtctgagtctcagcgagagagttgcaattataaaaggcacgtatgaacctgacgaggactgggaggaacaaagagaggaaaggaagaaaaccatggaactcacaacaagg

SEQ ID NO: 6649 - DNA, 795 bp, Artificial Sequence
  Description of Artificial Sequence: Synthetic coding sequence
atgaagaaagaagtgtgttcagtggcatttctgaaggcagtgttcgccgaattcctggcaactttgatttttgtattcttcggactcggttcggccctcaagtggccaagcgcgttgccgactatcctgcagatcgcgctcgcgttcggactcgcgatcggtacgctggctcaggcactgggaccggtgtcggggggacacatcaatcctgccattactctcgctctgctggtgggaaatcaaatcagcctgctgcgcgccttcttctacgtcgctgcccagctcgtcggagccatcgccggtgccggaattctgtacggagtggcgccgctcaatgcccggggaaatctcgccgttaacgctttgaataacaataccacccaaggacaggcgatggtggtcgagctgatcctcacgtttcaactggcactctgcattttcgcatccactgactcacgcagaaccagcccagtgggcagcccggcgctgtcaatcggactgtccgtgactctcggccacctggttgggatctacttcactggatgctccatgaacccagcgcggtcattcggcccggctgtcgtgatgaatcggttctccccagcacattgggtgttctgggtcgggccgatcgtgggtgctgtcctggccgcaattttgtacttctacctcctgtttcccaacagcctctcgctgagcgagcgggtggccatcatcaaaggaacttacgagccggacgaagattgggaagaacagcgcgaggagcggaagaaaactatggaactgactacccgc

SEQ ID NO: 6650 - DNA, 795 bp, Artificial Sequence
  Description of Artificial Sequence: Synthetic coding sequence
atgaaaaaggaagtgtgctccgtcgccttcttgaaggcagtgtttgcagagtttttggccacccttatctttgtcttttttggacttgggtcagctcttaagtggccgagcgcacttccgactattctccaaattgccctcgcattcggccttgctattggtacgttggcacaggcactgggacccgtgtcgggaggtcacataaatccagctattaccctggcacttcttgtggggaatcaaatttcgttgcttcgagccttcttttacgtcgcagctcagttggtgggggcaatcgcgggtgcggggattctgtacggagttgcgccactcaacgcacggggaaacctggcagtgaatgctctgaacaacaataccacccaaggacaagctatggtggtggaactgattttgacttttcagctcgcactgtgtatctttgcgtccaccgatagcaggagaacttcacctgtgggatcgcccgcactgtcgattgggttgtcggtgactcttggacacctggtgggtatctatttcaccggctgtagcatgaaccctgctcgctcattcggtcccgccgtggttatgaacagattttcacccgcccattgggtattctgggtgggaccgattgtgggagccgtgctggccgcaatcctttacttctacctccttttcccaaattccttgtcactgtccgaacgagtggcgatcataaaggggacttacgagccagatgaagattgggaagagcagagagaagaaagaaaaaagacgatggagcttactacccgg

SEQ ID NO: 6651 - DNA, 966 bp, Artificial Sequence
  Description of Artificial Sequence: Synthetic coding sequence
atgtcagcaaagtccaggactatcgggataataggtgcacctttttcaaaaggtcagccgaggggtggggtcgaagaaggaccaaccgtgttgcgtaaagcagggctgctggaaaagctgaaggaacaagaatgtgacgtgaaggattacggcgatctgcctttcgcggatatccctaacgattcgccattccaaattgtcaaaaaccctagatcagtgggaaaggcaagcgaacaactggctggtaaggtggcagaggtaaagaaaaatggtcgcatctcgctggtcctgggaggcgaccactcccttgcgatcggttccatttccggtcatgcacgggtccatcctgatcttggggtgatttgggtggacgcccataccgacatcaacacccccctcaccactacctcggggaatcttcatggccaacccgtctcctttttgctcaaggagcttaagggtaagattcctgacgtgccgggcttttcgtgggtcaccccatgcattagcgccaaggatatcgtgtacataggacttagggacgtcgatcctggagagcattacattctgaaaaccctggggattaagtatttctctatgactgaggtggatagactgggtatcgggaaggtgatggaagagactctttcgtacctgctggggcggaagaagcgcccaatacatctttcattcgacgtcgacggtcttgatccttcgtttactccagctactggtaccccagtggtcggaggtcttacctaccgtgagggactgtacatcactgaagaaatctacaaaaccggtttgctgtcgggacttgacatcatggaggtgaacccatcgctgggcaagacgcctgaagaagtcactaggaccgtgaacactgcagtggcaattaccctggcatgttttggactggcgagagaagggaaccataagcctattgattacctgaaccctcccaag

SEQ ID NO: 6652 - DNA, 966 bp, Artificial Sequence
  Description of Artificial Sequence: Synthetic coding sequence
atgtccgccaagagccggaccatcggaatcatcggagctccgttctcgaagggacagccacgcggaggcgtagaggaaggacctaccgtgctcagaaaggccggtctgctggagaagctgaaggagcaagagtgcgatgtgaaggactacggtgacctcccttttgcggatatcccgaacgactcaccatttcagatcgttaagaacccaaggtcggtcggaaaggcatcagaacaactggccggtaaggtggcagaggtgaagaagaatggacggatctccctcgtgctgggcggcgaccactccttggccatcggatccatctctgggcacgctcgagtccaccccgatctcggagtcatctgggtggacgcccacactgatatcaacactccattgaccactacctcaggaaatcttcatgggcagccggtgagcttccttctgaaggagctgaagggcaagatcccagatgtcccaggattctcctgggtgaccccatgtatcagcgctaaggacatcgtgtatattggcctccgggacgtggacccaggagaacactacatcctcaagacccttggcatcaagtatttcagcatgactgaggtcgacagactgggaatcggaaaggttatggaggaaaccctgagctatctcctgggtcggaagaaaagaccgatccacctctccttcgacgtggatgggcttgacccgtcgttcaccccggcgactggcactccggtcgtcggaggcctcacttacagggaaggactgtacatcactgaggagatttacaaaactggtttgctcagcggcctggacatcatggaagtgaacccatctctcggaaagactccggaggaggtgacgaggacggtgaataccgccgtggcgatcactctggcttgttttggcctggcgcgcgaaggtaaccataaacccatcgattacctcaacccaccaaaa

SEQ ID NO: 6653 - DNA, 966 bp, Artificial Sequence
  Description of Artificial Sequence: Synthetic coding sequence
atgtctgccaaaagtagaaccatcggaattatcggagcgcccttcagcaaagggcaaccaaggggtggagtagaggagggaccaacggtcctgcggaaagcgggcctcctggagaaactgaaggaacaagaatgcgatgtgaaggactacggcgacctcccttttgcagacatccccaacgactcccctttccaaattgtcaaaaatcctagaagcgtcggcaaagcgtctgagcagctcgccgggaaggttgccgaggtgaagaagaatggccgaatctccctggtgttgggcggcgatcacagtctcgccattgggtccatatccggtcacgcaagagtgcacccagacctaggggtgatctgggtagatgcgcacaccgatatcaacactcccctgacgacgaccagcggaaacctgcacggccagcccgtgagctttctcctcaaggaactcaaaggcaaaatccccgatgtgcctggtttttcatgggtgacaccatgtatcagtgcaaaagacatcgtctacatcggactccgagacgttgacccaggcgaacactacatcctaaaaacattgggtataaaatacttctcaatgactgaggtggaccggctgggaattgggaaggtgatggaagagaccctgtcctacctgctgggacgtaaaaagcggcctattcacttgtcatttgatgtagacggtctcgaccctagttttaccccagccaccgggacacccgtcgtcggggggctgacatatagggaaggactttacattaccgaagaaatttataagaccggccttttgagcggtctggacataatggaggtaaatcctagcctcggcaaaacccctgaggaggtgaccagaaccgtgaacacagccgtggctatcactttggcatgtttcggcctcgcaagagaaggcaaccacaagccgatcgactacctcaatcccccaaaa

SEQ ID NO: 6654 - DNA, 966 bp, Artificial Sequence
  Description of Artificial Sequence: Synthetic coding sequence
atgtcggccaagtcgcgcaccattggaatcattggggcgccgttctccaaaggccaacctcggggcggagtcgaagaaggaccaactgtccttagaaaggctggcctcctggagaaactgaaggagcaggaatgtgatgttaaggattacggagatctgccttttgccgatatcccaaatgacagccccttccagatagtgaagaacccacgctccgtaggaaaggcatcagagcagcttgctggaaaggtcgcggaggtgaaaaagaacggtcgaatttcgctcgtgctgggaggagatcactcgctggccatcggttcgatctccggacacgcacgggtccatccagatctgggtgtgatctgggtcgacgctcatactgacatcaacacccctctgactacgacctctgggaacctccatggccaaccggtcagctttctcctgaaagagctgaaaggcaagatcccagatgtcccaggtttctcatgggtgactccgtgcatctcggccaaggatatcgtgtatatcggactgagggacgtggacccgggggaacactacattcttaaaaccctcggcatcaaatacttctctatgaccgaagtcgaccggctcggtatcgggaaggtgatggaggagactctcagctaccttcttggacgtaagaaacgcccaatccatctgtctttcgatgttgacggactcgaccccagcttcacgccggcaaccggaacgcccgtggtgggaggactgacctacagagaaggactgtacatcactgaggagatctacaagaccggtctgctctccggactggatatcatggaggtgaatccaagcctggggaaaacgccggaggaagtgacccggaccgtgaacaccgccgtcgcgatcaccctggcttgcttcgggttggcgagggagggaaatcacaagccaatagactacctgaatccgccgaag

SEQ ID NO: 6655 - DNA, 966 bp, Artificial Sequence
  Description of Artificial Sequence: Synthetic coding sequence
atgtccgcaaaatcccgcactatcgggatcatcggagccccattttcaaaaggacagccccggggaggggtggaagaaggacccactgtgctgcgaaaggctggactgctggaaaagctgaaagaacaggaatgcgatgtgaaagattacggagatctcccattcgcagatatccctaatgactccccattccagatagtgaaaaatcctaggtccgtgggaaaagcatctgaacagctggccgggaaggtggccgaggtgaaaaaaaacggaaggatctccctggtactcgggggagaccattcattggccatcgggtcaatctcagggcacgcaagagtgcaccccgatttaggagtaatctgggtcgatgcccatacagatataaacacaccccttacaactacttcaggaaacctccacggacaacccgtgtccttcttgctcaaagagctgaagggaaaaataccagatgtccccggattctcatgggtcacaccttgtatcagtgccaaagatatcgtctacatcgggctaagggatgtggatccgggagaacattatatactcaaaactttaggaataaaatatttttcaatgacagaagtggacaggctcgggataggaaaagtgatggaggaaactttgtcctatttgctcggacgaaaaaaaaggcctatacatttatctttcgatgtggacgggctggatccttcttttacaccagctactggaacacccgtggtgggggggctaacataccgggaggggttatatatcacagaagaaatttataagacaggacttctttcaggactcgatattatggaagtgaacccttcccttgggaagacaccagaggaagttacaagaacagtgaatactgcagtagccataacacttgcatgttttggactggctagggaagggaaccataaacctatcgattatctcaaccccccaaaa

SEQ ID NO: 6656 - DNA, 966 bp, Artificial Sequence
  Description of Artificial Sequence: Synthetic coding sequence
atgagcgcgaagtcgagaaccattggaatcatcggagctccattctccaaaggacaaccaagaggcggtgtggaggaaggaccgaccgtcctcaggaaagccggactgctggagaaacttaaggagcaagaatgtgatgtgaaagattacggagatctcccattcgcagacatcccgaatgactcaccgtttcagattgttaagaacccgcggtccgttggtaaggcgtcagagcagctggcggggaaggtggccgaggtgaagaagaatgggcggatctccctggtgctcgggggtgaccacagcctggccatcggatccatatcaggacatgcccgcgtgcatccagatttgggagtgatctgggtcgatgcccacaccgatatcaacacgccgctgaccaccacctcgggaaacctccacggacagccagtcagctttctcctcaaggaactcaagggaaaaatcccggacgtgcctggattcagctgggtgaccccgtgcatctcggctaaggacatcgtatacatcggcctgcgcgacgtggatcctggggaacactacatcctcaagacgctcggaatcaaatacttctccatgaccgaggtggatagattgggaatcggtaaggtcatggaagagactctttcatatttgttgggacgaaagaagcgccctatccatctctcatttgacgtggacgggctcgacccgagcttcaccccagcgactggcactcctgtcgtgggcggcctcacttacagagagggtctttacatcactgaagagatctacaagactgggcttctgtcaggacttgatatcatggaggtgaacccgagcctgggaaagactccggaggaagtgactcgcactgtcaatacggcggttgcaatcactttggcctgcttcggacttgctcgcgaggggaatcataagccaatcgactatcttaacccgccaaaa

SEQ ID NO: 6657 - DNA, 966 bp, Artificial Sequence
  Description of Artificial Sequence: Synthetic coding sequence
atgtccgcaaaatcgagaaccattggcattataggggctccgttcagcaaaggccagccacgagggggagtggaggaaggaccaaccgtgttgcggaaggcgggactcctcgaaaaactgaaggaacaagaatgtgatgtgaaggattacggagatctccctttcgcggacattcctaatgattccccatttcagattgtcaagaacccaaggtcggtcggtaaagcaagcgagcagcttgctggtaaagtggcggaagtgaagaaaaatggcaggatttccttggtgctgggaggcgaccactccctggccatcggttcgatttcgggacatgcacgtgtgcatcctgatttgggggtgatctgggtcgatgcccataccgacatcaacacccctcttactaccacttcgggaaatctgcatgggcaacctgtgtccttcctgcttaaggagcttaagggcaagattcctgatgttcctggtttttcctgggtcaccccttgcatctcggcaaaggacattgtgtacatcggactccgagatgttgatcctggtgagcattacatacttaagactcttggaatcaagtacttctccatgaccgaagtggacaggttgggaattggaaaagtgatggaggaaactctttcttacctgcttggtcggaaaaaacgccccatccacctctcctttgatgtggatggcctggatccgagctttacccctgccactgggacccctgtggtgggaggcctgacgtaccgagaaggactgtacattaccgaggagatttacaagactgggctgttgtcaggtcttgacatcatggaagtgaatccatcgttgggaaagactcccgaagaagttactcgcaccgtgaacaccgcagtggctataactctggcgtgtttcggacttgcgagggaaggaaaccacaagccgattgattaccttaaccctccaaag

SEQ ID NO: 6658 - DNA, 966 bp, Artificial Sequence
  Description of Artificial Sequence: Synthetic coding sequence
atgtccgccaagagtcgaactattggaatcataggagcacctttctctaaagggcagcccagaggcggggtggaggaaggccccaccgtattaaggaaagccggcttgctagaaaagctgaaggaacaggaatgcgatgttaaggattacggcgacctaccatttgcggatattccgaatgatagcccttttcagatcgtaaaaaacccacgaagtgtgggcaaggcctccgaacagctcgcaggcaaagtggccgaagtcaagaaaaatggtagaatctctctggtgctgggtggggaccacagtcttgccatagggtccatttctggtcacgccagagtccacccggatctgggggtgatttgggtggatgctcacactgatatcaacacaccgcttacaaccaccagcgggaatctgcacggccagcccgtatcttttctgttgaaagagctgaaaggtaaaatccctgacgtaccaggttttagttgggtgacgccatgtatctcagctaaggatattgtttatataggcctgagggatgtggacccaggagaacactatattcttaagaccctggggattaagtatttcagcatgacagaggttgaccgactcggtatcggaaaagttatggaagaaactttgagctatttgttgggaagaaagaagcggccaatccacttaagctttgatgtcgatggcctggacccaagtttcacccccgccaccggcaccccagtggtggggggcctcacttaccgcgaaggcctctacattaccgaagagatctataagacaggcttactgagtggcctcgatatcatggaagtgaatccctccctgggaaaaacaccggaagaagtgactagaacagtaaacactgccgtggccatcacgctcgcttgcttcggtctagcacgagaggggaatcataagcccatagattacctaaacccacctaag

SEQ ID NO: 6659 - DNA, 966 bp, Artificial Sequence
  Description of Artificial Sequence: Synthetic coding sequence
atgtcggccaaatcccggaccattggcatcatcggcgcccccttttccaagggccagcccaggggcggagtcgaggaaggtccgaccgttttgcggaaagccgggctgcttgagaaacttaaggaacaagaatgcgatgtgaaggactacggagatttgccattcgcggacatcccgaatgactccccgttccagatcgtcaagaacccccgctcagttggaaaagcctcggagcagttggcaggcaaagtcgctgaggtgaagaagaacggcagaattagcctggtgctcggaggggaccactccttggcgatcggaagcatcagcgggcatgccagggtgcatccagatctgggggtgatctgggttgacgcgcacaccgacatcaacaccccactgactactacttctggcaatcttcacggtcaacctgtgtcctttcttctgaaggaattgaagggtaagatccctgatgtgccaggattcagctgggtcacgccgtgcatctcggccaaggacatcgtgtacatcggcctccgcgatgtggacccaggggagcactatattctgaaaactctcggaattaagtacttctcaatgactgaggtggaccgcttgggaatcggaaaggtcatggaagagactctctcctacctgcttggtcggaagaaacggccgatacacctgtcattcgacgtcgatggtctggacccgtcgtttacccctgcaactggaactccggtcgtgggaggcctcacgtacagagaaggactctacatcaccgaggaaatctacaagactggtctgctgtctggactggatatcatggaagtgaaccctagcctcggcaagaccccggaagaagtgactcgtactgtgaatacggctgtggcaataaccctcgcttgtttcggtctggctagagaaggaaaccataagccgatagattacctgaatcccccgaag

SEQ ID NO: 6660 - DNA, 966 bp, Artificial Sequence
  Description of Artificial Sequence: Synthetic coding sequence
atgagcgctaaatctaggacaataggaatcataggagcaccgttcagcaaaggtcagccccggggaggagtcgaagagggtccaaccgtgctccgcaaggccggtctgcttgaaaagctgaaggagcaggagtgcgatgtgaaagactatggggatctacccttcgcggacatccctaatgattcgccattccagattgtgaaaaacccacggagcgtggggaaggcaagcgaacagctggcaggtaaggtggcagaggtgaaaaagaatggtcgaattagcctcgttctgggcggggaccacagtctcgccatcggctccatctcaggccatgcgagagtgcaccccgatcttggggtcatctgggtggatgcacataccgatatcaatacgcccctgacgaccacatccggcaatctgcacgggcagccagtgtcctttctgcttaaagagctgaagggtaagatccccgatgttccaggtttcagctgggttaccccctgtatttccgccaaggatattgtctacatcggtttacgagacgtggatccgggtgagcactatatcctgaagaccctgggaattaaatatttttctatgacagaggtggaccggctcggaataggtaaggttatggaggagacactttcctacctgcttggtcgaaaaaagcgccctatccatctatccttcgacgtggatggattagacccaagctttactcctgctacgggcacccccgtcgtgggaggtctgacttatcgtgaaggactgtacatcactgaggaaatatataagacgggcttactctctggcctggacatcatggaagttaacccatcactgggcaagacgcctgaggaggtcacgaggaccgtaaacactgcagtggccatcaccttggcctgctttggcttagccagggaagggaatcacaaaccaatcgattacctgaacccgcccaag

SEQ ID NO: 6661 - DNA, 966 bp, Artificial Sequence
  Description of Artificial Sequence: Synthetic coding sequence
atgtcggcgaaatcgcgtacgataggtataataggtgcgccgttttcgaaaggtcaaccgcgaggtggtgttgaagaaggtccgacggttctacgaaaagcgggtttattagaaaaactaaaagaacaagaatgtgatgtaaaagattatggtgatttaccgtttgcggatataccgaatgattcgccgtttcaaatagtaaaaaatccgcgatcggtaggtaaagcgtcggaacaactagcgggtaaagttgcggaagtaaaaaaaaatggtcgaatatcgctagttttaggtggtgatcattcgctagcgataggttcgatatcgggtcatgcgcgagttcatccggatctaggtgtaatatgggtagatgcgcatacggatataaatacgccgctaacgacgacgtcgggtaatttacatggtcaaccggtatcgtttttactaaaagaactaaaaggtaaaataccggatgtaccgggtttttcgtgggtaacgccgtgtatatcggcgaaagatatagtttatataggtctacgtgatgttgatccgggtgaacattatatattaaaaacgttaggtataaaatatttttcgatgacggaagttgatcgtttaggtataggtaaagtaatggaagaaacgttatcgtatttattaggtcgaaaaaaacgaccgatacatttatcgtttgatgtagatggtttagatccgtcgtttacgccggcgacgggtacgccggttgtaggtggtctaacgtatcgagaaggtctatatataacggaagaaatatataaaacgggtctactatcgggtttagatataatggaagttaatccgtcgttaggtaaaacgccggaagaagttacgcgtacggtaaatacggcggtagcgataacgctagcgtgttttggtttagcgcgagaaggtaatcataaaccgatagattatttaaatccgccgaaa

SEQ ID NO: 6662 - DNA, 966 bp, Artificial Sequence
  Description of Artificial Sequence: Synthetic coding sequence
atgagcgcaaagtcccggaccatcgggatcattggtgcaccgttctctaagggccagccacgcggtggcgtggaggaggggcccactgtgctcaggaaggcaggcctgctggaaaagctgaaagagcaggagtgtgacgttaaagactacggcgacctgccgtttgcggatatcccgaatgactcaccttttcagatcgttaagaacccgaggtcagtggggaaggcgagcgaacaactcgccggtaaggttgcggaggtgaagaaaaatgggcgtattagcctggttctcggcggcgaccactccctggctattggctccattagcgggcatgctagggttcaccctgatctgggcgtcatctgggttgatgctcacactgatataaacactccactgacgaccacgagcggtaacctgcacggccagccggtttcttttctgttgaaagagctgaagggcaagattcctgacgtaccaggcttcagctgggttacgccgtgcatcagtgcgaaggacatcgtttacattggtctgcgagatgttgacccaggcgaacactacatcttaaaaacactcgggattaagtacttcagcatgaccgaagttgatcgcttgggtatcggcaaagtgatggaagagactttaagctatctgttaggtcgcaaaaaacgccctatccacctgagcttcgatgttgatggtctggacccgagcttcaccccggcgacggggacccccgtggtcggcggcctgacgtacagggagggcttatatatcaccgaagaaatctataaaactggcctcctgagcggtctggacatcatggaggttaacccatctttggggaaaaccccagaagaggtgacccgcaccgtaaatacggccgtggccatcactttggcctgcttcggattggcccgcgagggtaatcataaaccgatagattacctgaatccacctaag

SEQ ID NO: 6663 - DNA, 966 bp, Artificial Sequence
  Description of Artificial Sequence: Synthetic coding sequence
atgagcgcaaagtcacgtacaattggcattatcggggctccatttagcaagggccagccccgtggcggagtcgaagaggggcccaccgtactgaggaaagccggcctgttggaaaagcttaaagagcaggagtgtgacgttaaagactacggcgatttaccctttgccgacattcctaacgatagcccttttcagatagtgaaaaatcctcgtagtgtgggaaaagcctccgagcaactggctggtaaagtcgcggaagtcaaaaaaaacggcaggatttcattggttttaggcggcgatcactccctggctataggaagtatttctgggcacgcacgcgttcaccccgatctcggagtgatctgggtcgatgcccataccgacatcaatacccctctgaccaccacttctggaaacttgcatggccagcccgtctcctttcttctgaaggagctgaagggcaagattccggatgtccccggattctcatgggtgaccccttgtatttcggcaaaggacatagtgtacattggattgcgcgatgtggatcctggcgaacactacatacttaagaccctggggatcaaatacttttccatgaccgaggtggatcgcctgggtattggtaaagtcatggaagaaacactcagctatctattgggcaggaaaaaaaggccaattcacctttccttcgatgtggatgggttggacccttctttcaccccagcaaccgggacccccgttgtggggggtctgacctacagagagggcctgtacattactgaggaaatctataagaccggcctgctttccggcctggacattatggaagttaacccgtctttaggcaaaactcctgaagaagttacaaggaccgttaatacggctgtagccatcaccttagcctgcttcggcctggcgagagagggcaatcataagcccattgactacctgaacccaccaaag

SEQ ID NO: 6664 - DNA, 966 bp, Artificial Sequence
  Description of Artificial Sequence: Synthetic coding sequence
atgtccgccaagtccagaactattgggattattggtgcacccttttcgaaggggcagcctcgtgggggagtggaagaaggtcccactgtccttcgaaaggccggtctgcttgaaaagctgaaggaacaggagtgtgatgtgaaagattacggagatctgcctttcgccgacattcccaacgacagcccatttcagattgtcaagaatccccgcagcgtcgggaaggcatccgaacaactggcaggaaaggtcgccgaagtgaaaaagaatggtaggattagccttgtccttggtggagatcattcccttgcaatcgggtcgatttcaggccacgcgcgggtccacccggatcttggggtcatttgggtggacgcccacactgacattaacacgccactgactactaccagcggtaacctgcatggacagccagttagctttctgctgaaggaacttaagggaaagattccagacgtgcccggattttcctgggtcaccccatgcatctcagcaaaagacatcgtgtacattggtctgcgagacgtggacccaggagagcactacattctgaaaacccttggaattaagtacttctcgatgaccgaggtcgatagacttggcattggaaaagtgatggaagaaactctctcctaccttttgggacggaagaaaagacccattcatctttcttttgatgtggacggactcgatccatcatttacccctgctaccggtactccggtggtggggggacttacctacagggaagggctctacataaccgaagagatctataagaccggattgctgtcgggactcgacattatggaggtgaacccttcattggggaaaacccctgaagaagtgacccgcacggtgaacaccgcggtggctatcactctggcgtgtttcggacttgcgcgcgaaggcaaccataaacctattgattacctcaaccctccaaag

SEQ ID NO: 6665 - DNA, 966 bp, Artificial Sequence
  Description of Artificial Sequence: Synthetic coding sequence
atgtccgcgaaatcaagaactatcggaataataggagctccattctcaaaagggcagccaagggggggagtagaagaaggacccactgtattgaggaaagccggattgctcgaaaaactgaaagaacaggaatgtgatgtgaaggattacggagacctgccgttcgcagatattcccaatgattctccatttcaaatagtgaaaaaccccaggtccgtgggaaaagcatctgaacagctcgcagggaaggtagcagaggtcaaaaaaaacgggaggatatctctagtgcttggaggagatcacagtctagctattgggtcgatctctggacacgcccgcgtgcatccagacctaggagtcatctgggttgacgcccatactgatataaacactcctttgactactacttctggaaacctacacggacagcccgtctccttcttgctcaaggagctgaaaggaaaaatccctgatgtgcctggattttcttgggtcactccttgtatctccgcaaaagatatcgtatacatcggactaagagacgtggatcctggggaacattatattctgaagactcttgggatcaaatatttctcaatgacagaagtggacaggctggggattgggaaagtcatggaagaaacactgtcgtatctactggggcggaaaaaaagaccaatccacctgtccttcgacgtcgatggactggatcctagttttacgcccgcaacaggaacacccgtggtgggaggactgacatatagggaaggattgtatataacagaagaaatctataaaacaggactcctgtctgggctcgatatcatggaagtgaatccctctctcgggaaaactccagaggaagtgacaaggacagtaaatactgctgtggctataacattagcttgtttcggactggccagggaagggaatcataaaccaatagattatttaaatccgcccaaa

SEQ ID NO: 6666 - DNA, 966 bp, Artificial Sequence
  Description of Artificial Sequence: Synthetic coding sequence
atgtcagcgaagagccgcactatagggattatcggggcccccttttcaaaaggacagccacgcggaggggtcgaggaaggtcctacggtgttgagaaaggcggggttgctcgagaagctcaaagaacaggagtgtgacgttaaagactatggtgatctaccattcgccgacattccaaatgactctcctttccagattgtgaagaacccccgctccgtgggaaaggcctcagagcaactagccggaaaggtggcagaggttaaaaagaacggaagaatctcactggtcctcggcggcgatcacagtctggcgatcgggagtatttcgggacacgcccgagtacacccagatttgggtgtgatctgggtggatgcgcatactgacatcaatactcccttgacaacgacgtccggtaacctgcacggccagccagtctcattcctactgaaggagctgaaaggtaaaatccccgacgtgccaggcttttcgtgggtgacaccctgcattagcgccaaggacatcgtctatattggcctgagagacgttgatccaggggagcactacatcctgaagaccctcgggattaaatacttttcaatgactgaggtggaccgtcttggaattggcaaggtaatggaggaaactctctcatacttgctcggaagaaagaagaggcctatccacctgtccttcgacgttgacggactggaccccagctttacccccgcaaccggaacacctgtagtaggaggcttgacgtaccgagagggcctgtatattaccgaggagatttacaagacagggttgctgtcaggcctcgatatcatggaggtgaacccatccctgggaaagactcctgaagaagtgacacgcacggttaatacagccgtggctatcacccttgcctgctttggcctcgcgcgcgaagggaatcacaagcccattgattatctgaacccccctaaa

SEQ ID NO: 6667 - DNA, 966 bp, Artificial Sequence
  Description of Artificial Sequence: Synthetic coding sequence
atgagcgcaaagagccgtacgatcggtatcatcggtgcacccttttcgaagggccagcctaggggtggtgtggaggagggacctactgtgctccggaaggcaggactgctggaaaagttgaaggaacaggagtgtgacgtcaaggactacggtgatctcccgttcgccgacataccaaatgattcaccctttcagatcgtgaagaatccacgttccgtgggcaaggcctcggaacaactggcaggtaaagtggctgaagtcaagaagaacgggagaatttctcttgtcctgggaggggaccattcgcttgcgattggcagcatcagcggacatgccagagtgcatcccgatctcggtgtcatttgggtcgatgcacacaccgacattaacacccctctgaccacgacttcaggcaacctgcacggccaacctgtgagttttctgctcaaggaacttaagggtaaaatccccgacgtgcccggattttcgtgggtgaccccttgtatctccgcgaaggatatcgtgtacatcggtcttagagatgtcgatcccggcgaacactatatcctcaaaaccctggggattaagtacttctcgatgacggaagtggataggcttggcattggtaaggtgatggaggaaaccttgagctaccttctgggcagaaagaaaagacctattcatctgagctttgatgtcgacggactggacccatctttcactcccgcaactgggactccagtcgtcgggggtcttacctaccgcgagggcctttacattactgaagagatatacaaaactgggcttctgagcggtcttgacattatggaagtgaaccctagccttggtaagaccccagaggaggtaactagaaccgtgaatactgcagttgcaattacgctcgcctgctttggactggctagggaggggaatcacaaacctattgactacctcaaccctcccaaa

SEQ ID NO: 6668 - DNA, 966 bp, Artificial Sequence
  Description of Artificial Sequence: Synthetic coding sequence
atgtcagctaaaagtcgaacaataggtattattggagctccattttctaagggacaacctagaggtggtgtggaggaaggaccgactgtgctgagaaaagccggccttctcgaaaagcttaaggaacaagaatgtgatgttaaagattatggtgatcttcctttcgcagacattccgaatgacagcccattccaaatcgttaaaaaccccaggtcggttgggaaggcatcggagcaattggcaggaaaggtggctgaagttaagaagaacggccgcatatctctggtccttggaggtgaccattcgcttgcaataggcagtatctctggtcatgcgagggtacatccagaccttggtgtcatttgggttgacgcgcacacagatataaacacacccctgaccacaaccagcggtaatctgcacggtcagcctgttagcttcctgttgaaggaactcaaggggaagatcccagacgtcccaggttttagttgggttacaccttgtatatccgccaaagatatcgtttacatcggtctgagagacgttgatcctggcgagcattacattctgaaaactttggggattaaatacttttctatgactgaagttgaccggcttggtataggtaaggttatggaagagacgctctcttatcttttaggtaggaagaaacgaccgattcacctatcatttgacgttgacggcctcgacccaagctttacgccagcaacaggtacccctgttgtggggggattaacctaccgggaaggattgtacattactgaagagatatacaaaaccgggctgttaagcggacttgatattatggaagtgaacccttctcttggaaagacccctgaagaagttaccaggacagttaacactgcagtagccataaccctagcatgttttgggcttgcaagagaaggaaatcataaacctatcgattaccttaaccctccaaag

SEQ ID NO: 6669 - DNA, 966 bp, Artificial Sequence
  Description of Artificial Sequence: Synthetic coding sequence
atgtcggcgaaaagcagaaccatcggcatcatcggtgcccccttcagcaagggccaaccgcgcggcggtgtcgaggagggacccacggtcctccgtaaagctggcctgctcgagaagttgaaggagcaggagtgcgatgtgaaggattatggagaccttcctttcgctgatataccaaacgactctcccttccaaatcgtgaagaacccccggagcgtcggcaaggcatccgagcagctggccggtaaggtcgccgaagttaaaaagaacggccggatctctctggttctgggcggagatcactcactcgccataggatctatcagcgggcacgctcgggtgcatcccgacttaggagttatatgggtggatgctcacacagatatcaatacccccttaactaccacttctggaaaccttcacgggcagcctgtctcttttttgctcaaagaactcaagggtaagatcccagacgtgccgggcttttcttgggtaactccttgcatatctgccaaagatatcgtttacatagggctgagagatgttgaccccggggaacactacatcttgaagacgctggggatcaagtacttcagtatgacagaagtcgatagactcgggatcgggaaagttatggaggagactctctcctatctgcttggaagaaagaaaagaccaattcacctctcttttgacgtcgacgggctcgatcctagctttaccccagctaccggcacgccagtggttggcggactcacttaccgagaggggctgtatatcacagaggagatttataagaccggactgctgagcgggcttgacattatggaggttaatccttcgctcggtaaaacacccgaggaggttactagaaccgtgaataccgcagtggcgattaccctggcgtgtttcggactcgcacgtgaaggaaaccataaacctatcgattacctgaatccacccaaa

SEQ ID NO: 6670 - DNA, 966 bp, Artificial Sequence
  Description of Artificial Sequence: Synthetic coding sequence
atgtcagccaagtctagaacaataggcatcataggggcaccattttctaaaggtcagcccaggggcggggtagaagagggccccactgtgcttagaaaggccggtttactcgaaaaattaaaagaacaggagtgtgatgtgaaggattacggagatctgccatttgctgatattcctaacgatagccctttccaaatcgtgaaaaacccccgtagcgtaggcaaggcttctgagcagctcgcaggcaaagtcgccgaagtgaagaaaaatgggaggatcagcctggtgctcggtggtgaccacagcctcgcaatcggaagcatctccggtcacgcaagagtccaccccgatttgggcgtcatttgggtcgacgcccatacggacatcaacaccccactcaccacgacttctggaaacctgcacggccagccagtgtcgtttctgctcaaggaactgaaaggcaagatccccgatgtgcccggattcagttgggttacaccatgcatcagcgccaaagatattgtgtatataggacttcgggacgttgatccgggagagcactacatcttgaagactcttggaatcaagtacttttccatgaccgaagtggatcgcttagggattggcaaagtgatggaagagactctgagctatttattggggagaaaaaagcgcccaatacacttgtcctttgacgtggacggcctagacccttcctttactcctgcaactggcacacccgtggtcggcggcctaacttatagggagggtttgtatatcaccgaagaaatctacaagaccggactcctttcaggcttagatataatggaagtgaacccatcactgggcaagactccagaggaggtgacacggaccgttaacacggccgtcgctatcacgttagcttgttttgggctggctcgtgaggggaaccataaacctatcgattatcttaacccgcctaaa

SEQ ID NO: 6671 - DNA, 966 bp, Artificial Sequence
  Description of Artificial Sequence: Synthetic coding sequence
atgagcgccaagtcacgaacgatcggtatcatcggcgcgccgttctccaagggacaaccccggggcggagtcgaggagggacctacggtgctcaggaaggccggcctgctcgagaagttgaaagaacaggagtgcgacgtgaaagattacggagatctgcctttcgccgacatcccaaacgacagcccgttccagatcgtgaaaaatccgagaagcgtgggaaaagcatcggagcaactcgccggcaaggtggcagaagtgaaaaagaacggacggatctcactggtgctgggcggagatcactcccttgccatcggttctatctccggacatgcacgggtgcatccggacctcggagtgatatgggtggatgctcacactgacatcaatactccgctcaccaccactagcgggaaccttcacggacagccagtctccttcctgctcaaagaactcaaaggaaagatccctgacgtgcctgggttttcatgggttacgccatgtatctcagctaaggacatcgtgtacattggtctgcgggatgtcgatccgggcgagcactatattctcaaaactctgggaatcaagtacttcagtatgactgaggtcgacagactgggaatcggcaaagtgatggaagaaaccctgagctacctgctgggaaggaaaaaacggccgatccatctgtcgttcgacgtggatggccttgatccgtcgttcaccccggccacgggaaccccggtggtgggcggcctcacgtatcgcgaaggactttacatcactgaagagatctacaagactggcctgctctcgggtctggatatcatggaggtgaatccaagcctcggcaagacccctgaagaagtcactcggactgtcaacacggccgtcgcgattacgttggcttgcttcggcctcgcgagagagggtaaccacaagcctatcgattacctgaacccgccgaag

SEQ ID NO: 6672 - DNA, 966 bp, Artificial Sequence
  Description of Artificial Sequence: Synthetic coding sequence
atgtctgctaagtccaggaccatcggaataatcggagcacctttctccaagggccaaccacggggaggagttgaagagggccctaccgtactcagaaaggcaggcctgttggagaagctcaaggaacaggaatgcgacgtcaaggattacggcgatcttccattcgcagatatacctaatgattctccctttcagatagtgaagaacccaagaagcgtggggaaagcgagcgagcaactggccggaaaggtcgctgaagtcaagaagaacggcagaattagcctggtcctcggaggagaccactccttggcaatcggaagcatatccgggcacgctagagtacatcctgatctcggagtaatctgggtggatgcacataccgacattaatacaccacttaccaccacttctggcaacctacacggccagcctgttagctttctgctcaaagaactgaagggaaagataccagatgttccgggcttttcatgggtgaccccttgtattagcgctaaggacatcgtttacatcggactacgggacgtcgatcctggagaacactacatccttaaaaccctgggcattaagtacttctccatgaccgaggtggatcgcctgggtataggcaaagtgatggaggagactctttcctacctgcttgggcggaagaagcgcccgatccaccttagcttcgacgtagacggcctggaccctagctttacccctgctaccggcacccccgtcgtgggtggattaacctacagagaagggctgtacataaccgaggagatctataaaaccggcctcctaagtggattagatatcatggaggtgaacccctcactgggcaagacccccgaggaagtgaccaggacagtcaatacagccgttgcaattactctggcttgcttcggtcttgcaagagagggtaatcacaagcctatcgattaccttaaccctccaaaa

SEQ ID NO: 6673 - DNA, 966 bp, Artificial Sequence
  Description of Artificial Sequence: Synthetic coding sequence
atgagcgctaagtcgcggactattgggatcatcggtgcaccgttctcgaaagggcaaccacggggaggagtcgaagaagggcctacggtcctgcgcaaagccggcctgctggaaaagttgaaagaacaagagtgcgatgtgaaggactacggcgatctgccgttcgcggacatcccgaatgactcgcctttccagattgtgaagaacccgagatcagtcggaaaggcttccgaacagctcgccggaaaggtggctgaggtgaagaaaaacggccgaatttcgctggtccttggcggcgaccactccctggctatcggctcgatctcaggacacgcgcgggtgcacccagacttgggggtgatctgggtggacgcgcacaccgatatcaacactcccctgaccactacctcaggaaatctgcatggacagccagtgtcattcctgctgaaggaactgaagggaaagatcccagacgtgccaggattctcatgggtgacgccgtgcatctcggcgaaagacatcgtgtacatcgggctccgcgacgtcgacccaggcgagcactacatcctcaagacccttggcatcaaatacttctccatgactgaggtcgaccgcctcggtatcggaaaggtgatggaggaaacgctgagctacctgctgggtcggaagaagcgaccgatccatctttcatttgatgtggacgggctggatccctccttcactcctgcgaccggaactccagtggtgggcggactgacctaccgcgaaggtctgtacatcactgaagagatctacaaaacggggctgctgtcaggacttgacataatggaagtgaatccgtcactcggaaaaactccggaagaggtgactcgcactgtcaatactgccgtggctattactctggcttgtttcggactcgccagagaaggtaaccacaagccgatcgattacttgaaccccccaaag

SEQ ID NO: 6674 - DNA, 966 bp, Artificial Sequence
  Description of Artificial Sequence: Synthetic coding sequence
atgagcgcaaagtcaaggaccataggaataatcggtgcacccttttcgaagggacaaccacgtggtggagtcgaagagggacctaccgtgctgagaaaagccggactgctggaaaagctgaaggaacaagaatgtgatgtcaaggattatggtgatcttcctttcgcagacattccaaacgattcgccatttcagatcgtcaagaatccgagatccgtcggcaaggcatccgagcaacttgccggtaaagtggctgaagtcaagaaaaacgggaggatctcccttgtgcttgggggcgaccattctctggcaattgggtcgatctccggccatgcacgtgttcatccggatctgggggtgatttgggttgacgctcacactgatatcaacactccacttactaccacttccggaaaccttcacggtcagccagtgtcatttcttctgaaggaactcaagggtaagatcccagacgtgcctggattctcctgggtgaccccgtgtatctcggcaaaagatattgtttacattgggcttcgtgatgtcgacccaggggaacactacattctcaagactcttggtattaagtacttttcaatgaccgaggtggatcggcttggcattggcaaggtgatggaggaaactctgtcctacctgttggggcgaaaaaagcgccctattcatctctcattcgatgtggatggacttgatcctagcttcaccccagcaactgggacgccagtggtcggtggattgacgtacagggaaggactgtacatcaccgaagagatttacaaaaccggtctgctgtcgggacttgacatcatggaagtgaacccatcgctgggtaagactccagaagaggtgactaggaccgtgaacaccgcggtggcaattacccttgcttgctttggcctcgcaagagagggaaatcacaaacccattgattacctgaacccccctaag

SEQ ID NO: 6675 - DNA, 966 bp, Artificial Sequence
  Description of Artificial Sequence: Synthetic coding sequence
atgtccgcaaagtcgcgcaccataggaatcataggagcacccttttctaagggacaaccgcgaggaggggttgaggaaggtcctactgtccttcgaaaggccggactgcttgaaaagttgaaggaacaagagtgcgatgtgaaggactacggagatctgccttttgcagacattccaaacgactcccctttccaaattgtcaaaaaccccagatcagtgggaaaagcatcggaacaactcgccggtaaggtcgcggaggtcaagaaaaacggaagaatctcattggtcctggggggcgaccatagcctcgccattggatcgatctcaggccatgctagggtgcatccagacctgggagtgatctgggtggatgcacacaccgacatcaatactccccttaccacgaccagcggtaatctgcatgggcagccagtgagctttctgcttaaagaactcaagggcaagattcccgatgtccctgggttttcatgggttactccatgtatatccgccaaagatattgtctacataggccttcgagacgtggatcctggagagcactacatcctgaaaaccctcggtatcaaatacttttcgatgaccgaggtcgacagactcggaattggaaaggtgatggaagaaactctctcgtatcttcttggacgcaagaaaagaccaattcaccttagttttgacgtggatggactggatccatcgtttactccagcaactggaaccccggtggtgggcggactgacctaccgcgaaggcttgtacatcaccgaagagatatacaaaactggactcttgtcggggcttgatatcatggaagtcaatccttccctgggtaagacgccggaagaagtgactcgaaccgtcaacaccgccgtggcaattacccttgcatgtttcggactggctcgcgagggcaatcataaacctatagactacctgaatcctccgaaa

SEQ ID NO: 6676 - DNA, 966 bp, Artificial Sequence
  Description of Artificial Sequence: Synthetic coding sequence
atgtctgccaagtcccgtactatcggcataatcggcgctcccttcagtaagggccagccaaggggcggcgtagaagaagggccgaccgtgctcaggaaagcaggtctccttgagaagttgaaagagcaggaatgcgacgtaaaagactatggagatttgccatttgccgacatccctaatgactcccctttccagatcgttaaaaatcctcgttccgtcggcaaggcttcagagcagctggctggcaaggtcgcagaggtgaagaagaacggtagaatctcccttgtgctaggtggagatcatagcctggcaattgggtccatctcaggacatgcaagggtacaccctgatcttggggtgatctgggtggacgcgcacaccgacattaacacccccctgacaaccacgagcggaaatctgcatggccagcctgtctcctttctactgaaggagctaaagggaaaaatccccgacgtgcccggcttttcctgggtgacaccttgcatctcagccaaagacattgtttacatcggactgagagacgtggaccctggcgagcactacattttgaaaacgttgggcatcaaatacttcagtatgaccgaggtggaccgtcttgggatcggtaaggttatggaggagactctgtcttatttgctcggacgtaaaaaacgcccaattcatctgagctttgacgtcgatggcctggaccccagtttcacaccggctactgggacgcctgtagtgggggggttgacttaccgggaagggctgtacattaccgaggagatatataagaccggcttgctgtctggcctggacatcatggaggtgaacccctctctggggaagacccccgaagaagtgacacggacggtgaatactgcagtcgctatcaccctcgcgtgttttggactagcgcgtgaggggaaccataagccaatcgactacctgaatccaccgaag

SEQ ID NO: 6677 - DNA, 966 bp, Artificial Sequence
  Description of Artificial Sequence: Synthetic coding sequence
atgtccgccaagtcccgcactataggcattatcggtgccccattctccaaaggccaaccccgtggcggagtcgaggaaggccccacagtattgcgtaaggctggcctcctcgagaaactgaaggaacaggaatgcgatgtgaaggactatggagatctgccatttgccgatatcccaaatgacagtcctttccagatcgtgaagaatccacgctccgttggcaaggctagcgagcagctcgcaggaaaagtggctgaagtcaaaaagaacggccgcatctccctcgttctgggtggtgatcacagtctggccattggatccatctctggacacgccagagtgcaccctgacttgggcgttatatgggttgacgcacatactgacatcaacaccccactgacaacaaccagtggtaatttgcatggacaacctgtttccttcctgctgaaagaactcaaaggcaaaatacctgatgtccccggtttctcatgggttactccttgcatctccgctaaagatatcgtgtacattggtctccgcgacgtggaccctggtgaacactatatcctcaaaacattgggcattaagtacttttcaatgaccgaggtcgaccgccttggtataggtaaggttatggaggagaccttgagttatctgttgggcaggaagaagcgcccaatccacctctctttcgacgtggacggcctggatccctctttcactcctgccaccggcactccagtcgtgggtggcctgacttatagggaaggactgtacattaccgaggaaatctataagactggtcttctttccggcctggacatcatggaagttaacccttctctcggcaaaacaccagaagaggtcacccgcactgttaacactgcagtggctatcaccctcgcttgctttggcctcgcccgcgagggtaatcataagcctattgactacctgaacccaccaaag

SEQ ID NO: 6678 - DNA, 966 bp, Artificial Sequence
  Description of Artificial Sequence: Synthetic coding sequence
atgagtgctaaatcccgcacaatcggcatcatcggggcaccctttagcaagggacagcccagaggcggcgtggaagagggccctacagtgctcaggaaagcaggcctgctggagaaacttaaggaacaggaatgtgacgtaaaggattacggcgatctgccattcgccgatattcccaacgacagcccctttcagattgtcaagaatcctaggagcgttggtaaggcctcagagcagctggcaggcaaggtggcggaggtgaagaaaaacggaagaatcagtctggtgctcggaggtgatcacagcctcgccatagggagcattagcggacatgccagggtgcaccctgacctcggtgttatctgggttgacgctcataccgatatcaatacccccctgactacaacttctggcaatctccatggccagcctgtgtcattcctcctgaaagaactcaaaggcaagatcccagatgtgccaggtttctcttgggtcacgccctgcataagtgcaaaagatatcgtttatatcggcctgagagacgttgacccaggtgagcactacatccttaagaccctgggcattaagtacttcagcatgacagaggtggaccgactgggcatcggcaaagtcatggaggagaccctgagttacctgcttggacgcaaaaagcgccccatccacttgagcttcgacgtcgatggcctggacccttccttcaccccggccaccggaacacccgtggtaggcggcctcacttatcgcgaaggtctctatatcacagaggaaatttacaaaaccgggctgctgtcaggcctggacatcatggaggtgaacccgtcactgggcaaaacccctgaagaggtaacaagaacagtgaacactgcagtcgcaattacactggcgtgctttggtcttgcccgggagggaaaccataaacctatagattacctgaatcccccaaag

SEQ ID NO: 6679 - DNA, 966 bp, Artificial Sequence
  Description of Artificial Sequence: Synthetic coding sequence
atgagcgccaaaagccggaccataggcataatcggagcccctttttctaaaggacaacccagaggcggagtggaagaaggccccaccgttctgcggaaagccggactgctggaaaagctgaaggaacaggaatgtgacgtgaaggactacggagacttgcctttcgccgacatccctaacgatagcccatttcaaatcgtgaagaacccacgctctgtaggtaaggcaagcgaacagttggccggcaaagtggccgaagttaagaagaacggaaggatctcacttgtccttggcggcgaccacagtctggctatcgggtccatcagcgggcatgccagggtccaccctgacctgggcgttatctgggtggacgctcacacggatatcaacaccccccttaccaccacatctggaaaccttcacggccagcctgtcagctttctcctcaaggaactgaagggaaagatccccgacgtgccgggctttagttgggtgacgccttgcatctctgccaaagatatcgtttacatcggattgcgcgatgtcgatccaggagaacactatattctcaagacccttggaatcaaatacttctctatgaccgaggtggatcgcctgggcatcggcaaggtgatggaagaaacactcagttatttgctaggacgcaaaaaaagaccaatacacctctcctttgacgtagacggtctggatcctagctttaccccagctactgggaccccagtagttggcgggctgacctacagggaaggactctacatcacagaagaaatctataaaacaggactgctgtcggggcttgacatcatggaggtgaacccctctcttgggaagacacctgaagaagtgacccgaaccgttaatacagctgtggccattactcttgcttgtttcggactcgctagagaagggaaccacaaacctatagattaccttaatcctccgaag

SEQ ID NO: 6680 - DNA, 966 bp, Artificial Sequence
  Description of Artificial Sequence: Synthetic coding sequence
atgtcagcgaagagccggactatcggcatcattggagctccattctcgaaaggacagccacgcggaggagtggaggaaggccccaccgttttgaggaaagcgggattgcttgagaagttgaaggagcaggagtgcgatgtgaaggattacggtgatttgccatttgccgacatccccaacgactcaccattccagatcgtcaagaacccccggtccgtgggaaaggcgagcgaacagttggcgggaaaggtggccgaagtgaagaaaaacggtcgcatcagccttgtcctcggcggagatcattcgctcgcgatcggcagcatcagcggacacgcgagagtgcaccccgacctgggcgtgatctgggtcgacgcacacacggatatcaatacgcctttgactaccacctccggaaacctgcatggacaacctgtctctttcctgctgaaagagcttaagggaaagatcccggacgtgccgggcttctcatgggtcacgccatgcatcagcgcgaaggacatcgtgtacataggactgcgggatgtggaccccggagaacactacattctgaaaaccctgggaatcaaatacttttcgatgactgaagtggaccgcctcggaattggcaaagtgatggaagaaactctgtcgtatctgcttggacggaaaaagaggccgatccacctgtcgttcgacgtggacggactggacccgagcttcactccagccaccggaaccccggtggtgggaggcctgacctacagagaaggactgtatatcaccgaggagatctacaagactggactgctgagcgggctggatatcatggaggtcaacccgagcctgggaaagactccggaggaagtcaccaggactgtgaataccgcggtcgcaatcactcttgcttgctttggcctggcccgcgaaggtaatcataaacctattgactacctcaacccgccgaag

SEQ ID NO: 6681 - DNA, 966 bp, Artificial Sequence
  Description of Artificial Sequence: Synthetic coding sequence
atgagcgccaagtcccgaactatcgggatcattggagcgccgttctcaaaagggcaaccacgcggaggagtcgaggagggaccgaccgtcctcagaaaggcaggcctgctggagaagctgaaagagcaggagtgtgacgtgaaagattacggggatctgccattcgctgacattccgaatgattcgccgttccaaatcgtgaagaacccgcggtcggtggggaaagcaagtgagcagctggccggaaaagtggcggaagtgaaaaagaacggaaggatctcgctggtgctcggcggggaccactctctggcaatcggctctatcagcggccacgcccgcgtgcacccggacctcggggtgatatgggtcgatgcgcacaccgacatcaatacccctctgacgactacctcaggcaacctccacggtcaaccagtctccttccttctgaaggaactgaagggaaagatccccgacgtccctggattctcctgggtgaccccgtgcatctcagcgaaagacatcgtctacatcggcctccgggatgtcgatccgggggaacattacatcctcaagaccctgggaatcaagtacttctcaatgactgaggtggatagactgggaatcggaaaagtgatggaagagactctgagctacctgctgggccgcaagaagcggccaattcatctgtcctttgacgtggatggactcgacccctcgttcactccggcaaccggaaccccggttgttggcggactgacctaccgggaaggactgtacatcactgaggaaatctataagaccggactcttgtccgggctcgacattatggaggtcaatccatccctcggcaagacgccagaggaagtcacccgcacggtcaacactgccgtcgctattactctcgcttgtttcggcctcgcaagagagggaaatcacaagcctattgattacttgaacccgccaaag

SEQ ID NO: 6682 - DNA, 966 bp, Artificial Sequence
  Description of Artificial Sequence: Synthetic coding sequence
atgagtgccaaatctcgtactattgggatcatcggggctccattctctaagggccaaccacgcggcggggttgaagaaggccccaccgttctcaggaaagctgggcttttggaaaagttgaaggagcaagagtgcgacgtaaaagactacggcgacctcccttttgccgacattcccaatgattccccattccagatcgtaaagaatcccagatccgtgggaaaggcatctgaacagctagcaggaaaagtggccgaggtcaagaagaatgggcgaatctccctcgtgcttggcggggatcactctttggccataggcagtatttctggacacgcccgcgtgcatccggatttgggagtgatttgggtcgacgcacacacggacattaacacaccactgactaccacaagcggaaacctccatggtcagcccgtgtcttttctgctgaaggagctcaaagggaaaatccccgatgttcccgggttttcctgggtgacgccttgtatatccgctaaagatatagtctatatcggactaagggacgtcgaccctggagaacattacatcctgaagaccctgggaatcaaatacttctctatgaccgaggtcgatagactcggtataggcaaagtcatggaggaaaccctttcgtacctactcggaaggaaaaaacgaccaattcaccttagcttcgatgtcgatggcttagacccttcattcactccggcaactggaacgccagtcgtggggggactgacctacagggaaggtctctatatcacagaggaaatatacaagaccggcctcctcagcggtttggatattatggaggttaatcccagcttggggaagacacccgaagaggtgacacggaccgtaaataccgccgtggccataactctggcttgtttcggtctcgcacgtgaggggaaccacaagcctatcgattatctcaatcccccaaag

SEQ ID NO: 6683 - DNA, 966 bp, Artificial Sequence
  Description of Artificial Sequence: Synthetic coding sequence
atgagtgcgaaaagccgcactattggcataatcggagctcccttcagcaaggggcaacccagaggaggcgtagaagaggggcctaccgtgctcagaaaagcaggactgctcgagaagttaaaagaacaggaatgcgacgtaaaggactacggagatctccctttcgctgatattcccaacgatagcccattccagatcgtgaaaaacccacgcagcgtaggtaaggcctcagaacagctcgcaggtaaggtggcggaggttaagaagaacggtagaatcagcctagtcttgggtggagaccacagtctggctatcgggtctatttcaggtcatgccagagtccacccagacctgggggtcatatgggtggacgctcacacagatatcaacacccctctgaccaccacatctgggaacctacacggccagcccgtgtccttcctcttaaaggagcttaaaggaaagattccggacgttccaggattctcctgggttaccccctgcatctctgcaaaggatattgtgtatataggtctccgtgatgttgacccaggcgaacactatattctgaagactctgggcatcaagtatttttctatgaccgaggtggataggctggggatcggcaaagttatggaggagactctaagttatctgctggggagaaagaaacgtcctatacacctgtcattcgatgtagatgggctggatcccagctttactcctgcaaccggaacaccggtcgtaggaggcctcacatatagggagggactctacattacagaagaaatttataagacgggcctcctgagcggcttagacataatggaggtaaatccttcactgggcaagacccccgaagaggtcacacgaacagtgaacaccgccgtcgccattaccctggcgtgctttgggctggcccgtgaaggaaaccataagccaattgattacttgaatccccctaag

SEQ ID NO: 6684 - DNA, 966 bp, Artificial Sequence
  Description of Artificial Sequence: Synthetic coding sequence
atgtcagctaagagcagaacaatcgggatcattggggcccccttttcaaaggggcagcctagaggcggtgtagaagagggccctaccgtcctgagaaaagctggcctcctcgagaaactgaaggaacaagagtgcgatgtcaaggattatggtgatctaccattcgcagatattcctaacgactcacctttccaaatcgttaaaaacccacggagtgttggcaaagcctccgaacagctcgccggaaaggttgctgaagtgaagaagaacggccgaatctctctggtgctcggcggcgatcactcccttgcaatcggtagtattagcgggcatgcaagagtgcaccctgatctgggcgtcatctgggtggatgcccatacagacattaatacgccactgacaaccacaagtggcaatcttcatggacagcccgtgagctttctgctgaaggagctgaaaggaaagatccccgacgttcccgggtttagctgggttactccctgtataagcgctaaggatatagtttatatcggtcttagggatgtagacccgggagagcactatatcctcaaaacgctagggattaagtacttttctatgaccgaggtcgaccgactgggcattggaaaagttatggaggagacgctttcatatctcctcggaaggaagaagagaccaatccatttatccttcgacgtcgacggcttagatccttctttcacccccgcgactggtacaccagtggtcggcgggcttacgtaccgggaggggctctacataacagaagaaatctacaagacagggttgctttctggccttgatattatggaggtgaacccctccctcggtaaaactccagaggaggttacgcgcacagtgaataccgcggttgcaataaccctggcctgttttggcctggcacgcgaaggcaatcataagcccatcgattacctgaatccccctaaa

SEQ ID NO: 6685 - DNA, 966 bp, Artificial Sequence
  Description of Artificial Sequence: Synthetic coding sequence
atgagcgcaaagagtagaactatcggcattatcggagcgccattttctaagggtcagcctagaggaggagttgaggagggccccaccgtactgcggaaggccggccttcttgagaaactgaaggaacaagagtgcgacgttaaagactatggggatctgccctttgcggacatcccaaatgatagtccctttcaaatcgtcaagaatcctagatctgttggcaaggcctcagaacaactcgctgggaaggtggcagaggtaaaaaagaacgggagaataagccttgttctggggggggatcattctctggccataggaagtatttctgggcacgcccgggtacaccccgatctgggcgtgatatgggtggacgctcatacagacatcaacaccccactgactacaaccagcggtaacttgcacgggcagcctgtgtccttcctcctgaaggagctgaagggcaagattccagacgtcccgggcttcagttgggttacaccttgtatctctgctaaggacatcgtttatattggcctgcgagacgtggatccgggtgagcactatatccttaaaactttgggcattaagtactttagtatgactgaggtcgatcgacttgggatcggcaaagtcatggaagagacgctctcttaccttctgggccggaagaaacggccaatccatctctccttcgatgtcgacggtctggatcctagctttacccccgctacgggcacgccggtggtcggggggctcacgtacagagaaggcctttacatcaccgaagaaatctataagactggactcttgagcggtctggacatcatggaggtgaatcctagcctcggaaagactcctgaggaagtgacaagaacagtgaacacagccgtagcaatcaccctggcgtgcttcggcctggctagagaggggaatcataaaccgatcgactacttgaatcccccgaaa

SEQ ID NO: 6686 - DNA, 966 bp, Artificial Sequence
  Description of Artificial Sequence: Synthetic coding sequence
atgagcgccaagtctagaactattggaataattggagcccctttttctaagggccagccccgcggaggcgtcgaagaaggcccaactgtcttgaggaaggccgggctgctcgagaagctcaaagagcaagagtgtgacgtgaaagactatggagatttgcccttcgccgacatacccaatgattcacccttccaaatagtcaagaaccccaggagcgtcggcaaagcatctgaacagctcgcaggcaaggtagccgaggtgaaaaaaaatggcagaatttctctggtgctgggcggtgatcactcactggctattgggtcgatcagcgggcatgccagagtgcatcctgatctgggagtgatctgggtggatgcgcacacagacataaacactcccctgaccactacatcaggcaacctccacggccaacccgtgagttttttactaaaggagctgaaggggaagattccagacgtccccggattctcttgggttaccccctgcatctctgcaaaggacatagtgtatatagggttgcgcgatgtcgaccctggtgagcactacattctaaagactctgggcatcaaatacttttccatgacagaggtggataggttgggcattgggaaggtaatggaggaaacccttagctatctgctgggccgcaaaaaaagaccaatccacctctcgtttgacgtggatgggcttgacccctccttcacgccagctactggaacaccagtggttggcggactgacataccgggagggcctctacataaccgaagagatctacaagacaggactgctgagcggcctcgatattatggaggtgaacccctccttgggtaaaactccagaggaagtcactaggacagtgaatacagccgtggcgatcacgctagcatgcttcggcctggcacgggagggcaatcataaaccaatcgattacctcaatccccccaaa

SEQ ID NO: 6687 - DNA, 966 bp, Artificial Sequence
  Description of Artificial Sequence: Synthetic coding sequence
atgtcagcgaagtcacggactatcggaatcatcggagcacctttctccaaaggccagccgaggggaggggtggaagaaggacccaccgtgctcagaaaggcgggactccttgagaagctcaaggagcaggaatgtgacgtgaaagactacggagatttgccgtttgcggacatccccaacgactccccgttccaaatcgttaagaatccacgcagcgtggggaaagcctcggaacagctcgcagggaaggtcgccgaggtgaagaagaacggacgcatctccctggtcctcggtggcgaccactcgttggccattggctcgatctctggacacgcccgcgtgcaccctgatctgggggttatctgggtggatgcccacaccgacatcaatactccgctcactaccacgagcgggaacctgcatggacaaccggtgtcatttctgctcaaagaactcaagggtaagatcccggacgtaccaggattttcgtgggtcaccccttgcatttccgcgaaggacatcgtgtacattggactgcgagacgtggatccaggagagcattacatccttaagaccctgggcatcaaatacttctcgatgactgaagtggacagattgggaataggcaaggtgatggaggagactctctcctacctgctgggacggaaaaagcggccgatccacctgagcttcgatgtcgatggacttgatccttcgttcaccccggctactggaacgccagtggtgggtggcctgacctaccgggagggtctgtatatcaccgaagagatctacaagactggactgctgagcggcctggacattatggaagtcaacccgtcactgggcaagaccccagaagaggtgactagaaccgtcaacactgctgtcgcaatcaccctggcttgcttcggtttggcccgcgaaggcaaccataaaccaatcgattacctgaatccgcccaag

SEQ ID NO: 6688 - DNA, 966 bp, Artificial Sequence
  Description of Artificial Sequence: Synthetic coding sequence
atgtcagcaaagtcacgcaccattggaataatcggagctcctttctcaaagggacagccccgaggtggcgtcgaagagggccctactgtgctgagaaaggcaggattgctggagaagctgaaagagcaagaatgtgatgtgaaagactacggggatcttccatttgcggacattcctaacgattccccttttcagattgtgaagaacccacgttcggtgggcaaggcttccgaacaactcgcaggtaaagtggcagaggtgaagaagaatggtcgtataagcctggtgcttggcggggatcattccctggcaataggatctatctcgggacacgcacgtgtgcatcccgatctgggagtgatctgggtggatgcacacaccgatatcaatacccctctcaccaccacgtcaggaaacctccatggacaaccagtgtcctttctgctgaaggaactgaagggaaaaatcccggacgtccctggattctcctgggtgacgccatgtatctccgccaaggatattgtgtatattggactgagagatgttgatcctggcgaacactacattctcaagacccttggcatcaagtacttttccatgaccgaggttgatcgtcttggcattggaaaggtgatggaggagactctgagctacctgctggggcgaaaaaagcggcctattcatctttcgttcgacgtggatgggcttgacccctcattcaccccagcaacgggaaccccagtcgttggtggtctgacctacagggaaggcctgtacattactgaagagatttacaagaccggcttgctctccggattggatatcatggaagtcaatccctcccttggaaagacccctgaagaggtgaccagaactgtgaacactgctgtcgcgataactctggcatgcttcggcctcgcccgcgagggaaaccacaagccaattgattatctcaatccaccaaag

SEQ ID NO: 6689 - DNA, 966 bp, Artificial Sequence
  Description of Artificial Sequence: Synthetic coding sequence
atgtccgctaaaagccgaactatcggtattatcggtgcacctttctcgaaggggcaacctcgcggcggcgtcgaagagggacctactgtgctccggaaggccggtttgcttgagaagctgaaggagcaggaatgtgatgtgaaggattacggagatctgccatttgcggatatacccaacgactcgccgtttcaaatcgtgaaaaacccaagatcagtgggcaaggctagcgagcagctggcagggaaagtggcagaggtcaagaagaacggccgcatctctctcgtgctcggaggagatcattctctcgccatcgggagcatttccggacatgcaagggtgcacccagacctgggcgtgatctgggtggatgcacacactgacattaacactccacttaccaccacctccggtaatctgcatggacaacctgtctcattcctcctgaaagaacttaagggcaagattcccgatgtgcctggattctcgtgggtcaccccatgtatcagcgccaaggatattgtgtacattggactccgagacgtggatcccggagaacattacatacttaaaactcttgggatcaagtactttagcatgaccgaggtggatcggctgggtatcggtaaggtgatggaggaaacgctgagctacctgttgggccgaaagaagcgacctattcacctttccttcgatgtggacgggcttgatcctagcttcacccctgcaactggaacccctgtggtcggcggacttacctacagggaggggctctacattaccgaagaaatctacaaaaccggtcttttgtcaggcctcgatatcatggaggttaacccttcattgggcaagactcccgaggaagtgactcgtaccgtgaacacggccgtggctattactctggcatgctttggccttgcccgcgagggcaatcataagcctattgattacctcaatccacccaag

SEQ ID NO: 6690 - DNA, 966 bp, Artificial Sequence
  Description of Artificial Sequence: Synthetic coding sequence
atgtccgccaagagcaggacgataggcattataggtgccccattttcgaaaggccagccacgcggcggagtggaggaaggacctaccgtgctgcgaaaagcagggctgctggagaaactcaaagaacaagaatgtgatgtgaaggattatggggatctgccgttcgcagacattccaaacgactccccctttcaaatcgtcaagaatccgcggtcggtcgggaaagcatccgaacagctcgctggaaaggtggcagaggtgaagaaaaacggcagaatttcgctcgtgcttggaggtgaccacagccttgcaatcggctcgatttcagggcacgcgagagtccatcctgatctgggtgtgatttgggttgacgcacacacggacattaacaccccgctgacgacgacctctggtaatctgcatggacaacccgtgagctttctcctgaaagagctgaagggtaagatcccagatgtgcccggtttttcatgggtcactccctgcatatccgcgaaagatatcgtctacattggacttagggacgtggatccaggagaacactacattctgaaaacgctgggaatcaagtacttttcgatgaccgaagtggatagacttggaatcggtaaggtgatggaagagactcttagctacctgcttggtaggaagaaacgtcctatacacctgagcttcgacgtggatggtcttgacccatcttttacccctgcaactggcacccccgtcgtgggtggtcttacttaccgcgagggcctgtacattaccgaggagatttacaaaaccgggctgctgtccggtcttgacattatggaagtgaacccttcccttggtaaaacccctgaagaagtgactcggactgtcaacactgcggtggccattactcttgcatgttttggcctcgccagagaaggaaaccataaacccattgactaccttaaccctcctaag
